United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 106

SEQ ID NO: 206672 - DNA, 26250 bp, Artificial Sequence
  Description of Artificial Sequence: Synthetic coding sequence
atggccaccagccggggcgccagccggtgcccccgggacatcgccaacgtcatgcagagactgcaggatgaacaagagatcgtccagaagagaacattcaccaagtggatcaatagccatctggcaaagcgtaagcccccgatggtagtagatgatctgttcgaagatatgaaggatggagtaaaactgttggcccttctggaagtgctttctggacagaaactcccttgcgaacagggtcgtcgaatgaaacggatccacgcagtggctaatatagggacggcactcaaatttctggagggaagaaaaagtatgcatcgcggctcacccatcaagctcgtgaatattaactctacggacatcgccgacgggcggcctagcatcgtgctgggactgatgtggacaatcatcctgtacttccagatcgaagaactaacaagcaacctgcctcaactccagtctttgtcttcgtccgcttcctctgttgactcaattgtgtccagcgaaaccccttctccaccctcaaaacggaaggtcaccactaagattcaaggcaatgccaagaaggcattgctgaagtgggtccagtatacagcgggcaagcagaccggtattgaagtaaaggactttggcaaatcttggagaagtggcgtcgcattccattccgtaattcacgcaattagaccagagttggtggacctggagacagttaaggggagatctaatcgggagaatctcgaggacgcctttacaattgccgagaccgaactgggcatacccaggcttctagatccggaagatgtggacgtggacaaacccgatgaaaagtcaattatgacatacgtggctcaattcctcaaacactatcccgacatacataacgcatctaccgatggtcaggaagatgacgagatcctgccgggttttccctcattcgctaactccgttcagaatttcaagcgtgaggatcgggtcatcttcaaggaaatgaaggtgtggattgagcaatttgaacgagatctcacccgcgcacaaatggtcgagtcaaatttgcaggataagtaccagagcttcaaacatttcagggtgcagtatgaaatgaagcgcaagcagattgaacatctgatccagcccctccatcgcgacgggaaactgtccttggaccaagctctagtgaagcaatcatgggatagggttacctccaggttattcgattggcacattcagctggataaaagccttccagctcctctgggtaccatcggcgcctggctgtaccgcgctgaggttgcactcagagaggagatcactgtgcagcaggttcacgaagaaacggccaataccatccaacgcaaattggaacagcataaggacctgctgcaaaacactgatgcacacaagcgggcttttcacgagatctatcgcacacggagcgtcaatgggatccccgtgcctcccgatcagttagaggatatggccgagaggtttcacttcgttagctcgacttcagagctgcacttaatgaaaatggagtttttggagctgaagtaccgtctcctctccttgctggtgctcgcagaatccaaactgaaaagttggattatcaaatatggacgccgagagtctgtggagcagctcttgcagaactacgtgtcatttattgagaatagtaagttctttgaacaatacgaagtcacttaccaaatcttaaaacagaccgccgaaatgtatgtgaaagccgacggatccgtagaagaggccgagaatgtgatgaagttcatgaacgagactactgcccaatggcggaacctgtccgttgaggttagatctgtgagatcaatgctggaggaggttatctctaactgggaccgctatggtaacaccgtcgctagtctgcaggcctggctggaggacgctgaaaagatgttaaaccaatcagagaatgcaaaaaaagactttttccgcaacctgccacactggatccagcaacacactgcgatgaacgacgccggcaactttctgattgaaacatgcgacgagatggtttcccgggacttaaagcaacaactgttgctgttgaatggtcgctggagagaattgtttatggaggtaaaacaatatgcccaggcggacgagatggaccgcatgaagaaagagtataccgattgtgttgtaacgctctcagccttcgcgacagaagctcacaaaaagctctcggaacctctagaggtgagctttatgaatgtgaagcttctgattcaggaccttgaagacattgaacaaagagtccccgtgatggacgcccagtacaagatcattaccaaaactgctcacctcatcaccaaagagtctccacaagaggagggaaaggagatgttcgcaacgatgagcaaactcaaggaacagttaaccaaagtgaaagagtgctactctcctctcctctatgaatcgcagcaactactcattcccctggaagaattggagaaacagatgacctctttctacgatagcctcggaaagattaacgagataatcacagtgctggagcgagaggcccagagcagtgctttgttcaaacagaaacatcaagaactgctggcatgccaggagaactgcaagaagacgctcacgctcatcgagaagggatcccagagtgtgcagaagttcgttaccctcagcaacgtcctgaaacactttgatcagactagactgcaacgccaaatcgctgacatccacgttgcatttcagagcatggtgaaaaaaactggggactggaaaaaacatgttgagaccaatagccggctgatgaagaaattcgaagaatctcgagccgaactcgagaaggtgctgcggatcgcacaggaagggttagaagagaaaggggacccggaggagctcctgcgcaggcataccgaattcttctcccaattagatcagcgagtgctgaatgcattcttgaaggcatgcgatgagctgaccgatatcctgcccgagcaggaacagcagggtctgcaagaagccgtgcgaaagctgcacaagcagtggaaggaccttcaaggcgaggccccataccaccttcttcatctaaagatcgatgtcgaaaagaaccgattcctggccagcgttgaggaatgcaggacagagctcgatcgggaaacgaaactcatgccgcaggagggctctgaaaagattatcaaggaacatagagtgtttttcagcgacaagggaccacatcacctctgtgagaaaaggcttcagcttattgaggagctctgcgtcaaacttccagtgcgggatcctgttagggatactccaggaacctgccatgtcactctaaaagagctgagggctgccatagacagcacataccgcaagctcatggaagatcctgataaatggaaggactataccagccgctttagtgaattttcctcctggatttccaccaacgagacccaactgaaggggatcaaaggagaagctatagacaccgccaaccacggtgaggtaaagcgtgccgtagaggagatcaggaatggggttactaagaggggggaaactttgagctggcttaagagtagacttaaggtccttaccgaggtgtccagtgagaacgaagcccagaaacagggcgacgaattggcaaagctttcctcatcattcaaagccctggtgaccctgctgagcgaggtggagaagatgttatccaacttcggcgactgtgtacagtacaaggagattgtcaagaacagtctcgaggaactgatttccggatctaaggaggtccaggagcaggccgagaaaattttggatactgagaacctctttgaggctcagcagctgttgctccatcatcaacaaaagacaaagcggataagtgccaagaagcgggacgtgcagcagcaaatcgcacaggcacaacagggcgagggcgggttgcctgatcgtgggcacgaggagctgcgcaaactcgagtcgacactcgatggcctggaacgcagtcgggagcggcaggaacgaagaatacaagtgaccctaagaaaatgggagcgttttgagacaaacaaggagactgttgtgcgctacctctttcaaaccggctcttcgcatgagaggttccttagtttcagtagtttggagtccctgtctagcgaattagagcagacaaaggaattctcaaagcgtactgagagcatcgcagtgcaagccgaaaacctggtcaaggaagcatccgagatcccgctaggacctcaaaataagcagctgctacagcagcaggccaagtctatcaaagagcaggtgaaaaagctcgaggataccttggaagaagatataaaaacaatggagatggtgaagacgaagtgggaccacttcgggagcaactttgagacactgtctgtgtggattaccgaaaaagagaaggaactgaatgctttggagacatcctcttctgccatggatatgcagatctcacaaatcaaggtcaccattcaggagatcgagagtaagctctcgtctatcgtcggacttgaagaggaagcccagagctttgcccagttcgttactactggagagtctgcacggatcaaggcaaaattaacacaaatcagacgctatggcgaagaactgagagagcatgcccagtgcctcgagggaacaatcctgggccacttgagccagcagcagaaattcgaagagaatctgcgcaaaatccagcagagcgtaagtgaattcgaggacaagctggctgtacccatcaagatctgttcttccgcgaccgaaacatacaaggtgctgcaggagcatatggatctttgtcaggccctcgagagcctgtctagtgccatcactgccttctcggcgtcggctaggaaggtcgtgaaccgagattcttgcgttcaggaggccgcggccctgcaacaacaatatgaggacatccttagaagagctaaggaaaggcagaccgctctagaaaatctcttggcacattggcagcggctggagaaggaactctcctccttcttaacatggctcgagcggggggaggctaaagccagctccccagagatggatatatcagccgaccgcgtgaaggtggaaggcgagctgcagctcatacaggcctcgtccaggaagtttgtgagccaggctagcttttatagcaaacttctgcagctgaaagagtcactcttctccgtcgcctctaaggacgacgtgaagatgatgaagctgcacctggagcaacttgatgaaagatggcgcgaccttccccagatcatcaataaacgcatcaattttcttcagtctgttgttgccgaacaccagcaattcgacgagttgctgctttccttttcagtgtggatcaaattatttctctccgaattgcagacaaccagcgagattagcattatggaccaccaggtggccctgactaggcataaagaccatgctgcagaggtcgagagcaaaaagggagagctgcaatctctgcaaggtcatctggccaagctaggaagccttggacgcgcagaagacctccatctgctgcaagggaaagccgaagactgcttccagctctttgaagaggcctctcaggtggtcgaaaggcggcagctggcgctgagccacctcgcagagtttctgcagtctcacgcttcgctatctggcatattaaggcagctgcgtcagaccgtcgaggctactaactccatgaataagaatgagagtgacctcatcgagaaggatttaaatgatgctttgcaaaacgccaaagcgctggaatcagctgccgttagcctggatgggatactatctaaagctcagtaccacctgaaaataggcagttccgaacaacggacttcatgccgtgccacggctgaccaactctgtggcgaggtggagaggattcaaaacctgttagggaccaaacaaagcgaagccgatgccctggcagtgctgaaaaaagcattccaggatcagaaagaggagctgcttaagtctattgaggacatcgaggaacgaaccgacaaagagcgcttaaaggaacccaccagacaggctctgcaacagagattgcgggtgtttaaccagctggaggacgagcttaattctcacgaacacgagctgtgttggctgaaagataaggccaagcaaattgcacaaaaggatgtcgccttcgctccagaagtggacagagagatcaatagactagaagtgacttgggatgacacaaagcgactgatacacgaaaatcagggccaatgctgcggcctgatcgatttgatgagggaataccagaatctcaaatcagccgttagtaaggtgctggagaacgcctcatccgtgattgtgacccgcacaacaattaaggaccaggaggacctcaaatgggcattttctaagcacgagaccgcaaaaaataaaatgaactataagcagaaggacctggacaactttacctctaagggtaagcatctgctgagcgagctgaagaagattcacagcagtgacttttccctcgtaaaaacagatatggaatcaacagtcgacaagtggcttgatgtgagtgaaaaattggaggaaaacatggaccgcctgcgggtgagtctgtcgatttgggacgacgtcctgtcaacaagggatgagatcgagggttggtctaacaattgcgttcctcaaatggccgagaacatcagtaacctcgataaccacttgagggcagaggagttgttgaaagaatttgaatcggaggtcaagaataaggctctgaggctggaggaactgcacagcaaagtgaatgatctcaaggaactgacaaaaaatctcgaaaccccccccgacctgcagtttattgaggcagatctgatgcaaaaactggaacacgccaaggagattaccgaagtggctaagggaaccctgaaggacttcactgctcagtcgacacaggtggagaaatttataaatgatatcaccacgtggtttacgaaagtcgaagagagcctgatgaattgcgcacagaacgaaacatgcgaagccctgaaaaaagttaaagatattcagaaagaattacagtctcagcagagcaacattagcagcactcaggaaaacctgaactccctgtgtcgaaagtatcactcagcagagctcgaatcattaggtcgggcgatgactgggctgatcaaaaaacacgaggctgtgagccagctatgttcaaaaacacaggctagccttcaggaatcactcgaaaaacatttcagcgaatctatgcaggaatttcaggaatggttcctgggcgcgaaggcagcagcgaaagagtccagcgaccggaccggagacagcaaggtgctggaggctaagctgcacgatctacaaaatatcctggactcagtttccgatggacagagcaaactggacgcggtgacgcaagaagggcagaccttgtatgcccatctttccaagcagatagtgtcaagcatccaagagcagatcaccaaggctaatgaggaattccaagcattcctcaaacagtgcctcaaggataagcaggccttgcaggattgcgcaagcgaactcgggtcatttgaggaccaacataggaagttgaatctgtggatccacgaaatggaggaacgattcaacacagagaacctgggcgaaagcaagcagcacattcccgagaaaaagaacgaggttcacaaggttgagatgtttctaggcgagttgctcgccgcaagagagagtctggacaagctttcccagagaggtcagttactgtctgaggaaggacacggggccggccaagaggggaggctgtgctcccaattgttgacgtctcatcagaacttattgagaatgaccaaggaaaagctgcgctcctgtcaagtggcactacaggaacacgaggccttagaggaggcattacagagcatgtggttctgggttaaagctatccaggacagactggcttgcgctgagtctacgcttggctcgaaagacaccctggagaaacgtctgagccagattcaggatatacttctcatgaagggcgaaggggaggtaaagttaaacatggccattgggaaaggagaacaggcactgaggtcatccaacaaggagggccagcgtgtcattcaaacccagctggagactttgaaagaagtttgggccgatattatgtcatcatctgtacatgcacagtcaacactcgagtctgtcatctctcaatggaacgactacgtggaacggaagaaccagctggaacagtggatggaaagcgtagatcagaaaattgagcaccccctgcagccccagcctggcctcaaggaaaaatttgtactcctcgatcatctacagtcaatccttagcgaggcagaagatcatacgagggccctccaccggcttatcgccaaatcccgtgagctttacgagaagaccgaggacgagtccttcaaggatacggcccaggaagaactcaagacccaattcaacgatataatgacagtggcaaaggagaaaatgcgcaaggtggaggaaattgtgaaagatcatctgatgtatcttgacgccgtccatgaattcacagactggctccactctgccaaagaagagttacatagatggtctgacatgagtggagatagttctgcaacgcagaaaaaactcagcaaaataaaagaattaattgattcccgggaaatcggagcatcaaggctgagcagagtggagtccttggctccggaggtcaaacaaaatacgacggcttctggatgtgaactgatgcacacagaaatgcaggctcttagagctgattggaaacaatgggaagacagtgtgtttcagacacaaagctgccttgagaatttggtgagtcagatggcattgtctgagcaggagttctcgggacaggtagcacagctggagcaggcccttgagcagttctctgcattgctaaaaacttgggcccaacagttgaccctgcttgagggcaagaatacggatgaagagatcgtcgagtgctggcacaagggccaggagattctggatgccttgcagaaagcagagccacggaccgaagacctgaaatcccagctgaacgaattatgccggttttctagagacttatctacctacagcggaaaggtgtctggactgatcaaggagtataactgtctctgtctgcaggctagcaaaggctgccaaaacaaagagcagattctccagcagcgctttagaaaggccttccgggacttccagcagtggctcgtcaatgcaaaaattaccaccgccaagtgttttgacatccctcagaatatatccgaggtttccacatccctacagaaaatccaggaattcttgagcgagtccgagaacggccaacataagcttaatatgatgcttagtaaaggggagctgctttcaaccctcctgactaaagagaaagccaaggggattcaggccaaagtcacagccgcaaaggaagattggaaaaacttccattccaacttgcaccagaaagagtctgcactagagaatttaaaaattcagatgaaagactttgaagtctctgccgaacctatccaggattggctgtccaagacggaaaagatggtccatgaatcgtcaaataggctctacgacctccctgccaaaagaagggaacaacagaaattacagagtgtcttggaggagattcactgttatgagccccagctcaatcggctcaaggaaaaggcacaacagctgtgggaaggccaggctgcatccaagtcctttagacaccgcgtctctcagctcagcagccagtatctggcactctccaatttaacaaaggaaaaagtgtcacggcttgaccgtattgtcgctgagcacaatcagtttagcttaggaataaaggaactacaggactggatgactgacgcgatccacatgctagactcctactgccacccaacatcagacaaatctgtgctggatagcaggacactgaaactggaggcgttattgagtgttaaacaggagaaagaaatccagatgaagatgatagtgacaagaggcgaatctgttctgcagaatacttcacccgaaggaattccgaccattcagcagcaactgcaatccgttaaggacatgtgggcttccctgctgagtgcaggcatcagatgtaaatctcaactggaaggggccctgagcaaatggacaagctaccaggatggtgttcgccaattttcggggtggatggactccatggaagcgaatctgaatgaatccgagcggcagcacgcagagttacgtgacaagacgactatgctagggaaagccaagcttcttaacgaggaagtcctaagttattcctctctgttagagaccattgaagttaagggggcagggatgacggaacactacgtaacgcaactcgaactgcaggatcttcaggagaggtatcgcgctatccaggaaagggccaaggaggcggttacgaaatcagaaaaacttgtgcgactccaccaggaatatcagagagatctgaaagctttcgaagtttggctgggccaggaacaggaaaagctggatcagtattctgtgctagaaggcgacgcccatacccacgagacgactctgcgggatttgcaagagctgcaggtccactgtgcagaaggccaagcccttctgaactctgtgctgcataccagggaagatgtgatcccctccggtatacctcaggccgaggacagggccctggagagccttcggcaagactggcaggcataccagcaccgcctgtcggaaacacgaactcaattcaataatgtcgttaacaaattacgtttgatggaacagaaattccagcaggtggacgaatggctcaaaacagctgaagaaaaaaagtggcacgaagaggtgactgcataccgggacgaagttgaggaggtgggggccagggctcaggaaatactcgatgagtcccacgttaacagtaggatgggatgtcaagctactcagctgacttcccgataccaggcactactactccaggtgttggaacagatcaagtttctggaggaggagattcaatcgctcgaggagagcgaaagcagtctgtcctcctactctgattggtatggcagcacacataaaaatttcaagaacgttgctactaagatcgataaggttgacacagttatgatgggtaagaagcttaagacattagaggtgctcctgaaagacatggagaagggccacagtctgctgaagagcgcccgcgagaagggggaacgagccgtcaagtatctcgaagaaggcgaagccgagcgactgaggaaggagatacatgatcacatggaacagttgaaggaactcacaagcacagtccggaaggagcacatgaccttggagaaaggtctgcacctggcaaaagagttttctgataagtgtaaggccctgacacagtggattgctgagtaccaggaaatcctgcacgtaccagaagaaccgaaaatggaactctacgaaaagaaagcacagctcagcaaatacaaaagtctccagcagacggtactcagtcatgaaccctctgtgaaaagcgtcagagagaagggtgaggcacttctggaattggtccaggatgtgactctgaaggacaaaatcgaccaattacagtctgattatcaagacctttgctctatcggaaaagctatgatggaggagatcgccgggttcgaagaccggcttaataaccttcagatgaagggagataccctcataggacagtgtgccgatcacttgcaggctaaactgaaacagaatgtgcacgctcatctccagggcacaaaagactcctactccgcaatctgctcaacagcccagcgcatgtaccagagccttgaacacgagctgcaaaaacacgtgagccgccaggatactttgcagcaatgccaagcctggctctcagccgtacagcccgacttggagccgtctccccaacctccgctgagccgcgccgaagcaatcaaacaggttaaacacttccgagctttgcaggagcaggcaagaacctacctggacctcctgtgctctatgtgcgatcttagtaacgccagtgtcaagactacggcaaaggatatccagcagaccgagcaaaccatcgaacagaagctggtccaggcacagaacttaacccagggctgggaagaaattaagcatctgaaatccgagctctggatatacctgcaggatgcagaccagcaactgcagaatatgaaacgaagacacagcgaactggagctgaatatcgctcaaaacatggtgagccaggtaaaagactttgtcaagaagttgcaatcaaagcaagccagcgtcaacactatcatcgaaaaagtgaacaaactgaccaaaaaagaggagtcacctgaacataaggagataaatcatctgaacgatcagtggcttgacctttgcagacagagcaacaacctgtgcctccaaagggaagaagatttacaacggacccgagattaccatgactgcatgaacgttgtggaagtattcctggagaagtttacaactgagtgggataacctcgcgaggtccgacgcggagagcacagcagtccacttagaagctctgaaaaaactcgccctcgccctccaggagcggaaatatgcaatcgaagatctcaaggatcagaagcagaagatgattgaacacctaaatctggatgataaagagctggtgaaggagcaaacttcccacctagagcagcggtggtttcaactggaggacctgatcaaaagaaaaattcaagtgagtgtgaccaacctggaagagctgaacgtggtgcagagccggttccaggaattaatggaatgggctgaagagcagcagcccaacatcgcagaggccctcaagcaatccccgcctcccgacatggcacagaacctactgatggatcacctggccatctgtagcgaactggaagctaaacagatgctactgaaatctctgataaaggatgcagacagagtcatggcagacttgggccttaacgaaaggcaggtgattcagaaggctctcagcgacgcccaaagccatgtgaattgtctgtccgaccttgtgggccagagacggaagtacttaaacaaagcactgagcgaaaagacccagttcttgatggcagtgttccaagccacgtcacaaatccagcaacacgaacgcaaaatcatgttcagagagcacatttgtctactcccagatgatgtttcaaagcaggtgaagacatgtaagtccgcacaggcaagcctcaagacctaccagaatgaggtcactggattgtgggcgcaggggcgcgaattgatgaaagaagttaccgaacaggagaaatctgaggttctcgggaagctgcaggaacttcaatctgtttatgactcagtgctgcagaaatgttcgcatagactgcaagagctcgagaaaaacttggtttccagaaaacattttaaagaagacttcgacaaggcttgccactggcttaaacaggcggacattgtgacttttcccgagattaacctgatgaacgagtcctccgaattacacacacagttggccaaataccagaacatcttagagcagtctcctgaatacgaaaatttactactaacactacagaggaccggacagaccatactgccatcactaaatgaggtggatcattcatacctgtctgagaaactgaacgctttgcctcggcagttcaacgtaattgtcgcactagctaaagacaagttctacaaggtccaggaggctatactggcacgtaaagagtacgcctctcttatcgaactgacaactcagagcctctctgagctggaggcgcaattccttaggatgagcaaagtgcccaccgatctagcagtggaggaggctttgagcctccaagatggatgcagagccatcctggacgaggtagcagggctgggcgaagctgtcgatgaattgaatcagaagaaagaggggttccgttcaaccggccagccctggcaacccgacaaaatgctgcacctcgtaaccctatatcaccgcctgaaaagacagacagagcagcgcgttagtctcttggaagatacgacaagcgcttatcaggagcatgaaaaaatgtgccagcagctggagagacaactgaaatccgtcaaagaggagcaaagcaaagtgaacgaggagacactgcccgctgaagagaaactcaaaatgtaccacagtttggctggaagtctgcaagatagtggtattgtgcttaaaagggtgaccatccatttggaagacctggccccgcatctggacccgctggcgtacgagaaggccagacatcagattcaaagttggcagggcgaactcaagctgctaactagtgctatcggtgagactgtcaccgagtgtgaatccagaatggtgcagagcatcgatttccaaacggagatgtcccggtctctggattggctccgaagggtgaaagccgaattgagcggacccgtctacttagacctgaacctccaagatatacaagaggagattcgtaaaatccagatccaccaagaggaagttcagagctccctgcgaataatgaacgccttgtcacacaaggaaaaggaaaaatttaccaaggccaaagaactaatatccgcggatctggaacactcgctggccgagttaagtgaactcgatggagatatacaggaggccctgcggaccaggcaggcaaccctgacagaaatatactctcaatgccagaggtactaccaggtgtttcaggccgccaacgattggctggaagatgctcaggaactcctgcaattagcgggaaacgggttagacgtcgagagcgccgaggagaacctcaagtctcatatggaattcttttcaaccgaagaccagttccacagcaacctggaagaactgcacagcttagtggccacattagatccactcatcaagcccactggaaaagaggacctggagcagaaggtggcatctctcgagctgagaagccagaggatgtccagggatagtggcgcccaggtggacctgcttcagcgctgcactgcccagtggcatgattatcagaaagcgcgcgaggaagtaattgagctcatgaatgatacagaaaagaaactgagcgagttttccctgctgaagacttcttctagccatgaggccgaggagaaactttcagaacacaaggccctggtaagcgtggtgaacagctttcatgagaaaatcgttgccctggaggaaaaagccagtcagttggaaaaaactggcaatgatgcatcaaaagccacactgtcacggagcatgacgaccgtctggcagcggtggacaaggctacgagctgtcgcacaggaccaggagaagatcctcgaggacgcagtggacgagtggactgggtttaacaataaggttaagaaagctaccgagatgattgaccagctgcaggataagctgcccgggagctccgccgaaaaggcttctaaggcggagttgctgacgctgcttgaatatcacgacacattcgtgctggaactagagcagcagcagtctgctctcggcatgttaagacagcagaccctctccatgctccaggacggcgccgcacccactccgggcgaagaaccgccattgatgcaagagatcacagccatgcaggataggtgtctaaatatgcaggaaaaagtaaaaactaacgggaaactcgtaaaacaggaactgaaggatcgtgagatggtagaaacccagattaactcagtgaagtgctgggtgcaagagacgaaagagtacctcgggaaccctacgatcgagattgacgcacagctggaggagctccagatactgctgaccgaagccaccaaccaccgacagaacattgagaaaatggctgaggagcagaaagaaaagtatctcgggctctataccatccttcccagtgagctgagcctgcagctggccgaggtggctctcgatcttaagattcgtgatcagatccaggacaaaattaaagaagtggaacagtccaaggctacctctcaagagttgtcccgccagatccagaagctagcaaaagacctgacgaccatcttgactaaactcaaagccaagaccgataacgtagtgcaagccaagaccgatcagaaagttctcggggaagaactggatggctgcaactccaagctgatggagctggatgccgcagtacagaagttcctggagcagaacggacagctgggaaaaccgcttgccaagaagatcgggaaattaaccgagctgcatcagcaaactattcggcaagcagagaaccggctgagtaaactgaaccaggccgcaagccacctcgaagagtacaacgagatgcttgagttaatcctgaagtggatcgagaaggccaaggtgctggcccatggaacaatcgcatggaacagcgccagtcagttaagggagcagtacatcctccaccagacactattagaggagtctaaggagatagactcagaattagaggccatgaccgaaaagctgcaatatcttacttccgtgtactgtaccgaaaaaatgtcacagcaggtagccgaactaggacgcgagaccgaagaattacgccaaatgatcaaaattcgacttcaaaatctgcaagacgcggctaaagacatgaaaaaatttgaggccgagctgaaaaagctgcaagccgcactggagcaagcccaggcgaccctgacatccccggaagtggggaggctgagcctaaaagagcagctgtcacacaggcaacacctgctgtccgagatggaatccctgaagccgaaggttcaggccgttcagctgtgccaatccgcgttgagaattcccgaggacgttgtggcttccctgccgctgtgtcacgctgcacttaggcttcaggaggaggcctctagactccagcacaccgctatacagcaatgcaacattatgcaggccgccgtggtgcagtatgaacagtatgaacaggagatgaaacacctgcagcagctcattgaaggtgcgcatcgggagattgaagacaaacctgtggcaacatctaatatacaggaactgcaggctcagatctctaggcatgaggagcttgctcaaaagataaagggctaccaggagcagatcgcaagcctcaacagcaagtgtaaaatgcttactatgaaagccaagcatgccacaatgcttcttaccgtgaccgaggtcgaggggctggctgagggcaccgaagacctagatggggaactgctgcccacaccttccgcgcacccttccgtggtgatgatgacagcagggcgctgccacactcttctgtctccagtgacagaagagagcggggaggaaggcaccaacagtgaaattagcagccctcccgcctgcagaagcccatccccagtggctaacacagatgctagcgtcaatcaggacattgcctattaccaggccttatctgcggagcgactccagaccgatgcggccaagatccatccaagtacctctgcctctcaagagttctatgaaccaggtttggagccgagtgcaactgcaaagctgggggacctccagcggtcttgggagacactgaaaaatgtgatatctgagaaacagcgcacgctttacgaagctctcgaacgacagcagaaataccaggactcgttacaatcaatttcgacaaaaatggaagcaatcgaattgaagctgagtgaatcccccgagcccggtaggtctcctgaaagccaaatggcagagcatcaggcccttatggacgagatcctcatgctccaggatgaaatcaacgagctgcaatcctctctggcggaagaattggtcagcgaaagctgcgaggccgatcccgctgagcagctggccttacaatcaaccctgacagttttggcagaaagaatgtccacaatccgtatgaaggcaagtgggaagaggcagctgctggaagaaaaactgaacgatcagcttgaggaacaaagacaggagcaggcactccaacgctaccggtgcgaagccgatgagctggacagctggctgttaagcaccaaggccactcttgacacagccctctcgccacccaaggagcccatggatatggaggcacaattgatggactgccagaacatgctggttgaaatcgaacagaaagtggtggctttatccgagctatcagtgcacaacgagaatctgctgttagagggcaaggcacacacaaaggatgaagctgagcaactagctgggaaattacgtcgcttgaaagggagcttgttggagctgcagagagccctccatgacaagcagctcaatatgcaggggactgcgcaggaaaaggaagagtctgacgtagacctgaccgcgacacagtctccaggcgttcaggagtggctggcccaagctcggacaacatggacgcaacagaggcagtcttcccttcagcagcaaaaagaactggagcaggaattggccgaacagaaaagtctcctcaggagcgtggcaagccgaggggaggaaatcctcatccagcactctgcagccgaaaccagtggagatgctggagagaaacctgatgtgctgagccaggaactgggtatggagggcgagaaatccagtgctgaggaccagatgagaatgaagtgggaaagcctacaccaggaattcagcactaagcagaagttactgcaaaacgtactggaacaggaacaggagcaggtgctgtacagcaggcctaaccggttgctgtctggcgtcccactgtacaagggagacgtccctactcaggataaaagcgccgttacttctctactcgacggcctgaaccaggcttttgaggaagtcagttcccagagtggtggtgccaaacgccagtccatacacttggaacaaaaattgtatgatggggtgtcagctacgtccacctggctggatgatgtggaagagcgcctcttcgtggccaccgctctgctccctgaggagactgagacatgtctcttcaatcaggagattctcgccaaggacattaaagagatgagtgaggagatggacaagaacaagaatctcttttcccaggccttccccgaaaatggcgataatcgcgacgtcatcgaggataccctgggatgtctgctgggacgcctgtctttgctggattcagtcgtcaatcaacgctgtcatcagatgaaggaaaggctgcagcagattctcaacttccagaacgacctgaaggttcttttcactagtctggcagataacaagtacatcatactgcaaaaactcgcgaacgtattcgagcaacccgtggctgagcagatcgaggcaattcagcaagcagaagatggtctgaaggagttcgacgccgggattatcgaattaaagcgtagaggagacaagttacaggtcgaacagccttcaatgcaggagctctcaaagctacaggatatgtacgatgagttaatgatgatcataggctcgagacgaagtggtctgaatcaaaatctgaccctcaagtcgcagtatgaaagggcgctgcaggacctcgctgacctgctggagaccggacaggaaaagatggcgggggatcaaaagatcatcgttagttctaaggaggagatacagcagttgctggataaacataaagaatattttcagggattggagtctcacatgatcctgactgagacgctgttcagaaagataataagctttgctgtccagaaggagacccagtttcacaccgaactcatggcccaggctagtgctgtgttaaaacgagcccacaaaaggggcgtcgaactcgaatatattttagagacatggagccacctcgacgaggatcagcaggagctttcccgtcagctagaggtggtggagagcagcattccctccgtcggactcgtggaggagaacgaggatcgcctgatcgatagaataacactctaccagcacctgaagtcgtccctcaatgaataccagccaaaactgtatcaggttctggacgacggtaagcgcttgcttatcagcatttcctgctcggaccttgagagccagctaaatcagcttggggaatgctggctctccaataccaataaaatgtccaaagaactgcaccgcctcgaaaccattctgaagcactggacacggtaccagtcagagtcagccgacctaatacactggcttcagtccgctaaggaccggctggagttctggacacagcaatcagtgaccgttccccaagaactcgaaatggtccgagaccatctgaacgcgtttcttgagttttcaaaagaggtggacgcccagtcgagtctaaagtcttccgtcctgtcgactggcaatcagctactaaggcttaagaaagtggataccgccaccctccggtctgaactctctcgtatcgactcccagtggactgacctcctgaccaacatccctgcagtccaggagaaactgcaccagctgcagatggataaactgccaagtaggcacgccatatccgaggtaatgtcctggatttcgttgatggaaaacgtaatacagaaagatgaagataatattaaaaactccatcgggtacaaggccatccatgagtatcttcagaaatacaaaggtttcaagatcgatataaactgcaagcagctcactgttgattttgttaaccagagtgttctacagatcagtagccaagatgtggagtctaagagatctgataaaaccgattttgcagagcaattaggcgcaatgaacaagtcgtggcagattctgcaggggctggtgactgaaaaaattcagctgctggaaggcctccttgaaagttggagtgagtacgagaacaacgtgcagtgcctcaagacctggtttgagacacaagagaagcgtctgaagcagcaacacagaatcggcgatcaggcctctgtgcagaacgccctcaaagactgtcaggaccttgaggacctgatcaaagctaaagaaaaagaagtggaaaaaattgaacaaaacgggctggcacttattcagaataagaaggaagatgtctcttccattgtcatgagcacactgagggagcttgggcagacctgggctaacctggaccacatggttgggcagctaaagattttattaaagtcagttttggaccagtggagcagccataaggtggcctttgacaaaataaattcttaccttatggaagcgagatattcactgtcacgctttcgcctactaactggttcccttgaagcagtgcaggtccaggtcgacaatcttcagaatttgcaggatgatctggagaagcaagagcgtagccttcaaaaatttggctccattaccaatcaactgctgaaagagtgccatccgcccgtcacggaaacacttaccaacacactgaaggaggtaaatatgagatggaataaccttctggaagagatagccgagcagctgcaatcatccaaggccctgctgcagctctggcagagatacaaggactatagtaagcagtgtgccagcacagtgcagcaacaggaggacagaactaacgaattattgaaggccgccactaataaagatatcgccgacgatgaggtcgctacatggatacaagactgcaacgatctgctcaagggacttggtacagtaaaggacagcctgtttttcctgcatgagctgggtgaacagcttaagcagcaggtcgacgcatctgctgcttccgcgatccagagcgatcaactctctttgtctcagcacctctgcgcacttgagcaggcgctgtgtaaacagcagacgtccctgcaagcgggagtgttggactatgaaacattcgctaagtctctggaagctctggaggcatggatagtggaggccgaagagattctgcagggccaggatcccagtcattcgagtgatctatcaactattcaggagcggatggaggagctgaaaggtcagatgcttaagttcagttcgatggcacctgatctcgatcggctgaacgaattaggctaccggctgccccttaatgataaagaaattaagaggatgcagaacctgaaccgccattggtccctgatttcaagccagaccacagaaagattttctaaactgcagtccttcttgctgcaacaccagaccttcctggaaaaatgtgagacatggatggaatttctggtacagactgagcagaagctggcagttgagatctctgggaactaccagcacttacttgagcagcagcgggctcatgaactgttccaagccgagatgtttagccgacagcagatactgcattccattattatcgatgggcagaggctcctggaacaaggacaggtggacgatagagatgagttcaacctgaagctgacattactcagcaaccagtggcagggagtgattcgccgcgcccaacagagaagggggatcattgattctcagatacgccagtggcaacgctaccgtgaaatggcggagaagctgagaaagtggctggtagaagtttcttacctacccatgagcggcctgggtagtgttcctatccctttgcagcaggctaggaccctctttgatgaagtgcagttcaaggaaaaggtgtttctgcgacagcagggaagctacatcctgaccgtcgaagctggcaaacagctccttctatcggcagacagcggagccgaggcagccctgcaggccgaactggcggaaattcaagaaaagtggaagtcagcctcgatgagactggaagaacaaaagaaaaaactcgccttcctgctgaaggattgggagaagtgtgaaaaaggcatcgccgacagcttagaaaagctaagaacatttaagaagaagttatcccagagtttaccagatcaccacgaagaattgcacgctgagcagatgcgctgcaaagaactggaaaatgctgtggggtcctggactgacgatctgacccagctgagcctcctcaaggatacactgtccgcgtacatttctgccgacgacattagcatcctgaatgagcgggtggagcttctgcagcgccaatgggaagaactctgccaccagctttcactgcgaaggcagcagataggggaaaggctgaatgagtgggccgtttttagtgagaaaaataaagagctttgtgagtggctcacacaaatggaatcgaaggtctctcaaaatggggacattctcatcgaagaaatgattgagaagctcaagaaagactaccaggaggaaatcgctatcgcgcaggagaataagatccaactgcagcagatgggggaacggctcgctaaagccagtcatgaaagcaaggcgtccgaaatcgagtacaagctcggcaaggtcaacgatcggtggcagcacctgctagaccttattgctgcgcgagtgaagaagctaaaggagactttggtggctgtccagcagttagacaaaaatatgtcgtctctgcggacttggctggcccacatcgaaagcgagctggccaaaccgatcgtctatgacagctgtaactcagaggaaattcagcggaagctgaacgaacagcaggaactgcagcgggacattgaaaagcattcgacaggggtggcatctgtcctgaacctatgcgaggtgctgctgcatgactgcgacgcctgcgcaactgacgctgagtgtgactccattcagcaggcaactcgaaatctggataggcgctggagaaacatctgcgcaatgtccatggaacgcaggctgaaaatagaggagacttggcggctttggcagaaatttctggacgactatagccggttcgaggactggcttaagtcatcggagcggactgctgcatttccaagtagcagcggagtgatctataccgtggcaaaggaggagctcaaaaagttcgaggccttccaacgccaagtgcatgagtgcttgacacagctggaactgatcaacaaacagtaccgcagactggctagagagaatcgcacggactcagcgtgttctctgaaacaaatggttcacgaaggcaatcaacgctgggacaatcttcaaaagagagtgaccagcattctgaggaggctgaagcactttattggccagcgggaagagttcgagacagccagggattcaatcttagtgtggcttactgaaatggaccttcaactgaccaacatcgagcacttctcagagtgcgatgtgcaggcaaagataaagcagttgaaagccttccagcaggagattagcctcaatcacaacaagatcgagcagatcatcgctcaaggggaacaactgatcgaaaaatcagaacccttggacgctgccatcatcgaagaggaattggacgaacttcgcaggtactgccaggaagtgttcggacgagtggagaggtatcataaaaaattaataaggctcccactgccagatgatgaacacgatttaagtgacagagagctcgaactggaagatagtgccgcactgtcagatctccactggcatgaccggtctgccgattccctgctctctccccaaccgtccagcaacctgagtttatcgttggctcagccacttcgttccgagcggagcggacgcgatactccagctagcgtcgattccatccccttagagtgggatcatgactacgatctttccagagatctggagtctgcaatgagccgtgctcttccctccgaagacgaagaaggccaggacgacaaggatttctatcttaggggagccgtgggtctctctgacgtgatgatccctgaaagcccggaagcatacgtgaagctgacggagaatgccattaaaaacacatcgggagatcacagcgccctggagagtcagatcaggcagctggggaaagcactggacgatagtcgctttcaaatccagcagacagagaacatcatcaggtctaagacacctacaggccctgagcttgacacctcttacaagggctatatgaagctgttgggcgagtgcagcagcagcattgacagcgtgaagcgcctggaacacaagttaaaggaagaagaagagtccttgccaggcttcgttaacctccactcgaccgaaacacagaccgccggggttatcgacagatgggagctcctccaggcccaagcccttagtaaagaactgagaatgaagcagaaccttcagaaatggcagcaatttaatagcgatcttaattctatttgggcgtggctgggcgataccgaggaggaactggagcagctccagcggctcgaacttagtacagatatacagacgatcgaattacagattaaaaaactgaaggaattgcagaaagccgtggaccaccgaaaagccataatcctttctataaacctctgctctcctgaatttacgcaggccgactcaaaggaaagtcgggatcttcaggacagattgagccagatgaatggaaggtgggatagagtatgttcactgctggaagaatggaggggccttctgcaagatgccctaatgcagtgccagggatttcacgaaatgtcacacggcttgctgctgatgcttgaaaacattgaccgccgaaagaacgagatcgtaccgattgacagtaacctggatgcggaaatattgcaggaccaccataagcagttgatgcagatcaaacacgagttgctcgagagtcagttgcgggttgcatctctgcaggacatgtcttgtcagctccttgttaatgctgaaggcaccgactgtctggaggcaaaggaaaaggttcacgtgattggcaacagattgaagctcctgcttaaggaagtgtctagacatatcaaggaacttgagaagctgctggatgtctcatcatcgcagcaagacctgtcttcctggagctcagccgatgagctggacacttctggcagcgtaagccccacaagcggtcggagcaccccaaatcgccagaagacgccaaggggtaagtgctccttgtctcagcccgggccatcagtaagcagcccacactccaggagtaccaagggcgggagcgatagttccctgagtgagccaggcccgggccggagcgggaggggctttctgtttcgagttctgcgggcggcactgccactgcagttgctactccttttgttgatcggcctggcatgtctggtgccaatgtccgaggaagactattcttgtgctctgagcaataatttcgcccggagttttcatcccatgctcagatacacaaacgggccgccaccactgtag

SEQ ID NO: 206673 - DNA, 2859 bp, Artificial Sequence
  Description of Artificial Sequence: Synthetic coding sequence
atggtggtggccgaggacctgagcgccctgcggatggccgaggacagttgcgtggacgcagatctgccagactgtaactgcgacgtgactcgggtaaagaagctgaaggaaactctggttgcggtccagcagttagacaaaaacatgtcctccctgcgcacttggctggcacacatcgagtctgagctagccaagccaatcgtgtacgattcctgcaacagcgaagagatacagcgcaaactgaacgagcagcaagagcttcagagggacatcgaaaaacattcaactggagtggcatctgtccttaacctgtgtgaggtgttgctgcacgactgcgacgcctgtgccactgacgctgaatgcgacagcatacagcaagccactaggaatcttgaccgcaggtggaggaacatctgcgccatgagcatggagcggcgattgaaaatcgaagagacttggaggttatggcaaaagtttttggacgactacagtagatttgaagactggctgaagtcctcagagcgcaccgctgccttccccagttctagcggggtgatctatactgtcgccaaggaagagcttaagaaattcgaggccttccagcggcaggtgcacgagtgcctgacacagctggagctgatcaataagcagtaccgtagactggctcgagagaacaggacagattccgcttgctctctgaagcagatggtgcacgaagggaatcaacggtgggataacctgcaaaagagggtcactagtattctaagaaggcttaaacactttatcgggcagcgagaggaatttgaaactgctagggactccatcctcgtctggctcacggagatggatttacaattgaccaacattgaacatttcagtgagtgcgatgttcaggcgaagatcaaacaactgaaggctttccaacaggagatttccctcaatcacaacaagattgagcagatcatcgctcagggagaacagttaattgaaaagagtgagcccctggatgccgctattatcgaggaggagctcgacgagctgaggagatactgccaggaagtctttggtcgtgtagagaggtatcacaagaagcttatacgtctccccttgccagacgatgaacacgacttgagcgatcgcgagctcgagctcgaagatagtgcagccctttccgacctacattggcatgatcgatcagcggactctctcctgagcccacaaccaagtagtaatctgtccctctctttagcacagccactccgaagtgaacggagcggtagagacacccccgcctcagtcgacagtattcctctcgaatgggatcacgattatgatcttagtagagaccttgaatctgcgatgtctcgagcactgcccagtgaagatgaggagggacaagatgacaaagatttctacctgagaggagcagttgggctctccggcgaccacagcgccctagagtcacaaataaggcaactaggaaaggcattagatgatagccgattccaaattcagcaaacagagaatatcatccgctcgaagacccccactggccccgagctggatacaagctataaaggttacatgaagctcttaggtgaatgtagctcatccatcgatagtgtaaagcgtctggaacacaagttaaaagaggaggaggaaagcctgcctggcttcgttaacctccatagcactgagacacaaaccgccggagtcattgatcgctgggagttacttcaggcacaggcactcagtaaggaactgagaatgaagcagaatctgcagaagtggcagcagtttaactccgatctcaactccatctgggcatggctgggggacacggaggaggaactggaacagctacagcgcttggaactgtctaccgatattcaaaccatcgagcttcagattaaaaagctcaaggagcttcaaaaggctgtggaccaccgcaaagccatcattctctccatcaacctatgttcacccgaattcactcaagccgactccaaagagagtcgcgacttacaagatcggctctcacagatgaacgggcgatgggatcgtgtgtgctcactactggaggaatggagaggcctgctgcaggatgccctgatgcagtgtcaggggttccatgaaatgagccatgggttacttctcatgctggagaatatcgatagaagaaagaatgaaatcgtgccaatcgacagtaatctggacgcggaaatcttgcaggatcaccacaaacagcttatgcagattaaacacgagctgcttgagagtcaattacgggtggctagcctacaagacatgtcatgtcagctactggtgaacgccgaggggaccgactgcctggaggcaaaggaaaaagtccacgtaatcggaaaccgcctcaagctactgttaaaggaagtgagccgtcacatcaaggagctagagaagttactagatgttagcagctctcagcaggacctcagcagctggtctagcgccgatgagttggacactagtggaagtgtgtcacctacatccgggagatctactcctaataggcaaaaaactcctagaggaaaatgtagcttgtctcagccggggccctcggtatcaagcccccacagtcggtcaacaaagggcggctccgattcatcactgtccgaacccggaccaggtcggtctggcagggggttcctcttcagggtcttacgtgcagcactgccattacagttgctccttctgctcctcattggactagcgtgtctggtgcccatgtctgaggaggactattcctgtgccctatcgaacaatttcgcgcggagttttcaccctatgttaaggtataccaacgggcccccaccactgtag

SEQ ID NO: 206674 - DNA, 20475 bp, Artificial Sequence
  Description of Artificial Sequence: Synthetic coding sequence
atggccagcagccccgagctgcccaccgaggacgagcagggcagctggggaatcgatgatctccacatatcactacaagcagagcaggaggatacccagaagaaggccttcacatgctggattaattcacagctagcacgacacactagtccgtctgtcattagtgacctatttacagacattaaaaagggccacgtcctccttgacctgctggaagtcctgtccggacaacagcttccccgggacaaaggcagcaatacttttcaatgccggatcaatatagagcatgctcttacgtttcttaggaatcgtagtatcaagcttataaacatacacgtgactgacattattgacggcaatcctagcattatcctgggtctgatttggaccatcatcctgcatttccacattgagaagctggcccaaaccctgtcatgcaattataatcagcccagtcttgatgacgtaagcgtggtcgattcttctcctgcatcaagtcctccagccaagaagtgttctaaagtgcaggctcgctggcaaatgtccgcaaggaaggcgctcctactgtgggcccaagagcagtgtgccacctacgagtccgtgaatgtaacggacttcaaatccagctggagaaatggcatggccttcctagccattatccatgctcttcggcctgacttgatcgacatgaagagcgtgaagcaccgatcgaataaggataacctcagggaggccttccgcatcgcagagcaggagctcaagatacctcgactgctggagcctgaagatgtggacgtcgtagatccagacgagaaatctatcatgacatacgtggcgcagtttctgcagtattctaaggacgcacctggcacaggggaggaagcgcagggtaaagtcaaagacgctatggggtggctcacgctccagaaggagaaattgcagaaactgctcaaggattccgagaacgacacttacttcaaaaaatataacagtcttctgtccttcatggagagtttcaacgaggaaaagaaatccttcctcgacgtcctaagcatcaaacgggatctggacgaactcgataaggaccacttacagcttagagaggcctgggatggcctcgaccaccagattaatgcatggaagatcaagcttaactacgctctgcccccgcccctgcatcagacagaggcttggctgcaagaggtcgaagagctgatggatgaggacctgagcgcttcacaagaccactctcaggccgtcaccctcattcaggagaaaatgaccctcttcaagagtctgatggacagattcgaacatcacagcaacattctgctgacattcgaaaataaggatgaaaatcatctgccgctggttcctcctaacaagctggaggagatgaagcgcaggatcaacaacattctcgagaaaaagtttatcttgctcctggaattccactattacaagtgtctcgtacttggtttggtggacgaagtcaaaagcaagttagacatttggaatatcaagtatggaagccgagagagcgtagagcttctgctggaagattggcacaaattcatcgaagagaaggagtttttggcacggcttgatacttcttttcagaaatgcggggaaatctacaaaaacctcgcaggagaatgccaaaacattaacaaacagtatatgatggttaaaagtgatgtttgtatgtatcgcaagaacatttataatgttaaatccacccttcagaaagtgctcgcttgctgggcaacttatgtggaaaacctgcggctattgagggcctgcttcgaggagacaaaaaaagaggagattaaagaggtgcccttcgagacactcgctcagtggaacctggaacacgctacccttaacgaggctggaaactttttggtggaggtgagtaatgacgtggtcggaagcagcatttccaaggaactgaggaggctaaacaagcgctggcgcaagctcgtgtcgaagacccagctagagatgaatctgccactgatgatcaaaaagcaagaccagcctacattcgataatagcgggaacatcctgagcaaagaggagaaagccactgttgaattcagcaccgacatgagtgtcgagttacctgaaaactacaatcaaaatatcaaagccggagaaaaacatgagaaggaaaacgaagaattcaccggtcagctgaaagtggctaaggacgtggaaaagttaatcggtcaggtggagatctgggaggcggaagcaaaaagtgtgctggatcaggacgatgtggataccagtatggaggaatccctcaagcacctcattgccaagggtagtatgttcgatgaactaatggcacgttctgaagacatgctccagatggatatacagaatatttcttctcaggaatcttttcaacatgtactgaccaccggcctgcaagccaaaatacaggaagcaaaggagaaagtgcagatcaatgtagttaagctgattgcagccctcaagaaccttaccgacgttagccctgacctggacatacgcctcaaaatggaggagtcacagaaggaactggagagttatatgatgcgcgcccagcagttacttggccaaagggagagccctggggagctaatcagcaaacataaagaagcgctgatcatatcgaatacaaaatcgctcgcaaaatacttaaaggcagtggaggagctgaagaataacgttaccgaggacatcaaaatgagtctggaagaaaagtcaagggatgtctgcgccaagtgggaatcgctgcaccatgagctttctttgtacgttcagcagttaaaaatcgacatagaaaaaggtaagttgagcgataacattctgaagttggagaagcaaatcaataaggagaaaaagctgatcagaagggggcgcacgaaagggctcatcaaagagcacgaggcgtgtttttccgaggagggctgtctgtaccagctcaatcaccacatggaagtgctcagggagctgtgcgaggaactgccaagtcagaagagccagcaggaggttaagcgcctcttaaaggattacgagcagaaaatcgagcggctgctgaagtgtgctagtgagatacacatgaccctgcagcctaccgccggcggtacgagtaaaaatgaggggaccataaccacctccgaaaatcgaggcggggacccacatagcgaagctcccttcgctaaatccgataaccaaccatcaacggagaaagcaatggagcccacaatgaagttcagcctggcctctgtgctgcgccctctccaggaagaatccatcatggagaaggactacagcgcatctattaattcgctcttggagcggtacgatacctacagagatattctcgaacaccaccttcagaacaataaattcagaatcacttctgatttctcatccgaagaagacagatcctcatcctgcctccaagccaagcttactgacctgcaggtgataaaaaatgagactgacgccagatggaaagaatttgagatcatcagtctgaagctggagaaccacgtcaacgatattaagaagcccttcgtgatcaaggagcgagacactctaaaggagagggaacgcgagctgcagatgacgctgaacactaggatggaatctctggaaaccgccttacggttggttcttcctgtggagaaggcttcactcctgctgtgtggctccgaccttcctctccacaaaatggccatacagggctttcacctaatcgatgccgaccgtatctatcagcaccttcgaaacattcaggactccattgccaaacagatcgagatctgtaaccgacttgaggagccaggaaacttcgttctgaaggagctgcatccctttgatctgcacgccatgcagaacataattctgaagtataaaacacaattcgaaggcatgaatcacagggtgcagaggagcgaagatacactgaaggctttagaagactttctggcatccttaaggaccgccaaactgtccgccgaaccagtaaccgacctgagcgctagtgatactcaggtcgcccaggaaaatactctgactgtgaagaataaagaaggtgagattcatcttatgaaggacaaagcaaagcacttagacaagtgtctgaagatgctagatatgagttttaaagatgccgagcgtggagacgacaccagctgcgaaaaccttcttgacgccttcagcataaagctgtctgagacccacggatacggggttcaagaagaatttaccgaggagaataagctactcgaagcgtgtattttcaagaataacgagctccttaaaaacatacaggacgtgcagtcgcagatcagcaagatcggactcaaagatcctacagtaccggcagtgaagcacaggaagaaatctttgattcggttggacaaagtgctagatgagtacgaagaagaaaagcgccacttacaagaaatggcgaacagcctcccccattttaaagatggccgcgaaaagaccgtcaaccagcagtgccaaaataccgtggtactctgggagaacacaaaggcactggtgactgagtgtctcgagcagtgcggtcgagtgcttgaacttctaaagcagtaccagaattttaaaagtatcctgacaaccctaatccagaaggaagaatcagtgatctcgctacaggcaagctatatgggcaaggaaaacctcaagaaaaggatcgccgaaattgaaatcgttaaagaagagtttaatgaacaccttgaagttgtagataagattaaccaggtgtgtaagaacctccagttttatttgaacaaaatgaaaacctttgaggagccacctttcgaaaaggaagccaacattatcgtggaccgttggctcgacatcaacgagaaaacggaagactattacgagaatctagggcgagccctggcactctgggacaagctgttcaatctgaagaatgtgatagatgagtggactgagaaggccctccagaaaatggagctgcaccagctgacagaggaagacagggagagactgaaagaggagcttcaggtgcacgagcagaagaccagtgaattttctcgaagagtagcggagattcaattcctgcttcagagtagcgagataccacttgaattgcaagttatggagtcttcgatattgaataaaatggaacacgtgcagaaatgccttactggggagtctaattgccacgccctctctggctctaccgccgagctgcgggaggatctggatcaggcgaaaactcagatcggcatgactgaatctctgctcaaagcattgtcccccagtgactctctggaaatctttacaaaattagaggaaatccagcagcaaattctgcagcagaagcactccatgatccttttggaaaatcagattgggtgcctcacccctgaactgagcgagttgaagaagcagtacgagagcgtgagtgatttgttcaacacaaagaaaagtgtactacaagatcatttttctaaactgctgaatgaccagtgtaagaattttaatgattggttctcaaatataaaggtcaaccttaaggagtgtttcgaatcatccgagactaaaaagtcagttgaacagaaactgcaaaagttgagtgatttcttgacacttgaaggacgaaattcgaagatcaagcaggttgattccgtgctcaaacatgtgaaaaaacatctccctaaagcgcacgtgaaagaacttatttcatggctggtgggacaagagttcgaactggagaaaatggagagtatctgccaggcccgagcaaaggaactagaagatagtctgcagcaattgcttcggctgcaggacgatcatcggaacctccgcaagtggctgacaaaccaagaagaaaagtggaaggggatggaggagcccggagagaagactgaacttttctgccaagccctcgcgagaaagcgagagcagtttgagagtgtcgcacaactgaacaactccctgaaagaatatggattcactgaagaagaagagataattatggaggcaacatgtctcatggaccggtatcagacactgctcaggcagctttcagagattgaggaggaagacaagcttttgccaacagaagatcagtcgttcaacgacctcgctcacgacgtcatccactggattaaggaaatcaaggaaagtctgatggtgctcaatagttccgagggcaagatgccattagaagaacgcattcagaaaatcaaagagatcatcttgctcaagcctgaaggagacgcacgtatcgagacaataatgaagcaggccgagagctccgaggcccccctggtgcagaaaactttgaccgatatctccaatcaatgggataatacactgcatctcgcctctacctacttatctcaccaagagaagcttctgttggagggggagaaatatctgcagtctaaagaggatctgcgtctgatgctaatagaactgaaaaagaaacaggaggccggcttcgccctgcagcacggcctgcaggaaaagaaggcccagttgaagatttataagaagttcctcaagaaagcacaggacctgacatctttacttaaggagctgaaatctcagggtaattatctgttagagtgtacaaaaaacccatcatttagcgaggagccatggctggaaattaagcacctgcatgagtccctgctgcagcagcttcaagacagtgttcagaatctggacggacatgtgcgagagcatgatagctatcaggtctgtgtgactgacctgaataccacactggataattttagcaaggagttcgtctccttttctgacaagccagtggaccaaattgccgtggaagaaaagttgcaaaagctccaggaactggaaaataggctgagtttgcaagacgggacccttaaaaagatccttgcactcgcaaagtccgtgaagcagaatacatcgagcgtcggacagaaaattattaaggacgacatcaaatctttacaatgtaaacagaaagatcttgagaacaggctggccagcgcaaaacaggaaatggagtgttgcttgaactcaatcttgaaaagcaagcgctccacagagaaaaagggcaagttcaccctgccagggcgcgagaagcaagcaacttctgacgtccaggaaagtacacaagagagtgctgcagtagaaaagctggaagaagactgggagattaacaagaacttcgtcgagaacgtgatggcagttagcaaaaattgccaccacagcatgtacatttttgaaagtattgtgaagaacttcatctccgatgagatgcaagactcggctgtggagatggccatgtcaaagcagctctcccttaacgctcaggagagtatgaagaacaccgaagacgaacgtaaggtgaatgaactgcagaatcagccactggaattggacaccatgctccgtaacgagcaactcgaggaaatagaaaaactgtatacccaactcgaggcaaagaaagcagcaataaaaccgctcgagcagaccgaatgtcttaacaaaaccgagactggagcactggtactccacaacatcgggtacagcgcgcagcatttggacaatctgcttcaggccctgattacactgaagaagaacaaagaatctcagtactgtgtgctacgggacttccaagagtatctggcagctgtcgaaagttccatgaaagctttgctgacagataaagaatccctgaaagtgggccccttggactcagtgacttaccttgacaagataaagaaatttatagctagtattgaaaaggagaaggatagtctcggcaacctgaaaatcaaatgggaaaacctgtcaaatcacgtgacggacatggataaaaagttgctggagtctcagattaagcagctcgagcatgggtgggagcaagtcgagcagcagatccagaagaagtacagccagcaggttgtcgagtacgacgagttcaccactctcatgaacaaggtgcaggatactgaaataagcttacagcagcaacagcagcatctccaactgcggctgaaatccccagaagaaagagccggcaatcagtctatgattgctctgactacagaccttcaggctacaaagcacgggtttagtgtactgaagggacaagctgaactgcagatgaaacggatttggggggagaaggaaaagaagaatttggaggacgggatcaataatctgaagaagcagtgggagaccctggagcctctgcatctcgaagctgagaaccagatcaagaaatgtgatattcgcaataagatgaaggagaccattctttgggctaaaaaccttctcggggaacttaatcccagcataccactgttgcccgatgatatcctcagccagatccgcaagtgtaaagttacacacgatgggattctggcacgccaacagagcgtagaatccctggcagaggaggtgaaggacaaggtgcccagcctgactacatacgagggaagcgatcttaataacactttagaagacctgcggaatcagtatcaaatgctggtcttaaagtcaacccaacgaagtcagcagttggaattcaagctggaggagaggtccaacttttttgccatcattcggaagttccaactgatggtgcaggagtccgaaacactcattatcccgcgcgtagagaccgcagctacagaagcagaattgaaacaccatcatgtaaccctcgaagcttcacagaaagagcttcaggagatcgattctgggatttcaacacatctccaggaactgactaatatctacgaggagctgaatgtgttcgagcggctgttcctggaagaccagttgaagaaccttaaaatccgcacaaatagaatacagaggttcatccagaacacctgtaatgaagttgaacacaagatcaagttctgtagacagtttcacgagaaaacatccgcccttcaagaggaggccgatagtatccagcgcaatgaactgctgctgaaccaggaggtgaacaagggcgtaaaagaggaaatttacaacctcaaagatcggctcaccgctattaagtgctgcattttacaggtgttgaagttgaaaaaggtattcgattatattggcctcaactgggacttctcccagttggaccagctgcagactcaagtatttgagaaagagaaggagttagaagaaaagataaaacagctggatacattcgaagaagagcatggaaagtatcaggccctcctctccaaaatgagggctatcgacctgcagataaaaaagatgacagaagtcgtgctcaaggctccagactcttccccagagtctcgcaggctgaacgctcagatcctttctcagcgaatagaaaaggcaaaatgtttatgtgatgagattattaagaaactgaacgaaaacaagactttcgatgattccttcaaggagaaggaaattcttcaaatcaaattgaacgcggaagaaaacgataagctctacaaggtgttgcaaaatatggtgctggagttaagtcccaaagagttggatgaaaagaactgtcaggacaaactagagacatctctacatgttctgaaccaaatcaaaagccagctccagcagcctctcctgatcaaccttgagattaaacacattcagaatgaaaaggacaactgcgaggctttccaagagcaggtatgggccgagatgtgctccattaaggctgtgaccgctattgaaaagcaacgcgaagaaaattcaagcgaagctagcgacgtagagaccaaacttagggagtttgaggacctgcagatgcaactgaacacttccatcgaccttaggaccaacgtgctgaacgatgcttatgagaatctaactagatataaagaggcggtcacaagggccgtggagtccatcacaagcctggaggccattattatcccctatagggtggacgtgggaaacccagaggagagcctagaaatgcctctcaggaaacaggaggaactggagtctacagtggctcacatccaggatctaacagagaaactgggaatgatctcttcgccagaggccaaactccagctacagtacaccctccaggaactagtgtcaaaaaatagcgctatgaaggaggcctttaaagcccaagagacggaggcggagcgttacctggagaactacaaatgttaccgcaagatggaggaggatatttataccaacctctccaaaatggaaaccgtgctggggcagtcaatgtcatcactgcctctgagttacagggaagcacttgaacgtctagaacaaagtaaagccctagtgtccaacctaatcagcactaaagaggaactgatgaagttgcggcaaatcctacgcctcttgagactccggtgcaccgagaacgacggcatttgcctgctgaagatcgtgtcagccttgtgggaaaagtggctaagtctcttagaagcagcaaaggaatgggaaatgtggtgtgaggaactgaaacaggaatggaaattcgtttcagaggagatagagagggaagctattatcctggataatttacaggaagaattacccgaaatttccaagactaaagaggcggccactactgaagagctgtccgaactgctggactgcctctgccagtacggcgaaaatgtagaaaagcagcaactcctcctaaccttgctgctgcagagaattagaagcattcagaacgtgccagaatccagtggagccgtagagaccgtgccagcattccaggagattacctccatgaaggaaagatgtaataagctgcttcagaaggtccaaaagaacaaggagttggttcagacagaaattcaggagcgccactcattcaccaaagagattatcgccctgaaaaactttttccagcaaaccaccaccagctttcagaacatggcgtttcaggaccatcccgagaagagcgagcagtttgaggaactgcagtctatcctgaaaaaaggaaaactcactttcgagaacatcatggagaagctgcggattaagtattccgaaatgtatacaatagtgccggctgaaatcgaaagtcaggtggaggagtgtcgtaaggccctcgaggatattgacgaaaagattagcaatgaagtactgaaatcttcccctagttatgccatgcggaggaaaatagaggaaattaacaacggactgcataacgttgagaagatgttgcagcagaagtccaagaatattgagaaggctcaggagattcagaaaaaaatgtgggacgagctcgatctttggcattcaaagctgaacgagcttgactccgaagttcaggatatcgtggagcaggatcccggacaggctcaagaatggatggacaatctaatgattccatttcagcagtatcagcaagtgagccaacgggccgagtgcaggacaagccagctcaacaaggcgacagtcaaaatggaggaatactcagatctgctgaaaagtaccgaggcctggatcgaaaataccagccatctgctggccaatcccgcagattatgatagtttgcggaccctgtcccaccacgcaagcacggtgcagatggcattggaggattctgagcagaagcataacctgctccactccattttcatggacctcgaagatctgtctattatatttgagaccgatgagttgacacagtcaattcaggagcttagcaatcaggtcacagccctgcagcaaaagatcatggaatctctcccccaaatccaacgcatggcagatgatgtcgtcgccatcgagtcagaagtcaaaagcatggaaaaaagagtctctaaaataaagacgattctcttatccaaagagatattcgactttagcccggaagaacatcttaaacatggcgaggttatcctggagaacatccgtcccatgaaaaaaactatcgccgaaatcgtgtcttatcaagtggaactcagactgccacagactgggatgaagccattgcccgtcttccagcggacaaaccaacttctgcaagatattaaacttttggaaaatgtgacccaggagcagaacgaactgttgaaggttgtaattaaacaaacaaacgaatgggacgaggaaatcgagaaccttaagcaaatacttaataactacagtgcacagttctccctggaacatatgtctcctgatcaggcagataaattgcctcagctgcaaggcgaaattgagaggatggaaaagcaaatcctctctttgaaccaaaggaaagaagatcttctcgtggacctaaaggccactgtgctcaacctccaccaacacctcaaacaggagcaagagggagttgaacgcgatcggttgcctgctgtgacctccgaggagggcggcgttgctgagcgggatgcatcagaaaggaaactgaatcgacggggaagcatgtcctacttggcagccgtggaggaagaggttgaagaatcatcagtaaaatctgatcacgataaagatatggaagaagacagggcctcctcctctagtgggacaatagtgcaggaggcttacggtaaaatctcaacctccgacaactctatggcccagatactaacccccgactcactgaatactgagcaaggtcctgagtgttcccttcgacccaaccagactgaagaggggactacccctccaatagaagcggataccctggactcctcagacgcacagggcggcctggaaccccgcgtggagaagacgcgacctgagcccactgaagttctgcatgcctgtaagacccaggtggctgagttggagctttggctgcaacaggctaatgtggcagtggagccagagaccctgaacgccgatatgcaacaagtcctcgaacagcagctggtgggctgccaggcaatgctgaccgaaatcgagcataaggtggcctttctgttagaaacctgtaaagaccaagggcttggagacaatggtgctactcagcacgaggcagaggcacttagcctgaagctgaagaccgtaaagtgtaatctggaaaaggttcaaatgatgttacaagagaagcacagtgaagaccagcatccgacaatcttgaaaaagtcctctgagccggaacatcaagaggcccttcagcctgttaacctctctgagctcgagtcgatcgtgactgaacggcctcagttctctaggcaaaaggacttccaacaacagcaagtgcttgagctgaagcccatggaacagaaggactttatcaaatttattgaattcaatgctaaaaaaatgtggccccagtactgtcagcacgataacgataccacccaggagtcatccgcaagataccccacaaccgaggagttgaagacttatacaacccagctggaggatctccggcaggaagcctccaacctgcaaactcaggaaaacatgactgaagaggcatatatcaacctagacaagaaactgtttgagttgttcctaactctctctcagtgtctgagcagtgtggaggagatgttggagatgccccggctttaccgggaggacggatctgggcagcaggtgcattatgaaaccttggcgctcgagctgaagaaactgtatcttgcgcttagcgataagaagggtgaccttttgaaggcaatgacttggccgggggaaaatacgaatttgttactggagtgtttcgacaacttgcaggtgtgtttggagcacacacaggcggcagcagtgtgccgatctaagagcctcaaagcggggttggattacaatcggtcgtaccaaaaggccgacgcttatactgtcgagctggagaacgctgaatcaagggtggcgaaactgagggacgagggagagaggcttcacctcccgtatgccctgctgcaagaagtgtacaaactggaagacgtgctggatagcatgtgggggatgttgcgtgccaggtacacagagctgtctagcccgtttgtgactgagtcacagcaagatgcactgctgcaagggatggttgagctggtaaagataggtaaagaaaagctggcccacggccatctgaaacagaccaagtccaaggtggctttgcaggcacagattgagaaccacaaagtattctttcagaagttagtggctgacatgttactcatacaggcatattctgccaagatcttaccaagcctcctgcagaatcgggagaccttctgggctgagcaagttacagaagtgaagatattggaggaaaagtcccggcagtgcggcatgaaactgcaatcattgctccagaagtgggaggagtttgacgaaaactacgcatcactggagaaggaccttgagatcctgatcagtactctccctagcgtctcactggtcgaggaaacagaagagcgtctggtggagcgaatctctttctaccagcagatcaaacgcaacattggaggtaaacacgctcggctttaccagactttaaatgaggggaagcagctggtagcaagtgtgagttgccccgagctggagggccagatcgcaaagctggaagagcagtggttgtccctcaacaaaaaaatcgaccacgagctccatagactgcaagcgctgctgaagcacctcctacgtagtgctttccttggcgtgtataatcgcgatagcgaccagctgacaaaatggcttgagagctctcagcataccctgaactactggaaggagcagtctctcaatgtctctcaggaccttgacacaattcggtctaacataaataactttttcgagttttcaaaggaggtggacgaaaagtcgagcctcaagaccgctgtgatcagcatcgggaatcagctgttgcatctgaaagagactgacacagctaccttgagggcctccctggcccaattcgagcagaagtggacaatgttgattacacaactccccgatatccaagagaagctgcatcagctgcaaatggaaaaacttccctctcgaaaggctattactgaaatgatctcctggatgaacaatgtggagcaccaaacttccgatgaggacagcgtacattcaccctccagcgcttcccaggtgaagcacctactacagaagcataaagaattccgaatggaaatggactacaagcaatggatcgtcgacttcgttaaccaatcactgttgcaacttagcacctgtgatgtcgaatccaagagatacgaacggacagaattcgccgagcacctgggagagatgaacagacagtggcacagagtacacgggatgttaaacagaaaaatccagcatttggaacagctgttagaatccataactgagagcgagaacaagattcagattcttaacaattggctcgaagctcaggaagagaggctgaaaactctgcaaaagcctgagagcgttattagcgttcagaaactgcttttagattgtcaggacatagaaaaccagcttgccattaagtcaaaggcattggatgagcttaaacaatcttaccttactttggaaagtggagccgtccctctgctagaggacaccgcatccagaattgacgagctgttccaaaagagaagctcggtactgacacaggtgaatcagctcaaaacctctatgcagagcgtccttcaggagtggaaaatttatgatcagctgtacgatgaagtaaatatgatgactatccgattttggtattgcatggagcactccaaaccagtggtgctgtctctggaaaccctgcggtgtcaggtagagaatctgcagagcctccaggatgaggccgagtcttccgagggctcttgggagaagctccaagaggtgattggcaaactgaaggggctgtgtcccagcgtcgccgaaatcatcgaggaaaagtgtcagaacacgcacaagcggtggactcaggtaaatcaggctattgctgaccaattgcagaaggctcagagcctcctgcagctgtggaaagcctatagtaacgcacacggagaagctgcggctcgtcttaaacagcaggaggcaaaattccagcagctagcaaacattagtatgagcggcaacaatctggccgaaatactcccccccgcactgcaggacattaaagagctgcagcacgacgtgcagaaaacaaaagaagcgttcttacagaattcctctgttctggacaggcttccacagcctgctgagagcagtactcacatgctcctgcctgggccccttcatagtctccagagagctgcgtacttggagaagatgctccttgtgaaagcgaacgagttcgaaaatcacgtgctggccctgaccgctcaaagtccagacattgagcatttgaacgaagtctctctgaagttgccactttccgacgtcgccgtaaaaacactgcagaatatgaatagacagtggataagagccactgcaaccgctttggagcggtgcagtgagctgcaaggtattggtctaaatgagaaatttttgtattgttgtgagaaatggatccaactgctagaaaagattgaagaggcgctcaaggtagatgttgccaactcactgcccgaattactggagcagcagaaaacatataagatgcttgaagcggaggtgtctattaatcaaactattgctgactcctacgtgacccagtcactccagctgctggacactacagagattgaaaacagacccgaattcattacagagtttagcaaattaacagaccggtggcaaaacgctgtccaaggcgtccgacagagaaagggagatgtcgacggactgaatgctcatgtcgcacgatgtggaggggcaagcttgaagaagcaagatctgcgatattctctgcacacggcttgcggagcagcactactgtgccgaagcagccacggcgctaataaggagatccattttcagaggagacggacaacttgcgctctgacattagaggctggggagaaattactgctcactaccgacttgaaaaccaaagaatctgtaggccggaggatttcgcaactccaggatagttggaaagacatggaaccgcagctggcagaaatgattaaacaattccaaagcactgttgagacttgggaccagtgcgaaaagaaaattaaggagttgaagagccgactgcaagttctgaaggcccaatcagaggatccccttcctgagctccatgaggacctgcacaacgaaaaggaattgattaaagttgccattcgcaagcaggagattgaagatcggttaaatacatgggtggtgttcaatgagaaaaataaggaactgtgcgcctggttggtgcaaatggaaaacaaggtgctgcagacggccgacatcagcatcgaggaaatgattgagaagcttcagaagcgaactgtaggcagagaagaggtccctgagaggtgggagtgtgagacaatcgtcagtgggcacgggacagaggagtcttgtttcctcagtatccggaaatttcatcagggccgcggactgcatatactgacgtgtcagttgattccccaagattgtatggaggagatcaatctcttcagcgagaacaagctgcagttaaaacagatgggggatcagcttatcaaggctagtaataagtctagggccgctgagattgacgacaaactgaacaagattaacgataggtggcagcatctctttgatgtgattggttcatccatggccgatcagaccaactcacgttggatgttcttccagtggccccggggtatccaacgaactgtgacctggccctgggaccatctgtgctcctgcgccagcaccggacataccggccccttccacagcagcgtgctgcggtgcttcgaacagcatatcgaatttggcatctacaggcgcacctacaaggtgaataaggagcttgggggagacaagaatggccagcggtgtcccattatttaccctcacgggctggtgcagtgtatcagattaggagaacccctgatcttgaaaagggttaagaaattgaaagagaccttcgctttcattcagcagctggataaaaacatgtcaaacttgcgaacctggctggctcgcattgaatcagaattgtcaaaacccgtggtttatgatgtgtgtgacgaccaggagattcagaagcgcctcgccgagcagcaagacctacaaagagacatcgaacagcattccgcgggcgtggagtctgttttcaatatctgcgacgtgctactgcacgactcagacgcatgtgcaaacgaaaccgagtgcgatagcatccagcaaacaacccgctcactagatcggagatggaggaacatttgcgcgatgtcaatggagcgaaggatgaaaattgaagaaacatggagattgtggcagaagttcctagacgattattcccgatttgaagattggttgaagagcgccgaacgcacagccgcctgcccaaactcatctgaggtgttgtacacctctgctaaagaagaactgaagagattcgaaaggcaaatccacgagcgactgactcagttggaacttatcaacaagcagtatcgcagactggcccgagaaaatcgcactgatactgcgtcacgactaaaacaaatggtacatgagggcaatcagaggtgggataatctgcagcgaagggtgaccgccgtacttaggagactacgccacttcacaaaccagagggaggaatttgaaggaactagggaatctattctggtgtggctgaccgaaatggatctgcagctgactaacgttgaacacttttccgaatcagacgcagacgataagatgcgccagctgaacggattccagcaggaaattaccctgaacaccaataaaattgatcagctgatagtgttcggggagcagctgattcagaaatctgaacccttagatgccgtgttaattgaagatgaacttgaggagctccatcggtactgtcaggaaggtctggaagacgaaaaggaagcatctgagaacgaaaccgacatggaagatcctcgtgagatccaaacggactcctggcgcaaacgcggtgaaagcgaggagccgagcagccctcagtcactgtgccatcttgtggcaccaggacacgaacgtagcggatgcgaaacccctgttagcgtagactcaatcccgctagagtgggaccatacgggcgacgtgggagggtcatccagccatgaggaagacgaggaggggccatattactctgcgctaagcggaaaaagcatctcagatggccactcttggcatgtccccgactccccgagctgcccagagcaccattataagcagatggagggagataggaatgttcccccagtccccccagcctccagcactccttataagccaccatatgtttcgctgaactttactggcagcactgcctacgtttgtgcattcgatcgctgggagatgatacaagcccaggagctacataacaagctgaaaattaaacaaaacctgcagcagttaaactcggatatctccgcaattacaacatggttgaaaaaaacggaggctgagttagaaatgcttaagatggcaaagcctccaagcgacatccaggagatcgaattacgagtcaagaggctgcaggagatcctgaaggcatttgatacatacaaggctttggtggtctccgtgaacgtatcttccaaagagttcttgcagaccgagtcaccagagagcacagaattgcagtccaggctgcgacagttgtctttactctgggaggctgcacagggagccgtcgacagttggcgtggcgggctcaggcaatccctaatgcagtgtcaagatttccaccagctgagccagaacttgctactttggctggcgtctgcaaaaaaccgacgccagaaggcgcatgtcactgatcccaaagcagacccaagagcgctcttggagtgtcggagagagctcatgcaactagagaaggagctcgtggaaagacagcctcaagtcgatatgctgcaggagattagtaattctctactgattaaaggacatggtgaggactgtatagaggccgaggagaaggtgcatgtaatcgaaaagaagttaaagcagctgcgcgagcaggtgagccaagatctgatggctttgcagggaactcagaatcccgcctcccccctcccaagcttcgacgaagttgactcaggagaccagcctcctgccacatccgtgcccgcccccagggcaaaatttctgtacccagctgtgcagagcagtgaaaattatcggagaagggggggggatagggagcagggcccccggcaacatacagctacggcccttttgcccctgaagggagggccaggaagtcccactcccgccgccgcacccccagctgctgccgcacctggacttccagcagctttattgcggcgacggctacaattgcatagcggtcagcagctgtgcccagtcttgttaccacacgctgaggtgcatcagtgggctaccccccacatagaagggatagcgggccatagcgccacccccccagcttag

SEQ ID NO: 206675 - DNA, 20658 bp, Artificial Sequence
  Description of Artificial Sequence: Synthetic coding sequence
atggccagcagccccgagctgcccaccgaggacgagcagggcagctgggggattgacgacctacacattagtctacaggccgaacaggaggacactcagaaaaaggccttcacttgttggattaacagccagctcgcaagacacacttccccatccgtgatctcagatctctttactgacatcaaaaagggacacgttctactggacttgctagaagtattgagcggccagcaactgcctagagacaaagggtctaatacgtttcagtgtcgcattaacattgagcacgccctcacgttcctccgaaaccggtctattaagcttatcaatatccacgtgactgacataattgatggaaatccttccattattttagggctgatctggaccatcattcttcacttccacatcgagaagctcgcgcagacactgtcttgcaattacaaccagccttcccttgatgatgtttccgtggtagacagctcgccagcctcgtccccgccagctaagaaatgtagcaaagtccaggcgagatggcagatgagtgcgcgcaaagccctcctcctttgggcgcaggaacagtgtgcaacttacgagtctgtgaacgtaactgatttcaagtcttcttggagaaatggcatggcgtttctggccatcattcatgctctgagacccgatctcattgacatgaagtcagtgaagcaccggagcaataaggacaacctcagggaagcgtttagaatcgccgagcaggagctcaagatccccagactgcttgaaccagaagacgtagatgtggtggatcctgacgagaagtctatcatgacctatgtggcccagtttctacaatattcaaaggacgccccagggacaggtgaagaggcacaggggaaggtcaaggacgcaatgggctggcttactctacagaaggagaagctgcagaagctgctcaaggatagtgaaaatgacacctactttaagaagtataactccttgctgtctttcatggaatctttcaacgaagagaagaagagtttccttgatgttctgtcgattaagcgggaccttgacgagctggataaagaccacctccagttgagggaggcgtgggatggcctggatcaccaaattaatgcctggaaaattaagcttaattacgcattacctcctcctctccaccagaccgaagcatggcttcaggaggtcgaggagttaatggatgaggatctatccgcttctcaggaccattcccaggcagtgaccctgatccaggaaaagatgacactgttcaagtcattgatggatagatttgagcaccatagtaacattctcctgaccttcgagaacaaggacgagaatcacctgcccctggtgccacccaataaactagaggagatgaagagacgaataaataacatcctcgaaaagaaattcatacttttgttggaattccactactacaagtgtctggtcctcggattggttgacgaggtcaaatcgaaactggacatctggaatatcaagtatggatcacgggaaagcgtggagctgctcctagaagactggcacaaatttatcgaggagaaggaattccttgcaaggctggacactagttttcaaaagtgcggcgagatttataagaacttggcgggcgagtgccagaacattaataaacaatacatgatggtgaagtctgacgtgtgtatgtaccgtaaaaatatatataatgtgaaatccaccctgcaaaaggttttggcttgctgggcaacatacgtggagaatctgaggctgttgcgggcctgctttgaagagactaagaaggaggagattaaggaagtgccctttgagacactcgcccagtggaatctggagcatgccacacttaacgaggccggaaacttcctagttgaagtgtccaatgatgtggtggggtcgtccatctccaaagagctgcggcgattgaataagaggtggaggaagctggtaagcaagacccaactcgagatgaacctgcccctaatgatcaagaaacaggatcaacccacattcgataatagcgggaacattctcagtaaagaggaaaaggcaacggtggagttttccaccgacatgagcgtggagctgcccgagaattataatcaaaatattaaagccggggaaaaacacgaaaaggaaaacgaagaatttacaggccagttaaaagtggcaaaagatgtcgaaaagttgattgggcaggttgagatttgggaagctgaggctaaaagcgtgttggaccaagacgacgtggacacatcgatggaagaatccctgaagcaccttatcgccaagggctcaatgtttgatgagctcatggcccggagcgaggacatgctgcagatggacattcagaatatctcatcccaagagtctttccagcacgtgctcacgacgggtctgcaggccaagattcaggaggccaaggaaaaggttcagattaatgtggtcaaattgattgcagctctgaagaacttgacagatgtgtctccagatttggatattagattgaaaatggaagagtctcaaaaggagcttgagtcctacatgatgcgggctcaacagctgctgggtcagcgggaatcgcccggcgagcttatcagtaaacacaaagaagctctgattatatccaacaccaagagcctggcgaagtacttaaaggccgtggaagagctgaagaataatgtgacagaagatattaagatgtcactggaagaaaagagtcgcgatgtgtgcgcaaagtgggagtccttacatcacgagctcagtttgtacgtgcaacagcttaaaatcgatattgagaagggaaagctcagtgataatatcctcaaactggaaaagcaaatcaacaaggaaaagaagctgatcagacgcggccgcacaaagggcctgatcaaggaacacgaagcctgtttttcagaagagggctgcctttatcagcttaatcatcatatggaggtccttagggaactgtgtgaggaactgcctagccagaaaagccaacaggaggtcaagaggctcctcaaggactacgagcagaagatagaaaggttactgaagtgcgcatctgagatccacatgacgttacaacctactgcagggggaacatccaaaaatgaaggtacaatcacaacaagcgaaaatcggggaggagatccccattctgaggctccctttgctaagtccgacaatcagcccagcacggaaaaggccatggagccaacaatgaagttttctctggcttccgtgctgagacccttgcaggaggagagcatcatggagaaggattatagcgcatcaatcaacagcttgctcgaacggtacgatacgtatcgggacattctggaacaccatctgcagaataacaagttcaggataacaagcgactttagctccgaagaggataggtcgagctcctgtctgcaagcgaagcttaccgatttgcaggtgatcaaaaatgagacagacgccagatggaaagaatttgaaattatctcactaaagctcgagaaccacgtgaatgatattaagaagccattcgtcatcaaagagagagacaccctcaaggagcgcgagagagagctacaaatgacccttaacacccgcatggagtcactggaaacggccctccggctcgtccttccagtcgagaaagccagcttgttactgtgtggaagcgacctcccgctgcataaaatggcaattcaaggctttcatctaattgatgcagatagaatatatcagcacctgcgcaacatccaagactctatcgccaagcagatagaaatatgcaatcgcttagaagaaccaggcaacttcgtgctgaaagagctgcacccattcgatctccacgcaatgcaaaacatcatcctcaagtataagacccagtttgaggggatgaaccatagagtccaaaggtccgaggacacattaaaggcactggaagatttcctggcatctctgaggacagctaaactcagcgctgagcctgtgaccgatctaagtgctagcgatacacaggtggcccaggaaaacaccctgaccgtcaagaataaggagggcgagatccacctcatgaaggacaaggccaaacatctggataagtgcctcaaaatgctagatatgagctttaaggacgctgagcggggcgatgatactagctgtgaaaatttgctcgatgccttttcgattaagctatctgaaacgcatggatacggggtacaggaagaattcactgaagaaaacaaactgctagaagcttgcattttcaagaataacgagctgcttaaaaatatccaggatgttcagtcccagatctcaaagatcggcctgaaagaccccaccgtgcccgcagtcaagcaccgcaaaaaatccttgatcaggctagacaaagtgcttgatgaatatgaagaagagaagaggcatctgcaggaaatggccaattccttaccacactttaaggacgggagggagaaaactgtaaaccagcagtgtcagaatactgtggtactttgggaaaacaccaaggctctggtgaccgagtgtctggaacagtgcggtcgggtgttagaactcctgaagcagtaccaaaactttaaatctattctcactacgctgatccagaaagaagagagtgtcatcagtctccaggcctcgtacatgggtaaggaaaatctgaagaaaagaatcgcagaaatagaaatcgtcaaagaagagtttaatgagcacctggaagttgtagataagataaaccaggtttgcaagaacctgcaattctacctgaataaaatgaaaaccttcgaagagcctccattcgagaaagaggctaatatcattgtggatcgatggttggacattaatgagaaaacagaggattactatgagaatctcggcagagccctcgcactgtgggataagctgtttaatctgaagaacgttatcgacgagtggaccgaaaaagcgctacaaaaaatggagttacatcagttgacagaagaggatcgcgagaggctaaaggaggagcttcaggtgcatgaacagaaaactagcgaattctcccgcagggtggctgaaatacagttcttgctccagtcctccgagatcccccttgaactgcaggtgatggaatccagtatcctgaacaagatggaacacgtacaaaaatgtctaactggcgagagcaactgccatgccttatccggctctactgcagagctgcgcgaggatcttgaccaggctaagacccagatcggaatgaccgagtcacttctcaaagccttatcaccaagcgatagtttggagatcttcactaagttggaggaaatccagcaacaaattctgcagcagaaacacagcatgatactgctggagaaccaaatcgggtgcctgactcctgaactctctgaattgaaaaagcagtatgagtccgtgtcagacctcttcaatactaaaaaatcggtactacaagatcactttagcaagcttctgaatgatcaatgcaagaatttcaatgactggttcagcaacattaaagttaatctcaaagagtgcttcgaatcctctgagactaaaaagtctgtagaacaaaagctgcagaaactttcagattttctgactcttgagggaaggaactcaaaaattaaacaggttgatagcgttttaaaacacgtgaaaaagcacctccctaaagcccacgtcaaggagttgatcagctggctcgtcgggcaagaatttgaactggaaaaaatggaaagtatctgccaagcgagggctaaggagttggaagacagtctccagcaattgcttagactccaggacgatcaccgcaatctgcgaaaatggctcaccaaccaagaggagaaatggaaaggcatggaggaaccgggcgaaaagacagaactcttttgccaggcacttgcacgcaaacgagaacaatttgagagtgtggctcagctgaacaactctttaaaagagtatggtttcaccgaggaggaagagattatcatggaggcaacttgcctaatggatagataccagacactactgcgccaactcagcgaaatagaggaagaggataagctcctcccaacagaagatcaatccttcaacgacttggcacatgacgttatacactggatcaaggaaatcaaagagtctctgatggtgttaaactctagtgagggcaagatgcccctggaagaaaggatccaaaagattaaggagattatcctgcttaaacccgagggggacgcccgcatcgaaacaatcatgaaacaggccgagtccagcgaagctccacttgtgcaaaaaaccctgacagacattagtaatcagtgggacaatactttgcatctggcgtccacctatctgagccatcaggagaaactgctgctggaaggagaaaagtatctccagtcaaaagaggatctgagacttatgttgattgagctgaaaaaaaagcaggaagccgggtttgcccttcaacatggattacaggaaaagaaagctcagctgaaaatatataaaaaattcctgaagaaagcccaggaccttactagcctattgaaggaattaaaaagtcagggcaattatctattggaatgcaccaaaaacccaagctttagtgaggaaccttggctcgagatcaaacacttgcatgaatctctcctccagcagctgcaggatagtgtccaaaacctagatgggcacgtgcgcgaacacgatagttatcaggtctgcgtgacagatctaaatactactctggataatttttcgaaagagtttgtgtccttttcagacaagccagtggaccagattgctgtggaggagaagctacagaagcttcaggaactcgaaaaccgcctatccctgcaggatgggacgctcaagaagatcctcgcactagctaaatcagtcaagcaaaacacttctagcgtagggcagaagatcatcaaggatgacataaaatccctacagtgcaagcagaaggacttggaaaatcgactcgcatcggccaaacaggaaatggaatgttgtctcaattctatcttgaagagcaaaaggtccacagaaaagaagggcaagtttaccttgccaggccgtgagaagcaggctaccagcgacgtccaggaatcaactcaagagtccgcagcagtcgagaagctcgaggaggattgggaaatcaacaaagattccgctgtagagatggcaatgtcaaaacagctgtctctgaacgcacaggaatctatgaaaaatacagaagatgagagaaaggtgaacgaattacagaaccagcccctggagctcgacaccatgttaagaaatgaacaactggaagagatcgagaagctgtatacccagctggaggcaaagaaagctgctatcaagcctcttgagcaaactgaatgtctcaacaaaacagaaactggggcccttgtccttcataatattggatactccgcacagcacctcgataatttactgcaagcactcattaccctgaagaagaataaagagagccagtattgtgtgttgagggactttcaggagtacctggccgctgtcgaatctagcatgaaagctcttctcaccgacaaagaatcacttaaagtggggcccttagattccgtgacctacctggataaaatcaaaaaatttatagcgtcgattgaaaaggaaaaagattctcttggaaatctcaagatcaagtgggagaatcttagtaaccatgttacggacatggataagaaattgctggagtcccaaattaagcaattagagcacggttgggaacaagtggagcagcaaatacagaaaaagtactcccagcaggtggttgagtacgatgaatttaccacactgatgaacaaggtgcaggatactgagataagcctccagcagcaacagcagcatctgcagctcagattaaaatctccagaagagagagctggtaaccaaagtatgattgcccttacaacagatcttcaggcaacgaagcacggattttcggtgttgaaggggcaggcggagctacaaatgaaaaggatctggggcgagaaggaaaagaagaatctggaggacggtattaataacctcaaaaaacagtgggaaaccttagaaccgcttcacctcgaggcagagaaccagatcaagaagtgtgatatccgtaataagatgaaagagacaatcctgtgggccaagaatcttctgggtgagttaaatccctcgatccccctactccctgacgacatactgtcccagattcgcaagtgtaaagttacccatgacggaattttggctcgacagcaatcagtagagtcgctggcagaagaagtgaaggataaagtgcctagtctcacaacctatgaaggaagtgacttgaataataccctggaggacctccgtaatcaataccaaatgctcgtgttgaaatccactcagcgttcccagcagttagagtttaagctagaggaaagatccaacttttttgctattattaggaagttccagctcatggtccaggaaagtgagaccctcatcattcctcgagtggagaccgcggccacagaggcagagcttaagcatcatcacgtaaccctcgaagcgtcccaaaaagaactgcaggagattgactctggcatctcaacccatctgcaggaacttacgaacatctacgaggagctcaatgtcttcgagagactcttccttgaagatcagctaaaaaacttaaaaattcggaccaatcgaatacagagattcatccagaatacttgtaacgaggtagagcacaagatcaaattctgcagacagtttcacgagaagacttccgcccttcaggaggaggcagatagtatccaacgaaatgagttgctactcaatcaggaggtgaacaagggagtcaaagaggagatctataaccttaaggaccgcctgacggcaatcaagtgttgcattcttcaagtgctgaagctgaagaaagtgttcgattacataggactaaattgggacttctctcagctggatcagctgcagacacaagtgttcgagaaagaaaaggagctggaagagaaaattaaacagctcgatacatttgaggaagaacacggcaaatatcaggccctactgagcaagatgagggctatcgatctgcaaattaagaaaatgacggaggttgtgctgaaagctcctgattctagccctgaatctaggcgcttaaatgcccagattcttagccaacggatcgaaaaagcaaagtgtctgtgcgacgagattatcaagaagctgaacgagaacaagactttcgatgatagctttaaggagaaggagatcctccaaatcaagctcaatgccgaggagaatgataaattgtataaagttctccagaatatggtgctggagctgagcccaaaagaactggatgaaaagaactgtcaagataaattggaaacatcactccacgttctgaatcagattaaatctcagctccagcagccactgctcattaatctggaaatcaaacacattcagaacgagaaggacaattgtgaagcattccaggaacaggtgtgggctgagatgtgcagtatcaaggccgtcacggctattgaaaaacagcgggaggaaaattctagcgaagccagtgacgtggaaaccaagctgagagagtttgaggacctccagatgcagctgaacacaagcatcgatctaaggaccaatgtcctgaatgatgcgtacgagaatctcacacgctacaaggaggccgttacgagggcagtcgagtcgatcacttctctggaggccattatcatcccctatcgggttgacgtggggaatccggaggaaagcctggaaatgcctctcaggaaacaagaggaactggagagcacagttgctcatatccaggacttaaccgagaagctcggaatgatctcatcacctgaagcaaagctccagctgcaatacacacttcaggagcttgttagtaaaaatagcgcaatgaaagaagcttttaaagcgcaagaaactgaagcggagcgatacctcgagaactataagtgctataggaagatggaggaggacatatacacaaacctatccaagatggagacagtcttgggtcagtcaatgagctcgctccctctcagttaccgtgaagcactggagaggctcgagcagtctaaggcactggtatctaatctcatcagtacaaaggaagagctcatgaaactgaggcaaatcttgcgcttactacgtcttagatgcacggagaatgacggaatctgcttgcttaagatagtgagcgcactgtgggagaagtggctctccttgctcgaagcagctaaggagtgggagatgtggtgcgaagaactcaagcaggaatggaaattcgtgtccgaggaaatagagcgcgaggcaatcatcctggataacctacaggaagagcttcctgaaatcagcaagacgaaggaggctgccactaccgaggagctttctgagttgctcgactgcctgtgccagtatggtgagaacgtcgagaaacagcagttgctgctcactctattattgcagagaatcaggagcattcagaatgtgcctgaaagtagcggagcagtggaaaccgtgcccgcctttcaagagattacaagcatgaaggaacggtgtaataaactgcttcagaaagtgcaaaagaacaaagaacttgttcaaactgagatccaagagcgtcactcattcaccaaagaaataattgctctaaaaaactttttccagcagacaacaaccagcttccagaatatggcgttccaggatcacccagagaaatcggaacagttcgaagagcttcagagtatccttaagaaaggcaaactgacattcgagaatatcatggagaagctgcgaatcaaatatagtgaaatgtacaccatcgtgcctgcagagattgagagccaggtggaagagtgccgtaaggctttagaggacatcgacgagaaaattagtaacgaagtgctcaaatcctcaccatcttacgccatgcgccgtaagattgaggaaataaataatggcctgcataatgtggagaagatgctgcagcagaagtcaaagaatattgaaaaagctcaagagattcagaaaaagatgtgggacgagctggatctgtggcactcaaaactaaacgagctcgactctgaggtccaggacatcgtcgagcaagatccagggcaagctcaggaatggatggacaacttgatgattccatttcagcagtatcagcaggtaagtcagcgggccgagtgtcgcacctcgcagttgaataaggcaactgtaaagatggaagaatacagcgatctcctgaagtctacagaagcgtggatcgaaaacacaagtcatcttctcgcgaaccctgctgactacgactccctgaggacattgtcacatcacgcctccaccgtccaaatggcgcttgaagactccgagcagaagcataatctcctccattctatcttcatggatctagaagacctttccatcattttcgaaactgacgaacttacccaaagcattcaggagctgtcaaaccaagtgacagccctccagcagaaaattatggagtcactgccccagatccagagaatggccgacgacgtggtggccatagagagtgaagtcaagtctatggaaaagcgcgtgagtaaaatcaaaaccatcctgctgtccaaggaaatcttcgacttttcacctgaggaacacctgaaacatggcgaggtgattctggagaatatccggcctatgaagaaaacaatcgccgaaatcgtaagttaccaggtggaactgaggctgccacagacgggcatgaaaccgttacctgtctttcagcggaccaatcaactgttgcaggatatcaaactcctggaaaatgtgactcaagagcagaacgagttgctcaaggtggtaataaagcagacaaatgaatgggacgaggaaatcgagaatctcaagcagatcctgaacaattatagtgctcagttctcactcgagcacatgagtccagatcaggcggataagctaccccagttgcagggcgagatcgaaagaatggaaaagcaaatcctcagtctcaatcagcggaaggaggatctgttggtggatcttaaagcaaccgtcctcaacctgcatcagcacctgaagcaggaacaggaaggggttgagagagacaggcttcctgctgtgacaagcgaggagggaggagttgcggaacgcgacgcctccgagagaaagctgaaccggcgtggcagcatgagctatctggctgctgtggaagaggaagttgaggagtctagcgtgaaatccgacaacggggacgagaaggcggaaccaagccctcagtcctggagctctttatggaagcacgataaggacatggaggaggatcgagcatcttctagctccggtaccatagttcaggaagcgtacggtaaaatcagcacctcagataattccatggcacagattctcacacccgactctctgaatactgagcagggcccggaatgctcattaagacctaaccagacagaagaggggacaaccccgcctattgaggctgacacgctggactcttctgatgcacaggggggactcgagcctcgggtggaaaagaccagaccggaacctacggaagtgctgcacgcttgtaaaacacaggtggcagagctagaactgtggttgcagcaggccaatgtggctgtggagcctgaaaccttgaacgcggatatgcagcaggtgctagagcagcaactggtgggatgccaagctatgctgaccgagatcgagcataaggttgcattcctgctcgaaacatgcaaggaccaggggctgggagacaacggagccacccagcatgaggccgaagctctttccctgaaactgaaaacggtgaagtgcaatctggaaaaagtacagatgatgctgcaggagaagcatagcgaagatcagcatcccacaattttgaaaaaaagttcggagcccgagcaccaggaagcccttcagccggtcaacctcagcgaactggaaagcatcgttacagagcggccacaatttagccggcagaaagatttccaacaacagcaggtcttagaactgaaaccaatggaacaaaaggacttcatcaagttcattgaattcaatgccaagaagatgtggccccaatattgccagcacgataacgacacgactcaagaatcatccgctagtaatcaggctagcagtccggaaaacgatgtccccgattcaattctgagcccacagggccagaatggagataagtggcagtacctgcatcatgagctgtcatctaaaattaaattacctctgccccagctcgtggaaccgcaggtcagtaccaatatggggattttacccagtgtgaccatgtataactttcggtatcctaccactgaagagctcaagacctacaccactcagcttgaagacctaaggcaagaggcttccaacctgcagacacaggaaaacatgaccgaggaagcctatatcaatctcgacaaaaaattattcgagctgttcctgacgctgagtcagtgtttgtcatcagttgaggagatgcttgagatgccacggctataccgagaagacggcagcggacagcaggtgcactacgaaaccctcgccctcgagctgaaaaaactgtatcttgctctctccgacaagaagggggacctgctgaaagcaatgacctggccaggggagaacactaacctgttgctggaatgctttgacaatcttcaggtgtgtttggagcatacacaggctgcagcggtctgtagaagtaaatcccttaaagccggccttgattacaacaggtcttaccagaacgaaatcaagcgactctaccaccaactgatcaagagtaaaacgagtctgcaacaatctctgaatgagatatccggccagtctgtggctgaacagttgcagaaagctgacgcatacaccgtggaattagaaaatgcagagagccgcgttgcgaagctgagggacgagggcgaacggttgcacctgccctatgcactactgcaggaagtctacaaattggaagatgtgctggattcgatgtggggaatgctgcgcgctcgatataccgagctgagtagtccctttgtcaccgaaagtcagcaagatgcactcctgcaaggcatggtggagcttgtgaaaattggtaaggaaaaactcgcccacggacatctgaaacaaacaaaatccaaggttgccttacaggctcagattgaaaatcacaaagtatttttccagaaactggttgctgatatgttactaattcaggcctactctgctaagatcctgccaagcctgttgcagaacagagagacattttgggctgagcaagtgaccgaggttaagattctggaagaaaagtcacgccaatgtggcatgaaactgcagtctttgttgcagaagtgggaagagttcgatgagaattatgcctctctcgaaaaggatctcgagatattaatctctacccttccttcagtgtcactcgtggaggaaactgaagagaggcttgttgaacgcattagcttttatcaacagataaagagaaatattggcggaaagcatgcccgcttataccaaactctgaacgaaggcaaacaactggtcgctagtgttagctgccccgaattggaaggccaaatagctaagctggaggaacagtggctttcactaaacaaaaagatcgaccacgaactgcaccgactgcaggcacttctgaaacatttgctttcctacaatagggatagcgatcagctgactaagtggttggaatcaagccaacacactctcaactattggaaagagcagtctctaaatgtcagtcaggatctcgatacaatacgcagtaacatcaataactttttcgaattcagtaaggaagtcgatgagaagtctagtctcaaaaccgctgtcattagcataggcaatcagctcttgcacctgaaggagactgatacagccactcttagagcctcattggctcaatttgagcagaagtggactatgctgataacccagttgcccgacatacaggaaaagctccatcagctccaaatggagaaactgccttctaggaaagccataaccgagatgatcagctggatgaataatgtcgagcatcagacaagtgatgaggattcagtccactctccttcgagcgctagtcaagtgaaacatttgctgcagaagcataaagagtttcgaatggagatggattacaaacagtggatagtggattttgtcaaccagtcactcctgcagctgagcacgtgcgacgtcgagtccaagcgttacgagagaaccgaattcgccgagcatctcggggaaatgaaccggcagtggcatagagtccacgggatgctaaatcgcaaaattcagcacctggagcagctgctcgagtccatcacggaaagcgaaaacaaaatccaaattctgaataactggttggaggcccaggaggaaaggctcaagacactccagaagccagagagtgtcatttctgtccagaaactgctactggactgccaagatatcgagaaccagctggcaatcaagtcgaaggccctggacgaattgaagcaatcttatctcacactggaatccggagctgtccctctactggaggataccgcctcccgaatcgatgaactgttccagaaacgcagctccgtacttacccaggtgaatcagctgaaaacctctatgcaaagtgtgctgcaggagtggaagatctacgatcagctgtatgacgaggttaatatgatgactatcaggttctggtactgtatggaacattccaaacctgtggtcttgtctctcgagacactaagatgccaggtggagaacctgcaaagccttcaggacgaagcagagagctcagagggaagctgggagaagctgcaggaggtcatcggtaaactcaagggcttgtgtccctccgtggccgaaatcatcgaagagaaatgccaaaacacacataaacgctggacacaggtgaatcaagcaattgctgaccaacttcagaaggctcagagtctgcttcagctgtggaaggcatacagtaacgctcatggcgaagccgcagccaggctaaagcagcaggaagccaagtttcaacagctggcgaatatcagcatgagcggtaataacctcgccgaaatccttccccctgctctgcaggacattaaagaactccagcacgacgttcaaaagaccaaagaggcattcctccagaattcttccgtccttgaccggctaccccagcctgccgagtcctctactcacatgctcctgcccggaccgctacacagtctgcagcgagccgcatacctggagaaaatgctgctcgtgaaggccaacgagtttgaattcgtgctctctcaatttaaagacttcggggttaggctcgagtctctaaaaggactaatcatgcatgaggaagagaacctcgaccgactgcatcagcaggagaaagagaatccggacagcttcctgaaccatgtcctggccttgaccgcgcagtcccctgacatcgagcacctgaacgaggtttctttaaagctgcccctgagcgacgtggccgttaagaccctacaaaacatgaaccgccagtggattcgagccacagcgactgcacttgaaaggtgttcggaactacagggtattggcttgaatgagaaattcctgtactgttgcgagaagtggatacagcttttagaaaagatcgaggaggcgctgaaggtagatgtggcaaattctttaccagagctgctggaacagcagaagacatataagatgttggaagctgaagtgtccatcaatcagactatcgctgattcctacgtgacccagtcactgcagctactggacaccaccgagatcgaaaacaggccggaattcataaccgagttctcgaagctaactgaccggtggcagaacgctgtgcagggggtacgccagcggaaaggggatgtggacggcttggtccgtcagtggcaagacttcactacaagtgtagagaatctgtttaggttccttaccgataccagtcaccttctgtccgccgtcaagggtcaagaaagattttctctttaccagaccaggagtctgattcatgaactcaaaaacaaagaaatccactttcagaggaggcgcactacatgcgcactgacgctcgaggctggtgaaaagctgcttctgacaacggacctgaagacaaaagagagcgttggcaggagaatcagtcagctgcaggattcgtggaaagatatggagcctcagctggccgagatgattaaacaattccagtccaccgtggaaacttgggaccagtgcgaaaaaaagataaaggagctgaaaagccggcttcaggtgttgaaagcccagtccgaagaccccctccccgagcttcacgaagacctgcacaacgagaaagaactaattaaagaacttgagcaatccctcgcatcctggacgcaaaacctgaaagagctgcagactatgaaggccgatctcaccagacacgtgcttgtcgaggacgttatggttcttaaggaacagattgaacatctccatcgccagtgggaagacttgtgccttagggtggcaattagaaagcaggaaatcgaagatagactgaacacctgggtggtgttcaacgaaaagaacaaggaactatgtgcctggctagtgcagatggaaaataaagtacttcagacagctgatatctcaatcgaagagatgatagagaagttgcagaaagattgcatggaggagattaacctcttcagcgagaacaagctgcagttgaaacagatgggcgaccagcttattaaagccagtaataaatctagggctgcggagatagacgacaagctgaacaagatcaatgaccggtggcaacacctctttgatgtgatcgggagtcgcgtgaaaaaactcaaggagacatttgcattcatacagcagctggataagaacatgtcaaatcttcgcacatggttagccaggattgagtcagaactcagtaaacccgtggtttacgacgtgtgcgacgaccaagagatacagaaacgcttggccgagcagcaggacctccaacgtgacattgagcagcacagtgctggcgtcgaatctgtctttaatatttgtgacgtcttgcttcacgacagcgacgcttgcgcaaatgagaccgaatgtgattctatccagcagacgaccagatcccttgataggaggtggagaaatatttgcgctatgagtatggagcggagaatgaaaatcgaagagacgtggagactatggcaaaagtttttggacgattattctaggttcgaggactggctcaagtcggccgagcgaacagcagcatgtccgaactcgagtgaggtcctctacacttcagcaaaagaggaattgaaacggttcgaagcatttcaaaggcaaatccatgaacggctgactcagctggagctgattaataagcagtatcgcagactcgcgagggaaaatcgaactgatacagcttccagactcaagcagatggttcatgaagggaatcagaggtgggacaatttgcaacggcgtgtcaccgcagtgctgcgtcgtttacgccattttaccaatcagcgtgaggaatttgagggtaccagagaaagcattttggtgtggttaactgaaatggacctgcaactgacgaacgtggagcatttctctgaatcagacgcggatgataaaatgcgtcaacttaacggttttcagcaggaaattacactaaataccaataaaatagaccagttgattgtctttggagaacagctcatacagaagtctgaacctcttgacgccgtcctcattgaagacgagctggaagaactgcaccggtactgccaggaagtcttcggaagagtgtcccgatttcatcgacggctgacaagctgtaccccgggattggaggatgaaaaagaggcctccgagaacgagaccgacatggaggatccccgggagatccagactgactcttggcggaaaaggggggagtccgaagagcccagcagtccacagtctttgtgtcatctcgttgcaccaggacatgaacgttctggctgtgaaacaccggttagtgtggattctattccgctcgagtgggatcataccggggatgtgggcggcagttcctcccatgaggaagatgaagagggaccgtactattcggctctttctggcaagagcatctcagatggccatagctggcacgtgccagatagtcctagctgtccagagcaccactataaacagatggagggtgaccgaaacgttcctcctgtgcctcctgctagcagcaccccttataagcctccttacggaaagctgttgctgccgccagggaccgacgggggtaaggaaggcccaagagtgctgaatggaaatccacagcaggaggacgggggactggcaggcataacagagcagcagtcaggggcttttgatcgctgggagatgatccaggctcaagagctgcataataaactcaaaatcaaacagaacctgcagcaactgaacagcgacatcagtgctattacaacttggctgaaaaagaccgaagccgagctggaaatgctgaagatggccaagccgccgagtgacatccaagagattgaattgagagtgaagcgcctccaggaaattctgaaggcctttgatacctataaagcgctggtggtgagcgtcaatgtgagttccaaagagttccttcagaccgagagtcctgaaagtaccgaactgcagagccggctgaggcagcttagtctcctttgggaggcggcccagggcgctgtggattcctggagaggcggcttgcggcagtctcttatgcagtgtcaggacttccaccagctgtctcaaaatctgctgttgtggcttgcctcggccaaaaaccggagacagaaggctcatgtgaccgacccaaaggccgacccacgggctctgctggagtgcaggagggaattgatgcagttagaaaaagaactggttgaaagacagccacaggtggacatgctgcaagagatttctaactccctgctgataaaaggccacggagaggattgcatcgaagcggaggaaaaggtacacgtgatcgagaagaagctgaaacagctgcgcgagcaggtctctcaggacctcatggccctccaagggacccagaaccccgctagcccacttccgtcattcgacgaagtcgacagcggggatcaacccccagcaacttccgtccctgccccacgggctaaacagtttcgcgcggtgaggacaacagaaggggaagaagagacggagagcagggtgcctggtagcacacgcccccagcgttctttcctgtcccgcgtggtgcgcgccgcgctgcctctgcagctgctgctcctgctattattgctgctggcctgcctgctgccatctagcgaagaagattattcctgcacccaggcaaataacttcgccaggagcttttatcctatgcttagatataccaacgggcctcctcccacatag

SEQ ID NO: 206676 - DNA, 804 bp, Artificial Sequence
  Description of Artificial Sequence: Synthetic coding sequence
atggccagcagccccgagctgcccaccgaggacgagcagggcagctggggcatcgatgaccttcacatttccctgcaggccgagcaggaggacactcagaaaaaggccttcacatgttggatcaacagccagctcgctcgccacacatccccctccgtcatctcagatctgttcactgacattaagaagggccatgtattgctcgatcttctggaggtgctgtctggacagcagcttcccagagataaagggtctaatacatttcaatgccggatcaacatcgagcacgccttgaccttcttgagaaacaggtcgattaagcttattaacattcatgtgactgacataatagacggcaatcccagtatcatccttggtctgatctggactattatacttcatttccacattgagaagctcgctcagaccctttcttgcaattataaccagccaagtcttgacgatgtctcagttgtggatagttcaccagcatcctctcctcctgccaagaaatgctccaaggttcaggcccggtggcagatgagcgcaaggaaagctcttctgctttgggcccaggagcagtgcgcaacctacgaaagtgtgaatgtgaccgacttcaagtcatcttggaggaacggaatggcctttttagcaatcatccacgctctacggccagacctgattgacatgaaatctgtcaagcacaggtcaaataaagataacttacgcgaggctttcagaattgctgagcaggagctgaaaatccccagactgctcgaaccagaagcctacaaaaatttctag

SEQ ID NO: 206677 - DNA, 9813 bp, Artificial Sequence
  Description of Artificial Sequence: Synthetic coding sequence
atggagaagctgcggatcaagtacagcgagatgtacaccatcgtgcctgcggagattgagtcccaggttgaagagtgcagaaaggcgctggaagacatcgatgagaagatctcgaacgaggtgctgaaaagtagcccttcatacgcaatgagaaggaaaatagaggagattaacaatggcctgcacaatgtggagaaaatgctgcagcagaagagcaagaacattgaaaaggctcaagaaatacagaaaaagatgtgggatgagctcgacctctggcactccaagttgaacgagcttgatagcgaagtgcaagatattgtcgaacaggaccctggacaggctcaggagtggatggataatctgatgattcctttccagcagtatcagcaggtttcccagcgtgctgaatgcaggacgagccagctgaacaaggctacggttaaaatggaggagtacagcgatttactgaaatccaccgaggcatggatcgaaaatacctcacatttattagccaaccctgccgactatgactccctgcggaccttgagccaccacgcgtccaccgtgcaggacagtaaatgcttcaggagcggaccacggccaaacatttatgtatcctactacgtgaccgtcatccagatggcactggaggacagtgagcaaaagcataatcttttgcactccatctttatggacttggaggacctttcaatcatcttcgagaccgacgaacttacccagagcatccaggaactgagcaatcaggtgacggcactgcaacaaaaaatcatggaatcgctcccccagattcagcggatggcagatgacgtggtggctattgagtctgaggttaaaagcatggagaaacgcgtgtcgaagattaagaccatcctcctctccaaggaaatcttcgacttttcccctgaggaacacctgaagcacggcgaggtgatccttgaaaacattagaccgatgaaaaaaacgatcgccgaaattgttagctaccaagtggagctgaggctcccgcagaccggcatgaagccacttcccgtctttcaaagaactaaccagctgctacaggacattaaacttttggagaatgtgacccaggaacagaacgaactcctgaaagtcgtgataaagcagacaaatgaatgggatgaggagattgaaaacctgaagcagatcctaaacaactacagcgcccagttcagcctggagcacatgtccccagaccaggctgacaaactgccccagctgcagggcgaaattgaaagaatggagaagcagatcttatctttaaaccagcgaaaggaggacctgctggtcgacctgaaagccaccgtgttaaacctgcaccagcatctgaagcaggagcaggagggtgtagagcgggatcgcctgcctgctgtcacgagcgaggaaggtggagtagccgaaagggacgccagcgagaggaagctgaatcgccggggaagtatgtcttatcttgcggccgtggaagaggaggttgaagaaagtagtgtgaagagtgacaacggtgacgagaaggcagaacctagcccccaaagctggtcttcattatggaaacatgacaaggatatggaagaagacagagcttccagctcgtcaggaaccatcgtgcaggaagcttacgggaagatttccacctcagacaactctatggcccagatcctgacccctgactccttgaatactgagcagggaccagagtgcagtctacggcccaatcagacagaggaaggcaccacgccacctatagaggcagacaccttggactcttccgatgcacagggaggtctggaacctcgagtcgaaaagactaggcctgagcccaccgaggttctgcatgcatgcaaaacccaagttgcagagctggaactgtggctccaacaggctaacgtcgctgtagagccggaaaccttgaacgccgatatgcagcaggtactggagcagcagctcgtaggctgtcaggccatgctgaccgaaattgaacacaaagtagcattcttgctggaaacctgtaaagaccaggggctgggtgacaatggagcgacgcagcacgaggccgaggccttatctctcaagctcaaaactgtgaaatgtaacttagagaaggtgcaaatgatgctgcaggaaaagcacagtgaggatcagcatccaaccattctcaaaaaaagctctgaacccgagcatcaggaagctctccaaccagtgaacctgtcagagcttgagagcatcgtcacggagcgtccccaattcagcaggcagaaggacttccagcagcagcaagtgctagagttgaaacctatggagcagaaggacttcatcaaatttatcgagtttaacgcaaagaagatgtggccccagtactgccagcacgataacgacacaacgcaggagagtagcgcgagtaatcaggcctcctctccagagaatgacgttcccgactccatcctctcacctcaaggccagaatggcgacaagtggcagtatctccatcacgagctatcaagtaagataaagctccccctgccgcagcttgtcgagccccaagtgagtaccaatatggggatcttgccttcagtcacgatgtataactttcggtatcccaccacagaggaactgaagacatacactacccaactggaggatttaagacaagaagcctctaaccttcagacccaggaaaacatgaccgaagaagcttacattaatctggataagaaactgttcgagctctttctaaccctttctcagtgcctttcatctgtggaggaaatgcttgagatgccacggctttaccgggaagacggaagcggacaacaggtgcattatgaaaccctcgccctcgagctcaagaagctatatctggctttgagcgataagaagggcgatctgcttaaggcaatgacctggccaggcgagaacacaaatcttcttctggagtgttttgataatctgcaggtatgtctggaacacacccaggctgctgctgtgtgccggtccaagagccttaaggcagggctcgactacaacaggagctaccagaatgagattaagcgcctataccatcagctaatcaagagtaagacgagcctgcagcagtctctgaatgagatatccggtcagtctgtggccgaacagctgcagaaggccgacgcctataccgtggagttagaaaacgcagaaagcagagtcgctaaactgcgtgacgagggggaaagactgcacctcccttacgctctgctgcaggaagtctataagttggaagacgtcctggacagcatgtgggggatgctccgggcgcggtacacagagctctcctctccctttgtgaccgagtcccagcaggatgcgttgctgcagggaatggtagagctagtcaagatcggaaaggagaaactggcacatggacacttgaagcaaaccaaaagcaaggtagcactacaagcacaaattgagaatcataaggtattcttccagaaattggtggccgacatgcttcttattcaggcatattctgcgaaaatccttccttcgctccttcagaatcgcgagaccttttgggcagagcaggtgacagaggtgaaaattctcgaggagaaaagtcgccaatgtgggatgaaacttcagagtctcctgcagaagtgggaagaattcgacgagaactacgcctccctggagaaggatttggagattcttataagtacactgccatctgtgagtcttgtggaggagaccgaggagagactcgtggaacgcatctccttttatcaacaaatcaagaggaacatcggagggaaacatgcccggctgtatcagacacttaacgaaggcaagcagttagtggcatcagtgtcatgtcctgagctggaaggccagatcgcgaaactggaggagcaatggttgagtctgaacaaaaaaatcgaccacgagctacataggttgcaggctctgttaaaacacttactgagttacaatcgcgattctgatcagctgacgaaatggctagagagctctcagcacacgctgaactactggaaagagcagtcactcaacgttagtcaagatctggatacaataaggtccaacattaacaactttttcgaatttagcaaagaggttgatgagaagtcatcgctcaagacggccgtgataagtatcggaaaccaacttttacacctgaaggaaaccgatactgcaacgttacgagcaagtctggcccagtttgaacaaaagtggacaatgctcattacacagctcccagacatacaggaaaagctgcaccagctgcagatggaaaagctaccttctcgaaaggctatcactgaaatgatttcctggatgaataacgtggagcatcaaacaagcgacgaagactctgtgcattctccttcaagtgcaagtcaggtcaagcacctgttacagaaacacaaagaatttcgtatggagatggactataagcagtggatagtcgatttcgtgaaccagtctctcctgcaactctcaacttgtgacgttgagtcaaagaggtacgagaggaccgagttcgctgaacatctgggtgaaatgaatagacagtggcatcgggtccacgggatgcttaaccggaagatccagcatctagaacagctgttagagagtatcactgagtcagagaacaagattcagattctgaataactggctcgaggcccaggaggagcgtctaaagactctgcaaaagccagaaagcgtgatcagcgtacagaagctgcttttggattgccaggacatcgagaaccagctcgctatcaagtcgaaggcactagacgaactcaagcagagctacctaacccttgaatccggcgccgtccccctcctggaggataccgcaagcaggattgacgagcttttccagaaaagatcttccgtgttgactcaagtaaatcaactcaagacatccatgcagtctgtcctccaggaatggaagatatacgaccagctgtacgacgaggtcaatatgatgaccattcgcttttggtactgcatggaacattccaaacccgtcgttttatctctggagacattgcgttgtcaggttgagaacctgcaaagcctccaggatgaggctgaatcgagcgaggggagctgggagaagctccaggaggttattggcaagcttaagggcttatgtccctctgtggcagagattattgaggagaagtgtcagaacacgcacaagcgttggacgcaagtaaaccaagctatagccgatcagttgcagaaggcccagtccctcctccaactgtggaaggcctattcaaacgcccacggagaggctgccgcaagattaaaacagcaagaagccaagttccagcagcttgctaacatcagcatgagtggaaacaacttggcagagatacttccccctgccctgcaagacattaaggagttgcaacatgatgttcagaagaccaaagaggcgttccttcagaacagcagcgtgctggatcggctgccccagcctgccgaatctagtactcacatgctgttgcctggtcctctgcactctctgcagcgcgccgcctatctggaaaaaatgctgctggtaaaggctaacgagtttgaatttgtgctaagccagtttaaagatttcggcgtccgcttagagagcctcaaaggcctcatcatgcatgaggaggagaacctagaccggctccaccagcaagaaaaagagaaccctgactctttcttgaatcatgtgctggcactcaccgcccagagcccagacatcgagcacctcaatgaagtgtccctgaagctgccacttagcgatgtagcagtgaagactctgcaaaacatgaatcgtcagtggatccgagccaccgctacagccctggagagatgttcagaactgcagggcatcggtctgaacgaaaagtttttatattgctgtgagaaatggatccagttgctggagaaaattgaagaggccctcaaggttgatgttgccaacagtttgcctgaactgctcgaacagcagaaaacatataaaatgctggaggcagaagtgagcattaatcaaacaattgctgattcttacgttacgcagtcactgcagttgctggacacaactgagattgaaaacagacctgagtttatcacagaatttagcaaactgacagaccgctggcagaatgcggtacaaggcgtcagacagcggaagggcgacgtcgacggcctggttaggcagtggcaagacttcaccacatccgtggagaaccttttcaggtttctaactgatacaagtcatctgttgagcgccgttaagggccaagaacggttttcattgtatcagacccggtctttaatacatgaactgaagaacaaggagatccatttccagagacgcagaaccacatgtgccttgaccctggaagcaggagagaagctgctgttgacaactgatttgaagactaaagagtccgtgggtaggcgcatctcccagcttcaagactcgtggaaggacatggagccccagctggctgagatgataaaacagtttcagagtaccgtcgaaacgtgggaccagtgcgaaaagaagattaaggaactcaagtcacggttgcaggtcctaaaggcgcagtctgaggaccctctgccagaattgcatgaagatctacataatgagaaagagctgatcaaggagctggaacagagtctcgcaagctggacgcaaaacctgaaagaattgcagactatgaaagccgatcttactcggcacgtcctggtggaggatgtgatggtgttgaaagagcagattgagcacttgcacaggcagtgggaagacctctgtttgcgggtggccatccgaaagcaggaaatcgaagataggctgaacacgtgggtggttttcaacgagaagaacaaggaactctgtgcttggttggtgcagatggagaacaaagtgctccagactgcagacatctccatcgaggaaatgatagaaaagcttcagaaagattgcatggaagagatcaatctattttccgagaacaagttacagctgaagcagatgggggatcagcttattaaggcctccaacaaatccagggccgccgagattgatgataaactgaataaaattaacgatcgttggcagcatcttttcgacgtgattggctcacgtgtgaagaagctgaaggagacgtttgccttcatccagcaactggataagaacatgtctaaccttaggacatggttagcccgcatcgaaagcgaactctccaaacccgtggtgtatgatgtatgcgacgaccaggaaattcaaaaacgcctggccgaacaacaggatctgcagagagacatcgagcagcattcagccggggtagaaagtgtgttcaatatatgtgatgtcctgctccatgactccgatgcctgcgccaatgagaccgaatgcgattccatacagcagacaacccgctccttggatagaaggtggcgaaatatctgcgcgatgtctatggaacgcagaatgaagatcgaagaaacatggagactgtggcagaagtttctagatgattattctcggttcgaggactggttgaagtcagcggaacggaccgccgcctgtccgaactccagtgaagtgctctatacttctgccaaggaagagctgaagcgcttcgaggcctttcagaggcagattcacgagagattgacacagctggagctgattaataaacagtaccgtagacttgccagggagaaccgcacagataccgcctctaggctcaagcagatggtgcatgaaggaaaccagagatgggataacctgcaacgacgggtgactgccgtgctgcgccgattgcgccactttactaatcagcgggaggaatttgaggggactagagagagtattctggtctggctcacggagatggatctccaattgaccaacgttgagcatttcagcgagtccgatgctgacgacaagatgcggcaactgaatggatttcagcaggaaattacccttaacactaataagatagaccagctcatagtgtttggagagcagttgatccaaaagtctgagccattggatgccgttctgattgaggatgaattggaagagctgcacagatattgccaagaggtgtttggccgggttagtaggttccaccgcaggctcaccagctgtacacccggtctggaagacgagaaggaggcctccgagaacgagactgacatggaggatccgagggagattcaaaccgatagttggaggaaaagaggggaaagcgaggaaccttcatccccacagtctctgtgccaccttgtcgcacccggccacgagcggtccgggtgcgagacgccagtgagcgtcgattccataccactggagtgggatcataccggagatgtcggcggcagtagcagccatgaagaggacgaagaggggccctattattctgccctgtctggaaagagtattagcgatggccatagctggcacgtgccggactctccatcctgtcctgagcaccactacaaacagatggaaggagatcgcaatgtgcctcccgtcccaccagcaagcagtaccccatataagccgccttatgggaaactactgttgccacctggaacggatggggggaaggaaggtccacgcgtactaaacggtaacccgcaacaagaagacggtgggctcgcggggatcacagagcagcagtctggcgcattcgatcggtgggagatgattcaggcgcaggaactgcacaataaactgaaaatcaaacagaacctgcagcagctgaattcagatatcagcgccatcacaacctggctgaaaaaaaccgaggccgagttggaaatgctcaaaatggccaaaccaccatcagacatacaagagattgagctgcgagtcaaaagactacaggaaattctgaaggcgttcgacacttacaaagcactggtggttagcgtaaatgtgagcagcaaagagttcctgcagacagagtcccctgagagcacagagctgcagtcaagacttcggcagctaagtctcctgtgggaagccgctcagggcgcagtcgattcttggcgggggggactgcggcaaagtctgatgcaatgccaagatttccaccagctttcacagaatcttctgctgtggttggccagcgccaagaaccggagacagaaagcccacgtcaccgacccgaaagcggatccgcgagctctcctagaatgccggcgcgaattgatgcagctggagaaggagttggtcgagcggcagccccaggttgatatgttgcaggagatctccaactctctgctgatcaaaggacacggagaggattgcattgaagcagaagaaaaggtgcacgttattgaaaaaaagctgaaacagctgcgggagcaagttagccaggacctcatggctttacaagggacccaaaatcctgccagtcctctgccctcattcgatgaagtggatagtggggatcagcctccggcaacctccgtcccggcaccccgcgctaaacagtttcgggcagtcagaacgaccgagggagaggaagaaactgaatcgcgggtccctggttctacaaggccacagcgttccttcctcagccgggtggtccgcgctgcgctgcctctgcagctcctgctgctgctgctgttgttgctcgcctgtctgttaccaagctcagaggaggattattcatgtacccaggctaataactttgcccgcagcttctatcccatgcttcgttacacaaacggtccaccccctacctag

SEQ ID NO: 206678 - DNA, 20724 bp, Artificial Sequence
  Description of Artificial Sequence: Synthetic coding sequence
atggccagcagccccgagctgcccaccgaggacgagcagggcagctgggggatcgatgacctgcacatctcactgcaggctgaacaagaggacacacaaaagaaggcatttacctgctggatcaacagccagctcgcccggcacacaagcccctccgtgattagtgacctgttcaccgatataaaaaagggccacgttctgctcgatcttctcgaggtactctcaggccagcagctgcctcgagacaagggatcgaacacctttcagtgccggataaacatcgaacacgccttgacatttctgcggaataggtcaatcaagctgattaacatccatgtcactgacattattgacgggaatccttccataattctcggactcatctggacaatcatcctccatttccatattgagaaactcgctcagaccctctcttgcaactataaccagccaagcctcgacgatgtatcggtggttgattcatctccggcctcgtctccccctgctaagaagtgcagcaaggtacaggcacggtggcagatgtcagccaggaaggcattattgctgtgggcccaagaacagtgtgccacttacgaaagtgtgaacgtaaccgattttaaaagttcttggcgtaacggcatggcgttcctagcgatcattcatgcattgaggccagatttgattgatatgaagtcagtaaagcacagaagcaacaaagataatctgcgtgaggcatttcgcatagctgaacaggagctgaaaattccaagacttctggaaccggaggacgttgacgtcgtggaccccgatgagaagagtatcatgacatatgtcgcacagttcctacaatatagcaaggatgccccgggcaccggcgaagaagcacagggcaaggtgaaagacgcgatgggatggcttactctgcagaaagagaaactccagaagctcctcaaggactctgagaacgatacatatttcaaaaagtataactctttgctcagcttcatggagtcattcaacgaggagaagaagagttttctggacgtccttagcatcaaaagggatttggatgagctagataaagaccacctgcaactcagggaggcatgggacgggctagaccatcagataaatgcatggaagattaaactaaattatgcccttccccctccgttgcaccagaccgaggcatggctgcaagaagtggaagagcttatggacgaggatctgtccgccagccaggaccatagtcaggcggtgacgcttattcaggaaaagatgaccctgttcaagtctctcatggaccgcttcgaacatcactcgaatatcctgctgacttttgaaaacaaagacgaaaaccatctgccactggtgccacccaacaagctcgaggaaatgaagcgccggataaacaatatactggaaaagaagtttatcctacttctggaattccactactacaaatgtcttgtcctgggtttggttgacgaagtgaaatcaaaacttgacatatggaacattaagtacggatctcgagaaagtgttgaactcctgcttgaggactggcacaaattcatcgaggaaaaagaatttctggcccggctggacacctcttttcagaagtgcggtgagatctataagaatcttgccggggaatgccagaacatcaacaaacagtacatgatggtgaagtcagacgtgtgcatgtacagaaaaaacatatacaacgtgaagagtacattgcagaaagtcctcgcctgttgggcgacatatgtcgagaacctgaggctgcttagagcctgctttgaagagacaaagaaagaggagattaaagaagttccttttgaaaccttggctcagtggaatctcgagcacgcaactcttaatgaggccgggaatttcctcgtggaagtttccaatgatgtggtgggctcgagcatttcaaaggaacttaggcgcctgaataaacggtggagaaagctcgtgtctaagactcagttggagatgaacttaccactgatgatcaaaaagcaggatcaacctacctttgataattctggaaacatactgtccaaggaagaaaaagctacagtcgaattctctactgatatgagtgtcgagcttccagagaattacaatcagaacatcaaagccggcgaaaaacacgagaaggagaatgaggaattcaccggccagttgaaagtggccaaggacgtcgaaaaattgatcggccaggttgaaatctgggaagctgaagcaaagtccgtccttgatcaggatgacgtagacaccagcatggaggaatccctcaagcacctcatcgcgaagggctccatgtttgatgaactgatggcacggtccgaggacatgcttcagatggatattcagaatatctcatcccaggagtccttccaacacgtcctgaccaccggcctgcaggctaagattcaagaggccaaagagaaggtacagatcaatgtcgtgaagctcatcgccgcgttgaagaacctgactgacgtgtcccctgacctggacattagactgaagatggaagagtcccagaaggaactcgagtcctacatgatgcgagcacagcagctcctggggcaaagggagtcccctggcgagttaatcagtaagcacaaggaggccctcattattagcaacacaaagtctcttgcaaagtacctgaaagctgtagaagagctgaagaacaatgttaccgaggatatcaagatgtcccttgaggagaaatcccgcgatgtttgtgctaaatgggagtccctgcatcacgagctgtctctttatgtgcagcagctgaaaatcgacatcgagaaaggtaagctgtccgacaacatactgaagctcgaaaagcagataaacaaagagaagaaactcatacgtagaggcagaacaaaggggttaatcaaagaacacgaagcatgcttttctgaggagggctgtctgtatcagctgaaccaccacatggaggtcctgcgcgaactgtgtgaggagcttccaagccaaaagagccagcaggaggtcaagcgcctcttgaaagactacgagcagaagatcgagcggctgcttaaatgcgcttcagagatccacatgactttacaacctaccgccggcggtaccagtaagaatgaagggaccatcacaacgagtgagaataggggaggcgatccacattcagaagccccattcgccaagtccgacaaccagccgtcaacggaaaaagctatggaaccgacaatgaaattcagtctcgccagcgtactcagacctctccaagaggaatcgataatggaaaaagattactcagcaagcatcaattcactactcgaacggtacgatacttaccgagatatccttgagcaccacctgcagaataacaagtttcgaatcacctccgacttttcttccgaagaggatagaagcagttcatgcctgcaggcgaagcttactgaccttcaggtaattaagaacgagacggatgccaggtggaaagaattcgaaataatcagcctgaagcttgaaaaccacgttaacgatattaagaaacccttcgtgatcaaggagcgggacacactgaaggagcgtgagcgagagcttcagatgacactgaacacccgcatggagagtcttgagacagctttgaggctcgtgctgccagtggagaaagcatctttactgctctgcggaagtgatctgcctctacataagatggcgatacagggctttcacttgatcgatgctgaccgtatttatcagcacctccggaacatacaggatagtattgcaaagcagatcgagatatgtaatagactcgaagagccaggaaacttcgtgcttaaggagctgcacccattcgatctgcatgcaatgcaaaatattatcctgaagtacaagacgcagtttgaaggcatgaatcatcgggtccagcggagcgaggatactctgaaagctctggaggattttctggcctcattgcggaccgccaagttatcggctgagcccgtcaccgacttgtccgcttcggatacccaagttgcgcaggagaacacgttgaccgtgaagaacaaggagggtgaaatccatctaatgaaggataaggccaaacacctggacaagtgtctgaagatgctcgatatgtcctttaaagatgctgaacgaggagatgatacatcatgcgaaaacttgctggatgctttctccattaagttgagcgaaacccatggttacggagtgcaggaggagttcacggaagaaaataaactgctggaggcctgtattttcaaaaacaacgaacttctgaagaatattcaggacgtccagtcacagatatctaagataggcctgaaggacccaacggttcctgccgtcaaacataggaagaaaagtctcataagactggacaaggtcttggacgagtacgaggaagagaaaaggcatctgcaggagatggctaatagcctaccgcacttcaaagacgggcgcgagaaaactgtcaaccagcagtgccagaatacagtagttctgtgggagaacacaaaggcccttgtgaccgaatgccttgaacagtgcggccgtgttctggagctgcttaaacagtaccaaaacttcaaatcaatcctgaccacactgatccaaaaggaggagagcgtcatctctctgcaggcctcctacatgggcaaagagaacctgaagaagaggattgcagaaatagagatcgtcaaagaggaatttaatgaacacctagaggttgtcgacaaaatcaatcaagtttgcaaaaacctccagttctacctgaacaaaatgaaaactttcgaggagcctccgtttgaaaaggaagctaatatcattgtggaccgatggctggacattaatgaaaaaactgaggactactacgagaacctgggtagagctttggctctatgggataaactgttcaatctcaaaaacgtgattgatgagtggacagaaaaggcattgcaaaagatggaattacaccagctgactgaggaggaccgtgaaaggctgaaggaggaattgcaggtgcacgagcagaagactagtgagttcagtcgaagagtagctgagatccagtttttactgcagagctccgagattcccctagagctgcaggtcatggaatcctcgatcctgaataagatggaacacgtgcaaaaatgtttaaccggcgagtccaactgtcatgccctgtctggatctacagccgaactgcgggaagatttggatcaagctaagactcagattggtatgacagaaagcctgcttaaggctctgtctccgtctgatagcctggagatcttcactaagctggaagagatccagcagcagatactgcagcagaaacattccatgattttgctggagaaccagatcggctgtcttacacccgaattgtctgagcttaagaagcaatacgaaagcgtttcggacctttttaacaccaaaaagagcgtgcttcaggatcacttctctaagctgctgaatgaccagtgtaagaattttaatgattggttcagtaatatcaaggtaaaccttaaggagtgcttcgagagctcagagacgaagaagtcagtggaacaaaaacttcagaaactgagtgattttttaaccttggaaggacgtaacagtaagatcaagcaggtggactctgttctcaagcatgtgaaaaaacacttaccaaaggcacacgtgaaggaattaatctcctggctggtcggtcaggagttcgagctggaaaaaatggaaagcatatgtcaagcccgagccaaggaattggaggactcattacaacagctcctgagactgcaggacgaccaccgaaacctgaggaaatggctgactaatcaggaggagaagtggaagggtatggaggaacccggcgagaagaccgagctcttctgtcaggctctcgctcggaagcgggagcagtttgagagcgtggcgcagctgaacaacagcctgaaggaatatggctttaccgaggaggaagagattatcatggaggccacttgcctgatggatcgctaccagacacttctcaggcagctgagcgagatcgaggaagaggataagctgctcccaactgaggatcagtcctttaacgatttggctcatgacgttatccactggatcaaggagattaaggagagcctaatggtcctcaatagcagcgaaggaaagatgccactcgaggaaaggattcagaagataaaagagatcattttgttaaaaccagaaggtgacgctaggatcgaaacaatcatgaaacaggccgaatctagcgaagcgccgcttgttcagaaaacgctcacggacatttcgaatcaatgggacaacaccctgcatcttgccagtacgtacctttcacatcaggagaagctgctgctggaaggagaaaaatacttgcaatcaaaggaggatctgcgacttatgcttatagagctgaagaagaaacaggaagccggctttgcactgcagcatggcctgcaggagaagaaggcccagctgaagatttataagaagttcctcaagaaggcccaggatctgacttcacttctgaaagaactgaagtctcagggtaactatctgctggagtgtacgaagaaccctagcttctcagaggagccttggctagagatcaagcacctccatgaaagcctgctccagcagctccaagactcagtgcagaatttggacggccatgtgcgtgagcacgactcttaccaagtgtgtgtcacagatctgaacaccacattagacaacttttcgaaggaattcgtcagtttctcagataagcccgtcgaccagattgctgtggaagaaaagctccagaagctgcaggaactagagaatcgcttgagcctccaagatggaacactgaaaaaaattctggccctggcgaagagcgtaaagcagaatacttcctccgtcggtcagaagattattaaagatgacataaagagcctccagtgcaaacagaaggacctggaaaatcgattagcgagtgccaagcaagaaatggagtgttgcttgaacagcatacttaagagcaagagatccaccgagaagaagggtaaattcactctccccggtcgcgaaaagcaagccaccagtgacgtgcaggaaagcacacaggagagcgctgcggtggaaaagctggaagaggattgggagattaataaggactctgcagtcgagatggcaatgagtaagcagttgagtctcaacgcccaggagagcatgaagaacacggaggacgagcggaaagtaaatgagctacaaaaccagcctctcgagctggatacaatgttgcgaaatgaacagttggaagaaatcgaaaagctctatactcagctagaagcgaaaaaggccgccatcaaaccactggaacagactgaatgcctgaataagaccgagaccggtgctttggtcctgcacaatatcggctactcggcacagcacctcgataatcttctgcaggcacttataaccctgaagaagaataaggaaagccaatactgcgttctgagggactttcaggaatatttggccgcagttgaaagtagcatgaaggccctgcttacagacaaggagagcctcaaggttggtcccttagactccgtgacgtacctcgacaagatcaaaaaattcatagcaagcatcgagaaggaaaaagatagcctcggcaacctcaagatcaagtgggaaaacttatcaaaccatgtgaccgacatggataagaagttactggagagccagatcaaacagctcgaacacgggtgggagcaggtggagcagcagattcagaaaaagtattcacagcaggtggtggagtatgacgagttcacgacacttatgaataaggtacaggacacagagattagtctgcagcaacagcagcaacatctgcagcttcgcctcaaatcaccagaggagagggcaggaaaccagagcatgattgctctaactacagatttacaagctacaaaacacggtttcagcgtgctcaaggggcaggcggagctgcaaatgaagcggatctggggtgagaaggaaaagaagaatctagaggatgggattaacaacctgaagaaacagtgggagacactggaacctctccacctggaggccgagaaccagattaagaaatgcgacatcagaaataagatgaaggaaacaatcctatgggctaagaacctgctcggagagttaaatccatccatccctctcttgcctgacgacatcctttcccagattagaaaatgtaaagttactcacgacggaatcctggccagacagcagagcgtagagagtctagctgaagaggtcaaggataaggtaccaagcctgactacgtatgaaggatccgatttaaacaacacgctggaggatctcaggaatcagtaccagatgctcgtgctcaagagtactcagcgatcacagcagttggagttcaaactggaagaacggtcaaacttctttgccatcatacgcaaattccagcttatggtccaggaaagcgagactcttattattccaagggtggagaccgccgcaaccgaggcagaactcaaacaccaccatgtgaccctggaagcttcccagaaagagttgcaggagattgacagtggcatcagcacacacctgcaggagcttacgaatatctatgaagagttgaatgtcttcgaacgtctatttttggaagaccaactgaaaaatctgaagatacgcaccaacagaatacagcgctttatccagaacacgtgcaatgaagtggagcataaaatcaagttctgccggcaattccatgaaaagaccagcgctttacaagaggaggctgactctattcaacgcaatgagctgctgctgaaccaagaagtcaacaagggcgtgaaagaggagatctataatctcaaggataggctgacggcgataaaatgctgcatcttgcaggtactgaaacttaagaaggttttcgactacattggactgaattgggattttagccagctggaccagctgcagacacaagtgtttgagaaggagaaggaactggaggaaaagattaaacagctggacactttcgaagaggaacacggcaagtatcaggctctgctctccaagatgcgagcaattgaccttcagatcaagaagatgaccgaagtggtacttaaggcgccagacagtagtcccgaaagccgtcgtctcaacgctcaaatcctgtcacagcggatcgaaaaggctaaatgtctctgcgacgagattatcaagaagctgaacgaaaataagacatttgacgacagctttaaagagaaggaaatcctgcaaatcaaattaaacgctgaggaaaacgacaagctgtataaggttctgcagaacatggtattggaactctcacctaaggagctagatgagaagaactgtcaagacaaattggaaacgtctctgcatgttctgaaccagattaagtctcaacttcagcagccactgctcatcaacctcgaaattaaacatattcagaacgaaaaggataattgcgaggcttttcaggaacaggtgtgggcagagatgtgtagtatcaaagccgtcaccgcaatagagaagcaacgagaagagaattcctcggaagcttccgatgtggagaccaaactgagggagtttgaggatctgcagatgcaactaaatacgtcaattgacctcagaactaacgtgctgaacgacgcttatgaaaatctgactcgatataaagaagcagtcacgagagctgtcgaatccataacctccttagaagcgataataatcccttaccgcgtagacgttggaaacccagaggaaagtctggagatgcccctcagaaagcaggaagagctggagtccactgtggcccatattcaggacttgactgagaaactcggcatgatctcctctcccgaagcgaagctccagctacagtacactctgcaggaattggtgagtaagaatagtgctatgaaggaggcctttaaagcacaggagactgaggcggaacgctacctagagaattacaagtgttacagaaagatggaagaggatatttacacaaacctctctaaaatggaaactgtgctcggacagtccatgagttccctccctctgagttatcgcgaagccctggaaaggctcgagcagtcaaaagccctggtgagcaacctgatctctaccaaggaggagctaatgaaattgagacagatcctccggcttctgcggctcagatgtactgagaatgacgggatttgtcttcttaaaattgtttcagccttgtgggagaaatggttaagtttgcttgaggctgcaaaagagtgggaaatgtggtgcgaagaactgaagcaagagtggaagtttgtgagcgaagagatcgaacgggaagcaattattcttgacaatcttcaggaagagctacccgaaatctctaagactaaggaagcagcgacaaccgaggaactcagtgagcttctggattgcctgtgccagtacggtgagaatgttgaaaaacagcagctcctgctgaccttgttgctgcagcgtatcaggagcatacagaatgtccccgagtcatcaggcgctgtggagaccgtccccgccttccaggaaataacctccatgaaagagcgctgtaacaagctgctgcaaaaagtacagaaaaataaagagctggtgcagaccgaaatccaagagagacattcattcactaaagagattatcgctctcaagaatttctttcagcagaccactacctcatttcaaaatatggccttccaggaccatcctgagaagtcagaacagttcgaggagttgcaaagtatattaaaaaaaggcaagctgacatttgagaacattatggagaagctaagaattaaatactctgagatgtacacaattgttccagccgagatcgagagccaagtggaggagtgtcggaaggctctcgaggatattgacgaaaaaatctccaatgaagtgctgaagagctccccctcctatgccatgcgaagaaagatcgaggagattaacaacggcctgcacaacgtggaaaagatgttacagcagaagtccaagaacatcgaaaaggcccaggaaattcagaagaaaatgtgggacgaattggacctgtggcatagcaaactgaacgaattggatagcgaagtgcaggacattgtcgaacaagatccaggacaagcgcaggagtggatggacaacctcatgattcctttccagcagtatcaacaagtgtcgcagagagccgagtgtaggacgtcacagctgaacaaagctaccgtgaaaatggaagagtactccgacctgctcaagtccacggaagcctggatcgagaacacatcccacctacttgctaatcctgcagattacgattctctccgaaccctgagccaccacgcttccaccgtccagatggctttagaagacagtgagcagaaacacaacctgctacacagcatattcatggaccttgaggatctctctattatatttgagactgatgagctgacccagtccattcaggagttgtctaaccaggtcaccgccctgcagcagaagatcatggagagcctgccacagatccagcgaatggctgatgacgtagtggcaattgagtccgaggtaaaaagcatggagaaacgcgtgtcgaaaattaagaccattttgctgtccaaggagatctttgacttcagccctgaagaacacctgaaacacggagaggtgattctcgaaaatattcgccccatgaaaaagacaatcgcagagatcgtgtcgtatcaggtggaactgcgcctgccacagactggtatgaaaccattaccagtgtttcagcgcaccaatcagctgctgcaggacatcaagctacttgaaaacgtgactcaggaacagaacgaattattgaaggtagtcattaagcagactaacgagtgggatgaagaaatcgaaaatctgaaacagatcctaaataactatagcgcccagttctccctcgagcatatgtctcctgatcaggctgacaaattgccccagctccagggagagatcgagagaatggagaagcagatcctgagcttgaatcagcgcaaggaggatcttctcgtcgacctgaaagctacagtattaaatctgcaccagcacctcaaacaggagcaggagggggtggaaagagatagactgccagctgttacctctgaagaggggggagtagctgaaagggacgcgtcggagcggaagctcaataggcggggctctatgagctatctggctgcagttgaggaggaagtagaagagtcaagcgttaaatctgataatggtgatgagaaagcagagccatcaccccaatcttggtcttctctttggaaacacgataaggatatggaagaggaccgcgctagtagttccagtggaacaattgtccaggaagcctacggaaagatctctacgtcggataactcaatggcacagattctgacccctgactcccttaatactgagcaggggcctgagtgctcactgaggccaaatcaaaccgaagaagggaccactcctccaatcgaggccgatactctggactcatctgacgcacaagggggactcgagccgagggtagaaaaaacaagacctgagccgaccgaagtgctacatgcctgcaagactcaggtagcagagcttgagctttggcttcagcaggcgaatgtggccgtagagccagagacccttaacgccgacatgcagcaggtgcttgaacagcagcttgttggttgccaggccatgctcactgagattgaacacaaggtcgcttttctactagaaacatgcaaggatcaggggctgggcgataacggagccacacagcacgaggccgaggccctgtccctgaaattgaagaccgttaagtgtaatctggagaaggtgcagatgatgcttcaggaaaaacactcggaggatcagcaccctaccattctcaagaaaagctctgaaccagaacaccaggaggccctgcaacccgtgaacctctcagaactcgagtccatcgtaactgagcgccctcagttttctcgccagaaagattttcaacagcaacaagtgctggagctgaaaccaatggagcagaaagatttcattaaattcattgaattcaacgccaaaaaaatgtggccacagtattgtcaacacgacaatgacacgacccaggagtcgtcggccagcaatcaggcttcctcccctgagaacgacgttcccgactcaattctgagccctcaagggcagaacggtgataaatggcagtacctccaccatgagctatcttccaagattaagctcccgctaccgcagctcgtagaaccccaggtttctaccaacatgggaattctcccttctgtaaccatgtacaactttaggtatccaacaaccgaggaactaaaaacatatacaacacagctcgaagatctcagacaagaggcttctaatttacagacgcaagaaaacatgacagaagaggcatacattaacctcgataagaagctgttcgaactctttctgaccctgtctcagtgtctctccagtgtcgaggaaatgctggagatgcctcggttgtaccgtgaagatggcagcgggcagcaggtgcattatgaaacactcgctctggagctgaaaaaactgtacctggctttgtctgataaaaagggcgatctcctgaaggcaatgacctggccaggcgaaaacaccaacttgctcctagagtgtttcgataatcttcaggtttgtctcgaacacacacaggcagccgcagtttgtcggagtaaatctctgaaagcgggcctggactacaatcgtagttatcagaacgaaatcaagcgtttgtatcatcagctgattaagtctaagacaagtttgcagcagtctttgaacgaaatctcgggtcagtcagtggctgaacagctccagaaagccgacgcttacactgtggaactggaaaacgcagaatctcgagtggctaaacttagagacgaaggcgagaggctacacttgccctacgcgttactgcaagaggtctataagttggaggacgttctggattctatgtggggaatgctgcgggctcgctacactgagttatctagcccatttgttaccgaatctcagcaagatgcactgctccagggaatggtggagctcgttaagattggcaaagagaagctggcacatggtcacctaaaacagaccaaatcaaaagtcgcactgcaggctcaaatcgagaaccataaagtgttctttcagaagctcgtcgcagacatgctgttgattcaggcctactctgccaagattcttccatccctactgcagaatcgggagactttttgggctgagcaggtcacggaggtgaagatcctagaagaaaagtcgaggcagtgcggcatgaagctgcagtctttactacaaaagtgggaggagttcgatgaaaattacgcatccctggaaaaagacctcgaaattttaatttcgaccctacctagtgtgtctctggttgaagagactgaggagaggcttgtggagagaatatccttttaccagcagatcaaaagaaacataggcggaaaacatgctcgcctttatcaaacgcttaacgaggggaaacaactcgtcgcaagcgtgagctgtcccgaacttgagggccagattgctaaactggaggagcagtggctctctctaaataagaaaatagaccacgagctacacaggctccaggccttgttgaagcacctgctctcctataatcgggactccgaccagctcaccaagtggctggaatcttctcaacacacacttaactactggaaggaacagagcctcaacgtatctcaggatttggataccatcagatccaatattaataatttctttgagttttcgaaggaggtcgatgagaaaagcagcctgaagacagccgtcatctctataggtaatcaattgcttcatcttaaggagaccgataccgcgaccttgcgggcatctctggctcaattcgagcaaaagtggacaatgctgattactcagctccctgacatccaggagaaactgcatcagctgcagatggaaaaactcccctcacgtaaagcaatcaccgagatgatctcatggatgaacaacgtcgagcatcagaccagcgacgaagactccgtacactcaccaagcagtgctagtcaggtgaaacaccttctgcaaaaacacaaggagttcaggatggagatggattacaagcagtggattgtcgactttgtcaaccagtccctacttcaactgtccacctgcgatgtggagagtaagaggtatgagcggaccgagttcgctgaacacctgggcgaaatgaatcgccagtggcacagagttcatggcatgctaaatcgcaagatccagcatctagagcagcttttggagagcattaccgaatctgagaataaaatccaaatcctgaacaattggcttgaggcgcaggaagagcggctcaagaccttgcagaaaccagaatccgtgattagcgtccagaagctactgctggactgccaggacatcgagaaccagctggccatcaagtccaaagctctggacgagctgaaacaatcctaccttactctagagtcgggggctgtaccattgctagaggacaccgcgagcagaatagatgagcttttccagaagaggtcctccgttctgacccaggtgaatcagctcaagacttccatgcagagtgtccttcaagagtggaagatatacgaccaactgtatgatgaagtgaacatgatgactatcaggttctggtattgtatggagcattcaaagccagtggtgctctcattggaaaccctgcggtgtcaggtggagaatttacaatctctgcaggatgaggccgaaagctctgaaggcagctgggagaaactgcaggaagtgatcggcaagcttaaagggttgtgcccctcagtagcagagattattgaagaaaaatgtcagaatactcataagcggtggacacaggtcaatcaagccatcgcagaccaactccagaaagcacagtcgttgctgcagctttggaaggcttactcaaacgcccacggagaggcagccgcgagactgaagcagcaagaggccaagttccagcaactagctaatatctccatgtcaggaaacaatttagccgaaatccttccccctgctcttcaggatattaaggagctgcagcacgacgtccagaagaccaaggaggctttcctgcagaatagctcagtcctcgatcggttacctcagcctgcagagtcaagcacacacatgttactgcctggccccctgcactcccttcagagagctgcatacctggaaaaaatgctgttagtgaaggccaatgaattcgagttcgtcctttcccagtttaaggattttggggtacggcttgagtcactcaagggcctgattatgcacgaagaagagaacttagataggctccaccagcaagagaaggagaacccggacagctttctgaatcatgtgctggccctaaccgctcaatcccctgatatcgagcatctgaatgaggtcagcctaaaactccctctaagcgacgtggccgtaaagactctgcagaacatgaaccgccagtggatacgcgccacagccacagcactggagagatgttctgaacttcagggcatcggccttaacgagaaatttttatactgctgcgagaagtggatccagctactagagaaaatcgaagaagcgctgaaggtggatgtggcgaacagcctccccgagttactggagcagcaaaagacctataaaatgctggaggccgaggtgtccatcaatcagactatagctgactcctacgtaactcagtccctacagctcctggacaccactgaaatagaaaatcgcccagaatttatcaccgagttcagtaaacttacagataggtggcagaacgctgtccagggagttagacagcgaaaaggcgatgtggacggcctggttcgtcagtggcaggactttaccacgagcgtggagaacctattccgctttcttaccgacacatctcacttactctcagctgttaagggccaggaacgtttttccttataccagaccaggagcctgatccacgagcttaagaacaaagaaatccactttcagcgcagaagaaccacctgcgccctcactctggaggcaggagagaaactgttgcttacaacggacctgaagactaaagaatctgtcggacgcaggatctctcagctgcaggactcatggaaggacatggagccgcagctggctgagatgatcaagcagttccagtcaactgtagagacctgggatcagtgtgagaaaaaaatcaaggagctgaagagccgactgcaggtgctcaaagcacaatccgaagaccctctgccagagctgcacgaggatctgcataacgaaaaggagctcatcaaggagctggaacagagcttggctagttggacccagaatctcaaggaactccagaccatgaaggccgacctgacccgccacgtactagtggaagacgtgatggtattgaaggagcagattgagcatttgcatagacaatgggaagatctgtgcctgcgggtagccattaggaaacaggaaattgaggacagactcaatacgtgggtagtgttcaatgaaaagaacaaagagctgtgtgcatggttggtgcagatggaaaacaaagtgctccaaaccgcagacattagcattgaggaaatgatagaaaagttgcagaaagattgtatggaggaaatcaatcttttcagtgagaacaaactgcagttaaagcagatgggtgaccagctgatcaaggcttcaaataagtctagggccgctgagatcgatgataaactgaacaagataaatgacagatggcagcacttattcgatgtaataggttccagggtgaagaagctgaaagagaccttcgcctttatccaacagttagacaaaaatatgtcaaatttgagaacatggttagcccggatagaaagtgagctgagcaaacctgtggtttatgacgtctgtgacgaccaagaaatccagaagcgcctcgctgaacaacaggatctccagcgagacatagagcagcactccgcaggagtggagtctgtttttaatatctgtgacgtcctcttgcacgactcagatgcctgtgcaaatgaaaccgagtgcgactccatccagcagaccacaaggtcacttgaccgtcgatggcggaatatctgtgcaatgagcatggagcgccgcatgaagattgaggaaacttggagactatggcagaagtttctggacgactactctcgatttgaagactggttgaagagtgccgaaagaacagctgcgtgcccaaatagctccgaagttctctacaccagcgctaaggaagagctcaagagattcgaggcttttcagagacagatccatgagcggcttacacagttagaattgataaacaaacagtatcggcgactcgctagggagaatagaaccgataccgcaagccggctgaagcagatggtgcatgagggtaatcagcgttgggataacttgcagcgtagagtgacagcagttttgaggcggttgagacacttcactaaccagcgggaggaattcgagggcaccagagaaagcatccttgtgtggctgacagagatggatctacaattgacaaatgtggagcacttttctgaaagcgatgctgacgacaagatgcgccagctgaacggattccagcaggagatcactctgaatacaaacaaaatcgaccagcttattgttttcggcgagcaattgatccagaagagcgagcccctggacgcagtacttattgaagacgagttggaagaactccatagatattgccaggaggtgtttgggcgcgtgtctaggtttcacagacgcttgacatcctgcacgccaggtcttgaggatgagaaggaagcttcagaaaacgaaaccgacatggaggacccccgagaaatccagacagattcatggaggaagcggggtgaatcagaggagccaagctctcctcagtcactctgtcacctcgttgcccctggacatgagcggagcggctgcgaaacacccgtcagcgttgactccatccctctggagtgggaccacactggggacgtcggcggctcaagttcccacgaggaggacgaggagggtccatactattccgcactgagcgatgtggagattcccgaaaatcccgaagcgtacctgaagatgactactaaaactctaaaggccagctctgggaagtcgatttctgacggccacagctggcatgtgcctgattcaccatcctgccctgagcatcactataagcagatggaaggggatcgaaatgtgccgcctgtcccccccgcctctagtacaccttacaagcctccttacggcaagctgcttttgccgccaggcacagacggcggaaaggaggggcctagagtgctgaacggcaatccacagcaggaagacggagggttggccggcatcaccgagcaacaatccggcgcatttgaccgttgggaaatgattcaggcccaggaactgcacaataagttaaaaattaagcagaatttgcagcagctcaattccgacatctccgccattactacctggctcaagaagaccgaagcagaattggagatgctgaagatggctaagccaccatccgatatccaggagatagagctcagggtgaaacggttacaggaaattctgaaggcattcgacacctataaggctctcgtcgttagcgtgaatgtttcgagcaaagaattcctccagactgaatctccagagtctacagagctacagtccagacttagacagttgtcccttctgtgggaggctgctcaaggagctgttgacagttggcgtgggggtcttagacagtccctgatgcagtgccaggactttcaccagctcagccagaacctgttgctatggctcgcctccgccaagaaccggaggcagaaagcccacgtgaccgatcctaaggctgaccctcgggcactattggaatgtaggcgtgaactgatgcaactggaaaaagagcttgttgagcggcaacctcaggtcgatatgctgcaagaaatcagtaattctctcctgatcaagggacatggcgaggattgcatcgaggctgaggagaaagtgcacgtgatcgagaaaaaactgaagcagctgcgtgagcaggtttctcaggatcttatggctctacagggcacgcaaaatcctgccagccccctgcctagctttgacgaagtggacagtggcgaccagcccccagctacatctgttccagcccctagggccaaatttcgagcggtgcgcacaaccgagggcgaagaagaaactgaaagccgtgtgcctgggagtacaagaccacagcgaagctttttgtcaagagtggtccgagccgctctgccactgcagctcctcctgctcctcctgctattactagcatgcctattaccctcttctgaagaggattattcttgcacacaggccaacaattttgccagatccttctaccccatgttaagatataccaacggcccaccacctacatag

SEQ ID NO: 206679 - DNA, 9813 bp, Artificial Sequence
  Description of Artificial Sequence: Synthetic coding sequence
atggagaagctgcggatcaagtacagcgagatgtacaccatcgtgcccgccgagatcgagtcgcaggtggaagagtgtcggaaggccctggaggatattgacgaaaagatatccaacgaggtgctgaaaagttctccttcttacgccatgcggcggaaaattgaagagatcaacaacggactgcataatgtggaaaaaatgctgcagcagaagagcaagaatattgagaaggctcaggagatccagaagaagatgtgggacgagctggacctgtggcattccaaactgaatgaactggatagcgaggttcaagacatagtggaacaggaccctgggcaagcgcaggaatggatggacaatttaatgatcccttttcagcaataccagcaggtttctcaacgggccgagtgtagaacctcccagctcaataaggccactgtcaaaatggaagagtactctgatctccttaaatctactgaagcttggattgagaataccagtcatctgctggcaaatccagccgattacgactcactgagaacactatctcaccacgcgtcgacggtgcaggattccaagtgtttcaggagtggcccccggcccaacatctatgtgtcatattatgtcaccgtcattcagatggcacttgaagactccgaacagaagcacaatctcttgcattctatcttcatggacctcgaagatttgtccataatcttcgagacagatgagctgacccagtccattcaggagctgtccaatcaggtcacagccctgcagcagaaaattatggagtcccttcctcagatccagaggatggcagacgacgtggtcgcgatcgaaagcgaagtcaagagtatggagaagcgcgtgtctaaaataaagaccatcttgttatccaaagagatcttcgatttctcacccgaagaacatcttaagcacggcgaggtcatcttggagaatattaggcctatgaagaagactatagctgagattgtgtcttatcaagtagagttgaggctcccacaaaccgggatgaaacctttaccggtattccagcggaccaaccagctcttacaagatattaagttactagagaacgtcactcaggagcaaaacgagctgcttaaggtagtgatcaagcagaccaacgaatgggacgaggaaatagaaaacctcaagcagattctgaataactacagcgcccagttttccctggagcatatgtctccagaccaagccgataaactgccccagctccagggggagattgagcgaatggaaaagcagatcctttccttaaaccaacggaaggaagacctcctggtggacctcaaagctaccgtactgaacctgcaccagcacctgaaacaggaacaggaaggcgtggaacgcgacaggttgccagctgtgacctctgaagaaggtggggtcgcggaaagggacgcctcagagaggaaactgaatagacgcgggagtatgagctatctggcagcagttgaggaagaagtggaggaaagcagcgtgaagtcagataatggagacgaaaaggccgagccctccccacagagctggagttccttatggaagcacgataaggacatggaggaagaccgagcgtcctctagctctggcacgatagtccaggaggcctatggcaaaatttctacaagtgataactcaatggcccaaattctcactcctgatagcctgaacacggagcagggaccggaatgtagcctgcgccctaatcagaccgaggagggaactactccccccattgaggctgatacccttgactcctctgatgcccagggtggacttgaacctcgggtcgagaaaacaagacccgagcccactgaagtgcttcatgcatgtaagactcaagtcgccgagttggaactttggctccagcaggccaatgtcgctgtcgagcctgaaacactgaacgcagacatgcaacaagttctagaacaacagttggtcgggtgtcaggccatgctaacagaaatcgagcataaagtggccttcctactggagacttgtaaggatcagggattaggagacaacggcgcgacccaacacgaggcagaagcactctcacttaaactcaagactgtaaagtgtaatctggagaaagttcagatgatgttacaggaaaaacatagcgaggaccaacaccctacaatcctgaaaaaatccagtgaacccgagcaccaggaggcactgcagcctgtgaatctcagtgaactggagtccatcgtgactgagaggccccagttcagtagacagaaagattttcagcagcagcaggtgctggaactgaagccaatggagcagaaggatttcattaagtttatcgagttcaacgcgaagaagatgtggcctcagtattgccaacacgataatgacacaactcaagagtctagcgcttccaaccaagcgtcttccccggaaaacgacgttccagactccatactatcacctcagggccagaacggtgacaaatggcagtacttgcaccacgaactgagttctaaaattaagctgccccttccacaattggtcgaaccccaagttagtaccaatatgggaatccttccctcagtgactatgtataacttccggtatcccactacggaggagctcaaaacttatacaactcagctcgaggatctgcgccaggaagcatcgaaccttcagacgcaggagaatatgactgaggaagcttatatcaatcttgataaaaaactgttcgagttattcttaactctgtcccagtgcttgtcctccgtcgaggaaatgctagaaatgccaagactttacagggaagacggtagcggccagcaggtgcactacgaaacactggccctcgaattaaaaaagctgtacctggcccttagcgacaagaaaggagacctgctcaaagcgatgacatggcctggagagaatacaaatctgctgctggaatgtttcgataatctgcaagtttgcctcgagcacacccaggcagccgccgtatgtcgttcgaaatccctgaaagcaggcttagattacaatagaagctaccagaatgaaataaagcgcctgtatcatcaactgataaagtctaaaacttcgctgcaacaaagtctgaatgaaatctcaggtcaatctgtcgctgagcaactccaaaaggcagatgcctacaccgtagaacttgagaacgcagaaagcagggtggctaaactgcgggacgagggggaacggcttcacctgccatacgcgttattgcaagaagtctacaaactcgaggatgtcctcgactcgatgtggggcatgttgagagcccgctatactgaactgtccagccctttcgtgaccgagagccagcaagatgctttacttcaggggatggtcgagttggtcaaaattggaaaagaaaaactcgcacatggacacctgaagcaaacaaagtcaaaggtggccctgcaggcgcagatcgaaaatcataaagtgttcttccagaaactggtggccgatatgctcctgatccaggcatacagcgccaaaattttgccgtccctgttgcagaacagggaaacgttttgggccgaacaggttactgaagtcaaaatccttgaggaaaagagccggcaatgcggaatgaagttgcagtcactgctgcagaaatgggaggagttcgatgaaaactacgcctctctggaaaaagacctggaaattttaattagtactttaccaagcgtcagcctggtggaggagactgaggagcggttggtcgagaggatcagcttctatcaacagattaagcggaacattggtggaaagcatgctcggctataccagacactgaacgagggtaaacagctggtcgcatcagtcagctgtcctgaactcgaaggtcagatcgccaaactggaggagcagtggctctcactgaataagaaaatcgaccacgagcttcataggctgcaggcattactgaaacatctcctcagttacaatcgggatagtgatcagctgacaaagtggctcgaaagcagccaacacactctgaattactggaaagagcagtcactgaacgtgtcccaggatctggacacaatacggagcaatatcaataacttctttgagttctctaaggaggttgacgaaaagtcttcattgaaaacagcggtaatttctatcggaaaccagctgctgcacctgaaggagaccgacacagcaacgctacgagcctctctcgcccagttcgagcagaagtggactatgctcataacccaactgccagatatacaagagaaattgcaccaactgcagatggaaaagctcccctccaggaaggccatcaccgagatgatatcatggatgaacaacgtggagcatcagacgagtgacgaagactcggtgcacagcccgagttctgcaagccaggttaaacacctactccagaaacacaaggaatttcgtatggagatggattataaacagtggatcgtggattttgttaatcagagcttgcttcagctcagtacgtgcgacgtcgagagcaagcggtacgaaaggaccgagtttgcagaacacctgggggagatgaacaggcagtggcacagggtccacgggatgctgaataggaagattcaacatttggaacagctgcttgagtcaatcacagagtctgaaaataagattcaaatccttaacaactggttggaagcacaggaagagcgcctgaagacactgcaaaaacccgaaagcgtgatcagtgtccaaaagctgttgctcgactgccaggatatcgaaaaccagctggccatcaagtccaaggcgctcgatgaactaaaacagtcctacctcactctagagagcggcgccgtgccccttctggaggataccgcctctcgaatagacgaactgttccagaagcgaagttcagtcttgacccaggtcaatcagctcaagacttccatgcagtcagttctgcaggaatggaagatctacgatcagttatacgatgaggtgaatatgatgactatccgcttttggtattgcatggaacacagtaaacccgtggtgctaagcctagagaccctccgatgccaggtggaaaacttacagagcctccaggatgaggccgagtcctcagagggcagctgggagaagctccaagaggtcattgggaagttgaagggtttatgtccttccgtcgcggagattatagaggaaaagtgtcaaaatacccacaaacggtggacacaggtgaaccaggctatagctgatcagctacagaaagctcaaagcctcctccaactgtggaaggcctatagtaatgcccacggagaggccgcggcccgcctaaagcagcaagaggctaaattccaacaacttgccaacatctctatgtccggcaacaacctggccgagattttaccacccgccctccaggacattaaggagctgcaacacgacgtgcagaagactaaagaggctttcttgcagaatagtagcgtgctggatcggctgccacagcctgcggaaagttctacacatatgctactcccggggccccttcatagcctccagagagcggcatatcttgaaaaaatgctgctggtgaaagccaacgaatttgaatttgtgctaagtcagttcaaggattttggagtcagacttgagtctctaaagggtttaatcatgcatgaagaggaaaatctcgatcggttgcaccagcaagagaaagaaaacccagatagttttctgaaccacgtcttggccttaacggcacaatctcccgatattgaacatctgaatgaggtctcgctgaaactgccgctgtctgatgttgcggttaaaacactccagaatatgaacagacagtggatcagagcaaccgctaccgcactggagcgctgctcagagttacagggcatcgggttaaacgagaagtttctgtattgctgtgagaagtggatccaactgctcgaaaagattgaggaggctttgaaggtggacgtggccaactcactgcctgaacttttggaacagcagaagacttacaaaatgctggaagccgaggtgtcaattaatcaaaccatcgctgactcgtacgtgacccagtcgctgcagttactcgatacaaccgagatagagaaccgacctgagtttattacggaattcagcaagctcacagaccgctggcagaatgccgtgcaaggggtaagacagcgaaagggagatgttgatgggctggtgagacagtggcaggactttactacgagtgtggagaatctcttccggttcctcaccgatacttctcatttgctctctgcagttaagggccaggaaaggttctctctgtatcagacacgcagtctcatccacgaactgaagaacaaggagattcacttccagcggaggagaaccacatgcgccctgactctagaagcgggagagaagttgctgctcactaccgacttgaagactaaagagtcagtaggaagaaggataagtcagctgcaagactcttggaaagatatggagccgcagctcgccgaaatgataaaacagttccagagtacggtagagacttgggaccagtgcgaaaagaagatcaaggagctcaagagccggctgcaggtccttaaggcgcagagcgaggaccccctccccgagctgcacgaggatcttcacaatgaaaaagaactgattaaggaactcgaacagtcgctcgccagttggacccagaacctcaaggaacttcaaaccatgaaggcagacctaacgagacacgtactcgttgaggacgtgatggttctcaaggagcagatcgagcatttgcaccggcagtgggaagacctctgcctgagggtggccatccgaaaacaggagattgaagatcgactgaatacttgggtcgtgtttaacgagaaaaataaagaactgtgcgcctggctggtgcagatggaaaataaggttctgcaaaccgcagacatcagtattgaagaaatgatcgagaagttgcagaaagactgcatggaggaaatcaacctcttttcagagaataagctgcaactgaaacaaatgggcgaccaactgatcaaagcatccaacaagagcagggcggctgagatcgacgataaacttaacaagatcaatgaccggtggcaacacctctttgacgtcatagggtcgagagttaaaaaactgaaggaaacctttgcttttattcagcagcttgataaaaatatgtcaaaccttcgtacatggcttgccagaattgaatccgaactgtcaaaaccggtggtatacgatgtgtgcgatgatcaggagatccagaagcgcctagctgagcagcaagatcttcaacgcgacattgaacagcactctgcgggcgttgagagcgtgtttaatatctgcgacgtgctgctccacgactctgacgcttgcgcaaacgagacggagtgtgattcgatccagcagacaacacgtagccttgatcgacggtggagaaatatatgtgcgatgtccatggaaagacggatgaaaatagaggagacctggaggctgtggcagaagtttctggacgattattccaggttcgaagactggctgaaaagcgcagagagaacagcagcttgccctaattctagcgaagtgctgtacacaagcgccaaggaggaacttaagcggttcgaagcgttccagcggcagatccacgagaggcttacccagctcgagctgataaacaagcagtaccggaggctagctagagaaaataggactgacacagcatcccggctgaagcagatggttcacgaggggaatcagcggtgggacaatctccaaagacgagtaactgccgtgctgagaagattgcggcattttacaaaccaacgcgaggagttcgagggtacgcgcgaatcgattctggtttggctcaccgagatggaccttcaactgactaacgtggaacactttagcgaatctgatgcagatgataaaatgagacagctgaacggattccagcaggaaatcacactgaacactaacaaaattgatcaactgatcgtgttcggggagcagctgatacagaagtccgagcctttggatgctgtgctcattgaggatgaattagaggaactccatcgctactgccaggaagtatttggtagggtgtcccggttccatcggaggcttaccagctgtacaccaggtctagaggacgaaaaggaggcaagtgagaacgaaaccgacatggaagacccacgggagattcagacagacagctggagaaaacgaggggaatcagaggaaccaagttccccccaatccctgtgccacttagttgcgcctggccacgagagatccggttgtgaaacgcctgtcagtgtggactccatccctctggaatgggaccatactggcgatgtcgggggatcctcttctcatgaggaagatgaagagggcccatactacagcgccctgtcaggaaagtcaatttctgacggtcattcatggcacgtgccggattctccatcttgtcctgagcatcattacaagcaaatggagggggatcgtaacgtcccgcccgtgcctcctgcgtcatccacaccatataagcccccttatggcaagctccttttaccccccggaaccgacggagggaaagaaggacctagagtccttaatgggaacccccagcaggaggacggcggccttgcaggcatcactgaacaacagtctggggcattcgaccgttgggaaatgattcaggctcaagagctgcacaataaactgaagattaaacagaatctccagcagttaaactcagacatttctgccattacaacttggctaaagaaaaccgaagcggagttggaaatgttaaagatggccaaacccccaagtgacattcaagaaatcgaattgagggtgaaacggcttcaggagattttgaaagcttttgatacgtataaggccttggttgtgtcagtaaacgtcagctctaaagagttcctacagacagagtctcctgaatccacagagctccagtcccgcctaaggcagctgtccctcttatgggaagcagctcagggggctgtggactcctggcgaggaggcctcaggcagagtctgatgcagtgtcaggattttcaccagctgtcacaaaatctgctcctttggctggccagcgctaagaaccggcgtcagaaggcgcacgtgaccgaccccaaggccgacccccgagcactcttggagtgtagacgagagctgatgcaactggagaaggaacttgtggaacgtcagccccaggtggacatgctccaggaaatatctaacagcctgctgattaaaggacacggagaggactgcatcgaggcagaggagaaagttcatgtcatcgaaaagaagctcaagcagttgcgcgaacaggtgagtcaggatctaatggccctgcaaggtacacagaacccagcatccccactaccctcctttgatgaagtggactccggggaccagccaccagctacatccgtgcccgcgccacgggcgaaacagtttcgcgccgtacgcactacagaaggtgaggaagagaccgagtcacgcgtgccagggtctacgcgaccccagcggagcttcttgagccgcgtcgtaagagccgcactgccattgcagctcttattgttgttgctgctactgctggcctgcctgctcccgtcaagcgaggaggactactcatgtactcaggccaataactttgcccgttcattctatccaatgcttcggtacacaaacgggcccccgcctacctag

SEQ ID NO: 206680 - DNA, 1290 bp, Artificial Sequence
  Description of Artificial Sequence: Synthetic coding sequence
atggagggcgaccggaacgtgccccccgtgccccccgccagcagcacgccctataaaccaccctacggaaaactccttctcccccctggaaccgatggcgggaaggagggcccccgcgtcctcaatggcaatccccagcaggaagacggagggctggcagggattactgaacagcagagcggcgcctttgatcgttgggaaatgattcaggcacaggagttgcataataagctgaaaatcaaacagaatctgcagcagttgaatagcgatatcagtgccattactacctggctcaaaaagaccgaggccgagctggagatgctgaagatggccaaacctcctagcgacatccaggaaattgagcttcgtgtcaagcgacttcaagaaatactcaaagcattcgacacttataaagccctggtagtctccgttaatgtctcttcaaaagagtttctgcagacggagtctccagaatcaacagagctccagtcacggctcaggcagttgagcttgctgtgggaagccgcccagggggccgtggacagttggagaggggggctccgccagtcattaatgcaatgtcagggctcgaagacacgacctcgttcagatgtgctgtttttcaaagacttccatcagctttcacagaaccttctgctctggctagccagtgccaagaataggcgccaaaaggctcatgtaacagatccaaaggctgacccacgggctctcctggaatgtagacgcgagctaatgcagctggagaaggaactagttgagcgtcaacctcaggttgatatgctccaggagatctccaatagcctgctcattaaagggcatggagaggactgcattgaagccgaagaaaaagtgcatgtgatcgaaaagaaactcaagcagctcagagagcaggtgtcccaagatctgatggctcttcagggaacccagaaccctgcaagtcccttgcccagcttcgatgaggtggactccggagaccagcctccagccacatctgtgcctgccccaagggcaaaatttagggccgtacgcaccacggagggcgaggaggaaaccgagagtcgagttcccgggtcaacaagacctcagaggtcattcctttcgcgagttgtgcgggccgccctgcccttgcagctgctccttctgctgcttctgctccttgcctgccttctgccatcttctgaggaagactactcatgtactcaggctaataattttgcacggagtttctatccaatgttgcgctataccaatggccctccacctacatag

SEQ ID NO: 206681 - DNA, 1671 bp, Artificial Sequence
  Description of Artificial Sequence: Synthetic coding sequence
atggaggacccccgggagatccagaccgacagctggcggaagcggggcgaatcagaagaaccaagttcaccgcagtcactctgccatctggtcgcaccaggacacgagcggagtggttgcgaaactcccgtcagcgtggattcaatccccctggaatgggatcacaccggggatgtgggagggtcaagtagccacgaggaggacgaggaggggccctattactccgccctttccgatgttgaaattccggaaaaccctgaggcctaccttaaaatgactaccaagacgttgaaagctagctccggtaagtcaatttccgacgggcatagctggcacgtgcctgattcacctagctgtcctgagcatcactacaagcagatggagggtgacagaaacgtcccccccgttccaccagcttcttccacgccctacaaacccccgtacggcaaactgctcctcccacccggaacggacggcggaaaggagggtcccagggttctaaatggtaatccccagcaggaagacggaggactggctggaatcactgaacagcagtctggtgcgttcgacaggtgggagatgatccaggctcaggagctgcataacaaacttaagatcaagcagaacctccagcagttgaattctgacatctcggccatcactacatggctcaagaaaacagaggctgaattagagatgctcaagatggccaaaccaccgtctgacattcaggagatagagctgcgagtcaagcggctccaggagattttgaaagcctttgatacctacaaggctcttgtggtgagcgttaacgtttcttctaaggagttcctgcaaacagagagccctgagagcaccgaacttcagagccgattgcgtcagcttagtcttctctgggaggccgcacaaggtgccgttgacagttggagaggaggactgcgacagagcctcatgcagtgccagggctccaagacacgccctcgcagtgatgtgctgtttttcaaggatttccaccagctctcccagaacctgttgttgtggctggcgtccgccaagaatagacgacagaaggcgcacgtgacagacccaaaggcagatcctagagcactgcttgagtgtcggcgtgagttgatgcagctggagaaggagctcgttgagaggcaaccacaagtagatatgctgcaggaaattagcaacagtctccttataaaaggccacggggaagactgcatcgaagccgaagaaaaagtccacgtcattgagaagaaactcaagcagctgcgagaacaggtgagccaggacctaatggcattacaaggcacccagaaccctgcaagtccccttccaagctttgacgaagtcgactccggagaccaaccacctgctaccagtgtgcccgctcctcgcgccaagcagttcagggctgtgcgtactaccgaaggggaggaagagacagagtccagggtgcctggctcgacaagaccgcaaagaagtttcctctccagagtggttcgcgccgccttgccactgcagctgttacttctccttctcctgctgctggcctgcttgctgccctcctcagaagaggattacagctgtactcaggcgaacaactttgcccgctcattttacccaatgctcaggtatacaaacgggcctcctcctacctag

SEQ ID NO: 206682 - DNA, 2007 bp, Artificial Sequence
  Description of Artificial Sequence: Synthetic coding sequence
atggtgcacgagggcaaccagcggtgggacaacctgcagcggcgggtcaccgcggttttacggcgactgaggcattttacaaatcaacgagaggaattcgagggaacacgtgagtctatccttgtgtggctgaccgaaatggacctccagctgacaaatgtggagcacttcagtgaatcagatgctgacgataaaatgagacagttgaacggtttccagcaagaaattaccttaaacacgaacaagatcgatcagctgatagtatttggggaacagcttattcagaaatcagagcctctggatgcagtcctgatcgaggacgagttggaggagttgcatagatattgtcaggaggtcttcggccgtgtctcgcgattccaccggagattaacatcctgcacacccggcctggaggacgagaaggaggcttccgagaacgagacggatatggaggacccccgtgagatccagactgactcgtggcggaaacgcggggagtctgaagaacctagttctccccagagtttgtgccaccttgtggcacccgggcacgaacggagcggctgcgaaactcctgttagtgtcgattctatccctctggagtgggaccacaccggcgatgtcggagggtcaagctcacatgaagaggacgaggaaggcccctattactctgccttgagtgggaaatctatcagcgacgggcactcctggcatgtccccgatagtccttcctgtccggagcaccactacaagcagatggagggcgatagaaatgtgccacccgtgcctcccgcgagctcaaccccttataagcccccatatgggaagttgcttctacctcccggcactgatggcggaaaggagggcccccgtgtgctcaatggaaatccacaacaggaagatggagggcttgcaggcatcacagagcaacagtctggggcctttgatcgttgggagatgatccaagcgcaggaactgcacaacaagctgaaaatcaaacaaaatctgcaacagctcaattcagatattagcgccatcactacctggctcaaaaagacggaggcagagctcgagatgctaaagatggcgaagcctcctagtgacatccaggaaatagaactgagagtcaaaagacttcaggaaatattgaaggccttcgacacatacaaagccctggtggtatctgtgaatgtgagctctaaggagtttctgcaaaccgagagtcctgaaagtactgagctccagtctcgcctgcggcagttgagtttactctgggaggccgcccagggggctgtggacagctggcggggcggattaagacagagtttaatgcagtgtcaggattttcaccagctgtctcaaaatctgctcttgtggctcgccagcgccaaaaatcgccggcagaaggcccacgtgacggatccaaaagcagatccacgggccctgctcgagtgcagaagagaactgatgcaactggagaaagagctggtggaacgtcagccacaggtcgacatgcttcaggagatctccaactccctgctcatcaagggacatggagaagattgcatcgaagctgaagaaaaagtccacgtcatcgagaaaaagctcaagcagttgcgggagcaggttagccaggatttgatggctttgcagggaacccaaaacccggcttcacctttgccctcattcgatgaggtcgatagcggagatcagccgcccgccaccagcgtacctgccccgagagcgaaacagttccgggcggtgcggactacagagggtgaggaggagacagaaagcagagtgccaggcagcacacgcccccagcggtcctttctctcacgggtggttcgcgctgccctgcctctgcagctgcttctgctgctcctgctccttctggcgtgcctcctgccaagctctgaggaggattattcatgcacacaggctaacaatttcgcccggagcttctaccctatgcttagatacaccaacggcccgcccccgacttag

SEQ ID NO: 206683 - DNA, 10626 bp, Artificial Sequence
  Description of Artificial Sequence: Synthetic coding sequence
atggaggaggacatctacaccaacctgagcaagatggagaccgtgctcgggcagtcaatgagctcactccctctgagttatcgagaagctttagagcgattggaacagtccaaagcactggtgagcaaccttattagcaccaaagaagaactgatgaagctgagacaaatactccgactgctgcggctccgatgcaccgagaacgacgggatttgcctgctgaagattgtgtccgcactgtgggaaaagtggctctccctgctggaggccgctaaagagtgggagatgtggtgtgaggagctgaagcaggaatggaagtttgttagcgaggagatcgagagagaagctataatccttgacaatctacaggaggagctgcccgaaattagtaaaacaaaggaagcggcgacaacggaggagctgtctgaactgttggattgcctttgtcaatatggggaaaatgtggaaaagcagcaactgctcctgaccctgctgcttcagcggatccgcagcatccaaaatgttcccgaatcctcaggggccgtcgagactgtccccgcattccaggagatcacctcaatgaaggagcggtgcaataaattgctgcagaaagtacagaaaaacaaagaactggtgcaaactgagatccaggaaagacactcttttaccaaagaaatcatcgctctgaaaaacttctttcagcagacaaccacctccttccaaaacatggctttccaggatcacccagagaaaagcgagcagttcgaggaactgcagtcaatccttaaaaagggtaaactgacgttcgaaaacattatggaaaaactacgcatcaagtactccgagatgtatactattgtacctgcggaaatcgagagccaagtcgaagaatgcaggaaggccctagaggacattgacgaaaaaattagcaacgaggtgcttaaatcaagtccctcttatgccatgcggcgtaagattgaagagattaataatggactgcataatgtggaaaagatgctccaacaaaagagcaaaaacattgagaaagcacaggaaatccagaaaaagatgtgggatgaactggatctgtggcatagcaaactgaacgaattggattctgaggtccaggacattgtggaacaggaccccggccaagctcaggagtggatggataatctgatgattccctttcaacagtatcagcaggtctcccagcgtgctgaatgccgaacttcacagctcaataaagctactgtcaaaatggaagaatatagcgacttgctgaaaagcaccgaagcatggatcgagaatacatcccaccttctcgcaaatcccgcagattatgatagcttgaggacgctgtctcatcacgcaagcaccgtgcagatggctctcgaggactcagagcagaaacacaatctcctgcactcgatctttatggacctggaggacttatctattatcttcgagaccgatgagctcacccagagcatccaggagttgagcaaccaagtgaccgctctgcagcagaaaatcatggagagcctcccccagattcagcgtatggccgacgacgtcgtggctattgagtctgaggtgaagtctatggaaaagcgcgtttcaaaaataaaaaccattcttctgagcaaagagattttcgacttcagccctgaagaacacttaaagcatggggaagtgatcctggagaacattaggccaatgaaaaagactattgccgagatcgtctcttatcaggtggagctgaggctgccgcagaccggcatgaagccacttccagtctttcagaggacaaatcagctcctgcaggatattaagctgctcgagaacgtaacacaggagcaaaacgagttgctgaaagtggtcatcaaacaaactaacgagtgggacgaagaaattgaaaacctaaaacaaatactcaacaattactcggcccagtttagtctggagcatatgagtccagaccaggccgacaaactaccacagttacagggcgagatagagcgcatggagaagcaaatcttgagtctcaaccagcggaaggaggacctgctggtggacctaaaagcaacagtcctgaacctgcaccagcatctcaaacaagagcaggaaggtgtagaaagggatcgcctgccagccgtaacttcggaggaaggcggggtcgcagagcgggatgcctcagaaagaaaattgaacagacgtggctctatgtcctatcttgctgccgtcgaggaggaagtagaagagtctagtgtgaaatccgacaacggcgacgaaaaagctgaaccttccccacagagttggtcaagtctgtggaagcacgacaaggatatggaggaggaccgggcctcatcgagcagcggaactatagttcaggaggcttacggcaaaatttccactagtgataattctatggcacagatcctgactcctgactcactcaacaccgaacaaggacctgaatgttccttgcgaccaaaccagacagaggaggggactacccctccaatcgaggctgacaccttagattcctccgatgcccaggggggacttgagccacgggttgaaaagaccagaccggaacctaccgaagtcttgcacgcgtgcaagacccaagtggcagagctggaactttggctgcaacaggctaatgtggccgtggagcccgagacactgaatgccgacatgcagcaagtgctggaacaacaactggttggctgccaggctatgctgaccgagatcgaacataaggtggccttccttcttgaaacttgcaaagaccagggactgggtgataatggcgccacccaacacgaggcagaggcactttcactcaagctcaaaacagtgaaatgtaacctggagaaggtccaaatgatgctgcaggagaagcattcagaagaccagcacccaacaatccttaaaaagtcttctgagccagagcatcaagaggcgctccagccggtgaatttaagtgaactcgagtccattgtaactgaacgtccacagttcagccgccagaaagacttccaacagcaacaggtgcttgagctcaagcccatggaacaaaaagactttattaaatttatcgagttcaacgctaagaagatgtggccacagtactgccagcacgacaatgacaccacccaggagtctagtgcctctaatcaagcaagttcgcccgagaacgatgttcccgattccattttatccccccagggccaaaacggggataagtggcagtatttacatcatgaactgtctagtaagataaaattacccctgcctcagttggttgagccccaggtcagcaccaatatgggcatactgccatctgtgacgatgtacaacttccgatatccaaccacagaggaactgaaaacctatacaacgcaactcgaagacctgcgccaggaggctagcaacctgcagactcaagaaaacatgacagaggaggcctacatcaacctagacaagaaactgtttgaactgttcttaaccctctcacagtgcttatcatccgttgaagaaatgcttgagatgccgcgcctttaccgggaggacggatcaggccagcaggtacattacgagacgctggctttagaactgaaaaaactctacctggctctgagcgataagaagggcgacctcttgaaggcgatgacgtggccaggagagaacacgaaccttctgctggaatgtttcgataaccttcaggtttgcctcgaacatactcaggctgctgctgtgtgtagatccaaaagtttgaaggctggcctcgactataatcgcagctaccaaaatgagatcaaacggttgtatcaccagcttattaagagtaagacctcactccaacagtccctaaatgaaattagtggacagtccgtagcagaacaattgcaaaaggcagacgcctatacagttgaacttgagaacgcagaatccagagtagctaagctgcgcgacgaaggcgaaaggctgcacttaccctatgcactgctgcaggaggtgtataagctggaggatgtcctagactccatgtggggcatgctccgcgctagatatactgaactgagttccccattcgttactgagtctcaacaggacgcactcctacaagggatggtggaactggtcaagatcgggaaagaaaagttagcccacggccacctaaagcagacaaagagtaaagtggccctccaggcccagatcgagaatcataaggtgttctttcaaaagctcgtggccgacatgctgcttattcaggcctatagtgcaaagatcctgccctctttgctgcagaatcgggagaccttctgggctgagcaggtgaccgaggttaagattctggaggaaaagtctcgtcagtgtggtatgaagctgcagtcattattgcagaagtgggaggagttcgacgagaattatgcctcccttgagaaggacctcgagattctgatttccaccctgccctctgtctctttggtggaggaaaccgaggaacggctcgtggaaaggatatcgttctaccagcagatcaagaggaacataggtggtaaacatgcaaggctgtaccaaaccttaaacgaaggaaaacagctcgtggcaagcgtcagttgtcccgaactcgagggacagatcgccaagctggaagagcaatggttgtctctgaacaaaaaaattgatcacgaactccacagacttcaggccctactgaagcacttactgtcatataatagagatagtgatcaactcacaaaatggttggagagcagccagcataccctcaattactggaaggaacagtctctgaatgtgtcccaagatttggacacaattcgctctaacataaacaacttcttcgagttctccaaggaagtagacgagaaaagcagccttaaaactgcagtgatctctatagggaaccagctgctgcacctcaaagaaaccgatactgccaccctccgagccagtctggctcagtttgagcaaaagtggacaatgctgattacacagctacccgacattcaagaaaagcttcatcagctgcagatggagaagttgccatcccgcaaggcgatcaccgaaatgatttcctggatgaataatgttgaacatcagacatcggacgaagactcagtccactctccatcttcagcctcccaggtgaagcacctgctgcagaagcacaaagaattcagaatggaaatggattataagcagtggatcgtggactttgttaatcagagtctgcttcagctgagcacttgcgacgtggaaagtaaaaggtatgagagaacagaatttgcggaacatctcggcgaaatgaacagacagtggcacagagtccacggcatgctgaatcggaagatacaacacctggaacagttgctggagtccatcacagagagcgaaaacaaaattcagattctgaataattggctggaggcacaggaagaacgcctgaaaacattgcagaaacccgagtctgtgataagcgtgcagaaattactcctcgattgtcaagacatagagaatcagctggctattaagtcaaaggccctggacgagctgaagcagagctatcttactttagagtccggagccgtccctctgctcgaagataccgcgtctcggatcgatgagctgtttcaaaagagatcaagcgttctgacacaggtaaatcagctcaaaacttctatgcagagcgtgctccaggagtggaagatctacgatcaactctatgacgaggtgaacatgatgactatcaggttctggtattgtatggaacactcaaagccggtggtccttagccttgagaccctgcggtgccaagtggagaatctgcagagtcttcaggatgaggcagaatccagcgaaggcagttgggaaaaactccaggaggtgatcggaaagctgaaaggactgtgccccagtgttgcggaaattattgaggaaaaatgccagaacacccacaagcggtggacacaggtgaaccaggcgatcgccgatcaattgcaaaaggctcagtctctcttgcaactatggaaagcctactctaatgcccacggcgaagccgccgcccggctcaagcagcaagaagccaagtttcagcagttagcaaatatttctatgtccggaaataatctggccgaaatattgccaccggccttgcaggacataaaggagctccagcatgatgtgcagaagaccaaagaggccttcctccaaaattcgtcagtattagaccgcctcccacaacctgccgaatcctcaacgcacatgctgttaccaggacccctgcatagtctgcagcgtgcggcctatctggagaagatgctcttggtaaaagcaaatgaatttgaatttgtactaagccaattcaaggacttcggagtacgactggaaagtttgaaaggcttaatcatgcatgaggaggaaaatttggacaggctgcatcagcaggaaaaggagaaccccgactcattcctgaatcatgtacttgccctgaccgctcagtctcctgatatcgagcaccttaacgaagtcagcctgaagctacccctcagtgacgtcgccgttaagactctacagaatatgaacaggcagtggatacgggccactgctactgcactcgagcggtgttccgagctccagggcattggcttgaatgaaaaatttctgtattgctgtgaaaagtggatccagctgctggagaagattgaggaagctctgaaagttgacgtcgctaactcactgccagaactactggaacagcaaaaaacatataagatgctggaggccgaagtctccatcaatcagacgattgccgactcgtacgtaacacagtccctccagttgctggatacaactgaaattgagaatcgcccagagttcataactgaattcagtaaactcaccgatcgctggcagaacgcggtgcaaggtgttcggcaacggaagggcgatgttgacggtctggtgcgccagtggcaggactttaccacctcggtggagaacctcttcagattcctcacagacacgtcgcatttgctgtccgcggtaaaaggccaggagaggttctcattgtaccagacgcggagcctcattcatgaacttaagaataaggagattcacttccagagacggagaacgacttgcgccctgaccctagaagcaggagaaaagctgctcctgaccactgatcttaaaacaaaagagtccgtaggccggcggatttcacaactgcaagactcatggaaagatatggagcctcaactggcggaaatgatcaaacaatttcaatctaccgtggaaacctgggaccaatgtgaaaagaaaattaaggaactgaagagtcgtctgcaggtgctgaaggcgcagtcagaggatcctctacctgagcttcacgaggacctacataacgaaaaggagctgattaaagagctggagcaatcattagcctcttggactcagaacctaaaggagctgcaaacaatgaaggcagacctgactagacatgtgctggttgaggatgtgatggtgcttaaagaacagattgagcacctgcatagacagtgggaggacctgtgtcttagggttgcgatccggaaacaggaaatagaagacagattgaacacatgggtggtattcaatgaaaagaacaaagaattgtgcgcgtggctggtgcagatggagaacaaggtgctccagacagccgatatctccattgaagagatgattgaaaagctgcagaaagattgtatggaagagatcaatctcttttcggaaaacaaactacaactgaagcaaatgggggaccaactcatcaaagctagtaataagagccgggccgccgaaatcgatgataaactcaacaagattaacgaccggtggcagcatttattcgatgttattgggtctagagttaagaagctcaaggagaccttcgctttcatccagcagctcgacaaaaacatgtcaaatcttaggacatggctagctcgcattgagtcagagttgtccaagcccgttgtgtacgacgtgtgtgatgatcaggagatacaaaagcgactcgctgagcagcaggatctgcaacgcgatatcgaacaacactcagccggcgttgagagtgtatttaacatctgcgacgtcctgctccacgacagcgacgcatgtgcgaacgagactgagtgcgatagcattcagcagacaacacgaagtctggatcggaggtggcgcaatatctgtgctatgtccatggagaggaggatgaagatcgaggagacctggcgcctctggcagaagttccttgacgactactcgaggttcgaggattggctcaagagcgcagagcgaactgctgcctgccctaattcctccgaggtactctacacctctgctaaggaagaactgaaaaggttcgaggcgttccaacgccaaatccatgaaaggctgacccagcttgaactgattaataaacagtaccgtcgcttggcccgcgaaaacagaacagatactgcctcgaggctgaaacagatggtccacgaaggaaaccaacgctgggacaacttacaacgccgcgtaactgcagtgctgcggcgactacgtcattttacgaaccagcgcgaggagtttgagggcacccgagaaagcatactagtttggttgacagagatggacctgcagctgaccaacgtggaacacttttctgaatccgacgccgacgacaagatgcggcagctgaacggattccaacaggagatcaccttaaatactaacaaaatagaccagcttattgtcttcggggagcagctgatccagaagagcgaaccgttagacgcagtcctaatagaagacgagctcgaggaactgcacaggtactgccaggaggtcttcggtcgggtctcccgattccataggcgcctgacatcctgcacgccaggcttagaagatgaaaaagaggcctcagagaacgaaactgatatggaggaccctcgggaaatacagaccgatagctggaggaagcgtggcgagagtgaggaaccatcatccccccaaagcctgtgccacctcgttgcacccggccatgaacgatctggctgcgaaactcccgtgtccgttgacagcattccgctggagtgggaccataccggagatgtaggcgggtccagctcgcacgaggaggacgaagaggggccctactactctgctctttccgatgtggagatccccgaaaaccccgaagcctacttgaaaatgactacaaaaacacttaaggcctcttcgggcaagagcatctcagacggacatagttggcatgtgcctgactcgccctcttgcccagagcatcactataagcagatggagggcgacaggaacgtacctcccgtcccccctgcatctagcactccttacaagcccccttatggcaagcttctgctgccacccggcactgatggagggaaggaggggccacgcgtgctgaatggcaacccacagcaggaggacggaggcttagccggcatcactgagcagcagtccggagcctttgataggtgggaaatgattcaggcacaagaactacataacaagctgaagatcaaacagaatctgcagcagcttaatagtgatatctccgcaatcacaacttggctgaaaaagactgaagctgagctggaaatgctgaagatggccaaacctccaagcgatattcaggaaatagaactgagggtgaagaggctgcaagaaatcctgaaggcctttgacacgtataaagcgcttgtcgtctcggtcaatgtgagctccaaagaatttctgcagaccgagagtccagagtcaaccgaactccaatcacgtctgaggcaactgtcactgttgtgggaagcagcccaaggagcagtagacagctggcggggcggcctcaggcagtccctgatgcagtgtcaagactttcatcaattatctcaaaatctcctgctttggctcgccagcgctaagaataggcggcaaaaagctcatgtgacggacccgaaagccgatccaagggcactgctggagtgcaggagagagctgatgcagctggagaaggaactggtggaacgccagccccaagtagatatgcttcaggagatttcgaacagtcttctgatcaagggccacggggaggactgcatagaagctgaggaaaaagtacatgtaatagaaaagaaacttaagcaattgcgggaacaggtgtcccaagacctgatggcccttcaggggacccagaatcccgctagtccactccctagcttcgatgaggtggactccggcgaccagccacccgccacaagtgttccagcccctagagccaagtttagagcagttaggaccaccgagggggaagaggagacagaatcaagagtgccgggttccacgcgaccacagcgctcctttctcagccgcgttgtcagagcggcactgcccttgcagctactcctgttattattgctactcctcgcctgcctgctgccaagctctgaggaggactacagttgcacccaggcaaacaactttgcccgctcattttaccccatgctgaggtacacaaatgggcccccccctacttag

SEQ ID NO: 206684 - DNA, 2292 bp, Artificial Sequence
  Description of Artificial Sequence: Synthetic coding sequence
atgagcatggagcggcggatgaagatcgaggagacctggcggctgtggcagaagtttctggacgactattcgcgcttcgaggactggttaaaatctgccgagcgaactgccgcgtgtcctaactcttcagaggtcctttacacctcagccaaagaggaacttaagaggtttgaggcctttcagcgtcagatccatgagcgtttgacccagctggagcttatcaacaagcaatacagaaggctcgcaagagaaaacagaaccgacacagcgtctcggctcaagcagatggtgcacgagggaaaccagaggtgggacaacctccagaggagggtgactgcggtgctgagaaggctgcgccactttaccaatcagagggaggaattcgaaggtacccgggagagcattctcgtgtggctgactgagatggaccttcagctcacaaatgtagagcactttagcgagtccgacgctgacgacaagatgcgtcagctgaacgggttccagcaggagattacactcaatacaaacaagatcgatcaattgatcgtctttggtgaacaactgatacagaagtcagagcctctggacgccgtccttattgaggatgaactcgaggagttgcacagatactgccaggaagtcttcgggagggtgagccgctttcaccgccgccttacaagctgtacacccggcctcgaggacgagaaagaggcttcagaaaatgagactgatatggaggatcctagagaaatccaaacagactcatggcgaaagcgcggggaatcagaagagccctccagcccccagagcttgtgtcacctggtggcaccaggccatgaacgaagcggctgtgagacaccagtttccgtggatagcatccccctagagtgggatcatacaggggatgtcgggggcagcagcagtcacgaggaagacgaagaaggcccatactactcagctctctccggtaagagtatttccgatggccatagctggcacgtgccagacagccccagctgccctgaacaccactacaaacaaatggaaggcgataggaatgttcctccagtgccccctgccagcagtactccttataaacctccttacgggaaactcctgctcccccctggcacagatggcgggaaggagggccctagggtgctgaatggcaacccgcaacaggaggatgggggcctggctggaatcaccgagcagcaatctggcgccttcgatcgatgggagatgattcaggcccaggaactgcacaacaagctgaaaattaaacagaacctccagcagctgaattcagacatcagcgccatcactacctggctgaagaagactgaggccgagttagagatgctgaagatggccaagccaccatctgatatacaggagatcgagctcagagttaagcggttgcaggagatcctgaaagcatttgatacttataaggccctggttgtgtctgtgaatgtctcctccaaggagttcttgcagacagagtcaccagagtccacagaattgcagtcacgcctgcggcaactgagcttgttatgggaggcagcccagggcgccgtcgactcctggagaggcggtctgaggcagagtttgatgcagtgtcaggactttcatcagctttctcaaaaccttcttttatggttggcctcggccaagaaccgacggcagaaagcacacgtgacggacccaaaagccgacccccgcgccctgctcgagtgtcgaagggagctgatgcagttagaaaaagaacttgtggaaaggcagcctcaggtagatatgctgcaggagatttcaaatagtcttctgattaagggccacggcgaagactgcatagaggccgaggagaaggtgcatgtcattgagaagaagttgaaacagctcagagagcaagtgtcgcaggacctcatggctctgcagggcacacagaatcccgcctcccctcttccctcgtttgacgaggtggactcgggagaccagccgcctgccacctctgtaccagcacctcgcgctaaacagttccgggccgtgcgcacaaccgagggagaggaggagacggaatcaagggtcccggggagtactaggcctcaacgcagtttcctatctcgggtggtccgtgctgcattgccgctgcagttactgctgctcctgctgcttctcttggcctgtctcctgccatcatctgaggaggactacagctgcacacaggcaaataatttcgctaggagcttctacccaatgcttcggtatacgaacgggcccccccccacttag

SEQ ID NO: 206685 - DNA, 7251 bp, Artificial Sequence
  Description of Artificial Sequence: Synthetic coding sequence
atggagcagttccccaaggagaccgtggtggagagcagcggccccaaggtactggaaacagcggaggagattcaggagcgacggcaggaggtcttgacacgctatcagtcctttaaagagcgcgtagccgagagagggcagaaactcgaagatagttatcaccttcaagtctttaaaagggacgcggacgaccttggcaagtggatcatggagaaagtgaacattctaacagacaagtcatacgaggaccccactaatattcagggcaagtaccaaaaacatcagtccctggaggccgaggtgcagacgaagtcacggctcatgtctgagctggagaagaccagggaagagcggtttaccatggggcattccgcccacgaggagactaaggctcacatagaggagctgcgccacctgtgggacctgttactggagctaacactggaaaagggggatcaactgcttcgggctctcaaattccaacagtatgtgcaagagtgcgctgatattcttgaatggataggtgataaggaagccatcgcgacctccgtagagctgggggaggattgggagcgcaccgaggttctacacaagaagtttgaagactttcaggtggagctcgtcgccaaagagggaagagtcgtggaggtgaatcagtacgctaacgagtgtgcggaagagaatcaccctgacctccccttaattcagtccaagcagaatgaggtgaatgctgcctgggagcggttgagggggttagccttgcaaagacagaaagctcttagcaatgctgcgaacctccagaggttcaagcgagatgtgacggaggcgattcagtggattaaggagaaggagcccgtgctaacatctgaagactacggaaaggatctcgtggcgagtgaggggctgtttcactctcacaaaggcctggagcgaaaccttgcagtcatgtcagacaaggtgaaagagctatgcgctaaggctgagaagttgaccctttcacatccatctgacgctccacagattcaggaaatgaaagaggatttggttagttcttgggagcacatccgagccctcgcaaccagccgctacgagaagctgcaggcaacttattggtaccatagattcagctctgatttcgacgagctcagcggatggatgaacgagaaaaccgccgccattaatgctgacgagctgcccacagacgtagccgggggtgaagtgctcctcgacagacaccagcagcacaagcatgagatcgattcttatgatgacagatttcagagcgcggatgagacaggccaggatctcgtgaacgccaatcacgaagcttctgacgaagtgcgtgagaagatggagatcttggataataattggaccgccctcctcgagctttgggatgaaagacacaggcagtatgaacagtgcctcgacttccacttattttatagagattccgaacaggttgatagttggatgagcaggcaggaggctttcctggaaaatgaggaccttggaaatagtctggggagcgctgaagcccttctgcagaagcacgaggattttgaggaagcttttaccgcacaggaggaaaagataatcactgtcgataaaaccgcgaccaaattgattggcgacgaccattatgactccgaaaacatcaaagctattcgagacgggctgctcgcccgaagagatgccttgcgcgaaaaggcagcaaccagacgaagactgctcaaggaatctctgttgctccagaaactgtatgaggattccgatgatttaaagaactggataaataagaagaaaaagttagccgatgatgaagactataaggatatacagaacctcaagtcgcgtgtgcagaagcagcaagtgtttgagaaggaactggcagtcaataaaacacagctcgaaaatatccagaaaacaggacaggaaatgatagagggaggacactatgcctccgataacgtgaccactaggctgtctgaggtagcctccctgtgggaggaactgcttgaagcgactaagcaaaaggggactcagcttcatgaggcaaaccagcagctacagtttgaaaacaatgccgaggacttacagagatggctagaggacgtagagtggcaggtcaccagcgaggactacgggaagggactggctgaagtgcagaatagattacggaaacacggcctgttggaatccgctgtggccgcgcgtcaagatcaggttgacatccttaccgatctggctgcctatttcgaagaaatcggccacccagacagcaaggacatacgggccaggcaagaaagtctcgtttgccgctttgaggctctgaaggagcctctagctacccggaaaaagaagcttctggatttacttcacctgcaactcatctgccgggacaccgaagatgaagaggcctggattcaggaaaccgagccctctgctactagtacctacctaggaaaagatttgattgccagcaagaaactactcaacagacaccgggttatcctcgaaaacattgcatctcatgagccccgaatccaggaaattacagagcgcggcaacaaaatggtggaagaagggcatttcgccgcggaggatgtggccagccgagtgaaaagtctcaaccagaacatggaatccttaagggcgcgcgccgcccgaagacaaaacgaccttgaagcaaacgttcagttccagcagtaccttgctgatttacacgaagccgaaacgtggatacgcgagaaggagcctattgtcgacaatactaactacggggcagatgaagaagcagccggggcattgttaaaaaaacatgaggctttcctcctggacctgaactcttttggggatagtatgaaggctctgaggaatcaagctaatgcatgccagcagcagcaggccgccccagttgagggggtggctggagagcagcgcgtgatggctctgtacgacttccaagctcgtagtccgagggaggtgaccatgaagaagggcgatgtccttacccttctgtcttccattaataaggactggtggaaggtggaggccgccgatcatcagggtattgtacccgccgtgtacgttagacgcctggcacatgacgagttccccatgttaccccaaaggcgtcgggaagagcctggaaatatcacgcagcgccaggaacagatcgaaaatcagtatagaagcctgcttgacagggctgaggaaaggaggaggcggctgctgcagcggtataatgagtttctgctcgcctacgaggcaggagacatgctggagtggatccaggagaaaaaggccgagaacaccggagtggaactggatgacgtctgggagctgcagaaaaaattcgatgaattccaaaaggatctcaatacaaacgaaccacgcctccgggacatcaataaggtggccgacgaccttctattcgaaggactgctgacacctgaaggagcccagattcgtcaggagctcaactcccggtggggaagcctgcaaaggcttgctgatgagcagagacaactcctgggctccgcacatgcagtagaggtgttccatagggaggccgatgacactaaggaacaaatcgagaaaaaatgccaggccctgagtgctgccgacccagggtcagacttgttctcagtccaggcccttcaaagaagacatgagggattcgagcgagatctcgtgcccctcggagacaaggttactatcctgggagagacggcagaacggctcagcgagagccaccctgacgccactgaggacctgcaaaggcagaagatggagctgaacgaggcttgggaggacctccaggggaggactaaggacagaaaagagagtctcaatgaggcacagaagttttacttgtttctgagcaaggcgagagaccttcagaactggatatcttcaatcggcggcatggttagcagtcaagagctggccgaggacctgaccggtatcgaaatcctattggaaagacatcaggagcacagagctgacatggaagccgaagcacctactttccaggctctggaggactttagcgccgagctcattgactctggacaccatgcctccccagagattgaaaaaaaactccaggcggtaaagctagagcgcgacgatctcgagaaagcttgggagaagcgaaaaaagatcctggaccagtgcttggagctccaaatgttccagggcaattgtgaccaggttgagagctggatggtcgctagggaaaatagcctcaggtcagacgataagtcctcgctggattcactggaggctcttatgaagaaacgcgatgatcttgataaggctatcacggctcaggagggcaaaatcaccgacctggaacacttcgctgagtccctgattgccgatgagcactacgcaaaagaagagatcgcgacaaggctgcagcgcgtgctggacaggtggaaagcactcaaggcgcagcttattgatgagcgtacaaagctcggagactacgccaatctgaagcaattttatcgtgacctcgaagagctggaggagtggatcagcgagatgctgcccaccgcatgcgacgaatcatacaaagacgcaactaacatacaacgcaagtatctgaaacaccagacattcgcccacgaggttgacggcaggtctgagcaggtccacggtgtcatcaatcttggcaactccctcatagagtgttccgcatgcgacggcaacgaagaggcaatgaaagaacagctggaacagctgaaagagcactgggaccacttactggagcgaactaatgacaaggggaagaagttgaacgaggccagcaggcagcagcgcttcaatacaagtatccgtgatttcgagttctggttgagtgaggccgagaccctactggcaatgaaggaccaggcacgcgacttagcctccgcagggaaccttctgaaaaaacaccagctgttagagcgggagatgctggcccgcgaagatgctctgaaagatcttaatacacttgcagaagacctgttatcgtcggggactttcaatgtcgatcagatcgtaaagaagaaggacaatgtcaacaaacgctttttgaatgttcaggaattggccgctgcacatcacgagaaattaaaggaggcctacgccctctttcagttcttccaggacttggacgacgaggaaagctggatagaggaaaagttgattagagtcagctcacaggactatggaagagacctgcagggtgtccaaaacctgttgaaaaaacacaagcgtttagaaggagagttggtggcccatgagcccgccatccagaatgtgctggatatggccgagaagctgaaggacaaggccgctgtcggtcaggaggaaattcaattacgtctggcccagtttgtcgagcactgggaaaagttgaaggagctggcaaaggcgcggggattgaaactggaagagtccctcgagtacctacagtttatgcagaatgcggaagaggaggaggcatggattaatgagaagaacgcccttgcagttcggggagattgcggagatacattggcagccactcaatctctgttgatgaagcatgaagcattggagaacgactttgcagtgcacgagacaagagtccagaacgtttgcgcccaaggagaggatattctgaacaaggaggaatctcaaaacaaagagatctcctctaaaatagaagccctgaatgagaaaaccccgtcactggccaaagccatcgcagcttggaagctgcagttggaggacgactatgccttccaagagtttaactggaaggctgacgtggtagaagcatggattgccgacaaagagactagtttgaagaccaacggtaatggtgccgacctgggtgatttcctaactttgctggccaaacaagacactcttgatgcttcactgcaatcctttcagcaagagcgattgccagagatcactgatcttaaagacaaactaattagtgcccagcacaatcagtcaaaagccatagaagaaaggtatgctgccctgttgaagcgctgggaacagctgttggaggcctctgctgtgcatcgacagaaactactcgaaaagcagctaccacttcagaaggcagaggacctattcgtggagttcgcccacaaggcctcggcccttaataattggtgtgagaagatggaagagaatctgagtgagcccgtccactgtgtctcgctgaacgaaattcgccagctgcagaaggaccatgaagatttccttgctagcctggcccgggcccaggcggattttaagtgcctgctggaactagatcaacagatcaaagcactgggcgtgcctagctctccatacacctggctgaccgtggaggtcctagagcgcacgtggaaacacctgagtgacattatagaagagcgagaacaggagctgcaaaaggaggaggctagacaggtcaaaaacttcgaaatgtgccaggagtttgaacagaacgcttccacattcctccagtggattctggaaaccagagcctacttccttgatggatctctccttaaagagaccgggacattggaatcacagctagaagctaataagaggaagcagaaggagatccaggccatgaagcgacaactgacaaagattgtggatctgggcgacaatctggaggatgcactcatactggacataaagtattctacgattgggctggcccagcaatgggaccagttgtaccagctgggcttaaggatgcaacacaacctggagcagcaaatccaggccaaggatatcaagggggtgtctgaagaaacgttaaaggaattcagcacaatctataagcatttcgacgaaaacttgacagggcgactgactcataaggagtttcgctcatgcctcagaggcctcaactattacctgcctatggttgaggaagacgagcacgagcctaagtttgagaagttcttagatgcggttgaccccggccgaaagggatacgttagtctggaagactatacggcctttcttatcgataaggaatccgagaatatcaagagcagcgacgaaatagaaaatgccttccaagcactcgcggaagggaaatcctacatcacaaaggaggatatgaagcaggctcttacgcccgaacaggtgtcgttctgtgcaactcacatgcagcagtacatggaccccaggggaagatcccatctgagtggttacgactatgttggttttacgaattcatactttggcaattag

SEQ ID NO: 206686 - DNA, 7260 bp, Artificial Sequence
  Description of Artificial Sequence: Synthetic coding sequence
atggagcagttccccaaggagaccgtggtggagagcagcggccccaaagtccttgagaccgccgaggagattcaagagagacgtcaggaggtgctgacgcgatatcaatcttttaaggagagagtcgctgaaagggggcagaagcttgaagattcgtaccacctccaggtctttaaaagagacgccgatgacctcggtaaatggattatggaaaaggtcaacatcttgaccgataagtcctacgaagacccaactaacattcagggtaagtaccaaaaacatcagtctcttgaagctgaggtgcagacaaaatcgcgcctgatgagtgagcttgagaagactagggaagagaggttcaccatggggcacagcgcacacgaagaaacgaaggcacatattgaggagcttcgccatttatgggaccttctgctcgagttgacacttgagaagggtgaccagctgttgcgggcactgaagtttcagcagtacgtacaagaatgtgccgatatccttgaatggattggcgacaaggaagcaatagccacgtctgttgagttaggcgaggactgggagcgtactgaggtattgcataagaaattcgaagactttcaagttgagctcgtggccaaggaggggcgggtagttgaggtgaatcagtacgcaaatgaatgcgcggaagaaaaccatcccgacctccctctcatacagagcaagcaaaatgaagtcaatgcagcttgggagcgcctccgtggcctggctctgcagcgtcagaaagccttatccaatgccgctaacttgcagcgattcaaaagggatgtgacagaagccattcagtggattaaggaaaaagagcccgtgctgacatcggaggattacggaaaagaccttgtcgcctccgaggggctgttccattctcacaagggcctggagcgcaacttggcggtcatgagtgacaaagtgaaggagttatgcgcgaaggcagagaaactgacactgtcccatccaagcgacgcgccccagatccaggaaatgaaagaggacctcgtgtctagttgggagcatatcagagctctggcgacatccagatacgaaaaactgcaggcgacttattggtaccacaggttctcctcagactttgatgagctttccggctggatgaatgaaaagaccgcagccattaacgccgacgaactgccaaccgatgtagctggcggtgaggtgctgctcgacaggcatcagcagcacaagcacgaaatagatagttatgacgacagatttcagtccgccgacgaaactggccaggatctggtgaatgctaaccacgaagccagtgatgaggttcgggagaaaatggagattctggataacaactggacagcccttttggaactgtgggatgagaggcacaggcagtacgagcagtgcctcgatttccatctattctatcgcgattccgagcaggttgatagctggatgagcaggcaagaggcattcctggagaacgaggatctcggcaactctttgggatctgctgaagccctgctccagaagcacgaggacttcgaggaagccttcactgcccaagaggaaaaaattataactgttgacaaaactgctactaaactgatcggcgacgaccattacgactctgaaaatatcaaagccattcgggatgggctgctggcaagaagagatgctctgcgtgaaaaggccgctactaggcgacgtctgctgaaggagagtctgctgctgcagaagttgtacgaggactctgacgacctgaaaaactggattaacaaaaaaaaaaagcttgctgacgacgaggactataaggacatccagaaccttaagtccagagttcaaaagcagcaagtttttgaaaaggaactggccgtcaacaagacgcagttagagaatattcaaaaaacaggccaggagatgatcgaaggcgggcactacgcttctgataacgtgactaccaggttgagtgaagtggcttcactctgggaggagctgttggaggcgactaagcagaagggcacgcagttgcatgaggccaaccaacagttgcagttcgagaacaacgcagaagatttacagcgttggctcgaggacgtggaatggcaagtgacgtccgaggactatggcaaagggctggccgaagtgcagaatcggctcaggaaacacgggctgctggagtcagcagtcgccgccaggcaagatcaagtggacattctcacagacctggccgcctactttgaagagatcggccatcctgactccaaggacattcgggcacgacaggaaagtctggtctgtcgattcgaagccctcaaggaacccctcgcgacccggaagaagaaattactggatcttctgcatctgcaactgatctgccgagatactgaggatgaagaggcttggattcaggagacggagccttcagcaacgtccacttacctgggaaaggacttgatagccagcaaaaagttgcttaacagacaccgcgtgattctggaaaacatcgcatctcacgaaccgagaattcaggagattaccgaacgcggcaacaagatggtcgaggaaggccatttcgccgcagaagacgttgcgtcacgtgtgaaatcactcaaccagaacatggagtcactgcgcgcaagagcagcacgcaggcagaatgacctcgaggccaacgtgcagttccagcagtacctagccgacctgcacgaggctgaaacctggatcagggaaaaggagcccattgtcgacaacactaactatggggccgatgaagaagctgccggggccctgttgaaaaagcatgaggccttccttttagatctcaatagttttggggactcgatgaaagctcttcgcaatcaggctaacgcctgccagcagcaacaggcagcaccggtggaaggtgttgccggggaacagcgagtgatggctctgtacgatttccaagcccggagccctcgggaggtaactatgaaaaaaggagacgtccttaccttgctgtcctccatcaataaagactggtggaaagtggaggccgccgaccaccaaggtatcgtgcccgccgtctatgtgagacgcctcgcccacgatgagttcccaatgctgcctcaacgcagaagggaagagcctgggaatattacacagcgccaggagcaaatcgagaaccagtatcgatccctactggacagagccgaggagagacggaggaggcttttacagcggtataatgaatttctgctagcctacgaagccggagatatgctcgagtggattcaggagaaaaaagccgagaacaccggtgttgagcttgacgacgtctgggagctacagaagaagttcgacgaatttcaaaaggacctgaatacgaacgaaccgaggttaagagacattaacaaggtcgccgatgatctgctctttgaaggtctcctgactcctgaaggcgcacagattcgacaagagctgaactctcgatggggatcattgcagaggctggcagacgaacagcgccagctcctgggctccgcccacgccgttgaagtgtttcaccgagaggcagacgacaccaaggagcaaatagagaaaaagtgccaagctctgtcagcggccgatcctggtagcgaccttttttcggtacaagcacttcagcggcggcatgaggggtttgaacgagatctcgtgcccctaggcgacaaggtgacgattctcggggaaacggctgagagactaagcgaaagtcacccggacgctactgaggatttacagaggcagaagatggaactaaacgaggcgtgggaagacctccaaggacgtactaaggatagaaaggaatcactcaatgaggcgcagaagttctacttattcctttccaaggccagggatctgcagaattggatttccagtattggcggaatggtgtcctcccaggaattggctgaggatctgacaggcatagagatcctactggaacggcaccaagagcatcgtgccgacatggaagcggaggcacccacttttcaagctctggaagatttctcagctgagctcatcgattccggacaccatgctagtcccgagatcgaaaaaaagcttcaggccgtgaaacttgagcgcgatgaccttgagaaggcttgggaaaagcgaaaaaagatcctggatcaatgcctggaactgcaaatgtttcagggtaattgcgaccaggtggaaagctggatggtcgccagagaaaattcacttcggagtgatgacaagtcctctctggatagtctggaagccttaatgaaaaagagagacgacttggataaagctattacagcccaggaaggaaagattacagatctggaacacttcgctgagagcctcatagcggacgagcactacgcgaaagaggaaattgctacgagactccagcgtgtgctggatcggtggaaagctctgaaggcacagcttattgacgagagaaccaagttgggagattatgcaaacctgaagcagttctatagagatttggaggagctagaggagtggattagcgagatgttaccaacagcatgcgacgagagctacaaggacgccacaaatatacagcgcaagtacttgaagcatcagaccttcgctcacgaagtggacgggcgctcagagcaggtacacggagtcattaacttgggcaactcactaatcgaatgtagtgcatgcgatgggaatgaggaagcgatgaaggagcaactggaacagctgaaagagcactgggaccacttgctcgaaaggacaaatgataaaggaaaaaaactcaacgaggcgtcaaggcagcagcggtttaatacttccattcgcgatttcgagttctggttatctgaagcagagactttactggctatgaaagaccaggccagagacctcgcctccgctggcaacctgcttaagaaacatcagcttttagaacgggaaatgttggcacgggaggacgcgctcaaagaccttaacacactggccgaagacctgctgtcctctggaacctttaatgtggaccagatagtaaagaaaaaagacaatgtcaacaaacggtttttaaacgtccaggaactcgcagccgctcaccatgaaaaactcaaagaggcctacgccttgtttcagttcttccaggacctcgacgatgaggagagctggattgaagaaaaattaatcagagtatcatctcaggattacggtcgagacttacagggcgtccagaatctgttaaagaagcataagcgcctcgagggagaacttgtggctcatgagcccgctatacagaacgtgctggacatggcagagaagctcaaggacaaggcagccgtgggccaggaggaaattcagctccgactagctcagttcgtggagcattgggagaagttgaaagaactggcaaaggcgcgcgggttgaagctcgaggaatcattggagtacctccagttcatgcagaacgcagaggaggaagaagcatggatcaatgaaaaaaacgccctcgcagtccgaggagactgcggagataccctggctgccacccagagtctgctgatgaagcacgaggctctggagaatgacttcgcagtccatgagacaagagttcagaatgtgtgtgcccaaggtgaggacattctcaacaaggtgctacaagaggaaagtcagaacaaagagatttcaagcaaaattgaggcgctgaatgaaaagactccgagccttgccaaagcaatcgccgcttggaagttgcagctggaagacgattacgccttccaagagttcaactggaaagctgacgtcgtggaagcatggattgctgataaagagacctccctcaagactaatgggaatggcgctgatctaggtgattttctgacattgctagctaaacaagatacgttggatgctagcctgcaaagctttcagcaggaaaggcttccagagattactgatttaaaggacaagttgatctcggcacaacacaatcagagcaaggcaatcgaagaacggtatgcagctctcttaaaaaggtgggagcagttgctggaagcctccgctgtgcacagacagaagctgttggagaagcaactgccgctccagaaagccgaagatctgtttgtagaattcgcacataaagccagtgcgcttaataactggtgtgaaaagatggaagagaatctctccgagcctgtgcattgtgtttccctcaatgagatcaggcagttgcaaaaggatcatgaagattttctcgcctctctggctcgcgcccaggctgatttcaagtgtctgttagagttagaccagcaaatcaaagcgctgggtgtgccttcctctccttacacatggctcacagtcgaggtgctggagaggacatggaagcacttgtcggacatcatagaagagagagaacaggagctccagaaagaagaggcaagacaggtgaaaaacttcgaaatgtgccaggagtttgaacaaaatgccagtactttccttcagtggatcttggagacacgcgcttatttcctggacggtagtctactcaaagagacaggaactctggaatctcagctcgaagctaacaaacggaaacagaaagagattcaggcgatgaagcggcagctgactaagatagtcgacttgggagataaccttgaggacgcacttatcttggatatcaagtatagtaccatcggcctcgcacagcaatgggatcaactgtaccagctaggactgagaatgcaacataacttagagcagcagatccaggctaaggacataaaaggggtgtcagaagagaccctcaaggagtttagtacaatctataagcattttgatgagaacctcacaggccgtttaacccataaagagttcagaagttgtctacgaggccttaattactatctgcctatggtcgaagaggacgaacacgaacctaagttcgagaagttcctcgacgctgtcgacccaggccggaagggatacgtctcactggaggattacaccgccttcctgatagataaggaatcagagaatatcaagagtagcgatgaaatagagaatgccttccaggcactcgcagagggcaagagctatatcaccaaagaagatatgaaacaggctcttaccccagagcaggtgtccttctgtgcaacgcacatgcagcagtacatggatcctagagggagatcccacttgtctggttatgactacgtgggtttcacaaattcctactttggaaactag

SEQ ID NO: 206687 - DNA, 7434 bp, Artificial Sequence
  Description of Artificial Sequence: Synthetic coding sequence
atggaccccagcggcgtgaaggtgctggagaccgccgaggacatccaggagagacgccagcaggtcttggatcggtaccatcgtttcaaagaattatcaacattgcgacggcagaagcttgaagactcttaccgttttcagttcttccagcgggatgccgaggagctcgaaaagtggatccaggagaagttgcaaatagcctcagatgagaattacaaggacccaaccaacttgcaggggaagctgcaaaaacaccaggccttcgaagcagaggttcaggcaaactccggtgccattgtgaaactggacgaaaccggcaacctcatgattagtgagggacatttcgcttccgagactatccgaactagacttatggagttacataggcagtgggaactgctactggaaaagatgcgcgaaaagggaattaaactgctgcaggctcagaagttagtgcagtacctacgagaatgtgaggatgtgatggactggatcaatgataaagaagctattgtgacctcagaggagctggggcaagacttagagcatgtggaagttctacagaaaaagtttgaagagttccagactgatatggccgctcacgaagagcgcgtgaacgaggtgaaccagtttgctgccaagctcattcaggagcagcatccagaagaggagctgataaagacaaagcaggacgaagtaaacgcagcttggcagcgcctaaagggtctcgctttacagagacagggcaaactcttcggcgccgcagaggtacaacggttcaaccgcgatgtcgacgagactatttcttggattaaagaaaaagagcaactgatggcttctgacgattttggccgggatttagcctctgtacaagcgctactcagaaagcacgaggggctcgagagagacctggccgcactggaggataaggtcaaggctctctgcgctgaggcagaccggttgcagcagagtcaccctctcagtgctacccagatccaagtcaagagggaggaactgattactaattgggagcagatccgaaccctggccgccgagaggcacgccaggttgaatgatagctacagactccagaggttcctggcggatttccgcgacttgacctcgtgggtcaccgagatgaaagcgctgattaatgccgacgaattagcttccgatgtagcaggcgcggaagcactgctggatagacaccaggagcataaaggcgagatcgacgcccatgaagattcatttaaaagcgcggacgaatcaggccaagcattgctcgccgcagggcattacgcaagtgacgaggtccgagagaagctcaccgtgcttagcgaggaacgggctgccctgttggagctgtgggagttgcgacgccagcaatatgaacagtgcatggacctccagctgttctatagagatacagagcaggtggataattggatgtctaagcaggaggcctttttgttgaatgaggacctgggcgatagtttagatagtgtggaggccttactgaagaagcatgaagattttgaaaaatccctctccgctcaagaggagaagatcacagcccttgacgaattcgccaccaaactgattcagaacaaccactatgctatggaggatgtagctaccagaagggacgccttactgagcaggaggaatgctcttcacgagagagctatgagaaggcgagcacagctggctgattcttttcacttacagcagttctttagagactctgacgagttgaaatcttgggtcaacgagaagatgaaaaccgccactgacgaggcgtacaaggatccaagtaatctgcaaggcaaggtgcagaaacatcaggcgttcgaagcggaattgagtgctaatcaatcgagaattgacgcattggagaaggccggacagaagctgatcgatgtcaaccattacgcaaaggacgaggttgctgcgcggatgaatgaagtgatcagcctttggaaaaaactactagaggctaccgagcttaaaggaataaaactaagggaagcaaatcagcaacagcagtttaaccgcaacgtggaagacatcgagctgtggctgtacgaagtggagggtcatcttgccagtgacgactatggcaaggatctgactaatgttcagaatttgcagaaaaagcatgctctgctggaagccgacgtggcagcccaccaggaccgcatcgatggaattaccattcaggcccggcagttccaggatgctggacattttgatgccgagaatataaagaaaaagcaggaggcactggtcgcgagatatgaagctctgaaagagcccatggtggctcgcaaacaaaagctggcggatagcctccggctgcaacagctcttccgagatgtggaggatgaggagacatggattcgagaaaaagaaccaatcgccgcttctacaaatcgtggcaaagatttaattggggtgcagaacctgctaaaaaagcaccaagctcttcaggccgaaattgcaggccatgagcccagaatcaaggcagtaactcagaaaggaaacgccatggtcgaggagggccactttgcggctgaggacgtcaaagctaaattgcacgagctcaatcagaagtgggaggcactgaaagctaaagcttctcagaggcgacaggatctcgaggactcactacaggctcagcagtacttcgcggacgctaacgaagccgaatcttggatgagggaaaaagaacctattgtgggctccacagattacggaaaggacgaagattccgccgaggccctgttaaagaaacacgaggccctcatgagtgacctgtctgcctacggatccagcatccaagcacttcgagaacaagctcaatcctgtaggcagcaagtggcacccaccgacgatgaaaccggaaaggaattggttcttgcactctacgactatcaggaaaagagccccagagaggtgactatgaagaagggcgatattctgactttgcttaacagtacaaacaaagactggtggaaggtggaagtgaacgatagacagggctttgtgccggcagcatatgtcaagaaactggatcccgcccagtccgctagcagagagaatttgctggaggaacaggggagcatagcacttaggcaggagcaaatcgacaatcagacgcgtatcactaaggaggctggcagcgtgtcactgagaatgaaacaagtggaggagctgtaccatagtttgcttgagctgggtgaaaagcgaaagggcatgctcgaaaagtcctgcaaaaagttcatgctgttccgagaggccaacgaactgcagcagtggattaatgagaaagaggccgccttgacttctgaggaggtgggtgcggacctcgagcaggtggaggtgctgcaaaaaaagttcgacgattttcaaaaggatctgaaagccaatgagtccaggcttaaagacattaataaagttgccgaggatctggagtccgaaggcttaatggcagaagaggtgcaggccgtgcagcagcaggaagtgtatggcatgatgccccgtgatgagactgattccaaaacagcctcgccatggaaatcggctcgtcttatggttcatactgtagcaactttcaactccataaaagaactcaatgaaaggtggagatccctgcagcagctggcggaggagaggagtcagctcttgggtagcgctcatgaagtccagaggtttcaccgggatgcagatgaaacaaaggagtggatagaggagaaaaaccaggcccttaatactgacaattatggacacgatttagctagtgtccaggccctacagcggaagcacgagggatttgagcgcgaccttgcagcgttaggcgataaggtaaatagtcttggagaaactgctgaacggcttattcaatctcaccccgaatctgcagaagatctgcaggagaagtgtacagaactgaatcaggcctggtcgtcacttggcaaacgcgcagaccagagaaaggctaaattaggcgactcacatgatcttcaaaggtttctgtctgacttccgtgacctgatgtcctggataaacggcatcagaggactcgtgagctcagatgagttagcaaaagacgtcacaggggccgaggcactcctagaacgccatcaagaacatcgcactgaaattgacgcacgcgcaggaaccttccaggctttcgagcagtttggtcagcagctgctcgcccacggacactatgcctcccccgaaataaagcagaaattggacattctggatcaggagcgcgccgatttggaaaaggcttgggttcagaggagaatgatgctggaccagtgtctggaactgcagctgttccatagagactgcgagcaagccgagaattggatggccgccagggaggccttcctcaacacagaagataaaggagactctttagacagcgtcgaggccctaattaagaagcacgaggattttgacaaagccatcaacgttcaggaagagaagatagccgctctgcaggccttcgccgatcagctgatagccgcaggacactatgccaaaggcgatataagtagtcgccgcaacgaagtcttggatagatggcggcgtctgaaggcccagatgattgagaaaaggagtaagctgggggagtcgcagacattacaacagttctcccgtgatgtcgacgaaattgaagcctggatcagcgagaaactacagactgccagcgacgagtcttacaaagatccgacaaatatccaggtaagcctaatgctgtcaaaacatcagaaacatcaagcattcgaggctgagctacacgctaatgccgatcgtatcaggggagttatcgatatgggcaactcactcatagagcggggtgcttgtgccgggagcgaggatgccgtcaaagcccggctcgccgctctagccgaccaatggcagtttcttgtgcagaagtctgccgaaaagagtcagaaactgaaagaggcaaataaacagcagaattttaatacaggcatcaaggacttcgatttttggctttctgaagtcgaggcactactggcgagtgaggactacgggaaagacctcgcctctgtgaataacctgcttaaaaagcaccagttgttggaggcagacatttcagctcatgaggaccgcctgaaggacttaaactctcaagccgattctctgatgacctcatcggccttcgatacaagtcaggtcaaggataaacgagataccatcaatgggcggttccagaaaattaagtcaatggcggcatccaggagagcaaagctgaatgagtcccatcgcctgcatcagtttttcagagatatggacgacgaggaatcctggattaaagagaaaaagctgctggtgggtagtgaagactacggaagggacctcaccggtgtgcagaacctgcgcaagaaacacaaacgactcgaggccgagctcgcagcccatgagcccgcaatccaaggggtgctggataccggcaagaagttaagcgacgataataccattgggaaagaagagatccagcagagattagcccagttcgtagaacattggaaagaactcaagcaactggcagctgcgcgggggcaaagattagaggaaagcctggagtatcagcagttcgtggccaacgtcgaggaggaggaggcctggataaatgagaaaatgacccttgtggcttctgaggattacggagatacactcgctgccatccaggggcttctcaaaaagcacgaagcattcgagaccgactttacagtgcacaaagatcgggtaaatgacgtatgcaccaacggccaggacctgattaaaaagaacaatcaccacgaagagaacatttcaagcaagatgaaaggcctgaacggaaaagtgagtgacctcgagaaggctgcagcacagagaaaggccaaactagatgaaaattccgcctttctgcaattcaattggaaagctgacgtggtcgaatcatggatcggggaaaaagaaaactccctgaagactgatgattacgggcgcgacctgagttctgtccagactttgttaactaagcaagagacgtttgatgccggcctgcaggcttttcaacaagaaggaattgccaacatcaccgccctgaaggatcagctgctagctgccaagcacgtgcagtccaaagctattgaggccagacacgccagcctgatgaaacgatggagccaactgctcgcaaatagcgccgccagaaaaaagaaacttcttgaagcccagtcccactttcgcaaagtggaggacctattccttacatttgccaagaaggcatcggcttttaattcctggttcgaaaatgcagaagaagacctgacagaccccgtcagatgcaactccctggaagagattaaagctctgcgggaggcccatgatgcctttcgttcttccctgtcttcagcccaggccgatttcaatcagctggcagagctcgaccggcaaatcaaatcttttagagttgcttctaatccttatacttggttcacgatggaggccctggaggagacttggcggaacctgcagaagatcattaaggaacgggagctggaactacaaaaagagcagcggcgccaggaggaaaacgacaagttgcggcaggaattcgcccagcacgccaatgcattccatcaatggatccaagaaacccgctgtcaacccgcaggagcaagttgtatggtcgaggaatcaggaacgctcgagtcccagctcgaggcaaccaagagaaaacaccaggagatccgagccatgcgtagtcaactaaagaaaatcgaggacctcggcgccgcaatggaggaagcactgatcctggataataaatacacggagcactctacagtcggcctcgcccagcagtgggaccaactcgatcagctcgggatgaggatgcaacataatctggaacagcagattcaggcccgcaacacaaccggcgtgactgaagaagcattgaaggagttttctatgatgtttaaacattttgataaggacaagtcaggtagactcaaccatcaagagttcaaatcttgtttgagaagcctcggctatgatctcccgatggtggaggagggtgaaccagacccggagttcgaggcgatcctggacaccgttgatcccaatcgtgatggtcatgtgagtctgcaggagtatatggcttttatgatctcccgagagactgagaatgtaaaaagctctgaagaaatcgagagtgcttttcgagcactgtcatctgagggcaaaccatatgtcaccaaagaggaactgtatcagaacctaacccgcgagcaggcagattactgtgtaagccacatgaagccatacgttgatggtaaaggaagggagctgcccacggctttcgattatgttgagttcacgcgctcattgttcgtcaactag

SEQ ID NO: 206688 - DNA, 7359 bp, Artificial Sequence
  Description of Artificial Sequence: Synthetic coding sequence
atggaccccagcggcgtgaaggtgctggagaccgccgaggacatccaggaaagacgccaacaggtactggatagatatcacagattcaaggaactctcaacactgcgacggcagaaactggaggactcctatagattccagttcttccaaagagacgcagaagagttggaaaagtggatccaagagaaactccagatcgcaagcgacgaaaactataaggatccaacgaatctgcagggcaagctgcagaaacaccaagcgtttgaggcagaggtgcaggctaattcaggagccattgtgaaactggatgagacagggaatttgatgatctcagaggggcatttcgctagcgagaccatccgaactcgcttgatggagctgcaccgtcagtgggagctcctgttagaaaagatgcgcgagaagggcatcaagctgctacaggcccagaagctggtgcagtacctccgagagtgtgaggatgtgatggactggatcaatgacaaagaagctatcgttactagcgaggagctcgggcaggatctcgaacacgtggaagtcctgcaaaaaaagttcgaggagttccagaccgatatggccgctcatgaggagcgagtgaatgaggtgaatcagtttgcggccaaacttattcaagagcagcaccccgaggaggagctgattaagacaaaacaggacgaggtgaacgccgcctggcagcgcttgaagggattggccctgcagagacaaggaaaactgttcggagctgcagaagtccagagattcaaccgggacgttgacgaaaccatctcgtggatcaaggagaaggagcagttaatggccagtgatgactttggtagggatctcgcttctgtgcaggcgctcctccggaagcacgagggtctcgaacgggacctggccgcgctggaagacaaggtgaaagccttgtgcgccgaagctgaccgcctgcagcagtcccacccactgagcgcgactcagattcaagtgaaaagggaggagctgattaccaactgggagcagattcgcactctcgcagctgaacgtcacgcccgtctcaacgattcctaccgactacagcggttcctggccgactttcgtgatttgacgtcctgggtcaccgaaatgaaagccctgatcaatgcggacgagttagcctctgatgttgccggcgctgaggccctgctcgaccgacaccaggagcacaagggcgaaatcgacgctcacgaggattcattcaagtccgcagacgaaagtggtcaggctttattagccgcaggtcattatgcgtccgacgaggtaagagagaagctgactgtgttatcggaagagcgtgccgcactgctggaactgtgggagctgaggaggcaacagtatgagcagtgcatggaccttcagctcttctaccgtgatactgaacaagttgataactggatgtccaagcaggaagccttccttcttaacgaggatcttggcgactcactggattccgtggaagccctgttgaagaaacacgaggatttcgagaagtccttatctgctcaggaggagaaaattacagctttggacgaattcgccacaaagctaattcagaataaccactacgccatggaggacgttgccacacgtagggatgcactgctctcgagaaggaatgccctgcacgagcgagcaatgaggcgccgggcccagctcgctgatagctttcacctgcaacagttcttccgcgacagcgacgagttaaaatcctgggtgaacgaaaagatgaagactgctaccgatgaggcctacaaggacccaagcaatctccaagggaaggtgcagaaacatcaggccttcgaagcagaactgtcagcgaaccagagccgcatcgatgcgctggagaaggctggacagaaattgatcgacgtgaatcattacgccaaagacgaagttgctgcaaggatgaatgaagtcatatcactctggaaaaaacttctggaagctacggaactaaagggaatcaagcttcgtgaggctaatcagcagcaacagttcaacaggaacgtcgaagatatagagctatggctatacgaggtagagggtcacttggccagcgatgattatggtaaagaccttaccaatgtccaaaatctgcaaaaaaaacacgccttattggaggctgatgtcgctgcccatcaggatagaatcgatggtataactatccaggcacggcagtttcaagacgccggccactttgatgcagaaaacattaagaagaagcaggaagccctggtcgctaggtatgaggcactcaaggaaccgatggtggcccgtaagcagaaactggctgacagcctgagacttcagcagctgtttcgtgatgtggaagatgaggaaacatggatcagggaaaaagagcctatcgccgcttcaacaaaccgagggaaggacctgattggcgtgcagaatctgttaaagaagcatcaagctcttcaagccgagattgctggacacgaacccagaattaaggctgtaactcagaagggcaatgcaatggtggaagagggccactttgcagccgaagatgtaaaagctaaactgcatgaacttaaccaaaagtgggaggccctcaaggcaaaggccagccagcgaaggcaggacctcgaggattctttacaggctcagcagtatttcgctgacgcaaacgaggccgaaagctggatgcgggaaaaggagcccatcgttgggtccacagactacggcaaagatgaggacagtgcagaagccctgttgaagaagcatgaggcccttatgagtgatctaagcgcctacggatcgtcaatccaggccctgcgcgagcaggcccagtcttgtcggcagcaggtggcgcccaccgatgacgaaactggcaaagaactggttcttgctttatacgactaccaggagaagtctcctcgcgaagtgactatgaaaaaaggcgatatcctcacactgcttaattccaccaacaaagattggtggaaggtcgaggtgaacgacagacagggatttgtgcccgctgcctacgtgaagaaactggaccctgcacagtccgcctcacgggagaacctgctggaggagcagggtagcattgcactcaggcaggaacagattgataatcagtaccattctctgttggaactcggagagaagcgcaaagggatgctcgaaaagtcttgcaaaaaatttatgctctttagggaggcgaacgagctgcagcagtggataaatgagaaagaagcagcactgacatcagaggaagtgggcgcagacttggagcaggttgaagtcctgcagaagaaattcgacgacttccaaaaagatcttaaggcaaatgagagtcgactgaaggacatcaataaggtagctgaggaccttgaatcagaaggcttgatggcggaggaagtccaagctgtgcagcagcaggaggtttatgggatgatgccgagagacgagacagatagcaaaaccgcctcaccatggaagtccgcgcgcttgatggtccacaccgtggcgacttttaatagcatcaaggagcttaacgaaaggtggcggtccctgcagcagcttgctgaggagaggagccagctattggggagcgcgcatgaagttcagcggtttcaccgcgacgccgatgagaccaaggagtggattgaagaaaagaatcaggccctaaatacggacaactatggacatgacctggcttccgtgcaggcgctgcagcgtaaacatgagggatttgagcgtgatctcgccgctcttggagataaagtgaattccctgggggaaaccgctgaaagactcattcaatcccaccccgagtccgccgaggacctgcaggagaagtgtacagagctaaaccaggcttggagtagcctagggaagagagctgaccagcgcaaggccaagttgggtgactctcacgatctacaacggttcctgagcgatttccgggatctgatgtcttggatcaacggaatcagaggcttggtttcatctgatgagttggccaaggatgtaaccggggcagaggcactgcttgaacgccatcaagaacatagaaccgagatcgacgcccgcgctggcactttccaagcttttgaacagttcgggcagcaactcttagctcacggacactacgcatcaccggagatcaagcagaaactggacatcttggaccaagagagagcggacctcgagaaggcctgggtccagagacgtatgatgctggatcagtgccttgaactccaactgtttcatcgtgattgcgagcaggctgaaaactggatggccgctcgggaggccttcctgaacaccgaggacaagggcgacagcttggattcagtggaggccctaattaagaagcacgaagatttcgataaggcaatcaacgtgcaggaagagaaaatcgctgctctgcaggcatttgctgaccagcttattgcagcaggacattacgccaagggggatatcagctctcgtcggaatgaggttcttgaccggtggagaagactaaaagctcagatgatcgaaaagcgctccaagctcggagagtcacagacgctgcaacaattctctcgcgatgtcgacgaaattgaagcatggattagcgagaagctgcaaaccgcatcggacgaaagctataaagatcctactaatattcagagcaagcaccagaagcaccaggcgttcgaggcggagctgcacgctaatgccgataggatccggggcgtcatcgacatgggtaacagccttattgaacggggtgcctgcgcaggatccgaggacgccgtgaaagctcgcctggcggctttggctgaccagtggcagtttctggtgcagaaaagcgcagaaaagagccaaaagttaaaagaagctaataagcagcagaattttaacactggaataaaggatttcgacttctggctgtctgaagtggaagccttgctcgcctcggaggactacgggaaggacctggcctcagttaacaaccttctaaagaaacatcagctgctagaagcagacattagcgcccacgaggataggttgaaagatctaaatagccaagcagatagcttgatgacgagctcggcgttcgacacatctcaagtcaaggacaagcgagacacaataaacggaagattccagaagataaaaagtatggcagccagccgccgcgccaaattgaacgagtctcacagattgcatcagttcttcagagatatggatgatgaggaaagctggataaaagagaagaagttactggtaggatccgaagattacggacgtgatttgactggggtccagaatctgaggaagaagcacaaaagactggaagcggaactcgccgcccacgaacccgcaatacagggcgtgctcgataccggaaagaagctctctgatgataacactattggaaaggaggagatccagcagcgcttggcacagttcgtggaacactggaaggagcttaagcagctggccgctgctcggggccagagactggaggagagcctcgagtaccagcagttcgtggcaaatgttgaggaggaggaggcttggatcaatgagaagatgacattggttgcctctgaagactatggtgacaccctcgccgccatccagggattgctcaaaaagcatgaggctttcgaaacggactttacagtccataaagatagagtgaacgatgtgtgcactaatggtcaggatctcatcaagaagaataaccatcacgaggaaaatataagttcaaaaatgaagggtctcaatgggaaggttagcgacctcgagaaagctgctgcccaaaggaaggccaaactggacgagaacagcgctttcttacagttcaattggaaagctgatgtcgtggaaagttggatcggcgagaaggagaactccctgaagacggacgattatggacgggatctaagcagcgtgcaaacccttcttactaagcaggagactttcgatgcaggcctgcaagcgttccagcaagaggggattgctaacattacagccctgaaggaccagctcctagctgcgaagcacgtgcagagtaaggctatcgaagcccgacacgctagtctgatgaaaagatggtcccagctgctggctaattctgctgcaagaaagaagaagctcctggaggctcagtcacacttccggaaggtggaagacttgttcctaacttttgccaaaaaggcttctgcctttaacagttggtttgagaatgccgaagaggatctgactgatccggtacggtgtaattctctggaagaaatcaaggccttgcgagaggcgcacgatgcctttcgcagtagcctcagttctgcacaagctgacttcaatcagctggcagagctcgatagacagatcaaaagttttagggtggcatctaacccttatacctggtttaccatggaggcgcttgaagaaacctggcgcaatttacagaaaattatcaaggagcgggaactcgaactgcagaaggagcaacggcggcaggaggagaacgataagctgcgtcaggagtttgctcagcatgcaaacgccttccaccagtggatccaggaaaccagatgccagcccgccggtgcgtcctgcatggttgaggaatcagggacccttgaaagtcagctggaagctactaaacggaagcaccaggagattcgggccatgcgttcccagcttaaaaaaatcgaagacttgggggccgctatggaagaggccctgatcctggacaacaagtataccgaacacagtaccgttggtctagcgcagcagtgggaccagctcgatcagttgggaatgcggatgcagcacaaccttgagcagcagatccaggccagaaatacaactggggtcacagaggaggctctaaaggagttctccatgatgtttaaacattttgacaaagacaaatcgggaagactgaaccaccaggaattcaagtcctgcctccgctcactcgggtacgatctgcccatggtggaagaaggagagcccgatcccgagttcgaagccatccttgatacagttgatccgaaccgtgacggtcatgttagcctgcaagagtatatggcgtttatgatttcacgcgagacagagaatgtaaaatcatccgaggagatcgaatccgccttccgggcactttcttcagaaggcaagccatacgtgaccaaggaggagttataccaaaatttaacgcgagaacaggccgactactgcgtctcacacatgaagccttacgtggatggcaaaggccgcgagcttccaacagcatttgattacgtggagtttactaggtctctatttgtgaactag

SEQ ID NO: 206689 - DNA, 1485 bp, Artificial Sequence
  Description of Artificial Sequence: Synthetic coding sequence
atggccgccagccggcgggccaagctgaacgagagccaccggctgcaccagttttttcgggatatggatgacgaggagagttggatcaaagagaaaaagctgctggtgggcagcgaggattatggtagggacttgaccggggtgcagaatctacggaaaaaacacaagcggctggaagccgagttagcagcccatgaacctgctatccaaggggttttggataccgggaagaagcttagcgacgataacacgattggcaaggaggagatccagcagcggctagctcagtttgtagagcactggaaggagctgaaacagcttgccgcagctcgcggccagcggctggaggagtctctggaatatcaacagttcgtggctaacgtcgaggaggaggaggcgtggataaacgaaaagatgactttggtggcgtctgaggattatggtgacactttggcggcaattcagggcctgctgaagaagcacgaagcatttgaaacagacttcacagtgcacaaggacagagtgaacgatgtgtgcacaaacggccaggatctcatcaagaaaaacaaccaccacgaagagaatattagctccaagatgaaaggactgaatgggaaggtgagcgaccttgagaaagctgccgcccagcgcaaggctaaactagatgagaattctgcgttcctgcagttcaattggaaggctgacgttgtggagagttggataggggagaaggagaatagtctgaaaaccgatgactacgggagagatttgtcttccgtccagacactgcttactaagcaggaaacatttgacgcaggcctgcaggcgtttcagcaggaaggcatcgccaatataaccgccctgaaggatcaactgctggcagcaaaacatgtccagtcgaaggcaatcgaagcgaggcacgcaagccttatgaaacgctggtcacaactgcttgctaacagtgccgccaggaaaaaaaaactgcttgaagcacagtctcacttccggaaagtggaagatctgttcctgaccttcgctaagaaagctagcgcctttaattcatggttcgaaaacgccgaagaggatctcacggaccctgtccggtgtaacagtctggaagagatcaaagctctgagggaagcccacgatgcctttcgtagcagcttgagttccgcccaagccgactttaaccagctggctgagctggatcggcagattaaatcttttcgagtggccagcaacccgtatacttggtttaccatggaggctttggaagagacgtggaggaacctacagaaaattataaaggaaagggagctggagctgcaaaaggagcagcggcgccaggaagagaatgacaagctgcgccaggagtttgctcagcacgcaaatgcttttcaccagtggattcaggagactcgctgccaacgaaaggatggtcagctgcaaggaggcagagttggagatccccgcattcccgcctag

SEQ ID NO: 206690 - DNA, 7419 bp, Artificial Sequence
  Description of Artificial Sequence: Synthetic coding sequence
atggaccccagcggcgtgaaggtgctggagaccgccgaggacatccaggaacgccgtcagcaggtactggataggtaccaccgctttaaggaactgagtaccctgaggagacagaagctggaagattcatatcgcttccagttttttcagcgagatgctgaggagctcgaaaaatggatacaggagaagctgcagatcgcgtccgatgagaattacaaagatcctaccaacctgcaaggcaaacttcaaaaacaccaggcattcgaggccgaagtgcaggccaattccggcgccatcgttaagctggatgagacgggcaaccttatgataagtgaaggccatttcgcttccgagacgatcagaacgagacttatggagctacaccggcagtgggaactgctgcttgagaagatgagggagaaaggcatcaaactactgcaggcacagaagctagtgcagtatttgagagagtgtgaggacgtgatggactggattaatgataaagaagcgattgttacaagtgaagagttggggcaggacctggaacatgtcgaagtcctgcaaaagaaattcgaggagttccagacagatatggccgctcacgaggagcgggtgaacgaggtgaatcagttcgcggccaagcttattcaagaacaacaccccgaagaagagctaatcaagactaaacaggacgaagtgaatgccgcttggcaacgcttgaaaggactggctctccaacgccaagggaagctgttcggagccgccgaagtccagcgttttaatcgagacgtggacgagactatttcttggatcaaagaaaaggagcagctaatggccagtgacgatttcggccgcgatttggcttctgttcaggcactcctccgcaagcacgagggcctcgagcgtgatctggccgccttggaggataaggtgaaggctctttgtgcagaggcagatagacttcagcaatcccacccgttatccgcgacccagatccaggtgaaaagagaggaactgataaccaactgggagcagataagaactctggctgccgagaggcatgccagactaaacgatagctaccggctgcaaaggtttctggctgacttcagagacttgacaagttgggtgaccgaaatgaaagcgctgattaatgcagacgaactggccagcgacgtcgctggtgctgaggcgcttctggaccgccatcaagagcacaaaggcgaaatcgatgctcacgaagacagtttcaaatccgcggacgaaagtggccaagcgctgcttgctgctggccactacgcatccgacgaggttcgggagaaactcacagttctcagcgaagagagggccgctctcctggaactttgggagctgagaagacagcagtacgaacagtgcatggatctgcagcttttttaccgggacaccgagcaggtcgataattggatgagcaaacaggaggcatttctgctgaacgaggatttaggcgacagtctggatagcgtggaagctctcctgaaaaaacacgaagactttgagaaatccctatccgcgcaggaagagaaaattacggctctcgatgaatttgctactaagcttattcagaataaccattatgccatggaggatgtcgccacaagaagagatgccctgttgtcacgcagaaacgccctccacgagcgtgccatgcggcggcgagcccaattggccgactcatttcacctccagcaattcttcagagactccgatgagttgaaaagctgggtaaacgaaaaaatgaagaccgcaactgacgaagcatacaaagatccctctaacctgcagggaaaagttcagaaacaccaggctttcgaggccgaactctccgcaaatcaatctagaatcgacgctctggaaaaggccggtcaaaagttaatcgatgtgaaccactatgccaaagatgaggttgctgctagaatgaacgaagtaatttctctgtggaaaaagctgctcgaagcgaccgaactgaagggtattaaactcagagaggccaaccaacagcaacagttcaaccgcaatgtggaggacatcgagctctggttatatgaggtcgaaggtcacctggcttctgatgattacggcaaagatctgacaaacgttcaaaacttacagaagaagcacgccctgctcgaagctgacgtcgccgcacatcaggaccggatcgatggcataaccattcaggcacgccaatttcaggacgcagggcattttgacgctgaaaatatcaaaaaaaagcaggaagccttagtcgcccgctatgaggctctgaaggaacccatggtagccagaaagcagaaactcgcggacagtctgcgtctccaacaactatttcgagacgtggaggatgaggaaacttggatccgtgaaaaggaaccgattgccgcaagtactaataggggtaaggatctaatcggcgtacagaaccttcttaagaaacatcaggcactccaggctgaaatagccggacacgagcctcggataaaagctgtaacgcaaaaggggaatgccatggtagaagaagggcacttcgccgccgaggacgtgaaggccaagctacacgagttgaaccagaagtgggaggcattgaaagctaaggccagtcagaggcgtcaggatcttgaagattccctacaggcccagcagtattttgccgatgcgaatgaggccgagagctggatgagagaaaaagagcccatcgtcggcagcaccgactacgggaaagacgaggacagcgcggaagccctgctgaagaagcacgaggcgctcatgagcgacctgtccgcttatggttcatccatccaggctctgagggaacaagctcaaagctgtcggcagcaggtggccccaactgatgacgagacagggaaagagctggttctagctttatacgactaccaggagaagagcccacgggaagtcactatgaaaaagggcgatatccttaccctactcaatagcaccaataaggattggtggaaagttgaggtaaatgaccggcagggattcgtgcctgccgcatacgttaaaaagctcgacccagcacagtctgcatccagggagaacctactggaagaacagggatctattgctctgcgccaggagcagatcgataaccaaactcggattacgaaagaagccggttcagtgagtcttagaatgaagcaagtcgaggagctgtatcactctctgcttgagctcggagaaaagcgaaagggcatgcttgagaagagctgtaaaaagttcatgctttttagagaggccaacgaactgcaacaatggattaacgagaaggaggcggccctgaccagcgaagaagtcggagctgatttggaacaggtcgaggtgctgcagaaaaagtttgacgactttcaaaaggacctaaaagctaatgagtcaagacttaaggacattaacaaagtcgctgaggacctggagtcagaagggctgatggctgaagaggtgcaagctgtgcagcaacaggaagtgtacggcatgatgcccagagacgaaactgactctaagacggcatctccatggaaatccgctcgcctcatggtccatacagtagctaccttcaacagcatcaaggaactcaacgagcgatggcgcagcttgcagcagttggctgaagaaaggtctcagctcctcggcagtgctcacgaagtacagcgcttccaccgagacgccgacgagaccaaggagtggatcgaggaaaagaatcaagccctgaacaccgataattacggacatgacctagcttccgtgcaggctctgcagcgcaagcatgagggctttgaacgagacctggccgccttgggcgataaggtcaattcactgggcgagaccgccgagcgacttatccagagtcatcccgagtcggccgaagacctgcaggagaagtgcacagagctgaatcaagcctggtccagcctaggcaagcgcgcagatcaaagaaaagctaagctcggggattctcacgacttacaaagatttctgtcggatttcagggacctgatgagttggatcaatgggatacggggactcgtgtctagcgatgagttggccaaggacgtaaccggcgctgaagcgctgctcgagaggcatcaagagcataggaccgagatcgatgccagggcgggcacctttcaggcttttgagcaattcggacagcagttgctcgcccacgggcactacgcgagtcctgagatcaagcaaaagttagacatactggaccaggagcgcgcagatctagagaaggcttgggtccagaggcgcatgatgctggaccagtgcctcgagctgcagttatttcaccgcgattgtgagcaggctgagaactggatggctgccagagaggcattcctaaacaccgaggacaagggtgattccctggacagtgtagaggccctgattaagaaacatgaggatttcgacaaggcaattaacgtccaggaggagaaaatcgcagccttgcaggcgtttgccgatcagcttatagccgccgggcattatgcgaagggcgatattagcagcaggcgcaatgaggtgcttgatcggtggcgacgactcaaggcccagatgattgagaaacgctctaagttaggtgagagccaaacactccagcagtttagtagggatgtggatgagatcgaggcttggatctctgagaaactgcagaccgcgtctgacgaaagttacaaggatcccaccaacatccagtctaaacatcagaaacaccaagccttcgaagcagaactgcatgccaatgctgatagaattcgcggagtcattgatatggggaactccttgatcgaacgaggggcatgcgctgggagtgaagatgccgtgaaggccaggctggccgcactcgctgaccagtggcagtttctcgtgcagaagagcgcagagaagagtcagaagttaaaggaagccaacaaacagcagaatttcaatacaggcataaaagactttgacttctggctgtctgaggtcgaggccctcctggcaagtgaggattatggaaaagacctggccagtgtgaataatttgctgaagaaacatcagttgctggaagcagacatctcggcccatgaggaccggcttaaagacctgaatagccaggcggacagcttgatgacttcttcagctttcgacacgtcgcaggtcaaggacaagcgggacacaattaacgggagattccaaaagattaagagcatggcagcgtcccgccgcgcgaagctcaacgagtcacaccgattacatcagttcttcagggacatggacgatgaggaaagctggatcaaggaaaagaaacttctggtgggatcagaagactatggccgcgaccttacgggagtccagaacctccgcaaaaagcataagcggctggaagccgagctcgctgcccatgaacctgccatccagggtgtgttggacaccgggaaaaagctcagtgatgataatactatcggtaaagaggagatccagcagcggcttgctcaattcgtagagcactggaaagaactgaagcaacttgcagccgctagaggccagcggctggaggagtctctggagtaccagcagtttgtggcaaacgtggaggaggaggaggcttggattaacgagaagatgacgttagtggccagcgaggactatggcgatactctggcagccatccagggcctgttgaagaagcacgaggccttcgagaccgattttaccgttcacaaggatcgagtgaatgatgtgtgcaccaatggacaggacttgatcaagaagaacaatcaccacgaggagaatatttcctctaagatgaagggcctcaacggcaaggtgtctgacttagagaaggcagcagcccagcgtaaagcaaaactggacgagaactctgcatttcttcagttcaactggaaggcggatgtagtggagagttggattggcgaaaaagagaatagtctcaagacagatgattacggcagagatctgagtagcgtgcagacactgttgacaaagcaggaaaccttcgacgccggtttgcaggcttttcagcaagagggcattgctaacatcactgcgttgaaagaccagctgttggcagcaaagcacgtccagtcaaaggccatcgaggctcgtcacgcgtccttgatgaaacgatggtcccagttactagccaattccgctgccagaaagaagaagctactcgaggcgcagagccactttcggaaagtagaagacctttttcttaccttcgccaaaaaggcgtccgcttttaatagttggtttgaaaacgcagaagaagacctgaccgatcccgtcagatgtaattcattagaagaaatcaaggccttgcgtgaggctcatgacgcatttaggtcgagcctgagcagcgcccaggccgattttaatcagctcgcagagctggatcgccagatcaagtccttccgggtcgctagtaacccttacacttggttcactatggaggcccttgaggagacctggcgtaacttgcagaagatcattaaggagagggaactggaattgcagaaggaacagcgcaggcaagaagagaatgacaagctccgtcaagagttcgcacagcatgctaacgcgtttcaccaatggatacaggagaccagaacctacctgcttgacggcagctgtatggtggaagaaagcggcacgctggaaagtcagttggaggctaccaaaagaaagcaccaggagatccgggccatgaggtcacagctgaaaaagatagaagacctgggtgcagccatggaggaagcgttgattctggataataaatatacggaacactcaacagtcggactggcacagcagtgggaccagctcgaccagctcgggatgcgaatgcagcacaacttggagcagcaaattcaggcaaggaatacaacaggggtaacagaggaagcactcaaggagttctctatgatgtttaaacactttgataaagataagtctggccgcctcaatcatcaggagttcaagtcctgtctacgctcattgggctatgatctgccaatggtggaggagggtgaacccgacccagagtttgaagccattttagataccgtggatccaaacagggacggtcatgtgtccctgcaggaatatatggcttttatgatctccagagaaacagagaatgttaagtcaagtgaggagattgaaagcgcttttagagctttgagtagcgaggggaagccatatgtgaccaaagaagagctttaccaaaatctcacccgcgaacaggccgattattgtgtgtcccatatgaaaccttacgttgatgggaaggggagggaactacccactgctttcgattacgtggaattcacgcgttcactctttgttaattag

SEQ ID NO: 206691 - DNA, 7434 bp, Artificial Sequence
  Description of Artificial Sequence: Synthetic coding sequence
atggaccccagcggcgtgaaggtgctggagaccgccgaggacatccaggagcggcggcagcaggtgctagatagataccataggttcaaggaactctccactctaaggagacagaaactcgaggacagctatcgtttccaattctttcaacgcgatgctgaagagctggagaaatggatccaggagaaactgcaaatcgccagtgatgagaactacaaggaccccacgaatttacagggcaagctccagaagcatcaagcattcgaggctgaggtgcaagctaattcgggagccattgttaaactcgacgagacagggaatctcatgatatccgagggtcatttcgcctccgagaccatccgaactcgactcatggagctgcatcggcagtgggagctcttgctggaaaaaatgcgcgagaagggaatcaaactcctgcaggcacagaaattggtgcagtacctgagagagtgcgaagacgtgatggactggatcaacgacaaagaggcaatagtgacttcggaggaactcggccaggatctggagcatgtcgaagtactgcagaagaagttcgaagagtttcaaactgatatggcagcccatgaagagcgcgtgaatgaagtgaaccaattcgctgccaagctgattcaggagcagcacccagaggaagagctgatcaagactaaacaggacgaggttaatgcagcttggcaacgcctaaagggactggcactgcagaggcaagggaaactgttcggcgcagcggaggtgcagcgcttcaaccgtgatgtagatgaaacaatcagctggattaaagagaaagagcagctcatggcctctgatgattttggcagagatctggctagcgtgcaagccctgctgagaaaacacgaaggacttgaacgggaccttgctgcgcttgaggacaaggtaaaagctctctgcgcagaagctgaccgcttgcagcagagtcacccactgagtgcgacacagatccaagtaaagagggaagagctcatcactaattgggagcagatccgcaccctggccgccgagagacacgctagactgaacgattcatacaggttacagaggttcttggctgattttagagatcttacttcatgggtaacggaaatgaaagctctcattaacgctgacgagttggcctcagatgtagctggcgccgaggccctgctggacaggcaccaggagcacaagggagagattgatgctcacgaagacagcttcaaaagcgccgacgagtccgggcaggctctcctggccgccggccattacgccagcgacgaggtacgtgaaaagctgactgtgctttctgaggaacgcgccgcactcttggaactgtgggagctgcgccggcagcagtatgagcagtgcatggacctgcagttattctatagagataccgagcaagttgacaactggatgtctaaacaggaggccttcttgctgaacgaggatctaggagatagtcttgattcagtcgaggcactccttaagaagcacgaagactttgaaaagtcactatccgcacaggaggagaagataaccgccctcgacgagtttgccacaaagctgatccagaataatcactatgctatggaggatgtggctacacgccgcgacgccttactttccaggcgcaatgctctccacgagagggctatgcgaaggagggctcagcttgctgactcttttcacctgcagcagttttttagggacagcgatgagctgaagagctgggtgaacgaaaagatgaagacagctaccgacgaggcatataaagacccctccaacctccagggaaaggtgcaaaagcaccaggcgttcgaagctgagctgtctgcaaatcagtctcggattgacgctttggaaaaagccggtcaaaaactcatcgacgtgaaccactacgcaaaggacgaagttgcagcaagaatgaacgaggtgatctcactgtggaaaaagctcctggaggcaaccgagttgaaaggcatcaaactccgtgaagcgaaccagcagcaacagtttaaccgcaacgtggaggacattgaactctggttgtacgaagtggaaggtcatttagcaagcgacgattatggaaaggatctgacaaacgtgcagaatctccaaaagaaacacgctctactcgaagctgacgtcgctgcacaccaggatcgcatagatgggataactatacaggcccgacagtttcaagacgcaggccactttgatgccgagaacatcaaaaagaaacaggaagccctggtggccagatacgaggccttgaaggagcccatggtggctagaaaacagaagctggccgactctctgaggctacagcagctgttccgcgatgtggaagacgaggagacgtggatcagagaaaaggagcccatagccgcatcaaccaaccgtggtaaggatttgatcggagtccagaacctgctgaaaaagcaccaggcacttcaggccgaaatagccggtcacgagcctcgaataaaagccgtcacacagaaaggaaacgcgatggttgaagaagggcatttcgcagctgaagacgtgaaagccaagttacacgagctcaatcagaaatgggaggccctgaaggccaaagcctcacaacgacggcaggaccttgaggatagcctgcaagcacagcagtacttcgcggacgctaatgaagccgagagctggatgcgagagaaggagccaatcgtgggaagtactgactatgggaaggatgaggacagcgccgaggcccttctgaaaaagcatgaggcgctaatgagtgacctatctgcttacggcagcagtatccaggcccttcgggagcaggcccaatcatgtcgccagcaggtggcccccacagacgatgaaaccggtaaggagctcgtgctggccctgtacgattatcaggaaaagagccctagagaggtgacaatgaagaagggagatatactgactcttctgaatagcactaataaggattggtggaaggtggaagtcaacgaccggcaaggttttgtgccggccgcatatgtgaagaagttggaccccgctcagagcgccagccgggaaaacctcttggaggagcaggggagcattgcgctgcgacaggaacagattgataatcagactcgaattacaaaagaggcggggagcgtctcccttcgcatgaaacaggttgaagagttgtatcattcgttgctggaactgggcgagaagaggaagggcatgcttgaaaagtcttgtaaaaagtttatgctcttccgcgaagcaaacgagctccagcaatggatcaacgagaaggaggccgcacttacgagcgaagaggtgggagccgatctggagcaggtggaggtgctgcagaagaaatttgatgacttccagaaggatttaaaagccaacgagtcgcgcctaaaggacatcaacaaggtggctgaagacctcgagtccgaaggtttgatggccgaggaagttcaggctgttcagcagcaagaggtgtatggaatgatgccacgggatgaaaccgactctaagactgcatctccctggaagtcagcccgtctaatggtgcacaccgtcgccacattcaatagtattaaggagcttaacgagcgctggcggagcttacaacagctcgccgaggagagatcccagcttttaggaagcgcccacgaggtgcagcgcttccacagggacgccgacgagactaaagagtggattgaggaaaagaaccaagctctcaacacagacaactatggacacgatttagcctccgttcaggcattacagaggaaacacgaggggttcgaacgtgatcttgctgccctcggtgataaagtgaactcattgggggaaacagcagaacggctaatccagtctcacccagaatccgctgaagatctccaggagaagtgtacagaacttaatcaggcctggagttccttgggaaagcgtgctgaccagcgtaaggctaagctgggcgacagccacgacctccagcgcttcctctccgatttccgcgacctcatgtcgtggatcaacggcatccgcgggttggtatcaagcgacgaattggcaaaggatgtgacgggggcggaagctttgctagaacggcaccaagaacatcgcactgagattgatgcacgcgccgggacgtttcaggcgtttgagcagttcggacagcagcttctggctcacggccattatgcgagccctgagatcaagcagaagctggacattttggaccaggagcgggcagatctggagaaagcttgggtgcagagacgcatgatgttagatcagtgtttagagctgcagctcttccacagagactgtgagcaggctgagaattggatggcggcccgcgaggcctttctaaatactgaagacaaaggcgacagtttggacagtgtggaagcactaattaaaaaacacgaggacttcgataaagccatcaacgtccaggaggagaagattgcagctttgcaggccttcgccgatcagcttatcgctgccggtcactatgccaaaggggatatttctagccgtcgtaatgaagtgctagatagatggagaagactcaaggcacaaatgattgagaagcgctcgaagctaggagagtctcagactctgcagcaattttctcgggacgtggatgagatcgaggcttggatcagtgagaaactccagacagcaagcgatgagtcatataaagaccccactaacatccaacttagtaagctactgagtaagcatcagaaacaccaagcatttgaggcagagcttcacgccaacgctgatcgcattcgaggtgttatcgatatggggaatagcttaatagagcggggggcatgtgccggctctgaggatgctgtgaaagcccggttggcagcactggctgaccagtggcaatttctggtccaaaaatcagccgaaaagtcccaaaaactaaaagaagccaacaaacagcaaaatttcaatacagggatcaaggacttcgacttttggctcagtgaagtggaggctctgttggctagcgaggactatggcaaagatctggcctcagtgaacaatctgcttaagaaacaccagctcctcgaggcagacatctcggcccatgaggaccgcctgaaagacttgaacagtcaggctgactcactgatgacttcaagtgcttttgacacgtcacaggttaaagacaaaagagacacgattaatgggcgatttcaaaagattaagtctatggctgcttctagacgagccaagctgaacgagtctcataggctgcatcagtttttccgagatatggacgacgaggagtcttggattaaggaaaagaagctgctcgtcgggtcagaagattatggcagggatctgacgggtgtgcaaaacctacggaagaaacacaaaaggcttgaggcagaactggcagcacacgagccagccatccaaggtgttctggataccggcaaaaagctatcagatgacaatacaattggtaaagaggagatccagcagcgacttgcacagtttgtggaacattggaaagagcttaagcagctggccgcggcccgaggccagagactcgaggagagcttggagtaccagcagtttgtggcaaatgtggaagaagaggaggcgtggatcaatgagaagatgaccctggtggcctccgaagactacggagataccctcgccgccatacagggattgctaaagaagcacgaggccttcgagacagactttacggtgcacaaggatcgagttaatgatgtgtgcacaaatggtcaagatctgattaagaagaacaaccaccacgaagagaacattagtagcaaaatgaaaggcctgaatggaaaagtgagtgatctcgaaaaagcagccgcccagaggaaagccaagttagatgaaaattccgctttcctgcaatttaattggaaagcagacgtggtagagtcttggatcggtgaaaaggaaaattcccttaaaactgatgactatggcagagatctgagctcagtacaaactctgttgacaaaacaggagacgtttgacgcgggcctccaagcgtttcagcaagagggaatcgccaatataacagccctcaaggaccaactccttgctgcaaaacatgtgcagtctaaggccattgaagctagacatgcaagtctcatgaagagatggagccaacttctagcgaacagcgcagcaaggaaaaagaaactgctagaggcacagagccatttccgaaaagtagaggatctttttctgacttttgctaagaaggcatctgcattcaactcatggtttgaaaatgccgaggaggatctgacagatcctgtccgctgtaattctcttgaagaaattaaggcattgcgcgaagcacatgacgcgttccgttctagcctctcttcagcccaggccgactttaaccagctcgctgagctggaccgtcagattaagtcatttcgggtagctagcaatccttatacctggttcaccatggaggctttagaggaaacatggcgaaacctccagaagattatcaaggagcgggagctagagctacaaaaagagcagcgcaggcaagaggaaaatgataaacttagacaagaatttgctcagcatgccaacgcttttcaccagtggatccaggagacccgaacttaccttctcgacggatcttgcatggtcgaggaatccgggaccctagagagtcagctggaagcgacaaagcgaaaacatcaagaaatccgagcaatgcggagccaacttaagaagatcgaggatctcggcgctgccatggaagaggcgcttatcctggacaacaagtacacggagcacagcacggtaggactcgctcagcagtgggaccagctcgaccagttaggtatgaggatgcagcataatctggagcagcagatccaggcacggaatactacaggcgtgaccgaggaggcactgaaagagttttcgatgatgtttaagcacttcgataaagataagagcggcagactgaaccaccaggaattcaagagttgccttcgctccctgggttatgatctgcccatggtggaagaaggggagcccgatccagagttcgaggccattttggacaccgtcgaccctaaccgcgacggacacgtcagtttgcaggagtacatggcatttatgatttctcgagagaccgagaacgtaaagagttccgaggagatcgaatccgccttcagagccctgtctagtgaagggaaaccatatgtgacaaaagaagagctctaccagaatctcacgcgcgagcaggcggactactgcgtttctcatatgaagccctacgtggacgggaagggccgcgagttgcccacagcgttcgattacgttgagttcactaggtctctcttcgtaaattag

SEQ ID NO: 206692 - DNA, 3444 bp, Artificial Sequence
  Description of Artificial Sequence: Synthetic coding sequence
atggagaacaaccgggacaaggtgctgagccccgtggacagcggcaacaaattagtcgcagagggcaacctatactctgataagattaaggagaaggtacagctcatagaggatcgccacagaaaaaataatgagaaggctcaggaggcgtcagtgctgctgcgggataacctcgaactccagaactttctgcagaattgtcaagagcttactttgtggatcaacgacaaattgcttacttctcaggatgttagttacgacgaggctcggaacctgcacaacaagtggctgaaacatcaagcttttgttgccgagctggcctcccacgaaggttggctcgagaatattgatgccgaaggaaaacaacttatggatgagaagcctcagttcaccgctctagtttctcaaaaactggaggctttgcaccgactgtgggacgagctccaggccaccactaaagagaagacccaacacctgtccgcagcaagatcctcagaccttcggctgcagacccacgccgaccttaataaatggatttcggccatggaagaccagcttagaagcgacgacccgggaaaagacctcaccagcgtgaaccgcatgctcgctaagctcaagcgcgtggaagaccaagttaatgttcgtaaagaggaattgggggagctgttcgctcaggtgccatcgatgggcgaagagggtggcgatgcagaccttagtatcgagaagaggtttcttgatctgttagaacctttagggcgccgtaagaagcagttggaatcatcccgtgctaaactgcaaatatcaagagacttagaggatgaaacgttatgggtagaggagcggttacccctggctcaatccgccgactatggaactaatctccaaaccgtgcaactatttatgaagaagaatcagacactgcagaacgagattttgggccacacgcccagggtggaggacgttttgcagcggggtcaacagctcgtggaagcggccgaaatcgattgccaggacctggaagagagactggggcacctgcagtcttcgtgggaccgcctaagggaagccgcggcagggaggctccaacgactgcgtgatgccaacgaagcccagcagtattatttagatgctgacgaagcagaagcctggatcggcgaacaggagctttacgtgatcagtgacgaaattcctaaggacgaggaaggcgcaattgtgatgttaaagaggcacttacgacagcagagggcagtggaagattatggaaggaacattaaacaacttgccagtcgggcccagggcctgctgtccgccgggcacccagaaggggagcaaatcattcggctacagggacaagttgataagcactacgccggactgaaagatgtagcggaggaacgtaagcgcaaattggaaaatatgtaccacctcttccagctcaagcgcgagacagacgatctggagcaatggatatctgagaaggaactcgttgccagcagccctgaaatgggccaagattttgatcatgtcacccttttgagagataaatttagagattttgcaagggaaaccggcgccatcgggcaagagagagtggataacgtgaacgcatttattgaaagacttattgatgcaggacatagcgaggccgcaacaattgccgaatggaaggatggcttgaatgaaatgtgggcagacctcctggaactgatagatacccggatgcagttactcgcagcgagctatgacctgcaccggtatttttatacaggcgccgaaatcctgggccttattgacgagaagcacagggaactgcctgaggacgtgggacttgatgccagcacagctgagtctttccatagggtgcatacagcatttgagcgggaattgcacctgcttggagtccaggttcagcagtttcaagatgtggccacccgcctgcagaccgcttacgcaggggagaaggccgaggctatacagaacaaagagcaagaggtgagcgctgcttggcaggctcttctcgacgcctgtgccggtcggcgcacacagctggttgacaccgccgacaaatttcgtttcttctcaatggccagagacttgctcagctggatggaaagtattatccggcaaattgagactcaggaacggccccgggacgtctcctcagtcgagctgcttatgaagtaccaccagggcataaacgccgagatcgagacaaggagtaaaaacttcagtgcttgtttggaactcggtgaatctctgctgcagagacagcatcaggcttccgaggaaattcgcgagaaactgcaacaggtaatgtccaggcggaaagagatgaacgagaaatgggaagcccgttgggaacgcttaagaatgcttcttgaagtctgccaattcagcagagacgcaagtgttgctgaggcatggttgatcgcacaggaaccttatctcgcaagcggagattttggacacacggttgactccgttgagaagctgattaaacgacacgaggcctttgagaagagcaccgcctcgtgggcggaacgtttcgccgctctggagaagcccaccacccttgagttgaaagaaaggcagatcgcagaacgtccagccgaagagaccgggccgcaggaagaagagggtgagactgccggggaagcaccggtctcacatcacgcagcgacagaaaggacatcgcctggagaggaggaaggcacctggccgcaaaacctgcagcaaccgccaccacccggccagcacaaagatggacaaaaatcaactggcgacgaaagacccactacagaacctttgtttaaggtcctagacacacccttgtctgagggtgatgagcccgctactttgccggcgccccgggatcacggtcaatctgttcagatggaaggctacctgggacgtaagcatgacctggaggggcctaacaaaaaggcttccaactccaaaggagaggaaggtgaggagcgtcgtgagaccgaagaagaggacgaagaagaagaggagacagagtcagtcgccgtggaaatgcaacagcacgcaagccacgtgtcctggaataatctgtactgtgttctgcgcaattccgagcttaccttttacaaggatgcaaagaacctcgcactgggcatgccatatcacggggaagagccgctggctctccgacacgcaatttgcgaaatcgctgcaaattataagaagaagaagcacgtgttcaagttacggctctccaatggatccgagtggctattccatgggaaagatgaggaagaaatgctgtcctggctccaaggagtaagcacagccattaacgaaagccaatccatcagggtcaaggctcagagcctccctctcccttctctctctggcccagacgcatctttaggcaagaaagataaggaaaaacgcttcagctttttcccaaaaaagaagtag

SEQ ID NO: 206693 - DNA, 6321 bp, Artificial Sequence
  Description of Artificial Sequence: Synthetic coding sequence
atgaccagcgccaccgagttcgagaacgtgggcaaccagcccccctattctaggatcaatgccagatgggatgccccggacgacgaactggacaacgacaactcttctgcccggctgtttgaacgaagtaggataaaagctctggccgacgagagagaagtggtgcagaaaaagacgttcactaagtgggttaattcccacctcgcacgtgtctcatgtcggattaccgatctttacaaagacttgcgagacgggcggatgctaatcaaattacttgaggtgctttctggagaaatgctgcctaagccaaccaaaggcaaaatgagaatccactgcttggaaaatgtcgacaaggctcttcaattcctgaaagagcaacgcgtacacttggagaacatgggctcccacgacatcgtggacggcaaccaccgccttgtattgggactcatttggactatcatcttgcgtttccagatccaggacatcgtcgtgcaaacccaagaggggagggagacccgatctgctaaggacgcactgctgctgtggtgccagatgaaaacggccggttatccgcacgtaaacgtgaccaattttacgtcttcctggaaagatggcttggccttcaatgcgttgatccacaaacaccgccctgatctgatcgactttgacaagctcaaggatagcaatgctagacataacctcgaacacgccttcaatgtagccgaacggcagcttgggatcatcccgttgctggatcccgaagacgtctttacagagaatcctgacgaaaagagcataatcacgtatgtggtcgcattttatcactatttcagcaagatgaaggtactggccgtggaaggaaagcgtgtcggcaaagtgatcgaccatgcaatcgagaccgagaagatgatcgagaagtactccggtttggccagcgatctgttgacctggattgaacagaccattacagtgctgaacagcaggaagtttgccaattctctgacaggcgtacagcagcagcttcaggcattcagtacctatcggaccgttgaaaagcctcctaagttccaggagaagggaaatttggaggttctcctttttaccattcaatcacgcatgagggcgaataatcagaaagtgtatacgccacacgacggcaaacttgtgtcagatatcaatagggcatgggaatccctcgaggaggccgagtaccggcgagaactggctttgagaaatgaactgattaggcaggaaaaactcgagcagttggctaggaggttcgaccgtaaggcggccatgcgggaaacttggctctccgaaaatcagcgactcgtggcccaggataattttggctacgacctagccgctgttgaggcagccaagaagaaacacgaggctatagaaaccgacactgccgcatacgaggagagagttagagcccttgaggacctcgcccaggaattggaaaaagaaaactaccacgaccagaagcgtatcaccgctcgtaaggacaacattctgcgtttgtggagctaccttcaggaactcctgcaatcccggcgccaaagactggaaacgacactagctttgcagaaactcttccaagacatgcttcattctatagattggatggatgagataaaggctcatctgctgtcagccgagttcggcaagcacttactggaggttgaagacctgctccagaagcacaagctgatggaggccgacatcgctattcagggagacaaggtcaaagccattacggcggccacactcaagtttaccgaggggaagggataccagccctgtgatccccaggtgattcaagatcggattagccacctggagcagtgctttgaggaactgagcaacatggctgcgggccgcaaggcacagctggagcagagcaaacgactgtggaaattcttctgggaaatggatgaggctgaatcctggattaaggaaaaggaacagatctacagtagccttgattacgggaaggacctcacctctgtgctaatccttcagagaaaacataaagcatttgaggatgaactcaggggtctcgatgcccatttggagcagatctttcaggaggcacacgggatggtggcaagaaaacagttcgggcatccccagattgaagcccggattaaggaagtttccgcacagtgggaccaactcaaagacctggctgccttctgcaagaagaacctccaggacgccgaaaacttctttcagtttcagggtgatgcagacgacttaaaggcctggctacaggacgctcacaggctcctctctggtgaagatgtcggccaggacgaaggtgccactagagcattaggcaaaaagcacaaggactttctcgaggaactagaagaatctaggggtgtgatggaacatctggagcagcaggcacaaggatttcccgaagaatttcgcgattcccctgatgtcacccacaggcttcaagcactgcgcgaactgtatcagcaggtagtggcgcaggccgacctccgccagcagagattgcaggaagccttggatctttatactgtgtttggggaaacggacgcctgcgaactgtggatgggagagaaagaaaaatggctggctgagatggaaatgcctgacactcttgaggacctggaggtagtccagcaccggttcgacatactggaccaagaaatgaagacactgatgactcaaattgacggagtgaacttggcagccaacagtcttgtcgagagcggccaccctcgctctagagaggtgaaacagtaccaggaccatctgaatacacggtggcaggctttccagacactcgtgtcagagaggcgagaagctgtcgacagcgccctgcgcgtgcacaactattgcgtggactgcgaggagacctctaagtggatcactgataaaaccaaagtggtcgaaagcacaaaagatctaggtcgcgacctggctggaattattgccatccagagaaagctgtccggcctggaacgggatgtagcagcaatacaagcaagagtggacgccctcgaaagagagtcccagcaattaatggattcccacccggaacagaaggaagacattggtcagcgacagaagcatctagaggagctatggcagggcctgcagcagagcctgcaaggacaggaagatctcctcggtgaggtttcacagctgcaggcctttttacaggatctggatgatttccaggcatggctttctataacccagaaggcggttgctagtgaagacatgcccgagtccctgcccgaggctgaacaacttctgcagcagcatgccgggattaaggatgagatcgatggccaccaggactcttaccagcgagtcaaggagtccggtgagaaagtaatccaaggccagactgacccagagtatctgcttttgggccagaggctggagggactcgatactggctggaatgctttggggcgtatgtgggagagccgctcccatacattagcccagtgtcttgggtttcaggagttccagaaagacgccaagcaagctgaagctatcctgtcgaaccaggagtacacattggcacacctcgaacctcccgattcattagaagcagccgaggccggaatccgtaagtttgaggactttctcgggtcaatggaaaataacagggacaaggtcctgagccctgtggacagcggcaataaactcgtggccgagggtaacctgtattcagataagatcaaggagaaggtccagctgattgaagataggcatcggaaaaacaatgaaaaagcacaggaggcaagtgtccttttacgcgataacctggagctgcagaacttcttgcagaattgccaagaactaacactctggataaacgataagctactgacctcccaagacgtgtcctatgatgaggcccgtaatctacacaataagtggcttaaacaccaggcttttgtggccgaactggcttcacatgagggctggttagaaaatattgatgccgagggaaaacagctgatggacgaaaagcctcagtttactgccttagtgtcgcagaaacttgaagccctgcaccgcctctgggacgaattgcaggctacaaccaaagaaaagacccagcatctttccgccgctcgctcttccgacctccggttgcagactcatgcagacttaaacaaatggatttctgcaatggaagatcagctgcgatctgacgacccaggtaaagacctaacttccgtcaaccgtatgctggccaagctcaagcgggtagaggaccaggtgaacgtcaggaaagaagagttaggggagctcttcgctcaggtcccctctatgggagaggaggggggcgatgccgacctgtccattgagaaaagattcctggatcttctcgaacccttgggcaggcggaagaagcaactggaatcgagccgcgccaagctccagatttccagagatctggaagacgaaaccttgtgggttgaggagaggcttcccctcgcacagtcagccgattatggaactaacctccagacggttcagctgttcatgaagaagaatcagactctacagaatgagatactgggtcatacccctcgggtggaagacgtgctgcagcggggccaacagctggtagaggcggcagagatcgactgccaggacctggaggaacgcctggggcatctgcagagctcgtgggacagattaagggaggccgccgcggggcggttgcagcgactgcgcgatgctaatgaggctcaacagtattatttggacgcggacgaagcagaggcatggattggtgagcaggagctttatgtgattagcgatgagatacccaaagatgaggagggggccatcgtaatgttaaaacggcatctaagacagcaacgggccgtcgaggattatggcagaaatattaagcagctcgcctcccgagcacagggtcttttgtccgccggccaccctgaaggtgagcagattatcagacttcagggccaggtggataagcattatgctgggctgaaagacgttgccgaggagcggaaaagaaaattagagaatatgtaccatctgttccaattaaagcgcgagaccgatgacttagagcagtggatcagcgagaaggaactagtggcaagcagccctgagatggggcaggacttcgaccatgtgaccctgttgcgggacaagtttagggacttcgctcgagaaactggggcaattggccaggagagggtcgataacgttaatgcttttatcgaaaggctgatcgatgccggccattcggaggcggccaccatcgccgaatggaaggatggattaaacgaaatgtgggcagacctgttggagttgatcgacacacgaatgcagttactggctgcgagttacgaccttcacaggtacttctacacaggtgccgagattttagggctgatcgacgaaaaacatagagagctgcctgaagatgtcggtttggacgctagcacagcggagtcctttcaccgggttcacacagctttcgagagggagcttcaccttcttggcgttcaggttcagcaattccaagatgtggctactaggctgcagaccgcttacgctggggaaaaggccgaggccatccagaataaggagcaggaagtgagcgcggcttggcaagctctactcgacgcctgtgccggccgtcggacgcagttagtcgataccgctgacaagtttaggttcttctcgatggcacgggatctcctcagctggatggagtccattatacgtcagattgagactcaggagaggccgagagacgtttcatccgtggagcttctgatgaaataccaccaaggcataaacgccgagatcgaaaccagatctaagaatttctctgcctgcttggaactgggggaatccttgctgcaaaggcagcaccaagcgtccgaggagattagagagaaattacagcaggtgatgagtcgcagaaaagagatgaacgagaagtgggaggcccggtgggagcgactccggatgctgctggaagtgtgtcagttcagccgcgacgcctctgttgcagaggcgtggctgatcgcccaggagccctacttggcatccggtgattttggtcataccgttgattcagtggaaaagttgattaagcgtcacgaggccttcgaaaagtccacagccagctgggccgagcgcttcgccgccctcgagaagccaactaccgcttctagaggagggcgccgcgattcccgggggggatccagctttcccccctgcggccatcgcgagaacgtgcctggtcagtccttagtgtcctttgtgtag

SEQ ID NO: 206694 - DNA, 6414 bp, Artificial Sequence
  Description of Artificial Sequence: Synthetic coding sequence
atgaccagcgccaccgagttcgagaacgtgggcaaccagcccccctacagccgtattaatgcacgatgggacgcacccgatgatgagcttgacaatgataactcttctgcccgcctgtttgagcggtcacgcattaaagcacttgctgacgaaagagaggtggttcagaagaaaacgttcactaaatgggtcaactctcaccttgcgcgggtatcatgtaggatcaccgatctgtataaagatttacgggatggcagaatgcttattaaacttctggaagtgctgagcggggagatgctgccgaagccaacaaaggggaaaatgcggatacactgcctggagaatgtcgacaaagccctgcagttccttaaggaacagagagtgcacctggagaatatgggtagtcacgacattgtggacgggaaccacaggttggttctgggcctgatttggaccattattctgagatttcagattcaggatatagtggtacagacccaggagggacgggagaccagaagtgctaaagatgcactcctgctgtggtgccaaatgaagaccgcaggctatccccacgtaaatgtcacaaatttcacctcctcctggaaggacggtctggcttttaacgccctgatccacaagcatcgacccgatctgatcgattttgataaactgaaagacagcaatgctaggcataacctggagcatgcgtttaacgtggcggagaggcagcttggaatcattcctctgctggatcccgaggatgtctttaccgagaatcctgatgagaaaagcattattacttacgtcgtggcattttaccactacttttccaagatgaaggtgctcgccgttgagggcaagagagtcgggaaagtcatcgatcacgcgatagaaacggagaagatgatagaaaagtattcagggttggcctccgatttactcacctggatagagcaaactattaccgttcttaatagccgaaaatttgctaattctctaacgggggtgcagcagcaattgcaggcattttccacataccggacagtggaaaagcctccaaaattccaggagaagggcaaccttgaagtgttactgtttaccattcaatctcgaatgagagcgaataatcagaaggtttacaccccccacgacggcaagctcgtgtcagatatcaacagagcttgggagagtctggaagaagccgaataccgaagggagctggctctccgaaatgaactgattagacaggagaagctagaacagctggccagacgattcgaccggaaagccgccatgagagagacatggctgagcgagaaccagcgactggtggctcaagacaactttggatatgatctggcagcagtcgaggcggccaaaaagaaacacgaggccatcgaaactgacactgccgcctacgaagagagagttcgcgctctggaggacctggcccaggaactggagaaagaaaactatcacgaccagaaacgcattaccgccaggaaggacaatatcctcaggctgtggagctacctgcaggaactcctgcagagtcgacgacaacgtctggaaactacacttgccctgcaaaagttattccaggatatgctccactcgattgactggatggacgaaataaaagctcaccttctctctgcagagtttgggaaacaccttcttgaggtcgaagatctactgcagaagcacaaacttatggaggccgatatcgccatacagggtgataaggtgaaggcaattacagcagcgaccctcaaattcactgagggcaaaggataccagccatgcgaccctcaagtcatccaggaccgcataagccatctcgagcagtgttttgaggaattgagcaatatggccgccggcaggaaggctcagctggagcagtcaaagagactatggaagttcttttgggagatggatgaagccgaaagctggataaaagagaaagagcagatctattcgtccctagactatgggaaagatctgacgagtgtgctgatattgcagagaaaacataaagcttttgaggacgagcttagaggattggacgcacacctggagcaaatcttccaagaggcccatggcatggtcgcgcggaaacagttcggccatcctcaaattgaggccagaattaaagaagtgtccgcccagtgggatcagctcaaagatttagctgctttttgtaagaaaaatctgcaggacgccgagaattttttccagtttcagggcgacgccgatgatttgaaagcttggctgcaggatgcgcaccgattgctaagtggagaggacgtaggccaagacgagggggccactagagcattaggcaagaagcacaaggatttcctcgaagaacttgaagaatctcggggggttatggagcacctggagcagcaggcccagggctttccggaagagtttagagactccccggacgtaacacaccggcttcaggccttgagagaactctatcagcaggttgtggcacaagcagatctgcgccagcagcggcttcaagaagccctggatttgtatacagtgttcggggaaaccgacgcctgtgagctgtggatgggggagaaagagaagtggcttgccgagatggaaatgcctgataccttggaggacctagaggtggtccagcaccggttcgatatcctggatcaggagatgaagaccctgatgactcaaatcgacggagtgaatctcgctgcaaactcactggtcgagagtggccatccaaggtctagggaagtaaagcagtaccaagaccatcttaatacgagatggcaggccttccaaactctggtgtctgagcgtagggaagccgtcgatagcgctctgagagtccataattactgtgtggattgtgaggagacctctaaatggatcaccgacaagaccaaggtcgtcgaaagcaccaaagacctgggtcgcgacctcgcaggcataatcgcaatccagcgtaagttgtcaggcttagagagagacgttgcagccatacaggctcgagtggatgctcttgagagggaaagccagcagttaatggatagccaccctgaacagaaggaggatatcggacagaggcagaagcaccttgaggagctgtggcaagggcttcagcagagcctgcagggtcaggaggacctcttgggggaggtctctcagctccaggctttcctccaggacctagacgattttcaggcttggctgagtattacacagaaggctgtagcctccgaggatatgccggaatctttgcctgaggccgaacagctgctacaacagcacgccgggattaaagacgagatcgatggccaccaagatagttatcagcgggtaaaagagtcgggcgagaaggtgattcaaggtcagactgatcccgagtatttactcttgggacagcggctggaggggctggacactggctggaacgccctgggaaggatgtgggaatcacggtctcatacgctggcccagtgtctcggattccaggagttccaaaaggatgctaaacaggccgaggcaatcctgagcaatcaagaatacacattggcgcacctagaacccccagatagcctggaggccgcagaggcaggaatccggaaatttgaagattttctgggtagcatggagaataatagggataaagtcttgagtccagtggactctggcaacaaacttgtggcagagggaaatctctattctgacaagatcaaggagaaagtgcagctaatcgaggaccgccaccgcaagaataacgaaaaggcacaggaggcctccgtcctgctccgagataatctggagctgcagaacttcctgcagaactgtcaagagctgaccctgtggataaatgataaactcttgacctcgcaggatgtttcttacgacgaggcccggaacctgcacaataagtggctgaaacatcaggcctttgtcgccgaactagcttcccatgaaggatggctggagaacatcgatgccgaaggcaagcagctgatggatgagaagcctcagttcactgccttagtgtctcagaagctagaggcactgcacagattgtgggatgaactgcaggcaactactaaagagaaaacccaacatctgagcgctgcgcgcagttccgatcttcgacttcagacccatgccgacctgaacaagtggatctcggccatggaggaccagctccgctctgatgaccctggcaaagaccttacatccgtgaacaggatgctggcgaagctcaaacgcgtggaggaccaggttaatgttagaaaggaggagctcggcgagctttttgctcaggttccctcaatgggtgaagagggaggtgacgcggatctttccatcgagaagagattcttggacctcttggagcctctcggaaggcggaaaaagcagctagaaagctcgagggccaaactgcagatttccagagacctggaagatgagactctgtgggtcgaggaacgcttgccattggctcagagcgccgactacgggaccaatttgcaaacagtgcagttgtttatgaagaaaaaccaaaccttgcagaacgagatcttgggccatacacctcgtgtagaagatgtgttacaaagaggtcaacagctagtggaagccgctgagattgattgtcaggacctcgaagaacggttaggccatctgcaaagcagttgggatagacttcgagaggctgcagctggaaggttgcaacgcttacgagacgccaatgaggcccagcagtactatctggatgcggacgaggctgaagcttggattggggagcaggagttatatgtgatatctgacgagatacccaaagatgaggagggggcgattgtgatgctgaaaaggcatctaaggcagcagcgcgccgtggaggattatggcagaaatattaagcaattggccagccgtgctcaaggtctgttatctgcagggcatcccgaaggcgagcagatcataaggctgcaaggacaggtggacaaacactatgcaggtctaaaagatgtcgctgaggaaagaaaaagaaagctcgagaacatgtaccacctctttcagctcaaaagagagaccgacgatctggagcaatggataagcgaaaaggaactggtggccagttcacctgaaatgggccaggattttgaccacgttacactcctacgcgacaaatttcgggacttcgcaagggaaaccggtgcaatcgggcaggagagagtcgataacgtaaacgctttcatagagcggctcatcgatgcagggcacagcgaagcagcaacaatcgcagagtggaaagacggactcaacgagatgtgggcagatctgctggaactgattgacacgaggatgcagctcttggccgcaagttacgacctgcatcgctatttttacaccggtgcagaaatcttggggcttattgatgagaagcacagagagttacccgaagatgtgggtctggacgcttccaccgcagagagttttcatagggtacacacggctttcgaacgcgagttacacctgctgggtgttcaggtccaacaattccaagatgtggccacacgcttgcagaccgcctatgccggagagaaggctgaggctatccagaacaaggagcaggaggtgagtgcggcctggcaggccttgctcgacgcctgcgccgggagacgcacgcagctggtagatacggccgacaagttccgcttcttctcaatggccagagacctgctgtcgtggatggagtctattattcggcagatagagacccaggagcgcccccgagatgtctcatccgtggagctgctcatgaagtaccatcaaggtataaacgcagagatagaaaccagaagcaaaaatttttctgcttgtcttgagctgggcgaatctctccttcagcgccagcaccaggctagcgaagagatcagagaaaagctgcaacaggtgatgtcccggcggaaagaaatgaatgaaaaatgggaggctcgatgggagaggctccgcatgctgctggaggtttgtcagttcagccgcgatgcctccgtcgctgaagcgtggctgattgcccaagaaccttatctggcctctggcgactttgggcacactgtggacagcgtggagaaactgattaagaggcacgaggctttcgaaaagagcacagcttcctgggccgaacggttcgccgcattggagaaacccacaactctggagctgaaagagcgccagattgctgagcggccagccgaagaaacgggacctcaagaagaggaaggcgagacagcaggcgaggcccccgtgagtcatcatgcagccacggagcgaacgtctcccgtgagtctgtggagtcggctgtcctcctcctgggagtctctccagcccgagccatctcacccatactag

SEQ ID NO: 206695 - DNA, 6987 bp, Artificial Sequence
  Description of Artificial Sequence: Synthetic coding sequence
atgaccagcgccaccgagttcgagaacgtgggcaaccagcccccctacagtcgcattaacgcccgctgggacgcaccagatgatgagcttgataatgacaattcctctgcaaggctctttgagaggtcccgaatcaaggcgctggccgatgagcgggaagtcgtgcagaagaagacgttcacaaaatgggtaaactctcacctggcccgggtttcatgtcggatcactgacttgtacaaagatcttcgtgacggacgcatgctcatcaaactcctggaggtgctttcaggggaaatgttacctaagccaactaagggcaaaatgcgaattcactgtctggaaaatgtcgataaggcactgcaatttcttaaagaacagagggtgcatctggaaaatatgggaagccacgacatcgtggacggtaaccaccgtctggtgctcggactcatttggactatcatcctgcgtttccaaatccaggacattgtcgtgcaaacccaggagggtagggaaaccaggtcggccaaggatgccctgctcctttggtgtcagatgaaaactgctggctacccccacgttaacgtgaccaacttcacgagttcttggaaagacgggctcgccttcaatgctctcattcacaagcatcgtccggacctgattgatttcgataaactgaaagattctaacgcaaggcataaccttgagcacgccttcaatgtggcagaacgccagctaggcatcatccccttactggacccagaggacgtcttcacggaaaatcctgacgagaaatccattataacctacgttgtggccttttaccattatttttccaagatgaaggtgctagccgtcgagggcaagcgcgtaggaaaagttatagaccatgctatcgagactgagaaaatgatagaaaaatactctggactggcatctgatcttctgacatggattgagcagacaattaccgtgctgaactcccgcaaatttgccaactccttgacaggcgtccaacagcagctgcaggcctttagcacgtaccgtacggtggaaaaaccacccaagttccaggaaaagggaaatctggaggtgctcttgtttaccatccagagcagaatgcgcgccaacaatcagaaggtgtataccccccacgacgggaagctagtttctgatataaatagagcttgggagagcttagaagaagccgagtaccggcgagagcttgcccttcggaacgagctgatccggcaggaaaaacttgagcagctagcccgcaggtttgacagaaaagcggccatgagagaaacctggctgtcggagaatcagcgattggtcgcccaggacaacttcgggtatgatctcgctgcagtggaagctgcaaagaagaaacacgaggctatcgagacagatacagccgcatatgaggagcgtgtgcgtgcactagaggacctcgcccaggagttggaaaaggaaaattatcatgatcaaaaaaggatcaccgcgcggaaggataacatcctgagactctggagctacctccaagagctgctgcagagccgacggcagcggctcgagactacactcgccctgcagaaactctttcaggacatgctccattccatcgattggatggacgagatcaaagctcatcttttatccgccgagttcgggaagcacctgctggaagtcgaggatctcctacagaagcataaattaatggaggccgacattgccatacagggggataaagttaaggcaattacagccgcaaccctgaaatttactgagggtaagggctatcaaccttgcgatccacaggtcatccaggaccgcatctctcacctagaacagtgcttcgaggagctgtcaaatatggccgctgggcgaaaggcccagctggagcagtcgaagagactctggaagttcttctgggagatggacgaagccgagtcttggattaaagagaaggagcaaatctattcgtctcttgattatggaaaagacctaacttccgtacttatactgcagcggaaacacaaagcatttgaagacgagctgcgcggtcttgacgcacacttggagcagatcttccaggaggcccatgggatggtggccagaaagcaattcggccacccacagatcgaggccagaattaaagaggtgtctgcccagtgggatcagttaaaggatctggcagccttttgtaaaaagaatctccaggacgccgagaatttttttcagttccagggtgatgctgatgatcttaaggcatggctccaagacgcacacagattgctttctggggaggatgtcggccaagacgaaggggcgacccgggcactggggaagaagcacaaggactttctcgaggagctggaagagtccagaggggttatggaacaccttgagcaacaagctcagggattcccggaagagtttagggactcccccgatgtgacacacagactgcaggccctacgggagctgtaccagcaggtggtggcacaagcagatctgaggcagcagcggttgcaagaggccctcgacttgtacaccgtgttcggggagaccgatgcctgcgagctgtggatgggtgagaaggaaaagtggctggctgagatggagatgccagacactctggaagatctggaggtcgttcagcacaggttcgacattctagaccaggagatgaaaaccttgatgacacagatcgatggcgtgaatcttgctgctaactcattggtagaatccggccacccgagaagtcgcgaggttaaacaatatcaggaccatcttaatacccgatggcaggcgttccagacactggtgagtgagaggagggaggctgtggactcagccctgcgagtgcacaattactgtgtggactgcgaagaaacaagcaagtggattactgacaaaacaaaggtggtggaatcgaccaaggatctcgggagggatctggctggcataattgccatccagcggaaactgtcagggcttgagagggatgtagccgcaatccaggcccgcgtcgacgctcttgagcgcgagtctcagcagctgatggactctcatcctgagcaaaaggaggatatcggacagaggcagaagcacctggaagagctctggcagggcctgcaacagtcactgcagggtcaggaggacctccttggtgaagtgagtcagcttcaagcttttctccaggaccttgatgatttccaggcctggctgtcaatcacacagaaggctgtcgcaagcgaggacatgccagaatcactccccgaggccgagcagctccttcaacagcatgccgggatcaaggacgagatcgacggacatcaggactcataccagcgcgtgaaagaaagcggtgagaaggtcatccagggacagaccgatcccgaatacctgctcttagggcagcggctagagggccttgacacaggctggaacgccctcggacgtatgtgggagagtaggtcacatacactagctcagtgtcttggtttccaagagttccaaaaagatgccaaacaggccgaggccatattatccaatcaggagtatactcttgctcatcttgagcctcccgattcactggaagccgccgaggctgggatacgaaagtttgaggatttcttgggttccatggagaacaaccgggataaggtacttagccctgtcgattcagggaataagctggtggcagaaggtaacctgtactctgataagatcaaggagaaggtgcagctcattgaggacaggcatcgcaaaaacaatgaaaaggcacaagaagctagcgttctcctacgggataacctggagcttcagaactttcttcaaaattgccaagagctgaccttgtggattaacgacaagttgttaacatcgcaggacgtttcctatgacgaagccagaaacctgcacaacaagtggcttaagcaccaggccttcgtggctgaacttgcttctcacgaggggtggttggagaatatagacgccgaagggaaacagctaatggacgaaaaaccacagtttaccgcactggtgtcccagaagttagaggctctgcataggctgtgggatgaattgcaggctactactaaagaaaaaactcagcacttgtctgccgccagaagctcagaccttagactgcaaacccatgcagaccttaacaagtggattagtgcaatggaagaccagctccggtccgacgatcccgggaaagacttgacctcggtgaaccggatgttggcgaagctgaagagagtcgaagatcaggtgaacgtccgcaaagaagagctgggggagcttttcgcccaggtgccgtcaatgggagaggagggcggcgacgcagacttatcaattgagaaaaggttcctggacctgcttgagcccttgggccgaagaaagaaacagttggagtcctcacgggcaaagctacagatctccagggatctggaggacgagaccctgtgggtggaggagcgactgccactcgcccagagcgccgactatggaacgaacctgcagaccgttcagctgttcatgaagaaaaaccagactcttcaaaacgagatcctgggacatacaccccgggtggaggacgtcctgcagcgaggtcagcaactggtggaggccgccgagattgactgccaggatctggaagagcgccttggacatctgcagtcctcttgggatcgcctccgggaagccgccgccggccgactgcagcgtctgcgggatgcgaacgaggcccagcagtattacctggacgccgacgaggcagaggcctggatcggagaacaggaattatacgtgatatcagacgagattcctaaggacgaagagggcgctattgtcatgctgaagcggcacctgaggcagcagagggctgtggaagactatgggcggaatatcaagcagcttgcatctagagctcaagggttgctttccgccggtcacccagagggagagcagatcattaggcttcagggacaggtagataagcattacgcagggctgaaagatgtagccgaagagagaaagagaaagttagagaatatgtaccatctgtttcaactcaagagagaaactgacgatttggagcagtggatttccgaaaaggagctagtggctagctcgcccgagatggggcaggacttcgaccacgtcacactgctgcgcgataagtttcgggactttgccagagagaccggggcgatagggcaggaacgcgtagataacgtgaatgccttcatcgagcggctcattgatgcgggccattctgaggccgcgactattgccgagtggaaagacggtttgaacgagatgtgggccgatctgctggaacttattgacactcgcatgcaactgttggctgctagctacgacctgcatagatacttctatactggtgctgaaattctgggactgatcgacgagaagcaccgcgagctgcctgaggacgttgggttagacgcttcaaccgctgaatcattccatcgcgttcacaccgctttcgaacgcgagctgcaccttttgggggtccaagtccagcaatttcaggacgtggcgacccgattgcagactgcctacgccggagagaaagcagaggctattcagaataaggagcaagaggtctcagccgcctggcaggccttattggacgcgtgcgccggcaggcgcacacaactcgtggatacggcagacaagttcaggttttttagcatggcacgcgatctgctcagctggatggaatccatcataagacagattgagacccaggagcgcccaagggatgttagttccgtggagctgctgatgaagtaccatcagggaatcaacgcagaaattgaaaccagatcaaagaatttcagcgcctgcctcgagctaggagaatccctgcttcagcggcagcaccaggcatcagaagagatccgtgaaaagctgcagcaggtcatgtctcgtagaaaggagatgaatgaaaaatgggaggccaggtgggagaggctcagaatgctgctggaggtgtgccagttctcgcgcgacgcgagcgtcgctgaggcttggttaatcgctcaagaaccgtacttagccagtggcgatttcggccacacagttgacagtgtggaaaagcttatcaagcgccacgaggctttcgaaaaaagcacagcttcatgggcagagcgcttcgcagctctcgaaaagccgactaccctcgagctcaaggagaggcagattgccgagcgtcccgcggaagaaacaggccctcaggaggaagagggagaaaccgctggggaggcccctgtatctcaccacgcagctacagaacgaactagccctggtgaagaggagggcacatggcctcagaatctccagcaaccaccacctcccggccaacataaggatggtcaaaaatcaaccggggacgagcgaccaacaacagaaccgctattcaaggtcctggacacacccctgtcagaaggcgatgagccagccacgctgcctgcgccaagagaccacggtcagtctgtacagatggagggttacctgggtcgcaagcacgatctggaaggccccaataaaaaagccagtaacagaagttggaacaatctttattgtgttttgcggaacagcgagcttacattctataaggacgctaaaaatcttgccttaggtatgccataccatggcgaagaaccactggcactgcgccacgcaatttgtgagatagcagctaactataagaagaagaaacatgtgttcaagttgaggctgtccaatggatctgaatggctctttcatggtaaagacgaggaggaaatgctctcgtggttgcagggtgtaagcacagcaatcaatgaatcccagtcaattcgggttaaggcccagagcctgcctctccccagtctctctggaccggacgctagtctcggcaagaaggacaaagaaaagagattctcattttttccaaaaaagaaatag

SEQ ID NO: 206696 - DNA, 6999 bp, Artificial Sequence
  Description of Artificial Sequence: Synthetic coding sequence
gagcccgccgacatgaccagcgccaccgagttcgagaacgtgggcaaccagcccccttattcacggatcaatgccagatgggatgctcccgacgacgagctcgacaatgacaacagctcagctcggcttttcgagcggtcacgaatcaaggcacttgctgacgaaagggaggtggtccagaaaaagactttcactaaatgggtgaactcacacttggccagagtctcctgccggattactgatctttacaaggacctgcgggatggtcgaatgttgattaagcttctggaagtgctgagcggtgaaatgctgcccaaaccaaccaaagggaaaatgcgcatccattgcctggaaaatgtggataaggcactccagtttctgaaagaacaacgcgtgcacctggaaaatatgggatcccacgatatagtggatggaaaccaccgtcttgtgctaggactcatctggaccatcattctgcgcttccagatacaggatatcgttgttcaaacacaggagggtcgtgagacacgcagtgccaaggacgcccttctgctgtggtgccagatgaagaccgcgggttaccctcatgttaacgtgacaaatttcacttctagttggaaagatggtctggcgttcaacgccttgattcataaacaccgccctgacctcatcgatttcgataaactcaaagactctaacgcacgccacaacctggagcatgcctttaacgtggccgaaaggcagctggggatcatccctctgttggacccagaagacgtatttacggagaatcctgatgagaagagtatcataacctacgtcgtggccttttaccactacttcagcaagatgaaggtactggctgttgagggcaagagagtgggaaaggtcatagatcatgctatcgaaactgagaagatgatcgaaaagtattccggactcgcttcagatttgctgacttggattgagcaaacgatcacagtgcttaacagcagaaagttcgccaactctctcaccggagtgcagcagcagctgcaggcattctccacctatcgaacggtggagaagccacccaaatttcaagaaaagggaaacttggaagtactgctgttcaccatccagtctagaatgagagcaaacaatcagaaagtgtacacaccacacgacgggaagctcgtgtctgatattaacagggcctgggagagcttggaagaagcggaatacaggcgggagctggcattaagaaacgagctcataagacaagaaaaactggagcagctggcacggaggttcgacaggaaagccgccatgcgagagacatggctgtcagagaaccagcgactcgtggcccaggataacttcggctatgacttagctgctgtggaggctgcgaaaaaaaaacatgaggccattgagacagatacagcggcatacgaggagcgggtccgagcactagaagacctagcccaggagctggagaaggagaactaccacgaccaaaagaggatcactgcccgcaaggataacattctgagactctggagctacttacaggagctgctgcaaagtcggcgccagagacttgagacgactctagcactccagaagctgtttcaagacatgctgcattctatcgattggatggatgagattaaagctcacctcctgtccgccgagttcggaaagcatctgcttgaagtggaggaccttttgcagaagcacaagctgatggaggcggatattgcaatacaaggggacaaagtaaaggcgattactgcggcaaccctgaagtttactgagggtaaggggtaccaaccctgtgacccacaggtcatacaggatcggatctctcatctcgaacagtgtttcgaggaactgagtaatatggcagccggccgcaaggctcaattggagcagagcaaacgcttatggaagtttttctgggaaatggacgaggccgaaagttggattaaagaaaaagaacagatatattcatcgctcgactatggcaaagacctgacctccgtgttgattcttcagcggaaacacaaggcctttgaggatgagcttcgcgggcttgacgcacatttagaacaaatctttcaggaagctcacggcatggtcgcgagaaagcagttcggacacccacaaatcgaggctaggatcaaagaagtatccgcccaatgggaccagcttaaggacctggccgctttctgcaagaagaacctccaggacgcggagaatttctttcagttccagggggacgccgatgatttaaaggcgtggctgcaggatgcccatagattactttcaggcgaggacgtggggcaagacgagggcgctactagagcgttgggcaagaaacacaaggacttcctggaagagctggaggaatctcgaggggtcatggaacacctggagcagcaagcccagggcttccccgaggaatttcgtgatagccccgacgtgactcatcggttgcaggctctccgtgaactgtaccaacaagtggtggcgcaggcggacctgcgtcagcagcgtttgcaggaggccttagatctttacactgtgttcggggaaacagatgcctgtgagttatggatgggcgaaaaggagaagtggctggccgaaatggagatgccagacactctggaagacctggaagtggttcagcaccgattcgacatccttgaccaggaaatgaagactttaatgacacagatcgacggcgtgaacctggcagcaaattccctggtggagtctggccacccgcgcagccgagaggtgaaacaataccaagaccacctcaatacccggtggcaagccttccagacattagtaagtgaaagacgggaggcggtcgacagtgccctgcgggtgcataattattgcgtcgactgcgaggagacctcaaaatggattacggataaaactaaggtggttgaatccaccaaggacctcggtagagacctggctgggatcatcgctatacagagaaaactgtccggcctggaacgcgatgttgcagcaattcaggcaagagttgatgctctggagcgagagtctcaacaactcatggatagccacccagaacaaaaggaggatattgggcagagacagaagcatcttgaggaattatggcagggcctgcaacagagtctccaagggcaggaagacttattaggagaggtgtcccagctgcaggcattcctccaggatttggatgacttccaggcctggctcagtatcactcaaaaggccgtggcctctgaagatatgcccgaaagcttgcccgaagcagagcaactcctccaacagcatgctggaatcaaagacgagatcgacggacatcaggattcttaccagcgcgttaaggagagcggagagaaggtcattcagggccagaccgatcctgaatatctcttactcggccagagactggaggggctcgacacggggtggaacgccctcggccgaatgtgggagtcgcggtctcacactctggcacagtgcctaggctttcaggagtttcagaaggacgccaagcaggccgaagccatcttgagcaatcaggaatacaccctggcacatctggaacctcccgatagtctggaggcggcagaggcagggatccggaagttcgaggatttcctcgggtcaatggagaacaaccgggataaggttctgtctcccgtggactccggcaacaagttggtcgccgaggggaacctgtactcagataagattaaagaaaaggtgcaactgattgaagaccgacacagaaaaaacaacgagaaggctcaggaagcgtcagttctgctgcgagacaacctcgagctacagaattttctgcagaattgtcaagagctcacattgtggataaacgacaaactgcttactagtcaggatgtctcgtacgatgaggccagaaacctccacaataagtggctgaagcatcaagcatttgtcgcagagctcgcttcacacgagggatggctggagaacatcgatgcggaggggaagcagctgatggatgaaaagcctcagttcactgccttggtcagccagaaactggaagccttgcataggctgtgggacgaactccaggccacaactaaagaaaagacccagcacctcagcgcagctagatcaagtgatctgaggttgcagacccatgccgatttgaataaatggatcagcgccatggaagatcaacttcgaagcgacgatccagggaaggatctcaccagcgtcaaccgcatgctcgctaagcttaagcgagtggaggatcaagtcaacgtacggaaggaggaactcggggaactcttcgcgcaggttccatccatgggcgaggaagggggagacgctgatcttagcattgaaaaacgtttcctggacttgctggaacccttgggtcggcgaaaaaagcagctggagagctcaagggccaagctgcaaatcagcagagaccttgaggatgaaacgctctgggtggaggaacgcctcccgctggcacagagtgccgactatggcacgaatctccagaccgtacagctcttcatgaaaaagaaccagaccctccagaatgagattcttggacacacacctagagtggaggatgtcctgcagaggggccagcagctggtggaggccgccgaaattgactgtcaggacttagaggagcggctgggtcatttgcagtcttcatgggatcgtctcagggaggccgccgccggccggcttcagcgcctccgcgacgcaaacgaagcacagcagtactatctcgacgccgacgaagctgaagcttggattggtgagcaggaattgtacgtgattagtgacgaaatccccaaggatgaggagggcgccatagtgatgctgaagcggcacctgcggcagcaaagagcggtggaggattacggaaggaacatcaaacagctggcatcgcgtgcacagggacttctctcggccgggcaccctgaaggagagcagatcataagactgcagggacaagtcgataagcattacgcaggcctgaaagatgtggctgaggaaagaaagcggaagctagaaaatatgtaccacctcttccagctcaaaagggagactgacgacttagagcagtggatttctgaaaaagaactggtggcctctagtcccgaaatgggccaggacttcgatcacgttacattgttaagggataagttccgggacttcgcgcgagaaactggggcaatcggccaagagcgagttgataacgtcaacgcctttatcgagaggttgatcgacgctgggcacagcgaagccgccacaattgccgagtggaaggacggcttgaatgagatgtgggcagatctgttggagttgatcgacacgcggatgcagctcctggcagccagttatgacttgcatcgctacttctacacgggcgcagagatcctaggcctaattgatgagaagcaccgtgagctccccgaagacgtgggcctcgacgcctcaaccgccgagagctttcaccgcgtgcacaccgcatttgagcgtgagctgcacctgcttggcgtacaggtacaacagttccaggacgtggctacacgacttcagaccgcatacgctggtgaaaaggcagaagcgattcagaataaggagcaggaggtttccgctgcttggcaagctttgctagatgcctgtgccggccgccgaacacagctggtcgacactgccgacaaattcaggtttttttcgatggcgagggacctcctctcttggatggagagcatcatccgccaaattgaaacccaggaacggccaagggacgtttcaagtgtcgagctgctgatgaaatatcatcagggcatcaatgccgagatcgagactaggtcaaagaacttcagcgcctgcctggagctcggcgaatctctgctccagagacagcaccaggccagcgaggaaatccgagaaaagctacagcaggtcatgtctaggagaaaagaaatgaacgaaaagtgggaagctagatgggagcgcttaaggatgcttctcgaggtgtgccagttttcccgcgatgcatcagtcgccgaagcctggctcatcgctcaagagccatacctggcctcaggagatttcggccacacagttgattccgtggaaaaattgatcaagaggcacgaagcctttgagaaaagcactgcatcctgggcggagcgatttgctgcactggagaaaccaaccaccctggaactgaaagagcggcagattgcagagcggccagccgaagagacaggtcctcaggaggaagaaggggagacagctggagaagccccggtgtcacaccatgctgccactgagcggaccagccctggcgaagaggagggaacatggccacaaaacctgcagcagcctccgccccccgggcagcacaaagacgggcagaaatcaaccggcgacgagagacccaccacagagcccctatttaaggttttggataccccattgtcggagggagatgaaccggctacactccctgcgccacgagaccatggtcagtccgtgcaaatggagggctatttgggcagaaagcacgacctcgagggccctaacaaaaaggccagcaatcgctcctggaataatctctactgcgtgctgcgcaacagcgaactgacattttataaggatgcaaaaaatctggcactgggcatgccctaccatggagaagaaccattagctcttagacatgccatttgcgagatcgccgctaactataaaaagaaaaagcatgttttcaaactgcgcctctctaacgggagcgagtggttgtttcatggcaaggacgaggaggagatgctgagttggctgcagggcgtttccaccgctattaacgagagccagtcgatacgggtgaaagcgcagtctctccctctgccctcattgagtgggccagacgcaagtctgggtaagaaggacaaggagaaacggttttcatttttccccaagaaaaagtag

SEQ ID NO: 206697 - DNA, 6414 bp, Artificial Sequence
  Description of Artificial Sequence: Synthetic coding sequence
atgaccagcgccaccgagttcgagaacgtgggcaaccagcccccctacagccgtatcaatgcaaggtgggacgcccctgacgacgaacttgacaacgacaactcgagcgctaggctattcgagcgcagcaggataaaagccttagccgacgaacgggaggtcgttcagaagaagacatttaccaagtgggtgaattcacatctcgccagagttagttgcaggatcacggacctttataaggatctaagagacggtcgcatgttgattaaactgcttgaagtgttgtctggcgagatgctgccgaagcccacaaagggaaaaatgagaattcattgtttggagaacgtcgacaaggcccttcagttcctcaaggaacaacgtgttcatctggagaatatgggctcgcatgatattgtggatgggaaccatcgcctcgtgctaggcctgatttggacaatcatcctgcgatttcagattcaggacattgttgtgcagacccaggaagggcgtgagaccagatctgcaaaggacgcgctgctgctgtggtgccagatgaagaccgccgggtacccccatgtcaacgttactaacttcacctcatcatggaaagatggcctagcgttcaacgccctgattcacaagcaccgccccgatctgatcgattttgataagttgaaagactctaatgcacgccataacttggagcacgcgtttaatgttgcagaacgacagcttggaatcatcccactgctggatccagaggatgtgtttaccgagaatccagatgaaaagagtattattacctatgtagtggcattctaccattacttctcaaagatgaaagtattggccgtagagggcaaacgtgtgggtaaagtaattgaccatgctatcgaaaccgagaagatgattgagaaatatagcggtctggcaagcgatctgctgacctggattgagcagaccatcactgttttgaactctcgcaaatttgctaactccctgaccggggtgcagcagcagcttcaggcattctctacctatcgaacagtggaaaaaccaccgaagtttcaggagaaagggaacctggaggtccttctcttcacaatccaatcccgtatgagggcaaataaccagaaagtttacactcctcatgatggcaaactggtgtccgatataaatagggcctgggagagcctggaggaagcagaatatcgccgagagctggccctccgaaatgagctgatccgccaggaaaagctggagcagctagcacggaggtttgacaggaaggccgccatgcgggaaacctggctttcggagaatcagaggcttgtcgcccaggacaactttgggtatgacttggcagccgtggaggccgcaaagaaaaagcacgaagcaattgagaccgacaccgctgcatacgaggagagagtgcgggctctggaagacttggcccaagagttggaaaaggagaactaccatgatcagaaaaggatcacagctcgaaaggacaacatcctacgtctttggagttacctccaagagctgcttcagtcccggcggcagagactcgaaactacccttgcccttcaaaaactgttccaagacatgctgcacagcattgactggatggacgaaattaaagcccacctgctctctgcagagtttggaaaacacttactcgaggttgaagatctgctgcagaagcacaagcttatggaagcagacatagcaattcagggggacaaagtgaaagccatcacggcagccaccctgaaattcacggaagggaaagggtatcagccttgcgaccctcaggtgatccaggacaggatctcccatctggaacaatgctttgaagaactaagtaatatggcagcaggccgtaaagcacagcttgagcagtctaagcgactttggaaattcttctgggagatggacgaggccgaaagctggataaaggaaaaagaacaaatctattcgtctctcgattatggtaaggatctaacctcggtgctgatcctgcagcgaaagcacaaagcctttgaagacgaactgagagggctcgacgcccatttggaacagatttttcaggaagctcacggcatggtggctcgcaagcagtttgggcacccccaaatcgaggcacgtatcaaagaggttagcgcccagtgggatcagctcaaggatttggccgcgttttgtaaaaagaatctgcaggacgcagagaacttcttccagttccagggcgatgccgacgacctcaaggcttggttgcaagatgcacaccggctactgagtggggaagacgtcggtcaggacgagggagcaacccgggccctaggaaaaaagcacaaagacttcctagaagagcttgaggaatcccgcggggtgatggaacacctcgagcagcaagcacagggtttccctgaggaattcagggacagccccgatgtaacccatcgattgcaagcattgagagagttataccaacaggtcgttgcgcaagctgacctgcggcaacagagattacaagaagcattggacttatacaccgtgtttggcgagaccgacgcctgtgagctctggatgggagaaaaggagaagtggctggccgaaatggaaatgcccgacacgctcgaggacctcgaagtggtccagcaccggttcgatattttagatcaggaaatgaaaaccctgatgactcaaatcgacggagttaatttggcagctaactcacttgtcgagtcgggtcaccctagatcacgcgaggtgaaacagtaccaagatcacctgaacacaagatggcaggcatttcaaaccttagtcagcgagaggcgtgaagctgtcgactcagcactccgggtccataactactgtgtagattgcgaagaaacatccaagtggatcactgacaagacgaaagtggtcgagagcacgaaggatctcggacgggatctggctggaatcattgctatacagcgaaaattgagcggactcgagcgagatgttgctgcgatccaggcacgggtcgacgcactggaaagggagtcccaacagttaatggacagtcacccagaacagaaagaggatatcgggcaacgacaaaaacacctcgaggaactgtggcaaggacttcagcagtccctgcagggacaggaagatctgctcggagaagtgagccaactgcaggcctttctccaggatctggatgattttcaggcgtggctgtctatcacacagaaggctgtcgctagtgaggacatgcctgaaagcctgcctgaagctgaacagctgcttcagcagcatgccggaattaaggatgagatcgatggccaccaggactcataccaacgtgtgaaggaaagcggggaaaaggtgatccaaggacagaccgatccagagtacctattgttgggtcagaggctggagggtctagataccggttggaacgccctagggcggatgtgggaatcccgctcccacacccttgcacaatgtctcggattccaggagttccaaaaagatgcaaaacaggcagaggccatattatcaaatcaagagtacactctagctcatctggagccccctgattccctggaggccgcagaagccggaatccggaaatttgaagatttcctaggaagcatggagaacaaccgcgataaggttttgtcacccgtcgatagcggtaacaagttggtcgccgaaggcaacttgtactcagataagattaaagagaaagtccagttgatcgaggaccgacatagaaagaacaatgaaaaagcccaggaagccagtgtgcttcttcgggataacttagagctgcagaattttctgcagaactgccaggaactaaccctgtggattaacgataaactattgacttcccaggatgtcagctacgacgaggcaaggaacctccacaataaatggcttaaacaccaagccttcgtcgctgagctggcatcacacgaaggctggctcgagaacatcgacgcagagggaaaacaacttatggatgaaaaaccacaatttactgctctcgtgagccagaagcttgaagcgttacatcgcctgtgggacgagcttcaggccacgactaaggagaaaacacaacacctgagtgcggcaaggtcatcagacctgagactgcaaacacatgctgatttgaacaaatggatctccgccatggaagaccagctgcgcagcgacgacccggggaaagatctcacatccgtgaacagaatgctcgccaagctgaaacgtgtggaagaccaggtgaacgtgaggaaggaggaactcggggaattattcgctcaggtgccatcaatgggggaggaagggggcgacgcggacctgtccattgaaaagaggttcttagaccttcttgaacctcttgggcggcgtaaaaagcaattagagtccagcagagccaaactccagatttccagagacctggaagacgaaaccctgtgggtggaagagcggctgcctctggcgcagtctgcagactatggcaccaatctacagactgtacagctctttatgaagaagaatcagaccctccagaacgagatcttggggcacacccccagggtggaagatgtccttcagaggggccagcaacttgtcgaggcagctgagatagactgtcaggacctggaggagagactgggtcacctccaatccagctgggatagactgagggaggcggccgctggaaggctccagaggcttcgcgacgctaacgaagcccagcaatattacctggatgctgacgaagccgaagcttggataggtgagcaggagctttatgtcatctctgacgagatcccaaaagatgaggaaggcgcgattgtgatgcttaagcggcacttgcggcagcagcgcgcggtggaggactatggccgaaacattaagcagctggcctctagggcacagggattgctgagtgctggccacccagagggcgaacaaattattcgactgcaaggccaggtagataaacactacgccggactgaaagacgtggctgaggaacgtaagaggaagctggagaatatgtatcatctttttcagcttaagagggaaaccgacgacctcgagcagtggatctctgaaaaagagctagtggcctcatctccagaaatgggccaggattttgatcacgtgaccctcctgagagacaaattccgcgattttgccagagaaaccggggccattggccaggaaagagtcgacaatgtgaacgcattcatcgaaagattaatcgacgctggtcactcagaggccgcaactatagctgaatggaaggatggcttgaacgaaatgtgggcggatctgttggaactaatcgacaccaggatgcagctgttggctgcctcctacgatcttcacagatacttttacaccggggcggagattcttggtcttatcgatgagaagcatcgggaattacccgaagatgtaggcctcgacgctagcaccgcagagagcttccaccgcgtacataccgcattcgagcgggagttgcatctgttgggcgttcaagtgcagcagttccaagatgtggcaacaaggcttcagactgcctacgctggggaaaaagcagaagcaattcagaataaggagcaggaggtgagcgccgcctggcaggccctgctcgacgcatgcgccggccgccggacacagttggtagacactgcagataaatttagatttttttccatggcccgggacctcttgtcatggatggagtcaattattcggcaaattgagactcaggagcggccacgtgatgtgtcctccgtggaattgctcatgaaatatcaccaaggcatcaacgcggagatcgagacacggtccaaaaacttcagcgcctgtctggaactcggcgaatcactgctccagaggcagcaccaggcctccgaggaaattcgtgagaagctccagcaggtgatgtcacggcggaaagaaatgaatgagaagtgggaggcacgctgggaaaggttgcgcatgcttctggaggtttgtcagttctcacgtgacgctagcgtggcggaagcatggttaatcgcacaagagccctacctggcttccggtgatttcgggcacacagtggacagcgtggagaaacttataaagcggcatgaggcttttgagaaaagtaccgctagctgggcagagcgattcgctgcactcgaaaagccaacaacactcgagttgaaggaacgccagatcgccgagaggccggcagaggagaccggaccacaggaagaggaaggcgaaacggcgggggaggcccctgtctctcatcacgcagcgaccgaacggaccagtcccgtcagcctttggtcccggctgagctccagctgggaaagtctgcagcccgagccatcgcacccctactag

SEQ ID NO: 206698 - DNA, 6987 bp, Artificial Sequence
  Description of Artificial Sequence: Synthetic coding sequence
atgaccagcgccaccgagttcgagaacgtgggcaaccagcccccctatagtagaatcaacgcccgctgggatgccccggatgacgagctggacaatgacaattcctccgcccgtctttttgaacgttctcgaatcaaagccctggctgatgagcgggaggtggtgcagaagaaaacttttacaaagtgggtaaatagccatttggctagggtttcttgcagaatcactgacctgtacaaagacctgcgagacgggcgaatgcttatcaagcttctagaggtcctgagcggcgaaatgttgcccaaacccacaaaaggcaaaatgagaatccattgtctggagaatgttgataaagcgttacagttccttaaagagcagcgggtgcacttggagaatatggggagtcacgatattgtcgatggcaatcacagactggttctgggactgatctggactataatcctgcgcttccagatccaggatattgtggttcaaacccaggaggggcgagaaaccagaagtgctaaggatgcactcctgctgtggtgccagatgaagactgccggctatccccacgtcaacgtgacgaacttcacaagctcctggaaggatggactggcttttaacgccttgatccacaaacacagacccgatctcatcgacttcgataaactgaaggactctaatgcacgacacaatctggagcatgctttcaacgtggctgagcgccagctcggcatcatccccctgcttgatccggaagacgtgtttacagagaatcctgatgaaaaatctatcatcacatatgtggttgcattctatcattacttttctaaaatgaaagtgcttgcagttgaaggcaagagggtgggaaaagtgatcgaccatgccattgaaaccgaaaagatgatcgaaaagtattccggcctcgccagtgatttgcttacatggattgaacaaaccatcactgttctaaattcccgcaagttcgccaacagcctgacaggggtccagcagcagctccaggcattcagcacctatcgaacagtggagaaaccccctaagttccaggagaagggcaacctggaagttctcctgtttacaatccagtctcggatgagggccaataaccagaaagtatacaccccacatgacggtaagctggtgtccgatatcaaccgcgcttgggaatctctggaggaggctgagtacagacgtgagttggcactgcggaacgagttaatcaggcaggaaaagctggaacagctcgcacggaggttcgatcggaaggccgctatgagggagacatggctttccgagaaccagaggttagtggcccaagataacttcgggtatgacttagcagccgtggaggcagcaaagaagaaacatgaagcaatcgagactgataccgccgcttacgaggagagggtgagggctctggaggacctggcccaggagctggagaaagagaattaccatgatcagaaacgcattaccgcccgaaaggacaatatcctgcgactgtggtcatatctgcaagagctcctgcagagtcgccgccaacgccttgaaacaacattggctctacaaaaactgtttcaggacatgctgcatagcattgattggatggacgaaatcaaagcccatctcctctccgcagaatttggaaagcacctcctcgaggtggaggatttactgcagaagcacaagctaatggaagcagatatagccatacagggagacaaagtcaaggccatcacagcagcgactcttaaatttacagaaggaaaaggttaccagccctgcgatccacaggtgatacaagatcggatctcccatctcgagcagtgcttcgaggagctcagtaacatggctgctgggaggaaagctcaactagaacagagtaaacggctgtggaagtttttttgggaaatggacgaggccgaatcctggatcaaggagaaggagcagatctattcctcccttgactacgggaaggacctcacctccgtgctcattctgcagcgcaaacataaggcgttcgaggacgaactacgcggcctggacgcccacttagaacagatcttccaagaggcacacggcatggtggccagaaagcaattcgggcacccccagattgaggcacgtatcaaggaagtgagcgcacagtgggaccagttaaaggatctcgccgccttttgcaagaaaaatttgcaggatgccgaaaatttctttcagttccagggcgatgccgatgatttgaaggcttggctacaggatgcgcatagactgttgagcggtgaggatgtgggacaggatgaaggcgccactcgggctctgggtaaaaaacacaaggatttccttgaagagctggaagaatcccggggtgtgatggaacatctggagcagcaggcacaagggttccccgaagaattcagggattcccctgatgttacacatagattacaggccctgcgcgagctttatcagcaggtcgtcgcgcaggccgaccttcgacagcagcgcctccaggaagccctggatctctataccgtcttcggtgagacagacgcgtgcgaactgtggatgggtgagaaagagaagtggctcgccgagatggaaatgccggatactctggaagatcttgaggttgtgcagcatagattcgatattctagatcaggagatgaaaacattaatgactcagatcgacggcgtgaacctggccgccaacagcctggtggagagcggccatccccgttctagggaggttaagcaatatcaggaccacctcaacaccagatggcaggctttccagacactcgtgtccgagagaagagaggccgtggacagtgccctacgggtgcacaactattgtgttgactgcgaggaaacgtccaaatggataacagataaaaccaaagttgtcgaatctacaaaggatcttgggcgggacctagccggcataatcgccatacaacgtaagctgtccggattggaacgggatgtcgcggccatccaagcgcgggtggacgcactggaacgggagtcccagcagctgatggactctcacccggaacagaaggaggacatcggacaaaggcaaaagcaccttgaggagttgtggcaaggcctgcagcagtctcttcagggacaggaagatctgctcggagaagtgagccagcttcaggctttcttgcaggacctagatgatttccaggcttggctctctataactcagaaagccgtcgcctccgaggacatgcccgagagcctgcccgaggcggagcagctgctgcagcaacacgcaggaattaaagatgagatagatggacaccaggactcctaccaaagagtgaaggaaagcggtgagaaggtcatccagggccaaactgatccagagtacttactcctcggccagaggttagagggcttggatacagggtggaacgccttagggcgtatgtgggaatcccggtcacacacccttgctcagtgcctgggattccaagaatttcagaaggatgccaaacaggccgaggccatattaagcaatcaggaatacacactggcgcacctggaacctcccgacagcttagaagcagcagaagccgggatacggaaattcgaagatttcctggggagcatggaaaacaacagggataaagtactgtctccggtggactcgggcaacaagctggttgccgagggaaatctctattctgacaaaataaaggaaaaggtgcagcttatcgaagaccggcatagaaagaacaatgaaaaagctcaggaagcaagtgtccttctccgtgataacctcgaactgcaaaactttctgcaaaactgccaagagctgaccttgtggattaatgataagctcttgacctcacaggacgtgtcttatgatgaggccagaaatctgcataataagtggctgaagcatcaggcttttgttgccgagctggcgtctcacgaaggatggctggaaaacatagatgccgagggaaagcagctcatggacgagaaaccccagttcacagctctagtttctcagaaattagaagctctgcataggctgtgggacgaattgcaggcgacaacgaaggagaaaacccagcatctgagtgctgctaggagcagcgatctccgtttgcagacgcatgccgacctgaacaagtggatttccgctatggaggatcagctgcgatctgatgacccggggaaagacctgacctctgtcaacagaatgctggcaaagctcaaacgtgtcgaagatcaggttaacgtcaggaaggaggagctgggcgaactgtttgctcaggttccaagcatgggtgaggaaggaggtgatgctgacctgagcatagagaagcggttcttggatctgctggagcccttgggaagaagaaaaaagcagctcgagtcttcccgcgctaagctgcagatctccagagaccttgaggacgaaacactatgggtggaggagaggctgccactggctcaaagcgccgactacggcaccaatctccagacagtgcagctcttcatgaagaagaaccaaactcttcagaacgagattcttgggcacactccacgagtggaagacgtattacagcgcgggcagcagctggtagaggctgctgaaattgattgtcaggatctggaggagagattaggacatcttcagtccagttgggacagactgcgggaggctgctgccgggaggttgcagcggttacgcgatgctaatgaagcacagcagtactacttagatgcggacgaagcggaagcctggattggcgaacaggaactgtacgtgatcagcgacgaaatcccgaaggacgaagaaggtgcaatcgtcatgctcaagcgccacctacggcagcagcgtgcagtggaggactacgggcgcaacattaagcaattggcctctagggcacagggtcttctgagcgccggccatccagaaggagaacagatcatcagattacagggccaagttgataaacactacgccggacttaaggacgtcgcagaagagcggaaacgtaagcttgaaaatatgtaccatttattccagttaaagagggagacggacgacctcgagcagtggatatcggagaaggaacttgtggcatccagtcccgaaatgggccaagacttcgaccatgttacactgctgagagacaagtttcgggattttgcacgcgagacaggggcaattggccaggaaagggtagacaatgttaacgcctttattgagcgcctaattgacgctgggcactcagaagcggccacaattgctgaatggaaggacggcctcaacgagatgtgggcagacctattggagctgatcgacaccagaatgcagttgcttgccgctagctatgaccttcataggtacttttatactggtgccgagatcctcgggcttattgacgagaagcatcgggagttgccagaagatgttgggctggacgctagcacagcagaaagtttccatagagtgcatactgctttcgaacgggaattgcatctgttaggagtgcaggtgcaacagttccaggatgtcgccactagattgcaaaccgcatacgctggcgagaaggcagaggctatccagaataaggagcaagaggtttcagcagcctggcaggccctgttagacgcgtgtgccggtagacgaacccagctggtggacactgcggacaagtttcgctttttctccatggccagagacctgctgagctggatggaaagcatcatcaggcagattgagacgcaggaacgccctcgcgatgtttccagtgtggaactgttaatgaagtatcaccaaggcatcaatgctgaaatagagacaagatcaaagaatttcagtgcctgcctggaactgggggagtctcttctgcagcgccaacaccaggcctcagaagagatccgggaaaagctgcagcaagtcatgagccgtaggaaggagatgaatgagaagtgggaggcacgatgggaaaggctgcggatgttgttagaggtatgccagttctctcgagacgccagcgtggccgaggcctggcttattgcccaggaaccgtacctggcgtcgggagactttgggcacacagtcgactccgtcgaaaagctgattaagcgacacgaagcattcgagaagagcaccgctagttgggccgagagatttgctgcgttggaaaagcccaccaccctcgagctcaaagaaaggcaaatcgctgagaggcctgcagaggaaacaggccctcaagaggaggagggcgaaacggcgggagaagctcctgtctcacatcacgcggccacagagcggaccagtcccggcgaggaagagggaacttggccccagaatctacaacagcctcctccccccggtcagcataaggacgggcagaagtctactggggacgagaggccaactaccgagccattgttcaaggttctggacacaccactgtccgagggggatgaacctgccactctgccggccccccgggaccacggtcagtccgtccagatggaggggtatttagggagaaagcacgatttagaagggcctaataaaaaggcatcaaacaggtcgtggaacaacctgtattgtgtcttaagaaattccgagctaactttctacaaagacgcaaaaaacctggctctgggtatgccctaccacggggaagagcctttagcactgcggcatgccatctgtgagatcgccgctaattacaagaagaagaagcatgtgttcaaactcagacttagcaacggctcagagtggctgttccacgggaaagacgaagaggagatgctctcttggttgcagggcgtgagcaccgccattaacgaatctcaatctatccgcgttaaggcccagtcactccctctcccctcactgtccggaccagatgcctctctcggaaagaaggataaagagaagagattttcttttttccctaaaaagaaatag

SEQ ID NO: 206699 - DNA, 6468 bp, Artificial Sequence
  Description of Artificial Sequence: Synthetic coding sequence
atggagctgcagcggaccagcagcatcagcggccccctgagccccgcctatactggccaggtgccttataattataaccagctggagggtcggttcaaacagctgcaggacgaacgcgaggccgtccaaaaaaaaacttttacaaagtgggtgaactcacatttggcccgtgtctcttgccgcatcaccgacctgtacaccgacctacgcgatgggaggatgcttattaagcttctggaagtgctaagcggtgaaaggctgcccaagccaacaaaaggccgcatgaggattcactgtctcgagaatgtggacaaggcccttcagttcctcaaagagcagagggtgcacctcgagaacatgggttcccacgacattgtggacggcaaccaccgtctcaccttggggctcatctggactattatcctgagatttcagatacaggatatatctgtggaaactgaggacaacaaggaaaaaaagagcgccaaggatgctcttcttctatggtgtcagatgaagacagcaggttaccccaatgtgaacatccataatttcaccacgagctggcgcgatggaatggcgtttaacgccctgattcataagcaccgccctgaccttatcgactttgacaagctaaagaagtcgaatgcacattataacttacaaaatgccttcaatttagccgagcagcacttaggactgacgaagctgctggaccccgaagacatctcagtagaccacccagacgaaaagagtatcatcacgtatgtagtaacgtactaccattatttcagcaagatgaaagcactggctgttgaggggaagcgcatcggcaaggtactggacaacgctattgagaccgagaagatgatcgagaaatatgagtcccttgctagcgatcttctcgaatggatagaacagactattatcattctgaataaccggaagttcgctaacagtctggtcggggtccagcagcagctgcaagcttttaatacataccgcacagtggagaaacccccaaagtttaccgagaaaggaaacctggaagtacttctcttcacgattcagtcaaagatgagggctaataaccagaaggtctatatgcctagagagggcaaacttattagcgatatcaacaaagcctgggagcggttggagaaggcggagcacgagcgagaattagccttgaggaacgaactcattcggcaggagaaactggagcagctggcacgacggttcgacagaaaagctgctatgagagagacctggctgtcagaaaaccaacgcctagtgtcccaggataacttcggatttgacctcccagcggtggaggctgcaaccaagaagcacgaggcaattgagacagacattgccgcatacgaggagcgcgtccaggctgtcgtggcggtagcccgggagctggaggcagagaattaccacgatattaagcgcataaccgctcggaaggacaatgtgattcgtctgtgggagtacttgctggaactgctgagagctaggaggcagcgcctggagatgaacttagggttgcagaagatctttcaagagatgctctatattatggactggatggacgagatgaaagtacttgtcctgtctcaggactacggtaagcatcttttaggcgttgaagatctgctgcaaaagcatactttagtagaggccgacatagggatacaggcagagagggtgcggggcgttaatgcatcagcacaaaagttcgcaacggacggggaaggttataagccctgtgaccctcaggtgatccgcgaccgagtcgcgcatatggagttctgctaccaagaactctgtcagctggccgccgagaggcgcgctcgtttagaggagagtcgtaggctctggaagttcttttgggaaatggctgaagaagagggctggattcgggagaaagaaaaaatcctgtcgtcagacgactatggcaaggatctgactagtgtgatgcggctcctgtcaaaacatagagctttcgaggacgagatgtctggaagatccgggcactttgagcaagctatcaaagagggcgaagatatgatcgcagaggagcactttggctccgaaaaaatccgtgagagaattatctacattcgcgaacagtgggcaaacctggaacagctgtcagcaatacgcaagaagcgactggaagaggcaagtctcctgcatcagttccaggccgacgccgacgacatcgatgcctggatgttggatatcttgaagatagtgagctcatccgatgtaggacacgatgaatacagtacccagagtctggtgaagaagcacaaagatgtggctgaggagattgcaaattatcgtcctacactggatactctgcatgaacaggcaagcgctctgcctcaggaacacgccgaatcacctgacgtaagaggccgcttgtctgggattgaagagaggtataaggaagttgcagagcttacacggctacgtaagcaggctctccaagatactctcgccctctataaaatgttctctgaggctgacgcgtgcgagctgtggattgatgaaaaggaacagtggctgaacaatatgcagattcctgaaaagctcgaagacttggaggtaattcagcacaggttcgaaagcctggagcccgagatgaacaaccaggcatctagagtcgctgtggtcaaccagattgcccgtcagctcatgcattctggacatccgagtgaaaaggaaattaaagcacagcaggataaattgaacacaaggtggagtcagttccgggaactggtggaccggaagaaggacgctctactgtccgccctgagcattcaaaactatcaccttgaatgcaatgagactaaatcgtggatacgagaaaagaccaaagtgatcgagagcactcaagacctggggaacgacctggcaggggttatggccctgcagcgcaaactgacaggcatggagcgagacctggtggccatagaagctaagctgagtgatctgcagaaagaagcagagaagctcgaatcagagcatcctgaccaggcccaggccatcttgtccaggctggctgaaatctccgatgtgtgggaggagatgaagacaactctcaagaatcgcgaggcttccctgggcgaagctagcaagttacaacagtttctgagggacttagacgattttcagtcatggctcagtcggacccagactgcaatcgctagcgaggacatgcctaatacactcaccgaagccgaaaagttgcttacacagcatgaaaatatcaagaacgagatcgataattacgaagaggactaccagaaaatgagggatatgggcgagatggtcactcaaggtcagactgacgcccagtacatgttcttgagacagcggctccaggcattagacacagggtggaacgaactgcataaaatgtgggagaatcgccaaaacctgctctcccagtcccacgcataccagcaattcttacgggacacgaagcaggcggaggcgtttctcaacaaccaggagtatgtgcttgcgcacaccgaaatgcctacaaccctcgagggcgctgaagctgcaataaagaagcaggaggacttcatgaccactatggatgccaatgaagaaaaaattaacgcagttgttgaaactggcaggcgcttggtcagtgacggtaatatcaatagcgacaggattcaggaaaaggtggactctatcgatgacagacataggaagaaccgtgagactgcaagtgagttactcatgcgtctgaaggataaccgcgaccttcagaaattcctgcaggactgccaggagctctccctttggattaacgagaagatgttgacagcccaagatatgtcatacgacgaagctcgcaacctccacagtaaatggcttaaacatcaagccttcatggctgagcttgcttcaaacaaggagtggctagacaaaattgagaaggaaggtatgcagctgatcagcgaaaagcccgaaactgaagctgtggtgaaggagaaactcacgggtctccacaagatgtgggaagtgctggaatccaccacccagactaaagctcaaaggttatttgacgcaaacaaagcagaactatttacacaatcatgtgctgatttggataaatggctccatggcctcgagtcacaaattcagtctgatgactatggtaaagatcttaccagtgtgaatatcctcttgaaaaaacagcagatgctagagaatcaaatggaggtccgaaagaaggaaatcgaggaactccagagtcaggctcaagcgttatctcaggaaggaaaaagcacagatgaagttgattcgaaacggctgaccgtgcagaccaaattcatggagctcctcgaaccgctcaacgagagaaagcacaatttactggccagtaaggaaatccatcagtttaaccgggacgtggaggatgagattctttgggtgggcgagcggatgcccctggctacgtctaccgatcatggtcataatttacagacagtacaactgctcatcaaaaaaaatcaaacactgcagaaagaaatccaagggcaccaaccgagaatcgatgacatcttcgaaagaagccaaaacatcgttaccgactccagttccctttctgctgaggctattcgccagcgacttgccgatctgaagcagctatggggacttctgatagaggagactgagaaaaggcataggcgcctggaagaagcacatagggcccagcagtattactttgacgctgccgaggcagaggcctggatgtcagaacaggaactgtacatgatgagcgaagaaaaggcaaaagacgaacagtctgcagtgtctatgctgaaaaaacatcagatactggaacaggccgtcgaagattatgccgagacagttcatcagttatctaaaactagcagggctctggttgctgactcgcatcccgagtcggagcgcatttccatgcgtcagtccaaagtggacaagctttatgccggcctcaaggatctggcagaggagcgtcgtggcaaactggacgagaggcatcgcctgttccagctgaacagagaggtggacgacttggagcagtggatcgccgagcgggaggtggttgctggtagtcacgagcttggccaggactacgaacatgtcactatgctacaagagcgcttcagggagtttgccagggataccggaaacattggccaagagcgcgtcgataccgtgaatcatctagcagatgagcttatcaattctggccacagcgatgccgccacaatcgcggagtggaaagacgggttaaacgaggcctgggcagatctgctcgagcttatcgatactcggacgcagatattggcagcaagttatgaacttcacaagttttaccacgatgccaaagaaatttttgggcgcatccaggacaaacataagaaactgcccgaagagctcgggcgcgatcaaaatactgtggagactctacaaagaatgcatactaccttcgagcacgatatccaggccctggggactcaggtgcggcaacttcaggaggatgcggcccgactacaggctgcgtatgcaggtgataaggccgatgacatacagaagagggaaaacgaggtcctagaggcctggaaatctttgctcgacgcatgtgagagtagacgcgtgcgccttgtggacaccggagataaattccggttctttagcatggtgcgcgacctaatgctgtggatggaggacgtgatacgacagatcgaggcccaagaaaagcctcgagacgtgtcttctgtagagttgctgatgaacaaccaccagggtataaaagcggaaattgacgcccgcaacgacagctttaccacctgtatcgagttaggcaagtccctgctcgctcgaaaacactacgcctcggaggaaattaaagagaagcttctgcagctcacggagaaacgaaaagaaatgattgacaagtgggaggatcgctgggagtggttgaggcttattttggaagtgcatcaattcagtcgcgacgcatctgtcgccgaagcttggttgttaggccaagagccctatctgtcatccagagagattggacaatctgtcgacgaagtggagaagctcattaagaggcacgaagccttcgagaaatctgccgcaacctgggatgagcggttctccgcgttggagcgccttaccactctggagttgcttgaagtgcggcgacaacaagaagaagaggagagaaagcgacggcctcccagtcccgaacctagcactaaagtcagcgaggaagccgaaagccagcagcagtgggataccagcaagggcgaacaggtgagccagaacggcctgcctgccgaacagggcagtccaagagtctcctataggtcccagacgtaccagaactataaaaatttcaacagccgtcgcactgcgtcagaccagccctggtctggcctctag

SEQ ID NO: 206700 - DNA, 7095 bp, Artificial Sequence
  Description of Artificial Sequence: Synthetic coding sequence
atgaccaccaccgtggccaccgactacgacaacatcgagatccagcagcagtactctgatgttaacaaccgctgggacgtcgatgactgggataacgagaactctagtgcaagactttttgagcgcagccgaatcaaggctctggccgatgaacgggaagccgtgcagaagaaaacattcacgaagtgggtaaacagtcatctggcaagggtctcatgtaggatcacagatttatataccgatttgcgagatggaaggatgttaattaagctcctagaggtgctttccggcgaacgacttcctaaaccaactaaaggccgtatgcgaatccactgtctggaaaatgtggacaaggcactccagttcctgaaggagcaacgagtgcatcttgagaatatgggatctcacgatatcgtggatggcaaccaccgactcacactgggcctgatttggaccataatcttaagatttcagatacaggacataagcgtggagaccgaggacaacaaggaaaagaagagcgccaaggacgccttactgttatggtgccagatgaaaacggcggggtatcctaatgtgaatatccacaatttcacaacctcttggcgcgacggcatggccttcaacgccctgatccacaagcatagaccggatttaatagattttgataagcttaagaagtctaatgctcactataacttacagaacgcgtttaacctggccgaacagcacttgggactcacaaagctgctggaccctgaagacatcagcgtagatcatccagacgagaaatcaatcatcacatatgtcgtgacctactatcactattttagcaagatgaaggctctcgccgttgaggggaaaaggattggtaaggtgctggacaacgccatcgagaccgaaaagatgatcgagaaatacgagagcctggcctccgacctattggagtggatcgagcaaaccatcatcatcctcaacaatagaaagttcgccaactccctggtaggggttcagcaacagctacaggcgtttaatacatatcgcacagtcgagaagccacctaaatttactgagaagggcaaccttgaagtgctcttgttcactatccagtccaaaatgagagccaataatcaaaaagtctatatgccacgggagggaaaactgattagcgacatcaacaaggcttgggagaggttggagaaggcagagcacgagcgcgagctcgccctgcggaacgagttgatcagacaggaaaagcttgagcagctggctagacggtttgaccgcaaggctgctatgcgcgaaacatggctgtccgagaatcagagactagttagtcaggataattttggcttcgacttgcccgcggtggaggccgccacgaagaaacatgaggcaatagagacggacatcgcagcctatgaagaacgggtacaagctgtggtggccgtggccagagaacttgaggctgagaattatcatgacatcaaaagaattacagcgcgcaaagacaatgtcatcaggctgtgggagtacctgcttgagctgctccgggctagacgacagcgcctggaaatgaatctgggcctacagaaaattttccaggagatgctgtatatcatggactggatggatgagatgaaagttctcgtcctttctcaggactatgggaaacacctactgggcgtcgaggatctactccagaaacataccctggtggaggccgacatcggaattcaggcagagcgcgtcaggggcgtgaacgcttccgctcagaaatttgccaccgatggtgagggctataaaccctgtgacccccaggtcatcagagatcgcgtcgcccacatggaattctgctaccaggagctttgtcagcttgcagctgagcggcgcgccaggctggaagaatcccggaggttatggaagttcttctgggagatggccgaagaagaaggctggataagagagaaagaaaaaattctaagctccgacgattacggcaaagacctaacatctgtgatgcggctattgtcaaaacaccgcgcctttgaggacgagatgtcaggccgatctggacatttcgagcaagcaattaaggagggggaagacatgattgctgaggaacacttcggcagtgagaaaatccgggaaagaattatttacatccgggagcagtgggcgaatctggagcagctctctgccatccgtaagaagcgcctggaagaggcctctctgctgcaccagtttcaggcggacgctgatgacatcgacgcttggatgctggatatcttgaaaatagtgtcatcttcagacgtcggtcatgacgaatactccacccaatcgctggttaagaaacataaagatgttgcggaagagattgccaactacaggcctactctagataccctgcatgaacaggcaagcgctttgccccaggagcacgccgagtcccctgacgtcaggggtcggctgtcaggcattgaggagcgatataaggaagtggccgaacttacgcggctgcggaagcaagccttacaggataccttggcactgtacaaaatgttttccgaggcggacgcatgtgagctgtggatagatgagaaggagcaatggctgaataacatgcaaattccagaaaagctggaggacctggaggtgattcagcatcggtttgaaagcctcgaaccggaaatgaataaccaagcatcacgagtagccgtagtgaatcaaatcgcccggcagctgatgcattccggacacccttccgagaaggagatcaaggcgcagcaagataagctgaacacccggtggtcacagttccgcgaactggtggaccgtaaaaaggacgccctgctgagcgccttaagtattcagaattaccacctcgaatgcaatgagaccaagtcttggatccgcgaaaaaaccaaggtcattgagtccacccaggacttgggtaatgacctggctggggtgatggccttacagcggaaactgacaggaatggagcgagacctggtagcaatcgaggcaaaattgagtgaccttcagaaggaagccgagaagcttgagtcagagcatcctgatcaagctcaagccattctcagcaggctcgctgagatttctgatgtctgggaggaaatgaagaccaccctcaaaaatcgcgaggcctcactgggagaagcatccaagcttcaacagtttctgcgcgatctcgacgactttcaatcctggctgagtaggacacaaacagccatcgcctcagaggatatgcctaacactctgactgaggccgagaagctgcttacacagcatgagaatattaagaatgagattgataattatgaagaggattatcagaagatgcgagacatgggggagatggtgacgcagggccagactgacgcccagtacatgttcctgagacagagactccaagctttagacacaggctggaatgaactccacaagatgtgggaaaaccggcagaaccttctgagtcaatctcatgcatatcaacagttcttgagggatactaaacaggccgaagccttcctgaataaccaggagtacgtgctggctcacacggagatgccaacaactcttgaaggagcagaggccgcaattaagaagcaggaagatttcatgaccacgatggacgcaaacgaggagaaaataaatgctgttgtcgagacagggaggcggctggtctcagacggaaatatcaattctgataggatccaggaaaaggtagattccattgatgacaggcacaggaaaaatagggaaaccgctagtgagctgttgatgcggctgaaggataatcgcgacttacagaaattcctgcaggattgtcaggaactgagcctgtggatcaacgaaaagatgctcaccgcccaggatatgtcttacgatgaggctcggaatttacacagcaagtggctaaagcaccaggcattcatggccgaactcgctagtaataaggaatggcttgataagatcgaaaaggaaggaatgcagctgatctctgaaaagcccgagaccgaggccgtggtcaaggaaaagctgaccggcttacacaagatgtgggaagttcttgagtctacaacgcaaactaaagcccagagactgtttgacgctaataaggcagaattattcacgcagagttgcgctgatctagataagtggctgcatgggctggagagccaaattcagtccgatgactatgggaaagatctaacaagtgtgaacattctcttaaagaaacagcaaatgctggagaaccagatggaggtccgcaaaaaagagattgaagagctgcaaagccaggcacaggcactatcacaagaaggcaagtccacagacgaagtggactccaagcgtctgacagtgcaaactaagttcatggagttgctggagcctctcaatgaacggaagcataatctccttgccagcaaggagatccaccagtttaacagggacgtggaggacgagatcttgtgggtaggagaaagaatgcccttggccacaagcactgaccacggacacaacctgcagaccgtgcagctgttaataaagaaaaaccagacactgcagaaagagattcaagggcatcagcctaggatagatgacatctttgagagatctcagaatattgtgacagacagttcttcactgtccgctgaggcgatccgtcagcgcctcgcagacctgaagcagctgtggggactcttaattgaggagaccgaaaaaagacatcggagactggaggaagcacacagagctcagcaatattactttgatgctgctgaggcagaggcgtggatgagcgagcaggagctgtacatgatgtccgaggagaaggcaaaagatgaacagtctgctgttagcatgctgaagaaacatcaaattctggagcaagctgtcgaagactatgcggaaacggtacatcagctgagcaagacttctcgagcgcttgtggccgattctcaccccgagagcgagcgaatcagtatgaggcaaagcaaagtggataaactgtatgccggcctgaaggatctggctgaggagcggcggggcaaactcgatgagcggcaccgtctgtttcaacttaaccgcgaggttgatgatctggaacagtggattgccgagagagaagtggtcgcaggcagccacgaactggggcaagactatgaacatgtcacaatgctgcaagagcgctttagggagtttgcccgtgacaccggcaacatcggccaggaaagagttgacacggtgaaccacttggcagacgagttgattaattctggacactccgatgccgctaccatagccgagtggaaggacgggctaaatgaagcctgggctgacttacttgagcttatcgatacaaggactcagatcctagccgcatcctacgaattgcacaaattttaccacgatgctaaggaaatctttggccgcatacaggacaaacacaagaagctccccgaagaactcggaagagaccagaacacagtagagaccttgcagcggatgcatacaacctttgaacacgatatccaggcactcggaacccaggtgaggcaactgcaggaggacgctgctaggctgcaagccgcatacgcaggcgacaaagcagatgatattcagaagcgcgaaaatgaggtattagaggcttggaaatctctactagacgcatgcgaatccagaagggtgagacttgtcgacacaggggacaagtttcggttcttctctatggttagagatctcatgttgtggatggaagacgtcattcggcagatcgaggcccaagagaagcctcgagatgtgtcctccgtcgagctccttatgaacaatcatcagggaattaaggcggagattgatgctcgaaatgactccttcacaacctgtatagagctcggtaaatcacttctcgccagaaagcattatgctagtgaggaaattaaagagaaactgctgcagcttaccgagaaaagaaaagagatgattgataagtgggaggatagatgggagtggctgcgtctgattttggaagtgcatcagtttagcagggatgcttctgtggctgaagcctggctgctgggccaggaaccatacctgagctcacgcgagataggtcagagtgtggatgaagtggaaaaacttatcaagcggcatgaggctttcgaaaaatccgctgccacctgggacgagcggttcagcgccttggagaggctgactacgctcgaacttctcgaggtgcgcagacaacaggaagaagaggagaggaagcggcgtccgccaagccctgaaccctcaaccaaagtttcagaagaagccgagtctcagcagcagtgggacactagcaagggcgaacaagtgtcccaaaatggactgcctgcggaacagggctctccccgtatggcagagacagttgacactagcgaaatggtgaacggcgcgaccgagcagcgcacttcttctaaggagagctctccaattccaagcccgacctcggacaggaaggccaaaacagctttacctgcacaaagtgccgccacccttccagccagaacgcaggaaacgcctagcgcccagatggaaggttttttgaaccgtaagcacgaatgggaggctcacaacaagaaagcttcatccagaagctggcacaatgtgtactgcgtgattaacaatcaagagatgggcttctacaaagatgctaaaactgccgcttccggcatcccatatcactccgaggtgcccgtctcgttgaaagaggctgtgtgcgaggtggccctggactataagaaaaagaaacacgttttcaagctccggcttaacgacgggaatgaatacttgttccaggccaaggatgacgaggaaatgaatacgtggattcaggctatttctagtgccatctcaagtgacaagcatgaagtttcggcatccacgcaatctactcccgcttcctcaagagcacagacgttgccgacctcagtggtgaccattacctcagagagttcacccggcaagcgcgaaaaagataaagagaaggacaaggagaagcgcttctccctctttgggaagaagaagtag

SEQ ID NO: 206701 - DNA, 2073 bp, Artificial Sequence
  Description of Artificial Sequence: Synthetic coding sequence
atgaccaccaccgtggccaccgactacgacaacatcgagatccagcaacagtatagcgatgtgaacaacagatgggacgtggatgattgggataatgaaaattctagcgccagactgtttgagcgtagtcggattaaagcactcgcagatgagcgagaggcggttcaaaagaaaaccttcactaagtgggtgaactcacacttggctcgtgtgagttgtcgaattactgatctgtataccgatctcagagacggacgaatgttgattaagctcctcgaagttttaagcggcgaaagactgcccaagcccactaaaggtaggatgcggatccactgtctggaaaatgttgacaaagcattgcagttcctcaaagagcagcgggtccatctcgagaacatgggctctcatgacattgtcgatggcaatcaccggctcaccctgggactcatctggacaatcatcttacggtttcagatccaggacattagcgtcgagacagaagataacaaggaaaagaaaagtgccaaggacgccttactattatggtgtcagatgaaaaccgcgggctaccctaacgtgaatattcataattttaccacctcatggagagatggaatggcctttaacgcactcatccacaagcatcggccggacctcattgattttgacaagctgaagaagagtaatgcccactataaccttcagaatgcgtttaacctggccgagcagcacctgggcctgacgaaactactggatcctgaggacataagtgtagaccacccggacgaaaagtctatcattacctatgtggtgacctactatcattacttctctaagatgaaagctctggctgtggaaggtaagcgcataggtaaggtacttgataatgcaattgaaacagagaaaatgatcgaaaaatacgagtccctggcgagcgatctgttagaatggatcgaacaaaccatcatcatcctgaataatcgtaagtttgctaattctctagtcggggtgcagcaacagctccaagctttcaatacctacaggactgtcgagaaaccaccaaagtttacagaaaagggaaacctagaggtgctgttgtttacaattcagagcaaaatgcgtgccaacaatcagaaggtgtacatgccacgggaggggaaactgatttccgacatcaacaaggcttgggaaaggctggaaaaggctgagcatgagcgcgagctggcactgcgaaacgagctaatacggcaggaaaaactcgaacaactggctaggagatttgacaggaaggcagctatgcgcgaaacttggctatcggagaaccaacggcttgtgagtcaggataattttggcttcgatctgcccgcggtagaggctgcaaccaagaaacatgaagccatcgaaactgacatagctgcatacgaggaacgtgtgcaggctgtcgtggccgtggcaagagagctcgaagccgagaactaccacgacatcaaacggattaccgccaggaaagataatgtgattcggttgtgggaatacttgctcgagctattaagagctagacgtcagaggctcgaaatgaatctggggctccagaagatcttccaagaaatgctgtacattatggactggatggatgagatgaaggtgttggtgctgtcacaggattatggtaaacatctcctgggcgtggaagacttgttacagaaacacacactggtcgaggcagacatcggcattcaggcagagagggttcggggagtcaacgcatctgcgcagaagtttgcaaccgacggcgagggatataagccctgcgatccgcaggtgatccgggatcgggtcgcacacatggagttctgttatcaggaactttgccagctggcggccgagagacgcgcccgactcgaggaaagcaggagactgtggaagttcttctgggagatggctgaagaggagggatggatccgggagaaggaaaaaattctgtccagcgatgactacggcaaggatcttactagtgtgatgcggttgctttcgaaacatagagctttcgaggacgagatgtccggcagatag

SEQ ID NO: 206702 - DNA, 7173 bp, Artificial Sequence
  Description of Artificial Sequence: Synthetic coding sequence
atgagcagcaccctgagccccaccgacttcgacagcctggagatccagggccagtactccgatataaacaataggtgggatcttcctgacagcgactgggataatgattcctcatcggcccgactttttgaaaggtcaagaataaaggctctcgccgacgagcgcgaggccgtacagaaaaaaacgttcaccaagtgggttaacagccatcttgccagagttacctgcagggtgggcgatctgtattccgacttgcgggacggcagaaacctgctcaggctgctggaagtcctgagcggggagattctgcctaaacccacgaaagggcggatgagaattcactgtctggagaacgttgacaaggccctgcagtttttgaaagagcagaaggtccacttggaaaacatgggaagccacgacatcgtggacggcaatcaccgccttaccctcggtctggtgtggactattatcctgcggttccagatccaagacatatctgtcgagaccgaggacaataaggagaaaaagtccgccaaagacgctctactgttatggtgccagatgaagacagcaggctacccaaacgttaatgttcacaatttcactacctcgtggcgcgacgggttggcattcaacgctatcgtccacaaacatcgccctgatctccttgatttcgagagcttgaagaaatgtaatgcccattacaatcttcagaatgcctttaatttggccgaaaaggaactgggcctcaccaagctgctcgatcccgaagacgtcaatgtggatcagcccgacgagaaatctatcattacatatgtcgccacatattaccactacttttccaagatgaaggctttggcagtagagggcaaacggattggtaaagtccttgaccacgccatggaagcagagagacttgtagagaagtatgaatcactagcctccgaacttctgcagtggatagaacagaccatagtcaccttgaatgatcgccagctggctaacagtctgtctggtgtgcagaatcagttgcagtctttcaacagttatcgcaccgtggagaaaccccctaagttcacagaaaaaggaaatctggaagtcctgctatttaccattcagagtaaattgagggccaataatcagaaggtctataccccacgagaggggcggctgatatccgatattaataaggcgtgggagagactggaaaaggcggagcacgagagagaactcgccctacgaaccgaactgattcgacaagagaaactggagcagctggctgcccggttcgatcgaaaggctgctatgcgcgagacgtggctgtccgaaaatcagagactcgtctcacaggataattttggtctggagctggctgctgtggaagccgccgtcagaaaacacgaggctatcgagacagatatcgtagcctactctggccgcgtgcaggctgttgatgctgtcgctgctgaactcgcggctgaacgctatcatgatataaagcgtatcgccgccagacaacacaacgtcgctagactgtgggatttcctccgccagatggttgcagcacgcagagaacgcctcctacttaacttggagctgcagaaagtgttccaggacctgctgtacctcatggattggatggaggagatgaagggtcgccttcaatcccaggacctggggcgccacttagctggcgtggaggacctcttgcaactccacgaactggtcgaagccgacattgcagtccaggccgagagagtaagggccgtgtcagcatcagccttaaggttctgtaacccaggcaaagaatatcgaccatgtgatccgcaattagtctcagaaagggtggctaaactggagcagtcttatgaagcgctgtgcgaactcgccgctgcccggagagctcgcctggaagagtctagaagattgtggagattcctctgggaggtgggggaagccgaagcatgggtgcgggagcagcagcacctcttggcatccgccgacacgggccgcgacctgactggcgccctgagactgctgaacaagcatacggcactgcgcggagaaatgtcaggaaggctcggaccgctcaagttaaccctcgagcaaggacagcaactggttgctgagggccaccccggggcgtcccaggcaagtgccagagccgctgagttgcaggcgcagtgggagcggctggaagccttagcagaggaacgggcccagagattggcccaagccgccagcctgtaccagttccaggccgacgcaaatgacatggaagcttggctggtggacgctctgcgtctggtttccagccccgagctgggtcacgatgaattcagtactcaggcgctggctcggcagcacagagccctcgaggaagaaatcaggagccatcgcccaactctcgatgccctgcgtgagcaggcagccgctctgccccctactctgtcgcgtacaccagaagtccaatctcgggttcccactctggagcggcactacgaggagcttcaggcaagagctggcgagagagctagagctctggaggctgcccttgctctctacacgatgttgtccgaggctggagcctgtggcctttgggtcgaggaaaaggagcagtggttgaacgggttagctttgcccgagcggctagaggatctagaagtggtgcaacagcgcttcgagactttagagcctgagatgaacacgctcgccgcgcagataaccgccgtgaatgatattgccgaacagctcttgaaggccaatcctccaggaaaggatcggatagtaaatactcaagaacagcttaatcataggtggcagcaattcaggaggctggctgatggcaaaaaagctgccttgactagcgcactgtcaatacagaactaccatctggagtgtactgaaactcaggcctggatgcgcgagaaaaccaaagtgattgagtccactcagggcttaggcaacgacctggcaggtgtactggccctgcaacggaaactagccggcaccgagagagacctggaggccatcgccgccagagttggagagttaactagagaagccaacgctttggcagctgggcacccagctcaggccgtcgccataaacgctaggttgcgggaggtccagacaggctgggaagatcttcgagctaccatgaggcgtcgtgaggagagcttgggtgaggcacgaaggctccaggactttcttcggtccctggacgacttccaggcctggctcggacgtacacagactgctgtcgcatctgaggagggtcccgcgacattgcccgaggccgaagccctgctggcccagcacgctgcgctccgcggcgaagtggaacgcgcccagtctgagtatagtagactcagggctctgggagaggaagttacccgggatcaagccgaccctcagtgcctgtttctgaggcaacggttggaggcacttggcacaggctgggaagaattgggtagaatgtgggagtcgaggcagggcagactggcgcaggctcacggcttccagggtttcttacgtgacgcaagacaagccgagggcgttctctcaagccaagagtacgtgctgtcacacactgagatgccaggcactttgcaggcagccgacgcggcaatcaagaagttggaagacttcatgtcgacaatggacgccaacggggagaggatccatggtctgctggaggcagggagacaacttgtgagcgagggcaatatacacgccgacaaaattcgagagaaagccgacagtatcgagaggagacataaaaagaaccaggacgctgcccaacagtttctgggaaggcttcgcgataatcgcgaacaacagcacttcttacaggactgtcatgaactaaagttatggattgatgaaaagatgcttacagcgcaggatgtatcgtacgacgaagcccggaatctgcataccaagtggcagaagcaccaggctttcatggcggaacttgccgctaacaaagattggctggataaggtcgataaagaaggacgtgagctcaccctggagaagccggaattaaaagcactggtgagtgagaagctccgtgacctgcaccgccggtgggacgaactcgaaaccactacacaggctaaagcgcggagcctgttcgatgctaacagagctgaactttttgcccagagttgttgcgcgctggaatcttggctagaatctttacaggcccagctgcattccgatgattacgggaaggatttaacctccgttaatatcctactcaaaaaacagcagatgctggagtgggagatggccgtcagagagaaagaagtggaggcaatacaggcccaggcaaaggctttagcccaggaagatcaaggtgctggcgaagtggagcgcacctctcgcgcagtcgaggagaagtttagagctttgtgccagcctatgcgggagcgatgccggaggttgcaggcctccagagaacagcaccagttccaccgggatgttgaagacgaaatcttgtgggtgactgagaggctcccaatggcgtccagtatggaacatggtaaggatttaccaagcgtacagctacttatgaaaaagaatcagaccctacagaaggagatccagggccatgagccccgaatcgccgacctaagggagcgacagcgggccctgggtgcagccgctgccggaccagagcttgctgagttgcaggagatgtggaaacgacttggacacgaattagagttgcgggggaagaggctggaagatgcacttagagcccagcaattctatagagacgctgcagaagctgaggcctggatgggggagcaggagctccatatgatggggcaggaaaaggcaaaggatgaactgagcgctcaagcagaggtcaagaaacaccaggtgctcgaacaggcacttgccgattacgcacaaaccatccatcagctggcggcctcttctcaggacatgattgatcatgagcacccggagtcaaccaggatcagcatcaggcaggctcaggtggataaattgtacgccggccttaaagagctcgccggagaaaggagagagagactacaggagcacctcaggctctgccaattgcgccgcgagttagatgacttggaacagtggatccaggagagggaagttgtggccgctagccacgagcttggccaggattacgaacacgttactatgcttagggacaagtttcgggaattctcaagggacacaagcaccattggccaggagcgtgtggatagcgccaacgctttagctaacgggctaatcgcaggggggcacgctgcccgggccactgttgcagaatggaaagactccctcaatgaggcctgggccgatctgttagagttgcttgatacccgcggacaggtgcttgcagctgcttacgagctacaaaggtttcttcacggggccagacaagccctggccagggtgcagcataagcagcagcagttacctgatggaaccgggagagacctgaatgctgcggaggctctccagagacgacattgcgcgtatgaacacgacatccaggccctcagcccgcaggtgcaacaggtacaggatgacggtcacaggcttcagaaggcttacgcaggggacaaggcagaggagatcggacgtcatatgcaggcagttgccgaggcttgggctcagctgcagggtagctctgccgcacgacgtcaactcttgctggataccacagacaagtttaggtttttcaaggccgtgagggaactaatgctgtggatggatgaggttaatctccaaatggacgcccaggagcgcccacgggacgtgtcatccgccgatctcgtgatcaaaaatcagcaaggcatcaaagccgagatcgaggcccgcgccgatcgcttcagcagctgtatagatatgggcaaggagctactggctcgctcgcattatgccgcggaggaaattagcgagaaactttcacagctgcaagctcggagacaggaaaccgccgagaaatggcaggaaaaaatggattggctccaacttgtgctggaggttctggtctttggcagagatgccggcatggcagaagcgtggctctgcagccaggaacccctcgtcagaagtgcagagctggggtgtacagtggatgaggttgagagtttgattaaacggcatgaggcattccagaaaagcgcagtggcatgggaagaaaggttctgtgccctagaaaagctgaccgcactggaagagcgggaaaaggaaaggaagcggaaacgggaggaggaggagagacgtaaacagcctcctgctcccgagccaacagccagcgtgccgcctggcgacctggtgggcggccaaacagccagcgacacaacctgggacggcacccaaccaagacccccaccctctacgcaggcacccagcgtcaacggtgtatgtaccgatggcgaacccagtcagccactcttgggccagcagaggctggagcacagcagcttccccgagggtcccggaccaggatcaggagacgaggcaaacgggccaaggggagaacgccagactcggactagagggcctgcaccttcagccatgccacagagcagatctaccgaatcagcccatgcggcgactctgccgccacgggggcccgaaccaagcgcccaggagcagatggaagggatgttatgcaggaagcaggagatggaggcgttcgggaagaaggccgccaatagatcctggcagaacgtgtactgcgttctcaggaggggctctctaggcttttacaaagatgcgaaggccgccagcgccggggtcccctaccacggcgaagttccggtcagcctggcccgggcccagggctctgttgctttcgactatcgcaagaggaaacatgtattcaagttgggacttcaggatggcaaggagtatctgttccaggcaaaggacgaggcagagatgtcctcctggctgcgcgtcgtgaacgccgccatcgcgacagccagtagtgcttccggcgagccagaggagcccgtggtaccctccaccacccgcgggatgacaagggccatgaccatgccccccgtgtctcccgtgggagccgaagggccggtggtactgcgctcaaaggacggacgagaaagagagagagaaaagcggtttagtttttttaagaagaataagtag

SEQ ID NO: 206703 - DNA, 2805 bp, Artificial Sequence
  Description of Artificial Sequence: Synthetic coding sequence
atgagcagcaccctgagccccaccgacttcgacagcctggagatccagggccagtactctgatattaataatcgttgggacttgcctgatagtgattgggataatgacagcagctccgccagattgttcgaaagatccagaattaaggcacttgccgatgaacgcgaggccgtacagaaaaagactttcaccaagtgggtgaactcacaccttgcgcgagttacttgcagagtgggagacctctattcagatctgagagacggacgaaacctgctccgtctcttggaagtgctgagtggcgaaattctccctaagcccacaaaggggcggatgagaatccactgcctagagaacgtggacaaggccctgcagttcctcaaggaacagaaggtgcatttggaaaacatgggttcccacgatatcgtggatgggaaccaccggctcaccctgggcttggtttggacaatcatcttgcggttccagattcaggatatctctgtagagacggaggacaacaaggagaaaaagtccgctaaggatgctcttctgttatggtgccaaatgaagaccgccggataccccaacgtgaacgtacacaattttacaacctcctggagagacgggttagctttcaacgcaattgttcataaacaccgcccagaccttcttgacttcgaaagtctgaagaagtgcaacgcccactacaatctccagaacgcgttcaacctggcggagaaggaactggggctgactaaacttctggaccccgaggatgttaatgtggatcagcccgatgagaagtctattatcacttatgtcgcaacatattaccactattttagtaaaatgaaggctctcgccgttgagggcaaacgcatagggaaagtgctggaccacgccatggaggccgagcgcctcgtcgagaaatatgaatcactcgctagtgagctgctccagtggatcgagcaaacaatagtaacactgaacgataggcaattggctaactcactgagtggagtgcaaaaccagttacagagcttcaactcttaccgcaccgttgagaagccccccaagttcaccgagaaaggtaacctggaggttctgctcttcaccattcagagcaaactgagggccaataatcagaaagtgtatacgccaagggaggggagactgatttctgacattaacaaggcctgggagcgtctggagaaagctgaacacgaacgcgaattagccctcaggactgagctgattaggcaggagaagctggaacaactggccgcccgctttgaccgaaaggccgcaatgcgtgaaacttggctgtccgagaatcagcggctcgtcagccaggacaactttggactcgaattggcagctgtagaagctgccgttaggaagcatgaggctatcgaaacagatatcgtggcctactcaggcagggtgcaggctgtcgatgcggtggccgcagaactcgccgcagaaaggtaccacgatattaagcgcatcgcagcccgccaacataatgtggctcgactgtgggatttcctgcggcagatggtagctgcacgcagggagaggttgctcctgaacctcgagcttcaaaaggtgttccaagatctactgtatctcatggactggatggaggagatgaagggaagattgcagtctcaggacctggggcgccacttagccggggtggaagacctgctgcagctccacgagctggtagaagccgatatcgcagtacaggcggagcgggtgcgtgccgtgagcgcatccgcccttcggttctgtaacccaggtaaggagtatcggccatgcgatcctcaacttgtgtcagagcgcgttgctaaattgacagcgttggaagaaagggaaaaggaaagaaagcgcaaaagggaggaggaggagagaagaaaacagccccctgccccggagccaacggccagcgtgccccctggtgatctggtgggcggccagactgcctcggacaccacatgggatggaacccagccgcgccccccaccttccacccaggccccttccgttaacggggtgtgcacagatggtgagccgagccagccactgctgggccagcagcggctggagcactccagctttcccgaggggcctggacctggttccggggacgaggccaacggcccgagaggcgaaagacaaactcgcacacggggaccggcacccagcgcgatgcctcaatcgaggtcaacagaatctgcccatgcagctacattaccgccccgtggacctgagccctccgctcaggagcaaatggaaggtatgctttgtcggaagcaagagatggaggcattcggcaagaaagctgccaaccggagttggcaaaacgtctattgcgtgctgcggagaggctctctgggtttctacaaagacgctaaggccgcaagcgctggagtgccttatcacggagaggtgccggtatcccttgccagagcccaagggtctgtcgcattcgactataggaaaagaaagcatgtattcaagttgggcctgcaggatggaaaagagtatttgtttcaagccaaagatgaggccgagatgagtagttggctccgggtggttaacgcagctatcgcaacagcctcttccgcttcaggtgagccggaggagcctgtagtgcccagcactaccagagggatgactagggctatgacgatgcccccagtgtcccccgtcggcgctgaaggtcccgtggtgctgcgctccaaggatggccgtgaaagggagagggaaaaacggtttagttttttcaaaaaaaacaaatag

SEQ ID NO: 206704 - DNA, 354 bp, Artificial Sequence
  Description of Artificial Sequence: Synthetic coding sequence
atgagcagcaccctgagccccaccgacttcgacagcctggagatccaggggcagtacagcgacatcaacaataggtgggacttaccagactctgattgggacaatgactccagttctgctcgtctttttgagcgctcacgaattaaagcactcgccgatgaacgcgaagccgtacaaaaaaagaccttcactaaatgggtgaattcacatttagctcgtgtgacctgcagggttggggacctgtactcagacctgagggatggaaggaacctgctgcgtcttctggaggtgttatccggtgagatcctgccaaaaccaacaaagggtaggatgcggattcactgcttggaatag

SEQ ID NO: 206705 - DNA, 7098 bp, Artificial Sequence
  Description of Artificial Sequence: Synthetic coding sequence
atgagcagcaccctgagccccaccgacttcgacagcctggagatccaaggtcagtatagcgacatcaataacaggtgggatctgcccgacagcgattgggataatgatagctcttctgcacgcctgttcgagcgcagtcgcatcaaggccttagctgatgagcgcgaagccgtgcagaaaaaaacgtttacaaaatgggtgaattctcatctggctcgggtgacctgccgggtaggtgatctgtattccgatctgcgggatggcaggaaccttctgaggctgctggaggtcctgtcaggcgaaatcctgccgaagcctacaaaaggtagaatgcgaatacattgcttggagaatgtggacaaggccctgcaattcctgaaagaacagaaggtccacttggagaatatgggaagccacgacatcgtagatggaaaccacaggctcacgctcggtctggtgtggacgattatcctccgttttcaaatccaggatatttctgtcgaaactgaagacaataaggaaaaaaagtcagcaaaggacgcgctcctcctgtggtgtcaaatgaagactgcaggctacccgaatgtcaacgttcacaatttcacaacatcatggagagatggtctcgccttcaacgcaatcgtacataaacaccggcctgacctcttggatttcgagagcctgaagaagtgcaatgcccactacaatctgcagaacgcatttaatcttgcggaaaaagagctggggcttactaagctgctagatccggaagatgttaatgtggatcagcccgacgagaagtccattatcacctacgtcgccacctactaccattacttctcgaagatgaaagccttggcggtggaggggaagcgtatcggtaaagtacttgatcatgcaatggaagccgaacgactcgttgagaagtatgaatctctggcaagcgagttgctgcaatggatcgaacagacgatagtcaccctcaacgaccggcagttggctaacagcctttccggcgtgcagaaccagctgcagtcatttaacagctacagaaccgtcgagaagccacctaaattcacagagaagggcaatctggaagtcttgctttttacaatccagagtaaactcagagctaacaaccagaaagtctataccccccgggaaggtagactaatctcggatatcaataaagcctgggaacgtcttgagaaagcagagcatgagagagagttggcgctgcgcacagaactaatccgccaagagaaactggaacagttggcagccagattcgatcgaaaagcagctatgcgcgagacctggttaagcgagaatcagcgtttggtctcccaggacaactttggcctggagctggccgcagtggaggcagcagttagaaagcacgaggccatagagaccgacatagtagcctattccggtcgggtccaagcagtagatgccgtggctgcagaactggctgcagaaaggtaccacgacattaagaggatagctgcgcgacagcacaacgtggctcgactgtgggacttcttaaggcagatggtggccgctagacgtgaaaggcttctcctgaacctcgagctgcaaaaggtgtttcaggacctcctgtatctgatggactggatggaggagatgaaaggcaggcttcagagtcaggatttaggccgacacttggctggcgtagaagacttactccagcttcatgagctggtggaggcagatattgcagtgcaggccgaacgggtcagagcggtctccgcgagcgcactccgattttgcaaccccggtaaggagtatcggccctgtgacccgcaattggtgtctgaaagagtggcaaagttagagcagtcatacgaagccctctgtgagctggccgctgcccggcgagctaggctcgaggaaagccggagactgtggcggttcctctgggaagtgggtgaggctgaggcttgggtcagagagcagcaacaccttctcgccagcgctgacaccgggagggacctcaccggcgctctgcggctattgaataagcacacggccctccggggcgagatgagcgggaggcttgggcccttgaagctcacactagagcaaggacagcagctggtcgccgaaggacaccctggcgcctcccaggctagcgcgcgggccgccgagcttcaggcccagtgggaaaggctcgaggcactggcggaggagcgggcccagagactcgcccaagcagcatcactttaccagtttcaggccgatgcaaatgatatggaggcttggctagtagacgccctacgcctggtcagcagccctgaattaggtcacgacgaattttctacacaagcgctcgcaagacagcaccgcgctctggaggaggagatccggtcccatcggcccacactcgacgccctaagagaacaggctgccgctctccccccaacattgtcccggacccctgaagtgcagagccgcgtacctacactggagaggcattacgaggaattacaagcgagagcgggcgagagagctagggcgcttgaggccgcccttgccctgtacacaatgctgtccgaggcaggtgcatgtggcctgtgggttgaggaaaaggagcagtggctgaacggcctggctctcccagagaggctagaagatttagaagtggtgcagcagcggtttgagaccctcgagcccgagatgaataccctggccgcccagatcacagctgtcaacgatattgctgagcaattactgaaagctaacccgccaggaaaggaccggattgtgaacacccaggaacagcttaaccatagatggcaacaattccgaaggttagctgatggtaagaaagcggccctgaccagtgcactttctatacagaactaccacctcgagtgtaccgagactcaggcttggatgagagagaagactaaagtgatagagtcaacacagggtcttgggaacgacttggctggggtcctcgctctccagcgaaagctcgctggtactgagcgcgatctggaagccattgccgcacgagtcggtgagctgaccagggaagctaatgctctggccgcaggacaccctgctcaagcagttgccattaacgccaggctgcgggaggttcaaactggctgggaggacctgcgagccacaatgcgacgacgggaagaaagtctcggagaagctagacgcctccaggatttccttagatcactggacgacttccaagcttggctaggaagaacccagaccgccgtggcaagtgaggaagggccggcaacgttaccggaagccgaggccttactagcccaacacgccgccctcagaggcgaagtggagcgagcgcagagcgaatactcccggctgagggcactgggtgaagaagtcaccagggaccaggctgaccctcagtgcctcttcctccggcaaagattggaggccctcggtacgggctgggaggagctgggaagaatgtgggaatcacggcagggacggctggcccaagcccatggctttcaggggtttctacgggacgcaagacaagcagaaggggtgctctcttcccaggagtatgtgctgagtcatacagagatgcccggaacgctccaggccgccgatgccgctataaaaaaactggaagatttcatgtctacaatggacgctaacggcgagagaattcatggcctgttggaagctggcaggcagctcgtgtcagaggggaacatacacgctgataaaattcgggagaaggctgacagtatcgaaagaagacacaaaaagaatcaggacgcagcccaacagtttctcggcaggctgagagacaaccgtgagcagcagcacttccttcaggattgccacgaactgaagctttggatcgatgagaagatgctaacggcgcaggacgtgtcgtacgacgaagcacgcaacctccataccaagtggcagaagcaccaggccttcatggctgagctagctgcgaacaaggattggctcgataaggtagataaagaaggccgcgaacttacgctggaaaagcctgagctgaaagccctggtctctgagaaactcagggatctccaccgcaggtgggatgaactcgagaccaccacacaagccaaggctagatcattgttcgacgctaacagggccgaactattcgcccagtcctgctgtgcactggaatcttggttggaaagcctccaggctcaactccactcagacgattacggtaaggatcttacttccgtcaatatattactgaaaaagcaacagatgcttgagtgggaaatggctgtaagagagaaagaagtggaggccatccaggctcaagctaaggcactggcacaggaggaccaaggagccggagaggttgaacggacaagtcgagccgtcgaagaaaaattccgagcactctgtcaaccaatgcgagaaaggtgcaggcggttgcaggcatcccgcgagcaacatcaattccaccgggacgtggaggacgaaatcctctgggttactgagagactgcctatggcttcctcgatggaacatgggaaagacctcccgagcgttcagctactgatgaagaaaaaccaaacgctgcagaaggagattcagggccacgagccaaggatcgcagatctgagagaaaggcaacgcgccctcggcgcagctgctgcaggccctgagctagctgaactgcaggagatgtggaagaggctgggccacgagctggagctgaggggtaagcgcctcgaagatgcgctaagggcgcagcagttctacagggatgctgccgaggccgaagcctggatgggcgagcaggagctacatatgatgggccaagaaaaggctaaggatgagctgtcagcccaggccgaagttaagaagcaccaggttttggaacaggccttggctgactacgcccagacaatacaccaactcgcggctagctcacaagatatgatagatcacgagcatccagagtccacaaggatatcgattcggcaggctcaagtggataaactgtacgccggactgaaagaactggccggcgaacgaagggaaagactccaggaacacttacgtctgtgtcaactacggcgcgaacttgacgatttggagcaatggatccaggagcgggaggtcgttgcggccagccacgagttgggccaagactatgaacacgtgacaatgctgcgcgacaagttccgagagttttcccgggacacttcgactattggacaggagcgggtagacagcgctaacgcgttggctaatgggttgatagctggcggtcatgctgcccgggccactgtcgcagagtggaaggactctctgaatgaagcatgggcggatctgctggaattactggacacacgcggacaggtccttgcagcagcctacgaactgcagcgctttctacatggcgctcggcaagcgttggcaagggtgcagcacaagcagcagcaactccctgatgggaccggtcgggacctgaacgccgctgaggcgctgcagcgaagacattgcgcttacgagcatgatatccaagccttatcaccacaggtgcaacaggtccaagacgacggacatcggctccagaaggcctacgccggcgataaagccgaggagattggccgccatatgcaggccgttgctgaagcttgggcccagctgcagggttctagtgccgcgcgccgacagcttttgcttgatacaacagataaattccgcttctttaaagccgttagagaactgatgctgtggatggatgaggtcaacctccaaatggatgcccaggaacgacctcgcgacgtctcctccgccgatttggtgatcaagaaccagcaggggatcaaagccgagatcgaggcccgagccgataggttctcttcttgtatagatatgggcaaggaactcctggctaggtcccactacgccgcagaagaaatcagcgagaaattgtcccagctgcaggcgaggagacaggaaacggctgaaaagtggcaggagaagatggattggctgcagctcgttctcgaggtcctggtcttcgggagggacgctggaatggcagaggcctggctgtgcagccaggaacccctcgtgcgctctgccgagctgggctgcacggttgatgaggtcgagtccttgatcaagcggcacgaggcctttcagaaatcagcggtggcctgggaagaaaggttctgtgcacttgagaagcttacagccctggaagaacgagagaaggaacgaaagagaaagcgcgaggaggaggagcgccggaagcagcctccagcccctgagcccaccgcatcggttccccctggtgatcttgtgggagggcagactgccagcgacacgacttgggacggcacccagccaaggccacctccctccacccaagcaccttccgttaacggtgtgtgcactgatggcgagcctagtcagccattgcttggacaacaaaggcttgagcacagcagtttcccagaagggcccggaccgggaagtggcgacgaggccaacggccctaggggagagaggcagaccagaacgcgtgggcccgccccttccgctatgccgcaatctcggtcaacagagagtgcccatgccgctaccttgccacctagaggccccgaaccctccgcccaggaacaaatggaaggcatgctgtgtaggaaacaggagatggaggccttcggcaaaaaggccgctaataggagttggcagaatgtttattgtgtcctgcgccggggatcacttgggttctataaggatgcaaaggctgcttctgctggcgtcccgtatcatggcgaagtgcccgtttccctggccagggcccagggctcagtcgcgtttgactaccggaagaggaagcatgttttcaagctcggcctgcaagatggaaaagaatacttgtttcaggcaaaggacgaggtgagttgccctagttgcagttccctctcagtgccctttcaaaaactaccggcagctgacagccccagttttccggtgctgcctttgtttccaggcctcgttctgtgtggaaaaaccggatgcgtccgaaggccgcaccaagctgcacttcctgtttag

SEQ ID NO: 206706 - DNA, 7173 bp, Artificial Sequence
  Description of Artificial Sequence: Synthetic coding sequence
atgagcagcaccctgagccccaccgacttcgacagcctggagatccagggacagtatagtgatatcaataaccgatgggacctgcccgattctgattgggataacgactcaagttcggcccgactgtttgagcggagtcgcattaaagctttggcagatgaacgggaggctgttcagaagaagacattcaccaaatgggttaattctcatctggctagagtaacatgccgcgtgggggatctatatagcgacctgagggacggcagaaatctactgagactgctggaggtgctgagtggggagatcctgccgaaaccaaccaagggccgcatgcgcatccattgccttgagaatgtagataaagcgctgcagttcttgaaggaacagaaagtccacctcgagaatatgggcagccacgatattgtagatggaaatcaccgcctgaccctggggctcgtgtggaccataattctccgattccagatacaggacatttccgttgaaaccgaagataacaaggagaagaaatccgctaaggacgccctgctgttgtggtgccaaatgaaaacagccggatatccgaacgttaatgttcataattttacgaccagttggagagacggcctggcgttcaatgccatcgtgcacaaacacagacctgacctcctggattttgagagcctgaagaagtgcaacgcgcactataacttgcagaatgctttcaatttggcggagaaggaacttggcctgaccaagttgctcgaccctgaggatgtgaatgtcgaccagcctgacgagaagtcgataatcacttacgtggccacttactaccactatttttccaagatgaaggcccttgccgtagagggcaagcgcatcggtaaagtgctagaccacgctatggaggccgagaggctcgtggaaaagtatgagtctttagccagcgagctcctgcagtggatcgaacaaaccatcgtcacactgaatgatcggcagctagccaactctctgtcaggcgtccagaaccagctgcaaagtttcaattcctacaggacggtggaaaagccccctaagttcacagagaaagggaacttagaggtcctgctgtttacaatccagagtaagctaagagccaacaatcagaaggtgtacactcctcgagaagggaggctgatcagtgatatcaataaggcatgggagcgcttagaaaaggccgagcacgagagagaactcgcactgcgaaccgagttgatcaggcaggagaagctcgagcagctggctgctcgcttcgatcgcaaggctgcgatgcgcgaaacttggctgtctgaaaaccagaggctggtctctcaagataacttcggtttggagctggccgcagtggaagctgcagttcggaagcacgaagctatcgaaaccgacatcgtggcctatagcggcagggtgcaggccgtcgatgccgtggccgcagaactggcagcagagaggtatcacgacattaagcgtatcgccgcgcgacagcacaacgttgcgaggctgtgggactttcttagacaaatggttgccgctaggagggagcggttactgcttaacctcgaactgcagaaagtgttccaggatctattgtaccttatggattggatggaggaaatgaaggggcggcttcagagtcaggatttaggcagacatctggctggcgttgaggaccttttgcagctgcacgagctcgtcgaggccgatatcgcagttcaggcagagagggtacgggcagtgtccgccagcgctctccggttctgcaatccaggcaaagagtaccgcccctgtgacccacaacttgtgagcgagcgcgtggcaaagctggagcagtcatatgaagctctttgcgagcttgcagcagccaggagagccagactggaagagtctcggcgactgtggaggtttctgtgggaagttggtgaagccgaggcctgggtcagagagcaacagcatttactcgcctcagccgacactggtcgggatctcaccggcgcactcagattgctaaataagcacaccgctctgcggggagagatgagcgggagactcgggcccctgaagctgactctcgaacaaggtcagcagttggtcgctgaaggtcacccaggtgcgtcacaggcttctgctagggccgccgaactgcaggcacagtgggagcgccttgaagccctcgctgaggagcgcgctcagaggctcgcacaggccgcctccttgtaccaattccaggcggacgctaacgatatggaggcctggctggtggacgctcttcgactggtctcctcccctgagctgggccacgacgaattctcgacacaggcccttgctaggcagcatagagccctcgaagaagagatccgcagccatagacctacactcgatgccctccgggaacaagcagctgcattgccccctacactttcgaggactcctgaggtacagtccagagtgcccacgcttgagcgacactatgaggagctacaggcacgcgctggagaaagagccagagcattagaagcggccctggcgctttataccatgctgagtgaggccggggcttgtggtctgtgggtggaggaaaaagaacaatggttgaatggcctggcactgccagaacggctggaagacctggaggtggttcagcaacggttcgaaacacttgaaccagagatgaacaccctggctgcccagattaccgccgtaaacgacatcgcagagcaactgctgaaggccaaccctcccggtaaagatcggatcgtcaatacacaggaacaactgaaccacaggtggcagcaattcaggcgactggccgacggaaaaaaggccgctctcacatccgccttgtctattcaaaactatcatctcgagtgcaccgagacccaggcctggatgagagagaaaactaaggtgatcgagagcacccagggactgggtaacgacctcgccggcgtgcttgcgctacagaggaagctggccgggactgagcgggatctggaagcgatcgctgcgcgagtgggagagctcacaagagaggcaaatgctctggcagccggtcaccctgcccaagctgttgccatcaatgcacgcttacgggaagtgcagactggctgggaagatctgcgagcaacaatgcggcgtcgggaggagtccctcggggaggccaggcgattgcaggatttcttacgctctctggacgattttcaggcctggctgggaagaactcagacagcagtcgcatcagaagaaggaccagctactttgcctgaggccgaagccctgctcgcgcaacatgcagctttaagaggagaggtggaacgtgcacagagcgaatatagcagactgcgggctcttggcgaggaagtaactcgagatcaagccgatccacagtgtctttttctgaggcagcggctagaggccctcggcaccggctgggaagagttaggccggatgtgggagtccaggcaaggacgccttgctcaagcccacggcttccaggggtttcttcgcgatgctcggcaggctgaaggcgtgcttagcagccaggaatatgtactgtcccatacagagatgcccggaactctccaagctgccgacgccgccattaaaaagttagaagatttcatgagcaccatggatgccaatggcgaacgtatccacggtctgctggaggctggccgccagctggtgtctgaggggaacatccacgctgacaagataagggaaaaagctgactctatcgagcgccggcataagaaaaaccaggacgccgcccagcagtttttggggcggctgcgggacaatagagaacaacagcattttctccaggactgtcacgaactgaaactgtggatcgacgagaagatgcttactgcccaggacgtgtcatatgatgaagcgagaaacctacatacaaagtggcagaaacaccaggcttttatggccgagctggccgccaataaggactggctggataaagtggacaaggaggggcgggagttgacattggagaaacccgagctcaaggcccttgtttccgaaaagctccgcgatttacacagacgttgggatgagctggaaacaaccacgcaagccaaagcccggagtctgttcgacgccaaccgagctgaattgtttgcacagtcttgttgtgcattggagagttggttagagagccttcaggcccagcttcactctgatgattatggcaaagatctgactagcgtgaacattttgctgaagaaacagcagatgcttgagtgggagatggcagtcagagagaaggaagtggaagcgattcaggctcaggccaaggctctggcccaagaggatcagggtgctggcgaagtcgaacggacatcccgtgcggttgaagagaaatttagagccctgtgtcaacccatgagggagcgctgtcgccggctgcaagcctccagagagcaacatcagttccaccgggatgtggaagacgaaattttgtgggtgactgaaagactgcccatggcctctagtatggaacatggcaaggatctgccgtctgtacagctgctgatgaagaagaaccagactctgcaaaaggaaatacagggccacgaaccccgcatcgctgatctgcgagaacgccagcgagccctgggggccgctgccgctgggcctgagctggcagagttgcaggaaatgtggaagaggttaggccatgaactcgaactacgcggcaagcgcctcgaagacgccctgcgggctcagcagttttatcgagacgctgcggaagccgaagcatggatgggggaacaagagctgcacatgatgggccaggaaaaggccaaagacgaactgtctgcgcaggccgaagttaagaagcatcaggtgctggagcaagcacttgctgattatgcgcagactatccaccaactagcggccagttcacaggatatgatcgaccacgagcatcccgagagtacccgcatcagtattcggcaagctcaggttgacaagctgtatgccggcttaaaggaattagctggggaacggcgtgaacggctgcaagaacatcttcgactttgtcaattaagacgggagctcgacgatctggagcaatggattcaggagagggaagttgtagctgccagtcacgagctgggccaggattacgagcacgtgacaatgctgagggacaagttccgggaattttctagagatacgagcacaatcggccaggagagggtcgatagcgcaaacgctttggcaaacgggctgattgctggcggacacgccgctagggccacggtcgcagagtggaaagacagcctgaacgaggcctgggcagatctcctcgagttgctggatacccggggccaggtactggccgccgcatacgagctccaaaggttcctgcatggggcgagacaggccctagcacgtgttcagcataaacagcagcagctcccggacggaacaggccgggacctgaacgccgccgaggccctgcagaggcggcactgtgcatatgagcatgatattcaggccctgagcccacaggttcagcaagtacaggatgatggccatcggttacagaaagcgtacgcgggagataaagccgaggagatcggaaggcatatgcaggcggtggccgaagcctgggcccagctgcagggtagtagcgctgccagaagacagctgctattggacactaccgataagtttcgattctttaaggctgttcgcgagcttatgctttggatggatgaagtgaatctccagatggacgctcaggagcggcctcgcgacgtgtcatctgccgatttagtgataaagaatcagcaggggataaaagcggaaattgaggcccgggcggataggtttagctcctgtatcgacatgggcaaggaactgctcgccagatcacactacgctgcagaggaaatttctgaaaagctctcccagttgcaggccagaagacaggagacggctgaaaagtggcaggaaaagatggactggcttcaactggtgctcgaggtgctcgttttcgggcgcgacgccggcatggccgaggcttggctgtgcagccaggagccattggtacggagcgccgagcttgggtgcactgtcgacgaagtggagtccctgattaagcggcatgaggcctttcaaaagagcgccgtggcctgggaggagagattttgcgccctggagaaactgaccgccttggaggaaagggagaaggaaagaaaacgcaaacgagaagaagaggagagaaggaaacaaccacccgcacccgaacccaccgccagtgtgccccccggggacctcgtcggagggcagactgcctctgataccacctgggacggaacgcagccacggccgcctccctccacacaggccccgagtgtaaacggagtatgcactgatggtgagccttcacaaccgttactggggcaacagcgattggagcatagctcctttcccgagggcccgggacctggtagtggggacgaagccaacggaccacgcggggaaagacaaactcgcactcgcggcccagctccctcagcaatgcctcagagccgttccacagaaagcgcccacgccgctactctcccaccccgcggacccgagccctccgcccaggagcagatggaagggatgctctgtaggaaacaggaaatggaggctttcggtaaaaaagcagcaaataggagttggcagaacgtgtattgtgtgctgcggcggggttcactcggattctacaaggacgccaaggcggcttctgcaggggtgccataccacggcgaagtgcctgtgagtttggctagggcacaaggtagtgttgcgttcgattacaggaagagaaaacatgtattcaagcttggcctgcaggatgggaaggaataccttttccaagccaaggacgaggccgagatgagcagttggcttagagtggttaatgccgctatagcaaccgcatcttctgcctcaggtgagcctgaggagccagtcgtacctagtaccaccagaggaatgacacgggccatgacgatgcctccggtgtcccctgtaggagccgagggtccggttgttctgcgttctaaggacggccgcgaacgcgaaagagaaaaacggttttcctttttcaaaaagaataaatag

SEQ ID NO: 206707 - DNA, 6465 bp, Artificial Sequence
  Description of Artificial Sequence: Synthetic coding sequence
atggcccaggtgcccggcgaggtggacaacatggagggcctgcccgcccctaacaacaatcccgcagcacgttgggagagtcccgaccgaggttgggagagggagcagcctgccgcctcaactgccgccgcttctcttttcgaatgttcccggattaaggcgctggccgatgaaagggaggcggtacagaagaagaccttcacgaaatgggtgaattctcatctggcaagggtcggttgccacattggcgacctttacgtcgatttaagggatggatttgtgctcacacgactgcttgaagttctgagcggcgagcagcttcctagacccacgagaggtaggatgaggattcactcattggagaatgtggacaaagccctgcaatttctgaaagagcagagagtacacctcgagaacgtggggtctcacgacatcgtggacggcaatcaccgattaacattagggttggtgtggacaatcattctccgattccagatccaggtgatcaagatagaaacagaagacaaccgggagactcgtagcgctaaggacgccctgctcctctggtgtcagatgaagacagcaggctatccggaagtcaatatacagaattttaccacttcctggcgcgacgggctcgcatttaacgctttgatccataggcatcggcccgatctggtggacttttctaagctgactaaatcgaatgcgaattacaatttgcaaagggccttccgaaccgccgagcagcatttggggctggccagacttcttgaccctgaagatgtcaatatggaggctcctgacgagaaatccattatcacctacgtcgttagcttctatcattacttctctaaaatgaaggctttggccgttgagggaaaacgtatcgggaaagtcctggatcaggttttggaagttggaaagataatcgagagatacgaggagctggcagcagaactgctagcatggatccaccgcacagtcggtttaatttctaatcagaagtttgcaaatagcctgtctggtgttcagcaacaactgcaggcctttacagcgtactgcacccttgaaaagcccgtgaaatttcaagagaagggcaacctggaggtgttgttgtttagcatacagagtaaactgagagcctgcaatcgcagactcttcgtgcctagggagggatgtgggatttgggatattgacaaggcctggggcgagctggagaaggccgaacatgaaagagaagccgccctcagggctgaactgatccgacaagagaagttagaactgctggcccagagatttgaccataaggtcgccatgcgtgagagctggttgaacgaaaatcagcgtctggtgtctcaggacaatttcgggtatgagttgccggcggtggaggccgccatgaaaaaacatgaagcgatagaggcagatattgctgcctacgaagagcgggtccagggtgtggcagagctggcccaggcactagccgccgaagggtactacgatatcagacgcgtggcggcacagagggacagcgtccttcgccagtgggcactgctgaccggattggtcggggccaggcgaacgcgcctggagcagaatctagctttgcagaaagttttccaggaaatggtttacatggtcgattggatggaagagatgcaggcacaattgctgagtagagagtgtggccagcacttggtggaagccgatgacttacttcagaaacacgggctgcttgagggtgacatcgccgcacagagcgaacgggtcgaggccctgaatgccgccgccctcagattttcacaactgcagggataccagccctgcgatccacaggtcatttgtaaccgagtgaatcacgtgcatggttgccttgccgagctacaagaacaagcagctcgcagacgagccgaactggaggccagcagatccctctgggctctgttacaggaactggaagaagccgaatcgtgggcaagagacaaggagaggcttctggaagcggcaggaggaggcggggccgccggcgcagccggtgcagccgggaccgcagggggagcccatgatcttagctctaccgctagactcttagcgcagcacaagattctacagggagaattgggtgggagaagagcactacttcagcaggcgctgcgttgcggagaagagctggtcgcagccggaggtgcagtcggccccggagccgacacggtgcatctggtcggactcgccgagcgggctgcgtccgcccggcgccgatggcagaggttggaggaagcagctgccagacgagaacgtcggctgcaggaagcccgtgccctacatcaatttggcgctgatttggacggcctgctcgattggctgagggatgcttatcggcttgccgcagccggcgattttggccatgacgaggcctcttcaagacgcctcgccagacaacatcgggctctcactggggaggtggaggctcaccggggaccagtaagcgggctgcgccggcaactcgcaacgctgggcggcgcaagcggcgcgggcccgctcgtggtagctcttcaggtaagagttgtcgaagccgaacagctgtttgcggaagtaacggaggttgccgctttgcggcgtcaatggctgcgggatgccctggccgtgtacaggatgtttggggaagtccatgcatgcgaactctggatcggggaaaaggaacagtggctgctgtccatgcgagtaccagactctctggatgatgtcgaggtcgttcaacatcggtttgaaagcctggatcaagagatgaacagcttgatggggcgcgttctagatgtgaatcataccgtccaagaactcgtcgaaggcggccacccttcgagcgatgaagtacgctcatgtcaggaccatctgaattctagatggaaccgtatcgttgagttggttgaacagaggaaggaggagatgtctgccgtgctactagtggagaaccacgtccttgaggttgccgaggtgcgggcccaggtccgggaaaaacgacgcgctgttgaaagcgcacccagggctggcggtgcattgcaatggcgccttagcggcctggaagccgccctgcaggcgctcgagccacgccaggccgctctcttagaagaggccgcgctgctcgccgagcgctttcctgctcaggcggccagactccaccagggagccgaagagctcggggctgagtggggggcgctcgcctctgctgctcaagcctgcggtgaagcggtcgcagcggccggacgattacagaggttcctgcacgacctggatgcattcctggactggcttgttcgcgcccaagaagccgccggaggatctgagggccccctgccaaatagtctagaagaagctgacgcattgctggccaggcatgctgccctaaaagaagaagtggaccagcgggaagaagactatgcccgcatcgtagccgccagcgaggctctattggcggccgatggggctgagttgggtcccggcctcgccctggacgaatggctgccacatcttgaactgggctggcacaaactgctcgggctgtgggaggctcgcagggaagctctggttcaggctcatatctaccagttgtttctgagagatctgcgccaggcgttagttgtgctgcgaaaccaggagatggccctatcaggggctgagctgccaggaaccgtcgaatccgtggaggaggccttaaagcagcaccgcgattttctgaccactatggaactctctcagcagaagatgcaggttgccgtccaggcagctgagggtctgctgcgccagggcaacatctatggtgaacaggcacaagaagccgtgactcgattgctcgaaaaaaatcaggagaatcaactgcgcgcgcagcagtggatgcaaaagctgcacgatcagcttgagttacagcactttttacgcgattgccacgaactggacggttggatccatgaaaaaatgctgatggcccgcgacggcacccgagaagacaaccacaagttacataagcgatggctgcgtcaccaagctttcatggctgagctcgcccagaacaaggaatggctggagaagattgagcgagaggggcaacaacttatgcaagaaaaacccgagctggccgcctcagtacggaagaagctgggcgaaatccggcagtgttgggccgaacttgagagtactactcaggcaaaagctaggcagctctttgaggctagcaaggccgatcagctggtccagagcttcgccgaactggacaagaaactgcttcatatggagtcacagttgcaggacgtggaccctggcggtgatctcgcaactgtaaactcccaactgaagaaactacagagtatggagtctcaggtggaagaatggtaccgggaggtcggagagcttcaggcccagacagccgccctgccactggaacccgcatcaaaagaactggtaggcgaaaggcagaacgccgtgggtgagaggttagtccgattactagaacctctccaggagcgcaggcggctgcttctggcctccaaggagctgcaccaggtcgcgcatgatctggatgacgagctggcgtgggtacaggagcgcctgcccctggctatgcagacagaacgcgggaatgggctgcaggcagtacagcagcacataaaaaaaaatcagggactgcgaagagagattcaggcacacggcccaaggctagaagaagttttggagagggcaggcgccctcgcctcattgcggtccccggaggctgaggccgtcaggaggggccttgagcagttgcagagtgcctgggctggactgcgcgaagccgcagagcgccgtcagcaggtgttagatgccgcgttccaggtggaacaatattacttcgatgtcgcagaagtcgaagcctggctcggggaacaggagctgctgatgatgtcagaagataaggggaaggacgaacaatcaacacttcagctcctgaagaagcaccttcagctggagcaaggggtcgagaattacgaagagtcaatcgctcagctgtccaggcaatgccgagcgctgcttgagatgggacatcctgactcagaacagattagccggagacaaagccaggtggataggctctatgtcgcgttaaaagaactcggagaggagcgccgggtggctctggaacaacagtactggctgtaccagctcagccgccaggtcagcgagcttgagcactggattgccgagaaggaggtcgtcgccggctctccggagctggggcaagacttcgagcacgtgagtgtcttacaggaaaagttcagtgagttcgcctccgagactggcatggccggccgggagcgtctcgccgcagtgaatcagatggttgacgaactaatcgagtgcggtcacacagccgccgccaccatggcggagtggaaggacgggctgaatgaagcatgggcagagttactggagttaatgggcacgcgtgctcagctgctcgcagcctcccgagagctgcataagttttttagcgatgccagggagctgcaaggccagatcgaggaaaaaagaaggaggctcccgagactcacaacacccccggagcccaggccttcagcatcctccatgcaacgtacactacgcgccttcgaacatgatttacaactgctcgttagccaggtgagacagttacaagagggggcagctcagctgaggaccgtttatgccggtgagcatgctgaggctatagcttcacgggagcaagaggtgctgcaaggctggaaggaactgctaagtgcctgcgaggatgccagacttcatgtgagttctacggcagacgccctgaggttccattcacaagtacgtgacctgctgtcctggatggacggcatcgcttctcaaatcggggcagccgataagccgcgggatgtgagtagcgtggaggttttgatgaattatcaccaggggcttaagactgagttagaggctagagtgcctgagttgactacgtgtcaggagttgggccggtctctactgcttaacaagagtgctatggccgacgagatacaggctcagcttgacaaactgggtactagaaaagaggaagtgtcagagaaatgggacaggcactgggagtggctccagcagatgctagaagtccatcagtttgctcaagaggccgtggtggccgatgcttggttaaccgcacaagaacccctgttacagtctcgtgagctggggtcatccgtggacgaggtggaacaactcatccggcgacacgaggcgttccgaaaagcagcagctgcatgggaagagcggttttcatctctgcggaggctgaccaccccccgtagggaggaccatctcaatcccggtgtccaggaccaaccatggcagcacacagagaagccgtcactgccaaaacctaaagctaataaagagaaaaccgcccgcagagatggaacatgcctgtag

SEQ ID NO: 206708 - DNA, 3930 bp, Artificial Sequence
  Description of Artificial Sequence: Synthetic coding sequence
atggcccaggtgcccggcgaggtggacaacatggagggcctgcccgccccaaataacaatcccgctgctcgctgggagtctcccgatcgggggtgggagcgggagcaacctgccgcctcaactgccgccgcctcactcttcgagtgctccaggattaaggcccttgcagatgaaagagaagccgtacagaagaagacctttactaagtgggtgaactcccaccttgccagagtcggatgccacatcggagacttatacgttgatcttagagatggctttgttttaacaagactgttagaagtcctgtctggcgaacagctgccccggcccactcggggccgtatgcggattcattccctggagaacgttgacaaggcgctgcaatttttaaaagagcagcgtgtgcacctggaaaacgtagggtcacatgatatcgtcgacggaaatcacaggctcaccttgggcttagtgtggaccatcattctccgattccagattcaggtcatcaagattgaaaccgaggacaacagggaaaccagatcagcgaaggatgccctgttgctgtggtgtcagatgaagacagcaggctatccagaagttaatattcagaatttcaccactagctggcgagatggactcgcctttaatgctctgattcatagacatagaccagatctggtcgatttttccaaacttacaaagagtaacgccaactataatctgcagcgggccttcaggacggcagagcagcatctgggactggcacgattgctggacccagaggatgtgaacatggaggcccccgacgaaaagtctatcattacctatgtcgtttccttttaccactacttctccaagatgaaagctctggccgtggaaggcaaacgcatcggcaaagtgctcgatcaggtgttagaggtgggcaaaattattgagcgttacgaagagttggctgcagagctgctggcctggattcaccgaaccgtcgggttgatcagtaaccagaagttcgccaactcgctgtccggcgttcaacagcagcttcaggcctttacagcttattgcaccttggaaaagccggtgaaatttcaggagaagggaaatctggaggtgctgctatttagcatccagagcaaacttcgcgcttgcaatcgccggctgttcgtgccacgggaagggtgcgggatttgggatatagataaggcttggggggaactggagaaggcagagcacgagagagaggcagcgctccgcgctgagctgattagacaggagaagctagagctgctagcccagcggtttgatcacaaggtagcaatgcgggagagctggctgaatgagaaccaacgtctggtgagccaagataacttcggatacgaactacccgctgtggaggcagcgatgaagaagcacgaggcaatagaagccgacattgctgcctacgaagaacgggttcaaggagtagcggaactcgcccaggcgctagcagccgagggctactacgatattcggagggtagcagcacaacgggactccgtccttcgtcaatgggctttgttaacgggtcttgtgggtgccagacgcacaagactagaacaaaatctcgctcttcagaaggtgttccaagagatggtctacatggttgactggatggaagagatgcaggcgcagttgctctcaagggagtgtggtcagcatctggtcgaagctgatgacctgctccagaaacacgggcttttggagggagatattgccgcccaatctgagagagtagaggctttgaatgctgcggccctgaggttctcccagttgcaaggttatcagccttgtgatccccaggtgatctgtaatcgcgtcaatcacgttcatggatgcctcgcagagctgcaagaacaagcggctaggcgcagggccgagctagaagcgtcacggtcactatgggcccttctgcaggaattagaggaagcggaaagttgggccagagacaaggagcgactgttggaagctgctggaggaggcggtgctgcgggcgcagccggggccgccggcaccgccgggggcgcgcacgatttatcttcaacagcccgcctgttagcccagcataaaatattgcagggtgagctgggcggaaggcgggcactactgcagcaagctctcagatgcggggaagaacttgtggcagctggcggcgccgttggccctggcgccgatacggtgcacctggttgggctcgcggaacgtgccgcaagcgcaaggcggcgctggcagagactggaggaagccgcggcaaggagagaacgcagattacaagaggcaagagcactgcatcaattcggtgcagacctggatgggcttctcgactggctgcgcgacgcgtacaggcttgccgcagccggtgatttcgggcatgatgaggctagcagccggagactcgcaaggcaacacagagcactcactggggaagttgaagcccaccggggacctgtgtcaggtcttagaagacagctcgcgaccctggggggagcttccggcgccggtccattagtcgtcgccttgcaggtgcgggttgtcgaagcggagcagttgttcgccgaagtgactgaagtcgcggccttacggagacaatggctcagagacgccctggcagtgtaccgcatgttcggtgaggtccacgcttgtgaactgtggattggtgagaaggagcagtggctcctgtccatgagagtgcctgacagcctggacgatgtagaagttgttcagcaccgctttgaatccctggatcaggaaatgaacagcctgatgggcagggtgctggacgtgaaccacactgtgcaggagctcgtggaaggaggccaccctagttctgatgaggtgcgctcttgtcaggaccacctcaattcacgatggaataggatcgtggaattggttgagcaacggaaggaagagatgtctgccgtgctccttgtggagaaccacgttctggaggtcgcggaagtgcgtgcccaggtcagggaaaagcgccgcgccgtggaaagcgcacctcgcgccgggggcgcacttcagtggcgcttatcagggctggaggcagcgctgcaggcactggagccccgtcaagctgcattactggaggaggcagccctgctcgccgaaaggttcccagctcaggctgcacggctccatcagggggcggaggagctgggtgctgaatggggcgcccttgccagcgctgcccaggcctgtggcgaggctgtggcagccgctgggaggctgcaacgatttctgcacgacctggatgcttttttggattggttggtccgggcacaggaggccgccggaggtagtgaggggcccttgccgaacagccttgaagaggccgacgctttactcgccagacatgctgctcttaaggaggaggtggatcaacgtgaagaggactacgccagaatcgtggctgcatctgaagcgctgcttgctgccgatggggccgagctggggccaggtcttgctctcgacgagtggttgccccacctcgaacttggctggcacaaactgcttggcctttgggaagcgagacgcgaggcactagtacaggcccatatttaccagctgttccttcgcgatctacgccaagcactcgtggttctgcggaaccaggagatggctctttcgggcgcggagttgcccgggacagtcgagtccgtagaagaggcactaaagcagcacagagactttctgacaaccatggaactgagtcaacaaaagatgcaggttgccgtccaggccgccgagggcctcctccggcaagggaacatttacggtgagcaagcgcaagaagccgtaaccagattgctggagaaatgtctgattatacatccagccctccttcatccaccctgggagcctcccgatcttcctaggagtagttcctag

SEQ ID NO: 206709 - DNA, 7695 bp, Artificial Sequence
  Description of Artificial Sequence: Synthetic coding sequence
atggcccaggtgcccggcgaggtggacaacatggagggcctgcccgcccctaacaataatccagcagcacggtgggaaagccccgatagaggatgggagcgggaacagcctgccgcttccacagccgccgcttcacttttcgaatgttctagaataaaagccctggccgacgagagagaggccgtgcagaagaaaactttcacaaaatgggtgaacagccacctcgcaagggtgggatgtcatatcggagacctctacgttgatttgcgtgatgggtttgtactaacacgtctgttggaggtactctcaggggaacaattacccaggccgacccggggaagaatgcgcatccactcgcttgagaatgttgacaaggcactgcagtttctaaaggagcagagggtacacctggagaacgttgggagccacgatatcgtggatggtaaccaccgcctcacattggggctcgtctggactatcatcctaagatttcagatacaggtgataaagattgagacagaggacaaccgggaaaccaggtcagctaaggacgccttgctcctgtggtgtcagatgaagacggccggatatccagaagtcaatattcagaacttcacaacgagttggcgggatggcttggcgttcaatgctttaatccatcgtcacagacccgaccttgttgatttttccaagctcaccaagagcaatgcaaactataatcttcagagggcattccggaccgctgagcagcacctggggctggcaaggctcctggatcccgaagatgttaacatggaagccccagacgaaaagagtattattacttacgtggtgagcttttatcattatttctccaagatgaaggcgttggctgtggaaggaaaacgaatcggcaaagtattagatcaggtgttagaagttggcaaaatcattgagagatacgaggaacttgccgctgaattgcttgcatggattcatagaaccgtaggactaataagcaatcagaaatttgccaatagtctcagcggagtacagcaacagctgcaagcctttactgcatattgtactttagaaaagcctgtgaagttccaggagaaagggaatctggaagtgctgctgttcagcatccagagcaaactgcgggcgtgtaatcgccgactgttcgtgccccgagaaggctgcggaatttgggacatcgacaaagcgtggggagagctcgagaaagctgaacacgagcgcgaggccgcattgcgggctgaactgattcggcaggagaaactggaactcctggcccagagattcgatcacaaagtggccatgcgagagtcttggcttaatgagaatcagcgactcgttagccaggataactttggttacgagctgcccgcggtggaagccgccatgaaaaagcacgaagccatagaggccgatattgccgcgtacgaagaaagagtgcaaggcgtggccgagctcgcccaggccctggccgccgaaggctattatgacattagacgggtggcagcccaacgtgattcggtcctgaggcagtgggcgctcttgacgggcttagtgggagcaagaagaacccgtctggagcaaaatctggcacttcagaaagtgtttcaggagatggtctatatggtagactggatggaagaaatgcaggcccagctgttgtctagagagtgtggccagcatttagtggaagctgatgacctgctgcaaaaacatgggctgctggaaggagatatcgcggcccagagcgagagggtggaggctctcaacgctgccgccctccgtttttcgcagctccagggctatcagccatgcgatccccaggtgatctgtaacagggttaaccacgtgcacgggtgcctagcagaactccaagaacaggcagcaaggcgccgagcagaactggaggcaagtaggagcctatgggccctacttcaggagcttgaggaggcagagtcgtgggcacgggacaaagagcgtctgctggaagctgcaggggggggcggcgcagcaggcgcagcgggtgctgccggaaccgcgggcggagctcacgacctctccagtacagcgagattacttgcccaacataagatacttcaaggggagctgggtggacgacgggccctgctccagcaggcattgcgatgcggagaggaacttgttgcagcgggcggggctgttggaccaggagccgacaccgtgcacttagtgggacttgcggagcgcgccgccagcgcacgccgccgatggcaacgcctcgaagaggctgctgcccgccgtgaacggagactgcaggaagctcgcgcactccatcagtttggagctgatttggacggactgctcgattggctgcgcgatgcctatcgtcttgcagctgcaggcgatttcgggcatgatgaggcaagcagtcgtcggctggctagacagcacagagcccttaccggagaggtagaggctcatcggggtccagtgagcggcctcagacggcaactcgcaacgctaggcggagccagtggggctgggccattggtggtcgctctgcaggtgcgggttgtcgaagccgagcagctgtttgctgaagtgaccgaagtagccgctctcaggcgacagtggttgagggacgccctggctgtgtatagaatgttcggagaggtgcacgcatgcgaactgtggattggcgagaaagagcagtggctgctaagtatgcgcgtgcctgattcgttggatgatgtcgaagtggtccagcaccggttcgagtccctggaccaggagatgaattctctgatgggtagggtgttggatgtaaaccatacggttcaggagctagttgagggtggtcatccctccagtgacgaagttagatcttgccaagatcacctcaacagcaggtggaacagaattgtagagctcgtggaacagagaaaagaagaaatgagcgccgttctcctggtagagaaccatgtcctggaggttgctgaagtgcgagcacaagttcgagaaaagcgacgggccgtggagagtgccccgcgcgccggcggcgccctacagtggaggctgtcaggacttgaggccgccctccaagctttggaaccacgtcaagccgcactgctagaggaggcggcgctgttagctgagaggttccctgctcaagccgcccggctgcatcagggggccgaggaactgggagctgaatggggcgccctggcctctgcagcccaggcctgtggcgaggctgttgctgctgccgggcgactgcagagattcctgcatgacttggacgcattcttggactggctagtgagagcccaggaggcagccgggggatccgaagggcctctaccaaattcgctggaagaggcagacgcacttctcgcacggcacgccgcactgaaagaggaagttgatcagcgggaggaagactatgctagaattgtcgccgcctctgaggctcttttggcggcggatggcgctgagctagggccaggcctggcactggatgagtggctcccccatctggaactggggtggcacaaactactgggtctgtgggaggcacgaagggaagctctggttcaggcgcacatttaccagctcttccttcgcgacctccgccaggccctcgttgtccttaggaaccaggagatggccctgtccggtgctgagctccctgggacagtggagtccgtggaggaagcactaaaacagcacagggactttctgactactatggaactcagccagcagaagatgcaggtggcggtacaggcggcagagggcctcctccgccaggggaacatatatggggaacaggctcaagaggccgtcactcgcctgctcgaaaagaaccaggagaatcagttacgggcacagcagtggatgcaaaaattgcatgaccagctcgaactccagcacttcctgcgagattgccatgaactcgacgggtggatacatgagaaaatgcttatggccagggatgggacacgggaggacaatcataaattgcacaaacgctggttacggcatcaggcttttatggccgagcttgctcagaataaagaatggctcgaaaagattgagagagaggggcagcagctgatgcaagaaaagccagaactggctgcctcagtgcggaaaaaattgggggagatcaggcagtgctgggctgaattggagagtacaacccaggccaaggcgaggcagctcttcgaggccagcaaagcagatcagctggtgcagagtttcgccgaattggacaagaagcttttacacatggagtctcaactccaggacgtcgatcccggaggcgatctcgcaactgtgaacagccagttaaagaagttgcaatcaatggagagtcaggtggaggagtggtacagagaggtgggtgaactacaggcacagactgccgctctgcctctggaacctgctagtaaagagcttgtcggggaacggcagaacgccgtgggcgagagactcgtgcggctgctagagccactgcaggaacggagacgtctcttgctggctagcaaggaattgcatcaggttgctcacgacctcgatgacgagctggcctgggtgcaggagagacttccactggctatgcagacggagaggggcaacggactgcaggccgtccagcaacatataaagaagaaccagggcctccgaagggaaattcaggcgcacggaccaaggctggaggaggtcctggagagagccggggccctcgcctccttgcgtagccctgaagcagaagcggtgcgccgcgggctcgagcagcttcagagcgcatgggccggtctgagagaagcggcggagcggagacagcaggtgctcgatgctgcctttcaggtggaacaatactatttcgatgtagctgaggtggaggcctggttgggcgagcaggagctcctcatgatgagcgaggacaaaggaaaggatgaacagtcaaccctccagctgcttaaaaaacaccttcagttagagcagggagttgaaaactacgaggagagtattgctcagctgagccgccagtgcagggcgcttttagagatgggccaccccgacagcgagcagattagcagaagacagagtcaggtagacaggctgtatgtggccctcaaagagctcggcgaggagaggagagtggcattagagcagcagtactggttgtaccaattatccagacaggtgagcgagcttgaacactggatcgccgagaaggaggtcgtggctggttctcctgagttgggacaagactttgagcatgtgtccgtattgcaggaaaaattctctgagttcgcatctgaaactgggatggccggcagggagcgactcgcggcggtgaatcagatggtagacgagctcattgagtgtggtcatacagctgctgcaaccatggccgaatggaaagatgggcttaatgaggcgtgggctgagctcctcgagctgatgggaactcgagcccagttgctggctgcttctagagaactgcataaatttttttcagatgccagggaactgcaaggccagattgaggaaaagaggaggagattgcctagattgaccacaccccctgaaccccgacccagtgcatcatccatgcaaaggaccttgagagcatttgagcatgacctgcaactcctggtgagtcaggttaggcaactgcaggaaggcgctgctcagttgcggaccgtgtatgccggagagcacgccgaagcgattgctagcagggagcaggaggtgctccagggctggaaggaactgttatccgcttgtgaggatgctaggcttcacgtgagctccaccgctgacgcgctccggtttcattctcaggttagggatctccttagctggatggatgggattgcctctcagatcggtgcggcggataaaccacgcgacgtgtcctccgtggaggtgctaatgaattatcaccaagggctgaaaactgagcttgaagccagggtgcctgaactgaccacttgccaggagctgggacgctctttgctgctaaacaaatcggcgatggccgatgaaatccaggcccaattggacaagctgggaacacggaaagaagaagtcagcgaaaagtgggacagacactgggagtggcttcaacagatgctcgaggtgcaccaattcgctcaagaagctgtcgtggctgacgcttggctgaccgcacaggaacccctcttgcagtcacgcgagctaggtagtagtgttgacgaagtagagcagttgattcggcgccatgaggcctttaggaaggcagctgccgcctgggaggaaaggttctctagcttaaggcggttaactactatcgagaaaataaaagccgaacagtccaaacaaccgccaactcctctgctgggcaggaaattttttggggaccccactgagctcgccgccaaggctgcccctctcctgcggcctggcggttacgagcgcgggctggaacctctggcaaggcgtgcaagcgacacactgagtgctgaggtgcgcacacgagttggatatgtgcgtcaggagttgaaacccgaaagactccagcctagaattgaccggctgcctgagattccagggcgtgttgagcctgctgcgcttccagccgctcctgaggacgccgccgaaacacccgctacgcccgctgccgctgaacaggttcgaccccggccagaacggcaggaatccgctgaccgcgccgaagagttgcctagacgtcggcggcctgaaagacaggagagcgtggaccagtcagaggaggcagcccgccgcagaaggcctgagcgccaggaatccgccgagcatgaagctgctcactcactgactttgggacgctatgagcagatggagaggcgccgggaacggcgcgagcgccgcctggagcgccaggagagcagtgaacaggagatgcccatcaggggggacctggttaaaggcaaggccaccctggcagacatcgtcgagcagttacaggagaaggaagcagggcccggcttgcccgccggaccatctctaccccagccacgggaactgccacccggcagactgcctaacggtctggaactgcctgagagaactccccgaccagaccggcctcgtgccagggatcggccaaagccgaggaggaggcccagacctagagaggggggcgagggcggcggaagccgcaggtctagatctgctcctgctcaaggcggctcagcaccggcacctcctccacccccgactcacaccgtgcagcacgagggatttctcttacgcaaacgcgagctggatgctaaccgtaagtcatcaaaccgcagctgggtgtcactgtactgcgtgttgtccaaaggcgaactgggcttttataaggactccaaggggcccgccagcggctcgactcacggaggggaacccctcctgtctttgcataaggccacaagcgaggtggcttctgattacaaaaagaagaagcacgtgtttaaactgcaaacccaggacgggagtgagttcttgctgcaggctaaagacgaggaggagatgaacggctggctggaagcagtcgccagctccgttgccgagcatgccgaaatcgccagatggggccaaacactgccaacaacatcatcaaccgacgagggtaacccaaaacgtgaaggtggcgaccgtagggcatctggcaggagaaagtag

SEQ ID NO: 206710 - DNA, 2037 bp, Artificial Sequence
  Description of Artificial Sequence: Synthetic coding sequence
atgctgatggcccgggacggcacccgggaggacaaccacaagctgcataaaaggtggctgcgccaccaggcttttatggcggagttggcacagaacaaggaatggctagagaaaatcgaaagagaaggccagcaattgatgcaggaaaaacccgaacttgctgcctctgtccggaaaaagctcggagaaattcggcagtgctgggccgaactcgaaagcaccacacaggccaaagcccgacagctgttcgaggcatctaaggcggatcagctcgtccagtctttcgctgaactcgacaaaaagttacttcacatggagtcacagcttcaggatgtcgacccaggcggggacctggccactgttaattcacaattaaaaaagttgcaaagcatggagagccaggtcgaggaatggtatcgagaagtgggcgagctccaggctcagaccgccgcactgcctttggagcctgcctcgaaagagctggtaggtgagcgtcagaatgcggttggtgagagactggtgcggcttttggagccactgcaggagagacggagactactgctggcctcgaaggaactgcatcaggtggcacatgacttggatgatgaactggcatgggtccaggagcgcctgcccctggcaatgcagaccgaaagggggaatgggctgcaggctgttcagcaacacatcaaaaagaaccagggcctgagacgcgaaatccaggcacatggcccaaggctggaggaggtgctagagagagcgggcgctttggcctctttacgcagtcctgaggccgaggctgtccggcgtgggctggagcagctgcagtccgcttgggctggccttcgggaggctgccgagcgaagacagcaggttctagacgcagccttccaggttgagcagtattattttgacgtagccgaggtggaggcatggctcggggagcaggagctgctaatgatgtccgaggataaggggaaagacgagcagagcaccctgcagctcctgaagaaacacctccaactggagcagggtgtggaaaactacgaggagagtattgcgcagctttcgaggcagtgcagagcactgcttgagatgggacaccccgacagcgagcaaatcagcagaaggcagagtcaagtggaccggctttatgtagccctgaaggagctgggcgaagaacgacgggtggcacttgaacaacagtattggctgtatcagctgtctcgacaggtgtccgaactggagcattggatcgcagagaaagaagtggttgctggatctccagagctgggccaggactttgagcatgtgagcgtgctccaggaaaagttctctgagttcgcaagcgaaaccggaatggccggacgagagagactggccgccgtcaaccagatggtggacgagttaatagagtgcggccacacagccgctgccaccatggctgaatggaaggacgggctcaacgaggcctgggccgagctacttgagctcatggggaccagagcacagctacttgccgcctctagggaactgcacaaattcttcagtgatgctagggaactgcagggacagattgaagagaagcggcggaggctgcctcgactcactacccctccagagccccggccgtccgctagtagcatgcagcgtaccctgcgtgcttttgaacacgacctgcaactcttggtgagtcaggtgagacagcttcaggagggcgctgcccagctgcgcactgtttatgctggtgagcacgccgaagccatagcctcacgcgagcaggaggtgctgcaaggctggaaggaactcctttccgcctgtgaggacgcacgtcttcacgtgtcgagtactgccgacgcattgcgatttcattcccaggtacgtgatctcctgtcttggatggatggaatagcatctcagattggcgccgccgacaagccccgctgcccatccagcttgctgggtctacctgcaagtccttggtggccaacacctgctacacccagccccctgacagctcctttctccatggaatag

SEQ ID NO: 206711 - DNA, 3924 bp, Artificial Sequence
  Description of Artificial Sequence: Synthetic coding sequence
atgccccactaccccagctgcagcagcgcccccagcctgggcaccccaaggcccccccagattcagcagctggaagctcgtcatcgcaaccaggagaaccagctgcgggcacaacaatggatgcagaaactgcacgatcagctcgaactacaacatttcttgcgagattgtcacgaactcgatgggtggatacacgagaagatgcttatggctagagatgggacgcgggaagacaaccataaactacataagcgatggttacgccatcaggccttcatggccgagctagctcaaaataaagagtggctggaaaaaattgagcgcgaagggcagcagctcatgcaggaaaaacccgaactcgccgcttccgtccgaaaaaagctaggcgagatcaggcagtgttgggcagagcttgagtcaacaacacaggctaaagcacgtcaactcttcgaggcatccaaggccgaccagcttgtccagagttttgctgaactggacaagaaattacttcatatggaaagtcagcttcaggatgtggatccaggcggtgacctggcaacagtcaacagccagctgaagaagctgcaatccatggagtctcaggtggaggaatggtaccgcgaggtaggtgagctacaggcccagacggctgccctgcccttggagcccgctagtaaagagctcgttggagagcggcagaacgctgtgggggaacgcctggtgcggttgctggaaccgttacaggaacgccggagactcctgctggcatccaaggagttgcaccaggtcgcccatgatctggacgatgagctcgcttgggtgcaggaacggttgcctctggccatgcagacggagcgaggcaatggtcttcaagcggtgcagcaacacatcaagaagaatcaggggctcaggcgcgagattcaggcacacggcccgcgcctggaagaagtactggaacgcgccggtgcactggcaagcctccgatcccccgaggcagaggcggtaagaagggggctcgagcagcttcagagtgcctgggcgggactgagggaggccgctgaacgcaggcagcaagtactcgatgctgcatttcaagtggaacaatattactttgatgtagcggaggtggaggcctggcttggagaacaggagctgcttatgatgtccgaggacaaaggaaaggacgaacagtctacactccagctgctgaagaaacacctgcagttggagcagggcgtagagaactacgaagaatccatcgctcagctgtccaggcaatgtagagctctcctagagatgggtcaccccgattccgagcagattagtaggcggcaatcccaggttgatcggttatacgtggctctcaaagaactcggagaggagcggagggtggcgttagagcagcagtattggctttaccagctgagccgccaggtgtcagaacttgagcactggattgccgagaaagaggtggtcgcggggagcccggaactcggtcaggattttgagcatgttagcgtattgcaggaaaagttcagtgagtttgccagtgaaactgggatggccggtagagagcggcttgccgctgtgaaccagatggttgacgagctgattgaatgtggacacaccgcggctgctactatggcggagtggaaagacgggttaaatgaggcgtgggcagagctgctcgagctgatgggcactagggcccagctattggcggcctcccgagaactgcataagtttttcagtgacgctcgggaactgcaggggcagatagaggagaaacggcgtcgcctgccgagacttactaccccaccagaaccgagacctagcgctagctcaatgcaacgcactttaagggctttcgaacacgacttgcagctgctcgtgtcgcaggtgagacagctgcaggagggagcggcacagttgcggacagtctacgcgggggaacatgcagaagccattgcttcccgcgagcaggaggtgctgcaggggtggaaggagctactgtccgcttgcgaggacgcccgcctgcatgtctcttctaccgcagacgctcttagatttcactctcaggtacgggatctgctgtcttggatggacggcatcgcatcccaaattggcgccgccgacaagccccgggatgtctcatctgtggaggtcctaatgaactatcaccaggggctgaagactgagttagaggcacgtgttcccgaattgacaacctgccaagaactaggcaggtccctgcttctgaacaagtcagccatggcagacgaaattcaggcacagctggacaagctggggacaaggaaagaagaggtgtcagagaagtgggaccgccattgggagtggctgcaacagatgttggaagtgcatcagtttgcacaggaggcagtggtagccgacgcatggctcactgctcaggagcccctgttacagtcccgcgagctgggaagtagcgtcgacgaggtagaacagttgattcggaggcatgaagccttccgcaaagccgcagcggcctgggaggaacgtttcagctctcttaggcggctcaccaccatcgagaaaattaaggccgaacagtccaagcaaccccccactcctttacttggacgcaagttctttggcgaccctaccgaactggcagctaaagccgctccacttctgcggccaggcgggtatgaaaggggcctcgaaccgctcgctcggagggcttctgataccctgtctgccgaggtgcgcacaagggtggggtatgtgaggcaggagttgaagcccgaaagattgcaaccgaggattgatcgcttacctgaaatccccggccgcgttgaaccagcggccctccctgcagctcccgaggatgccgccgagaccccggctacacccgcagcggctgaacaagttcgcccgagaccagaacggcaggaaagtgccgaccgtgccgaggaactgcctcgaaggcgcagacccgagaggcaggaatcagttgatcagagtgaagaagcggccaggcgccgccgtcctgagagacaagagtctgctgaacacgaagccgcacactcactgacgttgggacgctacgagcagatggaacggcgtagggaacgaagagagcggcgactggagcggcaggagagctccgagcaggagatgcctattcgaggggacctggtgaaaggcaaagccacacttgcagatattgttgaacagttgcaggaaaaagaagcaggtcccggccttcctgcggggccatcgctgccgcaaccccgcgagctgccacctggaaggctgcctaacggcttggagttgcctgaaagaacaccccggccagatagaccacgggccagagacaggcctaagccccggcggcggccacggccccgcgaggggggagagggcgggggcagtcggcgctcccgctcagctcccgcccagggagggtcggcaccggcccccccacctccccctacccatacagtacaacatgagggctttttgttgcgaaagcgagagcttgacgcaaatcgcaagagtagcaatagatcttgggtgtctctttattgtgtgctgtctaaaggagaacttggtttctataaagatagcaagggccctgcgtccgggagcacgcatggcggggagcccttgctatcccttcacaaggcgacctcagaggtggcctctgactataagaagaagaagcacgtctttaagctgcagacccaggatggctccgaattcctactgcaggctaaggatgaggaggagatgaatggatggctcgaggccgtggcatcatcagttgccgagcatgcagagattgccaggtggggacaaaccttgccaacgacgagctccacagatgagggaaacccgaagcgcgaagggggtgataggcgcgctagcggcaggcggaagtag

SEQ ID NO: 206712 - DNA, 7695 bp, Artificial Sequence
  Description of Artificial Sequence: Synthetic coding sequence
atggcccaggtgcccggcgaggtggacaacatggagggcctgcccgcccccaacaacaaccccgcggccaggtgggaaagcccagatcgcggatgggaacgcgagcaaccggccgcatctacagcagccgcgagtctcttcgaatgtagtaggatcaaggcgcttgctgatgagcgggaagccgtgcagaagaagacctttactaagtgggtcaattcacatctggcaagggttggctgccatataggcgatctttatgttgacctcagggacggattcgttctgacgcgcctgcttgaggtactttccggcgaacagctgccaaggccaacccggggacgcatgagaatacactcactggaaaatgttgacaaggcactgcagttcttgaaggagcagcgggttcatttagagaacgttggctctcacgatattgtcgacgggaatcaccggctgacattgggcttggtttggaccatcatactgaggtttcagattcaggtgatcaagatcgagacagaagataacagggaaacgaggtccgccaaggacgccttactgctctggtgtcaaatgaagaccgctgggtacccagaggtcaacatccagaattttacgactagttggagagatggcctcgcgttcaatgctctgattcataggcaccggcccgatctcgtcgactttagtaaactcaccaagtctaatgccaactataacctccagagagcctttaggactgcagagcaacacctaggactcgcaagactgcttgaccccgaggacgtgaacatggaagcccctgatgagaagtccatcatcacctatgtggtgtctttttaccactacttctccaaaatgaaggctttggctgtggagggcaaaagaattggtaaggtcctggatcaggtgctggaggtcggcaagattatcgaacgctatgaggaactggccgctgagttgctcgcctggattcatcggaccgttggcttgattagcaatcagaaattcgccaatagcctctcaggcgtccagcagcagctgcaggcgtttaccgcgtactgtactctcgagaaacctgtgaaatttcaggaaaagggtaatctggaagtacttctgttttcaatccagtcaaagctcagagcttgtaatcgcaggctgttcgtgccccgagaagggtgtggcatttgggatattgacaaagcctggggcgaattggaaaaggcagagcatgaacgcgaggcagcactgcgagccgaacttataagacaggagaagctggagctgctggcccagcgatttgaccacaaagtggccatgagggaatcttggctcaacgagaatcagcgcctggtgtcccaagacaacttcggctacgagcttcccgccgtggaagccgcaatgaagaaacatgaggccattgaagcagatatcgcagcatacgaggaacgagtccagggcgtggccgagctagcccaggctcttgctgcggaggggtattacgacatcaggagagtggcagctcagagagacagcgtactgcgccagtgggccctcttaacaggcctggtcggcgcacggagaaccaggctggaacagaacttagccctacagaaagtctttcaggaaatggtctatatggttgactggatggaagagatgcaagcccagcttctctctcgtgaatgcggccagcacctcgtcgaggcagatgacttgttacagaagcatggcctgctcgagggcgatatagcagcgcaaagcgagcgtgtggaggccttgaatgcggctgcattacgcttttcacagctacagggataccagccctgtgaccctcaagtgatttgcaatagggtgaaccacgtgcacggttgcctagcagaactgcaggagcaggccgctcggcggagggccgagttggaagcgagccgctccctgtgggccttactccaggagttagaggaggctgagtcatgggcacgggataaggagcgcttgctggaagctgcaggtggggggggagctgcaggcgccgccggagcagccgggaccgccggcggcgcacatgatctgtctagcaccgccaggctcctagcccagcacaaaatccttcaaggagagctcgggggacggagagcactgctgcagcaagccctcaggtgtggcgaggaactagtggcagctggcggggctgtcggtcctggagccgacacagtccatctcgttgggctggcagaaagagcggctagcgctagaaggcggtggcagagactcgaggaggcagccgccagaagagagcgtcgcctgcaggaagcaagagcgctgcaccagttcggggccgacttagacgggttgcttgactggctgcgcgacgcctatcgccttgccgctgctggggatttcgggcatgatgaagccagttcccggaggcttgctcgacagcaccgggccttgactggggaggtcgaagcccaccgggggcccgtctctggtctccgtcggcagctggcaacacttgggggcgctagcggagccggccccctggttgtggcactgcaggttagagtggtcgaagcagagcaactatttgctgaggtgaccgaggtggccgccctcaggcggcagtggctgagagatgccctggcggtgtaccgtatgttcggcgaagtgcatgcctgcgaattatggatcggtgagaaggagcagtggctgctttctatgcgtgttcctgacagcctcgatgatgtggaagttgtgcagcaccgattcgagagcctagatcaggaaatgaactctctaatgggccgggtgctcgacgtcaaccacaccgttcaggagctggttgaaggcgggcatccttcgagcgacgaagtcaggtcctgtcaagatcatttgaactcccgctggaataggattgtggaactcgtggagcagcgaaaagaggagatgtcagctgttctgctggtagaaaatcatgtgctggaggtggctgaggtgcgggcgcaggtgcgggagaaaagaagagccgtcgagagtgcaccacgcgccggaggcgcactgcagtggcggctctccggcttagaagctgctctgcaggcattggagccacgtcaggccgccctgttggaagaagccgccctgttggccgaacgattcccagcccaagctgcgcgcttgcaccagggtgccgaggagctcggcgcggagtggggcgctttggcatccgcagctcaggcatgcggggaagccgtcgctgccgctgggcggttgcaacgtttcttacacgacctggatgcatttctggactggttagtgcgggcccaagaagctgctgggggatcagaggggcccctgccaaacagtttagaggaagccgatgctctcctcgccagacatgcggcactcaaggaagaggtagatcagagggaggaagactacgcccgaattgtggcggccagcgaggccctgctggcggcagatggcgcagagttaggacctggtctcgcactggacgaatggcttccccacctggagcttggatggcataaactgctcggtctctgggaggccagacgggaggccctagtccaggcccacatctaccagctgttcctgcgcgacttgcggcaggcgctggtggtcctcaggaaccaggagatggcgctgagcggggctgagctgccaggcaccgtggaaagcgtggaggaagcacttaagcaacatagggacttcctgactaccatggaactgtcccagcagaagatgcaggtggcggtacaggcagcggagggtctccttaggcaggggaacatctatggagaacaggcccaggaggccgtgacccgcctgttggagaaaaaccaggaaaaccaactgcgcgctcagcagtggatgcagaaattacacgaccagttggaactgcaacactttctccgagactgccatgaacttgacgggtggatccacgagaagatgctgatggcacgggacggaacaagagaagacaaccataaactgcacaagcgatggctacgacaccaggccttcatggctgagctggcgcaaaacaaggagtggctcgagaagattgagagagaggggcagcaactgatgcaggaaaaacctgaactagcagcatcagtgcgaaaaaagctgggggagatccgtcagtgctgggccgaactcgagtcgaccactcaggcgaaggctagacagcttttcgaggcaagtaaggcagatcagctggttcagtctttcgccgagctcgataaaaaacttctgcatatggagtcacagctgcaagatgtggacccaggcggggacctggcaaccgtgaactcccagcttaagaaactgcagagcatggagagtcaggttgaggagtggtaccgtgaggtcggagaactgcaagcccagactgcggctctccctctggaaccggcctccaaagagctcgtcggcgagcggcagaatgcagtcggcgaaaggctggtgaggttattagaaccacttcaagagcgacggagattgttactggccagtaaggagctgcaccaggtggcacatgactggacaacatcttgggcttgggtacaggagcggttgcccctggcgatgcagactgaaagaggcaatggccttcaggccgttcagcagcacattaagaaaaaccagggcctcagaagagagattcaagcacacggccccaggctagaggaagtattggagcgggcaggagccttagccagtttgcgctccccggaagctgaagctgtgcggcgggggctagagcagttgcagtccgcgtgggcagggctgagagaggccgcggaacgtaggcagcaggtgctggatgctgccttccaagtcgaacagtactacttcgatgtggccgaggtggaggcttggctcggtgagcaggagcttcttatgatgtccgaagacaagggcaaggatgaacagtccacattacaactgcttaagaagcacctgcagctggagcagggggtggaaaattatgaagagagcatcgcacagttatctcgccagtgccgggccctgcttgaaatggggcacccagactcagagcagatttctcgccgtcagtcgcaagtcgatcgcctgtacgtcgcactgaaggagttaggtgaagagcgccgagtagcgctagagcagcaatattggctctatcagctgagtcgacaggtgtctgagttggagcattggattgcagagaaagaggtggtggccggatcccccgagctggggcaagatttcgaacacgtttcagttttgcaagagaagttctccgaatttgcttccgaaacaggcatggcaggaagagagcgcttggcagctgtaaaccagatggtggacgaacttatagagtgcggccacacagccgccgctaccatggctgagtggaaggacggactgaatgaggcctgggccgaacttctagaactcatgggtacaagagctcagctgctagcggccagtcgagagctccataagtttttctccgacgcccgggagctgcaaggacagatcgaagagaaacgcagacgactgcctcggctgaccacgccacccgagcccagaccttctgccagttccatgcaacgtactttgagggcctttgaacacgacctgcagcttctggtttcacaggtccgacagctccaggagggagccgcgcaactcaggaccgtgtatgccggggagcacgcagaagcgattgcttctcgggaacaggaagtgctgcagggctggaaagagttactcagtgcctgcgaggacgctcgtctacacgtctccagcaccgccgatgcattgaggttccacagtcaggtgcgggatctgctatcgtggatggacggaattgcttcccagattggagctgctgacaaaccccgtgacgtaagctccgtcgaggttctcatgaattatcaccaaggtttgaagacagagctggaagcccgggtcccggaacttaccacgtgtcaggaactcggacggtcccttcttcttaacaagtcggccatggctgatgaaatccaggcccagttagacaaactggggacccggaaagaggaggtgtccgagaagtgggacaggcattgggagtggctacaacaaatgctggaggtgcatcagttcgcccaggaggcagtagttgcggatgcctggctcactgctcaagaaccattactgcagagccgggagctcggttccagtgtggatgaagtagagcagctgataagacgccatgaggcctttaggaaagcagctgcagcctgggaagagcgcttcagctccctccgccggctgacaactatcgaaaaaatcaaggcagagcaatccaagcagcctcccactccattactagggagaaaatttttcggcgaccccacagagcttgctgcgaaagccgccccgttgcttcgccctggcggctacgagcggggcttagagcccttggcaaggagagcttccgacacgctctctgcagaagtaagaactagggtgggatatgtgagacaggaattgaagccagagcgtttacagccgaggattgaccggcttccagagattccgggcagagtggagccagctgctctgcccgctgcccctgaagacgcagccgaaacccccgctacccccgccgcagctgagcaggtcagaccccgtcctgaacgacaggaatcggcagatcgggccgaggagttgcctcggaggcgccgtccagagagacaagaaagcgtggaccagagcgaggaggccgccaggaggagaaggcctgagagacaggagtctgcagagcatgaggctgcccactctcttactctcggacggtacgagcaaatggagcggagacgggagagacgggaacggagattggagcggcaggaaagcagcgagcaggaaatgccaattaggggtgacctggtgaaggggaaggccacgctcgccgacatcgtcgagcagctgcaggagaaggaggccggccctgggctccccgctggcccctcccttccacagcccagagaactgcctcctggaagacttcctaacgggctcgaactgcctgagagaaccccaagacccgatagacccagggccagggacaggccaaagccccggaggcgtccacgcccccgtgaaggcggggagggcggagggagtcggaggagccggagcgcccccgcgcagggggggtcagcccctgctcctcctcctcctcccacacatacagttcagcatgaaggttttctgctgcgaaaaagagaactagacgccaacaggaaaagttcaaacaggtcttgggtttcgctgtactgtgttctgtccaagggtgagcttgggttctataaggattctaagggccccgctagtgggtcaacccacggcggcgagccactgctcagcctccacaaggcgacaagcgaggttgcgagcgattataaaaagaagaaacatgttttcaagctccagacccaggacggatcagaatttctcttgcaggcgaaagacgaagaggaaatgaatggttggctcgaagctgtggccagtagtgttgctgagcatgcggaaattgcgaggtggggccagacactgcccaccacatcatctacagacgaaggtaatcccaagcgagagggcggggatcgccgggcctcgggtcgccggaagtag

SEQ ID NO: 206713 - DNA, 11025 bp, Artificial Sequence
  Description of Artificial Sequence: Synthetic coding sequence
atggccggccagccccacagcccccgggagctgctgggcgccgccggacaccgatccagaaggccatccacagaattgagggtaccccccagcccctctctgacaatggacagccaatacgagacaggccatataaggaaactgcaagcaaggcatatgcaaatgcaggagaagaccttcaccaagtggattaacaacgtcttccagtgcggacaagccggtattaagatccggaatttgtacacggagttagccgacggtatacacctgctgcgcctacttgagttgatttccggtgaggcgcttccaccaccctctcgcggtaggctaagagttcatttcctggaaaattctagccgggctctagctttcctcagagccaaggtgcccgttcctctgattgggcccgagaacattgtggacggtgatcaaaccctgatcttaggtctcatctgggtcattatactgagattccagatatcacacatcagtcttgacaaggaggagttcggagcctcagccgcgctgctgagtaccaaagaggctctgctcgtctggtgccagcgtaagaccgcatcatataccaacgtcaatatcactgactttagcagatcttggtcagatggtctcgggttcaacgcgctgatccatgcacacagaccagacctgctggattatggatctctcaggccagaccgaccgcttcataacttggcttttgcatttcttgttgcggaacaggaactgggcattgcccagcttctggaccccgaagacgttgccgcggcccagccagatgaaaggtctattatgacttacgtgagcttgtactatcattattgctcacggctccaccaaggccaaacagtgcaacgacgcctgacaaaaatactgcttcagctgcaggagaccgagctgctgcagacacagtacgagcagctggtggcggatctcctgcggtggattgcggagaaacagatgcagctggaggcccgcgattttcctgactctctcccagcgatgaggcagctcctggctgcgtttacaatttttagaacccaggagaagcccccaagactccagcagcgtggtgctgcagaggcactcttatttcgattacagacagcactgcaggcgcaaaaccgccggcccttcttaccacacgaagggcttgggttagccgagctgagccaatgctgggcggggctggagtgggcagaggccgccaggagtcaggccctacagcagaggctgctgcagcttcagagactggaaaccctagctagaaggttccaacacaaggccgctttacgggagtcattcctcaaagatgccgagcaagttctagatcaggcccgcgctcctccggcttctctggctacggtggaggccgcagtgcagagattagggatgctcgaggcgggcatcctgcctcaggagggtcgtttccaggccctggcggagattgctgatattttaagacaggaacagtaccattcctgggctgacgtggccaggcggcaagaggaggttaccgttaggtggcagagactgcttcagcacctgcagggacaacgcaagcaggttgcggacatgcaggccgtgttgtccctcctgcaggaagtagaggcagcttcacaccagctggaagaactgcaagagcccgcgcgtagcacggcttgcggacagcagctagccgaagtcgtcgaacttctgcaacgccatgacctcctagaggcacaggtgtccgctcatggggcccacgtgagccacttggcccaacaaacagctgagctagatagctccctgggtacatcggtagaagtgttgcaggccaaggccagaacactcgcccaactccagcagtcgctcgtggccctcgtcagggcgagacgcgccttacttgaacagacacttcagagagctgaatttctgcggaactgtgaggaggaggaggcgtggctcaaggaatgtgggcagagagttggtaatgcagcacttggtagggacttatctcagatcgcaggtgccctccagaaacataaagccctcgaagctgaagtccatagacaccaagctgtgtgcgtcgatctcgtgagaaggggccgggatctgtcggctagaaggccccctactcagcccgacccaggggagagagcggaggcagtacagggcggttggcagctgcttcaaaccagagttgtggggcggggggcccgccttcagactgctcttcttgtgctgcagtactttgctgacgctgcggaggccgctagttggctgcgggagaggcgatcttccctcgagcgcgcctcctgcggtcaagaccaggccgccgctgaaactctgttgcgccggcatgtgcgcttagaacgagtattgcgcgctttcgccgcggagctccgaaggctggaggagcagggtcgggccgccagcgcgcgcgcgagtcttttcacagttaatagtgccctgtccccaccgggtgaatcccttagaaacccaggtccctggtctgaagctagttgtcatcctggcccaggcgatgcctggaagatggctctcccagccgaacccgatccagactttgatccaaacaccattcttcaaacccaggatcatttatctcaggactacgagtcactcagagccctggcccaactgcgccgcgcacgtcttgaagaggccatggctctgtttggtttctgctcatcttgcggtgaattgcaactatggctggagaagcaaacggtgctcctacagagggtgcagccacaggcggatactttggaggtgatgcaactaaaatatgaaaacttcctgactgcattagctgtggggaagggactatgggcagaagtatccagctcagccgagcagttgcgtcaacgatatcccgggaatagcacccagattcaaagacagcaggaggaactgtcccagcggtggggacagctggaggctctgaaacgggagaaggctgtccaactggcccactccgtggaggtgtgttcttttctgcaggaatgcgggcccacccaggtccagctccgcgacgtacttttgcaactcgaagctctacaaccaggcagcagcgaagatacctgccacgcacttcaactggcccaaaagaagactcttgtgctggaaaggagggttcattttttgcagagcgtggtcgtcaaggtggaagaacccggctacgctgaaagccagcccctccagggccaagtcgagaccctgcaaggtctgttaaagcaagtgcaggagcaggtagcacaacgtgcccggagacaggccgaaacccaggctaggcagagcttcctgcaggaatctcagcagctgcttctctgggccgaaagtgtgcaggcccaactgcgcagcaaggaagtgagtgtggatgtggcatcagcccagagactgctgagggagcatcaggacctgctggaggaaatccacctatggcaagaacgcctccagcagctggacgcccaatcccaaccgatggccgcactggactgtcccgactctcaggaagtgccaaataccctgcgcgtgctgggacagcagggtcaggaactaaaagtactgtgggaacaaaggcagcaatggttacaagagggcctggagttacaaaaatttggccgggaagtagacggctttacggccacctgcgccaatcaccaggcgtggttgcacctggacaatcttggggaggatgtccgggaggctctctccctgctgcagcagcaccgggaatttgggcggctgctcagtactctgggccctcgcgctgaagctcttcgggcccacggcgagaagcttgtccagtctcaacatcctgcggcccacactgttcgggagcagctccaaagtattcaggctcaatggacacggcttcagggaaggagcgagcagcggcgcagacagctcttggcttcccttcagctgcaagaatggaagcaggacgtggcggaactgatgcagtggatggaggagaagggattgatggccgcccacgagcccagtggcgctaggaggaatatcctgcaaaccctcaagagacacgaggctgcagaatcagagttgctggctacccgccggcacgtggaagctttacagcaggttggtcgggagctgttgtcaagaagaccttgcggacaggaggacatccagacaagactgcagggattgcgcagcaagtgggaggcactcaaccgcaaaatgactgaaaggggggacgagttgcagcaagccgggcagcaggaacagctgctgcgtcaactgcaggacgcaaaggagcagcttgaacagctggaaggggccctgcagtccagcgaaaccggccaggatctcagaagctcccagagactgcagaagcgccatcagcagctggagtccgaatcgcgcactttggccgccaaaatggctgctcttgctagcatggcacatggtatggccgcttcacccgctatcctggaagagacccaaaagcatctccgtaggttagagctcttacagggtcacctggccatcagaggacttcaacttcaggcgagcgtggagcttcaccaattctgccacttgagcaatatggagctgtcatgggtagcagaacacatgcctcatggttcacctaccagctacacagagtgcctgaatggagctcaatccctacaccggaagcacaaggagttgcaggtcgaagtgaaagcccatcagggccaagtacagagagtactgagcagcgggaggagcctggcagcatccggtcatccccaggcacagcacattgtggaacagtgtcaggagcttgaaggccactgggctgaactcgaacgtgcctgcgaggcccgtgctcagtgtttgcaacaggcggtcacattccagcagtatttcctggatgtgagcgagctagagggctgggtggaggaaaaaagaccattggtgagctctcgggactatggacgagatgaggccgccactctgaggttgattaacaagcaccaggctcttcaggaagagcttgccatttactggagctctatggaagagctcgaccagactgctcagacgctgaccggccctgaggtgccagagcagcagcgggtcgttcaggaacgtctgcgtgagcaactcagagccctccaggagctggctgctaccagagatcgagaactagaaggaactttgaggctgcacgagtttcttcgcgaggctgaggacctgcagggatggctggctagtcaaaagcaggccgctaaaggtggcgaatcgcttggggaggatccggaacatgccctgcacctctgcaccaagttcgccaagttccaacaccaggtggagatgggcagtcagcgtgtcgctgcatgcagactcctggcagagtcactattggaacgggggcactctgctgggcctatggtacggcagcgccagcaggatctgcagacagcgtggtccgagctgtgggagctgactcaagctcgtggccacgccctgagagatacagaaaccactcttagggtccatcgagacctgttagaagtgcttactcaggtccaagagaaggcgacatccctgcccaacaacgtcgctagggatctctgcgggcttgaggcgcaactgcgatcccatcagggactagagagggagctcgttggcactgaacggcagttgcaagagctgcttgaaaccgccgggcgagtgcaaaagctgtgtcctggcccgcaggcgcatgcagtccagcaacggcagcaggccgttacacaggcctgggcggttctccagcgccgaatggagcagcgacgggcccagttggagcgggccaggctgctggcacgtttcaggactgctgtgcgggattacgcttcttgggctgcccgagttcggcaggaccttcaggttgaggagtctagccaggagccttcgtccggacccctaaaactgagcgctcatcagtggctgcgggccgaactggaagctcgggaaaaactatggcagcaggccacccagctgggccagcaggcgcttctcgcagcagggacccccactaaggaggtgcaggaggagctgagggcacttcaggaccagcgggatcaggtttaccagacctgggccagaaagcaggagcgactgcaggccgaacagcaagagcagctctttctgcgtgagtgtggtcgactggaagaaatcctggctgcgcaggaggtcagcctgaaaacttcggctctgggctcttccgtggaggaggtggagcagctgatccggaagcatgaagtcttcctgaaggtcctaaccgctcaggacaagaaagaggccgctctgcgcgaaagattgaaaacacttcggagaccaagggtgcgagatcgactgccaatcctgctacaaaggaggatgagagtgaaggagctagcggaatcccgggggcacgcattacatgccagtctccttatggcgtcatttacacaggccgctacacaggcagaagactggatccaggcatgggcgcaacaactcaaggagccagttccccccggcgacctgcgggataagctaaagccactgttaaaacatcaggctttcgaggcagaggtccaggcgcatgaagaagtcatgacctcagtggccaaaaagggtgaggctctcctcgctcagagccatccaagggctggagaagtgtctcagcgcctccagggcttgcgaaaacattgggaagacttgagacaagcaatggccctccggggacaagagttggaggatagacggaacttcttggagtttctgcagagggtagatttggcagaagcctggattcaggagaaagaggtcaagatgaacgtgggcgaccttggacaggatcttgagcattgcctgcagcttaggagacgcctgagagagtttcgtggtaactccgcaggggacaccgtgggagatgcctgtatccgcagtatatccgacttaagtttgcagctcaaaaaccgtgaccctgaggaggtgaagatcatatgtcaaaggcgttcacagctaaacaaccgttgggccagtttccacggcaacttgctccggtaccagcagcaactggagggcgctctcgaaatccacgttctgtcccgagaacttgacaacgtcacgaaacggatccaggagaaggaagccctgatccaggccctggactgcggtaaggacctggaaagtgtgcaacggctgttaaggaagcacgaagaattagaaagggaggtgcatcccatccaagcccaagtcgagagtcttgaaagagaagtgggccggttatgccagcgctcgccggaggccgctcacggactgcgacacaggcagcaagaagtggctgaatcttggtggcaactgaggagccgcgctcaaaagaggagagaggccctggacgcattacatcaggcccagaaactgcaggccatgttacaggagctcctggtgagcgcccagcgactgagagctcagatggacacctcaccggctccaaggagccccgtggaggccagaagaatgctggaggagcatcaggaatgcaaggcagaactcgacagttggaccgacagcatctcattggccagatccacaggtcagcagctcctgactgctggacatcctttttcttccgatataagacaggtactggctgggttggagcaagagttgtctagtctggagggcgcctggcaggaacaccaactccagcttcagcaggcactcgagctgcaactgtttctcagctccgtggagaagatggaacggtggctatgttctaaggaggactcgttggcgtctgaaggactctgggatcctctagcccctatggagccacttctctggaagcacaagatgctggagtgggacctcgaagtgcaggccggaaaaatttcagccttggaggccaccgcaagaggcctacaccaggggggtcatcccgaagctcagagcgcactgggcaggtgccaggccatgctcttgcggaaggaagccctgtttcggcaggcagggactcgacgtcaccgtcttgaagagttaaggcaattgcaggcctttctccaggactctcaggaggttgccgcttggcttagggaaaagaatctggtagcactggaagaagggctcttggatacggctatgctacccgctcagctgcagaaacaacagaactttcaagctgagttggacgcctcgatgcatcagcaacaggagcttcaacgagagggccaacgcctgttacagggcggacaccccgccagcgaagccatccaggagaggctagaagagctgggcgcactctggggggaactgcaggataattcccagaagaaagttgcaaaactccagaaggcctgcgaggcactaagactgcggaggagcatggaagagcttgaaaactggctggagcccatcgaagtagaactgcgcgccccgacggtaggccaggcgcttcctggcgtgggtgagcttctcggtactcaaagggaactggaagccgctgttgacaagaaggcacgccaagccgaagctctgctgggacaagcacaagcttttgtgcgcgagggccattgtctggcacaggacgtggaggagcaggcaagacgcttgctgcagaggttcaagagtctcagagagccgttgcaggagagacgcacagccctggaagctagatctctcctcctgaagttttttagagacgcagacgaggaaatggcgtgggtgcaggagaagctcccgttggccgctgcccaggattatggccagtccttgtcagcagtcaggcacctacaggaacagcaccagaacctggagagtgagatgtcaagtcacgaagctctgaccagagtcgtactcgggaccggttacaagttagtgcaagcaggccattttgcggcacacgaggtagcagccagggttcagcaactagaaaaggcaatggcacatttgcgggcagaggctgcgcggcggcggctgctcttgcagcaggcacaagaagcccagcagttcctgaccgagttgctggaggcagggtcatggctggcagagcggggtcatgtacttgattccgaggacatgggccactccgccgaggcaactcaggcactcctgcggcgactggaagccaccaagcgcgatctggaggccttctcccctcgaatagaacgacttcaacaaaccgcagcccttctcgagtcccgtaagaatcctgaaagtcccaaagtgctcgcacagctccaggctgtcagggaagctcatgctgagctcctgcgtagggcagaagcccggggccacggcctgcaagagcagttacaattgcaccagctggaaagagagaccttactgcttgatgcttggctgaccacgaaggcggctacggccgagtcacaggactacggacaggatcttgaaggagttaaggtccttgaagagaagttcgacgcctttcgaaaggaggtgcagtcgctcggccaagcgaaggtgtacgctctaagaaagctagccggcacgctggagcgtggagcccctcgccgctacccacacatacaggcacagagatcacgaattgaggctgcctgggagcggctggatcaggcaatcaaagcccggaccgagaacctagccgctgctcacgaagtccactcattccagcaggctgctgccgaattacagggtcggatgcaggagaaaactgctcttatgaaaggggaagacgggggccactctctttcctcagtcagaactctgcaacagcagcaccggaggcttgagcgagaactggaagcgatggagaaagaagttgccagactgcagacagaggcttgtaggctgggacagctgcatcccgcagcaccaggtggactggccaaggttcaggaggcgtgggcaacgctgcaggcaaaggcccaggaaagaggacagtggctggctcaggctgcacaaggacacgctttcctaggccgctgtcaggagctgttggcctgggcccaagaacggcaggagttagcttcttcagaggagttggcagaagacgtcgctggagctgagcagctgttgggtcagcacgaggagctgggccaagaaatcagggaatgcagattacaggcccaagatctgcgccaggaaggacagcaactggtggataattctcacttcatgagtgcggaggtcactgaatgcctgcaggagctggaaggacggctgcaggagctggaggaagcgtgggcattgcgctggcaacgttgtgccgagagctggggattgcagaaactccggcagagattggaacaggctgaggcctggctggcttgctgggaaggtctcctgcttaagccagactacggccatagtgtcagtgatgtggagctgctgctccacaggcatcaggatctggagaagctgctcgcggcccaggaggaaaaatttgcacaaatgcagaagacagaaatggaacaggagctgctgctgcagcctcaagaactgaaacccggaagggcgggatcctcgctcactagcttccagtggcgcccaagcggccaccaggggctcggagcacagttggccgaaacccgtgacccacaagatgccaagggcacccccaccatggaagggagcctggaattcaagcagcaccttctgcccggcggccgtcagccttctagcagtagctgggactcttgcagaggcaaccttcagggttctagcctcagcttgtttctggatgaacgcatggcagcagagaaggttgcaagcatcgccctcttggatctgaccggcgccagatgcgaaaggcttcgaggccggcacggacgtaagcatacattcagcctgcgactaacatctggggccgagatccttttcgctgctccttctgaagagcaggccgagagctggtggcgagccctgggcagtactgccgcccagtctctaagccccaaattaaaagccaaacccgtgagctctctgaatgagtgtacaacgaaagacgcccgacctggatgcctcctgcgctcggatccctag

SEQ ID NO: 206714 - DNA, 942 bp, Artificial Sequence
  Description of Artificial Sequence: Synthetic coding sequence
atgcggcacaaccagatgtgctgcgagaccccccccaccgtgaccgtgtacgtcaagtcggggtcgaatcggagccatcagcctaagaagcctataactttaaagcgccctatctgcaaggataattggcaagctttcgagaagaacacccataataataacaagtccaagcggccgaaagggccctgcttggtcatccagcgacaggacatgacggccttctttaagttgtttgacgacgatctcatccaggacttcttgtggatggattgctgctgcaaaatcgccgacaagtacctgctggccatgaccttcgtgtattttaaacgggccaaattcactatttccgagcacacaagaataaattttttcattgccttgtacctggcgaacaccgtggaagaagatgaagaggaaacaaaatatgagatattcccctgggcactcggcaaaaactggaggaaattgtttcctaactttctcaaacttcgagatcagctctgggaccgaattgactatagggcgatcgtaagtcgtcgctgttgcgaagaggtcatggccatcgcccccacccattacatatggcagcgtgaacgctctgtacatcactctggggccgtgcggaactacaatcgagatgaggtccaactgcccaggggcccctctgccactccagtagactgttccctgtgtgggaaaaaaagaaggtacgtgcgtctgggtctctccagcagttcctcactttcaagtcatacagccggcgtgacggagaagcattctcaggactcatataactccctgtctatggacattataggagatccaagccaagcctacactgggtcggaagtggtgaacgaccatcagagtaacaagggcaagaagactaattttctcaaaaaggacaaatcaatggaatggtttacgggatcggaggaatag

SEQ ID NO: 206715 - DNA, 942 bp, Artificial Sequence
  Description of Artificial Sequence: Synthetic coding sequence
atgcggcacaaccagatgtgctgcgagaccccccccaccgtgaccgtgtacgttaagtcaggcagcaaccgttctcaccaacctaagaaacctatcacgttgaaaaggccaatctgtaaggataactggcaagcctttgaaaaaaatacacacaacaacaacaaatccaagcggcctaagggcccttgtttggtaatccagcggcaggacatgaccgccttttttaaactttttgatgatgatcttatccaggacttcttatggatggattgctgctgtaagattgctgacaagtatcttctggctatgacctttgtgtattttaagcgtgctaaattcacaattagtgagcacactagaatcaatttctttatcgcactgtatctagccaataccgttgaagaagacgaagaagagacaaagtatgagatcttcccatgggccttagggaaaaattggaggaagctgtttcctaactttctcaaactgcgagaccagctgtgggatagaatagactaccgagccatagttagtcgcaggtgctgtgaagaagtgatggctatcgccccaacgcactacatttggcaaagggagcggagtgtgcaccattcaggagccgtcagaaattacaaccgcgacgaagtgcagttacctcggggcccaagcgcgacccctgtggactgttccctttgtgggaaaaagaggcgctatgtacgtctaggcctgtccagctcctccagtctgtctagccacacagcaggagttaccgaaaaacatagccaggacagctacaattcattgagcatggacatcatcggtgacccaagccaggcctataccgggagtgaagtggtcaatgatcaccagagcaacaagggcaagaaaaccaacttcctgaaaaaagataagtcaatggaatggtttacagggagcgaggagtag

SEQ ID NO: 206716 - DNA, 384 bp, Artificial Sequence
  Description of Artificial Sequence: Synthetic coding sequence
atgcggcacaaccagatgtgctgcgagaccccccccaccgtgaccgtgtacgtaaaaagcggatctaaccgctctcatcagccgaagaaaccgatcactttaaaaagacctatctgtaaggataactggcaggcttttgaaaaaaatacccacaataataacaagtctaagcgcccgaaggggccgtgcttggtgattcagagacaggacatgaccgccttcttcaagttgtttgacgacgacctgattcaggactttctgtggatggattgctgttgtaagatagcagataaatacctcctggctatgacgtttgtgtacttcaagagggcgaagtttactatttcagagcacacccgtattaacttcttcatagctctgtag

SEQ ID NO: 206717 - DNA, 882 bp, Artificial Sequence
  Description of Artificial Sequence: Synthetic coding sequence
atgctgtgggccatccccgagctgggcagcccctgccccatcagcatttcttatgagatgtctgactctcaggaccctaccaccagccctgtggttaccacacaggtcgagctgggtggctgttcacggcagggaggcggaaatggcttcctaaggttcagacagcatcaagaagttcaggcgtttttaagtcttctcgaagactcatttgtgcaagaattcttgtccaaggatccttgtttccagattagtgacaagtacctgctggccatggtcctcgtctattttcagagagcacaccttaaactgtctgagtacacccactcttccctcttcctcgcgctgtacctcgccaatgatatggaggaagaccttgaaggtcctaagtgtgagatatttccatgggccctcggcaaggactggtgcctgcgcgtgggaaagttcctgcaccagagagataaactgtgggcaagaatgggattccgagccgttgtcagcaggcaatgctgcgaggaagtcatggccaaggaacccttccactgggcatggactcgcgacaggcgaccccatcacgggggagttcaacgagtgtgtccccaggttcctgtccggctccccaggggccctggtcttagcccaccacattgctctccctgtgggttaccgcaacattgtagtagccatctgctgaagccagtctcaagtaaatgtccgtccttaacgtcggagtgtcaccgtccaccttctcaaaattatttgagtagagtcaagaacgcgtggggcggtgatttcttgatcgtattgcctccccagatgcagctggaacccgggacctacagcctgagaatcttccccaagcccccagctcggcccggacactag

SEQ ID NO: 206718 - DNA, 1122 bp, Artificial Sequence
  Description of Artificial Sequence: Synthetic coding sequence
atgaacgtggacaagttcctgatcgtgtgctacctgaagaaggaggtgtggggattcgaatcttattctctttccggaaccacttgcttccagtggaactattttgtgtggtccctgcgatttttctttagctgtggaagcagcaagtatcacctgaccccccttccaataaaaaaggtggattaccctcacaagaggggacagaattggggcagttacgtgcacaacagtctacccaggttcaattgggactacaggtcctgtttccatacctggaagcgagcgtctgacaatagagagagggcctacgagcattctgcctacggacaccacgaacgagggacgggcggtttcgacagaacccgtcattatgaccaggattactaccgtgaccctcgggagagaaccctgcagcatggactatattacgcctccaggtctagaagtccaaatcggtttgatgcccacgacccaaggtacgaacctcgtgcccgggaacaatttaccctaccctctgtggtgcatcgtgacatctaccgcgacgatataacccgggaagtgcgtggacggaggccagaacgcaattaccaacacagccgcagtcggtctcctcacagttcccagtcgcggaatcagtccccccagagactggccagccaggcatcacgtcctaccagatccccttctggctctgggtctaggtccagaagttcatcaagcgactccatatcctcgtcctcgtcaacgtcaagcgactcatccgatagctcctcaagttccagcgacgactctcctgctagatccgtgcagtccgcggcagtgccggctccaactagccagttactgagtagcttggaaaaggatgagcccaggaaaagtttcggaatcaaagttcagaacctccctgtacgtagtacagatacctctttaaaggatgggctattccacgagttcaagaaattcggcaaggttaccagcgttcaaatccatggtactagcgaggagagatacggcctggtgttctttcggcagcaagaggaccaagagaaagctctgacagcgagcaaaggaaagctgttttttgggatgcagattgaggttaccgcgtggattggcccgtag

SEQ ID NO: 206719 - DNA, 10995 bp, Artificial Sequence
  Description of Artificial Sequence: Synthetic coding sequence
atggtgcgggagacccggcacctgtgggtgggcaacctgcccgagaatgtccgagaggagaagatcatcgagcactttaagcgctatggacgcgtcgaatcagtgaagatcctgccgaagcggggatccgaaggcggagtggcagctttcgtggactttgtggatatcaaatccgctcagaaggcacacaactcagtgaacaagatgggggaccgtgacctgcgcacagattataacgaacctggaacgattcctagcgccgcacgcggactggacgacaccgtgagcatcgcgagccggagtagagaagtctctggttttcgcgggggcgggggtggtcctgcatatggcccaccaccttccctgcacgctagggaggggaggtatgagcgtcgactagacggggccagcgataatagggaacgagcctacgaacattctgcatacgggcatcacgagcgggggacagggggtttcgatcggacccgccattatgaccaggattattatagggatccaagagagcggactctgcaacacggcctgtactatgcaagtcgatcccgatcacctaacagattcgatgcgcatgaccctagatacgaacccagggccagggagcagtttactctccccagcgtggtgcacagagatatctaccgggacgatattacccgggaggtgcgggggcggcggccagagagaaactaccagcacagtcggtcccgatctcctcactcttcccagtccaggaatcaatctcctcagagactggccagtcaggcatcacggccaacccgttctccctccgggtccggctctcgttctagaagtagcagcagcgactcaatctccagctctagctcaacaagttcagattcttctgattctagttccagctctagcgatgattcgccagctcgtagtgttcagtcagctgctgtacctgctccaacctcacagctgctgtcttccctggaaaaagacgagccccggaaatctttcggaataaaagtccagaacttgcctgtgaggtcgactgacacctcacttaaagacggtctttttcatgaattcaagaaatttggaaaagtgacgtccgtacaaattcatggaaccagcgaagagaggtatggcctggtcttttttcgtcagcaggaagaccaggagaaagcacttaccgcttcaaagggcaaactgttctttggcatgcagattgaggtgacagcttggatcggtccggagacagaatccgaaaacgagttccggccactggacgaaagaattgatgagtttcacccaaaggccacacgcaccttatttatcgggaacctggaaaagactacaacgtatcacgatctgcgcaacatctttcagcggttcggcgaaatagttgatatcgacatcaagaaagtgaatggggttccacagtacgccttcttgcaatactgcgacatcgccagcgtgtgcaaggccattaaaaaaatggacggtgagtacttaggcaataatcgtctgaagctcgggtttgggaagtccatgccaacgaattgtgtctggctggatggcttgtcatccaacgttagcgatcagtacctgacccggcatttttgccgttacgggcctgtggtaaaagtcgtgttcgacagattgaagggaatggctctggtgctctacaacgaaatcgagtatgcccaagctgccgtcaaggagactaaaggcaggaaaattggagggaacaaaatcaaggtggacttcgctaatagggaatcccagctggcattttaccactgcatggaaaagtcaggccaagatatcagagatttttatgagatgctggcagaaaggagagaggagcgtagggcgagctatgactacaatcaggatcggacctactacgaatccgtcagaaccccagggacctaccctgaagactccaggcgagattatccagcccgggggagggagttttactcagagtgggaaacctaccagggagattactacgaaagtaggtactatgatgatccacgggagtatagggattatcggaacgacccatacgagcaagatatccgggaatatagttatagacaaagagaacgagagcgagaacgggaaagattcgagagtgatagagatcgggaccacgaaaggcggcccatagagagatcccaatcccctgtgcatcttaggagacctcagtctccaggcgcaagtccctcccaagcagaacgcctaccttccgactccgagaggcgattatatagtcgtagctctgacaggagtggctcttgcagcagcctgagcccccctcgttatgagaagctggataaaagccgccttgaacgctacaccaagaacgagaaaacagacaaggagagaacgtttgatcctgaaagagtagaaagagagcgccgactaattcgcaaggagaaagtcgagaaggataaaaccgacaaacagaaacgaaaggggaaagtccattcaccatccagccaaagctctgaaaccgaccaggaaaatgagagagaacagtcaccagaaaaacccaggtcctgtaacaagctgagtagagaaaaagcagacaaagagggaattgcaaagaaccgtctggagctgatgccctgtgtggtgctgacccgggtcaaggaaaaggaagggaaggtgattgatcacacacctgtggagaagctgaaggcaaaacttgacaatgacacagtgaagagttctgctctcgatcagaagctgcaagtgtcccagaccgagcccgcgaagagcgatctctccaaactagaatccgtgcggatgaaggtgcccaaggaaaaagggctgtcatctcatgtggaagtggtagagaaagaaggccggctaaaggcgcgaaaacaccttaagcctgaacagccagcagacggtgtgagcgcagtggatctggagaaactggaagcccgcaaacgccgttttgccgattccaacctgaaggccgaaaagcagaaaccagaggttaagaagagttctccagagatggaagacgcccgcgtcctgagcaagaaacaacctgacgtgagttctcgggaggttattcttctccgggaaggcgaagctgagcgaaaaccggtcagaaaagagattctgaagcgggaatccaagaagataaagctcgaccgcttgaataccgtcgcttcaccaaaagactgccaagaactcgcttcgataagtgttggatccggttctcgaccatcttccgatctgcaggccaggctgggcgagctcgccggggaaagtgtggaaaaccaagaagttcagtcaaaaaaacccattccctccaaaccgcaactgaagcagcttcaggttctggacgatcaaggccccgaaagagaagacgttaggaaaaactattgttcattgcgagacgagaccccagagcgtaagagtggtcaggaaaagtcccacagcgtaaataccgaggagaaaattggcatagatattgaccacacgcaatcttatcggaaacagatggagcaatctcgcaggaagcagcagatggagatggaaatcgccaagtcagaaaaattcggctctcccaaaaaagatgtggacgagtacgaacggcgcagtctggttcatgaggtaggcaaacccccccaggacgttactgacgatagccctccatccaagaaaaagcgtatggatcatgtcgattttgacatatgcacgaagagggagaggaactacagatcgtcaaggcagatctccgaggactctgagcggaccggcggttcacccagcgttcgccacggctcgtttcacgaggacgaggatccgattggatctcctcgtctgctgagtgtgaagggctccccaaaggtcgatgagaaggtgttaccgtactctaacatcaccgtgcgtgaggagtcgttgaagtttaacccttacgactccagccgaagggagcagatggcagatatggcgaaaatcaaactgtctgtgctgaacagcgaagacgagctgaaccgctgggattcacaaatgaagcaggacgctggcaggtttgatgtgagctttccaaactctattattaagagagacagcctgcggaaaaggtctgtccgggatctggagcctggcgaggtcccaagcgattcagatgaggatggggagcacaagtcccattcccccagagcatcggctctgtacgagtcgagtcggttatcatttttacttagagatcgagaggataaattgcgtgagcgggatgaacggctgtcctctagtcttgaacgcaataaattctacagcttcgctttggacaagaccatcacaccggatacaaaagctctgctggaacgggctaaatctttgtcctcaagtagagaagagaattggtcgttcctcgattgggattctagattcgcgaactttagaaacaacaaggataaagaaaaggtggattcggcccctcggcccatccctagttggtatatgaaaaaaaaaaaaattcgcaccgactcagagggaaaaatggacgataagaaagaagatcataaagaggaagagcaagaaaggcaggagctgttcgccagccgctttttacactccagcatctttgaacaggatagcaaacgactccagcacttggaacgcaaggaagaagacagcgacttcatctctggcagaatctacggcaaacagacaagcgaaggagccaattcaacaacagacagtatccaggaaccagtggtgttatttcattcacgcttcatggagcttacacgcatgcagcaaaaagagaaagaaaaagaccagaaaccaaaggaggtcgagaaacaggaggacaccgagaatcatcctaagaccccagagagtgctcctgaaaacaaggatagcgagctgaagaccccaccttcagtcggaccgccctcagtcacggtggtcacccttgagagcgccccaagcgccctcgagaaaacaactggagacaagacggtggaggcgccgcttgtgacggaggagaaaactgtggagcccgcgacggtgagcgaggaggcaaaaccagcgtcagaacccgcgcccgcccccgtggaacagctggagcaggtcgatctgccccccggcgcagaccctgacaaggaggccgctatgatgcccgccggggttgaagagggctcctctggggaccagccaccttacctggacgctaaaccccctacccctggtgcatctttctcacaggccgagtctaacgtagaccccgaaccggatagcacccaaccactctcaaaacctgcacagaaatcagaggaagctaacgagccgaaagcggaaaaacctgatgcaacggccgatgccgagcctgatgccaaccagaaagccgaggcggccccagaaagtcagccacctgccagcgaagaccttgaggttgatccccccgttgctgcaaaggataagaaaccaaacaaatctaagcggtcaaaaacccctgttcaggcagcagccgtttcaatcgtggaaaaacctgttacccgcaagagtgaacgtatagacagagaaaagctcaagagatccaattcccctcggggcgaggcgcaaaagttactggaactgaaaatggaagcagagaagattacccggaccgcctctaagaactcggctgcagatctggaacaccctgagccaagccttcccctgtcacggacgcgcagaaggaacgtgcgctctgtctacgcgaccatgggcgaccacgaaaacagatcgcctgtgaaagagccggtcgaacaacctagagtcactcgaaaacgtctggaacgtgaattgcaggaggccgccgccgtgcccacaacccccaggcgcgggcggcctccaaaaacccggcggagggctgatgaagaagaggagaacgaggccaaagagcctgcggaaactctgaaaccacccgagggatggcgaagcccgagatcccagaagacggctgctggcggcggcccccaagggaagaaaggcaaaaacgaacctaaggtggatgccacgagacccgaggctacaaccgaggtcgggccacaaataggtgtgaaggaatcttcaatggagcccaaggccgccgaggaagaggcaggttcagagcagaagcgggaccggaaggatgctgggaccgataaaaatccccctgagaccgcccctgtggaggtggttgagaagaagcctgctcccgagaaaaatagcaaatcaaagagggggcgtagtcggaattcaagattggcagtggacaaatctgcttcactgaagaatgtcgatgccgctgtgtccccccggggggcagcggcccaggcaggcgagcgcgaatccggagtagtggctgtgtcccccgaaaagtctgaatcaccacagaaggaagacggactctcatctcagttgaagagcgacccagtggacccggacaaggagcccgagaaggaggatgtgagtgctagcggccccagccccgaggctacacagctggcaaaacagatggagctcgagcaagctgttgaacatatcgccaagttagccgaggcctcagcttctgccgcgtataaagccgatgcccccgaggggcttgctccagaggaccgggacaagccagcccatcaggcatccgagactgaacttgccgcggcaattggaagcatcatcaacgacatctcaggagagccagagaattttccggccccgccaccatacccaggggaatcccagacagacctgcagccgcccgccggtgctcaggccctgcagccctcggaggaaggtatggaaaccgatgaagccgtgagcgggattctcgagacagaggcggctacagagtcaagtaggccccccgtgaacgcccccgatccctccgccgggcccaccgacactaaagaggctagggggaactcgtccgagacctcccacagcgtgccggaagcaaagggatccaaagaggtcgaagtaaccctggttcggaaggacaaagggcggcagaagacaacacgcagtcgtcgcaaaagaaacacaaataagaaggttgtcgcgcccgtggaaagccacgtgccagagagtaatcaggcccagggggagtctccggccgctaacgagggtaccacagtgcagcatcctgaagcaccccaggaagagaagcagtcagaaaaaccccactctactcccccacaatcctgcaccagcgatttgtctaaaatccctagcaccgagaactcctctcaggagatctccgtcgaagaaaggacccctaccaaagccagtgtgccaccagatctgccacccccccctcaacccgcccccgtggacgaagagccacaagcccgtttccgcgttcattccattattgaaagcgatccagtaacacccccatcagacccatccattcctatccccacactcccaagtgtcactgcagcgaaactcagcccgccagtggctagcggcggaatcccccatcagtctccacccactaaggtgacagaatggattacacggcaagaagagccgagggctcagtctacacctagcccagctcttcccccggataccaaggcgagtgacgtggatacctctagcagtacccttcgcaagattctcatggatccaaagtacgtttcggcgacatccgtaacttctacttccgtgacaacggctatcgcagagcctgtgtcagccgccccatgcttacacgaggctccacccccgccagtggacagcaagaaaccgctggaggagaagaccgcccccccagttacaaacaacagtgaaatccaggccagcgaagtactggtagcagccgacaaggagaaggtggcacctgtcatcgcccccaaaataacatccgtgattagcaggatgccagtatccattgacctggaaaatagccagaaaattacattggcaaagcccgccccacagaccctaactggactggtgagcgccctgacggggctcgttaatgtgagccttgttccggtgaatgccttgaagggtcccgttaagggttcggtgacaaccttgaagagcttagttagtacgcccgctggaccggtcaatgtgctgaagggccccgtgaatgtactaaccggtcccgttaatgtgctgacgaccccagtaaacgcgacggtcggaaccgtaaatgcagctccagggaccgtgaatgcagccgcatccgcggtcaacgcaactgctagtgccgtgacagtgacagcaggagctgtgacagccgcatccggaggagtgacagcaacgaccggcaccgtgactatggcaggcgcggtaatcgctccaagcactaagtgcaagcagcgagcctccgcaaatgagaactcacgctttcaccccgggagcatgccggtcattgacgacaggccagcagacgcaggcagcggcgcaggcctaagagtgaacacgagtgagggtgtggtgctgcttagttattcggggcagaaaaccgagggaccgcagcgcataagcgccaagatctcccagattccccctgctagcgccatggatattgaatttcagcagtcggtcagcaaaagccaggtgaaacctgactcagtgaccgcctcccagcccccatctaagggccctcaggctccagccggctacgccaatgtcgccacgcactcaaccttagttctcactgcccagacctataacgcaagtcctgttattagctctgtgaaggcagaccgaccaagtttagagaaacctgagcccattcacctgtctgttagcacccctgttactcagggtgggaccgtgaaggtgctcacgcagggaatcaatacgccgcccgtgctcgtccataaccagctggtactgacccctagcattgtcaccacaaacaaaaagctggctgaccccgtcacattaaaaatcgaaacgaaagtgttgcagcccgccaacctgggttccaccctgaccccccatcacccaccggctctcccatcgaagttacccacagaggtgaatcacgtccccagcggaccatctatccccgccgatagaactgtgtctcacctagctgccgcaaaacttgatgcgcacagccctcgtccgagtggccctggtcctagtagtttcccccgggcctcccacccttcgagcaccgcctccactgctctttcgaccaatgccacagtgatgttggccgctggaatacccgtccctcagttcatctctagcattcatcccgagcagagcgtcattatgccaccacattccattacgcagacagtgagtctctcccatctgtctcaaggggaggtgagaatgaacaccccgacgctcccatccataacatacagcattaggccagaagctctgcactcacccagggctcccctgcaaccacagcagattgaggtccgagctccgcagcgggcaagcacacctcagccagcaccggcaggggtgccagccttggcttctcaacaccccccggaagaggaggtccactatcacttgccagtagcgagagcaacggccccggtacagtcagaagtcctggtcatgcaaagtgagtacagacttcacccatatacagtaccaagggacgtgaggattatggtacaccctcacgtcaccgccgtgtccgagcagcctcgtgcagccgacggcgtggtaaaggttcctccagcctctaaggcaccgcagcaaccgggaaaggaggctgccaagacaccagacgccaaagccgcccctactcccaccccagcccccgttcctgtgcctgttcccttgcccgcccctgcgcctgcaccccatggtgaagccagaattctgaccgtgacacccagtaatcagctccagggtctccctctgactccaccagtggtcgtaacccatggcgtgcagatcgtgcactcctctggagagttatttcaggagtaccgctacggagacatcagaacataccacccccctgctcagctgacacacacacaattcccagctgcttcttctgtgggcctgccgtcacggactaaaacggcagcacaagggcctccccccgaaggggagcctcttcaacctcctcagccagtccagtctacgcagccagctcagcctgcccctccatgcccccccagtcaactaggtcagcctggccagcccccgagttctaagatgccacaagtgtcacaggaagccaaaggcacacaaacaggtgtcgagcaacctcgcctgccggcggggccggccaaccgtccaccagaaccccacacgcaggtacaaagggcccaggccgaaaccggcccaactagcttcccttcccccgtcagcgtctctatgaagcctgacctcccggtgagtctgccaacccagaccgccccgaaacagcctcttttcgtgcctactacctctgggccaagcacaccccccggtctcgtgctcccccacacagaatttcagcctgccccaaagcaagattcttctccccacttgacgtcacagcggcccgtcgatatggttcagctcttaaaaaagtatccgattgtctggcagggcctgctggccctgaaaaatgatacagccgcagtgcaactacatttcgtctccggcaataacgtgctcgcacaccgtagcttgccactcagcgaagggggaccacccctccggattgctcaaagaatgcgacttgaagcgactcaacttgagggggttgcgcgaagaatgaccgtagagactgactactgcctattgctggctttgccatgtggcagggaccaagaagatgtggtgtcccagacagaaagcttaaaggctgcattcatcacttacctgcaggcgaaacaggcagccggaattattaacgtgcctaatcctggatccaatcaaccagcctatgtgctgcagatttttcctccctgtgagttcagtgaaagtcatctttctaggcttgcccccgatttgcttgcttccattagcaacatcagcccacaccttatgattgttattgcaagtgtatag

SEQ ID NO: 206720 - DNA, 1122 bp, Artificial Sequence
  Description of Artificial Sequence: Synthetic coding sequence
atgaacgtggacaagttcctgatcgtgtgctacctgaagaaggaggtctggggatttgaaagttattctctgagtggcacaacatgtttccagtggaattactttgtttggagcctgcgatttttttttagctgtgggtcttctaagtaccatctgaccccgcttccgattaaaaaagtggattacccccacaagcgcgggcagaattggggctcatatgtgcataattctctcccaaggttcaattgggactatcgatcctgttttcacacctggaaaagggccagcgataatcgcgagagagcttacgagcattcagcttatggccaccatgagcgtgggaccggggggttcgacagaacacgacattacgaccaagactactatagggacccgcgggaacggacactccagcatggcctgtactatgcgagccgttctagaagtcctaaccggttcgacgcgcacgacccaaggtacgagccccgcgcccgggaacagtttacactaccctccgtagtccaccgcgatatttacagggatgacataactagagaggtgagagggcgaagacccgaaaggaattatcagcatagcagatccaggtccccacacagttcccagagcagaaatcagtctcctcagaggctggcctcacaggcgtcaaggccaacccgcagcccaagcggatcgggctcaaggtccaggtccagcagctccgacagcatctcgagctctagcagcacaagtagtgacagctccgactcaagcagttcatcctcagatgactctccggcccgctctgtccagtccgcggcagttccagccccgacttcacagctgctctctagtttggaaaaggacgagcccaggaaatcctttggaattaaagtgcaaaacttgcccgtccgcagtacagatacgtctctgaaagacggcttgtttcacgaattcaagaagtttggcaaggtcacatcagtgcagatacacggcacatcagaggaacgttacggcttagtgtttttccgtcagcaggaggaccaggaaaaggcccttaccgcaagtaaaggcaagctgttctttggtatgcaaatcgaagttaccgcttggatcggcccctag

SEQ ID NO: 206721 - DNA, 894 bp, Artificial Sequence
  Description of Artificial Sequence: Synthetic coding sequence
tgacaggccagccggcccacccggagccccagcggcagcggcagccgatcgagatccagctcatccgactctatatcttccagcagttccacttcatcagatagcgactcatcatcatcgtctagtgacgactccccagcacgttcagttcagtccgctgccgtgcccgctcctacctctcagcttctcagtagcctggaaaaggatgagccacgaaagagctttggaatcaaggttcagaatctgcccgtgcgatctaccgacacaagtctgaaggacggcctgttccacgaattcaagaaattcggaaaagtgacgtccgtccaaattcatggcacaagcgaggagcgctacggactcgtctttttcaggcaacaggaggaccaagagaaagctctcacagcatccaaaggcaaactgttctttggcatgcagattgaggtgactgcatggattggtcctgagaccgaatcagaaaatgagttccggccgctcgacgaaaggattgacgaatttcatccaaaggccacccggacattattcatcggaaatctggagaagactaccacgtaccatgatctgcgaaatatctttcaacgatttggagaaatagtcgacatcgatattaagaaggtaaacggagtgccccaatatgctttcctgcagtactgcgacatcgcttcggtctgtaaggcgataaaaaaaatggacggtgaatatctggggaacaaccgtctcaaactggggtttggaaagtctatgcctacaaactgcgtgtggttggatggactgtcctctaatgtaagtgatcagtatttaacgcgacacttctgtcggtacgggcccgttgttaaggttgtgtttgaccggctgaagggtatggccctcgtctag

SEQ ID NO: 206722 - DNA, 885 bp, Artificial Sequence
  Description of Artificial Sequence: Synthetic coding sequence
atgagcccccggggcaccggctgcagcgccggcctgctgatgaccgtggggtggttgctgcttgccggactccagtctgcacgcggaaccaatgtcacagctgcagtacaggacgccgggctggctcacgaaggagagggagaagaagaaaccgagaacaatgacagcgagacagccgaaaactacgccccccctgaaacagaggatgtcagtaatagaaacgtcgtgaaggaggtggagttcggaatgtgtactgttacctgcggaattggcgtacgggaggtcattctgaccaatggatgcccagggggggagtctaagtgcgtggttcgtgtcgaagagtgccggggccctaccgactgcgggtggggaaagccaatctcagaatcccttgaaagtgtacgactcgcctgtatacatacatctcctctgaatcgcttcaaatatatgtggaagttactgcgtcaggatcaacaaagtatcatcctggtgaacgattccgccatcctagaggtgagaaaagagtcacatccactggcattcgagtgcgacacgctggacaacaatgaaattgtggcgactataaagtttactgtttacactagctccgagctgcagatgaggcgcagctctctccctgcgaccgacgccgctctgattttcgtactcaccattggtgtgattatttgtgtcttcataatctttctcctgattttcattattataaattgggctgcggtgaaagctttttggggagctaaagcctccaccccagaagtgcagagcgaacaatccagtgtgcgatataaggactcaacgtccttggaccagctgcccacagaaatgcctggcgaggacgatgctctgagtgaatggaatgagtag

SEQ ID NO: 206723 - DNA, 648 bp, Artificial Sequence
  Description of Artificial Sequence: Synthetic coding sequence
atggtgagcgccctgcggggcgcccccctgatccgggtgcacagcagcccagtgtctagcccaagtgtgtccggcccccgtcgcctggtatcctgtctgtcatcccagtcatcggcactgtcccagagcgggggcggaagcacctccgctgccggcatcgaggccagatcccgagcgctgagaagacggtggtgcccagcagggattatgctgctcgcgctggtatgtcttctgagttgcttattaccatcatccgaagccaaactctatggcaggtgtgagttggcccgagttctccacgactttgggcttgatggttatagaggttactctctggcagactgggtgtgccttgcctatttcacctcaggctttaatgcagcggcccttgattacgaggcagacggatcaactaacaatggcattttccagatcaacagtcggcgatggtgtagtaacttaactcccaacgttcccaatgtgtgccgtatgtattgctccgacttactcaacccaaacctgaaggatactgttatctgtgctatgaaaatcacacaggaaccccaggggctgggatactgggaagcctggagacatcattgccagggcaaggatctgactgaatgggttgacggatgtgacttctag

SEQ ID NO: 206724 - DNA, 627 bp, Artificial Sequence
  Description of Artificial Sequence: Synthetic coding sequence
atgatccaggaggaccacgagggcagccaggacggcggcgtgcacagcagtcccgtcagcagccccagcgtgtcagggccacgaaggcttgtcagctgcctttccagccagtcttccgccctcagtcaatccggcggcggaagcaccagtgccgccgggatcgaggcccggtccagagcactgcggcgtcggtggtgccctgcaggtattatgctcctcgcactggtctgcttgttgtcttgtttgttgcctagttcagaagcaaagctttacgggaggtgtgagttggcccgggtcctccatgacttcggtctcgacggttaccgaggctactctctcgccgattgggtgtgtttggcttactttactagtgggtttaacgccgccgctttagattacgaggccgatgggtctacaaataatggtatctttcagattaacagccgtaggtggtgtagtaacctgactccaaatgtccccaacgtctgtagaatgtattgcagtgatctgctgaacccaaatcttaaggacacagtgatttgcgctatgaagatcactcaagagccccaagggcttggatattgggaggcctggcgccaccactgtcaaggcaaagaccttacgtag

SEQ ID NO: 206725 - DNA, 339 bp, Artificial Sequence
  Description of Artificial Sequence: Synthetic coding sequence
atggtgagcgccctgcggggcgcccccctgatccgggtgtgcctggcttactttactagcggattcaatgctgccgcactggactatgaggccgacgggagtaccaacaacggcatcttccagatcaacagccgtcgttggtgcagtaatttaacgcccaatgtccccaacgtatgccgcatgtattgcagcgacctgctcaatccaaacctcaaggacacggtcatatgcgccatgaagatcacccaagaaccccagggactcggttattgggaggcctggcgacaccattgtcagggcaaagatcttactgaatgggttgatggatgtgacttctag

SEQ ID NO: 206726 - DNA, 372 bp, Artificial Sequence
  Description of Artificial Sequence: Synthetic coding sequence
atgaccagcggctggaccgacaccggcgacaccgcctggctgaccgcctacgctctgccatacgcaggtgtatgtcttgcttattttacttcgggcttcaacgctgctgcgctggattacgaagcggacgggagcacaaataacggtatttttcagatcaatagcaggagatggtgttccaacctgactccaaacgtgcctaatgtgtgtcgaatgtactgcagcgatctcttgaaccctaatctcaaggacactgttatctgtgccatgaagataacccaggaacctcaaggattaggttattgggaagcctggcggcatcactgccagggcaaggaccttacggaatgggtggacgggtgtgacttttag

SEQ ID NO: 206727 - DNA, 375 bp, Artificial Sequence
  Description of Artificial Sequence: Synthetic coding sequence
atggtgctgtgctggctgctgctgctggtgatggccctgccccccggcacaacaggggttaaggactgtgtgttctgtgagctgactgatagcatgcaatgccctgggacctacatgcactgcggcgacgacgaagactgcttcaccggtcacggcgtcgctccagggactgggccagtgatcaataaaggatgcttgcgggcaacatcttgtgggttggaggaaccggtttcttaccgcggcgtgacatacagtctgaccaccaactgctgtacaggtaggctctgcaatagagccccttcgagccaaactgtaggtgcaacaacaagcctggcactgggcctggggatgttactacctccacgtctgctttag

SEQ ID NO: 206728 - DNA, 480 bp, Artificial Sequence
  Description of Artificial Sequence: Synthetic coding sequence
atgaaggcctggggcaccgtggtggtgaccctggccaccctgatggtcgtgactgtggacgcgaaaatttatgagcgctgcgagctggccgctcggttggagcgtgctggcttgaatggatacaaaggctacggagtcggcgactggctgtgtatggctcattatgagagtggatttgataccgccttcgtggatcataaccccgacggaagcagcgaatatggcatcttccaactgaactccgcctggtggtgcgacaacgggattacacccacaaaaaacctttgtcatatggattgtcatgatcttctgaataggcacatcctcgacgacattagatgcgccaaacagattgtgtcctcccagaacggactctctgcatggacgtcctggcgccttcactgcagtggacatgatctaagcgagtggctcaaagggtgtgatatgcacgtgaagattgatccaaagatccatccatag

SEQ ID NO: 206729 - DNA, 480 bp, Artificial Sequence
  Description of Artificial Sequence: Synthetic coding sequence
atgaaggcctggggcaccgtggtggtgaccctggccaccctgatggtagtcacagtggatgcgaaaatctacgagcgctgtgagctagcggccaggctggaaagagccggattgaacggctataagggctacggcgtaggagattggttatgcatggctcactatgaaagtgggtttgataccgcttttgtcgatcacaaccctgacggttccagtgagtatggcatttttcagctcaactctgcctggtggtgcgataacggaattacgccaactaaaaacctttgtcatatggactgtcacgatctgctgaacagacacatactcgacgatatcaggtgtgccaaacagatagtaagctcccagaacggtcttagcgcctggacttcttggaggctacactgctcgggtcacgatttgtcagagtggctgaagggctgtgatatgcacgttaagatcgaccccaaaatacacccttag

SEQ ID NO: 206730 - DNA, 3207 bp, Artificial Sequence
  Description of Artificial Sequence: Synthetic coding sequence
atgcggagcgccgccaagccctggaaccccgccatccgggccggcggccacggcccggatcgcgtgcggcctctcccagccgcctcctccggaatgaagtcctcaaagtcatccacaagtcttgcttttgaatccagactgagccgtctcaagagagccagcagcgaggacacgctgaataaaccaggttccacagcagctagtggggtcgttagactgaaaaaaaccgcaacagctggcgcaatctcagaactgactgaaagcagactgaggagcggaacaggtgcattcacgacaacaaagagaactggtatacctgcacctcgtgaattctccgtaaccgtttctcgggagagatccgtccctagggggcctagcaacccacgtaaatccgtgagctcacccaccagtagcaatactcctacaccaacaaagcacctgcggaccccaagtaccaagcctaaacaggagaatgagggtggcgagaaggcagctctggaatcccaggtgcgggaacttctcgccgaggccaaagctaaggactctgagatcaaccggttacgctctgagttgaaaaaatataaggagaagcgaacactgaacgctgagggtactgacgcgctcggacctaacgtggacggcaccagcgtttcgccaggggacacagaacctatgatccgagccctcgaggagaagaacaaaaacttccagaaggagctgagtgatctggaagaagaaaatcgcgtcctcaaggagaagctgatttacctggaacactcccctaacagtgagggggcagcctcccataccggggactcctcctgtcccacctctattacgcaggaaagctctttcggtagtccgacgggaaatcagatgagtagcgatattgatgaatacaagaaaaatatacatggtaatgcattgaggacgagcggttcatccagctccgacgtgacaaaggctagcctgtcccccgacgcttctgattttgagcatatcacagctgagaccccatccaggcctctgtcatccacatccaaccctttcaaaagttccaagtgttcaacagctggttcttcccctaattcagttagcgaactgtccctagcctctctaacggaaaaaatccagaaaatggaggagaaccaccattccaccgcggaagagctacaggccacgctacaggagttgtccgaccagcagcagatggttcaagagctgactgccgaaaatgagaaactggtggacgagaagactatcctcgagacaagcttccatcagcatcgagagagggctgagcaactgtctcaggagaacgaaaaactgatgaatctcctgcaggaacgtgttaaaaatgaagaaccaacaacccaggaaggcaagattatcgagttggaacagaagtgcacagggattttggagcaagggcgcttcgagagggagaagctgcttaatatccagcagcaattgacctgttccctgcgaaaagtcgaagaggaaaatcaaggagccctcgagatgatcaagagactgaaggaggaaaatgagaaactcaatgaatttctggagctcgaacgacacaacaacaacatgatggccaagacattggaggaatgccgggtgacactcgagggactgaagatggaaaatggttccctcaaaagtcacctccaaggggagaagcagaaggccactgaggcgtccgctgtcgaacagacggctgaatcctgtgaggtacaagagatgttaaaggtagcaagggcagaaaaggacctgctcgagcttagctgtaacgaattgaggcaggaacttttaaaggcaaatggggagatcaagcatgtgtccagtcttttggcaaaggtagaaaaagattacagctacttaaaggaaatatgcgatcaccaggcagaacagctcagcaggaccagtttaaagctccaagagaaagctagcgaaagcgatgccgaaataaaggacatgaaggaaacaatcttcgagctggaggatcaagtggagcagcatcgggcagtcaaactgcacaacaatcagttgatctctgagctggagtcatccgtcatcaaactggaggaacaaaagagtgatctggagaggcagctcaagactcttaccaaacagatgaaggaggagactgaggagtggagacgttttcaggccgatctccagacagcagtcgtggttgcgaacgacattaaatgtgaggctcaacaagaactgaggaccgtaaaaaggaaacttttagaggaagaagagaagaacgctcgactgcagaaggagttgggtgatgtgcagggccacggtagggtcgtgacatctagggctgcccctcctcccgtagatgaagaaccagagtcatcagaggtagacgcagccggccgctggccaggggtttgcgtgagccgaaccagcccgactccgccggaatccgccacaaccgtcaagagccttatcaagtccttcgacctcggacgacccggcggcgccggacagaacatctctgtccataagaccccccggtctccgctttcagggattccagtccggaccgcccccgcagccgcagtatcccccatgcaacgacacagcacttattcaagtgttcgtcccgcgagccgaggcgtaacacagaggctcgacctaccagacttgcccctgagtgacatattaaaggggagaaccgaaactttaaagcctgacccacatctgaggaagagtcccagccttgaaagcctgagtcgtcccccctccctcggttttggagacacaagactcctgtctgcctccactagagcctggaagcctcagtcaaaactaagtgttgaaaggaaagaccccttggcggcccttgcccgtgagtacggaggtagcaagcgcaatgccttattaaaatggtgccagaagaagactcagggttatgcgaatatcgatattaccaatttcagctcatcttggagcgatggcctggccttttgcgcactattgcacacctacctgcccgcccacatcccctaccaggagctgaactctcaagaaaaaaaacggaatttgctccttgcatttgaagctgccgagagcgttggtatcaagccctctctcgagctctccgaaatgctgtatacagaccgccctgattggcagtctgtaatgcaatatgtagctcagatttacaagtacttcgaaacttag

SEQ ID NO: 206731 - DNA, 2112 bp, Artificial Sequence
  Description of Artificial Sequence: Synthetic coding sequence
atgggcaaccacagcggccggcccgaggaccccgagcccggcgccttcaccacgacgaagcggaccggcattccggccccacgcgagttttcagtaacggtgtcacgcgagagatcagtgcccaggggaccctccaatcccaggaagtcggtctccagtccaacttctagcaatactccaacacctaccaagcatcttagaacaccatcaacgaagcctaaacaggagaacgaggggggagagaaagccgcgctcgagtctcaggtccgggagctgctcgctgaagcaaaagctaaagatagtgagataaaccggctgcggtctgagttaaaaaagtataaagagaagcggacgctcaatgctgagggtacagacgcattaggaccgaacgttgacgggacttccgtgtcccccggcgataccgagccaatgattcgtgcccttgaggaaaagaataagaacttccagaaggagctgagtgacctggaggaagaaaaccgcgtattgaaggaaaagcttatctacctggaacactctcctaatagcgagggcgctgcatcacacactggggattctagctgtcctacgagcatcacacaggagtcaagcttcggatcgcctaccggcaatcagatgagttccgacattgacgagtacaagaaaaatattcatggaaacgcactcagaacctcaggctcaagctcttccgacgttacaaaagctagcctgagcccagacgcgagcgacttcgagcacattaccgcagagacgcccagccgcccgctgtctagtactagtaaccccttcaagtcatcaaaatgctccacagcaggcagcagtccgaatagtgtctcggaactttcactcgcctcgctgacagagaagatacagaaaatggaggaaaaccatcatagcactgctgaggagctccaagctaccctgcaggagttgtccgaccaacagcagatggtgcaggagctcaccgctgaaaatgagaagctggtcgatgagaagaccatcctggagacatcatttcatcaacatcgagaacgggcggaacagctcagccaagaaaatgagaagctcatgaaccttttacaggaacgcgtgaagaacgaagagcccaccacacaggaaggaaaaattatcgagctggaacagaaatgcaccgggatcctggagcagggtagattcgagcgcgagaaactgctaaatatccaacagcagctgacttgttccctgcggaaagtggaggaagaaaaccagggagccctggagatgatcaagcgcctgaaggaggaaaacgagaaactgaatgaatttctggaacttgaacgacataacaataacatgatggctaaaacgctggaagaatgccgtgtgacccttgagggcctgaaaatggagaacggcagtcttaagtcgcacctgcagggcgagaagcagaaggcaaccgaagcctctgcggttgagcaaacagcggagtcatgtgaagtgcaagagatgctgaaggttgccagagccgagaaagacttgctggagctgtcatgtaatgaactgagacaggaactgcttaaagcaaatggtgagataaaacatgtaagctccctgcttgcaaaagttgagaaggactactcctaccttaaagagatttgtgaccaccaggcagaacagctgtccagaacatcgctcaaattacaggagaaggcctcggagagcgatgcagaaatcaaggacatgaaagagactatcttcgaactggaggaccaggttgaacaacatcgggctgtgaagctgcacaataatcagttgatttccgagttggagtcctccgtgattaagcttgaagagcagaagagcgacctggaacgccaactcaaaactttaaccaagcagatgaaagaagagaccgaggaatggcgcagattccaagcagatctgcagacagccgtggtggttgccaatgatatcaagtgcgaagctcagcaagaactaaggacagtgaaacggaaactgttagaagaagaagaaaaaaacgcacgtctgcagaaagagctgggcgacgtgcagggccacggacgcgtggtgaccagccgcgccgcaccaccatag

SEQ ID NO: 206732 - DNA, 2130 bp, Artificial Sequence
  Description of Artificial Sequence: Synthetic coding sequence
atgggcaaccacagcggccggcccgaggaccccgagcccggcgccttcacgacaaccaagcgaactgggattcctgcacctagagagttttcagtcacagtgtcacgagagcgatccgtgccgcgtggtccttctaacccccggaaaagtgtctcctcacccacaagcagcaacacacccacccctacaaaacacctacgcaccccatctaccaagcctaagcaggaaaacgagggcggggaaaaagcagcactcgagtcacaggtgcgcgagctgttggcagaggccaaggccaaggactccgagattaatagattgaggagtgagctgaaaaaatacaaagagaaaaggactctgaacgccgagggtaccgacgctcttggcccgaacgtggatgggacttccgttagtccaggggatacagagcctatgattcgcgccttggaggagaagaataaaaactttcagaaggagctcagtgaccttgaagaagagaatcgtgtcttgaaagaaaaactgatataccttgaacactctccaaatagcgaaggggctgcttctcacaccggcgatagctcctgcccaacgtctattacacaggaatcaagcttcggttcgccaacaggaaatcagatgagttcagacattgacgaatacaaaaagaatatacatggcaatgctcttcgcacgtcaggctccagttctagcgacgtcaccaaggcctccctgagcccagacgcgagcgattttgagcacatcaccgcagaaacaccgagcagaccactctcctccaccagcaatccattcaaaagcagcaagtgcagcacagcgggctcctcccctaattccgtctctgaactttctctggcctccctcaccgagaagattcaaaagatggaggagaatcatcactctacagctgaagagttgcaggctacacttcaggagctgagcgaccagcagcagatggtccaggagctgacagccgaaaacgaaaaattggtcgatgagaagactatcctcgagacttcctttcaccagcaccgagaacgcgccgagcagctctcccaggaaaatgagaagctcatgaatctgctgcaggaacgagttaaaaacgaagagcctactacgcaggagggcaagataatcgagctggagcaaaagtgcacgggaattcttgaacagggacgcttcgaacgggaaaaattgctgaatattcaacaacagctgacctgttccctgcggaaggtggaagaggagaatcagggcgcactcgaaatgataaagaggctgaaggaagagaatgagaagctcaacgaattcctggaactcgagcgtcacaacaataacatgatggccaaaacgttggaagaatgccgagtaacacttgaggggctgaaaatggaaaacggaagcttgaagagccatcttcagggggaaaagcaaaaagcaaccgaagccagtgccgttgagcagactgctgagtcttgtgaagtacaggaaatgctgaaggtggctagagccgagaaggatctgctagaactgtcgtgtaacgagctcaggcaggagcttctgaaggcaaatggagaaattaagcatgtgtcgtctctgctggctaaggtggaaaaggattatagctacctgaaggaaatctgtgatcaccaggcagagcagctgtctaggacgtccctcaaactacaagaaaaagcatctgagtctgatgccgagatcaaggatatgaaggagactatctttgagctcgaagatcaagtcgagcaacatcgggccgtaaagctccacaataaccagctgatttctgagctggagtcgtctgtgatcaagctagaagagcagaagagcgaccttgagaggcaattgaagacccttactaaacagatgaaggaggaaactgaagagtggaggcggtttcaggccgacctccagacggccgtggttgttgctaacgacattaagtgtgaagctcagcaggagctgagaaccgtcaaaagaaagttgctggaagaggaggaaaagaacgcacgactgcagaaagagctaggagatgtgcaagggcacggtcgagtcgtcacctctcgagcagctccccccagcttagggtccgtcagctag

SEQ ID NO: 206733 - DNA, 2964 bp, Artificial Sequence
  Description of Artificial Sequence: Synthetic coding sequence
atgggcaaccacagcggccggcccgaggaccccgagcccggcgccttcactactacgaaaagaactggaataccagccccacgtgagttctccgtgaccgtctccagggagaggtctgtgccaagaggtccctctaatcccagaaagtctgtgtctagccccaccagcagcaatactccaacacccaccaagcatttgagaacgccatctacaaaacctaaacaagagaatgaaggcggcgaaaaagccgctctggagagccaggtcagggagctgctggccgaggccaaggccaaggactcggagataaatagactcagaagcgaactgaaaaagtataaagaaaaaaggacattaaatgccgagggaacggatgccttgggaccgaacgtagatggtacctctgtgtcccctggcgatactgagcctatgattagggccctggaggaaaagaacaagaacttccaaaaggaactgtccgacttagaggaggagaatcgggtcttaaaagagaaacttatctatctggagcatagccccaacagcgagggagccgccagccacaccggggattccagctgccccaccagcattacacaagagagcagcttcggatcacctactggaaatcaaatgagctcagatatcgacgaatataaaaagaacatccacggcaatgccctgaggactagcgggtcttcctcttctgacgtgaccaaggctagcctcagccctgacgcttcagactttgagcacataaccgcagaaacgccctcccgtcccctgagcagcaccagcaacccatttaaaagttcgaagtgttccactgccggtagctcacctaatagtgtcagcgagttgagtttggcaagtctgacggaaaagattcagaagatggaggagaatcatcattccactgcagaggaactccaggcaaccctgcaagagctatccgaccagcaacagatggtgcaggagctcacagccgagaacgagaagctggttgatgaaaaaaccatcctggagacatcttttcatcagcaccgtgagcgcgccgagcagttgagccaggagaatgaaaagcttatgaacctactacaagaaagagtgaaaaatgaggagccaacaactcaagaggggaaaataatcgagttagaacagaagtgtactggaattcttgaacaggggagatttgaacgcgaaaaactcctgaatattcaacagcagctaacctgtagcttgcgcaaagtcgaggaagagaatcaaggtgccttggagatgatcaaacgccttaaggaagaaaacgaaaaactcaacgagtttctcgaactggagaggcacaacaataacatgatggcgaaaacgctggaagagtgccgcgttaccctggaaggactcaagatggagaatggaagcctgaaatcacacctgcaaggggagaagcagaaagccaccgaggcctccgctgtggagcagacagctgagagctgtgaggtgcaggagatgctgaaggtggcccgggcagagaaagacctgttggaactctcatgcaacgagctccgtcaggagttgctgaaggctaatggcgaaattaaacacgtgtccagcctcctcgccaaggtagaaaaagactactcctatctgaaagaaatctgtgatcaccaggcagagcaactctcccgcacctctctaaaacttcaggagaaggcaagcgaaagcgacgccgaaatcaaagatatgaaggagacgattttcgaactggaagatcaggtggagcagcaccgcgccgttaaattacataataaccaactgatctccgaactcgaatcaagtgtgattaagttggaggaacagaaatctgatcttgagcgccagctaaagactttgacaaagcagatgaaggaggagaccgaggagtggcggaggttccaggccgacctacagaccgctgtagtggtcgctaacgatattaagtgtgaggcacaacaggagctacgaactgtcaaaaggaaactcctagaggaagaggaaaaaaacgctcgcctacaaaaggagctgggagacgtccagggccacggccgagttgtgacgtcacgcgctgccccaccacctgtcgacgaggaacctgagagctcggaagttgatgcagccgggcggtggcccggtgtgtgcgtgtcacgaaccagtcccacacctccagaaagtgcaacaacagtcaaatccttgattaaatcgttcgacctagggaggcccggaggcgctggccagaatatctctgttcacaagacacctcggtccccactgagtgggatccctgtgaggaccgcaccagcggccgcggtttctccgatgcaacgccattcgacttacagctctgtcaggccggcctcccggggtgtgacccagaggctggacctgccagatctccccctgtcagacatcttgaagggacggacggagacgctaaagcccgacccgcatctcaggaagagcccgagccttgaatcactatcacgtcctcctagccttgggtttggggacactcggttgttatccgcatcgacacgcgcatggaagccacagtctaagctgtctgtagagagaaaggaccccctggccgcgctagccagagagtatggaggcagtaaacgaaatgcattgcttaagtggtgccagaagaagactcaagggtatgcaaatattgacattacgaacttctccagctcctggagtgacgggctcgccttttgcgccctacttcacacttacctgccggctcacattccatatcaggagctgaactctcaggagaagaaacggaatctcctattagctttcgaagctgcagagagcgtgggtatcaagccgtcccttgagctctctgagatgctgtataccgatagaccagattggcaaagcgtgatgcagtacgttgcccagatctacaaatactttgaaacatag

SEQ ID NO: 206734 - DNA, 2373 bp, Artificial Sequence
  Description of Artificial Sequence: Synthetic coding sequence
atgcggagcgccgccaagccctggaaccccgccatccgggccggcggccacgggcctgacagggttcgtccacttcccgcggcttcatcaggcatgaagagctccaagagcagtacatcattagctttcgagtcaaggctcagtcgactcaaacgcgcgtcctccgaagacacgttaaacaaacctggctccacagcggcttcgggtgtcgttaggctgaagaagactgccaccgcaggggcgatttccgagctgactgagagccgcctgaggagcggaactggtgcgtttacaacgactaagcgcacaggtatcccagcgcccagggagttcagtgttactgtgtctcgagagcgaagcgtgcctaggggaccctcaaacccgagaaagtctgtcagctcccccacgagcagcaatacacctactccaacgaaacatttacgaacaccctcgaccaaacctaagcaggaaaacgagggcggggaaaaggccgccctcgaaagccaggtgagggaactacttgctgaagccaaggccaaagactcggagataaatcgactccgcagcgagcttaagaagtacaaggagaaaaggaccctcaatgctgaaggcaccgatgcactggggcccaatgtagatggcacctcggtgtctcccggggacaccgaaccaatgattcgagcgttagaggaaaagaacaaaaacttccagaaagaactctctgatctggaggaggagaatagagtcctgaaagaaaaattgatctacctggaacattcccctaattcggagggagccgcaagccacacaggcgactcatcatgtccaactagcatcactcaggagtcatcctttggaagtccgaccggaaatcagatgtcttcagatattgatgagtacaaaaaaaatatccacggtaacgctctgcggaccagcggcagtagctcatctgatgtgactaaggcttcactgtctcctgacgcctctgacttcgagcatatcaccgctgagacaccatcccgcccgctgtcatccaccagcaatccgttcaaatcatctaagtgctccactgccggctctagcccaaattccgtatccgagctgtccttagcttcactcacggaaaaaatacaaaaaatggaggagaaccaccacagcaccgccgaggagctccaggccacactccaggaactttccgaccagcagcaaatggtgcaggagctgaccgcggagaacgagaaactggtggacgagaaaactatcttagagacgagtttccaccagcatcgcgagagagccgagcaacttagccaggagaacgagaaactcatgaacctactgcaggagagagtgaagaacgaggagcctacaacacaggaaggaaagattatagaattggaacagaagtgtactggcattttggagcagggccgattcgaaagggaaaagctgttaaacattcaacagcagttaacgtgctcactccggaaggtggaggaggagaatcaaggcgcgctcgagatgattaagcgtcttaaggaggagaacgaaaaactcaatgaattcctggagctcgaacggcacaacaataacatgatggcaaaaactttggaagaatgtcgtgtcacactggaaggccttaagatggaaaatggcagcttaaaatcgcatttacagggcgagaaacaaaaggctaccgaggcatccgcagtggagcagacagcagaatcatgcgaggtccaggagatgttgaaggtcgcacgggccgaaaaagatctgttggagctctcgtgtaatgaacttcgacaggagctcttaaaagccaatggcgagataaagcatgtgagttctctacttgcaaaagttgaaaaggattattcttaccttaaagagatctgcgatcaccaagctgaacaacttagtcgcacttcactgaagctgcaggaaaaagcctctgagagtgacgctgaaatcaaggatatgaaggagacaatctttgaactggaggaccaggtcgaacagcaccgcgcggtgaagctccacaacaaccagctgatatctgagctcgaatcttccgtgattaagcttgaggagcagaagtctgacctggagcgccagttgaagacactcaccaagcagatgaaagaggagacggaggagtggcgccggttccaggctgatctgcaaactgcagtggttgtggccaacgacatcaagtgcgaggctcagcaagagctgagaactgtgaagcgcaagctgctggaggaagaggagaaaaatgcccggcttcagaaggaattgggggatgttcagggacacggcagagtggtcacctcccgcgcagctccacctagcctgggttccgtgagctag

SEQ ID NO: 206735 - DNA, 3090 bp, Artificial Sequence
  Description of Artificial Sequence: Synthetic coding sequence
atgcggagcgccgccaagccctggaaccccgccatccgggccggcgggcacggcccagatcgcgtgcgaccccttcccgccgcttctagcggaatgaaatcttctaaatcctctacgtcactggcttttgagagcagactaagcaggctgaaacgcgcatcgtctgaggatactttgaataagcctggcagtacagctgcgagcggagtagttagactaaaaaagacggccaccgcaggagctatcagtgagttaaccgagtctagactgaggtctggaacaggcgcatttactactacaaagcggaccgggatccctgccccaagagaattttcggtcaccgtgagccgagagcgctccgtgccccgcggcccctctaaccccagaaaaagtgtgagctcccctactagttctaacacaccgaccccaacaaagcatctccggactccgtcaacaaaaccgaagcaagagaatgaaggcggtgaaaaggcagccctggagtctcaagttcgagagctgctcgcagaagccaaggcaaaggattccgaaattaatcggctgcgttccgaactgaaaaaatataaggaaaaaagaacgctgaacgcggaaggcacagatgccctcggtccaaatgttgacggcacgagtgttagccccggagacaccgagcccatgataagagcacttgaggaaaagaataaaaattttcagaaggagctctccgacctggaggaagagaaccgcgtacttaaagaaaaactgatctatctggagcacagtcctaattctgagggcgctgcctctcataccggggacagcagctgccccacgagtattacacaggaatcatctttcggaagccccacagggaatcagatgagttccgatatagacgaatacaaaaaaaatatacacgggaacgccctgaggacatcaggctcctcgtcttcagatgtgaccaaggcatccctgtccccagacgcgagcgacttcgaacacatcacagcagagactccaagccggcccctcagcagcacctcgaatccctttaaatcatcaaagtgctcaacagcaggttcctcccccaactcagtaagcgaactctccctggcctctctcactgagaagatacagaaaatggaagagaaccaccacagcactgcagaggagctgcaagcaaccttgcaggagttgtctgatcaacagcaaatggttcaggagctgaccgccgagaacgagaagctggttgacgaaaaaacaattctggagactagcttccaccagcacagagagagggcggaacagctgtcccaagaaaacgagaagttgatgaacttgcttcaggaacgggtgaagaacgaggagcctactacacaagagggaaaaatcatcgagctggagcagaagtgcaccggtatcctcgagcaaggcaggttcgaaagagagaaacttctcaatatacagcaacagctaacctgttcccttcgaaaagtcgaagaggagaaccagggcgccctggagatgatcaagcgtctgaaggaagagaatgagaagctgaacgaattccttgaactggaaaggcataacaataacatgatggctaagaccctcgaagagtgtagggttacactggaagggttaaagatggagaatggatccttgaaaagccatttacaaggtgagaagcaaaaagcaacagaagcctccgcggtcgaacagaccgccgaaagttgcgaggtccaagagatgttgaaagtggccagggctgagaaggatctgcttgagctgtcttgcaacgaactgcgccaggagcttctaaaggctaacggagaaatcaaacacgtaagtagccttctcgctaaggtcgagaaagactactcatatttgaaagagatctgcgaccatcaagccgaacagttgagtaggacatctctgaagcttcaggagaaggcctcagaaagcgatgctgagattaaagacatgaaggaaactatctttgagcttgaagaccaggtcgagcagcatagagccgtaaaacttcataacaatcagctcatatctgagctggagtcctccgtcatcaaactggaggagcagaaatccgatctggagagacagcttaagacgctgacgaagcagatgaaagaggaaacagaagagtggcgccgtttccaagctgaccttcagactgccgtcgttgtcgcgaacgatattaagtgcgaggcacagcaagagctcagaacagtgaaacggaagctccttgaggaggaagagaaaaacgctcgcctacagaaagagctgggagacgttcagggtcatggcagggtggtgacaagccgggccgcacctcccccggtggacgaagagcctgaaagtagtgaagtggacgccgctggacgctggcccggtgtttgtgtaagtagaaccagcccaacaccccccgagagtgccacaactgtgaaatctttgattaaatccttcgacctgggcagacccggtggtgcgggacagaatatctctgttcataaaactccgcgttcacctctctctggaattcctgtgagaacggccccagccgcagctgtgagtccaatgcagcggcattctacatactcctccgtacgcccggcgagtcggggggtgacgcagaggctggacctgccagacttaccgctttcagacattctaaaaggaaggaccgaaacactcaagcctgacccacatttgcgtaagtcgccaagcttagaaagcttgagtcgccccccatcactaggcttcggcgatacacggcttctgagcgcaagtacaagggcttggaaaccccagtcaaaactctccgtcgagcgaaaagatccactagccgctctggcaagggagtacggggggagcaagcgaaacgctcttctaaaatggtgccagaagaagactcaggggtacgccaagcgtaacttactgcttgcgtttgaggccgcggaatccgtcggcataaaacccagcttggagttgtctgaaatgctgtacaccgaccggcctgactggcagagcgtgatgcaatatgtggctcagatttataagtatttcgaaacttag

SEQ ID NO: 206736 - DNA, 237 bp, Artificial Sequence
  Description of Artificial Sequence: Synthetic coding sequence
atgcggagcgccgccaagccctggaaccccgccatccgggccggcggacatggtccagaccgggtccgccccttaccagccgccagctcaggaatgaagtcaagcaagtcctcaacatcgctggcctttgagtccagattaagtaggcttaaaagagcatcatccgaggatacgctcaacaaaccgggcagcaccgccgcctctggggtggttagactaaagaagaccgccacctag

SEQ ID NO: 206737 - DNA, 1227 bp, Artificial Sequence
  Description of Artificial Sequence: Synthetic coding sequence
atgaaggagaccatcttcgagctggaggaccaggtggagcagcaccgtgccgtgaagctacacaataaccagttaatctcagaactagagagctctgtgataaagctcgaggaacaaaaatctgatctggaaaggcagttgaaaactttgactaagcagatgaaagaagaaacggaggagtggaggagattccaggcagatctgcagactgcggttgtggttgcaaacgacatcaaatgtgaagctcagcaagagctccgcaccgtgaagcgcaaacttttggaagaggaagagaagaacgcaaggctgcaaaaggagttaggcgatgttcagggccacgggagggtagttacttcaagagctgccccacccccagtggacgaagagcctgaaagcagtgaagtggatgcagcaggacgttggccaggtgtttgtgtctcacggaccagcccaacaccacccgaaagcgcaaccaccgtgaaatcccttatcaagagtttcgatctgggcaggcccggaggagccggccagaatatatctgtccataaaactccaagatcgccactgtccggaatcccggtgcgaaccgcccctgctgccgcagtgagtcctatgcagagacatagcacatactcctcagtgcgcccagcctcaaggggtgtgacacagcggctggatctgccagaccttccgttaagcgatatcctgaaagggaggaccgagaccttaaagccagatccacacctcagaaagagccccagcctagagagtctgtccaggccaccatccttggggtttggtgacacccggctcctgtccgccagtactagagcatggaagccccaatccaagctgtcagtggagcgaaaggaccctctggccgcgctagcacgagagtacggtgggtctaaaaggaacgccctcttaaagtggtgccaaaagaaaactcagggatatgctaacatcgacatcaccaatttctcttcaagctggtccgacggcttggccttctgtgctctgttacacacctatttacctgctcatatcccttatcaggaactaaactcccaagaaaaaaagcggaatttgctcttggcttttgaggcagcggagtcagtgggaattaagccgagcctggagctgtcagaaatgttgtatacagacagacctgactggcagagcgtcatgcagtatgttgctcagatttataaatactttgaaacttag

SEQ ID NO: 206738 - DNA, 3354 bp, Artificial Sequence
  Description of Artificial Sequence: Synthetic coding sequence
atgaagaaggccagccggagcgtgggcagcgtgcccaaggtgagcgccatatctaaaacccagacagcagagaaaatcaagcccgagaactcgagcagcgctagtaccggcggaaaattggtcaagccaggtactgcggccagccttagtaagacaaagagctctgacgacctccttgccggtatggccgggggggttaccgtcaccaatggggttaaaggcaagaagtctacgtgccccagcgcagctccatcagcgtcggcgcccgcaatgacaaccgtggaaaataagtctaagatctctaccggtacggccagctctaccaaaagatcaacctcaacgggaaacaaggaatcttccagtacgagggaacgacttcgggaacggactagactgaatcaaagcaaaaagctgccgtcagccggacagggcgccaatgacatggcactcgcaaagcgctctcgcagtagaacagcaacagagtgcgacgttagaatgtcgaagtccaagagcgacaatcaaatatcagatagagctgctcttgaggctaaggtaaaagatctactgactctggccaagacaaaggatgtggaaattcttcacctgagaaacgagcttcgtgatatgagggcccagttaggaattaatgaggatcatagcgagggcgatgagaaatccgaaaaggagacaattatggcccaccagccgactgatgtagagtcaacactgctccagttacaggagcaaaatactgcaattcgggaggagctgaaccagctaaagaacgagaacaggatgctgaaggatcgactcaacgcactcggcttctccttggagcagcgcctggacaattctgagaaactgtttggatatcagagcctgtcacccgagatcacaccagacaatcagagcgatgggggaggcacactgacatcatccgtggaaggaagcgccccaggatctgtcgaagacctgttgtcacaagacgaaaatactttgatggatcatcagcattctaattccatggataatctcgattctgaatgcagcgaagtataccagcctctaacctcaagcgatgacgctctggatgcaccgtcatcaagcgagagcgagggtattccgtcaattgagagatcccggaaaggctcttcggggaacgcctccgaagtgtccgtcgcctgcctgaccgaacgtattcaccagatggaagaaaatcagcactcgacctcagaagagcttcaagcaacacttcaggaattagccgacctgcaacaaataactcaggagttgaattctgagaacgagaggctgggtgaggaaaaggtcatactcatggaatccctctgtcagcagagcgataaactcgagcacttcagccgacagatcgagtatttccggtccctcctggatgaacatcatatatcttacgtgattgatgaagacgttaagagcgggaggtacatggagttggaacagaggtacatggacttagccgaaaatgccaggtttgagcgtgaacagctgctcggcgtgcagcagcaccttagcaatactctaaaaatggccgaacaggataacaaggaggcacaggagatgattggggctcttaaggagcgaagtcaccatatggaaaggataatagagtcggagcagaaggggaaggcagcccttgctgcaactcttgaagaatacaaagctaccgtggcgtcagatcaaattgagatgaatcgccttaaggcccagctagaaaacgaaaagcagaaggtcgccgagctctatagcatccacaatagcggagataagagcgacatccaggacttgttggagtccgtgcgattagacaaagagaaagcagagactttggcgtccagcctgcaggaggatctcgcacatactcgcaacgatgcgaatcgccttcaggacgccattgcaaaagtggaagacgagtacagggcctttcaggaagaggctaaaaagcagatcgaggacttaaacatgactcttgagaaattgcgctccgaccttgatgaaaaggagactgagagaagtgacatgaaagagaccatattcgagctggaagatgaagttgagcagcaccgcgcggtcaagctccacgataacctgatcatatccgacttggagaacacagtgaaaaagctccaggatcagaaacacgatatggaacgggaaataaaaacccttcacagaagattgcgggaggaatccgcagagtggcggcaatttcaggccgatttgcaaactgccgtggtcattgccaacgacatcaaaagcgaggcccaggaagagatcggggacctcaagcggaggcttcacgaggcccaggaaaaaaatgaaaagctcactaaggaactggaagagattaagagtagaaaacaggaagaggagagaggtagagtctataattacatgaatgctgtggaacgagatttggctgccctgcgacagggcatgggcctctctagacggtccagcacctcgtccgaacccacccctacagtgaagactttgattaagtcttttgattcggcatcccaggtgccaaacccggccgctgccgcgattcctaggactcctctctcccctagtccgatgaaaacccctccggccgctgcagtatctccgatgcaaagacacagcatttccggcccaatctctaccagtaagccgctgacagcgctgagtgacaaacgaccaaattacggtgaaatcccggtgcaagagcacctgctgcgcacatcctcagcaagccgccctgcatcactaccaagggttcctgccatggagtccgctaaaacattatccgtcagccgtagatcctccgaagaagtgaagcgtgatatttctgcacaggagggagcctcaccggcatccctcatggctatgggtaccacatccccccagctctccctgtcctcttcgcccacagcctctgtcactccaaccactagaagtagaatccgtgaagagcggaaagatccactctcggctctggccagggaatacggaggatcaaagcggaacgccttgctgaagtggtgtcagaagaaaactgagggataccagaatatagatatcaccaacttcagctcgtcctggaacgatggactggctttctgtgcactgctccacacttatcttcccgctcacatcccttaccaggagttgaacagccaagacaagcgtcgcaattttatgctggcattccaagcagctgagtccgtcggcataaaatcaacgctcgacatcaatgagatggttcgcactgaacgaccagactggcagaacgtgatgctatatgtgacggctatttacaagtattttgaaacttag

SEQ ID NO: 206739 - DNA, 2820 bp, Artificial Sequence
  Description of Artificial Sequence: Synthetic coding sequence
gtgcccgaggccgtgcggtggggctacttcatccccgagcagagccaattcgcttgcaaatgcattactaaaaggcagcctcggatgaaaaaggccagcagaagcgtgggatcggtgcccaaggtgtccgctattagtaagacccagactgccgagaagatcaaaccagagaactctagtagcgctagtaccgggggcaagctagtcaagcctggaacagcagctagtttaagcaagacaaaatccagcgacgacctactggcgggaatggccggcggcgtgaccgtgacaaatggtgtgaagggtaaaaagtctacctgcccatcagctgctccctccgccagcgcgcctgccatgaccacagttgagaataaatctaagatcagcactggtacggcaagcagcacgaagagatcgacatcaacaggaaacaaggaatcctcaagcacaagggaacgactccgcgagcgcacaagactgaatcagtccaagaaactcccatcggccgggcaaggcgccaacgatatggccctcgccaaaaggtctcggtcgcgcacagcaactgaatgcgatgtaagaatgagtaagagtaaatccgacaaccagatttctgacagagctgcactggaggctaaagtgaaggatctgcttactctcgcaaaaaccaaggatgtggagattctgcacctgcgcaacgagcttagagacatgagagctcagctcggaataaatgaggaccattccgagggggatgagaagtcggaaaaggagacaataatggcccaccagcccactgatgtcgaatccacgctcctgcagctgcaagagcagaacaccgcaatccgagaggagctaaaccagctaaaaaatgaaaatcgcatgctgaaggataggctgaatgctttagggttctctctcgagcagagactggataacagcgaaaaattattcgggtaccaaagcctctctcctgaaataactccagataatcagtccgatggaggaggcacactgacttcttccgtggaggggtcagctcccggaagtgtggaggacctgctgtctcaggatgagaacacacttatggatcaccagcattccaatagcatggataatctggactcggagtgtagcgaggtgtatcagccccttacctcttctgacgatgccctcgatgccccaagctcaagtgagtctgaaggaatccccagcatcgagcggtcaagaaaaggcagtagcgggaatgcgagcgaagtgagcgtagcatgtttgaccgaaagaatccaccaaatggaggagaaccaacactccacatcggaggagctccaggcgacactccaggaacttgcggatctgcaacaaattacacaggaactcaacagcgaaaatgagcgcctgggggaagagaaagtgatcctcatggaaagtctgtgccagcagagcgacaagttggagcacttttcccggcagattgaatactttagatctctactcgacgagcatcacatctcctatgtcattgatgaggatgtgaagtcaggccgatacatggagcttgaacagcgctatatggacctggcagagaacgccaggtttgagcgcgagcagctcctgggagtgcaacaacatctgtcaaatactttaaagatggccgagcaggacaacaaggaggcccaggagatgatcggagccctgaaggaacgatcccatcatatggaaagaattatcgaatcagagcaaaaagggaaggctgccctggcagccactctggaggaatataaagctaccgtggcgagtgatcaaattgagatgaataggctcaaggctcaattggaaaacgaaaagcagaaagtggctgagctctatagtatccataacagtggtgataagtccgatatccaggacctgttggaaagcgttcgattggacaaggaaaaagcagagacactcgcatcatctcttcaggaagatctagcacataccagaaatgatgccaatcggttgcaggatgcgattgccaaagttgaggatgaatacagggccttccaggaggaagctaagaagcagatagaggaccttaatatgactcttgagaagctgagatctgacctggacgagaaggaaaccgagaggagtgatatgaaggagactatcttcgagctggaagatgaagtggaacagcaccgagccgtcaaactgcacgataacctgatcatctcagatctcgaaaacaccgtgaaaaaactccaggatcaaaagcatgacatggaacgagaaataaagaccttgcacaggagactcagagaggagtctgctgaatggcggcagtttcaagcggacttgcaaaccgccgtcgttatcgctaacgatattaagtccgaggcacaggaagagatcggtgacctgaagcggcggctccacgaagcccaagagaaaaacgaaaagctcactaaagaactcgaagagattaaaagccggaaacaggaggaggaacggggccgagtgtataattatatgaatgccgttgagcgcgatctggctgcgttaagacagggcatgggcctgtcacggaggagtagtactagctcagaaccgactcccacagtgaaaactcttatcaaaagctttgattcagccagccaggtaccgaacccagccgccgcagctatccctagaaccccgctgtccccatcccctatgaaaactccacctgcagctgccgtctcgcctatgcagatggagagttcctctgttgcacatgctggcatgcaatggcgcgatctggggagcctccagcccctgcctccaggattcaagtag

SEQ ID NO: 206740 - DNA, 2370 bp, Artificial Sequence
  Description of Artificial Sequence: Synthetic coding sequence
atgaagaaggccagccggagcgtgggcagcgtgcccaaggtgagcgctattagcaagactcagactgcagaaaagatcaagcctgagaattcctcgtcagcctcgaccggggggaagttggtgaaaccgggcactgctgcatcactgtcgaagacaaagagtagcgacgacctccttgcgggcatggcgggcggcgtgacagtgacaaatggggtcaagggcaagaaatcaacctgtccctcagctgccccgtcagcgagcgctccagcgatgacgaccgtcgaaaataaaagcaagatatccactggcaccgctagctctactaagagatccacgtctaccggcaacaaggagtcctcctctacacgagagaggcttagagaacgaacacgcctgaaccagtccaagaagctgccttccgccggacagggggccaacgacatggcgttggctaaaaggagccggtcgcgtaccgccaccgagtgcgacgtgaggatgagcaaaagcaaaagcgataaccagatcagtgaccgtgcagccctcgaagcgaaagttaaggatctcctgactttggccaaaaccaaagacgtggaaatcctacaccttagaaacgagttaagagacatgcgggcccaattgggtattaatgaggatcatagcgaaggtgacgagaagagcgaaaaggagactattatggcccatcagcccactgatgtcgagagtaccctgctccagctgcaagaacagaacacggcaatcagagaggagctaaaccagctaaagaacgaaaatcgcatgctgaaagaccggttaaacgctctgggattctctctggaacagaggctggataactcagagaagctgttcggctaccaatcacttagtcccgagataactcccgataatcagagcgacggggggggcactctgacctctagtgtcgagggctctgcgcccgggagtgtggaagatcttttgagccaggatgagaatacgctgatggaccatcagcactcaaatagcatggataacctggactcagagtgttccgaggtttatcagcccttgacatctagtgatgatgccttggacgccccatcatcctccgagagcgaaggtataccctctattgaacggtcaaggaagggctcatctggcaatgccagtgaggtgagcgtggcttgccttacagaacgaatccaccagatggaagagaatcagcactctaccagtgaagagctgcaggcgactctgcaagaactcgctgatctgcagcagattacccaggagcttaattcagaaaacgaacgcctgggcgaagagaaagttattttaatggagagcttatgccagcagtccgacaaacttgagcattttagcaggcagatcgagtattttcgcagcttactggatgagcatcacattagctacgtgatagacgaggatgtcaaatccgggcgctacatggaattggagcagaggtacatggatttagctgaaaacgcccggttcgagagggaacaactccttggtgtgcagcagcacctaagtaacactctcaagatggctgagcaggacaataaagaagcccaggagatgatcggtgcccttaaggagcgcagccatcatatggagagaatcatcgagtcagagcagaaaggcaaggcagccttagcagcaactctcgaagagtacaaggcaaccgtggccagcgatcagatcgagatgaatagattgaaggcgcaactggagaatgaaaaacagaaggtggccgaattgtatagcattcataacagcggagacaaatcagacattcaggatcttctggagtctgtgcgattggacaaggagaaagcggagacattagcctccagcctgcaggaagatctcgcacatacaaggaatgatgctaatcgactgcaggacgcaattgccaaggtcgaggatgagtatagagctttccaggaagaagcaaagaagcagatcgaagacttgaacatgaccctggagaagctgaggtctgacctcgatgaaaaagaaactgagcgctcagatatgaaggaaactatctttgaactggaggacgaggttgagcagcatcgggccgtgaaactacacgataatctgatcatcagcgacctggaaaacaccgtgaagaagctccaggaccagaaacacgatatggaaagggaaatcaagactcttcaccgtcggctgcgagaggaatctgctgagtggcggcaattccaggctgatctacagaccgccgtggtgatcgcaaatgacattaagtccgaggcccaggaggagattggggatctgaagcgcaggctgcacgaagcccaggagaagaacgaaaaattaacttag

SEQ ID NO: 206741 - DNA, 3354 bp, Artificial Sequence
  Description of Artificial Sequence: Synthetic coding sequence
atgaagaaggccagccggagcgtgggcagcgtgcccaaggtgagcgctatatcgaagacacaaactgcagagaaaattaagcccgagaactcttctagcgccagtaccgggggtaagctggttaagccgggaactgccgcttccctcagtaagacgaagagtagtgacgatctgttagctggtatggctgggggagttactgtgactaatggtgtgaagggaaagaaatccacatgccctagtgctgccccctccgcctctgcccctgctatgacgaccgtcgagaataaaagcaagatctccacaggtacggcttcatctacaaaaaggagtacgagcacaggcaataaggagagttctagtacgagggagcgcctaagagagcggacaagactgaaccagtctaaaaagctgccctccgccggtcagggtgccaacgatatggcactcgcaaagcgtagcaggagccgcacagcaacagaatgcgacgtgcggatgtcaaaatccaaatccgataatcagattagtgatagggcggctctggaagcgaaggttaaggacctgctcacgctggcaaaaaccaaggatgtggaaattctccatttgcggaacgaactgagagacatgcgtgcgcagctgggcattaacgaggatcacagcgaaggcgacgaaaaatcagaaaaggagacaattatggcacaccagccaacagatgtggaatccactctcctacagctgcaggagcagaacactgccatacgagaagagctaaaccagctaaagaatgagaaccgcatgctgaaggatcggttgaacgctctgggcttctcactcgaacaaagattagacaacagtgagaaactattcgggtaccagagcctcagccccgaaatcacaccagataaccagagtgatggcggcggcactcttacaagcagcgtggagggatctgctccagggagtgtggaagatctgctgagtcaggacgagaacaccctgatggaccatcaacacagtaattctatggacaatctcgactcagagtgcagcgaagtgtaccaacctcttacatcctcggacgacgctctggatgccccatcatcgtctgagagtgaggggatcccctccattgaacgctcacggaaaggaagctcggggaacgctagtgaagtgtctgtcgcgtgcctgacagaaagaattcaccagatggaggaaaatcagcactctacctccgaggaactgcaggcgacgcttcaggaactggcagatctgcagcaaattacccaagaattaaactcagagaacgaaagactgggcgaggaaaaagtgattctgatggagtctctgtgccagcagagtgataaactggaacatttttctcgccagatcgagtactttagaagtttgctagacgaacatcacatcagctatgtgatagacgaagatgtgaaatccgggcggtacatggagctggaacagcggtatatggatctggcggagaacgcaagattcgagcgcgagcaactgttgggcgtccaacaacacctgagcaatacgttgaaaatggccgaacaagacaataaagaagcacaggagatgattggcgccctgaaggaacgtagtcatcatatggagaggatcatcgagtccgagcagaaagggaaggcagcactggcagcgactctggaggaatataaggcaactgttgccagtgaccagattgaaatgaacagactgaaagctcagcttgagaacgagaaacagaaggttgctgaactctatagcattcataacagcggagataagagcgatattcaagaccttttagagtccgtaagactcgataaagaaaaagctgagactctggcctcaagcctgcaggaggatctcgcccacacacgaaacgatgcaaaccggctacaagatgcaattgccaaagtcgaagacgaataccgcgccttccaagaggaggccaagaaacagatagaggatcttaatatgaccctagagaagctacgctctgatctagatgagaaagaaaccgagcgctccgatatgaaagagaccattttcgagctggaggatgaggtggagcaacacagggcagtgaaattacatgacaatctgataataagcgaccttgaaaacacagtgaagaagctgcaggatcagaaacacgacatggaacgtgagatcaagaccctccaccgtagactgcgtgaggaatccgcagaatggcgccagttccaggcagacctgcagactgctgtggtcatcgctaatgacataaagagtgaggcacaggaagaaattggggacctcaagaggagactccatgaagcccaggaaaagaatgagaagctaaccaaggaactcgaggagataaaaagccgcaaacaagaagaagaacgggggagggtttataactacatgaacgccgtggaaagggatctggccgcactaaggcagggaatgggactgtctcgccgctcctcgaccagcagtgagcccactccaaccgtgaagactctgatcaagtcttttgattcggcgtcccaagttccaaatccagcggcagctgcgattccacgcactcctctgtctccctcacccatgaaaacacccccagcagctgcagtgtcgcccatgcagaggcattctatttcaggacctatcagtacgagcaagcctctcactgcactgagtgataagcgtcccaactatggcgaaattcccgtgcaggaacatctactgcgaacaagttcggctagccgccctgcatcactgcccagagttccagcaatggagagcgccaagaccctgtctgtctcccgaaggtccagcgaggaggtcaagagggacatcagcgcccaggagggcgccagcccagctagtctcatggcaatgggtactacatcaccccagctttctctctcaagcagccccacagcgagcgttacccctactactcgcagtagaattcgcgaagagcggaaggaccccctttccgccctggcgcgagagtacggtggctccaaacggaacgcgctgctcaaatggtgccagaagaaaactgaaggataccaaaacatagatattacaaacttttcttctagctggaatgacggcctcgctttttgtgcgttattacacacctacttgccggcccacatcccttaccaggaactgaactctcaggacaagaggagaaacttcatgctggcctttcaggctgcagagtcggttggtattaagtccacgctcgatatcaacgaaatggtccgaaccgagaggcctgactggcagaatgtcatgctctacgtgacagcgatctataagtactttgagacctag

SEQ ID NO: 206742 - DNA, 3237 bp, Artificial Sequence
  Description of Artificial Sequence: Synthetic coding sequence
atgaagaaggccagccggagcgtgggcagcgtgcccaaggtgagcgccattagcaagactcagacagcagagaagattaagcccgagaactcctcatctgcgtcgaccgggggcaaactggtcaaacccggaacagcagcttcactgtccaagaccaagagttctgatgacctcctggctggtatggctggaggcgtgaccgtcaccaacggcgtaaaggggaaaaaatccacctgcccaagcgcagctccatctgcttctgcccccgcaatgaccaccgtggagaataagtctaaaatttcaaccggaaccgcctccagtacaaaaaggtcaacctcgaccggaaacaaggagtcaagctccacaagagagcgtctgagagagaggacccgattgaaccagagcaagaaactgccctctgctggtcaaggcgccaatgatatggcattggctaaaaggtctcgtagtaggacagccaccgaatgcgacgtgcggatgagcaaaagtaagagcgataaccagattagcgaccgcgcagccttggaggcaaaggtcaaagacctcctgactttggccaaaacaaaagacgtggaaatccttcaccttaggaatgagctcagagacatgcgtgcgcagctcgggataaatgaggatcatagtgaaggagacgaaaaatctgaaaaggagactatcatggcacatcagccaactgacgtggagtctacactcctccagttgcaggaacagaatactgccattcgcgaggagctgaatcagttaaaaaacgaaaatcgcatgcttaaagaccggctgaatgcactgggctttagtttggaacagcgcctggataattcagagaagctctttggatatcagtcgctttcccccgaaattactcccgataaccagtctgacggggggggcaccttgacttcctctgttgagggtagtgcaccgggatctgtagaggacctactaagccaagatgagaacacgctgatggaccaccagcactctaatagcatggataatctcgactcagaatgttctgaggtataccagcccctcacctcctctgacgatgccctagatgcgccttccagttctgagagcgagggcatcccaagcattgaaagatctcgaaagggcagctctggaaatgccagtgaagtcagcgtcgcttgtctgacagaacggatacaccagatggaggagaaccagcattcgacatctgaagaactgcaggcaaccttgcaggagctggcagatttgcagcaaatcacacaggagttaaattccgaaaatgagcggctgggagaggaaaaagtcatcctgatggaaagcctgtgtcagcagtctgacaagctggaacattttagccgccaaattgaatatttccggagcctcctcgacgagcaccatataagttacgtaatagatgaggatgtgaaatctggacggtatatggagctcgaacaacgctacatggacctcgctgagaacgcaaggtttgagcgcgagcaactgctgggcgtgcagcaacacctcagcaatacactaaagatggccgagcaggacaacaaggaggcccaagagatgattggtgccctgaaggaaagatcacaccacatggagagaatcatcgagtccgaacagaaagggaaggctgcactggctgcgactctggaggagtacaaagccaccgtagcctcggaccagattgaaatgaatcggttaaaagctcaacttgagaatgagaaacagaaggtagcggaattgtattctattcataactctggagacaagtccgatatccaggatctccttgaatcggtgcgccttgacaaagaaaaggccgaaacgctcgcctcgtcgcttcaagaagacttggcacacactcgcaacgacgccaacagactgcaggatgccattgccaaggtggaagacgagtaccgagcatttcaggaggaggccaagaagcaaattgaggatctgaatatgacattggagaaacttagaagtgacctggacgaaaaagagactgagagatccgacatgaaagagacaattttcgaattggaggacgaagtggagcagcatagggcagtaaagctgcacgataatctcatcatctctgatctcgagaatacagtcaagaaactgcaagatcagaagcatgacatggagagagaaatcaaaaccttgcacagacggttgcgagaggaaagcgctgagtggcgtcaattccaggccgacctgcaaactgcagtcgtaattgcgaatgacattaaaagtgaggctcaagaggagattggagatctcaaacggaggctgcatgaagctcaggagaagaacgagaagctgaccaaagaacttgaagagattaaatcccgcaagcaggaggaggaacgcgggcgggtctataactatatgaacgcagtcgaacgcgacttggcagcacttcgccagggcatggggctcagtaggcgctcttcaacatctagtgaacctacgcctaccgtgaaaaccctgatcaaaagttttgattctgcctcacaggttcctaaccctgcagctgccgcaatccctcgcactcccctgagcccttctcctatgaagacccccccagccgcggccgtgtcccctatgcagcgccatagtataagcggaccaatctcaacctcaaagcccctgacagccttaagtgacaagagacctaactatggagagattccggtacaggaacacctgcttaggacaagcagtgcctctcgaccagcgtcccttcctcgcgtgcctgcaatggagtccgcaaagacgttgtcagtaagtagaagaagcagcgaggaagtaaagcgggatatctcagcccaggagggtgcatctccagcaagtctgatggccatggggacgacctcaccacagctgagcctaagcagcagccccactgcatcagtaaccccaacgacacgatcacgcatcagagaggaacgcaaggatccactttcggctctggccagggaatacgggggcagtaaaaggaatgctttgttgaagtggtgccagaagaagactgaaggatatcagcgccgaaacttcatgttagctttccaggcagcggagagcgtgggtatcaagagcaccctcgacattaacgagatggtgagaaccgagcggcctgactggcagaacgtgatgctatacgtaacagccatttataagtactttgaaacgtag

SEQ ID NO: 206743 - DNA, 2781 bp, Artificial Sequence
  Description of Artificial Sequence: Synthetic coding sequence
atgaccaccaaggactaccccagcctgtggggcttcggcaccaccaagactttcaaaatacccatcgaacacctggacttcaagtacatcgagaagtgctctgatgtgaagcacctggagaagatcttatgtgtcttgcgcagcggcgaggagggttattaccccgagctcactgaattctgtgaaaaacacctacaggctctggcacctgaatcgagggcactccgtaaggacaaacccgccgcgactgccgcttcgtttactgcagaggagtgggagaagatcgatggggatattaagagttgggtctccgaaattaaaaaggaggaagacaagatgcactttcacgaaacagagacctttccagctatgaaagataatttacctccggtacggggtagcaacagttgcctgcacgttggcaaagagaaatactctaaaagacccacaaaaaaaaaaaccccaagagactacgccgaatgggacaagtttgatgtcgaaaaagaatgtctaaaaatcgacgaggattacaaagagaagaccgtcatcgataagagtcacttgtctaagatcgaaacccgcatcgatactgcgggcctgacagagaaagagaaagatttcttagctacccgggaaaaggagaagggtaatgaagcattcaatagcggagattacgaggaagcagtcatgtactatacccgcagcatcagcgccttaccaaccgtggttgcctacaataatagagcccaggcagaaattaagctccaaaattggaacagcgcctttcaggactgcgagaaagtgcttgaattggagcctgggaacgtaaaggcgctcttgaggcgcgccaccacatataaacaccagaacaagctgcgggaggccactgaggatttgtcaaaggtattagacgtggaacctgataatgaccttgcgaagaaaaccctcagcgaggtcgagcgcgaccttaaaaacagcgaagcagcctccgagacgcagaccaaaggaaagagaatggtcatccaggagatagagaactctgaggacgaggagggcaagagcggaagaaagcacgaggatggtggcggagataaaaagccagcagaaccagccggcgcggcccgcgccgcccaaccctgtgtgatgggcaatatccagaaaaaacttactggaaaggccgagggaggcaaaaggcctgcgcgcggtgctccccagcggggccagaccccagaggccggggcagacaaacggtctcctcggcgggcctccgcggccgcggccgccggtggaggcgccaccggacaccccgggggggggcagggcgcagagaatccagcggggctgaaatcacaaggtaacgaactgtttcgctcagggcagtttgccgaggcagcgggcaagtattcggcggccatcgctcttctcgaacccgcgggcagtgagattgcggacgacttaagcatactgtactcgaaccgtgcagcctgttatctcaaggagggtaactgttcaggatgtatacaagactgtaacagggcattagaactccatcccttttctatgaaacctctcctgcggagggcgatggcctatgagactctagagcagtatggcaaagcgtatgtggattataagacagtgctccaaattgattgtggactgcagttggcgaacgattccgtgaacaggttaagtcgcatacttatggaattggatggaccaaattggagagagaaactgagccccatccctgccgtgcctgcctcagtccctctgcaggcctggcaccccgccaaggagatgatctctaagcaggcgggtgatagtagcagccacagacagcaagggataaccgacgagaagacatttaaagccctcaaggaagaaggtaaccagtgcgttaacgataagaattataaggacgcactatcaaagtatagtgagtgtctgaaaataaataacaaagaatgtgctatctatacaaatagggcactgtgttatctgaagctgtgccagtttgaagaagccaaacaggattgcgaccaagcactgcagttggcagacggaaacgtcaaggcattctacagacgggcattggcgcataagggtctgaagaattaccagaaaagtctcatagatctgaataaggtgatcctgctggacccctcgattatcgaggccaaaatggaactggaggaggttaccaggctgctgaatctgaaggataagaccgccccttttaacaaagaaaaagagaggagaaaaatcgagattcaggaggtgaatgaaggcaaagaagagccgggcaggcccgccggcgaggtgtcgatgggctgtttggccagcgagaaaggcggtaagtctagccgctcgcctgaggatcctgaaaaacttcctatagccaaacccaataatgcttacgagtttggccagattattaacgcgttaagcacccgcaaagacaaagaagcatgtgctcacctcctagccattactgctcccaaggatctcccaatgttcttgtctaataaattggagggggatacatttttgctactcatccaatcattaaagaacaatctgattgagaaagatccgtcactcgtttatcagcacctgctgtacttgtccaaggcagaaagatttaagatgatgctcacgctgatcagcaaggggcagaaggaacttatcgagcagctgtttgaggacttatctgacacccctaacaaccacttcaccctggaagatatccaggccctgaaacggcagtacgaactgtag

SEQ ID NO: 206744 - DNA, 2781 bp, Artificial Sequence
  Description of Artificial Sequence: Synthetic coding sequence
atgaccaccaaggactaccccagcctgtggggcttcggcaccaccaagaccttcaagattcccattgaacatcttgatttcaagtacatcgagaagtgtagcgatgtaaagcacctggagaaaattctatgtgttctgcggagcggagaggagggatactaccctgaacttaccgaattttgcgagaagcatctgcaggcactggctcctgagtctagagccctccgtaaggacaaacccgccgccacagccgccagcttcacagcagaagagtgggagaagatcgatggagacattaagtcttgggtgtctgaaataaaaaaggaagaggataagatgcattttcatgagaccgagactttcccggctatgaaggacaatttgccccccgttcgtgggtcaaatagctgtctgcatgtgggcaaggagaagtatagcaagcgtccaacaaaaaaaaagaccccaagggactacgccgagtgggacaaatttgatgttgaaaaagaatgtctcaagattgacgaagactacaaggaaaagacagtgatcgataagtctcacctgagcaaaatcgaaactagaattgacaccgcgggactgaccgagaaggaaaaagacttcctcgccacacgagagaaggagaagggcaatgaggcttttaactccggcgactacgaggaggcagtgatgtattatacgcggtctatctccgcccttcccaccgtggtcgcatacaacaaccgagcacaggccgaaatcaagctgcagaattggaactctgcctttcaggactgtgagaaagtactggaattggaacctggaaatgtgaaagctctgcttcgtcgggctacaacatacaaacaccagaataagctgcgtgaagccaccgaggatctgtcaaaggtcctggatgtcgagcccgacaacgatctggccaagaaaaccctctccgaggttgagagggatctgaaaaactcagaggccgcgtctgagacacaaactaaggggaagaggatggtgatccaggagatcgaaaactctgaggatgaagagggtaagtctggacggaaacatgaagatggaggaggtgataaaaagcccgctgaacccgcaggtgcagcccgggcagcgcagccctgtgtgatgggtaatattcagaagaaacttacgggcaaggctgagggaggcaaaaggcctgcaagaggagcacctcaacgcggccagacaccagaggccggcgcagacaagcgatcccctcgaagggctagcgccgcagcggctgcagggggaggggcgaccggtcaccctggcggaggccaaggcgccgaaaatcccgcaggactcaaatcacaggggaatgagctgtttaggagtggccagtttgccgaagcagctggaaagtactccgctgcaatagctcttttggagcccgcggggtcagagatagctgacgacctcagtattctgtattctaacagagctgcttgctacttgaaggaggggaactgtagcggatgcatccaagactgcaaccgagctcttgagctgcatccatttagcatgaagccactgctcagacgggccatggcttacgaaactttggaacaatacgggaaagcatacgttgactataagacggttttacaaattgattgtgggttgcagctagcaaatgactccgtcaatcgcctgagccggattctgatggagttggatgggcctaattggcgagagaagttatcccccatacctgctgtgccagcatctgttcccctgcaggcttggcaccccgctaaggaaatgataagtaaacaggccggcgacagctcctcgcaccgccaacaggggattacagatgagaaaaccttcaaagccttaaaggaggaagggaatcagtgtgtaaatgataagaactacaaagacgccctgtctaaatacagtgagtgtctgaaaatcaacaacaaggaatgcgcgatctacactaacagagcactatgttacttaaagctgtgccaattcgaagaagcaaaacaggattgcgaccaagccctgcagttggctgacgggaacgtgaaggccttttatcggagggctcttgcgcacaagggactcaagaactatcaaaaatcacttattgacctcaataaagtgatactgctcgatcccagcatcatagaggccaagatggaactggaggaagttacaagactccttaacctaaaagataaaacggccccttttaacaaagagaaagagcgccggaagattgagatccaggaggtcaatgagggcaaggaagaacccggtcggccagccggggaggtgtccatgggatgtctggcttccgagaagggcgggaagtcatctaggagccccgaggatcccgaaaagctgccaatcgccaagcctaacaatgcttatgaatttgggcagattatcaacgctctgagcacacgaaaggataaggaggcatgtgctcacctactggccattacagcccccaaggacctcccaatgtttttaagtaacaagctggaaggggacacattcttgcttttgatccagagcctgaaaaataatttaatcgagaaggatccctctcttgtgtaccagcatctactctacttgtctaaagctgagagattcaagatgatgctgacattgatatccaaaggccagaaagagttaattgaacagttgttcgaggacctctcagacacgcccaataatcattttactctggaagatattcaggccctgaagaggcagtacgaactgtag

SEQ ID NO: 206745 - DNA, 1044 bp, Artificial Sequence
  Description of Artificial Sequence: Synthetic coding sequence
atggccgcccagcggggcatgcccagcagcgccgtgcgggtgctggaagaagcccttggtatgggcctcaccgcggcaggagatgcccgggacacagcggacgcagtcgctgcggagggtgcctattatctcgagcaagtaacaatcactgaagccagcgaggatgactacgagtacgaggaaattccggacgacaatttctcaatcccagagggagaagaagacttggctaaagccattcagatggctcaagagcaggccaccgacacggaaattctggagcgtaagaccgttttgccaagcaaacacgccgtgccggaagttatcgaagatttcctctgcaactttctgatcaaaatggggatgacccggacactagactgcttccaatccgaatggtatgaactgattcaaaagggagtgacggagcttcgtacagtgggcaatgtgcccgacgtttacacacaaattatgctgctagagaacgagaataaaaacctcaagaaagacctcaagcactacaagcaggcggctgacaaggcgagagaggacctgctgaaaatccagaaagagagggacttccacagaatgcaccacaaacgcattgtgcaggaaaagaacaagcttataaatgatctgaaaggcttgaaacttcactacgcaagctacgagcccaccatccgcgtcttacacgagaagcaccacacactccttaaggagaaaatgctcacaagcctggagagagacaaggtggtgggccagataagcggactgcaggagaccttgaaaaagcttcaacgcggccattcctaccatgggccccagatcaaggtcgatcacagcagggagaaggaaaacgcgcccgagggccctacgcaaaaagggctgcgcgaggccagagagcaaaataagtgtaaaacaaaaatgaaggggaatactaagcaatggactggcaactctcagacctggaacaaaactgtgccgctgcaagataccatcggtagaaggcaggagaacaacagcgcacaccagcacatcgattag

SEQ ID NO: 206746 - DNA, 1896 bp, Artificial Sequence
  Description of Artificial Sequence: Synthetic coding sequence
atggccgcccagcggggcatgcccagcagcgccgtgcgggtgctggaagaggccctggggatggggctgaccgccgcaggagatgctcgcgataccgctgacgcagttgcagccgaaggcgcctactatttggagcaagttacaattacggaagctagtgaggatgactatgagtatgaggagatccctgatgacaacttttctatccctgagggggaagaggatctcgctaaagcaatccagatggcacaggaacaggccaccgatacagagatcctcgagaggaagactgttctcccttccaaacacgccgtgccagaggtgatcgaagactttctgtgcaattttttgataaaaatgggcatgactcgtactttggactgttttcagagcgaatggtacgagctgatccagaagggggtcacagagcttcgaacggtgggaaacgtgcccgacgtttacacacagatcatgttgctggaaaatgaaaataaaaatctgaagaaagatcttaagcattataagcaggccgctgacaaggcacgggaagacttgttgaagattcagaaggagcgggatttccatagaatgcaccacaaaaggatagtacaggagaagaacaaactgattaacgacttgaaaggattgaagctgcattacgcaagttacgagcctacgattcgggtgctgcacgagaaacaccacactttgctgaaagaaaaaatgctgactagtctggaacgcgacaaggtggtgggtcagatcagcggattgcaggaaacacttaagaaactgcagcgcggccactcttaccatggcccacaaatcaaggtcgaccactccagggaaaaggagaatgcaccggagggtccgactcagaagggtctgcgggaagctcgcgaacaaaacaagtgcaaaaccaagatgaaaggtaatactaaagattctgagtttcccatcgatatgcagcctaatcctaacctcaatgtgagtaaagagtccctgagtccggcaaagttcgattacaagctgaaaaatattttcagactgcacgagttgccagtcagttgtgtcagcatgcagccacacaaggatattctagtatcctgcggagaggacagactgtggaaggtgctcgggcttcccaaatgcaacgtcctgttaaccggtttcggccacactgattggcttagcgactgctgtttccacccatccggagataaacttgctacgtccagtggagataccaccgtgaagctttgggatctttgcaaaggagattgcattctgacgttcgaaggacacagccgggcagtatggtcctgcacttggcactcatgcgggaactttgtagccagcagctctttggacaagacgagcaaaatatgggatgtgaacagtgaaaggtgtagatgtacgctgtacggtcacacagactcagtaaattctatagaattcttcccatttagcaacactctgctgaccagcagcgcagacaagacccttagcatttgggacgcccgcacaggcatctgcgagcagtccctgtacggccacatgcacagtataaacgatgctattttcgatcctagggggcacatgattgcctcctgcgatgcttgcggggtgactaaattgtgggatttcagaaaattactccccatcgtcagtattgacatcggtccctcccctggtaatgaggtgaactttgattcgtccggccgggtgctcgctcaggcatcaggcaatggggtgatacatttactcgatctcaagtctggcgaaatccataaacttatggggcatgagaatgaggcccacactgtggtcttctctcatgatggagagattcttttctctggggggtctgatggcaccgttcgcacctggtcctag

SEQ ID NO: 206747 - DNA, 1614 bp, Artificial Sequence
  Description of Artificial Sequence: Synthetic coding sequence
atgaccatgaacatgaagcggtaccagatgaccatcctggccagccagaaggtgaagaaaatctggcagaaacagtttagatggccaaagaataggctccagatcctgaagttctggtatgaactgatacaaaaaggggtgacagaactgcgcactgttggcaatgtacctgatgtttacactcagattatgctgttggaaaacgagaacaaaaatctgaaaaaagacctcaagcattataaacaggcagctgataaagcacgagaggacctgctgaaaatccagaaggaacgagacttccacaggatgcaccataaacgcatcgtgcaggagaagaataagttaatcaacgacctgaaaggcctcaaactgcactatgccagctacgagcccaccattcgggtgctccatgagaaacaccatacgctgctgaaggaaaaaatgttgacttctttagagagagataaggtcgtaggccagatcagtggcctccaagagacactgaaaaagctgcagcgcgggcattcatatcacggtccgcagataaaagttgaccactcgagggaaaaagaaaatgcgcctgagggcccaacccaaaagggactcagagaggctcgagaacagaacaagtgcaaaaccaagatgaaagggaacactaaggatagcgagtttccaatagacatgcagcctaaccctaatctgaacgtttcaaaagagtctctgtccccggcaaaatttgattacaagctgaagaacatctttcgcctgcacgaactgcccgtcagttgtgttagtatgcaacctcacaaggatattctggtatcgtgtggagaagaccgcttgtggaaggtgttgggcctacctaagtgtaatgttcttctcaccggcttcgggcataccgattggttgagcgactgttgcttccatccgtcgggcgataagttggcaacctcgtcaggcgatactactgttaagctgtgggatttatgcaagggcgactgcattctgacgtttgagggccacagtagagccgtttggtcctgcacctggcacagttgtggcaactttgtggccagttccagcttggacaaaacaagcaaaatttgggatgtgaacagtgaacggtgtagatgcaccctgtacggccatacagacagtgtgaattcaatagagttcttccccttttctaacacactcctcacaagttctgccgataaaacgttgagcatctgggacgccagaaccggtatttgtgaacagtcactgtacggtcacatgcattcaattaatgatgccattttcgaccctagagggcatatgatagcctcttgtgatgcctgtggcgtcactaagctgtgggattttaggaaactgttgccaattgtgtccattgatattgggccgagtccgggcaacgaggttaattttgattccagcggccgagttcttgcccaggcctccggcaacggggtaattcaccttctggacttgaaatcaggcgagatccacaagctcatggggcacgagaacgaggcccatacggtggtgttcagtcacgatggggagatactattttcaggcggaagtgacggcacggtgcgcacctggagctag

SEQ ID NO: 206748 - DNA, 756 bp, Artificial Sequence
  Description of Artificial Sequence: Synthetic coding sequence
atgggcgtgggcaccaaggcccgggccagccactggcggcggctgctttctctcggagctacccccgaggagccactgttggacttcaagatacctgacgacaacttttctattccagagggcgaggaagacctggctaaggcgatacagatggctcaggaacaggccactgacaccgagatcctggagcgaaaaactgttctgccatctaaacacgccgtgcctgaggtaattgaggattttctctgtaacttcttgataaagatgggcatgacgcggacacttgattgctttcaaagcgaatggtatgaactcattcagaagggcgtcactgaactccggacagttggaaacgtgcccgatgtatacacccaaatcatgttgctggagaacgagaacaaaaatctgaaaaaagatctgaaacactacaaacaggctgccgataaagcacgcgaggatctccttaagatccagaaggaacgcgacttccaccgtatgcatcacaaacggattgtccaagagaaaaataagctaatcaatgacttgaagggcttgaaactccactacgcaagctacgaacccacaatccgcgtcctgcacgagaaacatcatacattattaaaagagaaaatgttgacatccttagagagggacaaggtggttggacagatctctggtctgcaagagacgctcaagaaactgcagcgtggccatagctatcacggccctcaaattaaaggaaaatgtaagatgtag

SEQ ID NO: 206749 - DNA, 552 bp, Artificial Sequence
  Description of Artificial Sequence: Synthetic coding sequence
atggccgcccagcggggcatgcccagcagcgccgtgcgggtgctggaggaagcactcggcatgggtttgaccgcagcaggagatgctcgggacactgctgacgctgtggctgcagagggcgcctactatctagagcaagttacgatcactgaggcaagcgaggatgactacgagtacgaagaaatcccagacgacaacttttcaattccagaaggggaagaagaccttgcaaaggccatacagatggctcaggagcaggctacagacaccgagatcctggaacgaaagactgtccttccatccaagcatgcggttcccgaagtcatcgaagatttcctgtgtaacttcctgattaagatgggaatgacacgcactctggattgcttccaatccgaatggtacgaactgatccagaagggggtcactgaactcaggactgtggggaatgttccagatgtatatactcagatcatgcttcttgagaatgagaataagaatctaaagaaagacctgaagcactacaagcaggcagcagagtatgtgatcttttag

SEQ ID NO: 206750 - DNA, 768 bp, Artificial Sequence
  Description of Artificial Sequence: Synthetic coding sequence
gacagcgagttccccatcgacatgcagcccaaccccaacctgaacgttagcaaagagtccctgtctcccgcgaaatttgactataagctcaaaaatattttccggctgcatgaattgcctgtgagttgtgtatcaatgcagccccacaaggacatcctggtgagctgtggagaggataggttgtggaaggtgctggggttgcccaaatgcaacgtgttactcactggctttggccacaccgattggctctccgactgctgctttcacccctcagaaagatgccgctgcacattatacgggcacaccgattctgtaaattctattgaatttttcccttttagtaacacattgttgacctcttccgcagacaagacactgtcaatctgggatgccaggacgggaatatgtgaacagtccctgtacggacacatgcattccatcaatgacgccatcttcgaccccagaggccacatgattgcttcgtgcgatgcctgcggagtcacgaagctttgggattttcggaaactattacccatcgtatccatcgacataggcccgtcgcctgggaatgaggttaactttgactcctccggccgagtgttggctcaggcgagtggcaacggggtgatccacctgttagatctgaagtctggggagattcacaaactgatgggtcacgaaaacgaggctcacaccgtggtctttagtcatgatggagaaatactcttctctgggggcagcgatggtacagtgcgcacttggtcttag

SEQ ID NO: 206751 - DNA, 1314 bp, Artificial Sequence
  Description of Artificial Sequence: Synthetic coding sequence
atgcggcggagcagccggcccggcagcgccagcagcagccggaagcatactcccaacttcttctctgaaaacagttcaatgtccatcacttcggaagacagcaaaggcttacggagtgccgaaccgggtcctggcgagcccgagggcagaagggctcgagggccttcctgtggagagccagccttatcagccggagtcccaggcggaaccacatgggcaggttctagtcaacagaaaccagcaccgagaagccacaattggcagacagcttgcggcgccgctaccgtaaggggcggggcttcagagccaacaggcagcccagtggtgtccgaagagccactggacttgttgcccacattagacctgaggcaggagatgccacccccccgcgttttcaaaagcttcctctcgcttctgttccaaggactcagcgttcttttgtccctagcgggggacgtcctggttagcatgtatagggaagtgtgctccattcgcttcctgtttacagccgtctcactgctcagcctcttcttatccgccttctggctggggctcctgtatctggtgtcacctctcgagaacgaacccaaggaaatgctgaccctttcagaataccacgagcgggtgcgctctcaagggcaacagcttcagcagcttcaggccgaactcgacaagctgcacaaggaagtgtccacagtgcgggccgcaaactccgagagagtggccaaactagtgttccagcggcttaacgaggactttgtcagaaaacccgactacgcattgagcagcgttggcgcttcgattgacttacagaaaacctcccacgactatgccgaccgaaacaccgcctatttttggaatcggtttagcttttggaactacgcaaggccccccacagtcattctggaaccacacgtgtttcctgggaattgttgggctttcgagggggaccaagggcaggtggttatccagctgcccggacgggtgcagttgtctgatatcactttacagcatcccccaccatctgttgaacatacagggggtgcaaactccgcccctcgggactttgccgtgtttggattacaagtctacgacgagacggaggtatccctgggcaagttcactttcgacgtcgagaagagcgaaattcagaccttccacctccagaatgaccccccagctgctttcccaaaggttaagattcaaatactcagcaattggggccacccacgcttcacttgcctgtaccgcgtaagggctcacggcgtgaggacatctgaaggagctgaaggctcggctcaggggccgcactag

SEQ ID NO: 206752 - DNA, 1377 bp, Artificial Sequence
  Description of Artificial Sequence: Synthetic coding sequence
atgagccagcggcaggtgctgcaggtgttcgagcagtaccagaaggccaggactcagtttgttcagatggtggccgaactcgccactcgcccccagaacatcgaaactctccagaatgcaggggttatgtcgttactcagaacccttttgctcgacgttgttcccacaattcagcagacagcggcattggcccttggccgcctggcaaactataacgatgacttggcagaggccgttgtcaagtgcgatatactgccccagcttgtctatagcctggccgagcagaatcgattctataaaaaggctgccgcgttcgtgctgagagctgtcggtaagcacagcccgcagctggcgcaggctattgttgactgtggagcgcttgatactttggtgatatgcttagaggatttcgatccgggagttaaggaggccgctgcctgggccctacgctacattgctaggcataatgcagagctttcacaagccgttgttgatgcgggggctgtccctttgttagtcttgtgcatccaggaaccagagattgcccttaaacgaattgctgctagcgcactcagcgacattgctaagcactctccagaactcgcacagacagtggttgatgccggggcagtagctcatctggcgcagatgattctgaacccagacgcaaagctcaaacaccaaattttgtccgcattgtcacaggtgagcaagcacagcgttgacttggccgaaatggtggtcgaggccgaaatcttcccggtggtactgacatgcctgaaggacaaggacgagtacgtgaagaagaacgccagcaccctcattcgcgagattgctaaacacaccccagagctgtcccagctggtggtaaacgcggggggcgtggctgccgtcatcgattgcattggctcttgcaaaggcaatacacggctccctgggattatgatgctgggttacgtagccgcccactccgagaatctggccatggctgtgattatctctaagggcgtgcctcagctcagcgtctgtctctctgaagaacccgaggaccacattaaagcggcagctgcttgggctttaggtcaaatcggccgacataccccagaacatgccagagctgtggcggtgacaaatacgttgcctgtgctgctatccttgtacatgagtaccgagagctccgaggatctccaggtgaaatccaagaaggctattaaaaacattcttcagaaatgtacttacctcccggctctggagccattcctgtacgatgccccaccaaacatcctgaaacacgtagtcggtcagttttccaaagtactctttccttggatctttcgctacacatctgcagagggagggcagctgagtacgacttag

SEQ ID NO: 206753 - DNA, 813 bp, Artificial Sequence
  Description of Artificial Sequence: Synthetic coding sequence
atgagccagcggcaggtgctgcaggtgttcgagcagtaccagaaggccaggactcagttcgtgcaaatggttgctgaactcgccacgcgccctcaaaacatcgagacgctgcagaatgccggcgttatgagcctgctgcgtacattacttctggacgtggtacctactattcaacaaactgcagccctcgctctgggcagactggctaactataacgatgacctggctgaagctgtcgtcaaatgcgatatcctgcctcagctggtgtacagtctcgccgagcagaatggcgtgcctcagctgtctgtctgtctgtcagaggaacccgaggatcacataaaggccgctgccgcctgggctctggggcagatcggaaggcataccccagaacatgctcgcgccgtggcagtcacgaacacccttcccgttctgttatcactctatatgtccaccgagtcaagtgaggacctgcaagtgaagtcaaagaaggctatcaagaatattctacagaagtgtacatacctgcctgctttggagcccttcctttacgacgcgcctcctaacatactcaaacatgttgtcggacagttttctaaggtcctccctcatgactcaaaagcccggcggctgtttgtgacctcgggtggtctcaaaaaggtgcaggagatcaaggccgagcccggttctttactgcaggaatacattaactccatcaattcctgctatccagaagaaatcgtacggtattacagccctggatacagcgacacactgttacagcgggtagacagctatcagccacttaataattag

SEQ ID NO: 206754 - DNA, 1758 bp, Artificial Sequence
  Description of Artificial Sequence: Synthetic coding sequence
atgagccagcggcaggtgctgcaggtgttcgagcagtaccagaaggcaaggacccagttcgtgcagatggtggcagagctcgcgacaaggcctcagaatatcgagacccttcaaaacgcaggtgagccaggtgcccggacaccggtggccccccgagctctctccccacgccggcttagacccgcagccttacccgtggagctattagggtctcgtagcgtcggcactggggtcagaaagtctattcacagttttcagcgcgtctttggcgggcaggcggaaagggttaaattgccggacggttgcggacgatgcgcgctgtccctctttccgagtagtctccatacaggggtgatgagtctgcttaggacactcttactggatgtggtccctaccatccagcagacagcagctctcgccttggggcgactggccaattataacgacgacctggcagaagctgtggtgaaatgtgacatcctgccccaactcgtatattctcttgctgaacagaatcgattctacaagaaggccgcagccttcgtgctaagggcagtgggcaaacacagccctcagcttgcccaggctatcgttgattgtggggccctcgatacactggtgatctgcctggaggactttgaccccggcgtcaaagaagctgcagcatgggcccttcgatacatagcccggcataacgcagagttaagtcaagccgttgtggatgcgggagcagtgccgctgctggttttgtgcattcaggaacccgaaattgcactgaaacggatcgcagctagcgctctaagtgacattgcgaagcattcacctgagttagcccaaacagtggtagacgccggcgctgtggcccacttagctcagatgatccttaatccagacgcgaaattgaagcaccagattctgtcagcacttagccaggtgtccaagcactcagtggaccttgcggagatggttgtggaggccgaaatttttccagtagtcctgacatgtctgaaggacaaggacgaatacgtgaagaaaaacgccagcacactgattagggagatagccaaacatacccccgaactgtcgcaattggtggtgaacgccgggggtgttgctgccgtaattgactgcatagggtcctgtaaaggtaatactcgacttcctggaataatgatgcttgggtacgtggccgcacactccgaaaacctcgccatggcagtgatcatctccaaaggtgtgccacagctctctgtatgtttgagtgaggaaccagaggatcatatcaaggcagccgcggcctgggctctggggcagatcggacgtcacacccctgaacatgctcgtgcggtagctgtcacaaacacactaccagtgctgctgtccctgtacatgagcacagaatcatcagaagatctgcaggttaagtcgaaaaaagcaatcaaaaacatcttgcagaagtgcacctatcttccagcattagagcccttcctgtatgacgcaccaccaaacatcttgaagcacgtggttgggcagttctcaaaagtgttgccccatgattctaaggcgcgcaggctcttcgtgacttctggaggtctgaagaaggtccaagaaatcaaggcagaaccgggatcactactgcaggaatatattaacagtattaattcttgctacccagaagaaattgtgcgttactatagtcccggctattccgatacactgctgcagcgagtggactcttatcagcctctgaataattag

SEQ ID NO: 206755 - DNA, 1530 bp, Artificial Sequence
  Description of Artificial Sequence: Synthetic coding sequence
atgagccagcggcaggtgctgcaggtgttcgagcagtaccagaaggcccggacgcaatttgttcagatggttgccgagttagctaccagacctcaaaacatcgaaacattacagaatgcaggagtcatgagcctgttacgaacactgcttctggacgtcgtcccgacgatacagcagactgctgcgctcgccctgggccggcttgcgaattacaatgatgatctagcggaagctgtcgttaaatgcgatattctgccacagcttgtctactctctcgctgaacagaatcgcttttacaaaaaggcagccgcatttgtgcttcgcgctgtggggaagcactctccccagcttgcccaggccatcgtcgattgcggagccctggatacactcgtcatatgcttggaggacttcgaccccggggtaaaggaggccgccgcctgggcgctacgttacatagcaaggcataatgccgagctcagtcaggctgtggttgacgcaggcgctgtgcccctgctcgttctgtgtatacaggagcctgaaatcgccctgaagcgtatcgctgctagcgccctatcagacattgctaaacactcacccgaactcgcccaaaccgtggtagacgctggcgcggtggcccatctggcgcagatgatacttaatccagatgccaagctgaagcaccagattctttcggccttgtcccaggtctccaagcattcagttgacctggctgaaatggtcgtagaggcggaaatcttccccgtcgtgcttacctgtttaaaggacaaagacgaatatgttaagaagaatgcaagtacacttatacgagagatcgctaaacacacccccgagctcagccagctcgtggtgaacgccgggggagtagctgccgtgattgattgtattgggtcctgcaaaggaaacaccagactccctggtattatgatgctcgggtacgtcgcagcgcactcagaaaatctcgctatggccgtcatcatttcaaaaggcgtccctcagctcagcgtgtgtctctcagaagaacctgaggaccatatcaaagcggctgccgcctgggccctgggccagatcggccgtcatactcctgagcacgcaagagccgtagctgtgaccaataccctgccagtgctcctatcgctgtatatgtctacagaaagttccgaagatctgcaggtgaagagcaagaaggcaattaagaacattctgcagaaatgcacctatttacctgccctagagccattcctgtacgacgctccgcccaatatccttaagcatgtggtcggccagttctccaaggtgctgccgcatgactctaaagccaggcgactgtttgtaacctcaggggggcttaagaaggtccaagaaattaaggcagaaccaggctcactgttgcaagagtacatcaacagcattaactcttgttaccccgaggaaatcgtcagatactatagccctggctactcggacaccctgctacaaagagtcgatagttaccaaccattgaacaactag

SEQ ID NO: 206756 - DNA, 741 bp, Artificial Sequence
  Description of Artificial Sequence: Synthetic coding sequence
atgagccagcggcaggtgctgcaggtgttcgagcagtaccagaaggcaaggactcaatttgtacagatggtggctgagctagccactcggcctcagaatattgagacattacaaaacgctggcgaacctggcgcccgcacacccgtcgcccccagggctctttctcctcgccggctgcgccctgcggccctgcccgtggaacttctgggtagccggtctgttggtacaggggtgagaaagtccatccacagctttcaacgcgtgttcgggggacaggctgagcgcgtcaaattacctgatgggtgtggacgctgtgcgctgagcctgtttccaagttcactccataccggcgtcatgtccctcctacggacccttctgctcgatgtggtgcccacaattcaacagaccgccgcgctggctctggggaggttggctaactacaacgatgatctggctgaggctgtggttaagtgcgatattttacctcaactcgtgtactccctggcggagcagaacaggttctataagaaggcagctgctttcgtgcttagagccgttgggaagcacagcccccagctagctcaggctatagtggactgtggcgctctcgatactttagtgatttgtctcgaagacttcgaccccggcgtgaaagaagctgccgcttgggcactccgatacattgcacgccataacgcagagctctctcaagcggtcgtagacgcaggcgccgttccatag

SEQ ID NO: 206757 - DNA, 576 bp, Artificial Sequence
  Description of Artificial Sequence: Synthetic coding sequence
atgagccagcggcaggtgctgcaggtgttcgagcagtaccagaaggctcggacgcagttcgtccaaatggtagccgagctggccacccggcctcaaaacatcgagactctccaaaacgccggtgtcatgagccttctgaggactctgttgcttgacgttgtacccacaatccagcagacggcagccctggctctggggaggctggcaaattataacgatgatcttgctgaagcagtcgttaaatgcgacatcttgcctcagctcgtttactctttagccgagcagaatggcgtcccacagttaagcgtatgcctgtcagaagagccagaagaccatatcaaagccgccgccgcgtgggccctgggccaaattggccgacataccccggaacacgcccgcgctgttgctgttacaaacaccttacccgtgctgcttagcctatacatgagtacggagagctcagaggacttgcaggtcaagtctaagaaggcgatcaaaaacatcttgcagaagtgcacgtacctgccagcactggagcccttcctatacgacgccccacctaatatcctgaagtag

SEQ ID NO: 206758 - DNA, 1455 bp, Artificial Sequence
  Description of Artificial Sequence: Synthetic coding sequence
atgcacagcctgaccatggacctgtggatccccaacggccaggccggcgttatgagcttactgaggacgctcttgcttgacgtcgtaccaaccattcagcagaccgctgccctggctttgggccgcctggccaattataacgacgatttggcagaggccgttgttaaatgcgacatcctaccccaactcgtgtattcactcgctgaacaaaacaggttctacaaaaaagcggcagctttcgtgctccgcgcagtcggcaaacacagtcctcagctcgcgcaggccattgtcgattgcggtgcgctcgataccctcgtgatatgcctggaggattttgatccgggcgttaaggaggcagcagcatgggcccttcgctatatagcgagacataatgcagagctgagccaggcagtggttgatgcgggggctgtgcctttgttagtgttgtgcattcaggaacctgagatcgccctgaagcggatcgctgcgtccgccttaagcgacattgctaaacatagcccagagcttgcccagacagtcgtggacgccggggccgtcgctcacctggctcagatgatcctgaaccctgatgctaagctgaagcaccaaatactttctgccctgtctcaggtgagtaagcactccgtggacctggccgagatggttgtcgaggcagaaatcttcccagtggtgctaacatgccttaaggacaaagacgagtatgtgaaaaaaaacgcctccaccttaattagagagatagcgaagcacacccccgagctctcccaactggtggttaatgctggaggcgtcgctgctgttattgactgtatcgggagctgcaaaggaaacacgaggttgcccggaatcatgatgttgggatatgttgcagcacacagcgagaatctggccatggcagtgatcatctcaaagggtgtcccccaactatctgtctgtctcagcgaagaaccagaagaccatataaaggcagctgccgcgtgggctttggggcagatcggacgacacactcccgagcatgccagggctgtcgcggtgactaacacactgccagtcttgctaagtttgtatatgagtactgaaagctcagaggacctccaagtaaaatcaaagaaggctataaaaaacattctccagaagtgtacctacctgcctgccctcgaacctttcctgtatgatgcccccccaaacatcctgaaacacgtggtggggcaattctcaaaagttttgcctcatgattcaaaggccagacggctgttcgtcacgagcggcggtctgaaaaaggtccaggaaataaaggccgaacccggctccttattgcaggagtacattaattcaataaactcatgttacccagaagagattgtaagatactattccccaggctattcggataccctgctgcagagggtggacagctaccagcccctgaataattag

SEQ ID NO: 206759 - DNA, 1506 bp, Artificial Sequence
  Description of Artificial Sequence: Synthetic coding sequence
atggagaccaacgagagcaccgagggcagccggagccggagccggtcattagacatccagcccagtagtgaaggtttggggcccacctccgagcctttcccatctagtgacgatagccctcgatccgccctagcagcagcaacagccgccgcggcagctgcggcttcagccgcagccgctacagccgctttcaccactgccaaagccgccgccctgtccacaaagacacccgctccttgtagcgagtttatggagcctagtagcgatccctccttacttggcgagccgtgtgctggtccaggcttcacacacaatatcgcccacgggtccctgggttttgagccggtttatgttagttgtattgctcaggacacatgcacaactaccgatcactcgagtaaccccggcccagtgcccggatcatctagtggcccggtcctgggttcttccagtggcgcgggacacggcagcggtagtggcagcggaccaggctgcggtagtgtgccagggtcggggtccggtcctgggccaggatcaggacccggaagtgggcctggacacgggtccgggtcacaccccggaccagctagcggtcccgggcctgacactggaccagacagtgagctatccccctgtatcccacctgggttccgtaacctcgtagccgacagggtacctaactatacatcctggagtcagcactgcccatgggaaccccagaaacagcccccctgggagttcttgcaggttcttgagcccggagctcgaggtctttggaagcctcctgatatcaaagggaaattgatggtgtgctacgaaaccctccccaggggccagtgccttctctataattgggaagaggaacgggcaaccaatcatctggatcaggtgccgagcatgcaggacgggtccgagagcttttttttccgccatgggcacagaggactgctaacaatgcagctgaagagtcccatgccttccagtacgacccagaaggattcatatcaacctccaggaaatgtctattggccgctcagaggtaaaagagaggccatgctcgaaatgctactgcagcaccagatctgtaaggaagtgcaggccgagcaggaacccacacgcaaactgtttgaagtggagtctgtaactcaccacgactatcgcatggagttagctcaggcaggaaccccagccccaactaagcctcatgactaccgacaggagcagccagaaactttctggattcagcgcgctccccagttgccaacctggtggcccttaccaactcaagtcccagcagctgaggactacctgacctggaaagagtggggttttaccggcgtccaggaggtcctgtctgcactcctgagagccacacccggcgaatactctgtgaatatctgcggtatgaacgaacatcctgtatgtagtaggacctggaccaatagattatgtcatcaagagatggggagcaaaaaaaccgttacccaggaagatagggggtggtag

SEQ ID NO: 206760 - DNA, 1458 bp, Artificial Sequence
  Description of Artificial Sequence: Synthetic coding sequence
atggagaccaacgagagcaccgagggcagccggagccggagccggtccctggatatccagccttcttcagaagggctgggccctactagtgaacctttcccatcatctgacgatagtcctcgcagcgctctggctgccgccaccgcggcagccgctgccgctgcctctgctgcggcagcgacagctgctttcactaccgccaaagcagccgctctgtccacaaaaactcccgccccctgctcagaattcatggaaccttcatccgatccttctctgcttggtgagccctgcgctggccccggcttcacgcacaatatcgctcacggctctctcggattcgaacctgtttatgtaagctgcatcgcacaggatacatgcacaactacagaccatagcagcaatcctggacccgtgcccgggtcctctagcggtcccgtgctggggtccagttcaggagcggggcatggcagtggatctgggtccggacctggatgcggtagtgtgccgggctcaggtagcggtcccgggcccggctcgggaccaggatccggccccggacacgggtccggcagccatccaggccctgccagtggtccagggcccgataccggccccgattcggagttgtccccttgcattccccccggctttaggaacctggtcgccgacagggtccccaattacacttcttggtcccagcattgcccttgggaaccgcagaagcagcccccatgggagtttctgcaggttctggagcccggagcccgaggcttgtggaagcctcctgacattaaggggaagctgatggtctgttatgagactctcccccggggccaatgcttgctgtataactgggaagaagagcgcgctacgaatcaccttgaccaggttcccagtatgcaggacggatcagagagcttttttttccgacatgggcacagagggctgcttacaatgcagctgaaatcacccatgccctcttctacaacgcagaaagattcctaccagcctccgggcaacgtgtactggcctttgagaggcaagagagaagctatgctggagatgctgttacagcaccagatctgcaaagaggtgcaagccgagcaagagcctaccagaaagctgtttgaggtcgaatccgtgactcatcacgactacagaatggagctggcgcaggctggaactccagcccccactaagccacacgattaccgacaagagcaaccggagacattctggatccaaagggcaccacagctgccaggcgtgagtaacatcaggacactggacacaccgtttcgcaaaaattgttcctttagcactcccgttcctctatctctgggaaaactgctcccttacgagcctgagaactacccctatcagctgggggagatctcctcattaccttgccccggaggccggctgggaggtggtgggggacgcatgacacccttttag

SEQ ID NO: 206761 - DNA, 1281 bp, Artificial Sequence
  Description of Artificial Sequence: Synthetic coding sequence
atggagaccaacgagagcaccgagggcagccggagccggagccggagccttgacatccagccgtcctcagagggccttggccccaccagcgaaccgttcccttcatcagatgacagtccaaggtccgccctagccgcagctactgcagccgcggccgcagccgccagtgcagcggccgcgacagccgcatttaccacagctaaggccgccgccctctcgacgaaaacgcccgccccatgctcagagttcatggagccatcctcggatccatccctgttgggcgagccttgcgcggggcctgggttcacacataatatagctcacggcagtcttgggtttgaaccagtgtacgtgagctgtatcgcccaggatacatgcacaacaacagatcattcatccaacccggggcccgtacctggatcctcctctggcccggtcctgggcagcagctccggcgccggccacggatccgggagtgggagcggacctggatgcgggagcgtgccagggagcggctccgggccagggccggggtcaggccctggcagtggaccaggacacggttccggatcccacccaggacctgcttcaggaccaggacccgacacagggcctgatagcgaactgtctccttgtatccctcctggctttaggaacctggttgccgaccgtgttccaaactatacctcttggagtcagcattgcccatgggagccacaaaagcagccaccatgggaatttctccaagttttggagccaggggccaggggtctgtggaaacctccagacatcaagggcaagctgatggtgtgctatgaaacgcttcctaggggccagtgcctgctgtacaactgggaggaagagagagctactaatcacctggaccaggtgccatccatgcaggacgggagtgaatctttcttcttccgccatgggcacagagggctcttgacgatgcagttgaagtcacccatgcctagttccactacgcagaaggacagttaccaaccgcctggcaatgtgtactggcctttgcggggaaaacgagaggctatgttggagatgcttctgcagcaccaaatctgcaaagaagtacaggccgaacaggagccaacgcggaagcttttcgaagttgaatctgtgactcaccacgattaccggatggagctagcccaggcagggaccccagcccctactaaaccacacgactacagacaagagcaaccggagactttttggatccagagggccccacagctgcctgtatgtgagggggactag

SEQ ID NO: 206762 - DNA, 3966 bp, Artificial Sequence
  Description of Artificial Sequence: Synthetic coding sequence
atggagctggaggacggcgtggtgtaccaggaggagcccggcggctcaggggctgtgatgagcgaaagggtttctggcctagccggatctatctatagagaatttgagagactgatcgggcggtatgacgaggaggtcgtcaaagagctgatgcctttagtggtcgctgtcctcgaaaaccttgattcagttttcgcacaggatcaggaacatcaggtggagttggagctgttgcgcgacgacaatgaacagttgataacccagtacgaacgtgaaaaagcacttcgcaaacatgctgaggagaaatttatcgagtttgaggactctcaagagcaggagaagaaagacttacagaccagagtggagtcactcgaatcccagacgcgacaactcgagcttaaagctaaaaactacgccgaccaaatcagccggctcgaagagagagaagcagagctgaagaaggaatataacgcgctccaccagcggcacacagagatgatccacaattatatggagcacctggaacgcacgaaactgcaccaactctccggcagtgatcagctggagtctaccgctcatagtcggattcggaaggagaggcctatcagtctgggaatttttccccttcccgccggcgatgggcttctgacacctgacgcccagaaaggcggtgagactcccggctctgaacagtggaagtttcaggaactctctcaacctcgaagccatacatcactgaaggtttccaacagccccgaaccacagaaggctgtggagcaagaagacgagctgagcgatgttagccagggcgggtctaaggcgacaacccctgctagtactgccaactccgacgtcgctacaattcctaccgacaccccattgaaagaggaaaatgagggatttgtcaaggtaaccgacgctccaaacaaatccgagatatcaaagcatattgaggtccaggtagctcaggaaactcgaaatgtgtcaacaggcagcgccgaaaacgaggagaaatctgaagtgcaggcaatcatcgaatccacgcccgagctggatatggacaaagatctcagtggatacaaaggatccagcacccccactaagggcatagagaataaagccttcgacagaaatacggagagcttgtttgaggagctgagcagtgcaggaagcggtctcatcggtgacgtggatgaaggcgcagatctgctggggatgggcagggaggtagaaaatttgatcttggagaacacgcaactgttagagaccaagaatgctttgaacattgtaaaaaacgaccttatcgctaaagttgacgaattgacatgtgagaaagacgttctgcagggcgagctggaggcagtgaagcaagctaaactgaagttggaggagaaaaacagggaactggaagaagaactgagaaaagccagggccgaagcggaggatgccagacaaaaggcgaaggatgacgatgacagcgatattcctacggcgcagcgaaaaagattcacccgcgtggagatggctcgggtgctgatggagagaaaccaatacaaagaaagacttatggagctgcaggaagctgtcagatggaccgaaatgatcagagcttctagggagaaccctgccatgcaagaaaagaaacgtagttcaatctggcaattttttagtagactttttagctctagctcgaacaccaccaaaaaaccagaaccccccgtgaatttgaaatataacgcccccacttctcacgtgaccccctctgtcaagaagagatcctccactctgtcacaattgcccggcgataagtcaaaggcattcgatttcctttcggaagagaccgaggcctccctggcttcacgcagagagcagaagcgcgaacagtataggcaggtgaaagcccacgtccagaaagaggatggacgagtgcaggcctttggttggtccctcccccaaaagtacaaacaggtgacaaacgggcagggggagaataagatgaagaacctgcctgtgccagtgtatctccggcctctggatgagaaggatacaagcatgaagctgtggtgcgccgtcggagtgaatttatctggcggaaagacgcgggacggcggtagcgttgtaggcgcctccgtcttttataaggacgtggccggtctagatactgagggatcgaaacagcgcagcgcctctcagagttctttggataaattagaccaggagctgaaggaacagcagaaagaactgaaaaaccaggaggagttgtcatccctggtgtggatctgtacctccacacacagtgctacaaaagttctgattatagatgcagttcaacccggcaacatcctagacagttttaccgtctgtaacagtcatgtcctatgtatcgcctccgttccgggggctcgggaaacagactatcccgctggcgaggatctgtcggagtcaggtcaggtggacaaggccagtttgtgtggctcaatgacctccaactcttccgccgagaccgactcgctgttgggcggaatcacggtcgttggctgcagcgccgagggggtcaccggcgctgccacttcgccttccacaaatggcgctagcccggtgatggacaagccccctgaaatggaggccgagaacagcgaagtcgacgagaatgtcccgactgcagaagaagccactgaggctactgagggtaatgcaggatcagccgaggatacagtggacataagtcagacgggcgtctacacagagcacgtctttactgatcctttgggtgtgcagattccggaagatctgtcccctgtgtatcagagcagtaatgattcagacgcctacaaggaccagatcagtgttctgcccaacgagcaggatctcgttcgtgaagaggcccagaagatgtctagcctgttacctaccatgtggctcggagctcagaacggctgcctctatgtgcactcgagcgtggctcagtggcgtaagtgcctgcattccattaagctaaaggattcaatactctccattgttcacgtgaaagggatagttctcgtcgctctcgccgatggcactctggccatatttcatcgaggagtggacggacagtgggatctgtccaactatcatctgttagacctcggtcgcccccaccatagtatcaggtgcatgaccgttgtgcatgacaaggtgtggtgtggatacagaaacaaaatctatgttgtgcagccaaaagctatgaagatagagaagagcttcgatgcacaccccaggaaggaaagccaagtgcggcaactggcctgggtgggagacggagtttgggtgagcatacgcctcgattccacattgcgtctgtatcacgcccacacctaccaacatctccaggacgtggacattgagccctacgtaagcaagatgttagggaccgggaagctggggttttcattcgttcgaataaccgccctgatggtttcgtgtaaccgcctgtgggtggggactgggaacggagtgatcatttctattcctctcactgagactaataagacaagcggtgttcctgggaaccgcccagggtccgtgattcgcgtgtacggagacgagaactctgataaagtgacacctggcacgtttatcccttactgctcaatggcacacgcacagctatgtttccatgggcacagggatgccgtgaagttctttgttgccgtgcccggtcaggtaattagcccccagtcttcctcttctggaaccgatctgaccggagacaaagccggcccttccgcccaagagcctgggtcacaaacccccctgaagtctatgctcgtgatctcgggaggcgaagggtacatcgattttagaatgggagacgagggaggggaatccgaattattgggtgaggatctcccattggagccgagtgttaccaaggcggagcggtctcacttaatcgtatggcaggttatgtatggcaacgagtag

SEQ ID NO: 206763 - DNA, 3924 bp, Artificial Sequence
  Description of Artificial Sequence: Synthetic coding sequence
atggagctggaggacggcgtggtgtaccaggaggagcccggcggctctggtgctgttatgtcagagagagtgagcggactcgccggcagcatctatcgggagttcgaaagactgatcgggcggtacgatgaggaggttgtcaaggaactgatgcctctggtggtagcggtgctggaaaatttggatagcgtgtttgcccaggatcaggaacatcaggttgagctggaattgctgagggacgataacgagcagctgattacacagtacgaaagagaaaaggccctgaggaagcatgcagaagaaaaattcatcgagttcgaggactcacaggagcaggaaaagaaagatttgcagacaagagtcgaaagtctggagtcccagaccagacagttggagctgaaggctaaaaactacgccgatcaaattagcagacttgaagagcgagaggctgaactcaaaaaggaatataatgcattgcatcaacggcatacagaaatgattcacaactatatggaacatctcgaacgcaccaagcttcaccaactatcaggcagcgatcagctcgagtccaccgctcacagccgcattagaaaagaacgccccattagcttgggcatcttccctttgcctgcaggggacggcctcctgacaccagatgctcagaaaggcggtgagacaccaggctctgagcagtggaaattccaggagctctcccagcctcggagccatacgtctctgaaggacgagctgtctgatgtgtctcagggtggcagcaaggccacaactccagcttccaccgcaaactctgacgtggcaacaatcccgaccgacactcccctgaaagaggagaacgaaggattcgtgaaagtgaccgacgctccaaataagtccgagatctcaaagcatattgaagttcaggtcgcacaagagacgaggaatgtaagcaccggcagcgccgagaacgaagagaaatccgaggtccaagcaattattgagtcaacacctgagctggatatggacaaagacctcagcgggtataagggctctagtacccccacgaagggaatcgagaacaaggccttcgatcgcaacaccgaatctttgtttgaggaattaagctctgccggctcaggccttattggtgatgtagacgagggagcagacctgcttggcatgggccgtgaggtcgagaatttaatactggaaaacacccagcttcttgaaacaaaaaatgccttaaatatcgtgaaaaacgatttgattgccaaagtggacgagctcacatgcgaaaaggatgttttgcagggggaattggaggcggtgaaacaggcaaagctgaagctggaggagaaaaatcgggagttggaagaggagctgaggaaagccagggcggaggccgaagatgcaaggcagaaggcgaaagatgatgatgactcagatatccccactgcacaaaggaaacgattcacccgcgtggaaatggcccgcgttctgatggagcgcaatcagtataaagagagactgatggagttgcaggaggcagtgcgctggaccgagatgatccgggcgtcccgcgagaatccagcgatgcaggaaaagaaaaggagctcgatctggcagttcttctccagactatttagtagttcatccaatacaaccaagaaacctgagcctcccgtgaacctgaaatacaatgcaccgacatctcacgtaacacccagcgtcaagaagcgctcttcaaccctttcacaattacccggcgataaaagtaaggcgttcgactttctgtccgaagaaacagaggcatcattagccagtagaagagagcagaagagagaacaatacaggcaggtgaaggcccacgtgcagaaagaggacgggcgcgtgcaagccttcggatggagtctccctcagaagtataagcaggtgaccaacggccagggggagaataaaatgaagaacctgccagtgccagtttacttacgtcccctggacgaaaaggacacctctatgaaactgtggtgcgctgttggcgtcaaccttagcggcggcaaaacacgagacggaggctctgtagtaggcgcttcagtattttacaaagacgtcgcgggcctcgacaccgaagggtccaagcaaaggtcagcatctcagtcctcccttgacaaattagatcaagagcttaaggaacagcaaaaggaactgaagaaccaggaggagctgtcctcgttggtctggatttgtacctcgacacacagcgccacaaaggttctgatcattgatgccgtccagccaggaaatattctggactcttttactgtgtgtaattcccatgttttgtgtattgccagtgtgcctggagcgagagagacagattacccggctggggaggacctgagcgaatccggccaggtcgacaaagcctctttgtgtggatctatgacctctaattcttctgcagaaacggatagtctgctgggcgggatcactgtggtgggatgcagcgccgagggcgtgaccggcgctgccacatcgcccagtacaaacggtgcctctcccgtgatggataagccacccgaaatggaagccgagaactcagaggtggatgaaaacgtgcctactgccgaggaggcaaccgaggcgaccgagggtaacgctggctcagccgaggacaccgtggatatctcccagaccggcgtttatactgagcatgtattcacggatcctcttggtgtgcaaattcctgaagatctgtctcccgtgtatcagagtagcaatgacagcgacgcttataaggatcagatatctgttttgcctaacgaacaggacttagtcagggaggaagctcagaaaatgagtagtctgctccccacaatgtggctgggtgcacagaacggttgcctttatgtgcattcgtctgtggcccagtggcgaaagtgtttgcattcaatcaagttgaaagattccattttaagcatagtgcacgttaaggggatagtgttagtcgccctagcagatggcacacttgctatcttccataggggagttgatggccaatgggacctttcaaactatcatcttttggacttgggaagaccccatcacagtattcgatgcatgactgtcgtccatgataaagtgtggtgtggctatcgcaataaaatttatgtagtgcagcccaaggccatgaaaattgaaaaatcattcgacgcgcatccaagaaaggagagccaggtacggcagctcgcctgggtcggggacggcgtctgggtgagcatacggctggacagtaccttacgcctgtaccatgctcatacttatcagcacttacaggacgtggatatagagccgtacgtgtcaaagatgctgggcacaggcaagctcggcttctcattcgttcgtatcacagctctgatggtgtcttgcaatcgtttgtgggtaggaaccggcaacggagtgattatttctatccctctgacggaaaccaacaagacatctggagtgccaggtaatcgccctggttctgtcatacgcgtatacggggacgaaaacagcgacaaagtgacaccagggaccttcataccctactgtagtatggctcatgcacaactgtgcttccacggacacagagacgccgttaagttcttcgttgccgtcccgggccaagtgattagtccccagtcaagctccagtggaacagacttgactggcgacaaggcgggacccagcgcacaggaaccagggagccagaccccccttaaatcaatgctcgtgatctcagggggcgaaggttatatcgacttccggatgggggatgagggcggggagtcagaactgcttggcgaggacctgcccctagaaccatccgtgacaaaggccgagcgatcacatctcattgtgtggcaagtaatgtacggcaacgagtag

SEQ ID NO: 206764 - DNA, 1908 bp, Artificial Sequence
  Description of Artificial Sequence: Synthetic coding sequence
agcctgaaggacgagctgagcgacgtgagccagggcggcagcaaggcaacgaccccagcctccacagctaacagtgatgttgccactattcccacagacacccctcttaaggaggagaacgaaggttttgtgaaagtaactgatgccccaaataagtccgagatcagcaaacacattgaagtgcaagtggcccaggaaacaagaaatgtttctactggttccgccgagaatgaggagaagtctgaggtgcaggcaatcatcgagagcacacccgagctggacatggataaggatctctccggctacaaggggagcagcactccaaccaaggggatagagaacaaggccttcgatagaaacacagagtctctgtttgagaagaggtcttccacactgtcacagctcccaggagataagagtaaggcctttgacttcctgtccgaggagacagaagcgagcttggcctccaggcgcgaacagaaacgagagcagtaccggcaagtgaaagctcacgtccagaaagaagatgggcgggttcaggcttttggctggagtttgccccagaaatacaaacaggttaccaacggtcaaggagaaaacaagatgaaaaaccttccggttcccgtctaccttcgacctttggatgagaaggatacatccatgaaaaagttgtggtgcgccgtgggcgttaacctgagtgggggaaagaccagggacggtggatccgtggtcggcgccagtgtcttctataaggatgtggcaggactagataccgagggctcaaagcagagaagcgctagccagtcgtcactggacaagctggatcaggagctcaaggagcagcagaaggagctgaagaaccaggaggaactcagcagtctcgtgtggatttgtaccagcacccactccgcgacaaaggtgctcataatcgacgctgtccagcccgggaatatcctggatagttttaccgtctgtaattcccatgtgctatgcatcgcatctgttcctggagcacgggagaccgactacccagctggtgaagacctgtctgagagcggacaggtcgacaaggcctctctgtgtgggagtatgacaagcaactcttctgctgaaaccgatagcctgctgggcggcatcactgttgtaggctgctcagcggagggggtaactggagcggcaacttccccctctactaacggtgcttcacccgttatggacaagccacctgagatggaggcagaaaattctgaggtcgacgagaacgtgcccacagctgaggaggccaccgaagctaccgagggcaacgcgggcagtgcagaggacacggtcgacataagccagaccggggtgtatacagagcatgtttttacggatcctcttggagtgcagatcccagaagacctttccccagtctaccagagctctaacgacagcgatgcctacaaggaccagatatctgtgctaccaaacgaacaggacctagttcgggaagaggcacagaaaatgagctccctccttcccaccatgtggttgggggcacaaaacggttgcctatacgtgcatagctcagtggcccagtggaggaaatgtctgcattccatcaaactcaaggacagcatactgtctatagtgcacgttaagggcatcgtccttgtcgctttggcagacggcacattggctatcttccacagaggtgtcgacggccagtgggatctatccaattaccatctactggacctcgggcgcccgcatcattcgatccgctgtatgacagtggttcatgataaagtctggtgtggttaccgcaacaaaatttacgtcctgcacagcagcctgggggacggcgcgaggccctgcctgaaaacagataagcaggcgaagaaccggttgaagagcggctttcactag

SEQ ID NO: 206765 - DNA, 3207 bp, Artificial Sequence
  Description of Artificial Sequence: Synthetic coding sequence
agcctgaaggacgagctgagcgacgtgagccagggcggcagcaaggccactactcctgcctcgactgctaattcggatgtggccaccatcccgacagacaccccgctgaaggaagagaacgaaggctttgttaaggttactgacgctccaaataaaagcgagatctccaagcacattgaagtccaggtcgcccaggaaaccaggaatgtgtcaactggttcagccgaaaacgaggagaaatcagaagtgcaagccatcattgaatctaccccagagttggacatggacaaggacctgtccgggtacaagggaagctcaacacctaccaaaggtatcgagaacaaagccttcgaccgcaacacagagagcctattcgaggagcttagctccgctggaagcggtctgataggcgatgtggacgaaggagctgacttacttggaatgggacgggaagttgagaatttgattcttgaaaacactcaactgttagaaactaagaacgctctaaatatcgtgaagaacgacctaattgccaaggttgacgaattgacatgtgagaaagacgttctccagggagagcttgaagccgtcaagcaggctaagcttaagttggaggaaaaaaatcgagaactggaagaagagctcaggaaagctcgtgcggaagcagaagatgcccgccaaaaagcaaaggacgatgacgacagcgacattccaacagcccagagaaagagatttacccgggtcgagatggccagagtactgatggagaggaatcagtacaaggaaagactgatggagctgcaagaagccgtccggtggacagaaatgattcgggctagccgagagaatcctgcaatgcaagagaagaaacgctcctctatatggcaatttgttcctactaggttcagtcgcctgttctcctcttcgtctaatacaactaagaaacctgaaccccctgtgaatttgaagtacaacgccccaacttcccatgttacgcctagcgtgaaaaagcgttcctcgactctcagccaactgcccggagataaaagtaaggccttcgacttcctttccgaagaaaccgaagctagcttggcaagcagacgcgaacagaaaagagagcaataccgtcaagtgaaagcccacgttcagaaggaggacggtagggtgcaggccttcggttggagcctcccgcagaaatataaacaagtgaccaacgggcaaggggagaacaaaatgaagaatctgccagtgcccgtttatctcaggcctttggatgaaaaggatacgagtatgaaaaaactgtggtgtgcagtcggggtgaacctcagcggcgggaaaacgcgcgatggcgggagcgtggtgggggccagtgtcttttacaaggacgttgctgggctcgatacagagggctcaaaacagaggtccgcttctcagagctctctggataagctcgaccaagaactcaaggagcagcagaaggagctgaagaaccaagaggagcttagcagccttgtatggatttgcacatcaactcactcggctaccaaggtgctaatcatcgacgctgtccagcccggaaacatcctggactcctttactgtgtgcaattctcacgtgctttgcattgcgtctgtgccaggcgctcgcgaaacagactacccagcgggcgaagatttgtcggaatcaggccaggtggataaagcgtcactctgtgggtccatgacatccaactcctccgctgaaacggattccctcctgggtggcatcaccgtcgtcggttgctcggctgaaggtgtgacaggtgccgcaaccagtccgtcaaccaacggggcaagtcctgtgatggataagcccccggagatggaggcagaaaacagcgaagttgacgaaaatgttcctaccgctgaggaggcaactgaggccaccgaaggaaatgccggttcagctgaggacactgttgatatctctcagacgggggtttatactgaacacgttttcaccgaccctctgggagtgcagatccccgaagacttaagtccagtctaccagagtagtaatgacagcgacgcctataaagaccagatttccgttctgccgaatgaacaggacctggtgcgcgaggaggcacagaagatgtcttcacttcttccaactatgtggcttggcgcccagaacgggtgtctttatgttcattcatcagtggcacagtggcgaaagtgccttcactcgatcaaacttaaggatagcatccttagcatcgttcacgttaagggcatcgtgttggtggcgttagccgatgggaccctcgcaattttccaccggggtgttgatggccagtgggatctgtcaaattatcacttgctcgacctcggaaggccacaccatagtatcagatgtatgacagtcgttcatgataaggtgtggtgcgggtacagaaataagatctatgtggtacaacccaaggcaatgaaaatcgagaaaagcttcgacgcacaccccaggaaggaatctcaggttcggcagttggcctgggtcggtgatggcgtttgggtgtcaattcgtctggatagcacccttcggctctatcacgctcacacgtatcagcacctgcaggatgtggatatcgagccctatgtctccaagatgttgggtacaggtaaattgggcttcagtttcgtccggatcaccgctcttatggtctcttgtaataggctctgggtgggcaccggaaatggtgtgattatatctattccactgactgagaccaacaagacatcaggggtacccggcaatcgcccagggagtgtgatccgggtgtacggggatgagaattccgataaagtcactcccggaaccttcatcccctactgttcaatggcccatgctcaattgtgttttcatggacacagagatgcagtgaagttttttgttgccgtgcccggccaagttatttctcctcagagctcttcttccggcactgatctgacaggcgacaaagcgggacctagcgctcaggagccagggagtcaaacacccctgaagagcatgttagtgatctccggcggcgagggctacatcgatttccgcatgggcgacgaaggcggcgaatcagaactactgggggaggaccttccgctagagccatccgtaactaaagccgagcgcagccatcttattgtctggcaggtgatgtacggcaacgaatag

SEQ ID NO: 206766 - DNA, 3237 bp, Artificial Sequence
  Description of Artificial Sequence: Synthetic coding sequence
agcgtgaaggtgagcaacagccccgagccccagaaggccgtggagcaggaagatgaactttcagatgtatctcagggcggtagtaaagctacaacacctgcctcaacagcaaactccgatgtcgcaaccatcccgactgatacgccactcaaagaagagaacgagggattcgttaaagtcaccgacgcaccaaacaagagcgaaattagtaaacatattgaagtgcaagtggcccaggagacccggaacgtaagcacagggtccgctgagaacgaggaaaagagcgaggtccaagcaattatagaaagtacccctgaactggatatggataaggatctgtccggatacaaaggtagcagtacccccaccaaaggcattgagaataaagcattcgaccgcaacacggaatccctgttcgaggagctgtctagcgccgggtctggactaattggagacgtggatgagggagcggacctgttaggcatgggcagggaagtagagaatctgattctcgaaaatacacagttactggaaaccaaaaatgctctcaatatagtgaaaaatgacctgattgccaaagtcgatgaactcacctgcgagaaagacgttcttcagggagagctggaagctgtcaaacaagccaagcttaagcttgaggagaaaaaccgagagcttgaggaagaacttcgcaaggcccgagcagaggccgaggacgccaggcagaaagccaaggatgacgacgatagcgatatcccaaccgcacagcgcaaacgtttcacccgcgtcgagatggccagagtgttaatggaaagaaaccaatacaaagagagactgatggaactccaagaggcggtgagatggacagaaatgatcagagcaagtagggagaacccagcaatgcaagaaaagaagcgtagctccatttggcagtttttttcaaggctcttttcctcgagtagtaacactaccaaaaagcctgaaccgccggtgaatttaaagtataacgccccaacctctcatgtcacaccaagtgtgaaaaagcggagtagtacgctgtcccagttgccaggggacaaatcaaaggcatttgatttcctgtctgaagagaccgaagcatcactcgccagccgcagagagcagaagcgggagcagtacaggcaggtgaaagcccatgtgcagaaagaagacgggagggtacaggcttttggttggtcactgccacaaaagtacaagcaggtcacaaatgggcaaggagagaacaaaatgaaaaacctgcctgtgccggtatacctgaggcccctggacgagaaggatacctccatgaaaaaattgtggtgcgccgtgggagtgaacctaagcggcggaaaaactcgggacggcgggtcagtggtgggcgccagcgttttctataaagatgtggcgggcttggacactgaaggctctaagcagcggtccgcatcgcagagctccctggacaagctggaccaggagttgaaggagcagcagaaggaactgaagaatcaagaagaacttagcagcctagtttggatttgtaccagtacccattcagctacaaaggtgcttatcattgacgcagtgcagccagggaatatactcgactcatttacagtctgcaacagtcatgtactctgcatcgcttcagtgccaggcgcccgggaaacagactaccctgcaggcgaggacttgtctgagtctggccaggtggataaagcctcactgtgcggatccatgacttccaattcgtccgctgaaacagattccctacttgggggaatcacggtcgtgggctgctcggccgaaggcgtgacgggggctgccacatctccttctacaaatggcgcctccccagttatggataagccgcccgagatggaagcagagaacagcgaagtagacgagaacgtgcccaccgctgaagaagccactgaggctactgaaggaaacgcaggctccgccgaggacaccgtagacatttctcagacgggcgtgtacactgagcatgtgttcacagatccactaggcgtccagattccagaagacctgagcccggtgtatcagtccagcaatgactctgacgcctacaaagaccagatttctgtattacctaacgaacaagatttggtgagagaggaggcccaaaaaatgtcttctctcctccccacgatgtggttgggcgcccagaacgggtgcctatacgtgcattctagtgtcgcccagtggagaaagtgcctccactcgatcaagttgaaagactcaatcctgtcaatcgtccacgtgaaagggattgtccttgttgctcttgcggacggaactttagcaatcttccatagaggggttgacggtcagtgggacctcagcaattaccatctgttggatctggggcgtccacaccattccattaggtgcatgactgtggtgcacgataaggtctggtgcggatatcgcaataagatttacgttgttcagcccaaggctatgaaaatagagaaatcttttgacgctcacccaaggaaggaatcccaagtccgccagctggcatgggtaggggatggagtttgggtgagtatccggctggacagtaccctgcggctgtaccacgctcatacatatcagcatttgcaggacgtggatatcgaaccctacgtgtctaaaatgttggggaccggaaaattaggcttttcgtttgtgagaatcacagcactgatggtatcctgcaaccgcctctgggtcgggacaggcaatggggtgattattagcatccccctgactgagacaaacaaaacttcaggcgttccagggaatcggccagggtctgtgattcgagtgtatggggatgagaactcagacaaagtgacccctggcaccttcatcccctactgttccatggcccatgcacagctctgctttcacggacatagagatgcggtgaagtttttcgtggcagtcccaggacaggtgatcagtccccagtctagctcctctgggacggatctgacaggcgataaggcagggccttccgcgcaagaacccgggtcccagacccctctcaagagtatgctggtcatctccgggggggagggctacatcgactttcgaatgggggacgaggggggcgagagcgagttgctgggggaagatcttcctctggaaccgtctgtcactaaagccgaacgatctcatctcatcgtctggcaagtaatgtatggtaacgagtag

SEQ ID NO: 206767 - DNA, 3936 bp, Artificial Sequence
  Description of Artificial Sequence: Synthetic coding sequence
atggagctggaggacggcgtggtgtaccaggaggagcccggcggctctggggccgtcatgtctgaacgcgttagcgggcttgctggtagtatctatcgggaatttgagaggctaattgggagatacgacgaggaagtagtgaaggagctgatgccactggtggtagctgttctggaaaacctggattctgtgtttgcccaagatcaggaacatcaggtcgaactcgagcttttgcgcgacgacaacgagcaactgatcacacagtacgaaagagaaaaagccctcaggaagcacgcagaggaaaagtttattgagttcgaagactcgcaggagcaggaaaagaaagatctgcagacgagagtcgagtccctcgagtcacaaacaagacagctcgaactcaaggctaagaattatgcagatcagatctctcggctggaagagcgagaagccgaattaaaaaaggagtataatgccctccaccagcgccacacggaaatgatccataactatatggaacacctggaacgtaccaagctacatcagctgagtgggagcgatcagctggagagcacagcccattccaggatcagaaaagaacgcccaatttcgctgggcattttcccccttcccgctggcgacgggcttctgactcctgatgcccagaagggaggcgaaactccaggcagtgagcagtggaaatttcaagagttgagccagccaaggagccacacctccctgaaagacgaactgtccgacgtgtcgcagggaggctcgaaagccacaacacctgcaagtactgctaattcggacgttgcaacaattcccacagacactcccctgaaagaggaaaatgaggggttcgttaaagttacagacgctccaaataagagcgagatcagcaaacatatagaagtccaggtggctcaggagacgagaaacgtctccaccgggagcgcagagaatgaggaaaagagcgaggtgcaagccatcattgaatccacgcccgagctcgatatggacaaggatctgtccggttataaagggtcctctaccccaaccaagggaattgaaaacaaggcctttgataggaatactgagagcctgtttgaagaactcagcagcgctggtagcggactgattggcgacgttgacgaaggggcagacctcctgggcatggggcgtgaggtcgaaaatcttattctggagaacacccagctcctcgagactaagaatgccctgaacatcgtgaagaatgatctcattgccaaagtggatgagctgacatgcgagaaggatgtcctccagggcgagctcgaggcggtaaaacaggctaagctgaaactcgaggaaaaaaacagggagttggaggaggagcttaggaaggcaagggcagaagccgaggacgccagacagaaggcaaaggacgatgatgattctgacatacccactgcacagaggaaacgctttactcgagtcgagatggccagggtgctcatggagagaaaccagtacaaggaaaggcttatggagctccaggaggccgtgcggtggactgagatgatcagggcgtcacgtgagaaccccgcgatgcaagaaaaaaagaggtcgagcatttggcaattcgtccccacacggtttagtcgcctgttctcaagctcttctaatacgaccaagaagccagaaccacccgtaaacctgaagtacaatgctcccactagccacgtgacacccagtgtcaagaagaggtcaagcacattgtctcagctgcccggcgataaaagtaaggctttcgacttcctctccgaggaaacagaggcatccctggccagtagacgcgagcagaagcgcgagcagtacaggcaggtcaaggcacatgtgcaaaaggaagacggccgcgtccaggccttcggttggagtctccctcaaaaatacaaacaggtcacaaacgggcagggagaaaacaagatgaaaaatctccctgtgcctgtttatttgagaccccttgacgagaaggatacgagtatgaagttatggtgtgctgtgggcgtgaacctgagcgggggaaagacaagagatgggggaagcgtggtcggcgcgtctgttttttataaagatgtggctggactggacaccgaaggctcaaagcagagaagtgcgagtcaatcttccctggataaactggaccaggagttgaaagagcaacagaaagaactcaaaaatcaggaggagctctctagcctggtctggatttgcacctcaacacatagcgccacgaaagtgctaataatcgacgccgtgcagccaggcaatattctggactccttcaccgtgtgcaatagtcacgtgctgtgcatcgcatccgttcctggagcacgcgagacagactatcccgctggggaagacctgagcgaatctggtcaggtagacaaagcatcgctctgcggctctatgacaagcaatagttctgccgaaactgactctctgctgggcgggatcacagtggttggctgttctgcagagggggttactggtgccgccacttctccgtcgacgaacggggctagtcccgtgatggacaagccacctgagatggaggcagagaattctgaggtcgacgaaaatgtgccgactgcagaagaagctactgaagccaccgagggcaatgctgggagcgccgaggataccgtagatatttcccaaaccggcgtgtacaccgaacacgtgttcacagacccactcggcgttcaaatcccagaagacctcagcccagtgtatcagtcctcgaacgattcagatgcatacaaagatcagatcagcgtcctgcctaatgaacaggacctggtccgcgaggaagctcagaaaatgtccagcctgttgcccactatgtggttgggcgctcagaatggctgcttgtacgtccattcatcagttgcccagtggaggaaatgcctccattctatcaaactgaaggacagtatcctttcgatcgtgcacgtgaagggcatcgtcttagttgccctcgccgacggcacactcgcaatttttcatcggggagtggacgggcagtgggacttatcgaactaccatctgctggatctggggaggcctcaccattctattagatgcatgaccgtggtgcacgataaggtgtggtgtggctaccgtaacaaaatctacgtggtgcagcccaaagcaatgaagattgagaaatctttcgatgcacacccacggaaagaatctcaagtgcgccagctcgcttgggtgggagacggcgtatgggtctccatcagactcgatagcacacttcgactgtaccatgctcacacctaccaacatctccaggacgtcgacatcgagccttacgtatcaaaaatgttgggtaccggcaagcttggcttcagttttgtgcgtattacggccctgatggtgagctgtaacagactctgggtcggcactgggaatggagtgattatctcgatccccctcacggagaccaacaagactagcggagttcccggcaacaggccaggcagcgtcattagagtatatggtgacgagaactcagacaaagtaaccccgggcacattcatcccctattgttctatggctcacgcccagctgtgttttcatgggcatagggatgcagtgaagttttttgttgccgtacccggtcaagttatctcaccacagtcaagcagttcgggcaccgatctgaccggggataaagcgggaccttctgcccaggagccagggagtcagactccactcaagagcatgctggtcatctctggcggtgaaggctatattgactttcgtatgggagacgaaggaggtgagagtgaacttctcggggaggatcttcctctggaaccctccgtgaccaaagctgagaggtcccatttgatcgtgtggcaggtgatgtacggcaacgagtag

SEQ ID NO: 206768 - DNA, 3534 bp, Artificial Sequence
  Description of Artificial Sequence: Synthetic coding sequence
atgagccccggctgcatgctgctgttcgtgttcggcttcgtgggcggcgccgtggtgatcaacagcgccatcctcgttagtctaagcgttctcctgctggtgcatttcagcatcagcacgggagtgcccgcgctgacccagaacttgcctcgcattttgagaaaggagaggccgatttccctgggcatattccctctgccggcaggagacgggctgctcactcctgacgcccaaaagggtggggagactccgggtagcgagcagtggaaattccaggagctcagccaacctcgcagccacacctcactcaaagacgaactgtctgatgtgagccagggcggcagcaaggcaacaactcccgcctcgacagctaattcagacgtagcaacaatacctacggacaccccacttaaagaggaaaacgagggcttcgtgaaggtcaccgatgcccctaacaagagtgagatttcaaagcacatagaagtgcaggtggctcaggagaccaggaatgtgagcacgggtagcgctgagaacgaggagaagagcgaggtgcaggccatcatcgagagtacacctgagttagacatggacaaggatctgtccggatataaggggtcatcaactcccacgaaagggatcgagaataaggccttcgatcgaaataccgagtctctgtttgaggaattgtcatcggcgggcagtggtctgataggtgatgtggatgaaggtgccgacctgctgggcatgggcagggaggtggaaaatctaatcttggagaacactcaactgctagagacaaaaaacgcattgaatatagtgaaaaatgatctaatcgctaaggtcgacgagctcacgtgcgagaaagatgtcctccagggagagctcgaggcagtcaaacaggcaaaacttaaactggaggagaaaaatagggaactggaggaggagctccggaaggcccgtgccgaagcagaggacgcacgccagaaagctaaagacgacgacgatagcgacattcctaccgcgcaacggaaaagatttacacgagtggagatggctcgtgtcttaatggaacgcaaccagtataaagaacgccttatggaattacaggaggctgtaaggtggacggaaatgataagagcctcaagggagaatcccgcaatgcaggagaaaaagagaagtagcatctggcaattcttttcccggctgttctccagctcttccaatactacaaagaagcctgagcctcccgtcaacctgaagtacaacgcgcccacgtcacatgtaaccccaagtgtgaagaagagaagctcaactctgtctcagctgccaggggataagtccaaagcttttgactttctgagcgaagagaccgaggcctctcttgctagcaggagagagcaaaaaagggaacaatatcggcaggtcaaagcacatgtgcaaaaggaagatggaagagtgcaggcctttggctggtcactgccacagaaatacaaacaggtcaccaatgggcaaggtgagaataagatgaagaatctcccagttcccgtgtacttaaggccactggatgaaaaagatacctccatgaagctctggtgcgcagttggagtgaacctgtcaggaggcaaaacccgggatggggggtcagtggttggcgcctctgtgttttacaaagacgtcgcaggactggataccgaaggtagcaagcagaggagcgctagtcaaagctcgcttgacaagctagaccaggagctgaaagaacagcaaaaggagctgaagaaccaggaggaactgagcagtcttgtgtggatatgtacctcgactcattcagcaaccaaagtacttatcatcgatgctgtccagcctggcaatattctcgattcattcaccgtctgcaattcccacgtgctctgtattgcttccgtgcccggtgcaagagaaaccgactaccccgcaggcgaggatctgtccgaatctggccaggttgacaaggccagtttgtgtgggagtatgactagtaattcaagtgctgaaacagactccctgctcggcggcattactgtggtaggttgctcggccgagggcgtgaccggggctgctacaagccctagcacaaatggcgcaagtccagtgatggataagccgcccgaaatggaagccgagaacagcgaggtggatgaaaacgtgcctaccgccgaggaagcaactgaagctacggagggcaatgctggaagcgccgaggacactgtagatattagtcaaacaggcgtgtatacggaacacgtgtttaccgacccactcggagtgcaaattcccgaagaccttagtcctgtataccagagcagtaacgactccgacgcttacaaagaccagatcagcgttttaccaaacgagcaagacttagtgagggaagaagctcagaaaatgagtagcctgcttcccactatgtggctcggcgcccagaatgggtgcctgtatgtacacagctcagtggctcagtggcgcaaatgtctgcattctattaagctgaaagatagtatactgagtattgttcatgtaaaggggattgtcctcgtcgcattggctgatgggaccctggctatttttcataggggcgtcgatggacagtgggacttatctaattatcacctactggacctgggccggccgcatcactctataagatgtatgacagtggtccatgataaagtctggtgcgggtatcgaaataagatttatgtagttcagccaaaggctatgaagatcgaaaaaagttttgatgcccacccgagaaaggaatctcaggtaaggcagctggcctgggtgggagatggtgtgtgggtgagtatccgtcttgatagtaccctgaggctgtaccatgcccacacatatcagcacctgcaagacgtggatatcgaaccttacgtaagtaaaatgctaggcacaggcaagttaggttttagttttgtgcggatcactgcgctgatggtaagctgcaaccggctgtgggtgggcacgggaaacggtgttattatcagcatacccttgactgagaccgtgatcttacaccagggcagattgctcggattaagagctaacaaaactagcggcgttcctggaaataggcccggaagcgtgattcgcgtttatggcgacgagaatagcgataaggtcactcccggaaccttcatcccctactgctccatggcccacgcacaattgtgcttccatggccatcgcgacgccgtgaagttcttcgtagccgttccaggacaggtcatctctcctcagtcttcctcatcaggaacggacttgactggcgacaaggccgggccgagtgcacaggagcctggcagccagacgcctctaaaatctatgctggtcatttctggaggagagggctatatagatttccgcatgggcgatgagggtggtgagtcggaacttctgggagaggatctccccctggagccgtcggtgaccaaggctgaacggtcccatctgatcgtgtggcaggtcatgtacggcaacgagtag

SEQ ID NO: 206769 - DNA, 2760 bp, Artificial Sequence
  Description of Artificial Sequence: Synthetic coding sequence
atggtgatgcggtggggcgagcggaacgacgtgatcgcctgggagttactccaagacggggtggaaaacgcattaaatattgtgaaaaacgacctgatagcaaaggtagatgagctgacatgtgagaaagatgtgctacagggggaactggaggccgtgaaacaggctaaactaaagctcgaggagaaaaatagggaactggaagaggagttgcggaaagctagggctgaggcggaagatgctcggcagaaagcaaaggacgacgacgattccgacatcccgacagcccagcgcaaacgctttacaagagtagagatggcccgagtgctgatggaaagaaatcagtacaaagagcgtctcatggaactgcaagaggctgtgaggtggaccgaaatgattcgcgcttcccgggaaaaccccgcaatgcaggagaagaagagatccagcatctggcaatttttctctcgactctttagcagtagcagcaatactaccaagaagcctgaacctcctgtgaatctgaaatacaacgccccaacttcacacgtcaccccgagtgtgaagaagagatctagcactctctcccaactcccaggggacaagtctaaagctttcgactttctgtccgaggaaaccgaggcaagtctggcctccaggagggagcagaaaagagaacaatatcgtcaggtgaaggctcacgtccagaaggaggacggaagggtccaggcctttggctggagtctgccccaaaagtacaaacaggtcaccaatggccagggagaaaataagatgaagaatcttcccgtcccggtgtatctgagacctctcgacgagaaagacactagcatgaagctctggtgcgccgtcggggtcaatctctccggcggaaagactcgggatgggggcagcgtggtgggagccagtgttttttataaggacgtggcaggactagacaccgagggcagcaagcaacgctctgcctctcaaagtagcttagataagcttgatcaagaactcaaggagcaacagaaggagctaaagaatcaggaggaattaagttctctcgtgtggatctgtactagcactcattccgccactaaagtgttgattatcgatgctgtgcagcccggcaacattctagattcttttacagtctgtaacagccacgttctgtgcatcgcctctgtgcctggagcacgtgagacagactaccccgcaggggaggatttgtccgagagcggacaggtggacaaagcttctctgtgtggaagtatgacctccaattcatccgctgagacagattctctgttgggtggaattaccgtggtgggctgctccgcagagggggtcaccggggccgcaacttccccctctactaatggggcgagtcccgttatggataaaccccctgaaatggaggctgagaattctgaggtcgatgagaacgtcccaactgccgaggaggcgacagaagccacagaaggcaacgcgggctctgcggaggatacagtggacatctctcagacaggagtgtacaccgaacacgtcttcacagaccctctgggagttcagatcccagaggatctctcaccagtgtatcaaagcagtaacgattccgacgcttataaggatcagatttctgtcttacctaacgaacaggacctcgtccgcgaggaagcccagaaaatgagctctttactgcctacgatgtggctcggcgcgcagaatggctgcctgtacgtccacagttcggtggctcagtggaggaaatgcctacactccataaaattgaaggattctatcctatccattgtacatgtgaagggcatagttttagttgctttagctgacgggacactggcaatcttccacagaggcgtagatgggcaatgggatttgagcaattaccacctcctggaccttggccggccccatcactctatccgctgcatgacagtcgtccacgacaaagtgtggtgtgggtatcgaaacaagatttatgtggtccagcccaaagccatgaaaattgaaaaaagtttcgacgcccacccaaggaaggagtcacaagtccgtcagctggcgtgggtgggggatggtgtatgggtgagcatcagacttgattcgactctcaggttatatcacgctcacacctaccagcatctacaagatgtagatatcgagccttatgtttctaaaatgctgggaaccggtaaactcgggttctcttttgtacgtatcactgctctaatggtctcctgtaatcggctgtgggtgggcaccggcaacggcgtaattatctcaatccccctcacagagactaataaaacgtcaggcgttcctgggaacaggccgggtagcgtaatacgcgtatatggcgacgaaaactcagacaaggtgacgccagggacattcatcccttattgcagcatggctcacgctcaactgtgctttcacggacacagagatgcagtgaaattttttgtggcagtgcctggccaagtcattagcccccagagtagtagcagtggaaccgatctgactggtgataaggcgggaccatccgcccaggaaccgggaagccagacgccactcaagagtatgttggttatatccgggggcgagggttatatcgacttcaggatgggagatgagggtggcgaaagtgagctactgggagaggatctacccttggaaccttccgtgactaaagcggaaagaagccacctgattgtgtggcaggtaatgtacggaaatgagtag

SEQ ID NO: 206770 - DNA, 825 bp, Artificial Sequence
  Description of Artificial Sequence: Synthetic coding sequence
atggagctggaggacggcgtggtgtaccaggaggagcccggcggcagtggagccgttatgagtgagcgtgtgtcagggttggccggtagtatttacagggaatttgagaggctcattgggcgttacgacgaggaggtcgtaaaggaattgatgccattagtggtggccgtgttggagaatctggattcagttttcgcccaagatcaggaacaccaggtggagcttgagcttctgcgtgacgacaacgagcagctgatcacacagtacgagagagaaaaggccctgcgaaaacatgcagaggagaagtttatcgaatttgaggattcacaagagcaggagaaaaaggacctgcagacgcgcgtggagagcctcgagagccagactagacaactcgagctcaaagcgaagaattatgccgaccagtctgcgatgtcgcctggttgcatgctcttgttcgttttcgggtttgtgggcggggctgtggttataaacagtgccattttggtcagtctgtcagtcctactgctcgtgcacttttcaattagcactggcgtacccgcactcacccagaatctccctcgtattctgaggaaagagcgccctataagtctcggaatatttcccctgcccgcaggtgatggactgctgacacccgatgcgcagaaggggggcgaaaccccaggaagtgagcaatggaaattccaagaactttctcagccaagatctcacacaagtcttaaggttagcaatagtccggagcctcaaaaggcggtagaacaggaggtgcgtatggtattgttaaacattttgcagaaagtgtattag

SEQ ID NO: 206771 - DNA, 1053 bp, Artificial Sequence
  Description of Artificial Sequence: Synthetic coding sequence
atgaagcccctggtgctgctggtggccctgctgctgtggcccagctccgtgcctgcgtatccatctatcacagtgactcctgatgaggagcagaatctcaatcactacattcaggtgttggaaaatctcgtgcgcagtgttcccagtggggagcctggaagagaaaagaaatccaacagcccaaagcatgtttactccatcgctagcaaggggagcaagtttaaagaactggttacacatggggacgcctctactgaaaatgacgttctgacaaaccctatatctgaggaaactaccacgtttccaaccggaggctttacaccggagatcgggaagaagaagcacacagagagtacgccgttctggtccataaaaccaaataacgtttcgatcgtactccatgctgaggagccatatatagaaaatgaagaaccggagcccgaacctgaacctgcagcaaagcagacagaagccccacgcatgctgcctgtcgtgacagaatcctccacaagcccatacgtcacttcatataaaagtcccgttacaacgctagacaagagcaccggaatcggcatttctacggagtccgaagacgtcccccagctgtctggcgagacggccatcgaaaaacccgaagagttcggcaagcaccctgaatcatggaataatgatgatatactgaagaaaattctggacatcaatagccaagtgcagcaagccctgctctccgacacttccaacccggcctatagggaggatatcgaggcctccaaagaccatcttaaaagaagcctcgctctggccgctgctgccgaacacaagctaaagactatgtataaaagtcaactcttaccagtcggaaggactagtaacaagattgacgatattgaaacagtcatcaatatgctctgcaacagtaggtcaaaactgtacgagtatttagacattaagtgcgtgcccccagagatgcgggaaaaagcagctaccgtgttcaataccctgaagaatatgtgcagaagtcgccgtgtgactgccctcctcaaagtatattag

SEQ ID NO: 206772 - DNA, 711 bp, Artificial Sequence
  Description of Artificial Sequence: Synthetic coding sequence
atggccagcagcgtggacgaggaggccctgcaccagctgtacctgtgggtggataatatcccactctccagaccaaagcgtaatctgtccagggatttctctgatggggtgttggtggctgaagtgattaaattttatttcccaaagatggttgagatgcataattatgttcccgccaatagcctgcagcagaaattgtcaaactgggggcatctcaatcggaaggttctgaaacgactgaattttagtgtccctgacgacgtgatgcgcaaaattgcccagtgcgcccccggggtggttgaacttgttttgattcctctgcgtcaaagactggaggagagacaacggaggagaaaacagggagccggctccctgcaggaactggcgccccaagacggttccgggtacatggacgttggcgtaagccagaaggctaggggtgagggggtcccagatccccagggtggcggtcagctgagctgggatcgcccacctgccccacggcctccggcatacaatagagcactgcagggggatcctagcttcgtgctgcagatcgccgagaaggaacaggagctgttagcctcgcaggagacagttcaagtgttgcagatgaaggtgcgccgactagagcatttattacaacttaaaaatgtaagaattgaggacctgtcaagacgccttcagcaggctgaacgcaagcagagatag

SEQ ID NO: 206773 - DNA, 351 bp, Artificial Sequence
  Description of Artificial Sequence: Synthetic coding sequence
atgtgcgaccagaccaagcacagcaagtgctgccccgccaagggcaaccaatgctgtccaccccagcaaaaccagtgttgtcaaagcaagggcaaccagtgttgccctcccaaacagaatcagtgttgtcaacccaaggggagccagtgttgtccaccaaagcacaatcactgctgtcaaccaaagccaccttgttgcattcaggccaggtgttgcgggctggagacaaaacccgaggtaagcccattaaacatggagtctgagccaaactcccctcagacccaggacaaagggtgccagacgcagcagcagcctcactctcctcagaacgagtcccgcccctctaaatag

SEQ ID NO: 206774 - DNA, 294 bp, Artificial Sequence
  Description of Artificial Sequence: Synthetic coding sequence
atggacaagcagagcagcgccggcggcgtgaagcggagcgtgccctgcgatagcaatgaggcgaatgagatgatgcccgagacaccaacaggcgactccgacccgcagcctgccccaaagaaaatgaagaccagcgaatcctcgactatcttggtggtgcgataccggcgtaatttcaaaaggacatctccagaggaactgttgaatgaccacgctcgggaaaacagaatcaatccgttacagatggaagaagaggaattcatggagattatggtagagatccctgccaaatag

SEQ ID NO: 206775 - DNA, 2019 bp, Artificial Sequence
  Description of Artificial Sequence: Synthetic coding sequence
atgcggagcatccggagcttcgccaacgacgaccggcacgtgatggttaagcattccactatctacccaagccctgaagagctagaagccgtacagaatatggtctctaccgttgaatgcgcattgaagcatgtgtccgattggcttgacgagacaaacaagggcaccaagacagagggcgagactgaggtgaagaaggacgaggccggagaaaactattcgaaggaccaaggcggaagaactctttgtggggtaatgaggatcggtctggtggcaaagggcctcctgatcaaagacgacatggatctggaactcgtcttgatgtgcaaagacaagccaaccgagacattgcttaacacagtgaaagacaatctgccaattcagatacaaaaactgaccgaggagaagtaccaggttgaacagtgtgttaacgaagcgagtatcataattaggaacacaaaggaaccaactctgacactcaaagtgatcttaaccagcccacttatacgggatgaactagaaaagaaagatggcgagaacgtttcaatgaaggatccgcccgacctcctggataggcagaagtgcctcaacgctctggcatccctccggcatgctaaatggttccaggcaagagcaaatggtctcaaaagctgtgtgatcgtgctgagaattctgcgcgacctctgcaatcgcgtgccgacatgggccccactcaaagggtggcccctagagctgatctgcgagaaatccatcgggacctgcaacaggcctctgggcgccggtgaagcgctgaggagggtcatggagtgcctagcttctggtattctgcttccaggtggacccgggctgcacgatccatgcgaaagggaccccaccgatgctctaagctatatgacaatccagcagaaggaggatataacccactcggcccagcacgcactgaggctgagcgcatttggtcagatctacaaagtgctcgaaatggatcctctgccaagttctaaaccgttccagaagtattcttggagcgtgaccgacaaggagggcgcgggcagcagtgctctgaagcgcccattcgaggatggtctgggtgacgacaaggatcccaacaagaagatgaagcggaacctccggaagattcttgactccaaggccattgacctcatgaatgctctaatgcgcttaaaccagatcaggccgggcctacagtacaaactcttgagccagagtggccctgtgcacgccccagtctttacaatgagcgtggatgtcgatggaacaacttatgaggccagtggcccgagcaaaaagactgctaaactccatgtggcggtgaaggttctgcaggctatgggttaccccacaggctttgacgctgatattgagtgtatgagttccgacgagaagtctgacaacgaatccaagaatgaaaccgttagctcgaacagctccaacaacaccggaaacagcaccaccgagactagtagtacgctcgaagtgaggactcaggggccaatcctgacagcgagcgggaagaacccggtgatggagttgaatgagaaacggcgaggcttaaagtacgagttaatctctgagactggcggtagccacgataagcggtttgtgatggaagtggaggtcgacggacagaaattcaggggtgcaggccctaacaagaaagtggccaaagctagtgcggcactggctgcgcttgagaaattattttctggccccaatgctgctaacaataaaaagaagaagatcatcccacaggccaagggagttgtgaacactgccgtcagcgctgctgtgcaggccgtgcgcggaagaggcaggggcaccctgacacggggggcctttgtgggcgcgaccgccgctcccggatatattgcccccggctatggaactccttacggatacagcactgccgcccccgcttatggcctgccgaaaaggatggtccttctgccggtaatgaagttcccaacttacccggtgccccactactcctttttttag

SEQ ID NO: 206776 - DNA, 1977 bp, Artificial Sequence
  Description of Artificial Sequence: Synthetic coding sequence
atggtgaagcacagcaccatctaccccagccccgaggagctggaggcagttcagaatatggtgtccactgtagaatgtgctctgaagcacgtgagcgattggctggatgaaaccaataaaggcacgaagacggaaggagagaccgaagttaaaaaagacgaagctggggagaattactccaaggaccagggaggacgcacactttgcggcgttatgcgaatcgggctggtggctaaggggctgttaatcaaggatgatatggatcttgaacttgtccttatgtgcaaggataaaccgactgagactctcctgaacacagttaaggataatctccctatccagatccaaaagctcacggaagagaagtaccaggtcgagcaatgcgttaatgaggcttcaatcataattcgcaacaccaaagagcctaccctgacgctaaaggtcatattaacctcacccctgatccgggatgagcttgaaaagaaggacggtgagaacgtgtctatgaaagacccaccagatctgctcgataggcaaaagtgcctgaacgctttggccagcctgaggcacgcaaagtggttccaggccagagcaaacggactgaaaagttgcgtaatcgttttgcgcatattgcgcgacctctgtaacagggtgcctacatgggcccctctgaaaggctggcccttagagctgatttgtgaaaagagcattggaacgtgtaatcgacctctgggcgcgggggaagcgttgcgacgggttatggaatgtttagcatcgggcatcctcctcccgggaggacccggtctgcacgacccgtgcgaaagggatccgacagacgccttaagctatatgacaatccagcagaaagaagacatcacgcatagcgctcagcacgctctccgtctaagcgcgttcggccagatctataaagtcttggagatggatccattgccgagtagtaagccttttcagaagtatagctggtcggtcacagacaaggagggggccggctctagtgcgttgaaaagaccctttgaggatgggctgggggatgataaggacccaaacaagaaaatgaaacgaaacctgcgcaagattttggatagcaaagcaatcgacttgatgaacgctctgatgagacttaatcagattcgtcccggactacagtacaaactcttaagccagtctggcccagtgcatgcacctgtgtttactatgtcagtcgacgtggacgggacaacgtatgaagcatccggcccctcaaaaaaaacagccaagctgcatgttgccgtgaaagttctgcaggccatggggtaccccaccggctttgacgctgatattgaatgcatgagcagcgatgagaagtccgacaacgaatcaaagaatgagaccgtctcctctaacagctcaaataacactgggaattcaaccaccgaaacttctagtaccctcgaagtcagaacacaaggacccatcctgactgcctccggtaaaaatcccgtgatggagcttaatgaaaagagacgcgggctcaaatatgaactgatctcggagaccggcggatcccatgacaagagattcgtgatggaagtggaagtggacggacagaaattccgcggggctgggcctaacaaaaaggttgctaaggcgtccgccgctcttgccgctcttgaaaaactgttctctggtcccaatgcagcaaataataaaaagaaaaagattattcctcaagcaaagggtgtcgtcaacacagccgtcagcgccgccgttcaggctgtgagggggcgcggccgtggtaccttgaccaggggtgcttttgttggtgctaccgccgccccgggatacattgcccccggatatgggaccccctatgggtacagtaccgccgctcctgcctatggcctgcctaaaagaatggtattgcttcctgtcatgaaattccctacttacccggtgccacattactctttcttctag

SEQ ID NO: 206777 - DNA, 285 bp, Artificial Sequence
  Description of Artificial Sequence: Synthetic coding sequence
atgcggagcatccggagcttcgccaacgacgaccggcacgtgatggtaaagcatagcactatctaccctagtcctgaggaactcgaggctgtacagaatatggtgagcacagtcgagtgtgccttaaagcacgtaagtgattggctcgacgaaacgaataagggtacaaaaactgaaggcgaaactgaggttaagaaagatgaggctggagagaactacagcaaatggagtgacatagtttggtgcaacgaggattggcctggttgcaaaagattggcggattag

SEQ ID NO: 206778 - DNA, 2019 bp, Artificial Sequence
  Description of Artificial Sequence: Synthetic coding sequence
atgcggagcatccggagcttcgccaacgacgaccggcacgtgatggtcaaacattccacgatctatccttcccctgaagagctggaggccgtacagaatatggtaagtacagtggagtgtgctctgaaacacgtgagcgattggctggacgaaacgaacaagggaactaagactgagggtgaaaccgaggtgaagaaggatgaagccggcgagaactactcgaaggatcagggcgggagaaccttgtgcggggtaatgcgcatcggcttggtggctaagggacttctgattaaggatgacatggacctggaactggtattaatgtgtaaggataagcccactgaaacactgctgaacactgtgaaggataacttaccaatccagattcagaagctgaccgaggaaaagtaccaagtagagcagtgcgtgaacgaggcctcgatcatcattagaaacactaaggaacctactctcacgcttaaggtgatccttacaagcccactgatcagggatgaattggagaagaaggatggcgagaacgttagcatgaaagaccctccggacctcctggaccggcagaaatgccttaatgctctggcgtccctaagacacgcaaagtggtttcaggctcgtgcaaatggattgaagtcctgcgtgattgttctgcgtattcttagggacctgtgtaacagggtacctacatgggcccctcttaagggttggcccctggagctcatctgcgaaaagagcattggcacatgtaacaggcccctgggtgccggtgaagccctgcgaagggtcatggaatgcttagcctcaggcattcttctcccaggcggcccaggtctgcatgacccttgcgagcgagatccaacagacgctttaagttacatgactatccagcagaaggaggacatcacccacagcgcccagcatgctttacgcctgtctgctttcggacaaatttataaggtccttgaaatggatcccttaccaagctccaaacctttccaaaagtacagctggagtgtcactgataaagagggagcaggtagcagcgctctgaagaggcctttcgaggatggcctaggagatgataaagatcccaataagaaaatgaagcgcaacctgcggaaaattctggactcaaaggcgattgatcttatgaacgctctcatgcgtcttaatcaaatacgtcctggcctgcagtacaaacttctgtcccaatctgggcctgtgcacgcccctgtgtttacaatgagcgtggacgtcgacggcacaacttatgaagccagcggaccctcaaagaaaacagccaaactgcatgtggcggtcaaagtgctgcaggccatgggatacccgacgggattcgatgcagacattgagtgtatgtcaagcgatgagaagtctgataacgaatctaagaatgaaactgtttcgtctaatagctcgaacaacaccggcaactctacaactgaaacttctagcacacttgaggttagaacgcagggaccaatcctgacagcaagcggaaagaatcccgttatggagctcaacgagaaaaggcgaggattgaaatacgaactcattagtgagactgggggctctcacgacaaacgctttgtgatggaggttgaggttgatgggcagaaatttaggggagccgggccgaataaaaaagtggccaaagcttcagccgcgctggccgccctggagaagctgttctccggccccaacgccgcgaataataagaaaaagaaaataattcctcaggctaaaggcgtggtgaatacagccgtatcagccgccgtgcaggcagttcgggggcggggtcgcggcacactcaccagaggtgctttcgtgggcgccactgctgccccaggctacatcgcgcctgggtacggtaccccatacgggtacagtactgccgcccctgcatacggtctcccaaagcgtatggtgctcttgccggtgatgaagtttcccacataccctgtgccgcactatagcttcttctag

SEQ ID NO: 206779 - DNA, 225 bp, Artificial Sequence
  Description of Artificial Sequence: Synthetic coding sequence
atgcggagcatccggagcttcgccaacgacgaccggcacgtgatggtaaaacacagtacaatctatcctagtcccgaagagctggaagcagtgcagaacatggtgtcgacggtggaatgtgccctgaagcacgtgtctgactggctggacgagaccaacaaggggacaaagacggagggcgagaccgaagtgaaaaaagacgaggccggcgagaattattcatag

SEQ ID NO: 206780 - DNA, 1776 bp, Artificial Sequence
  Description of Artificial Sequence: Synthetic coding sequence
atgagcctgctgaccaactacgagggcctgcggcaccagatcgagagactagttagggagaacgaggagctgaagaaactggtccgcttgatccgggagaatcacgaactcaagtcagccataaaaacacaggctggcggacttggaatcagcggctttacctcaggactcggggaagcaactgctgggttgagctccaggcagaataacggtgtctttctcccaccgagcccagccgtggctaacgaaagagtccttgaagaggtcggaataatggcactcgctccgctggccgagatgttgacctccctgcagccgagcgccaccccagggagccttatgtccccactaactggtacactctctaccctcttgagcggcccagcccccacttcccagtcaagccctttaacctccttccttactagccccatcgccggccctctgacaggtaccttagcttcgtcactgggactgccctccacgggtaccctgacaccttcctccttggttgctggacctgtggccatgagccagtctagcccattgatcgcccccgttatgggaactgtcgcggtgtctttgtccagtccactgctgagctctacagccactccacctggtgtctcacagaacttactcgctaatcccatgagtaatttggtgcttccggaagcaccgcgtctgcgcctagcagagccgctccgaggtgggcccactggcccacagtctcctgcctgtgtcgttcctaccgcaacaacgaaagtcccgctttccaccgaacccccacagtccacccaggaccccgaacctctgagcatggccttcgccggggcgccgttgcagacctcaacgcccattggggctatgggcacaccagcacctaagaccgcattttcctttaatacatcagacacccaagcccaaccgagcgcagcccaagaacaagtcgtgcccgcctccgtgcccacatctcccactacatcccccaccgtcaccgtactggcaagtgctccagccctggccccacaagtcgctacatcctacactccttcaagcactactcatattgcacagggtgcacctcaccctcccagccgtatgcataactcccctacccaaaaccttccagttccgcactgtccacctcacaacgctcattcacccccaagaacatcatcgtcacccgccagcgtcaacgattcgcggggaccaaggaccaccgaacccagcactaagtcaatgatggaggtggaaaggaagttggcccaccgcaaaacctccaagttcccagaaaaccccagggagagtaagcagctcgcgtgggagaggctagtgggtgaaatagcttttcagttggataggcggattttgtccagtatcttcccagaaagggtgcggctgtacggatttactgtctctaatatcccagaaaagatcattcaggctagtctcaacccttcagaccacaaattagatgaaaagctgtgccagagactgacccaaagatatgtaagtgtcatgaaccgactccagtcactgggatataacggtcgggtgcatcccgccctaacggagcagctcgtgaacgcttacggcatattgcgagaaagacccgaactggcagcgtcagaaggcgggccctatactgtggacttccttcagcgggtggtggtggaaacagtgcacccaggcatgctcgccgatgccttactgttgcttagctgcctgagtcagttggcccacgatgatggtaaacccatgttcatctggtag

SEQ ID NO: 206781 - DNA, 1326 bp, Artificial Sequence
  Description of Artificial Sequence: Synthetic coding sequence
atgagcctgctgaccaactacgagggcctgcggcaccagatcgagcggctggtcagggagaatgaagagctgaagaaactggtgagactgatccgagagaaccatgagttgaagtccgccatcaaaacccaagccgggggcctaggaatttcaggattcacaagcgggcttggggaggccacggccggtttgtctagccggcagaacaatggagttttcctgccacctagccccgccgttgcaaacgagcgagtgctggaggaagtcggcattatggcattagccccacttgcagagatgctgacatcactacagcccagtgccacccccggttcgctgatgagtccactgacgggcactctgtctaccttgctgtcagggcccgcccccaccagccagagctctccattgaccagtttcttgacctctcccatcgcaggacctctgacagggacattggctagtagcctgggcttgccttccactggtacccttacgccctcttcccttgttgccggtccggtggctatgtcacaatccagtccactgatcgcccctgtaatgggaacagtcgcagtgtcgctatctagccctctgctgagttcaaccgccacccctccaggggtgtcacagaatctgctcgctaatccgatgagtaaccttgtgctcccagaggcgcccaggttgcgtcttgcagaaccgctgaggggcggtccgactggaccccaatcccctgcttgcgtagttcctaccgcgaccacgaaagttcccctctcaactgaacctccccagtccactcaggaccccgaacctttgtccatggctttcgcaggtgcccctctccagacatccacaccgattggagccatgggaacccccgcccccaagactgccttttcctttaatacctccgacacacaagctcagcccagcgccgcacaagaacaggtcgtgccagcttccgtgcccacatcacccacaacaagccccaccgtgactgtgctggccagtgcccctgctcttgccccccaggtcgccacctcttatacgcccagtagcacaacccacatagcacagggcgcaccccaccctcctagcagaatgcataactctcccacccagaacctgccagtcccccactgccccccccacaacgcccacagtcccccaaggacctcatccagccccgcatccgtcaatgacagcagaggcccaagaacaactgaacccagtaccaagtctatgatggaggttgagcgaaagctggctcataggaagacgtccaaatttcccgagaatcccagaggctttcccgagccacagtag

SEQ ID NO: 206782 - DNA, 573 bp, Artificial Sequence
  Description of Artificial Sequence: Synthetic coding sequence
atgagcagcagcgccctgacctgcggcagcaccctggagaagagcggagatacgtgggaaatgaaagccctcgacagtagtcggctagttccttggccccctcgtggcctcgggtccagcactcagcacccgaataagccacattgcgccttggccagttgtcaaggaccgggtgttttgcccggggcggccagcgccctgccagaactaacatttcagggtgatgtgtgccagagcgagacctgtcagcgttacttacaggcggccatctcactggacatagccgtgagccaaattaacctgctcggcagaccatcaagccctcctgctctgctgattcagcagggttcttgtgagcaggtaatccacaattctactccacagttcttggggatggaggacggggacaatgagcgaacaacaggttggctgtggcgactgtgcgaggacattgacgccgaaccttcctcgaccggatgcagccggagcaaccagctgacgtttactgaaggttgctttgtgagatcactgagcaccgtttactctaatactcacattcacacacatctgtag

SEQ ID NO: 206783 - DNA, 1791 bp, Artificial Sequence
  Description of Artificial Sequence: Synthetic coding sequence
atgggcttcatcatccacatccagcaggtgaagaagcagcggaagaagctagaccaggggcttatcctgaagaaagaaaagtaccgcaaggaaaaaaaatgcgccagtctgagcttcgaagtgtccagtgatgggggcacggagccatcagccctggtcgacgacaacggatccgaggaagacttttcgtatgaggacctctgtcaggctagcccccgctacctgcagccaggtggtgaacaactcgccattaacgagctcatatcagatggaaacgtggtgtgtgcagaggccctttgggatcacgtgaccatggatgatcaggaactgggattcaaggccggcgatgtgatacaggtgcttgaggcctctaacaaggattggtggtgggggaggagcgaggataaggaggcttggtttcccgcaagcttcgtcaggctccgagtgaaccaggaggagctatccgagaacagctccagtacaccaagtgaagagcaggatgaggaggcttcacagagtagacatcggcactgcgagaataagcagcagatgcgaaccaacgtgattcgagaaatcatggacacagaaagggtgtacataaagcaccttagggacatttgcgaagggtacatccgtcagtgccgcaaacacaccggtatgttcacagtcgcccagctggccacaatatttggtaacatagaggacatctataaattccagcgcaagttcctgaaagatctcgaaaaacagtacaacaaggaagagccccacctcagtgaaatcggatcatgctttttgcaaaaccaggagggcttcgctatctattccgaatactgtaataaccatcctggagcatgcctcgagcttgctaatttgatgaagcagggaaaatatcgccattttttcgaagcctgtcgtctgctgcagcagatgattgatatcgccattgacggcttcttgctgacccccgtgcagaagatatgcaaataccctttgcaactggcggaactgctcaaatataccactcaagaacatggagattacagcaatattaaggccgcctatgaggccatgaagaacgtagcgtgtctgataaatgaaagaaaacggaaactagagtctatcgacaagatcgcgagatggcaggtgtcaatcgtgggatgggaaggattggacatcctcgatcggagctctgagcttatccacagcggggaactcaccaagatcaccaaacaaggaaagtcacagcaaaggactttttttctcttcgaccatcagcttgtgagttgtaagaaagatctcttgaggcgagacatgctctattataaaggtcgcctcgacatggacgaaatggaactggtggacctgggcgacgggcgtgataaggactgtaacctgtcggtgaagaacgcgttcaagctggtgagccgcacaacagacgaggtttatctcttctgtgcgaagaagcaagaagacaaggcacgctggcttcaagcctgtgccgatgagcgccggcgggtgcaggaagataaagagatgggcatggaaatttccgaaaaccaaaagaagctcgcaatgctcaatgcccagaaggctggccacgggaaatcaaaaggctataaccgatgccctgtggccccaccacaccagggcctgcacccaattcatcaacggcatattacaatgccaacttctgtgccccagcagcaggttttcggcttggccgaacccaagcgaaagtcttccctcttctggcatacctttaatcgactgacacctttccggaagtag

SEQ ID NO: 206784 - DNA, 1959 bp, Artificial Sequence
  Description of Artificial Sequence: Synthetic coding sequence
atgaccagcgccagccccgaggaccagaacgcccccgtgggctgccctaaaggcgctaggcgtcggcgtccaatcagtgtaattgggggcgtatctctgtatggaacgaatcagaccgaagaactggataacctcctcacccagccggctagccggcctcctatgcccgcccaccaggtccccccctacaaagctgtgtcggcccggttcagaccgtttacattttcccagtccacacccatcggcctcgacagggtgggacgcagacgccagatgagagcaagtaacgtgagctccgacggtggaactgaaccctctgctttagtggatgacaatggttcggaggaggatttctcttacgaagatttgtgccaggccagcccgcggtacctccagcccgggggtgaacaattagcaatcaacgagctgatctcggacgggaatgtggtctgcgcagaggcactttgggaccacgtgacaatggacgatcaggagctggggttcaaggctggagatgtgatccaggtcttagaagccagcaataaagactggtggtggggacgcagcgaggacaaggaggcctggttccccgccagttttgttcggctgagggtaaaccaggaggagctgtctgaaaactcctcaagcacaccatccgaagagcaggacgaggaggccagccagtctcgtcatcggcattgtgaaaacaaacagcagatgcggaccaatgtgatccgggagataatggacactgagcgtgtttacattaagcacctgcgcgacatttgtgagggatacatcaggcagtgtaggaaacatacaggcatgtttactgtcgcccagctggctactattttcggaaacatcgaggatatatacaaattccagcggaagtttctaaaggacctcgaaaagcaatataacaaagaagaaccacatttgagcgaaatcgggtcatgctttttgcagaaccaggagggcttcgcaatttattctgagtactgcaataatcacccgggggcctgcctggagctggctaatctgatgaagcagggcaaatataggcacttcttcgaggcctgccgccttctccagcagatgattgacatcgctattgatggttttttactcacaccagtacaaaaaatttgcaaatacccactgcaacttgccgagcttctgaagtacaccacacaggagcacggagactattccaacattaaggccgcctacgaggctatgaaaaatgtcgcttgtctgatcaacgagcgcaaacgcaagctggagagtattgacaaaattgccaggtggcaggtgtctatcgttgggtgggagggactcgacattctggatagatccagcgaacttatacacagcggcgaattgactaagataaccaagcaaggcaaatcgcaacagcgcactttttttctatttgaccaccaactggtctcttgcaagaaagacctccttcggcgcgacatgctttattacaaaggtcgattggacatggacgagatggagctggtcgaccttggcgacggccgggataaggattgcaacctgtcggttaaaaacgcgttcaaactggtgtctcggaccaccgatgaggtgtacttgttttgcgcgaaaaaacaggaggacaaagctcgatggctgcaagcttgtgcagacgagagaagacgtgtgcaggaagacaaagaaatgggaatggaaatttcggaaaatcaaaaaaaactggctatgctgaatgcccagaaggctggccatggcaaatcaaaaggttacaatcgatgccccgttgccccaccccaccaggggttgcatcccatccatcagagacatatcactatgccaaccagtgtaccgcagcaacaggtgtttggtctggcagagccgaaacgcaagtcttctttgttctggcatacgtttaaccggctaaccccgtttcggaagtag

SEQ ID NO: 206785 - DNA, 3834 bp, Artificial Sequence
  Description of Artificial Sequence: Synthetic coding sequence
atgacccaggccgccgtgcggccctgggccccctgcctggagaacatgaccactgccccgaatggtttgggtccggggcctgccgccccatgcgctgggtccgacctgaaggacgcaaagatggttacatcgctggcatgtggcaacggagtctgtggatgctcccctggcggcgacaccgatacccaggaggcaaaactctcacccgccaaactcgtgaggttgttttccaccagcagaaaacggactggggcccaccccgagagacctcattccatggttctcgtgggcaattcaagcacatggaacaccttagcatctttccgcaagatgggctcgttcaagaagcttaagagctctgtactaaaggggatccaatcccgggagggttcaaacgcatgttcaaaaggagaagcatccgagcatggcctggggaaatcaattcctaatggcgcagtgcctggggcccaggccagtcgcggctcccccctcgctcctgggcccgcttgcggggcactgcggcctgccgagtggggcaccctagatggatcagacttggaggataccgatgacgcgtttcagaggtctacccatcgttcccggagcctcaggcgcgcctacggcctgggaagaatctgcctactcgacgcaccacagaaccatgccactccaactatagccactgggcaggtgccagccgtctgcgagattttggtgcgagatcccgaaaacaactctatgggttatcggcgaagcaagtccaccgataacctcgcattcctgaagaagagttcctttaaaagaaagtccaccagtaacctcgcggatctgcgcaccgcccatgacgccagagtccctcaaaggaccctgagttccagttccaccgacagtcagaagctgggctccggcagaacaaagcgctggcgatcacctatcagggccaaagactttgaccgggtcttcaagttagttagcaacgtcaccgaggccgcttggagaagagaatctccaagaagcggcgcaccctctccgggagaagcctctctcaggctgcaggctcactctaggttacatgacgactactcaagaagggtctcaagaagcactgagcaagactcaagacgcgggggcgccgtcatgcatggaacaaccgccacatgtacagtggccccggggttcggatctgctaccagtaagggtccacatctagacgccgacacggcggtgttcccgctggagactaaatccagttgggcggtcgaaagcgacagttcgtgtacctgcagctcacttccctctcccattgtgcaagatgtcctgtctaaagactcttgcgatccaaatgctggctctcagctgacatttgatccggagcaacccccaacgccactgaggcccacaacacctaagcctcaatcaccacagagtccccagagccccggtgccgggagcgcctcatgccatagcaatcacagcgcactgtctgcaaactcagaagagagcgaggggcgggccgaagagcccgcccagagggagcccggaccagtgagcctacaggatccactggaggccacacatggcgacgaaggatcaaaggacctcctggttaatattggggttgcggcaggtcccgaagaaaaggagaaggaagaggtcgtccccgacggaccctggcgcagaagctcctcccaggatgaggaacgtacggaagcacagcgaacacccaagcgccggtggggctcagggcgccgacctagaccaagaccgtttagtgactacggtcagctggcaagccggagtctgagtatccccgaggacagcgtggctgctgatccacagaaagaagacagggtggatgaggatcctcaagcttcaatgacctctgcatcccctgaagatcaaaacgctcctgtcggctgccctaaaggtgccaggaggaggcggcctatctctgtaattggtggggtaagtctgtacggaacaaatcaaacagaggagcttgataacctgctgactcaaccagcctcccgaccccccatgcccgcccaccaggtcccaccatacaaggcggtgagcgcccgattccgccctttcacattctcgcagtcaactccaatagggctcgatcgagtgggacgtagaaggcagatgcgcgcctcaaatgtgtctagcgacggaggcacggaaccaagtgcgctggtcgatgacaatgggtctgaagaggattttagttatgaggatctctgtcaggctagccctcgctacttgcagcccggaggggagcaacttgcaatcaacgaactgatatccgatgggaatgttgtctgtgcagaagctttgtgggaccatgtaactatggatgaccaggagttaggattcaaggctggcgatgtcatacaggtgctggaggcgtctaacaaagattggtggtggggtaggtctgaagataaagaggcctggtttccggcctcctttgtaaggctccgagtgaaccaggaagagctgtcggagaatagctcaagcactccctcagaagaacaggatgaagaggccagccagtctcggcacagacactgtgagaacaagcaacagatgaggacaaatgttatcagggagattatggacaccgagcgggtttatattaaacacttgagggacatttgcgagggatatatccgccaatgccgcaagcacactgggatgtttactgtggcccagcttgctaccatctttggaaatatcgaagacatctataagtttcagaggaagttccttaaagatctggaaaaacagtataacaaagaggaaccccacctctctgagattggatcctgctttctacagaatcaagagggatttgccatctattccgagtattgcaataaccatcccggcgcctgtttggagctagctaatttaatgaagcaggggaaataccggcacttttttgaagcatgtagacttcttcaacagatgattgacatcgcgatcgatggctttctgctgaccccggttcagaaaatctgcaaatatcccctacagttggcagagctgctgaagtatacaactcaggagcatggtgattatagcaacattaaagccgcttatgaggccatgaaaaacgttgcatgcctgatcaatgagaggaaacgcaagctcgagtctatcgacaagattgcccgttggcaagttagtatcgtaggctgggagggactcgacattctagaccgctcctctgaactgatccatagcggggaactcacgaaaatcacaaagcaagggaagagtcaacaaaggacatttttcctttttgatcatcaattggtgagctgcaagaaagacctcctgagacgtgacatgctgtactataagggacggctggatatggacgagatggagctagtcgatctcggcgatggtcgtgacaaagactgcaatcttagcgtgaaaaacgctttcaagctggtaagccgcactaccgatgaggtttatttattttgtgctaaaaagcaggaggacaaggctcggtggttacaagcttgcgccgatgagagaagaagggtccaagaagataaagaaatgggaatggagatcagcgagaaccaaaagaaactggccatgttaaacgcacagaaggctggacacgggaagagtaaaggctacaatcgctgtcctgtcgccccacctcaccaaggtttgcacccaattcatcagagacatattacgatgcccacttctgtcccacagcaacaggtgtttgggctagccgaacctaaacgtaaaagttccttgttttggcacacctttaaccggctgacgcctttccggaaatag

SEQ ID NO: 206786 - DNA, 3948 bp, Artificial Sequence
  Description of Artificial Sequence: Synthetic coding sequence
tgacccgtggccacccaggagcccgacgtgcagggccggtgcgagtgccaggacggcatccctggagatgagggccttgagctcaggtccgctgacagtgccgtgcctgttgccatgacccaagccgccgtgcgtccatgggctccctgcctggagaacatgactacagcccccaatggtctgggccccgggccggccgcaccatgcgctggttccgacctgaaggatgccaaaatggttacgtccctcgcatgcggcaatggggtatgcggctgcagtcctggcggcgataccgacacccaggaagcaaaactctctcccgccaaattggtgcgccttttctccaccagccgcaaacgcacaggcgcccacccagagagaccacacagtatggtcttggtgggtaattctagcacttggaacacattagctagtttccggaaaatggggtctttcaaaaaactgaaatccagtgtactgaagggcattcagtctcgagagggctccaacgcatgtagtaaaggcgaggccagtgaacacgggctggggaagtccataccgaacggcgcagtacccggagcccaggcatccagaggctctcccctggccccgggtcctgcatgtggggcactgaggcccgccgaatggggaaccctcgacgggtccgacctagaggacactgacgacgcttttcagagaagcacccatagatcgcgtagcctccgcagagcatacggcctaggtaggatctgtctcttggatgccccacagaatcacgccacacctaccatcgcaaccggacaggtgcccgccgtctgtgaaatcctggtgagagacccagagaataactccatggggtataggcgcagcaagtctactgacaacctggctttcctgaagaagtctagctttaaacgtaagtccactagcaatcttgccgatttacgcacagcgcacgacgcccgggtacctcagcgcaccctgtccagctcaagtacggactcccaaaaactgggcagtgggagaactaagcgttggaggtcaccgatacgagcaaaagactttgaccgggtattcaaactggtgtccaacgtcactgaggcagcatggcggcgagagagccctagatccggagcaccgtcaccaggtgaggccagcttgcggctgcaggcacattcaagattacatgacgattactcaagaagagtttcaaggtcgaccgagcaggactccagacggggtggcgcagtgatgcatggtaccaccgctacctgtaccgtggcaccgggcttcggctccgcgacgtcgaaagggccgcacctcgatgccgacactgcagtctttccactggagaccaagtcttcctgggcagtggagtcagattcttcgtgtacctgtagttccttgcccagcccgatcgttcaggacgtgttaagtaaggacagctgtgacccaaatgctggctcacagctgacattcgaccctgagcagccaccgacacccctccgacccaccactcctaagccccagagcccacagtccccacagtctcccggtgccggatcagcctcttgtcattctaatcattctgctctctccgctaacagtgaggagtcagaagggagggctgaggagccggcgcagcgggagccagggccagtgtccttacaagatcctttggaagccacccacggggacgagggtagtaaagacctgctggtgaatattggtgtcgctgcaggacctgaggagaaggaaaaagaagaggtagtgcctgatgggccctggcgacgatcctcgtctcaggacgaggaacgcactgaggcacagagaacacctaagcgccgatggggctccggaaggagacccaggcctcggcctttcagcgactatggtcagctcgcctcccgatccttgtcaatccccgaggattctgtcgccgctgacccccagaaagaagatagagtggatgaggatccacaggcctcaatgactagcgcgtctccagaggatcagaatgcccctgtggggtgcccaaaaggcgcccggcgcagacggcctatttcagtcataggaggggtgtcgttgtacgggaccaatcagacagaggagctcgacaatctgctgacccagccggcctctcgtccacctatgccagcacatcaagtgccaccatacaaggctgtgtccgccaggttcaggccttttacgttttctcagagcactcccatcggtctggatcgggtggggcgacggcgccagatgagagcttccaatgtctcttccgatggcggcacagagccctctgctctagtggatgataacggttcggaggaagacttcagctacgaggatctctgccaagcctcccctcggtatctgcaacccggtggcgaacagctggccataaacgaactgatctccgacgggaatgtggtgtgtgccgaggcactgtgggaccacgtgacgatggacgaccaagaacttggcttcaaggctggagatgttattcaggtgttagaagcatctaacaaggactggtggtgggggcgcagcgaggacaaggaggcctggttccccgctagcttcgtgcgtttacgggtgaaccaagaagagcttagtgaaaatagcagttccacaccttcagaggagcaggacgaggaagccagccagtccagacatcgacactgtgagaataagcagcagatgcggacaaacgtgatccgcgagatcatggataccgagagagtgtacatcaaacatctgcgggatatctgtgaggggtacataaggcagtgcaggaagcacactggaatgttcaccgtcgctcagttagctacgatcttcggaaacattgaggacatctataaatttcagaggaaattcttgaaggacctggagaaacagtataataaggaagaaccgcatctgtcggagatcggatcatgctttcttcaaaaccaggagggcttcgccatatatagtgaatactgtaataatcatccaggggcgtgtcttgagctcgcaaatcttatgaaacagggaaaataccggcatttctttgaggcatgccgcctgctgcaacagatgattgacatcgccattgacggattcctgctgacaccggtccaaaaaatctgcaaatatccattacagctcgcggagttgctgaagtataccacccaagagcacggcgactactcaaacattaaggcagcatacgaagcaatgaagaacgtggcctgccttatcaacgaaagaaagcgcaaactggaatcgattgataaaatcgcccggtggcaggtgtctatcgtaggctgggagggcctggacattttggatagatcatctgagctgatccatagtggggagctaacaaagataactaagcaaggcaagtctcagcagaggaccttctttttatttgatcaccagcttgtgtcctgtaagaaagatctactgagacgagacatgttatactacaaaggcaggctcgatatggatgaaatggaacttgtggacctcggagacggccgggacaaggactgtaatctctcagtaaaaaacgcatttaaattggtttcccggactacagacgaggtttacctgttttgtgcaaaaaagcaggaggacaaggccaggtggttgcaggcttgtgccgatgagagaagaagggtacaagaagacaaggagatgggcatggaaattagcgagaatcagaaaaaattggcaatgctgaacgcccaaaaagctggacatggcaagagcaagggctacaatcggtgtccagtggccccaccccaccaagggttgcatcctattcaccagcgccacattacaatgccaacttcagttccacagcagcaggtctttggcctagccgagccgaagcgaaagtcatccctgttttggcatacatttaacagattgacacccttccgcaagtag

SEQ ID NO: 206787 - DNA, 1851 bp, Artificial Sequence
  Description of Artificial Sequence: Synthetic coding sequence
atgcccgcccaccaggtgcccccctacaaggccgtgagcgcccggttcaggccattcacctttagccagagcacaccgatcggcctggatcgcgtcggaaggcggaggcaaatgagggcaagcaacgtgtcatcagatggaggcaccgagcccagtgccttagttgacgacaatggctcggaggaggatttcagctatgaagacctatgtcaggccagtcctaggtacttgcaacctggcggggaacagctcgcaataaacgagttaatctccgacggcaacgtggtgtgcgcagaggcgctctgggatcacgtgaccatggatgatcaggaactgggtttcaaggctggagatgttatccaggtgcttgaagctagcaacaaggactggtggtgggggaggtctgaggacaaggaagcctggttccctgctagtttcgtgaggcttcgggttaatcaggaagaacttagcgaaaactcttcctccactccgtccgaggaacaggacgaggaagctagccagtcccgtcaccgccactgcgagaataagcagcagatgcgcaccaacgtgatcagggaaatcatggataccgagcgtgtctacataaaacacctgcgagatatttgtgaaggatatataaggcagtgtcgaaagcatactggaatgttcacagttgcccagctggccactattttcggcaacatcgaagatatttataaattccaacggaaatttctgaaagacctggagaaacagtacaacaaggaagagccacacctgagcgagataggatcttgctttctacagaatcaggaagggtttgcgatttacagcgaatattgcaataaccacccgggggcctgtctcgagttagccaacttaatgaaacaggggaaataccgccacttctttgaagcatgcaggctccttcagcaaatgatagatatagccatcgatgggtttctgctcaccccagtgcagaaaatctgcaagtatcccctgcagcttgccgaactgttgaagtacacgacacaagaacacggcgattactctaacattaaagccgcctacgaagcaatgaaaaacgtggcgtgcttgatcaatgaaagaaaaagaaaactggaaagcattgacaagatcgcccggtggcaggtgtcgattgtggggtgggaaggactagacatccttgacaggagctctgagctaatccactctggagaactgacgaaaatcacgaagcaggggaagtcacagcagcggaccttttttctgtttgatcatcagctcgtctcctgcaagaaggatctcctccgtcgcgacatgctctattacaaaggtaggttagatatggacgaaatggagctggtggatcttggggatgggcgagataaagattgcaatcttagtgtgaaaaacgcctttaagctggtttctagaacgacagacgaggtctacctattctgcgctaaaaaacaggaggataaggcccgctggcttcaggcatgcgcagatgagcgccgacgagtgcaggaagataaggagatgggtatggagattagcgagaatcagaaaaagctggcaatgctgaatgcgcagaaggctggacacggcaaaagtaaagtacgactgcagcaggttccctgcggcccaacagctcccgggcctgccccccaccccccagcccctcatcattacgcgcacaaacggccccctgccgctggtctgtggcctggaggaacccaggaagaggtcttggcactgctggcccacctgcaacaggcccatccactgccagaaatgaaaactggaggttgcgccagtatggaactgggcgtcaaaaggaggaactag

SEQ ID NO: 206788 - DNA, 1710 bp, Artificial Sequence
  Description of Artificial Sequence: Synthetic coding sequence
atggacgccggcagcagccggagcctggagaacgccgtgaaccggatctaccacgatcaattggtgcccaagatcaatacttcaaagaagatgagcacgcttgcccaccctcccaatatccttgaaatgtcccaggagatcaagaagaattgcggaggaaagcaggtggaaataaccctggagcggacaaaaatgaccaagggtatcaaagaaaagcagtctaacgaccttgaaaaggccgccttcaaaagaaaggcagagggcgaagagaagcctacccgcaagaaacaggctaaaatcaccgaactggacaaccaactcatcactatgccacttcctcatatcccactgaaaaatatcatggatgtggaaatgaaactggtatatattgatgagatgggcgtgcgttacgagtttgtcgaaagtttcatgtccactggcagtcagcccacatgtcaggctgccgaaattgttgatcccttgtctgtccataatttctcattcctgccccagatagacaagtggttacaggttgccttgaaggacgcatccagctgctaccggcagaagaagtacgctctcgctgcagggcaattcagaactgctcttgaactgtgcagcaaaggggccgtgttgggcgagcctttcgatgcccctgccgaggacattgcgtctgtcgcatcctttatagaaactaagcttgtgacttgttatctccggatgcggaagcctgacttggccttgaaccacgcccacaggagcatagtgctgaatcctgcatactttaggaaccacctacggcaggcgacggtgttccggtgtctggagcggtactccgaggccgctcggtctgcaatgatcgccgactatatgttttggctgggtgggggccgcgaagaatctatttctaaattaattaaattgtattggcaggcaatgatcgaggaggccattactagagctgaatcgttttctgtcatgtatacgcccttcgcaactaagatcagagctgataaaatcgagaaggtgaaagatgctttcactaagacccacccagcctacgctgaatacatgtataccgatcttcaggccctccacatgctcccacagactgtcgactggtcgtcctttccacctcaacagtatctgctcaccctgggattcaaaaataaagacgacggcaaattcctagagaaaataagttcgcggaagctgccaatctttactgagcataaaaccccctttggcttgacaagagaggatactgttcgacaaatggagaccatgggtaaacgaatcctgccaatcctggatttcattaggtctacacagctcaacgggtcttttcctgcttcgtcaggagtgatggagaaacttcagtacgcctctcttctttcacagctacaacgagtgaaagagcaatctcaagtgattaaccaggctatggccgagctagcgacaatcccatatttgcaggatatttctcaacaagaggccgagctgctccagagtttgatggcagacgcgatggatacgctagaggggcggaggaataacaatgagcgtgtgtggaacatgatccaaaaggtaggacagatcgaagactttctgtaccagctcgaagatagttttcttaaaacaaaaaagctccggacggccaggcgtcagaaaactaagatgaagcggctgcagaccgtccagcaaaggtag

SEQ ID NO: 206789 - DNA, 1086 bp, Artificial Sequence
  Description of Artificial Sequence: Synthetic coding sequence
atggccaccctggcccggctgcaggcccggagcagcaccgtgggcaaccaatactactttagaaattcagtggtcgatccttttcggaaaaaagaaaacgacgccgccgtaaaaattcaatcttggttccgcggctgtcaagtacgggcgtacattagacatctgaacagaatcgtcaccatcatacagaagtggtggcgcagttttcttggccgaaagcaataccagctgacagtacaggtggcatattacaccatgatgatgaacctttacaacgcaatggcggtgcgaatacagagacggtggcgcggttaccgcgtcaggaaatatctgttcaactattactatttgaaggaatatctgaaggtggtgagcgaaaccaatgacgctatccggaaggcccttgaggaattcgcagagatgaaagaaagagaggaaaaaaaggcgaacctcgaacgggaggaaaagaagcgagactaccaggcccggaagatgcactatctcctgagcaccaaacagatacctggcatctacaacagccccttcagaaaggaacccgacccctgggaactgcaactgcaaaaagctaagccacttacacatcgcaggcccaaggtgaaacagaaggactccacttccctgaccgactggctggcttgcacctcagcccgaagctttcctagatcagaaattttgccgcctataaatcgtaagcaatgccagggtccgttccgcgatattacagaagtgctagagcagcggtacagacctctggagccgacactgcgtgtggcagagccaatcgatgagttgaagctggccagggaagagctacgaagggaagaatggttgcagaatgtgaatgacaatatgttcctgccgttttcaagctatcataaaaatgaaaaatacattccctctatgcatctgagttctaaatacggaccaatttcttataaggagcagttccgtagcgaaaacccaaaaaagtggatctgcgataaggacttccagacagtcctcccaagttttgagctgttttccaagtatggcaaattgtatagtaaagctggccaaattgtgtag

SEQ ID NO: 206790 - DNA, 1617 bp, Artificial Sequence
  Description of Artificial Sequence: Synthetic coding sequence
atggccgagaacctgaagcggctggtgagcaacgagaccctgcggactctgcaggaaaagcttgatttttggctgaaggaatataataccaatacatgcgatcagaacctcaatcactgtttggagctcattgaacaggtcgcgaaggttcaaggccagctgtttggtattctgacggctgctgcccaggagggggggcggaacgacggagttgaaacgatcaaaagcagattactaccctggcttgaagccagtttcactgccgcttcgttgggcaagtctgtcgactccaaggtcccttccctgcaggacactttcgaccgcgagaggcataaagaccccagcccccgcgatagagacatgcagcaactcgatagcaacttgaactcaactagaagtcagtgcaatcaggtccaggatgacctggtggaaacagagaaaaacctcgaggagtctaaaaaccgaagcgctatcagtctgctggcagccgaggaagagattaaccagctcaaaaaacagttgaaaagcctgcaagcccaagaagatgccagacatcgcaataccgaccagcgaagctctgagaataggaggtccgaaccatggtcactggaggaaagaaaaagggaacagtggaatagcctgaagcagaatgccgaccagcaggatacagaggccatgagtgactataagaagcaactgaggaacctgaaggaggagattgctgtattaagcgccgagaaatcagccttgcaaggaaggtcatctaggtctcgcagtccgtcccctgcgccacgctcccggagttgttccaggtcccggagtgcaagccccagcactgccgtcaaggtacgccggccctccccgaaccgctcgaagctgagcaatgttgccaggaaagctgccctgctctctagattttctgacagctactctcaagccagactggacgcccagtgtcttctgcgtcggtgtattgacaaggctgagaccgtacagaggattatatacatcgccacagtggaggcatttcacgtggccaagatggccttccggcatttcaagatccatgtgcggaagagtcttactccgtcatacgtaggcagcaacgactttgaaaacgcggtcctggactatgtgatctgccatttggacctctacgattctcagtctagcgtcaatgacgtgattagggccatgaatgttaatccaaagatttccttcccaccagtcgtggacttctgcttactcagcgacttcatacaggagatttgttgcatcgcgtttgccatgcaagccctggagccacccctggacatcgcctatggcgctgacggagaggtgttcaatgattgcaaatataggaggagctatgatagcgactttaccgcgccgctagtcctgtatcacgtctggcccgctctgatggagaatgattgtgtcatcatgaagggtgaagccgtcactcgtcggggagccttttggaactcagtgagaagcgtctctcggtgtagaagtcgctctctgtcacccatttgtccaaggtcgcagattggcttgaacacaatgagccgaagcaggagcccttcccctatccgctgtggactgcctagattctag

SEQ ID NO: 206791 - DNA, 504 bp, Artificial Sequence
  Description of Artificial Sequence: Synthetic coding sequence
atgatcatcaccacctggatcgtgtacatcctggcccggaagggcgttggcctaccattcctccccataaccagtagtgacattgacgtggtagagtcagaggccgtctcagtgctgcaccactggctcaaaaagactgaagaggaagcttctagaggcattaaggaaaagctgtcgataaatcacccatcacaaggcgtccgcgagaaaatgagtacagacagtccacccacacatggccaggacattcacgttacgcgcgacgtagtgaagcatcatctcagcaagagcgatttgctggccaaccagagtcaagaggttctggaagagcgcactcggattcaatttattcgatggagtcacacacgaatctttcaagtgcccagtgagatgaccgaggatattatgagggacagaatcgagcaggtgaggcggtccatctcgcggctcactgacgtgtctgcccaggacttctcgatgcgaccctcatcttccgattgctag

SEQ ID NO: 206792 - DNA, 504 bp, Artificial Sequence
  Description of Artificial Sequence: Synthetic coding sequence
atgatcatcaccacctggatcgtgtacatcctggcccggaagggcgtgggcttgcccttcttacccatcacttctagcgacatcgacgtcgtggaatcagaagcagtttctgtcctgcatcattggcttaagaagacagaagaggaggcatcccggggcatcaaggaaaaactgtcaataaaccacccatcccagggcgtgagggagaagatgagcaccgacagccctccaactcatggccaggatatccatgtcacacgcgatgtcgtgaagcatcacttatccaagtctgacttgttggcaaaccagagccaggaagtgctagaagagcggactaggattcagttcatcagatggagccataccagaatattccaggtcccctctgagatgaccgaagacatcatgcgggacagaatagagcaggtgcggcgctcaatttcccggctgaccgacgtctccgcccaggacttttccatgcgtcctagctcttccgattgctag

SEQ ID NO: 206793 - DNA, 1563 bp, Artificial Sequence
  Description of Artificial Sequence: Synthetic coding sequence
atgggcaagcccagcagcatggacaccaagttcaaggacgacctgttcaggaagtatgtccagtttcacgagagcaaggtggacaccaccacctctcgtcagcggcccggttcagacgagtgtctgagggtggctgctagtacgctgctgtccctccataaagtggatcctttctaccgatttcgtctcattcagttctatgaggttgttgaaagttctctccgaagcctgagcagctctagtctgcgggcactgcacggcgcgttcagcatgctcgagaccgttggcattaatctctttctgtatccgtggaagaaagagttccggagtatcaaaacctacaccggacctttcgtatattatgtcaagtctacactgctggaggaggacattagagccattctgagttgtatgggctacaccccagagctgggcacagcgtataaactgagggaactggtcgagactttgcaggtgaagatggtgagctttgagctgtttctggcaaaggtcgaatgtgagcagatgctggaaatccattcacaggtgaaagacaagggctattcggaactcgatatcgtgagtgagcgtaagtcctctgccgaggatgtgagaggatgttctgatgctctgcgacgccgagcggaaggcagggaacacctcaccgcgtcgatgagcagagttgctctgcagaaatctgcttcagagagggcagctaaagactattacaagcccagggtcacaaagcctagtcgcagcgtggacgcctacgacagttattgggaatccaggaaacctccgctcaaagcctcgctgagccttcggaaagagccggtcgccacagacgtgggagacgatctgaaggatgagattatccgcccgtctccctccctgctgacaatggcttctagccctcacgggtcccctgatgtgctgcctcccgcatccccgtcaaatggtcccgccctcctgcgtgggacatacttttccacccaggatgacgtggacctgtatacagattccgaaccccgggccacatataggagacaggatgctttgcgacccgacgtttggctgctgcgcaacgatgcccattctctctaccacaagagatctcccccagctaaagagagtgctttgagcaagtgtcagagttgtggcctctcctgtagctccagcctgtgtcaaagatgcgactctctgttgacgtgccccccagcctcaaagccgtccgccttccccagcaaggcttccactcatgacagcctagctcacggcgcttctctcagagaaaaatatcccgggcagacacaggggttagatcgacttcctcatctccactctaagtctaagccatctactaccccaacttcccgctgcggtttttgcaataggccgggcgctacaaacacctgcacccagtgtagtaaagtgtcctgtgatgcctgcctcagcgcataccactatgatccatgttacaaaaagtctgaactgcataaattcatgccaaacaaccagcttaactacaagtcaacacaactgtcacacctggtgtaccgctag

SEQ ID NO: 206794 - DNA, 1563 bp, Artificial Sequence
  Description of Artificial Sequence: Synthetic coding sequence
atgggcaagcccagcagcatggacaccaagttcaaggacgacctgttccggaaatatgttcagtttcatgaaagtaaagttgatacaacaacgtccagacagaggccggggtccgacgaatgcctccgagttgctgccagcacactgttgagcctgcataaagtcgaccctttctatcggttccggctgatccagttctatgaagtagtcgagtctagcctgcgttctctttcctccagttctctacgggctttgcacggcgctttcagcatgctcgaaaccgtcgggatcaacctcttcttatacccctggaagaaggaattcagatccatcaaaacttatactgggccgtttgtgtattatgtcaaatcaacactgctcgaggaggacatccgggccatcctgagctgcatggggtacaccccggagttgggtacagcttacaaactccgcgagctcgtggaaaccttgcaggtgaagatggtgtccttcgaactgttcctggctaaagtcgagtgtgagcaaatgctggaaattcacagtcaggttaaggacaagggatatagcgagctcgatatcgtcagcgaacgcaagtcttccgcggaggatgttagaggatgcagcgacgccctgaggcggcgggcagaaggtagggagcatctcacggcttccatgtcgcgcgtggctctccagaaaagtgcaagcgagagagccgccaaagattactacaagcctagagtcaccaagccctcgcgctcagtggatgcttacgattcatattgggaatccaggaaaccacctctaaaagcttcactgagcctgcggaaagagcctgtggcgaccgacgttggagacgatctgaaagatgaaataattagaccttcaccttctctcctgaccatggcttcatcgccgcacggcagtcccgacgtcctgcctcctgccagcccaagcaacgggcctgctctcctgcgcgggacctacttctccacacaggacgatgtggacctttatactgattccgagcccagggctacgtacagacgccaagacgccctaagacctgatgtctggttgctgcgcaatgatgcacatagcctgtatcacaagcgcagtccacctgccaaggagtcagcactttcaaaatgtcagtcatgcggactatcttgcagctcctcactgtgccaacgctgcgattctctgctcacctgcccccctgcttctaagcccagcgccttcccgagcaaggcgagcacccacgactcgctcgcgcacggcgccagtctgagggaaaaataccctggccaaacccaaggactagatcgactcccccatctgcacagcaagagcaagcctagcacgacccctacatccagatgtgggttttgtaacagaccaggcgcaaccaacacctgcacgcagtgtagcaaagtctcttgcgatgcttgtctaagtgcctatcactacgatccatgctataagaagtctgagctacacaagtttatgccgaacaatcagctcaactataagtccacacagctgtcacacctagtgtaccggtag

SEQ ID NO: 206795 - DNA, 1152 bp, Artificial Sequence
  Description of Artificial Sequence: Synthetic coding sequence
atgggctacacccccgagctgggcaccgcctacaagctgcgggagctggtcgaaactctgcaagtgaaaatggtctcattcgagttattcctggccaaggtggaatgcgaacagatgctcgagattcactcccaggtcaaggacaaaggctactcagagcttgacattgtctcagaacgcaagtcttcagccgaagacgtgcgcggatgtagcgacgcattaagacgaagagcagaaggccgggagcacttaaccgcgtccatgagccgggtcgccctgcaaaagtccgctagtgagcgagccgccaaagattattataaacctcgcgtgactaagcctagtcgctctgtggacgcctacgactcttactgggagagcaggaaacctcctctgaaagccagcctgagtctgcgcaaggagccggtcgctaccgatgtgggagatgacttgaaggatgagatcatcaggccatctccctctctgctcaccatggcctcctcaccccacgggtctccggacgtcctgcctccagctagccctagtaatggacctgctctgcttaggggcacttacttctccacacaggacgacgtcgacctgtataccgactctgaaccgagagccacatataggcgacaggatgctctgcgcccggatgtatggttgctaagaaacgatgcccattccctgtaccacaaacgatccccacccgccaaggagagtgccctatctaagtgccagagctgtggcctcagctgctctagcagcctatgccagcggtgcgactctctcctgacttgtcctcccgcaagcaagccatctgccttcccttccaaggcctctacccatgattccctcgcccatggagcatctctgagggagaaataccccggacagacacaaggccttgatcgactgcctcatctccattcgaagtcgaaaccctcaacaacaccaacaagtcgctgcggcttttgtaatcgtcccggagctacaaatacctgtacgcagtgcagcaaggtgtcttgtgacgcctgtctgtcagcgtatcattacgatccatgttacaaaaaatctgagctgcataaattcatgcctaacaaccagctcaactacaagtccacccaactttcccatctggtgtacagatag

SEQ ID NO: 206796 - DNA, 2409 bp, Artificial Sequence
  Description of Artificial Sequence: Synthetic coding sequence
atgctgggcgcccgggcctggctgggccgggtgctgctgctgccccgtgctggtgccggacttgctgcttccagaagatgccccggagtgtggcctagaacatggccacacaggagcccaagtcggggctcgtcatcaagggataaggacaggtcggccacagttagttcttcggtccctatgcccgcaggtgggaagggctctcacccctcttccacccctcagcgcgtgcccaatagactgatccatgagaagtccccctatctgctgcagcatgcttataaccctgtcgactggtacccatggggccaggaggcctttgataaggctaggaaagagaacaagcctatcttcctgtccgtggggtacagtacctgtcattggtgccacatgatggaagaagaaagtttccagaacgaggaaatcgggaggcttctttcagaagatttcgtttccgttaaggttgatcgcgaggaaaggcccgatgtggacaaggtgtacatgactttcgtacaagcaacgagtagtggaggcggctggccaatgaatgtctggcttacacccaatctacagccctttgtcggagggacttacttccctccggaggatggtctaacgcgggtaggtttccgaacagtgctgttgcggatccgtgaacaatggaagcaaaacaagaataccctgctcgagaactcgcagagggtcaccactgccctgctggctcggtcagaaatatctgtaggtgaccgccagctgccaccatcagcagctacagttaacaatcggtgcttccagcaacttgatgagggctacgatgaggaatacggagggttcgctgaggcccctaagtttcccacgcccgtaatcctgtctttcctcttttcctattggttatctcacaggctgacccaagacggaagccgcgcacaacaaatggctcttcacacgttgaaaatgatggcaaacggaggaataagagatcatgtcggacagggattccatagatactcaactgatagacaatggcatgttccgcattttgaaaagatgctgtacgatcaggcgcaactagctgttgcctattcgcaggcattccagctcagtggggacgagttttattccgacgttgctaagggcatcctccaatacgttgccagatcgctgtcccacaggtccggaggcttttacagcgcagaggatgccgatagcccgcccgagcgtggccagaggcctaaagagggggcatattacgtgtggacagtgaaagaagttcagcagctgctgcccgagcctgtgctcggagctactgaacccctgacaagcgggcagctgctgatgaaacactacggtctgaccgaggcgggaaacatctcccccagtcaggatcccaagggcgaattacagggtcagaatgttctgactgtgagatacagcctggaactgaccgctgcccgattcggcctcgacgtggaggcagtgcgcacactgctgaacagcgggctggagaaactgtttcaggccagaaaacaccggcctaaacctcatctggattccaagatgctggcagcctggaatggcctgatggtgtctggttatgcggtgacaggagccgtgctggggcaggatcggctgattaactatgccaccaatggcgcgaaattcctgaaaaggcacatgtttgacgtcgcgtccgggcgcttgatgcgaacctgttataccggcccaggtggcacggtggaacactccaacccaccctgctggggttttcttgaagactacgcctttgttgtacgcgggctactggatctctatgaggcgagccaggaaagcgcatggctagaatgggccctgcggctccaagacactcaggataaacttttctgggactcgcaagggggaggatacttctgtagtgaagccgaactgggggccggccttcctcttaggcttaaagacgatcaggacggagcagaaccttctgcgaactcggtgtcagcacacaaccttctccgcctgcacggattcaccggccacaaggattggatggataaatgcgtgtgtttgctgactgctttcagcgaaagaatgcgaagggtaccagttgccctgcccgaaatggtgcgagccctcagcgctcagcagcaaaccttgaagcagatcgtcatctgtggggaccgacaagccaaggacacaaaggccctggtgcagtgtgtccattccgtttacatccccaacaaggtgcttattttggctgacggcgatccttcgtcattcctgagccggcagctgccgttcttatccacactgcgccgcctggaggatcaggcaaccgcctacgtatgtgaaaatcaggcgtgtagtgtgcccatcacagatccgtgtgaattgcggaagctgctgcacccatag

SEQ ID NO: 206797 - DNA, 2361 bp, Artificial Sequence
  Description of Artificial Sequence: Synthetic coding sequence
atgctgggcgcccgggcctggctgggccgggtgctgctgctgccccgcgccggtgctggcctcgccgcctctcgacgaggatcatcgtccagggataaagaccggagcgcgacagtatcgtcttctgtgcccatgcctgctggaggtaaaggctcacatccctcctcgactccccaacgtgtgcctaatcggctgatccacgaaaagagtccttatctactgcagcacgcctacaaccccgtggactggtacccgtgggggcaggaggcctttgataaagccagaaaagaaaataaacccatctttctgtctgttggatacagcacctgccactggtgtcacatgatggaggaagagtcctttcaaaacgaagaaatcggcagactcctttctgaagactttgttagcgtgaaggtagacagagaagaaagaccggatgtggacaaggtatacatgacctttgttcaggcaaccagcagcggcggaggatggcccatgaatgtgtggctcacccctaatctgcaaccatttgttggcggaacttattttccacccgaggatggcctcactagggtcgggttccggaccgttcttttacggattcgcgaacagtggaagcagaataagaataccttgctggagaattctcagagagttacaacggctttactggcgaggtcggagatctccgtaggtgatcggcagcttcccccatccgcagccacggtgaataacaggtgtttccaacagctcgacgaaggctatgacgaggaatatggggggttcgctgaagctcccaagttcccaactcctgttatcctcagtttcctcttctcgtattggctatcccaccggctgacccaggatggttcccgcgctcaacagatggcactgcatactttgaaaatgatggccaatggaggcataagagaccatgtgggccagggatttcatcggtattcaacagaccggcagtggcatgtccctcatttcgagaaaatgctctatgatcaggcacagcttgctgtggcctatagtcaggcttttcagttatctggcgacgagttctatagtgatgtggcgaagggaatacttcagtacgtggccagatcactgtcccacagatctggcggattctactcggccgaggacgctgatagcccccccgagcggggacagcgcccaaaggaaggagcctattatgtgtggacagtaaaggaagtgcagcagctgctcccagaaccagtgctgggagcaaccgagcctctcactagtggtcagcttctgatgaagcattacgggctgaccgaggcgggcaacatctcacctagtcaggatccaaaaggagagctccagggtcagaatgttctcaccgtgaggtacagcctggaactcaccgcagctaggttcggccttgatgttgaggcagtgcggaccctgctcaactctgggcttgagaagctgttccaagccagaaagcataggcctaagccacacctcgatagcaagatgcttgccgcctggaacgggctaatggtaagcggatacgccgtgaccggcgcagtgctcggtcaggataggctgataaactacgctaccaatggagccaagttccttaaaagacatatgttcgacgttgccagtggacggctgatgaggacgtgctacactggtcctggcgggacggtggaacactctaaccctccctgttggggctttctggaggattatgccttcgtcgttcgtggcctgcttgacctctacgaggcgagtcaggaaagcgcctggttggagtgggctctcaggttacaggacacacaggacaagctcttctgggactcccagggaggggggtatttctgctccgaagccgagctaggagcagggttaccattgaggcttaaagatgatcaggacggagcggaacccagtgccaactctgtgagcgcccacaatcttctaaggctgcatggttttactggtcataaggactggatggataaatgcgtctgtcttctgacagccttctccgagagaatgcggagggttcctgtggcgctgcccgaaatggttagagccctcagtgctcaacaacaaacacttaaacagattgtcatctgtggggatcggcaggctaaagacacgaaggccctggttcagtgcgtgcattccgtatacattccaaacaaggtgctcattttggcagatggcgatccctcctcattcctgagtagacagctcccgttccttagcacgctgcggaggctggaagaccaggcgactgcatacgtttgcgaaaatcaagcgtgtagcgttcccatcactgacccatgcgagctgcgcaaactgctgcacccatag

SEQ ID NO: 206798 - DNA, 2229 bp, Artificial Sequence
  Description of Artificial Sequence: Synthetic coding sequence
atgcccgccggcggcaagggcagccaccccagcagcaccccccagagggtgccgaataggctgatccacgaaaagagcccctacctcctgcaacatgcctacaatccagtggactggtatccgtggggacaagaagcattcgataaggcgcggaaagagaacaagccgattttcttgtctgtgggttattcgacgtgtcactggtgtcacatgatggaggaggaaagctttcaaaacgaagagattggccgcctgttgtctgaagacttcgtcagcgtaaaggtggatagggaggagaggcccgacgtcgataaagtatacatgacatttgtccaggccacatcaagcggaggaggatggcccatgaacgtctggttaacccccaacttgcagccatttgtgggtggtacctacttcccgccagaggacgggctgactcgcgtgggctttcggacggtattactgcgcatccgggagcagtggaagcagaataagaacacactgctcgaaaactcccagcgagtcacaacagccctcctggcccggtcggaaatctcagtgggggataggcagctaccacccagtgcggctacagtaaacaaccgctgctttcagcagctcgacgagggttacgatgaggaatatgggggcttcgccgaagcccccaaatttccaacgccagtcatactgagtttcctgttctcttattggctgtcccaccgcctgacacaggacggtagtcgcgcccagcaaatggccctgcatactttaaagatgatggcaaacggcggtattcgagaccatgttggccagggctttcaccggtattctacagataggcagtggcacgtgccccactttgagaaaatgctctatgaccaggcccagctggccgtggcctatagtcaggctttccaactctctggagatgagttctattctgacgtggccaagggaattttgcagtacgttgctagatcccttagccatcgctccggtggcttttactcagctgaggacgccgattctccccccgagcgtggtcagaggccgaaggaaggagcttattacgtgtggaccgtcaaagaggtgcagcagctattgccagaaccagtgctgggggctactgagcctctgacatcaggacagctactgatgaagcactatggtctgactgaggcggggaacatctccccaagccaggatcccaagggtgaactgcagggacagaatgtgttgactgttaggtacagtctcgagctgacagcagcaagatttggtctcgatgtggaggccgtacgaaccctactcaatagcggacttgagaaactgtttcaagcacgaaagcaccgccccaaacctcatctggatagtaagatgctggctgcctggaatggtttgatggtgtccggatatgccgttacaggcgccgtgctgggacaagatcgtctgataaactacgctacaaacggcgccaagttcctgaagcgccatatgttcgatgttgcttctggccgactcatgcgcacctgctacactggaccagggggcaccgttgagcactctaacccaccatgctgggggttcctggaggactacgcatttgtcgtgaggggtctcctggacttgtatgaggcttcacaggagtctgcctggctcgagtgggccctacgactgcaggatactcaggacaagctattctgggacagccagggaggagggtatttttgcagtgaagcggagctaggagctggcctgcccctgcggctgaaagacgaccaagacggggcagagccaagtgctaacagcgtgtcagcccacaacctactcaggctccacggcttcactggacacaaagactggatggacaaatgcgtgtgccttctaaccgcattctcagagcggatgaggagagttccggttgcattgcctgagatggtgcgagccctgtccgcgcagcagcagactttaaagcagattgtgatctgcggggaccgtcaagcaaaggataccaaagcccttgtgcaatgtgtccatagcgtttatatccccaataaggtactgattctggccgatggcgaccctagcagtttcttatccagacagctaccctttttaagcactctgcgtaggttggaggatcaagctaccgcctacgtgtgcgagaatcaggcttgtagtgtgccaattaccgatccatgcgaactcaggaagttgctgcatccttag

SEQ ID NO: 206799 - DNA, 228 bp, Artificial Sequence
  Description of Artificial Sequence: Synthetic coding sequence
ggccagggccaccagggccccggccagtgcgtgcacagcgtgtacatcccgaacaaagtgcttattcttgccgacggagatccttcatcattcctgagccgtcagctcccatttctgtcgactctgcgaaggctcgaagatcaggccaccgcatacgtgtgcgagaatcaggcctgctccgttcccatcactgatccctgcgagttacgaaagttgcttcacccgtag

SEQ ID NO: 206800 - DNA, 132 bp, Artificial Sequence
  Description of Artificial Sequence: Synthetic coding sequence
atgctgggcgcccgggcctggctgggccgggtgctgctgctgcccagagctggagcagggctggctgcttctagaagatctgcttgttccccgacatcaagactcaactccctgcgatcgctgattccctag

SEQ ID NO: 206801 - DNA, 918 bp, Artificial Sequence
  Description of Artificial Sequence: Synthetic coding sequence
atggccgccgccggccaggagaagggctacctgacccagaccgccgccgctctggataaaagtcccagtctgagtccacaactcgcagctcccatccgaggacgtccaaagaagtgtctagtttatcctcatgccccgaagtcatcccgcctgagccggagcgtgctaaggtggctgcaaggcttagacttgtctttcttccctcggaacatcaacagagacttttccaacgggtttctgattgcagagatcttttgcatatattacccatgggagctggagctctcaagtttcgaaaacggtactagcctgaaggtgaaactggataactgggcacagctggaaaagttccttgcacgaaaaaaatttaaactccctaaggagttgatccacggtaccatccattgcaaggcaggcgtgccagagatcctgattgaggaagtttacacgcttctgacacaccgggagattaaatctatacaggacgactttgtgaacttcaccgactacagttaccaaatgagactgccattagttagcagaagcacggtttccaagtcgatcaaggataacataaggttatctgagctgctttccaacccaaatatgctgacgaatgagctaaaagccgagtttctcatactcttgcatatgcttcaacgcaagctcggtcgcaagctcaatcctgagtggttcgatgtgaaaccaacagtgggcgaggtcaccctaaaccatctgcctgcccaagcctcaggacgtaggtataacttgaaggtcaagcgcggtagagtggtccccgtcctccccaacataggatccgggggctcgagccatcgggagattcatgtgaagcaggctggccagcactcctattattccgcaatgaagcccatcagaaatatggacaagaaaccttag

SEQ ID NO: 206802 - DNA, 2682 bp, Artificial Sequence
  Description of Artificial Sequence: Synthetic coding sequence
atgagcagcaagaagaaccggaagcggctgaaccagagcgccgagaatggatctagcttaccaagcgccgcgagtagttgtgccgaagcacgagcccccagtgcaggctccgacttcgcagcaacctctgggacactaacagttaccaatctgctggaaaaggtggacgataagatccctaagacttttcagaattccctgatacacctcggtctgaacacgatgaagtctgctaacatctgcattggcagacccgtgttacttactagcctcaacggaaagcaggaggtttacactgcctggccgatggcaggctttcctggcggaaaagtgggtctgtcagaaatggcacaaaagaatgtgggtgtgagaccaggggacgcgatccaggtgcagcctctcgtgggagctgtgttacaggcagaagaaatggacgtcgctctgtcagacaaagacatggagatcaatgaggaggaactaacggggtgcatcctgcgaaagctggacggaaagatcgtgctcccaggcaattttctctactgcaccttctacggtaggccgtacaaactgcaggttctgagggtcaaaggggctgacggcatgatcctgggggggcctcagagtgactccgataccgatgcccaacggatggcgtttgaacaaagtagcatggagacttccagtttggagctatccctgcagctcagccaactggacctagaagatacccagatccccactagtcggtccacgccctataagcctattgacgacaggatcactaacaaggcttccgacgtgctactcgacgtaactcagtctcccggggacgggtctggtttgatgttagaggaagttacagggttgaaatgtaacttcgaatccgctcgggaaggaaacgaacagctgaccgaggaggagagactcttaaaattctccattggggctaaatgcaacactgataccttctatttcattagctcaacaacccgcgtgaattttacagagatagataagaactctaaggaacaggacaaccagttcaaggtgacatacgatatgattggcggactgtcatctcagctgaaggccatcagggaaattatcgagctgcccctgaagcagcctgagctgtttaagagctacggcatacccgccccaaggggcgtgttattgtatggccccccggggacaggtaagacgatgatcgcccgggccgtcgctaatgaagtaggagcttacgtctccgttatcaatggcccagaaatcatatctaaattctacggggagaccgaagctaagctcagacagatattcgccgaggctacactccgacacccctcaattattttcatcgacgagcttgatgccttatgccctaagcgagaaggagcccagaacgaggttgagaagcgggtcgtcgcttctctcttgacactcatggacggcattggctccgaggtgtcagagggccaggtactcgtactgggcgccactaaccggcctcatgcactggacgcggcgctgaggagacccggcaggttcgacaaagaaatagaaattggggtacctaacgcacaggatcgcctggatattcttcagaagctgttgagaagagtcccccacttactgaccgaagcagaactgctgcagctggctaatagcgctcacggctacgtgggggcagacctgaaggtactatgcaatgaggcaggcctgtgtgcacttcgccgaattctgaagaagcagcctaacctcccagatgtaaaggtggctggcctggtgaaaattaccctgaaggacttcctgcaagcaatgaacgatataagaccctcagctatgagagagattgcaattgatgtacctaacgttagctggagcgatataggaggtctcgagtcaattaaattgaagcttgagcaggctgtagaatggccactcaagcaccccgagtcctttataagaatgggaatccaaccacccaagggcgttctcctgtacggaccgcccggatgcagcaagaccatgatcgccaaggctctcgctaacgagagcgggttgaactttctcgccatcaaagggcctgaactgatgaacaagtatgtgggagagtctgaaagagccgtgagggagaccttccgaaaagctagggctgtagctccaagcatcatctttttcgatgaactggatgctctagcggtggaaagagggagttcacttggcgcaggaaacgtcgctgaccgagtactggctcagcttttgaccgaaatggacgggatcgagcaactgaaagatgtgaccatcctcgctgccaccaatcgcccagataggatcgacaaggccctgatgagaccaggacggatcgatcgcattatctatgttccgcttccagatgcagccactcggcgagagatattcaagctgcaatttcacagcatgcccgtgtcaaatgaggtagatctggatgagctgatattgcagactgacgcgtatagcggagctgaaatcgttgcggtttgtcgggaggccgccttgctcgccctggaagaggacatccaagctaatttgatcatgaaaagacactttacacaggccttgagtacagtcaccccccggattcccgaatccctgaggcgtttctatgaagactaccaggaaaaaagtgggctgcatacactatag

SEQ ID NO: 206803 - DNA, 750 bp, Artificial Sequence
  Description of Artificial Sequence: Synthetic coding sequence
atgcagctggacaagttcatctaccacctggcccccgtggagaagagtcacgggcgcctgcaaaacagaactagccggtctcagaaaaaaaagagtaaatctccagaaagaagcaagtattgcataaacgccaagaattatgagcagcccacaattagctcaaagagccatagtccgtctccttacacgaagagacgaatgtgtgaactgtcagaagacacacgcagacggctcgcacacttaaatctcgggccttatgaattcaaaaaggagacagacaagccgccttttgtaattagacacgtggatcctccttccccaagagcagatactctgctgggctcttctgggagggattgtgagcgggatggttggtccagggtccataacgaccactcccacttgggatgctgtagaccaaaagattacaaagtcatacgcacaccccatggtagggactttgacgacagtctggaaaagtgtgaagagtacctgagtccaagaagctgctctaaacctaggcactctgcccgcacattgctggtacattcagcccctagcacaatgcctaaacactccccctctcccgttctcaatcgagcttctctgagggaacggttccacagcgactggtgctctcccagtaattgtgacgagattcatgaccgtgatgagagggaccttgaaaaagacgacgagcttgaacttaaacgaagtctgctctgccgggattcagcttatgattcctag

SEQ ID NO: 206804 - DNA, 1419 bp, Artificial Sequence
  Description of Artificial Sequence: Synthetic coding sequence
atgcccaaggtgaaggccctgcagtgcgccctggccctggagatcagttcagtgacatgtcctggagtggtcctgaaagataaggaggatatatatttgtctatctgtgtcttcgggcagtataagaagacccagtgcgtacctgcaactttcccactagtgttcaacgctcggatggttttcgagaaggtattcccagacgccgtcgatccaggtgacgtcgtgactcagctggaatatgatactgctgttttcgaactcatccagctggtgcctcctgtaggcgaaaccctgtctacatacgacgaaaataccagagatttcatgtttccgggccccaaccagatgagtggacatcacgatagtaaccggcaggtaaccatgcgccggattagcggactgagaggcaacgccccccggctggagttcagtaccacctcagtgatcaccgagtgcctgataagctcgcgcaaatgtcatacccaggataagttcatctatcatcttgctccagtagagaaaagccatggcagactccaaaacaggacttcccggtcccaaaaaaaaaagtccaagtcgcctgaacggtcgaagtactgcatcaatgctaagaattatgaacagcctacgattagctccaaatcccatagtccttctccgtataccaaaaggcgcatgtgtgagttgtcagaggacacacgtcgtcggctagcacacctgaatctgggaccttacgagttcaagaaagaaacagataagccccctttcgtgatccggcatgttgaccctccaagccctagggctgatacgctgctgggctcctcggggcgggattgcgagcgggatggatggtctcgcgtgcacaatgaccattcgcatctcggttgttgtaggcctaaagattataaggtaattagaaccccgcacggccgcgatttcgatgatagccttgaaaaatgcgaggagtacctgagcccacgctcctgtagcaagccccgccacagcgctagaacactactggttcacagcgccccctcaaccatgccaaaacactcaccatcccccgttttgaacagagccagcctccgggagcggttccattccgattggtgtagtccaagtaattgcgatgagatccatgacagggacgagagggacctggaaaaagacgatgaactggagctcaaaagatcccttctgtgtcgagatagcgcttacgactccgatccagagtatagtagctgtcagcagcctcgaggaactttccatcttgacgacggggagtactggagtaaccgcgctgcgtcctacaaaggaaaatctcatagacctattttcgagaattcaatggataaaatgtacagaaatttgtacaaaaaagcctgcagcagcgcgtcacatactcaggagtctttctag

SEQ ID NO: 206805 - DNA, 1467 bp, Artificial Sequence
  Description of Artificial Sequence: Synthetic coding sequence
atgcccaaggtgaaggccctgcagtgcgccctggccctggagatctcatctgttacttgtcctggtgtggtgctgaaagataaagaagatatatacttaagcatttgcgttttcggacagtataagaaaacccagtgtgtgcctgccacattcccactcgtcttcaatgccagaatggtgttcgaaaaagtcttcccagacgccgttgaccccggagatgtcgtaacacaattagagtatgataccgctgtgttcgagctgatccaactggtcccccccgtcggggagaccttaagcacttatgatgagaacactcgcgatttcatgttccctgggccaaaccagatgagcggacaccacgatagcaaccgtcaggtgactatgcggcggatcagcgggttgagggggaacgcaccccgactggaattcagcactacatcagtcatcaccgaatgccttatttcttccaggaaatgccacacgcaggacaaattcatataccacttggctccagtcgagaagtctcatgggagactgcagaaccggacctcaagatcccagaagaaaaagtccaagagccccgagcgcagcaaatattgcatcaacgctaaaaattacgagcagccgacaatctcttcaaagagtcactcacccagtccctataccaagagaaggatgtgcgagttgagtgaggacaccagaaggaggctagcccatttaaacctggggccatatgagttcaaaaaggagacggacaagccgcctttcgttataaggcacgtcgatcctccttccccacgcgctgacactctactcggcagtagtggccgggattgcgagagagacggatggtctcgggtgcacaatgatcactctcacttaggatgttgtcgccctaaggattacaaggtgattagaaccccccatggaagggattttgacgacagccttgagaagtgcgaagagtacctgagtccgaggtcatgcagcaagccaaggcattcagcaagaacactcctcgtacacagtgcaccgagcactatgcccaagcactcaccctcacctgtgctcaacagggcatcactgcgtgaacggttccattctgattggtgctcaccatccaattgcgacgaaattcatgaccgtgtcaagaatgtattgaaatcgcatcaggcccatcagaggcacttgtacgacgagcgggacctggaaaaagacgacgagctggagctgaagcggtcactcctgtgcagggatagtgcctatgattcagacccagagtacagttcttgtcaacagcctcggggaactttccacctggatgatggggagtactggagcaatagggcggcaagctataagggaaaatctcacagaccaatttttgagaacagcatggacaaaatgtaccggaatttatataagaaggcctgtagtagcgcgagccatacacaagaaagcttctag

SEQ ID NO: 206806 - DNA, 1251 bp, Artificial Sequence
  Description of Artificial Sequence: Synthetic coding sequence
atggtgttcgagaaggtgttccccgacgccgtggaccccggcgacgtggtcacccagttagaactgggcgagaccctgtctacttacgacgagaatacacgtgatttcatgtttccgggccccaaccagatgtcaggccaccacgatagtaatcgacaggtgacaatgcggcggatctctgggctgcggggtaacgcaccacggcttgaattctcaacgacctcggtcatcaccgagtgcctcatcagctcccgcaagtgccatactcaagacaagttcatctaccaccttgcacctgtcgagaagagccacgggaggctgcagaatcgaaccagcaggtctcagaagaagaagtccaagtccccagagaggtctaagtactgcattaatgccaaaaactatgagcagccaactatctcatccaagtcccattcaccgtctccctacacaaaaagaagaatgtgtgagctttcggaagacactcggagaagactcgcccacctgaatctaggcccatacgagttcaagaaggagactgacaaacccccttttgtcatacgtcacgtcgatcccccgtcgccgcgcgctgacactctactggggtccagcgggagagactgcgaacgcgatggctggagcagggtgcacaacgatcacagccatctcggatgctgtaggccaaaggattataaggtgatccgtacacctcacggacgcgatttcgacgattctcttgaaaagtgtgaagagtatctaagcccaagaagttgctcgaaaccccgtcacagtgcccgcacactcctcgtccacagcgcacccagtactatgcccaaacacagtccttcgccagttctcaatagggcttccttgagagagaggtttcactccgattggtgttctccatcaaactgcgatgaaattcatgacagagtgaagaatgtgctgaaaagccaccaggctcatcagcgtcacctgtacgacgagcgagaccttgagaaagatgacgagttggagctcaaacgcagtctactctgccgggattctgcctacgatagtgatcctgagtacagttcctgtcagcagcctcggggtacattccacctggacgacggagagtattggagtaacagagcagcctcttacaaaggcaaatcccatcggccaatcttcgagaactcaatggacaagatgtaccgaaatctctataaaaaggcgtgcagctccgcgtctcatacacaggaatcattttag

SEQ ID NO: 206807 - DNA, 1377 bp, Artificial Sequence
  Description of Artificial Sequence: Synthetic coding sequence
atggacggcagccggcgggtgcgggccaccagcgtgctgccccggtatgggccaccttgtttgtttaaaggccacctgtcgacaaaatctaatgccttctgtacagactctagctctttgcgtctgagcaccctgcagctcgtgaagaatcatatggccgtccattacaacaagatcctgtcggccaaggctgccgtcgattgttccgtcccagtctccgtctctacatctatcaagtatgcagaccagcagcgtcgcgagaagcttaagaaagagcttgcccaatgtgaaaaggagttcaagcttacaaaaacagcaatgcgcgccaactacaagaataattctaaatccctctttaacacgctgcagaagcctagcggcgagccccagatcgaagatgacatgttgaaagaagaaatgaacggcttcagttcatttgcccgcagtctggtgccaagtagcgagcgactgcatctttcgttacacaagagctccaaagtgattacaaatggcccagagaagaatagctctagttccccatcttcagtcgattacgccgcgtcagggccccgcaaactgagctcaggggctctctatggacgaaggcctcgcagcacctttccaaacagccatcggttccagctggtgatatctaaggcgccatcaggagacctgctcgataaacattctgagctgttcagcaacaagcagcttccatttacacccaggaccctgaaaaccgaggcgaaatcatttttgagccagtataggtactacaccccagccaaacgaaagaaggacttcaccgatcagcgcattgaggccgaaacgcaaacggagctaagcttcaagagtgaattaggaacggcggagactaaaaacatgacagacagcgagatgaacattaagcaggcatcaaactgcgttacctatgacgcgaaggagaaaattgcgcccctccccttagaaggccacgatagcacctgggatgagatcaaggatgacgcgctccaacattcctccccccgagctatgtgccagtacagcctgaagccaccatccactcggaaaatttattccgacgaggaggagctcctttacttaagtttcattgaagacgtcacggatgagatcctgaagttaggcttattttcaaacagatttctggaaagactgtttgagaggcatataaaacagaataagcacttagaggaggagaaaatgcgccacttattgcatgtgctgaaagtcgacctcgggtgtacttccgaggagaattccttctcatcagtgaaaggtgataacaatcacgatatggaactgtctactctgaagattatggagatgtcaattgaagattgccctctggatgtgtag

SEQ ID NO: 206808 - DNA, 1704 bp, Artificial Sequence
  Description of Artificial Sequence: Synthetic coding sequence
atggacggcagccggcgggtgcgggccaccagcgtgctgccccggtacggccctccctgcctctttaaaggccacctctccaccaagtcaaacgctgccgtggattgcagcgtgcccgtgtccgtctctacctcaataaaatacgcggaccagcagaggcgagaaaaactaaaaaaggaactcgcccagtgcgagaaggagtttaagctgactaagacagctatgcgggcaaattataaaaataatagcaaatcacttttcaacacactgcagaagccttccggcgagccccaaatcgaggacgatatgttgaaggaggaaatgaatggttttagcagcttcgcacggagcttggtacccagctctgagaggctgcaccttagcctgcataaaagcagtaaagtcattaccaacgggccagagaaaaattcaagctcgagtccatcctccgttgactacgctgcctccggaccccgcaagctgtcatcaggtgccctgtacggccggagacccaggtccaccttccccaacagccatagattccagctggtgatttccaaggctcccagcggggacctcttggataagcacagcgagctgttcagtaataagcagctgccatttactccacgcacactgaaaaccgaggcaaagagcttcctatcccagtaccggtattataccccagctaaaagaaagaaagactttaccgaccaacgtatagaggctgagacccagacagagttgtctttcaagtccgagttaggcacggccgagaccaaaaatatgactgacagcgagatgaatattaagcaggcatcgaactgcgtgacctatgacgcaaaggagaagattgcgccactgccgctggaaggccacgattcgacatgggacgagatcaaggacgatgcattacagcacagtagtcccagggctatgtgtcagtacagcttaaaaccacccagcacaaggaagatctattccgatgaagaggagctactttacctgtctttcatcgaagatgttactgacgaaatcctcaaactgggtttattcagcaaccgattcctagaaagactgttcgaaaggcatattaagcaaaataagcatctagaggaggagaagatgaggcatcttcttcatgtgctgaaggttgatttggggtgtacaagtgaggaaaattctgtgaagcaaaacgatgtggatatgttgaatgttttcgattttgagaaggccgggaattctgagcccaacgagttaaagaacgagagcgaggttactatccagcaggagagacaacagtaccaaaaagcactagatatgttgctctcagctccaaaggacgagaacgaaatttttcccagcccaaccgagttctttatgccgatttacaagtctaagcactctgagggagtaattatacaacaggtcaatgacgaaaccaacttagaaacatcgaccctggacgaaaaccacccgagtatctccgactctctcacagatagagaaacctcggtgaacgttattgagggcgattcagaccctgagaaggtcgaaatcagcaacggcctgtgcggtcttaatacaagccctagtcaatcggtgcagttcagttcagttaagggcgacaacaaccacgacatggagctgtccactctcaagattatggagatgtctatcgaagattgccctttggatgtgtag

SEQ ID NO: 206809 - DNA, 1800 bp, Artificial Sequence
  Description of Artificial Sequence: Synthetic coding sequence
atggacggcagccggcgggtgcgggccaccagcgtgctgccccggtacggtcctccatgtctgtttaagggacacctgtctacaaagtcaaacgccttttgcacagactcgtcttctctgcgtctgtctaccctgcagctcgtaaagaatcacatggcggtccactacaacaagatcctcagcgcaaaagccgccgtggactgctctgttcccgtgtctgtgtccacatcgatcaaatacgccgatcagcagaggagagagaaactgaagaaggaactcgcccaatgtgagaaagagtttaaactcaccaagacggccatgagggccaattataaaaacaattccaaatcactgtttaatacacttcagaaaccgtccggggagccacagattgaggacgacatgctgaaggaggagatgaacggctttagctcatttgctcgaagtctcgtgccatcttctgaacgtctacacctgtccttgcataaaagcagtaaagtgattacaaacggcccggagaagaactcgtcctctagccctagctctgtggattatgccgcgtctgggcctaggaagctcagcagcggggccctgtacggccgccggccgaggagcaccttcccaaacagccatcggtttcagctagtcatttccaaggccccatcgggggacctcctcgataaacacagtgaactcttcagcaacaagcagctgccgttcactccccggaccttaaaaacggaggctaaaagcttcttgagccaataccgttattatacgccagccaagcgcaaaaaagattttacagaccaaaggatcgaagccgagacacagactgagttatctttcaaatccgagttgggtaccgcagaaactaaaaacatgacggactcggaaatgaacatcaaacaagcttccaactgtgttacatacgacgcaaaagaaaaaatcgctccactaccccttgagggccacgactcaacctgggatgaaattaaagacgacgccctgcagcactcaagccctagagcaatgtgccaatactcattaaagcccccaagtactagaaaaatctacagcgacgaggaggagcttctttatctcagtttcatcgaggacgtcacggacgaaatccttaagttgggtctcttttctaacagattcctggagcgactctttgagcgtcatatcaaacaaaataaacacctggaagaggagaaaatgcggcacctgctgcacgtcttaaaggtggatctcggatgtacatcagaggagaactccgtcaaacagaacgacgttgatatgttaaacgtcttcgactttgaaaaggccggtaattccgaacccaatgagctgaagaatgaatcagaagtcacgattcagcaggaaagacaacagtaccagaaagcgctcgacatgttactctctgccccgaaggatgagaacgagatctttccctcccccacagagttttttatgcctatttacaagagtaaacacagcgagggggtgatcatccagcaggtgaacgatgaaaccaatctggagacatcgactcttgacgaaaatcacccaagcatctcggatagtcttaccgatagggagacctcggtcaatgttatcgaaggggactccgacccggaaaaagttgagatctccaatgggctctgtggactgaatacgtccccctcacagtccgtgcagtttagcagcgtaaaaggcgataacaatcatgatatggaactaagcaccctcaagatcatggagatgtctattgaggattgccccctcgacgtctag

SEQ ID NO: 206810 - DNA, 1704 bp, Artificial Sequence
  Description of Artificial Sequence: Synthetic coding sequence
atggacggcagccggcgggtgcgggccaccagcgtgctgccccggtacggccccccctgcctgttcaaaggacatctctccaccaaatccaatgctgcggttgactgttctgtgcccgtcagtgtgagtacctccattaaatacgccgatcagcaaagaagagagaagctgaaaaaggaactggcccagtgcgagaaagagtttaagctgactaagacagcaatgagagccaactataaaaacaatagtaaatcactattcaacacactacagaaaccctctggcgagccccagattgaagatgacatgctcaaggaggaaatgaatgggttttcatccttcgcacgtagtctagtcccgtcgtcagagcgtctgcacctgagcctgcataagtcctcaaaggtcatcacaaacggtccagaaaagaattcatcatcctcaccctctagcgtggactatgccgctagtggtccccgaaaactcagctcaggggccttgtatggaaggcgaccaagatcaacatttccaaactcccatcggttccagctggtgatatcaaaagcacccagcggcgacctgctcgataagcactctgaactcttctctaacaaacagttgcccttcacacctagaacactgaagacggaagcgaagagcttcctgtcccagtaccgttattacacacccgccaagaggaaaaaagatttcaccgaccagaggattgaagcagagacccaaacagagttgtcattcaaaagcgagttgggtacagccgaaaccaagaatatgactgatagcgaaatgaacattaaacaggcgagcaattgtgtgacctacgacgccaaggagaaaatcgcccccctgcccctggagggccatgattcaacctgggacgaaatcaaagatgatgcgctgcagcacagtagcccaagggccatgtgccaatatagccttaaaccaccgagcacccggaagatttactctgacgaggaggaactcctctacttgtcgttcatcgaagacgtgacggacgaaattcttaaattgggactgttttctaatcgatttttagaacgcctgtttgagcgacatatcaagcagaataaacatctggaggaggaaaagatgagacatttgctgcatgtactaaaggtcgatctgggttgcacttctgaggagaactcggtgaagcagaatgatgtagacatgctcaatgtttttgattttgagaaggccggaaatagcgagcccaacgagctgaagaatgaatctgaggttacaatccagcaggagcgacagcagtatcagaaggccctggatatgctgttatctgctccaaaagatgaaaatgaaattttccccagtcctactgagttcttcatgcccatatataaatcaaagcacagtgaaggggtgattatccagcaggtgaacgacgaaacaaacctggagacttccacgcttgacgagaaccacccaagtataagtgatagccttaccgaccgcgaaaccagcgtgaacgtaatcgaaggagattcagatcctgagaaggtggagattagcaatggactgtgcgggttgaatacatcccctagtcagtcagtacagttctcgagcgtgaaaggtgataacaaccacgatatggaactgtctaccctcaagatcatggagatgtccatcgaggattgcccgctcgatgtgtag

SEQ ID NO: 206811 - DNA, 318 bp, Artificial Sequence
  Description of Artificial Sequence: Synthetic coding sequence
atggcccccgccggcatgagcggcgcccaggacaacagctgcctgtatcaggagatcgcaccaagttttcaaagactgccctgtcccagaacctcctctcggcatttcagtgaagctatgacttgcccctgcggatggcgtccgttcaaaggaggccccggcggactgaaaggaccagtatggcccgccaaagaggaaaattcctgttcacacggcagaatccagagggtccaaaggagaagagttccctccgcctctccattgattcagaaaattaaccgccggagcgttctattccacccttactgttggtcgtag

SEQ ID NO: 206812 - DNA, 1638 bp, Artificial Sequence
  Description of Artificial Sequence: Synthetic coding sequence
atgagccggaagcagaaccagaaggacagcagcggcttcatcttcgacctgcagtcaaacaccgttcttgcccagggcggcgctttcgaaaacatgaaagagaagattaacgctgttcgcgccatcgtaccgaacaaatctaataatgagatcattctagtgcttcagcatttcgataactgtgtggacaagacagtgcaggcatttatggagggatcagctagcgaggtcttgaaggagtggacggtgactggaaaaaagaagaataagaagaagaaaaacaagccaaagcctgcggcagaaccaagcaatggcataccggacagcagtaagtctgtaagtatccaagaggaacagtctgccccatcctctgaaaaaggaggaatgaatggctatcatgtgaacggagctattaatgacactgaatccgtcgactctctgagtgaagggctggagacactcagcatagatgcacgggaattggaagacccagaatccgcgatgctcgacactctcgatcgtaccggcagtatgctacagaatggtgtctccgatttcgaaactaaatctttaacaatgcactcaatccataattcccagcagcctcgcaatgctgccaagagcctgtcccggccgaccactgagacacagttcagtaatatgggcatggaggacgtcccgcttgctacatccaagaagctcagttccaatatcgagaagtcagtgaaagacctccagcggtgcactgtctcactagctagatatagggtggtcgtgaaagaggaaatggatgcttcaatcaagaagatgaaacaagctttcgctgaactggagagttgtctcatggatcgtgaggtggcgctcctcgctgagatggacaaggtgaaggcggaagctatggagattctgctctcccgccagaagaaagctgagctcttaaaaaagatgactcacgttgccgtgcaaatgagcgagcaacagctggtagagctgcgggccgatatcaagcatttcgtttctgagcggaaatatgatgaagatctggggcgagtggcccgtttcacttgtgatgttgaaaccctcaaaaagtccatcgattcattcggccaggtgtcacatcctaaaaatagctactctactcgttccaggtgcagtagtgtgacgagcgttagtctgagctcgccatcagatgcttcagccgcttcatcatccacctgcgcgtcacctcccagtctcaccagtgccaataaaaaaaatttcgccccgggtgaaacgcccgccgctattgccaattcttccggccagccataccagcccttgcgcgaagtcctcccaggaaatagaaggggaggtcagggctacaggccccagggacaaaaatccaacgaccctatgaaccagggtcggcacgacagcatgggccgctatcgcaatagtagttggtattcctcgggttcgcgataccagtccgccccatcgcaagcccccggcaatactatcgaacgcggacagacacacagcgctggaacaaatggcaccggagtctccatggagccatccccaccaaccccatcctttaagaaggggttgcctcagcgcaaaccaagaacatctcagacagaagccgtcaactcttag

SEQ ID NO: 206813 - DNA, 1638 bp, Artificial Sequence
  Description of Artificial Sequence: Synthetic coding sequence
gtgagcaagaagaagaagaagaaggacagcagcggcttcatcttcgacctgcagtcaaacacagtattggcacaaggaggcgccttcgagaatatgaaagagaaaattaacgctgtgagggctattgtgccgaacaagagcaataatgagataattctcgttctgcaacactttgacaactgcgtggacaaaacagtgcaggcttttatggaaggcagcgctagtgaggtgctaaaggaatggaccgtgaccggcaagaagaagaacaaaaagaagaaaaacaagcctaaacccgccgcggaaccatctaacggaatcccagacagtagtaagagcgtatctattcaagaggaacaatccgcaccttctagcgaaaaagggggcatgaacggctaccatgttaatggtgctatcaacgatactgagtctgtcgactccctgagcgaaggcctggagacgctgtcaatcgacgcgagggagctggaggatcctgagtcagctatgctcgacaccctggacagaactgggagtatgctccagaatggcgtctccgacttcgagaccaaatcccttaccatgcatagtatccacaattctcaacagcccagaaacgccgctaagagtctatctcgcccgaccaccgaaactcaattcagcaatatgggcatggaggatgtgcctctagccacctccaagaagctgtctagtaatattgaaaaatccgttaaagatcttcagaggtgtacagtgtccttggctcggtatagagtagttgttaaggaagagatggacgccagtataaagaaaatgaagcaagctttcgcagaacttgagtcctgtctgatggatagggaagtggcgctgctggctgagatggacaaggttaaggctgaggccatggagatcctcctgagcaggcagaagaaggccgagctcctgaagaaaatgacccatgtggctgtccaaatgtcagagcagcagctagtcgagctgcgcgccgacatcaagcattttgtgagcgaacggaagtacgacgaagatttgggaagggttgcccggttcacttgcgacgttgagactctgaagaaatccatcgatagctttgggcaggtttcccaccctaagaattcatacagtacacggagtagatgcagtagcgtcacatccgtgagtttgtctagcccttctgatgcatctgcagcatcttctagcacatgtgctagcccaccctcattgacatcagcgaataaaaaaaatttcgctcccggggagaccccagccgccattgcaaattcatccgggcagccataccagcctctccgggaagtgctaccaggaaacaggcgcggcggccaggggtatcggccccaggggcaaaaaagcaatgatccaatgaatcagggccggcacgactccatgggccggtaccggaattcttcttggtacagcagcggatcgcgataccagagtgcgccctctcaggccccaggcaacactattgaacgcggccagactcacagtgcaggaacaaacgggaccggtgtcagcatggaaccaagcccacccactccatccttcaagaagggacttccccagcgcaaaccaagaacttctcaaactgaagcggtgaacagctag

SEQ ID NO: 206814 - DNA, 27 bp, Artificial Sequence
  Description of Artificial Sequence: Synthetic coding sequence
atgagccggaagcagaaccagaagtag

SEQ ID NO: 206815 - DNA, 27 bp, Artificial Sequence
  Description of Artificial Sequence: Synthetic coding sequence
atgagccggaagcagaaccagaagtag

SEQ ID NO: 206816 - DNA, 204 bp, Artificial Sequence
  Description of Artificial Sequence: Synthetic coding sequence
atgagccggaagcagaaccagaaggacagcagcggcttcatcttcgatcttcagagcaacacagtactggcacaggggggcgccttcgaaaatatgaaagaaaaaattaatgctgtccgagcaatcgtccccaacaagtctaataatgagataatcctggttctgcaacattttgataattgtgtggataagactgtccagtag

SEQ ID NO: 206817 - DNA, 102 bp, Artificial Sequence
  Description of Artificial Sequence: Synthetic coding sequence
atgagccggaagcagaaccagaaggacagcagcggcttcatcttcgacttacagtccaacactgtgctcgctcaaggaggcgcgtttgaaaatatgaaatag

SEQ ID NO: 206818 - DNA, 18 bp, Artificial Sequence
  Description of Artificial Sequence: Synthetic coding sequence
atgagccggaagcagtag

SEQ ID NO: 206819 - DNA, 111 bp, Artificial Sequence
  Description of Artificial Sequence: Synthetic coding sequence
atgagccggaagcagaaccagaaggacagcagcggcttcatcttcgatctccagtcaaataccgttctggctcagggtggtgctttcgaaaatatgaaggaaaaggtttag

SEQ ID NO: 206820 - DNA, 201 bp, Artificial Sequence
  Description of Artificial Sequence: Synthetic coding sequence
atgagccggaagcagaaccagaaggacagcagcggcttcatcttcgacttgcagtccaatacagtgctcgcccagggcggtgcttttgagaatatgaaggagaaaatcaatgccgtccgcgctattgtgccaaacaagtcaaataatgagataatccttgtactccaacattttgataactgtgtagataagacagtttag

SEQ ID NO: 206821 - DNA, 105 bp, Artificial Sequence
  Description of Artificial Sequence: Synthetic coding sequence
atgagccggaagcagaaccagaaggacagcagcggcttcatcttcgacctgcagagcaacacggttctcgcccaaggtggggcattcgaaaatatgaaagaatag

SEQ ID NO: 206822 - DNA, 297 bp, Artificial Sequence
  Description of Artificial Sequence: Synthetic coding sequence
atgagccggaagcagaaccagaaggacagcagcggcttcatcttcgaccttcagagcaatacggtgctggcccagggtggcgcttttgaaaatatgaaggaaaaaattaatgcagtgagggcaattgtgcccaataaatccaacaatgagatcatcctggtgcttcagcactttgataattgtgtagataagaccgtccaggccttcatggagggatccgccagcgaggtgttgaaagagtggactgtgacaggaaagaaaaaaaacaagaagaagaagaacaagccgaagccttag

SEQ ID NO: 206823 - DNA, 225 bp, Artificial Sequence
  Description of Artificial Sequence: Synthetic coding sequence
atgagccggaagcagaaccagaaggacagcagcggcttcatcttcgatctgcagtcaaataccgtcttggcacagggcggggcatttgaaaacatgaaggaaaaaatcaatgctgttagggctattgtcccaaacaaatctaacaacgagatcatcctggttttgcagcatttcgataattgtgtcgacaaaaccgtgcaggctttcatggaggggagtgcatag

SEQ ID NO: 206824 - DNA, 33 bp, Artificial Sequence
  Description of Artificial Sequence: Synthetic coding sequence
atgagccggaagcagaaccagaaggacagctag

SEQ ID NO: 206825 - DNA, 1638 bp, Artificial Sequence
  Description of Artificial Sequence: Synthetic coding sequence
atgagccggaagcagaaccagaaggacagcagcggcttcatcttcgacctgcagtccaataccgttctggcacaaggaggcgcttttgaaaatatgaaagaaaagatcaatgccgtcagggcaattgtgccaaacaagagtaacaacgagatcattctcgttctgcagcacttcgacaactgtgtggataagactgtgcaagccttcatggaggggtctgcctctgaggttctcaaggaatggacagtcaccgggaagaaaaagaataaaaaaaaaaagaacaagccgaagcccgcagcagaaccatccaacggcatccctgatagctccaagtccgtgagcattcaagaagaacaatccgctccctcttcagagaaaggcggcatgaacggctaccatgtgaacggagcgattaatgacacagaaagcgtcgatagcctttcagagggactggagacactgtcaattgatgccagggagctagaagacccggagtccgccatgctggacaccctggatcgcacagggagcatgctacagaacggagtgtccgacttcgagaccaaatccctgacgatgcactccatccacaattcccagcaacctcgcaacgccgcaaagtccctctcacgaccaacaaccgagacacaattctcaaacatggggatggaggatgtgcctcttgcgaccagcaaaaaactaagcagtaacatagagaaatctgttaaggacctacagaggtgtactgtatccctggctcgctaccgcgttgtcgttaaagaagagatggacgcaagtataaaaaaaatgaagcaggctttcgcggaactggagtcttgccttatggacagggaggtcgcacttctagccgaaatggataaagtaaaggccgaagccatggagatcctgctcagtcggcagaaaaaagccgaactgctgaagaaaatgactcacgtagccgtacaaatgagtgagcagcaacttgtggaattgagagctgacatcaaacacttcgtgtccgaaagaaaatatgacgaagacctaggccgcgtggccaggtttacctgcgacgtagaaaccctgaagaagtcaatcgattcgtttggacaagtcagccacccgaagaactcctattccactagaagtagatgttccagcgtgacgagcgtatcactgtcgtcgccctccgacgcctcagcagctagcagctccacatgcgcatcccccccttctcttacatccgctaacaagaagaattttgctcccggggagacccccgctgccattgccaattccagtggacagccttatcagcccctgcgagaagttctacctgggaataggagaggggggcagggctatcggccgcaaggacagaagtctaatgaccccatgaatcagggacggcacgacagcatgggtcgttatagaaactccagttggtattcttccggatctcgctaccagagtgcaccctcccaggcccctggcaacacaattgagcgtggacagactcactctgccggaactaatgggaccggagtgtcaatggaacccagtccacctaccccatccttcaagaaggggctacctcagaggaagccacgcacatcccagacagaagccgtcaacagttag

SEQ ID NO: 206826 - DNA, 1638 bp, Artificial Sequence
  Description of Artificial Sequence: Synthetic coding sequence
atgagccggaagcagaaccagaaggacagcagcggcttcatcttcgatctgcagtctaacacggtgctggcccagggcggagcgtttgaaaatatgaaagagaaaatcaacgccgtcagagcgattgtgcccaacaaatcgaataatgaaattatcctcgtgctccagcactttgataactgcgtcgataagacagtgcaggccttcatggaaggctcggcgtctgaggtgttgaaggagtggacagtgacaggcaaaaagaaaaacaagaagaagaagaataagcctaaaccagccgccgaaccttctaacggcattccggatagcagcaaaagcgtctcgatccaggaggaacaatccgccccgagctctgaaaagggtggcatgaatggttatcacgtgaacggggccatcaacgatactgaatccgtagattctctaagtgaggggttggagacacttagcatcgatgcacgggagctggaggaccccgaatcagcgatgttggataccctggaccgaaccgggagcatgctgcagaatggagtcagcgacttcgagaccaagtccttgacaatgcactccattcacaactcccaacagccccgcaacgcagccaagagcctttctcgccccaccactgagacacaattttctaacatgggcatggaggacgtgcctctggccacgagcaaaaaactgtcgtcaaatatcgaaaaatccgtgaaggatttacaacggtgtacagtttcattggctagatatagggtagtggtcaaggaggagatggacgcaagcatcaaaaagatgaagcaggccttcgccgaactagagagctgtctgatggatcgcgaggtcgctttactggccgaaatggacaaggtgaaagcagaggccatggagattttactttcacggcaaaagaaggctgaacttctgaagaagatgactcacgtcgcagtccaaatgtctgaacagcagttagtggagctcagggctgatatcaaacactttgtgagcgaaaggaagtatgacgaggaccttggcagggtggcaagattcacctgcgatgtcgagaccctcaagaagtcaatcgattccttcggacaggtgtcccatcctaaaaacagctactctacccgcagcaggtgttcctcagtaacttcagtctcgctgtctagtccatctgacgcctccgcggcgagctcgtctacctgcgcatcaccaccctctctgacctcggccaacaagaagaatttcgcgcctggagagacacccgccgccatcgctaattctagcggccagccataccaaccactgcgcgaggtcctccccgggaaccggagagggggccaggggtacagaccacaaggccagaagtctaacgaccctatgaaccagggccggcatgacagcatggggagatacagaaactccagctggtattcatcaggttcccgataccagtccgccccaagccaggctcccgggaacactatcgaaaggggccaaacccatagtgccggcaccaacgggacaggtgtttcgatggagccaagccctccaacaccaagctttaaaaaagggcttccgcagcggaagcccaggacatcacagaccgaagccgtcaattcctag

SEQ ID NO: 206827 - DNA, 1677 bp, Artificial Sequence
  Description of Artificial Sequence: Synthetic coding sequence
atggccgagctgaacacccacgtgaacgtgaaggagaagatctacgcagtgcgcagcgttgtgcccaacaaatcgaataatgagattgtccttgtgctgcagcagtttgatttcaacgtggataaggctgtgcaggcttttgtcgacggcagtgctattcaggtgcttaaagagtggaatatgactggtaagaaaaaaaataacaaaagaaagcgctcaaaaagcaaacagcaccaagggaacaaggatgctaaggacaaggtggaacggcccgaagccggacccctgcagccgcaaccccctcaaatacagaatggaccaatgaacgggtgcgagaaagactccagctctactgacagcgctaatgaaaagcctgccctgatccctcgggagaaaaagattagcatccttgaagaacctagcaaggcattgcgaggagtgactgagggaaaccggctgctgcaacaaaagctgtccctggacggcaacccaaagcctatacacggtaccacggaacggtctgacggcctgcagtggtccgccgagcaaccgtgcaatcccagtaagcccaaggccaaaaccagcccggtgaagtccaacaccccggccgcccacttggagattaaacctgatgagctggcaaaaaagaggggccccaacatcgaaaagtccgtgaaggatctccaaaggtgcacagtgtctctgacaaggtaccgcgtgatgatcaaggaagaagtggattccagcgttaagaagattaaagccgcttttgccgaactgcacaactgcataatcgataaggaagtttcattaatggccgaaatggataaagtcaaggaagaggcaatggagatcctgaccgcccggcagaaaaaggccgaggagctgaaaagattgacggatctcgctagtcaaatggccgaaatgcagttggctgagctaagggcagagatcaagcatttcgtcagcgaacgcaaatacgacgaggagctgggcaaagccgctaggttttcttgcgacatcgaacaacttaaggcccagattatgctctgtggggaaatcacacatccaaagaataactactcatctcggacgccatgttcctcgctgctccccctgctgaacgcccacgcggcaaccagtggcaagcagagcaatttcagcaggaagtcaagcacccacaataagccgtctgagggtaaagccgctaatcccaagatggtgagctcgctgcccagtactgctgatccatctcaccagactatgcctgctaacaaacaaaacggatctagcaatcagaggcgaagatttaatcctcagtatcataacaatcggctgaatggccccgctaaaagccaggggagcgggaacgaggccgaaccgctaggaaaaggtaattcccggcacgaacatcgtaggcagccgcacaatggcttcaggcctaaaaataaaggtggagctaaaaaccaggaggccagccttggtatgaaaacccctgaggcgcccgcccatagcgagaagccgaggcggaggcagcacgctgcagacacatcagaggccagacctttcaggggtagcgtcggaagagtgtcccaatgcaatctttgccccacccggatcgaggtgtcgacggatgctgccgtgttatccgtgccggcggtcaccctggtagcatag

SEQ ID NO: 206828 - DNA, 1470 bp, Artificial Sequence
  Description of Artificial Sequence: Synthetic coding sequence
atggccgagctgaacacccacgtgaacgtgaaggagaagatctacgcggtacgcagcgttgtccccaataaaagcaacaacgagattgtgctggttttgcagcagtttgattttaatgtggacaaagctgttcaggctttcgtcgacggaagtgccatccaggtcctcaaggaatggaatatgacggggaagaagaagaataacaagcgcaaacgcagcaaaagtaagcagcaccaaggtaataaggatgcgaaagataaggtggagaggcccgaggctggacccctgcagccacagccaccacagatccagaacgggcccatgaatggttgtgaaaaggacagttctagtacagactccgctaatgagaaacccgctctcataccgcgcgagaagaagatatctatcctggaggaaccatcaaaggctctcagaggagttacagggcccaatatagaaaagtccgtaaaggatcttcagagatgtaccgtgtcgctgacgaggtacagagttatgataaaggaggaagtcgacagcagcgtgaaaaaaataaaagctgcttttgctgaactccataattgtatcatcgataaagaagtgtctctgatggctgaaatggataaagtcaaggaagaggcaatggagatactcacggctaggcagaagaaagcggaagagctgaaaaggctcactgaccttgccagccaaatggcggagatgcaactggcagaactgagggccgaaatcaagcatttcgtgtcagagcggaagtacgatgaagaactagggaaagctgcacggttttcttgtgacatagagcagctgaaagctcagataatgctgtgtggggaaatcacccaccccaaaaacaattacagctcacggaccccttgctcaagtcttctgcccctgctgaatgctcatgcggcaactagtggaaaacagtctaacttcagccgaaagtcttcgacgcacaataaaccgtccgaaggcaaagctgcgaaccccaaaatggtgtctagcctccctagtaccgccgacccaagccaccagacaatgccagctaataagcagaacgggagcagcaaccagagaagaaggtttaacccacagtatcacaacaaccgactgaatgggccggctaagagccaaggcagcggtaatgaggccgagcccctcggaaaaggcaattcaaggcatgagcaccggcgccagccccacaatggatttagacctaagaataagggaggagcgaagaaccaggaagcctccctcggtatgaagacccccgaagcaccagcccactcagaaaaacccagaaggcgccagcacgccgctgatacttcagaagcaaggccatttcgcggaagtgtgggccgagtgagccaatgcaacttgtgtcccactcggattgaagtctccaccgacgcagctgtgctatccgtgccggccgtgactctggttgcctag

SEQ ID NO: 206829 - DNA, 1677 bp, Artificial Sequence
  Description of Artificial Sequence: Synthetic coding sequence
atggccgagctgaacacccacgtgaacgtgaaggagaagatctacgccgtccgcagcgttgtgcccaataaatccaacaacgagatagtgctagttctgcaacagttcgactttaatgttgataaggccgtccaggccttcgtggacggatcagccattcaggtgctgaaagaatggaatatgactggtaaaaaaaaaaataataagagaaaaagatccaaaagcaagcaacatcagggcaataaagatgccaaggacaaagtggagagaccagaagctggcccactgcagccccaacctccccagatccagaacgggcctatgaatggatgtgaaaaagacagctcttcgaccgacagtgccaacgagaagccggccctgatcccgagggagaagaaaatttccatcttggaggagccctccaaggctctgcgaggcgtgacagagggaaatagactgctgcagcagaaactatctctcgatggcaatcctaaaccgattcacggcacaactgagaggtctgatggactccagtggagcgccgaacagccgtgcaatccttctaagcctaaggccaaaacatccccagtgaagtccaacaccccagctgcccacttagaaatcaagccggacgagctagccaagaaacgcggccccaacattgaaaagagcgtcaaggatttgcagcggtgtactgtatctctgacaagatatcgggttatgataaaggaggaggttgattcgtccgtcaaaaaaatcaaagctgcgttcgccgaactgcacaactgcattatcgacaaggaagtctccctgatggccgagatggataaagtgaaagaggaagccatggaaattctcactgcacggcagaagaaagcggaagagcttaaacggctaaccgatttggcaagtcagatggcggaaatgcaattggctgagctgcgggctgaaatcaaacatttcgtgagtgaaagaaagtatgacgaagagctcgggaaagctgctagattctcatgcgatatcgaacagctgaaggctcaaatcatgctgtgtggagagattacacaccccaaaaacaactactcctccagaactccttgtagcagtttattgcctttgcttaatgcccacgcagctacctccggaaagcagtctaacttctctagaaagtctagcacacacaacaagccctctgaaggtaaggcagccaaccccaaaatggtgtcctctcttccttcaaccgcagatcccagccatcaaaccatgcccgctaacaagcagaacggctcatctaatcagcgccgacgtttcaaccctcaatatcataataaccgattgaatggccccgctaaatcccagggtagcggcaatgaggccgagccattggggaagggaaactcacgtcatgagcataggcggcaacctcacaacgggttccgccccaaaaacaagggcggtgccaagaatcaggaggcctctctgggtatgaagacccctgaggctcccgcgcactccgaaaaaccacgcaggcggcagcatgccgccgacaccagtgaagcacgtccttttagggggtcagttggacgggtcagccagtgcaatctgtgcccaaccagaatagaggtatccaccgatgccgccgtgctctccgtacccgctgtcaccttggttgcttag

SEQ ID NO: 206830 - DNA, 1701 bp, Artificial Sequence
  Description of Artificial Sequence: Synthetic coding sequence
atggcctacagcacccggagcaagatggccgagctgaacacccacgtgaacgttaaagaaaaaatctatgctgtgcggtccgtggtgcccaataagagcaacaacgagatagttctcgtactgcagcagtttgacttcaacgttgacaaggcggtgcaggcctttgtcgatggatccgcgatacaagtgctgaaagagtggaatatgacaggcaagaagaagaataacaaacgcaagcgaagtaagtccaagcagcatcagggtaacaaggacgctaaagataaagttgagcgccccgaagctggccctctgcagccccagccaccacagattcagaacggacccatgaacgggtgcgaaaaagacagctcatccaccgactccgctaatgaaaagcctgcccttattcctagagagaaaaagatcagcatccttgaggagccttctaaagccctccggggagtgacagagggaaaccgcctgctccagcagaaactttcacttgacggcaatccgaagcctatccacggtaccacagagagaagcgacgggcttcaatggtctgctgaacagccgtgcaacccctcaaagccgaaggccaaaacatctccggtcaaaagcaatacgccagcagctcatctggaaatcaagcccgacgaactggctaaaaagaggggtcctaacatcgagaaatctgtcaaggacctacagaggtgcactgtgtctctcactagataccgcgtcatgatcaaggaggaggtggactccagcgtaaaaaaaataaaagccgcgtttgctgagctgcataattgcatcattgataaagaggtcagcctgatggccgaaatggataaggtaaaggaagaggcgatggaaatcctaaccgcaaggcagaagaaggccgaggaactgaaaagactcaccgacttagcgtctcagatggctgagatgcagttagcagagttaagagcagagattaaacattttgtgtctgaacggaaatatgatgaagagctgggtaaggcggcccggttttcatgtgacatcgaacagctcaaagcccagattatgttatgcggcgagataacccatcctaaaaataattacagttcgcggacgccatgtagcagtctgctgcccttgctgaatgcgcacgcagccacaagcggtaagcaaagcaatttctctcgtaagtcttccactcataacaaaccctccgaaggtaaagcagccaatccaaagatggtcagttcgctgccttctacggcggatccaagtcaccaaacaatgcctgccaacaaacagaatgggagttccaaccagcgtaggcgtttcaatccgcaataccataataatcgcctgaatgggcccgcgaaaagccagggcagcggaaatgaggctgaaccgctcggcaagggaaattcccgtcatgagcacaggcgacagccccataatggctttcgccctaagaacaagggcggggctaaaaatcaggaggccagcctgggaatgaaaacacccgaggctccagcgcactccgagaaacctaggagacgtcaacatgccgccgataccagtgaagcgcgcccttttcgcggatcggtgggcagagtgtcccagtgcaacctgtgccctaccaggatcgaagtgagcacagacgcagccgtcctgtctgtcccagcagtgacactggtggcatag

SEQ ID NO: 206831 - DNA, 801 bp, Artificial Sequence
  Description of Artificial Sequence: Synthetic coding sequence
atggccgagctgaacacccacgtgaacgtgaaggagaagatctacgccgtacgctccgttgtgcctaataagtctaataatgagatagtcttagtacttcaacaattcgactttaacgtggacaaagctgttcaggcatttgtagacgggtcggccatacaggtcctcaaagagtggaacatgacaggaaagaaaaagaacaataagagaaagcggagcaagtccaagcagcatcagggtaataaggatgccaaagataaggttgagaggccagaggcggggcctttacagcctcagccaccccagatccagaacggccccatgaacggttgtgaaaaagactcatcatcaactgacagcgctaacgaaaagcctgctctcatccctcgcgaaaagaaaatcagtatccttgaggagccttcaaaagcattaagaggggtgaccggccccaacatcgagaaatccgtgaaagacctgcaacgctgtacagtgtcacttacccgataccgggtgatgattaaggaggaagtggactcctccgtgaaaaagatcaaagccgccttcgccgagctacacaactgcataattgacaaagaagtcagtctgatggctgaaatggataaggtcaaagaggaggccatggaaatccttactgctagacagaaaaaggcggaagaactgaaaagactgaccgacctggccagccagatggccgagatgcagttggcggagcttagagctgagatcaagcacttcgtctccgaaaggaagtatgacgaagagttgggcaaggcggcctag

SEQ ID NO: 206832 - DNA, 1677 bp, Artificial Sequence
  Description of Artificial Sequence: Synthetic coding sequence
atggccgagctgaacacccacgtgaacgtgaaggagaagatctacgccgtgaggagtgtggtgcctaacaaaagcaataacgagatcgttcttgtgctgcagcagttcgatttcaatgtggacaaggccgtgcaagcctttgtggatgggtcagctatacaggtgctaaaggaatggaatatgactgggaaaaaaaaaaataacaagcgcaagcgctcaaaaagcaaacagcaccaagggaataaagatgcaaaagataaggtggaaaggcccgaagcagggccccttcaacctcaaccaccacagatccagaacggtcccatgaacgggtgcgaaaaagactcatcctccacagattcagcaaatgaaaagccagcactcattccaagggagaaaaaaattagtattctcgaggagcccagtaaagccctcaggggcgtcacggagggaaacaggctgcttcaacaaaaattgtctctcgatggtaaccccaagccaatccacgggaccacagagcggtccgatggcttgcagtggagtgccgaacagccgtgcaatccctctaaaccaaaggctaaaacttccccggtgaagtccaatactcccgcggcacacctcgagattaaacctgacgagctggccaagaagcgcggtcctaatatagaaaagtcagttaaggacctgcagcgctgtacagtgtcccttacgaggtatcgcgtgatgatcaaggaggaggttgattcgagcgttaagaaaataaaggcagctttcgccgagctgcacaactgtattattgataaagaggtatccctcatggccgaaatggataaggtgaaagaggaggcaatggagatcttaacagcccgacagaaaaaagcagaggagttaaagagacttactgatttggcctctcaaatggccgaaatgcagctcgctgagctgcgcgcagaaatcaagcacttcgtgtcagagaggaagtatgacgaagaattgggcaaagcggcacgctttagttgcgacattgagcagctgaaagctcagatcatgctgtgcggtgagatcacccacccaaagaacaactactcttcaaggactccctgctcctcgttgttgcccttactgaatgctcacgctgccaccagcggaaagcagagtaatttttcccgcaaatcttccacccacaataaaccttcagaggggaaggcagcaaatccaaaaatggtctcttctctcccttcaacagcagatccaagccatcagaccatgccggccaataaacagaacgggagttccaaccaaaggagacggttcaacccgcaataccacaacaacagactcaacggaccggcaaagtcccagggaagtggaaacgaagccgagccgcttgggaagggaaatagccgccacgagcacaggaggcagccacacaatgggttccgtcctaagaacaaagggggggctaaaaaccaggaagctagtctcggtatgaaaacgcccgaggccccggcccacagcgaaaaaccccgtcgccgtcagcatgctgccgacacgagtgaggccagaccttttaggggcagtgttggtagggtgtctcagtgtaacctgtgtcccacccggatcgaagtttctaccgatgccgccgtcctgtctgtgcctgccgtaactcttgtggcctag

SEQ ID NO: 206833 - DNA, 1767 bp, Artificial Sequence
  Description of Artificial Sequence: Synthetic coding sequence
atggaccccttctgccacagcagcagcgagacccggctgctgagcggaacgctgttgtggattccaagagcgtattcaacaagaagcaagatggctgaactaaatacacacgtcaacgtgaaggagaagatctacgcagtgcgcagtgtggtacccaacaagagcaacaacgagatcgtgctcgtgctacaacagttcgacttcaatgttgacaaagccgtgcaggcattcgttgatggttcagccatccaggtgttgaaagaatggaacatgacaggaaagaagaagaataataagaggaagaggtctaagtctaagcaacaccagggcaataaggacgccaaggacaaggtcgagcgtcctgaggcaggtcctttgcagccacagcccccccagatccagaatggccccatgaacgggtgcgaaaaggacagcagcagcactgactccgccaacgaaaagcctgccctgatccctagggaaaaaaaaatttctattctggaagaaccttcaaaggccctgcgcggcgtgacagagggaaacaggctcctgcagcagaagttatccctcgacggcaacccaaaaccgatacacggaaccacagaaagatcagatggactacagtggagtgcagagcagccgtgtaacccttctaagccaaaggcaaagaccagccctgtgaaatcaaacacccccgcggcccatctggaaattaagccagacgagctggcgaagaagcgggggcctaacatcgagaagagtgtcaaggacttgcagaggtgcactgtcagtctcacacgttatcgggttatgatcaaggaagaggtggattcctctgtgaagaagataaaagccgcattcgcggaactacacaactgcatcatagacaaagaggtgtctctgatggccgagatggacaaggttaaggaagaggccatggagattcttaccgccaggcaaaagaaggccgaggagcttaagcgactgacagatctggccagccagatggccgaaatgcagctggctgagctgagggcggagatcaaacactttgtgtccgagagaaagtatgacgaagaactagggaaggctgcacggttcagttgtgacatagagcagttgaaggcccagatcatgttatgtggggagatcacccaccctaagaacaattatagctctcgcactccttgcagctctttgcttcccctcctgaacgcgcacgctgccacaagcggaaaacagtcaaacttttcaagaaagtctagtacgcacaacaagccttctgagggcaaggccgcgaacccaaagatggtctctagcctgcctagtaccgctgacccttcccaccagacaatgccggccaataaacagaacgggtcttctaaccagagaagaaggttcaacccacagtaccacaacaataggttgaatggaccggccaagtcccagggcagtggtaacgaggcagaaccactgggtaagggcaacagtcgtcatgaacatcgcaggcagccccataatggtttcagaccaaagaataaaggcggcgcgaagaaccaggaggcctctctgggaatgaagactcctgaggctccagcacatagtgaaaagccccgcaggaggcagcacgcagctgacaccagcgaagcccgaccgttccgtggctctgttgggcgggtgtcccagtgcaatctgtgcccgacacgtattgaggtgtccacagacgccgcagtgctcagtgtgcccgccgtgactctggtcgcttag

SEQ ID NO: 206834 - DNA, 1677 bp, Artificial Sequence
  Description of Artificial Sequence: Synthetic coding sequence
atggccgagctgaacacccacgtgaacgtgaaggagaagatctacgctgttcggagcgtggtacccaataaatctaacaacgaaatcgttcttgttctgcagcagttcgactttaatgtagataaggctgtgcaggcatttgttgatgggagcgcaatccaggtgctgaaggagtggaatatgaccggaaagaagaaaaataataagagaaagagaagcaagtccaaacagcatcaggggaacaaagacgcaaaggacaaagtcgaacggcctgaagccgggcccttgcaaccacagcccccccagattcagaacggccccatgaacgggtgcgagaaggacagcagtagcactgactctgccaacgagaagccagccctgatccctagagaaaaaaagatttcaattctcgaggaaccaagcaaagcacttcgcggcgtgactgaggggaataggctgctgcagcagaaattaagcctcgacgggaacccgaagcctattcacgggactacagagcgatccgacggactccagtggtcagcagagcagccctgcaacccctcaaagcctaaggccaagaccagcccagtgaaaagtaacacaccagcagctcatcttgaaataaagccagatgagctcgcaaagaagcgcggtcctaacattgagaaatccgtgaaggatcttcagcgctgcacagtgagcttgacccggtacagagtcatgattaaggaggaggttgatagctcagtcaaaaagattaaagccgcatttgcagaattacacaattgcataattgacaaggaggtgagtctgatggccgaaatggacaaggttaaagaagaagcaatggaaatcctgacggcgcggcagaaaaaggccgaagagctcaagcgcctcacagatttggccagccaaatggctgagatgcagctggcggagctgcgcgccgagatcaaacattttgtttcagagcgaaagtatgatgaagagttgggtaaggccgccagattttcctgtgatatcgagcaactcaaggcccagattatgttgtgcggtgaaatcacccatcccaagaacaactatagctcccgaacaccttgttcttctctgctgcctctccttaatgcacatgccgcaacttcaggaaagcaaagcaatttttctagaaagagttcaacccacaacaaaccttctgagggcaaggctgctaaccccaaaatggtatcaagcctccctagcaccgccgatccaagccaccaaacaatgcctgccaataaacagaatggatcctctaaccaacggagacgattcaacccgcaatatcacaacaatcggttgaacggcccggccaaatcccaaggaagtggtaacgaggccgagccactaggtaaggggaactccaggcatgagcatcgcaggcagccacataacggttttagacctaaaaacaaaggtggtgccaaaaaccaggaggcgtccctggggatgaagacgccggaggcccctgcacacagtgagaaacctaggagacggcagcacgctgccgacacaagcgaagcccggccattccggggatcagtcgggagagttagccagtgtaatctctgccccactcggattgaggtttcaaccgacgccgcggtcctgagcgtcccagccgtaactctggtggcctag

SEQ ID NO: 206835 - DNA, 465 bp, Artificial Sequence
  Description of Artificial Sequence: Synthetic coding sequence
atggccgagctgaacacccacgtgaacgtgaaggagaagatctacgctgtccgctcggtggtcccaaataagagtaataatgagattgtgttagtcctacagcagtttgattttaatgtcgataaagccgtccaggccttcgtcgacggcagtgccattcaagtactaaaggagtggaacatgaccggcaaaaaaaagaacaacaagcggaaaagaagtaaatctaagcagcatcagggtaacaaagacgccaaggataaggtcgaacggcccgaagccggaccactgcagccccaaccccctcagattcagaacggcccgatgaatgggtgcgagaaggacagtagcagcacggattcagcaaatgagaaaccagcccttatcccgagagagaagaagattagcatcctcgaagagccatctaaagctctgagaggggtgacagaagggaacaggctcctctag

SEQ ID NO: 206836 - DNA, 423 bp, Artificial Sequence
  Description of Artificial Sequence: Synthetic coding sequence
atggccgagctgaacacccacgtgaacgtgaaggagaagatctacgctgtcaggagtgtggtgcccaacaagagtaataacgaaatcgtgctggtcctccagcagtttgatttcaatgtggacaaggccgtccaggcattcgttgatggttcagcgattcaagtgcttaaggaatggaatatgacgggtaagaagaagaataataaacggaagcgctccaagagtaaacagcatcagggaaataaggacgccaaagacaaggtggagaggcctgaagccggacctctccaaccccagccaccgcagatccagaacggccccatgaatggttgtgaaaaagattcatcgtccacggacagcgccaatgaaaagccagcactgatcccccgtgagaagaagattagcattttggaggaaccatag

SEQ ID NO: 206837 - DNA, 42 bp, Artificial Sequence; identical to SEQ ID NO: 100643
  Description of Artificial Sequence: Synthetic coding sequence

SEQ ID NO: 206838 - DNA, 285 bp, Artificial Sequence
  Description of Artificial Sequence: Synthetic coding sequence
atggccgagctgaacacccacgtgaacgtgaaggagaagatctacgctgtgcgttccgtggtgcctaataaatcaaataacgagattgtgttggtactgcagcagtttgacttcaacgtcgacaaggccgtgcaggctttcgtagacgggtccgctatccaggtgttgaaggagtggaacatgacgggaaaaaagaaaaacaacaagaggaagcgctcaaagtctaagcagcaccagggtaacaaagacgcgaaggacaaagtggaacgtcctgaggctgggtag

SEQ ID NO: 206839 - DNA, 348 bp, Artificial Sequence
  Description of Artificial Sequence: Synthetic coding sequence
atggccgagctgaacacccacgtgaacgtgaaggagaagatctacgcagttagaagcgtggtccccaataagagcaacaatgagattgtgctcgtgctccagcagttcgacttcaacgtcgacaaagccgtccaggcgtttgtggatggctcggctatacaggttctaaaagagtggaacatgaccggcaaaaaaaaaaataacaaacgcaagaggtctaagtctaagcagcatcagggtaacaaggatgccaaggataaagtggagcgccctgaagccggtccgctgcaaccccagccaccccagattcagaacggcccaatgaatgggtgcgagaaggattcctag

SEQ ID NO: 206840 - DNA, 72 bp, Artificial Sequence
  Description of Artificial Sequence: Synthetic coding sequence
atggccgagctgaacacccacgtgaacgtgaaggagaagatctacgccgtgcggagcgtggtcccaaactag

SEQ ID NO: 206841 - DNA, 522 bp, Artificial Sequence
  Description of Artificial Sequence: Synthetic coding sequence
atggccgagctgaacacccacgtgaacgtgaaggagaagatctacgccgtgcggtctgtcgttccaaacaaatccaacaacgaaattgttctggtcctccagcagttcgactttaatgttgacaaagcagtgcaggctttcgtggacggatccgcgatccaggtcctgaaggagtggaacatgactggtaaaaaaaagaataacaagcggaaaaggagcaaatctaagcagcatcagggtaacaaagacgccaaggacaaagtcgaaaggccagaagccggccctctgcagcctcaaccacctcagatccagaacgggcctatgaacgggtgcgagaaagacagttcgtcaacggactctgctaacgagaaacctgctttgattccacgggagaagaaaattagcattctggaggaaccgagcaaggctctgagaggggtgacaggccccaatatcgaaaagtccgtaaaagaccttcagcggtgcactgtgtctctcacgcggtaccgggtgatgatttag

SEQ ID NO: 206842 - DNA, 1677 bp, Artificial Sequence
  Description of Artificial Sequence: Synthetic coding sequence
atggccgagctgaacacccacgtgaacgtgaaggagaagatctacgctgtgcggtcggtggtccccaacaagtcgaataatgagatcgtgttggtcctccagcaattcgatttcaacgttgataaggccgtacaggcatttgtagacggcagtgccattcaggtacttaaagaatggaacatgactgggaagaaaaaaaacaataagcgcaagagaagcaagtccaagcaacatcagggtaacaaagacgccaaggacaaagttgaaagaccagaagctgggccacttcagccccagcccccccaaatccagaacggacctatgaacggctgtgagaaagattccagcagtaccgactctgctaatgagaagcccgccctcattcccagggaaaaaaaaatctcaatcctggaggagcctagcaaggcattacggggcgtgactgaaggcaaccgtctactgcagcaaaagctatcactggacggaaacccaaagcctatacacgggacaactgaacggtccgatggcctccagtggtccgcggaacaaccctgtaacccaagtaaacctaaagcgaagacctctccagtcaaatccaatacgcctgccgcccatttggaaatcaaaccagatgaattggcaaagaaacggggccctaacattgagaaaagcgtgaaggacctgcaacggtgtacagtctctctcacacggtaccgagtgatgatcaaagaggaggtggactcgtcggtgaagaagatcaaggcagccttcgctgagttgcataattgcattatcgataaggaggtgtcattaatggctgagatggataaagttaaagaggaggccatggaaatcctcacagctcgtcagaaaaaggctgaagagctgaagcgcctgacagacctagcaagtcaaatggctgagatgcagttggccgaacttagagcagaaatcaaacatttcgttagtgaacgaaaatacgacgaagagctggggaaggccgctcggtttagctgcgatattgaacagcttaaggcgcagataatgctttgcggcgaaatcacccaccccaaaaacaattacagtagtcgtactccttgttccagcctcttgccccttcttaatgcacacgccgctacaagcggtaaacagtccaactttagccgcaagagtagcacacataacaagccgtctgaaggcaaggccgcaaaccctaaaatggtctctagtctgcctagcaccgccgacccttcacaccagacaatgccagccaataagcagaacggttcatctaaccagcggcggagatttaatcctcagtatcataacaatcggcttaacggacctgccaagagccaggggagcgggaatgaggcagaaccactggggaagggaaatagtaggcacgagcacagacgtcagccccacaacgggtttcgcccaaaaaacaagggcggcgcgaagaaccaagaagccagcctggggatgaaaacaccggaggcgcccgctcactctgagaaacctcggcggcgacagcacgcagccgacacatccgaggcaagacccttccgtgggtctgtggggcgcgtgtcccagtgcaatctgtgccctacccggatcgaggtaagtacggacgccgcggttctgagcgtgccagccgtgactcttgtggcatag

SEQ ID NO: 206843 - DNA, 567 bp, Artificial Sequence
  Description of Artificial Sequence: Synthetic coding sequence
atggccgagctgaacacccacgtgaacgtgaaggagaagatctacgctgtgagatctgtcgtacctaataaaagcaacaatgagatagtgctcgtcctgcagcagttcgacttcaacgtggataaggccgtgcaggcgttcgtcgatggctctgcaatccaagtacttaaggaatggaacatgacggggaaaaagaaaaataacaagcgcaaacgatctaaaagcaaacagcaccaaggcaataaagatgccaaagataaagttgaacgaccagaggccgggccccttcagccgcagccacctcaaatccagaacggccccatgaatggttgtgagaaagattcctcgagcacggactccgcgaacgagaagcctgctctcatccccagagagaaaaagatctccatcctggaagagccctcaaaggcgttgcgtggtgtgaccgaaggcaataggctgcttcagcagaagctctctctggatggaaaccctaaacccatccacgggactacagaaaggagtgacgggctgcagtggtccgctgaacagccgtgtaacccgtcgtag

SEQ ID NO: 206844 - DNA, 909 bp, Artificial Sequence
  Description of Artificial Sequence: Synthetic coding sequence
atggagcccggccccgacggccccgccgccagcggccccgccgccatcagggaaggatggttccgtgagacctgctcactatggcctgggcaggccctcagcttgcaggtggaacagttacttcatcaccgccggtcacgttatcaagatattctcgtatttcggtccaagacctatggcaacgtcctcgtcctggacggcgtgattcagtgcacagagcgtgacgaattcagctatcaggagatgatcgccaatctgcccctgtgcagccaccccaatccacgaaaggtactcatcatcggaggtggggatggaggcgtgctcagggaagtggtcaaacatccctctgtggagagcgtcgtccaatgcgagattgacgaagatgtgatccaggtctcaaagaagtttctgcccggcatggctataggctatagctcaagcaagctaacattgcacgtcggggatggttttgagtttatgaagcaaaatcaggatgccttcgatgttatcattaccgattcttccgacccaatgggtcccgccgagagtctgttcaaggaatcctattatcagttgatgaaaacagccctcaaagaagatggggtactctgctgtcagggagagtgccaatggctgcatttagacctgatcaaggagatgcgtcagttttgccaaagcctgttcccggtcgtggcctacgcctactgcaccatccctacctaccctagtggtcagatcggttttatgctttgctccaagaatccttccacaaacttccaggaacctgtgcaacctctaacacagcagcaggtcgctcagatgcagcttaaatattacaattccgacgttcatagggccgcattcgtattgccagagtttgcacggaaggcgttgaacgatgtcagctag

SEQ ID NO: 206845 - DNA, 600 bp, Artificial Sequence
  Description of Artificial Sequence: Synthetic coding sequence
gaggagccccccccccccaccgtgcaggtgcagggccccggcccccaacgcgaggagaaacagaaaactaagatggcaaaattcgtcatccggcccgctaccgccgctgattgctccgatatcttacgcctcattaaggagctggccaaatacgaatacatggaagaacaggtgatcctcaccgagaaggatcttctggaagacggattcggggagcaccccttttatcattgcctggtggcagaagttccaaaggaacactggacgcctgagggaaatccatccccatttcctgaggcccgggaaaccaaatgttactactttacttatgatccctggatcgggaaattgctctaccttgaggatttcttcgtcatgagcgattacaggggactgtggcatcggatcaggaactccgaggaaagtaaaccgggctgtaatgaagtgtctctggctgcttgcacctcttgggctgagtggaacgaaccaagcatcaacttctacaagcggcggggtgcctccgacttgtcttctgaagaggggtggaggctatttaaaatagacaaggaatacttactgaagatggccactgaggaatag

SEQ ID NO: 206846 - DNA, 453 bp, Artificial Sequence
  Description of Artificial Sequence: Synthetic coding sequence
atggccaagttcgtgatccggcccgccaccgccgccgactgcagcgatatcctccggctgataaaagagcttgcaaaatacgaatatatggaggaacaggtaatcctgaccgaaaagggcaacagtaccgtcgccgggcggggcacctctgtccgatgtctgagcccctccccgcggccgttacctcccctgctgcccctgctcgccgacttgttggaagacgggttcggagagcatccattctatcattgtctggtggccgaagtgccaaaagagcactggactccagaaggaaacccatccccgttccccgaagctagagaaaccaagtgttacgtgcgtagcagcgtgggatgtgtcgagcctctgacaacccaggccgaggtgactgagaacttggataggaagaatagccagcaggttttcaaactgctcaggaagaagaaaaactag

SEQ ID NO: 206847 - DNA, 363 bp, Artificial Sequence
  Description of Artificial Sequence: Synthetic coding sequence
atggccaagttcgtgatccggcccgccaccgccgccgactgcagcgacatcctgagactgatcaaagaactcgctaagtacgagtacatggaagagcaggtgatacttactgaaaaggatctgctcgaggacggatttggagagcatcctttctaccattgtctggtggccgaggtgcccaaagaacactggacccccgagggcaacccgagccctttcccagaggcccgcgagactaagtgctacgtgcgctcatctgttggatgcgtggaacctcttacaacgcaagcggaggtgacagagaacttggataggaagaatagccagcaggtttttaagctgctgcgcaagaagaaaaactag

SEQ ID NO: 206848 - DNA, 432 bp, Artificial Sequence
  Description of Artificial Sequence: Synthetic coding sequence
atggccaagttcgtgatccggcccgccaccgccgccgactgcagcgacattctaagactaatcaaggagttagccaaatatgaatacatggaggagcaagtgatattaacagaaaagggccactctattgttggatttgctatgtactactttacttatgacccttggatcggcaaactcctctaccttgaggacttttttgtcatgtcagactataggggctttggtattggcagcgaaatcctgaagaaccttagccaagttgctatgcggtgcagatgctctagcatgcattttctcgtcgcggaatggaacgaaccttctatcaatttctataaaaggcggggggccagtgacttgagcagcgaagaagggtggcggctgtttaagattgataaggagtatctcctcaagatggccaccgaagagtag

SEQ ID NO: 206849 - DNA, 516 bp, Artificial Sequence
  Description of Artificial Sequence: Synthetic coding sequence
atggccaagttcgtgatccggcccgccaccgccgccgactgcagcgacattctccgtctgattaaagagctggctaagtacgaatacatggaggaacaggtaatactcaccgagaaggatcttctcgaggacggatttggcgagcatcctttttaccattgtctcgtggccgaggtccccaaggagcactggaccccagaggggcactcgatagtgggctttgcgatgtattattttacctatgacccctggatcggtaaattgctgtatctagaggacttcttcgtgatgtccgattacaggggcttcggaatcgggtcagagatcctgaagaacctgagccaagttgcaatgcgttgccgttgcagctccatgcacttcctggtcgccgagtggaatgagccctcaataaatttctataaaaggcgcggtgctagtgacctgtctagcgaggagggctggcgcttgtttaaaatcgacaaagaatacctgctcaaaatggccacggaagagtag

SEQ ID NO: 206850 - DNA, 513 bp, Artificial Sequence
  Description of Artificial Sequence: Synthetic coding sequence
atggccagcgtgcggatccgggaggccaaggagggcgactgcggcgatatcctcaggcttatccgcgagctagccgagttcgagaagctgtctgaccaagtgaagatctcggaagaagccctcagggccgacggattcggtgacaaccctttctaccattgcctggtagccgagatcctgcccgctcccggaaaactgcttggaccctgtgtcgtgggatacgggatttactacttcatatactctacctggaaaggaagaactatttacttagaagacatctacgtaatgcctgaatacagaggccagggcattggcagtaagatcataaaaaaagtagcggaggtggccctggacaaaggctgcagccagttcaggctcgcagtcctggactggaatcagcgtgccatggacttgtacaaggccctaggagcacaggatctcacagaggccgagggctggcacttcttctgttttcaaggcgaggcaactcgcaagcttgccggaaaatag

SEQ ID NO: 206851 - DNA, 750 bp, Artificial Sequence
  Description of Artificial Sequence: Synthetic coding sequence
atgcccggccagcggatcgccagcctggcctacagcctgctgccctatggtgcggggattcccgcccccctaacgagacctcggcttccacgccgcccaccgagactgccccctccgcggagtctgagactctttcgcatccaggtgcggcgcccttttaaagggagtagctgtagactgaggggcccaggcaccctggtccccgactcaggggaccctgacggatttcgggcagatcccagaggacaggggggtcgcctctggaggtacccggaggcagacagcggcgaggactgccgccctgagctcgcggaatttgagaaattgtcagatcaagtgaagatctcagaggaagcactgagagccgacggcttcggcgataatcctttttatcactgtctcgtagcagaaattctgcccgctcccgggaaactgcttggcccctgcgtggtaggatatggaatctactacttcatttactcaacgtggaaaggccgaacaatttaccttgaagacatttatgtcatgccagagtatcgggggcaagggatcggctcaaagataataaagaaagtcgccgaagtcgccctcgacaaaggctgcagtcaattcaggctcgcagtattggactggaatcagcgggcgatggatctgtacaaagctctcggcgcccaggacctgaccgaggccgagggatggcactttttttgcttccagggggaggccacccgaaagctagcagggaagtag

SEQ ID NO: 206852 - DNA, 942 bp, Artificial Sequence
  Description of Artificial Sequence: Synthetic coding sequence
atggccgccgcccggcacagcaccctggacttcatgctgggcgccaaggcagatggtgagacgatcttgaaagggctgcagagtatctttcaggaacagggcatggcggagtccgtgcacacatggcaagatcacggatacttagctacatacactaataaaaacggacgcctgccccccatcgtccgggggggtgctattgaccggtattggccaaccgcagacggccgcctggtcgagtatgatattgacgaggttgtgtatgacgaggactctccataccaaaacattaaaatcttgcacagtaagcagttcgggaacattctcatcctgtctggtgacgttaaccttgcggaatctgacctcgcctatacccgcgcgataatgggctctgggaaggaggactacactggcaaggatgttctgatccttggtggaggagacggaggcatactgtgcgagatcgttaagctgaagccaaaaatggtgacaatggtggaaattgaccaaatggtaattgatggctgcaagaagtatatgcgcaaaacttgtggtgatgtgctggataacttgaaaggcgattgttatcaggtgctgatagaggattgtattcctgtgctgaagcggtatgcaaaggaagggagagaatttgattatgtgatcaatgacctcactgcggttcctattagcacctcacccgaggaggattctacgtgggaatttttgaggctcattctggacctcagcatgaaggtgctgaagcaggacggcaaatacttcactcagggaaactgtgtgaacctgactgaggctctgagcctgtacgaggagcagctgggaagactttattgtccagtcgagtttagcaaggagattgtgtgcgtcccatcttatctggagttgtgggtgttttacaccgtttggaaaaaagccaagccatag

SEQ ID NO: 206853 - DNA, 1101 bp, Artificial Sequence
  Description of Artificial Sequence: Synthetic coding sequence
atggccgccgcccggcacagcaccctggacttcatgctgggcgccaaagcggatggtgaaaccatcctcaaagggttacagagcatttttcaggaacaggggatggcggaaagcgtacacacttggcaagatcatgggtacctggcaacctacacaaacaaaaacggatcatttgccaaccttaggatttacccacatggattggttctcctggacctacagtcatatgacggggatgctcagggaaaggaagagatcgactcaattctaaacaaggttgaggagcgcatgaaggaactgtctcaggactcaacagggcgagtgaaaagactaccacccatcgtgaggggcggggccattgacaggtattggccaacagctgatggcagactcgtggagtatgatatcgacgaagtcgtctacgacgaggacagcccttaccagaacattaagatactgcactccaagcaatttgggaacatcctgatactcagtggggatgtgaatctggcagaatcggacctggcctacactcgggccatcatgggcagcggcaaggaagattacaccggcaaggatgtgctcattctcggggggggcgacggtgggatactctgcgaaatagtgaagctgaagccaaaaatggtgactatggttgagattgatcagatggttatcgatgggtgtaaaaagtatatgcgaaaaacctgtggcgacgtattggacaacctcaaaggcgattgctaccaggtcctcattgaggactgtatccctgtactgaaacggtacgctaaggagggaagagagtttgactatgttattaatgacctaaccgctgtccccatcagcacatcgcccgaagaggactccacctgggagtttctgcgactgattctggacctcagcatgaaggtcctgaagcaagatgggaagtattttacgcagggaaactgtgtaaacctgactgaagcattgagtctgtacgaggagcagctgggtagactgtattgccctgtcgagttcagcaaagaaattgtgtgtgtcccttcatatctggagttgtgggtcttctacacggtatggaaaaaggctaaaccttag

SEQ ID NO: 206854 - DNA, 828 bp, Artificial Sequence
  Description of Artificial Sequence: Synthetic coding sequence
atgaaggagctgagccaggacagcaccggccgggtgaagcggctgccaccaattgtaaggggcggggctatcgacaggtattggccaacagcggacggcaggctagtggaatatgacatcgatgaagtcgtgtacgacgaggattccccttaccagaacattaaaatccttcattccaagcaattcggcaacatcctcattttatccggtgacgtaaatctcgctgagtcggaccttgcctatacccgggcaatcatgggatcagggaaggaggactacacaggaaaggatgtgctcatacttggcggcggggacggcgggatcctgtgcgagatcgtcaagctgaaacccaaaatggtaactatggtggagatcgatcagatggtaatagatgggtgtaaaaagtacatgcgcaagacctgcggcgatgtgctggacaatttgaaaggggactgctatcaggttctgatcgaggattgcatcccggtgttgaaacgctatgccaaagagggaagggagtttgactatgttattaatgacctcaccgcagttcctatttcaactagcccggaggaagacagcacttgggagttcctgaggttgatactggacttgtcaatgaaggttctgaagcaggatggaaagtacttcactcaggggaattgtgtgaacttaacggaagcactgagtctctatgaagaacagctggggagactttactgcccagtggagttttccaaggagatcgtctgtgtgcctagttacttagaacttttcctcctgcaattctggcgtgtccggtcgagcaaatgtgcactggagggatag

SEQ ID NO: 206855 - DNA, 936 bp, Artificial Sequence
  Description of Artificial Sequence: Synthetic coding sequence
tgaggcggccgggccgaggccgccctgctgctggccccccggagcgtgccagcagcggcacgcggactccaggggcagtcccgagtacctgcaggcagggcagccctaccaggtcctggccgaccccccgctcttccaagaggcctcgccgcattcgccctaccactgggggagtcccccgggtgcagagcccgcgccgaccctccgtgggacgaaggctgtagagactgtggaggtgctaggcgtgatccccgaggcgagcccggcctcggtgcttgtgctgagcgcggctgtcccagagatttatttctgtttcttcaggcagctgatggggaaaccattctgaaggggctgcagtctatattccaagagcagggtatggccgagagtgtccatacttggcaggaccacgggtacctcgccacttacactaataaaaatggatcatttgctaaccttcggatctatcctcatggtctagtgctactcgacctacaatcctatgatggcgacgcccaaggaaaggaggaaatcgactccatccttaacaaagtggaagagcggatgaaagagttgagtcaagactcaaccgggcgggtcaagcgcttgccgccaattgttcgagggggggccattgaccgatactggccaacggcagatgggcgtctggtggagtatgatatcgacgaagtcgtgtacgatgaggattccccttaccagaatataaagattctgcatagcaagcagtttggaaacatattaatcttatccggcgatgtcaacctggccgaaagcgaccttgcctatactagggccatcatggggtctgggaaggaggattacaccggcaaagacgttctaatacttggcggaggggacgggggaatactctgcgaaatcgtaaaattgaagccaaaaatggtgaccatggtttag

SEQ ID NO: 206856 - DNA, 3801 bp, Artificial Sequence
  Description of Artificial Sequence: Synthetic coding sequence
cgggaggccaccccccccctgcggggcctgcccgcccccccccggcacgcgcccttccctgctggtagatttgaaccacctaggaccaaacaaggtggccgcggcagccatacaccttgggtttacgtgatcaatgatctgggcatagaagagaaccttaaaaacgacgggaaacctaaatgtcaaacaggcggcaagagcaagagaaccatccagggcacacacaaaacaactaagcagcagagcactgccgtagactgtaagatcaccagctcaaccacaggggataaacattttgataaatctccaactaagacaaggcacccccgcaagattgatcttagagcccgatactgggccttccttttcgataacctgaggcgagctgtggatgaaatctatgtaacctgtgagagcgatcaatcagtcgtggaatgcaaggaagtgttgatgatgttggataactatgtcagagatttcaaggccttgatcgactggatacagcttcaagagaaacttgaaaaaacagacgcccagtctcgcccaacatccctggcttgggaagtcaagaagatgtcccccggccggcacgtgattcctagtccatccactgatcggatcaatgtgacatccaacgccagaagatccttgaacttcggtggctcgaccggtacagtacctgctccccgcttggcccctaccggcgttagctgggctgacaaagtgaaagctcatcacacaggctccaccgcatcatctgaaattactcccgcgcaatcatgtccacctatgactgtgcaaaaggcatcacgcaagaatgagcgaaaggacgcagaaggctgggagactgtacagaggggcagaccaatacgcagccgcagcactgccgtgatgcctaaagtgagcctagccaccgaagctactcggtccaaagacgactccgacaaggagaacgtctgcctcctcccagacgaaagtatacagaagggccagtttgtgggtgatggcacaagtaatacgatagagagtcatccaaaggattctctccattcctgtgatcaccccctggcagagaaaactcagtttacagtttccactttagacgatgtaaagaacagcggcagcatccgagataactatgtgagaacctctgaaatttccgcggttcatatcgacactgagtgtgtgtccgttatgctgcaggccggaacaccacctctacaagtgaatgaggagaaattccctgccgagaaggcacggattgaaaacgaaatggatccgtccgatattagcaacgtgagcgctgcaaatctcagtatggctgaagtgctcgccaagaaagaagagctggcggacaggttggagaaggcaaacgaggaggccatcgccagcgccatcgcagaggaagagcaactgacaagagagatcgaggccgaggaaaacaacgatatcaacatcgagactgacaatgactcagatttcagcgcctccatgggcagcggctcggtaagtttttgcggtatgtcaatggactggaacgatgttctagctgactacgaagccagggaatcctggcggcagaatacttcttggggcgacattgttgaagaagagcccgctcgaccacccgggcatggtattcacatgcatgagaagttgtcttcaccgagccgcaagcgcacgatcgcggagagcaaaaaaaagcatgaggagaagcaaatgaaggcccaacagctgagagagaagctgcgtgaggagaagacactgaagctccagaaacttttggaacgggagaaggacgtgagaaagtggaaggaggagctgctggaccagagaagacgcatgatggaggagaagctcttacatgctgaatttaaacgggaagttcaactccaggccatcgtaaaaaaggcccaggaggaggaggctaaggtgaacgagatagcctttattaacactctcgaagctcagaataaaagacacgatgttctcagcaagctgaaggaatatgaacagaggttaaatgaattacaggaggaaaggcaaagacggcaggaggaaaagcaagctagagacgaggccgtccaagagcgcaagagggcgctggaggcagaacgtcaagctagggtcgaagaactgctcatgaaaaggaaggagcaagaggcccgcattgaacagcaaagacaggaaaaggagaaggctcgtgaggatgccgcaagagaacgtgcacgtgacagagaggagcggctcgctgccctgaccgcagctcagcaagaggccatggaggaactccagaagaagatccagttgaaacatgatgagagcattagaaggcacatggaacaaatagagcagcggaaggagaaggcggcggagctgtctagcgggaggcacgcaaataccgattacgccccaaagctgaccccttatgagagaaagaagcagtgtagcctgtgtaatgtcttaatatctagcgaagtctacctgttcagccacgtgaaagggcgcaagcaccagcaagccgtgagagagaatacctcaattcaaggccgggagctgtctgatgaggaggtggagcatcttagccttaaaaagtatatcatcgatattgtggtcgagagcactgcgcccgcagaagcgttgaaagacggcgaggagaggcagaagaacaaaaaaaaagccaagaagataaaagctaggatgaatttcagggccaaggagtacgagtcccttatggagaccaaaaattctggaagcgactccccctacaaagctaaattgcaacgcctggccaaggatttactgaaacaggtccaggtccaggacagtgggagctgggcaaacaataaggtgagcgctctcgataggacactgggggaaatcactcgcatattggagaaggagaatgtggcagatcagattgcattccaggcggcaggcggtctcaccgccttagaacacatcctgcaggcggtagtgccagccacaaatgtaaatactgtgttgagaattcccccgaagagtctttgcaacgccattaacgtatataacctcacgtgtaacaactgctccgagaattgttcggatgtgctgtttagcaacaagattactttcctgatggacctcctgatccatcaactgacagtctacgttcctgatgaaaataatacgattctgggacggaacacgaacaagcaggtcttcgaggggctcactacaggacttctcaaagtgagtgctgtggtcctagggtgcctaattgctaatagaccagatggaaattgtcagcccgccacgccaaaaatccccactcaagaaatgaagaacaagccatcccagggcgacccatttaataacagggttcaggacctcatttcctacgtagtgaacatgggtctgattgacaaactttgtgcatgttttctgtctgtgcaggggcctgtcgatgaaaaccctaaaatggcgattttcctccagcatgcggcaggtctgctccacgcaatgtgtaccttatgcttcgccgtgacgggcagatcctattccatttttgacaataataggcaagatccgaccggtttgaccgccgcactgcaggccacggatctggctggggtactgcacatgctgtattgcgtgctctttcacgggacaatccttgaccctagcactgccagccccaaggagaattatacacagaataccatccaagtcgcgatccagtccctgagatttttcaactccttcgcagccctgcacctgcccgcctttcaggtgccttcgatcggcctgtacaggtgctag

SEQ ID NO: 206857 - DNA, 4203 bp, Artificial Sequence
  Description of Artificial Sequence: Synthetic coding sequence
atgatggccagcttccagcggagcaacagccacgacaaggtgcggcggatcgtcgccgaggagggccgcacagcccgaaatctcattgcttggagtgttcctctggagagtaaggacgacgacggaaagcccaaatgccagactggtggcaaatctaagcgcacgattcaaggcacacacaaaacaaccaaacagtccactgctgtagactgtaaaatcaccagcagtaccacgggggataagcactttgacaaatcgcccaccaagacccgacacccaagaaagatcgacctgagggccaggtactgggcgtttctgtttgacaacctgcggagggccgtggacgagatatacgtcacttgcgaatccgaccagagcgttgtggaatgcaaggaggtgttgatgatgctggataattatgtccgcgatttcaaagcactgatagactggatccagctgcaagagaagttggagaaaacagatgctcaaagcagacccacctcgctcgcctgggaggtgaagaagatgtctcccggccgccatgtcatcccttctcccagcactgatcgcattaacgtaacttctaatgctcgtagaagtctcaacttcggtggctcgaccggaacagtgcctgcaccacgccttgcacctaccggagtgtcttgggctgacaaagtgaaagcccaccacactggctcgacagcgagttccgaaatcacaccagcgcagagctgccctccaatgacggtccagaaggcctcacgcaaaaacgagagaaaggacgctgagggatgggaaaccgtacaacgggggaggcccatccggagtcgctcaacggcagtgatgcccaaagtgagcctcgctacagaggctaccagaagcaaagacgactcagataaagagaacgtgtgcctcctgccggacgaatccatccagaaaggtcagttcgtcggcgacggcacctcaaacactattgagtcacatcccaaggactccctccactcctgtgatcatcctttggcggagaaaactcagtttaccgtaagcaccttggatgatgtcaagaactcaggaagcattagagacaactatgttcgcactagcgaaatttccgccgtccatatcgatacagagtgcgtgagtgtgatgctccaggcagggaccccacccctgcaagtaaatgaggaaaaattccccgccgaaaaggcaagaatcgagaacgaaatggatccgtccgacatttctaacagcatggccgaagttctggcaaaaaaggaagagctggctgatcggctggaaaaagccaacgaagaggccattgcctctgccattgctgaagaagagcaacttacgagggagatagaggccgaagagaacaatgacataaatattgaaacggacaacgattcagacttcagtgcttcaatggggtcaggatctgtcagcttctgtggtatgagtatggactggaacgatgtgctggcagactatgaagctcgagaaagctggcggcagaacaccagttggggggacatagtagaggaggaaccagcacgacctccgggtcacggcatccacatgcacgagaagctgtcctccccctctaggaagcgcaccatcgccgagagtaaaaagaagcacgaagagaaacaaatgaaggcccaacaactccgagaaaagctacgcgaggagaagactcttaagttacaaaagctgctcgagcgcgagaaggacgtgagaaaatggaaggaggaactgctggatcagcggagacggatgatggaggagaagctcctccatgccgaatttaaaagggaggtccaactgcaagcgattgtgaaaaaggcacaggaggaagaagcaaaggtaaacgaaatcgcctttatcaatacactggaggcgcaaaataagaggcacgacgttctctctaagttgaaggaatatgagcagcggttgaatgaactccaggaggaacgccaaaggaggcaggaggaaaagcaggcacgagatgaagcagtgcaggaacggaagagggcactggaggccgagcggcaggccagggtggaggagctcctcatgaaacgaaaagagcaggaagcgcgcatcgaacagcaacgtcaggagaaggaaaaagccagagaggacgctgccagagagagagctcgtgatagggaagaacggttagccgctctgaccgcagctcagcaggaagctatggaggaacttcaaaaaaaaatccagttaaagcacgatgagagcatcaggaggcatatggaacaaatcgagcagaggaaagagaaggcagccgagttgagcagcgggagacacgccaacacggactatgcgcccaaactgacaccctatgagcggaagaagcaatgttccctgtgcaatgtattgatttcatcagaggtctatctcttttcccacgtcaagggcaggaagcatcagcaagctgttcgcgaaaacacttccatccagggtcgtgagctgagcgatgaggaggtcgaacacctatctttgaaaaagtatattattgacatcgtggtcgagtcaactgccccagctgaggctctgaaggacggagaggagcgccagaaaaataaaaaaaaggctaagaagatcaaagcgcggatgaacttccgtgcaaaagagtacgagtccctgatggaaaccaagaactcggggagcgattcgccttacaaggccaagttacagaggctggctaaagatttactaaaacaggtccaggtgcaggattctggatcctgggcaaataataaagtcagcgccttagatcggacgctgggtgaaataacaagaatcctggagaaggagaatgtggcagaccaaatcgccttccaagccgctggcggcctaactgccctggagcacattctgcaggccgttgtgcctgctacaaacgtcaacaccgtgctgcgcatccctccaaaaagtctgtgcaatgcgataaatgtctacaacttgacgtgtaataactgtagtgagaactgctccgacgtgttgttctcgaacaagatcacatttttgatggacctcctcattcaccaactgacagtgtacgtgcctgacgaaaacaacacgattctcggccggaacacaaacaagcaagtctttgaggggttgaccaccggcctactgaaggtaagcgctgtcgtcctgggctgcctgatcgccaatagacctgacggtaactgccaacccgcaacccctaaaatccccacccaggagatgaagaataaaccatcccagggcgatccctttaataaccgagtccaggatctcatctcatacgtggtgaacatgggcttgattgataaactctgtgcctgctttttatcagttcagggcccggtggacgagaacccgaaaatggctatctttttgcaacatgccgccggactgctgcatgcaatgtgcaccctctgtttcgcagttacaggaaggtcatactctatcttcgacaacaatcgtcaagatcctaccggcctgacagctgccttgcaggcgacagacctggcaggtgtgctgcacatgctctattgtgtactattccacggcacaatcctggacccttccaccgcctcaccaaaagaaaattatactcagaataccatccaggttgccattcaatccctccgcttttttaatagttttgccgctctgcacttaccagccttccagagtatcgtcggtgctgagggcctgtctttggcctttcggcacatggcctcctctctgctggggcactgctcacaggttagctgtgagtccctacttcatgaggtgattgtgtgcgtgggctatttcactgttaatcaccctgacaatcaagtgatcgtacagtctgggcgacaccccacagtgctgcagaaactctgccaacttccatttcagtatttctctgacccacgcttgatcaaagtactgtttcctagcctgattgcggcgtgctacaacaatcaccaaaacaagattatcctggaacaagaaatgagttgcgttttattggccacctttattcaggacctcgcccaaacaccaggccaggcagagaatcagccctatcagccaaagggcaaatgtctcggcagccaggactatctggaacttgccaacaggttccctcagcaggcctgggaggaggcaaggcagttctttctaaaaaaggagaagaagtag

SEQ ID NO: 206858 - DNA, 3465 bp, Artificial Sequence
  Description of Artificial Sequence: Synthetic coding sequence
atgaagaccaagtacatcttctgcaacatcaccgagcggaaggacgccgaaggttgggaaacagtacagcggggccggcccattagatctcggtccaccgccgtgatgcccaaagtatcattagctaccgaggcgacccgcagcaaggatgactcagacaaagaaaatgtctgtttgctccccgatgaatccatccagaaaggacagttcgtgggcgacggtacatctaatacaatagaaagtcatcctaaggactcacttcactcatgcgatcatccacttgcagagaagacacagttcacagtatcaaccttggatgatgtgaaaaatagtggctcgattagagataactacgtccggacctccgagatctcagcagtgcatatcgatactgaatgtgtgtcagtgatgctgcaggctgggacccccccgctgcaggtcaatgaggaaaagttccccgctgagaaagctaggatcgaaaacgagatggatccctccgacattagcaattcaatggcagaagttctggccaagaaggaggagctagcagatcgtctggaaaaggcaaacgaagaagccatcgcgagtgctatcgccgaagaggagcagctgacaagagaaattgaggctgaggaaaataacgacatcaatattgagacagacaacgatagtgactttagtgcttccatgggaagcggtagcgtgagcttctgcgggatgagtatggattggaacgacgtcctggctgattacgaggcccgtgagtcttggaggcagaacacaagttggggggacatcgtggaagaagagccggcccgcccacccggccacggcatccacatgcacgagaaattgtcctcgccctcacggaagcgtacgattgccgaaagcaagaaaaagcatgaggaaaagcagatgaaggcacagcagctgcgggagaagctccgtgaagaaaagactcttaaactgcagaaacttttggaaagagagaaggatgttcggaagtggaaggaggaacttttagaccaaaggagacgcatgatggaagaaaagctattgcacgccgagtttaaaagggaagtgcaattacaggccattgttaagaaagctcaagaagaagaggctaaagtgaacgagatcgcttttatcaatactttggaagcacagaacaagagacacgacgttttatctaagctgaaagagtacgagcagaggctcaacgaacttcaggaggaaagacagcggcgtcaggaagagaagcaggcccgagatgaggcagttcaggagcgaaaaagggctctcgaggctgaacgacaggcccgggtggaggaactgctgatgaaacgaaaggaacaggaggcccgcatcgagcagcagagacaagaaaaggaaaaggctagggaggatgccgcgagggagagggctagggatagggaggagcggctggcggcgcttaccgcagcccaacaggaggctatggaggaactgcagaagaagatccagctgaaacacgatgagagtataagaaggcacatggagcagatcgaacagcgcaaggagaaggccgccgagctaagctccggccggcatgcaaacactgattacgcaccgaagcttacaccttacgaaaggaaaaaacagtgctccctgtgtaacgtcctgatttcttcagaggtatacttattttcacacgtgaagggccgcaaacatcaacaagcagtccgcgaaaacacgtcgatccagggtcgggaactctcagacgaagaggtggaacacctcagcttgaagaaatatataatcgatatcgtagtggagagcacagctcctgcagaggccctcaaggacggagaggagaggcagaaaaataaaaagaaggcaaagaaaatcaaagccaggatgaatttcagagctaaggagtacgagagtctgatggaaaccaagaactccggaagcgacagtccttataaggccaaactgcagcgattggcaaaagatttgttgaaacaggtacaggtgcaagatagtggatcctgggccaacaataaggtaagcgccctggacaggactttaggggaaatcacgagaattctcgagaaggagaacgtcgctgaccagatagcctttcaggccgcagggggacttacagctctcgaacacatcttgcaggccgtcgtgccagccactaatgtaaatacagtgctgcgcataccccctaaatccctgtgcaatgcaattaacgtgtacaacctaacttgcaacaattgtagcgagaactgttccgatgtgctgttcagcaataaaatcacttttttaatggacctccttattcaccaactcacggtgtatgttcctgatgagaacaatacgatactggggcgtaacactaataagcaggtttttgaaggactaacaactggactgctcaaggtgtcagccgtcgttctcgggtgtctgatcgctaaccggccggatggcaattgccagcccgcaacgcccaagatccccactcaggaaatgaaaaataagccctctcaaggagatccattcaacaatagggtccaggatctcatatcttacgtagtcaatatgggtttaattgataagctatgtgcatgcttccttagtgttcaaggaccagtcgacgagaacccaaaaatggccatctttctgcaacacgcagctggccttcttcatgctatgtgcacactgtgcttcgccgttacaggcaggagctatagcatcttcgacaacaacaggcaggaccccaccggcctcactgcagctctccaggccacagatctagctggggttttgcacatgttgtattgtgtgctatttcacgggactatactcgatccttctaccgcttcccccaaagaaaattacacacagaacactattcaggtcgcaatccaaagccttcgctttttcaacagttttgctgcactgcacctcccagcatttcagtcaatcgtgggcgccgagggcctctcgctggcattccgccatatggcctcctccctgttgggacactgctcacaagtttcctgcgagtccttactccacgaagtcattgtgtgcgtgggctatttcactgtaaatcacccggacaatcaggtaatcgttcaatctgggaggcacccaactgttttgcagaagctgtgtcagctgcccttccaatacttctcagacccccgactcattaaagtgctttttccatctctcattgccgcgtgctacaacaatcaccagaataaaattattctggagcaggagatgtcctgtgtactgctcgccacttttattcaggacctggcccagacaccaggccaggcagaaaaccagccctaccaaccgaagggtaagtgtctagggtctcaggactatctggaactcgctaataggttccctcagcaggcttgggaagaggcgagacagttctttctgaagaaagagaaaaaatag

SEQ ID NO: 206859 - DNA, 4203 bp, Artificial Sequence
  Description of Artificial Sequence: Synthetic coding sequence
atgatggccagcttccagcggagcaacagccacgacaaggtgcggcgcatcgtggctgaggaagggcgtactgccagaaatctgatcgcatggtccgtgcctttagagtctaaggatgacgatggaaagccaaaatgccagacagggggtaaaagcaagcgaacaattcagggaacacataaaaccaccaaacagtcaaccgctgtggattgtaagattacttcaagtaccaccggggacaagcattttgacaaaagcccaacgaaaacccgtcaccctcgaaaaattgacttgagggcaagatattgggctttcctgttcgacaatctgcgccgagctgtagacgaaatctacgtcacatgtgaatccgaccagtccgtcgttgaatgcaaggaggtgttgatgatgctggataattatgtgcgggacttcaaagccctgatcgactggatccaacttcaggaaaagctcgagaaaaccgatgcgcagtccaggcccactagcctggcgtgggaggttaaaaagatgagccctgggagacacgtcatcccttctccttccacggataggatcaacgtgacctcgaacgccaggagatcactaaatttcggtggttccacgggaaccgtgcccgcaccccgccttgccccaaccggcgtctcgtgggcggacaaagtcaaggctcatcataccgggtcgactgcgtcctccgaaatcactcccgcacagtcatgtccccccatgacagtgcagaaggcatcacgcaaaaacgagcgtaaggacgcggaaggttgggagaccgtgcagcgtgggcggcctataagaagccgctcgactgctgtgatgcccaaagtgtctcttgccacagaggctacaagatctaaagatgactccgataaggaaaatgtgtgccttttgcctgacgagtccatccagaaagggcagtttgtgggagacggcaccagcaatacaatcgagtcccatccaaaggactcactgcatagttgcgatcacccgctggccgagaaaacgcagttcacagtttctactctggatgacgtaaaaaatagcggaagtatcagggataattacgtcaggaccagtgagatttccgcagtgcatattgatacagaatgtgtgtcggttatgctccaagcaggcacacctcccctgcaggtcaacgaagagaaattccctgcggaaaaggcccggattgagaacgaaatggatccaagcgatatttccaatagtatggccgaagttttggcaaaaaaagaggagttggccgatcgtcttgaaaaagccaatgaggaagcaatcgcatcggccatcgccgaagaagagcagctcacaagagagatcgaagctgaagaaaacaatgacattaatatcgaaactgacaacgatagcgactttagcgcttcaatgggtagcggtagcgttagtttttgtggaatgtctatggattggaatgatgtgctcgcagactacgaggctcgcgagagctggaggcaaaacaccagttggggcgatatcgttgaggaagaacccgccaggccacctggacacggcattcacatgcatgagaaactttcctccccatcacgcaaacgcaccattgcggaatcaaagaaaaagcatgaggagaagcagatgaaggcacagcaactgcgcgaaaaactcagggaggagaaaacactgaagctgcagaaattgctcgagcgtgagaaggacgtcagaaagtggaaagaggaactattagaccagcggagacgcatgatggaggagaagctcctccacgcggagtttaagcgagaggtccagctccaggcaattgtgaaaaaggcccaagaggaagaagctaaagttaacgagatcgcattcattaacacacttgaagcacagaacaaaagacatgacgtcctgtctaagctcaaagaatatgaacagcgattgaacgaactacaggaggagaggcaacggcgacaggaggaaaagcaggcccgggatgaagctgtgcaggaacgcaagcgggcgctggaggccgaaaggcaggccagagtcgaggagctgctaatgaagaggaaagagcaagaagcacgcatcgagcagcagcggcaggaaaaggaaaaagcaagggaggatgctgccagagaaagagcccgagatcgagaagaacgactcgccgctctaacagccgcgcagcaagaggccatggaggaactgcagaagaaaatacagcttaagcacgatgaatctatacgccggcacatggagcagattgagcagcgcaaagagaaagcggctgaattgtccagcggccgtcatgccaataccgactatgcacccaagctgacaccctacgaaagaaaaaagcagtgcagtttgtgcaatgtgctcatatcttctgaggtctatctgttcagccacgtgaagggccgcaagcatcagcaagcggttagggaaaatacctcaatccaggggcgggagctttccgatgaggaggtggagcatctgtctcttaaaaagtacattattgacatcgttgttgagtcaacggcacctgcagaagccctgaaggacggcgaggagcgtcagaaaaacaagaagaaagccaaaaagatcaaagcccgcatgaatttccgcgctaaggagtacgaatctctaatggagacgaaaaattctgggtctgatagtccatataaagcaaagctgcagagactggccaaggatctgctgaaacaagtgcaggtccaggactcaggctcgtgggccaacaataaagtgtcagccctagaccggaccctgggtgagatcacccgcattctcgagaaagagaatgtcgccgatcagattgcttttcaggcggccggcggtcttacggctctggagcacattcttcaagctgtcgttccagcaacaaacgtgaatacagtcctgcggattccaccaaagtccctgtgtaacgccatcaatgtgtataatttaacctgcaataactgctcggaaaactgtagtgacgtgctcttttctaataaaatcacttttttaatggaccttctgatacatcagttaaccgtttacgtcccagacgagaataacaccatactcgggcgcaataccaacaagcaggttttcgagggccttaccactggcctgctgaaggtgagcgccgttgtgctgggttgcctcatagctaaccgaccggatgggaattgccagcctgctacaccaaaaatccccacacaggaaatgaaaaataagccatctcagggtgaccctttcaataatagggtccaggacctgatcagttatgtcgtgaacatgggcctaatcgacaaactgtgtgcctgtttcctgtccgtacagggacccgtggacgagaatcctaagatggcaatattcctacagcatgctgccggcctgttgcacgccatgtgtactctatgctttgctgtgacaggtcggtcctacagcatctttgacaacaatcggcaagatccaacaggactcaccgctgccctgcaagcaaccgatttggcgggagtcctgcacatgctgtactgtgttctctttcatggcactatcctcgaccctagtacagcctctcccaaggagaactatacacaaaatactattcaagtcgccatccagtcacttaggttcttcaatagtttcgctgccttgcacctgcctgcgttccagagtatcgttggcgcagagggtctcagcctcgcatttcggcacatggcgtcaagtctgctggggcactgcagccaggtgagctgcgaaagtcttctgcacgaagtgatcgtctgtgtggggtattttacagtgaatcatccagataatcaggtaatcgtccagtccggcaggcacccaacggtcttgcagaagctatgtcagctgcctttccagtatttctcagatcctaggttgattaaggtgttatttcccagcctgatcgccgcgtgctacaacaaccatcagaataagatcattctggaacaggagatgagctgcgttctactagctacctttatccaagatctggcccagacaccaggccaggctgagaatcaaccataccagcccaagggaaagtgtctgggctcacaagactatctggaactagcgaaccgattcccgcagcaagcctgggaggaagctaggcagtttttcttaaagaaggagaaaaaatag

SEQ ID NO: 206860 - DNA, 1233 bp, Artificial Sequence
  Description of Artificial Sequence: Synthetic coding sequence
atgcaccggaagcacctgcaggagatccccgacctgagcagcaacgtcgctacctcgttcacatgggggtgggattccagtaagaccagcgagcttctttctggtatgggggtctcagccttagagaaagaggaacctgactcagagaatataccacaggaactgctgtccaacctcggccacccagaatccccccccaggaaaaggctgaagtccaagggatcagataaggacttcgttattgtcaggcgtcccaagctgaatcgcgagaatttcccaggcgtcagctgggactcactccctgatgagttgctgctggggattttctcttgtttgtgcctccccgagttgttaaaagtcagtggagtgtgcaagcgctggtatcggctcgcctctgatgaaagcctgtggcagactctggacctgaccgggaaaaatctccatccagacgtgacgggcaggcttcttagtcagggggtgattgccttcaggtgcccgcgcagtttcatggatcaaccactggcagagcacttttcgcctttccgcgtgcagcatatggatctgtcaaattctgttattgaggtgtcaactctgcatggcatattaagccaatgttcaaagctgcagaacctgtcattggagggcctccgcctctccgatccgatcgtgaatacattggctaagaatagcaacctggtgcgcctcaatctgtcagggtgttctggatttagcgagttcgcgttgcaaacactcttgtcatcctgttcccgcctggatgagctgaacttgtcttggtgttttgacttcacagagaaacacgttcaggtggccgtcgcccacgtaagcgagacgatcacccagctgaacctgagtggctataggaaaaatttgcaaaagtccgacttgtccactttggttcgcaggtgtccgaatctcgtgcaccttgacctctctgacagtgtcatgctgaagaatgattgtttccaggagttctttcagttgaattacctacagcacctgtctctgtcccgctgttatgacatcatcccagaaaccctactgctggtgacccgggccggcgtgaggatacgcctggattcagacatcggttgtcctcagacctatagaacaagcaagctaaaaagcagccataaactgttctgtcagcacgttcgggtgatctgcatattcgtgtgtgatttctacttctacagactggtgttgaaacaatag

SEQ ID NO: 206861 - DNA, 1275 bp, Artificial Sequence
  Description of Artificial Sequence: Synthetic coding sequence
atgcaccggaagcacctgcaggagatccccgacctgagcagcaacgtcgcgacaagttttacctggggctgggacagcagcaagacatctgaattgctcagtggaatgggggtttcagccttggaaaaggaggaacctgactctgaaaacatacctcaggaattactgagtaatctgggtcaccccgagtccccgccacgcaaacggttgaaatctaaaggaagtgataaagactttgtgatagtccgacgccctaagttaaaccgggagaatttcccaggagtgtcgtgggactcactgccagacgagcttctgctgggcatctttagctgcctctgcctgccggagctacttaaagtgagtggcgtgtgcaaaagatggtacaggttggctagcgacgagtctctgtggcagaccttggatttgactggtaagaaccttcatcctgacgtcaccggaagattattgtcacaaggggtcatcgcctttagatgtccaaggtcctttatggaccagcctttagccgagcatttctccccctttcgcgtgcagcacatggatctgtccaattccgttattgaggtcagtactcttcacggcattctttctcaatgctcaaaactgcagaacctcagtctggagggattaaggctcagtgaccctattgtgaatacactggccaagaatagcaacctcgtgagattgaatttatccggttgctccggattttccgaattcgccctgcagacattgctgtcctcttgtagcagattagatgaacttaatttgtcttggtgcttcgatttcaccgaaaagcacgttcaggtagctgtcgcacacgtgagtgagacaatcacacaacttaacttgtcgggataccggaagaatctccagaagtcagacctgagcacacttgtccgtaggtgccccaacctcgttcacctagatcttagcgattcagtgatgctcaagaacgactgctttcaggaatttttccagctaaattacctgcagcacctcagcctgtccagatgctacgacataatccctgagactctcctggagctcggagaaattcctactttaaaaaccctccaggtattcgggatcgttcctgatggcaccctgcagctcctgaaggaggcactcccccacctgcagataaattgttctcattttacaaccatcgctaggcccaccattggcaataaaaagaaccaagagatctggggaatcaagtgtcgcctgaccctgcagaagcccagctgcctgtag

SEQ ID NO: 206862 - DNA, 1173 bp, Artificial Sequence
  Description of Artificial Sequence: Synthetic coding sequence
atgcaccggaagcacctgcaggagaaggaggagcccgacagcgagaacatcccacaggaactgctgtcgaatctggggcatcctgagagccctccaaggaaaagactcaagtctaaaggcagcgataaggacttcgtcatcgtgaggcgaccaaagctgaatagagagaactttcccggggtaagctgggattcccttcctgatgagttgctattaggcatcttttcttgtttatgtttgcccgagctgttgaaagtcagcggcgtgtgtaagcgctggtatagactagcatcagacgagagcctctggcagacgcttgaccttactggcaagaacttgcacccggatgttaccggtcggctgctgagccaaggggtcatagcgtttcggtgtcctaggtcattcatggatcagcccttggctgagcacttttcccccttcagggttcagcacatggacttgtctaattccgtcatcgaagtctccaccttgcacgggatcctctcacagtgcagcaagttgcagaatcttagtctggagggtttgaggctgagtgacccaattgtgaacaccctggctaagaactccaatttggtgagactcaacctttctggctgcagcgggttcagcgagttcgctttacagactttgttgtctagttgttccagacttgatgaactgaatctctcatggtgctttgatttcaccgaaaagcatgtccaggtcgccgtcgcacatgtgtcagagactataactcagcttaatctgagtgggtaccgcaagaatctgcagaagagtgatctcagcacccttgtaagaaggtgtcccaacctggtacatcttgacctctcagacagcgtaatgctgaaaaacgactgctttcaggagtttttccagctgaactatctgcagcatctgagcctctccagatgctacgacataatacccgaaaccctccttgaactaggcgaaatacctaccctcaagaccttgcaggtgtttggtattgttcctgacgggaccctgcagctcctgaaggaggcactgccacacctgcagatcaactgtagtcacttcaccacaatcgccagacccaccattggaaacaagaagaatcaggagatatggggaatcaagtgtcgattgactctacagaaacccagttgtttatag

SEQ ID NO: 206863 - DNA, 633 bp, Artificial Sequence
  Description of Artificial Sequence: Synthetic coding sequence
atggaccagcccctggccgagcacttcagcaccctggccaagaacagcaacctggttcggcttaacctgagcggctgtagtggcttttcagaattcgcgctgcagacattactgagttcttgcagccggctggacgaactgaaccttagctggtgtttcgatttcacagaaaaacacgtacaggtggcggtagcacatgtttccgagacaatcacccagttgaacttgtctggctatcgaaaaaacctgcaaaaatcagaccttagcacactcgtaaggcggtgtcccaacctggtgcatctggatttgtcagattcggtgatgctgaaaaacgattgcttccaagaattctttcaactcaactacctgcagcacctctcactgagccggtgttatgacattattccagaaacactgttggagcttggggaaatccccacacttaaaaccctgcaagtgttcggcattgtgcccgatggaacactgcaacttctgaaagaagcactaccacacctccagattaactgttcccactttactacgatcgctaggcctacgatcgggaataagaaaaatcaagagatttggggcattaaatgcaggctgaccttacagaagcctagttgtctctag

SEQ ID NO: 206864 - DNA, 1362 bp, Artificial Sequence
  Description of Artificial Sequence: Synthetic coding sequence
atggccctggtgcgggccctggtgtgctgcctgctgaccgcctggcactgccgtagtgggctgggccttcccgtggcccctgcaggcgggaggaatcctcctccggccattggccagttttggcatgtcaccgaccttcaccttgatccaacctaccacataaccgatgatcacacgaaggtctgcgcaagtagcaaaggagcaaacgccagtaatcccggcccattcggtgacgtgctgtgcgacagcccctaccagctgatcctcagtgcctttgactttatcaagaactctgggcaggaagcctctttcatgatctggacgggagactcacctccccacgtgccggtgcccgagctgtctactgataccgtaatcaatgtcatcaccaacatgacaaccacaatccagtctctgttcccaaacctgcaagttttcccagccctgggaaatcacgactactggccgcaggatcagttacccgtcgtaacatccaaggtgtataacgccgtggctaatctatggaagccttggcttgatgaggaggctatctcgacattaaggaaaggaggcttctactcccaaaaggtcacaactaaccctaatctgcgaattatctcccttaatacaaacttgtattacggtcccaacataatgactcttaataaaaccgatcctgccaaccagttcgaatggctggaatccactctcaacaactcccagcaaaacaaggagaaggtctatataatcgcgcacgtccctgttgggtacctgccctcttctcagaatatcaccgcaatgcgtgaatactacaacgaaaagcttattgatattttccaaaaatatagtgatgtgattgccggccaattttacgggcacacgcatagggactccatcatggtgctgtccgacaagaagggatctcctgttaacagcctgtttgtcgcccctgcggttacgccagtgaaatcagtgctcgagaaacagacaaataaccctgggatccgcctgtttcaatacgacccaagagactacaaacttctcgacatgctacaatattatctgaacttaacagaggctaatctcaagggagaatcaatttggaaattggaatacattctcacacagacttatgatatcgaagacctgcagcccgagagcctgtacggtttagctaaacagtttactatcctggatagtaagcaattcatcaaatattataattatttttttgtaagctacgatagcagcgtgacatgcgacaagacgtgcaaggctttccagatatgcgctattatgaacctcgacaacatctcctatgctgactgtcttaaacagctttatattaagcataattattag

SEQ ID NO: 206865 - DNA, 969 bp, Artificial Sequence
  Description of Artificial Sequence: Synthetic coding sequence
atgaccaccaccatccagagcctgttccccaacctgcaggtgttccccgccctggggaatcatgattattggccccaagatcagttaccagttgttacatcaaaggtgtataacgcagtcgctaatctatggaaaccctggctggacgaggaagcgatttctaccttacgaaaggggggtttttattcccagaaagtcactaccaacccaaaccttcgaatcatcagcctgaatactaacctgtattatgggcccaacattatgacgctgaacaagaccgacccagcaaaccaattcgagtggttggagtccaccctgaataacagccaacagaacaaggagaaggtctatattatcgctcatgtcccagttgggtacctgccctcaagccagaatattaccgcgatgcgcgagtactacaacgagaagctgatagacatttttcagaaatattccgatgtcattgccggacagttttacggacatacccatcgggatagcatcatggtattgtcagataagaagggttcaccagtaaacagcctgtttgtggcccctgcggtgacacccgtgaaaagcgtcctggaaaaacaaaccaataatccaggtatacgcttgttccaatacgacccacgggactacaagctgctggatatgctgcagtactacctcaatctcacagaggcaaatcttaaaggtgagtctatctggaaactggaatacattctgactcaaacgtacgacattgaagacctgcagccagaaagcctgtacggtctcgcaaagcagttcaccatccttgatagcaagcaattcattaagtactacaactatttctttgtgtcctatgatagtagcgttacatgcgacaagacttgtaaggctttccagatctgtgccatcatgaacctggacaacatcagctatgctgactgcctgaaacagctgtatatcaagcataattactag

SEQ ID NO: 206866 - DNA, 726 bp, Artificial Sequence
  Description of Artificial Sequence: Synthetic coding sequence
atgaaggaggtggtgtactggagccccaagaaggtggccgactggcttctcgaaaatgcaatgcccgagtattgtgagcctttagaacattttacagggcaagacctgattaacctgacccaggaggattttaaaaaaccgccactttgtagggtgagctcagacaatgggcaacgcttactggacatgattgaaaccctcaaaatggaacatcacctagaggcacacaaaaatggccatgccaacggccaccttaatattggcgtggatataccaacccctgacggctctttcagtatcaaaattaagcctaatggtatgccgaatggatataggaaggaaatgattaagatcccaatgcccgagctggagaggtcacaataccctatggagtggggaaagactttcctggcgttcctttacgcactgtcctgttttgtattgactactgtcatgatatccgtagttcacgagcgggtgcctcctaaggaagtgcagccccccctgccagacactttcttcgaccactttaatagggtgcaatgggctttttccatttgcgaaattaatggaatgatcctggttggactgtggttgatccagtggttgctgctaaagtacaaggatgtggggaacgagtctagagtagtgatgattttcctctctatcgtacatcctgtgttgctgttgggatctattgccggcttcctgtcactaagcctatag

SEQ ID NO: 206867 - DNA, 1242 bp, Artificial Sequence
  Description of Artificial Sequence: Synthetic coding sequence
atgaaggaggtggtgtactggagccccaagaaggtggccgactggcttctggagaatgcaatgcccgaatattgtgaacctctggagcacttcaccgggcaggatctgatcaacctgacgcaggaggactttaaaaaaccaccactctgtagggtctctagcgacaacggccagcgactgttggatatgatcgagacactaaaaatggaacaccacctggaggcccacaagaatggccacgctaatgggcatctgaacatcggcgtcgacatccccactccagatggttcgttctctatcaagatcaagcccaacggaatgcccaatggatatcgtaaggagatgattaagatacccatgcccgaactggagcgctctcagtacccaatggagtgggggaagacttttctagccttcctgtatgcactgagctgcttcgttctaaccacagtcatgatcagtgttgtccatgagcgagtgccacccaaagaggttcaaccaccgttgccagataccttctttgaccattttaaccgggtgcaatgggcatttagcatatgcgaaatcaacggaatgatcttggtgggcctctggcttattcaatggctcctgctaaaatacaaaagcatcattagtaggaggtttttctgcatcgtcgggacgctgtatctctacaggtgtataactatgtacgtcacaacactgcccgttcccgggatgcactttaactgctcgcctaaactttttggcgattgggaggctcagctgcgacgcattatgaagttaatcgccggcggcgggctgtctattacgggcagccacaatatgtgcggcgactacctgtattctggccatacggtgatgttgaccctgacctacctcttcattaaggagtattccccccgacgactctggtggtaccactggatttgctggctgctgagtgtggttggcatcttttgcatcctgctcgctcacgatcattatacagtcgacgtggtggtcgcctattatattacgactcgcttattctggtggtaccacaccatggctaaccagcaagtgctgaaggaggcctctcagatgaatctgttggcacgcgtctggtggtaccggcccttccagtatttcgagaaaaatgtccagggaatcgtacctaggtcataccattggccttttccttggcctgttgtgcacttgtccagacaagtcaaatattcgcggctggtgaacgacacctag

SEQ ID NO: 206868 - DNA, 642 bp, Artificial Sequence
  Description of Artificial Sequence: Synthetic coding sequence
acctacatgtacatcagcaacaagagcatcatcagccggcggttcttctgcatcgtcggcacactctatctgtatcgctgcattaccatgtatgttactaccctgcccgtgcccggtatgcattttaattgcagcccgaagctttttggcgactgggaagctcagctacggaggattatgaagctgatagccggaggcggcctgtccattacagggtctcataacatgtgtggagactatctctactccggccatactgtgatgctgacactcacctacctgttcattaaggagtactcacctcgccggttgtggtggtaccactggatatgttggctgttaagtgtggttggcatattctgcatcctgctggcccatgatcattacactgtagacgtcgtcgttgcttattatattacgacaagactgttttggtggtatcacactatggctaaccaacaggttctgaaggaagcttcccaaatgaacctcctagcgagggtatggtggtataggcctttccagtactttgagaagaacgtccaggggattgtccctaggtcttaccactggccttttccttggccagtagtacacctgtctcggcaggtgaaatacagtcgcctcgtgaatgacacatag

SEQ ID NO: 206869 - DNA, 735 bp, Artificial Sequence
  Description of Artificial Sequence: Synthetic coding sequence
atgggcggccggggcggcggcggccggagccggcagctgcccggcagattccgcgcccccgctgcccggtggccggggggtagatggctgccaggggctccgagaacagtgacttggtctatcatttctcgacggttcttctgcatcgtgggcactctgtacttatatcgctgcatcactatgtatgtcacaaccctgccagtacccggaatgcatttcaattgcagccctaagcttttcggtgactgggaggcccaactgagacgtattatgaagttgatcgccggaggggggctgtcgattaccggatcccacaatatgtgtggtgactacttgtatagcgggcatactgttatgctcacattgacttatctgtttatcaaagaatattctccacggcggctgtggtggtaccactggatctgttggctgctctcagtggttgggattttctgcatcctcctggcacacgatcactacactgtggatgttgttgtagcatattacatcaccacaaggctcttctggtggtaccatacaatggctaaccaacaggtacttaaggaagcctcccagatgaatcttcttgctcgcgtgtggtggtacagaccatttcaatattttgagaaaaacgtccagggaatcgttccaaggtcttatcattggccattcccttggcctgtcgtgcatctgtcacgtcaggtaaagtatagtcgacttgtaaacgatacctag

SEQ ID NO: 206870 - DNA, 1098 bp, Artificial Sequence
  Description of Artificial Sequence: Synthetic coding sequence
atggacatcatcgagaccgccaagctggaggagcacctggagaaccaaccaagcgaccctacaaatacctatgccaggcctgcagaaccagtcgaagaagagaacaaaaacggaaacggaaaaccgaaatcgctgagttcaggcctgagaaagggcacaaaaaaatacccagactatatccagatcgctatgcccaccgaaagccgcaacaaattccccctggagtggtggaagacaggaatcgcattcatctatgccgtgtttaacctcgtactcaccacggtgatgattacagtagtccacgaaagggtacctccaaaagagctatccccgcccctccccgacaaattctttgactacatcgaccgcgttaaatgggccttcagcgtctcggaaataaatggcattatactggtgggtttgtggatcacgcagtggctgttcctgcgctacaagtccatagtgggcaggcgattctgctttattattggcacgctgtacctttatagatgtatcaccatgtacgttaccacactgccagttcctggcatgcacttccaatgtgctcctaaattgaatggtgactctcaggctaaagtgcagaggattctaaggcttatcagtggcgggggtttatcaatcaccgggtcccatatcttgtgcggggatttcctgttttctggccatacagtcacccttactctgacgtacttgttcatcaaagagtactccccccgtcacttttggtggtatcacttgatttgctggcttttaagcgccgccggaattatttgcatactggtggcccatgagcactacacaattgacgtgatcattgcatattacatcactactcgcctgttttggtggtaccacagtatggcaaatgagaagaacctgaaggtatcatcacaaactaactttttgtctcgagcatggtggtttcccatcttctacttttttgagaagaacgtgcagggttctataccatgctgtttcagctggcccttgtcttggcctcccggttgctttaagagctcttgcaaaaagtattcgagagtccaaaagattggggaggataacgagaagtctacctag

SEQ ID NO: 206871 - DNA, 1098 bp, Artificial Sequence
  Description of Artificial Sequence: Synthetic coding sequence
atggacatcatcgagaccgccaagctggaggagcacctggagaaccagccctcagatccaaccaatacctatgcccggcccgctgagccggtggaggaagagaacaaaaacggaaatggtaagcctaagtccctgtccagtggccttagaaaggggactaaaaagtatcccgactacatccagatcgccatgcccactgagtcgcgaaataaattcccgctggagtggtggaaaacagggatcgcattcatctatgccgttttcaatctggtgctgactactgttatgatcaccgtggtgcatgagagggttcccccaaaggaactcagtccgcctctccctgataaatttttcgactacatcgaccgtgtgaagtgggcctttagtgtgtctgagattaatggcattatcctagtgggcttgtggattactcagtggctgtttctgaggtacaagtctattgtaggaaggagattttgttttatcatcggtactctgtacctttataggtgcattaccatgtacgtgaccactcttccagtgcctggcatgcacttccaatgcgctccaaaattaaacggagacagccaggccaaggtccagaggattctgcgccttatctctggcggagggttaagcataaccgggtctcatatcctgtgtggagacttccttttctcaggtcacactgtcacattaaccctcacttatctgttcatcaaggaatacagcccaaggcatttttggtggtaccacctgatctgttggttgctttcggccgcgggtataatttgcattctggtggcccacgagcactacacaattgacgtgataattgcttattacatcactacccgcctgttttggtggtaccactctatggctaacgagaagaacctgaaggtgtcgtcacagaccaacttccttagccgggcatggtggtttccgatattctattttttcgagaaaaatgttcagggaagcataccctgttgctttagttggcctttgtcttggcccccagggtgctttaaatcatcatgcaaaaagtacagtcgagtccagaaaataggggaagataacgagaagagtacatag

SEQ ID NO: 206872 - DNA, 1098 bp, Artificial Sequence
  Description of Artificial Sequence: Synthetic coding sequence
atggacatcatcgagaccgccaagctggaggagcacctggagaaccagccttccgatcctacgaatacctacgccaggccagcagagcctgtagaagaggagaataagaacgggaatggcaaaccaaagagtctcagctccggacttcgcaaaggcacaaagaagtatccagattatatccagatcgcgatgccaacagagtctaggaacaagttccccttggagtggtggaagacggggatagcttttatctatgctgtatttaaccttgtgctaaccacagtcatgatcaccgtggtccacgagcgcgttccaccaaaagagctttcgccaccattgcccgacaaattctttgactacatcgaccgggtgaaatgggcattttccgtatctgaaataaacggaattatcttggtgggactctggatcacccagtggctcttcttgcgctacaagagtattgtgggtcgccgattttgtttcattattggtacactctacctgtataggtgtataactatgtacgtgacaaccctccccgttccaggcatgcattttcagtgtgcacctaaactgaacggtgattctcaggccaaagtccagcgcatcttgcgcctgatatccgggggtgggttgtccatcacaggttcacacatcctctgtggcgattttctgttcagcggccataccgttacactgacactgacctaccttttcatcaaagagtactcaccaaggcacttctggtggtaccatctgatttgttggctcctgtccgccgcgggtatcatttgcatactagtcgcacatgaacattatactatcgatgtgatcatcgcttactacattacgacccgactgttttggtggtatcattcgatggctaatgagaagaacttgaaagtcagttcacaaacaaattttctgagcagggcctggtggttccccattttttatttttttgaaaagaacgttcagggttcaatcccttgctgctttagttggccgctctcttggccccccggttgctttaaaagcagttgcaaaaaatattcgcgagtgcaaaaaataggcgaggataacgagaaaagcacatag

SEQ ID NO: 206873 - DNA, 135 bp, Artificial Sequence
  Description of Artificial Sequence: Synthetic coding sequence
atggacatcatcgagaccgccaagctggaggagcacctggagaaccagccatctgacccaacaaacacgtatgcaagaccagccgaacctgtagaagaagagaataaaaatggcaacggcaaacccaagtcctag

SEQ ID NO: 206874 - DNA, 105 bp, Artificial Sequence
  Description of Artificial Sequence: Synthetic coding sequence
atggacatcatcgagaccgccaagctggaggagcacctggagaaccagccctccgatccaacgaacacttacgctagacccgctgagcccgtagaagaagaatag

SEQ ID NO: 206875 - DNA, 1326 bp, Artificial Sequence
  Description of Artificial Sequence: Synthetic coding sequence
atgagcctgcggcagcggctggcccagctggtgggccggctgcaggatcctcagaaggtggctagattccaacggctctgtggagtggaggccccccctaggcgctccgcagaccgccgagaagatgaaaaggccgaggcgcccctagcaggggatccacgtcttaggggtcggcaaccaggagcgccaggtgggccccagccgcccggatctgaccggaatcagtgccccgccaaacccgatggtggtggtgcccctaacggagtcaggaacgggctggccgccgagctggggcccgcaagcccgcggcgcgccggtgccttgagaaggaatagcttgactggggaagagggccaactggctcgggtgagcaattggcctctctactgtctgttctgctttggaactgaactgggcaatgaactgttttatattctttttttccccttctggatctggaatttggaccccctggtaggacgcagattggtggtcatctgggtgctggttatgtacctgggacagtgcaccaaagatataatcagatggcccaggccggcctcccctccagtggtcaagttggaagtattctacaattctgagtactccatgccaagcacacacgcaatgtccgggaccgctatcccaatcagcatggtgctgctgacctacggacgatggcaatatcctcttatttatggcttgattctgattccttgttggtgctcccttgtgtgcctgagtcgcatttacatgggcatgcactcgattctcgacataatcgcagggtttctctacacaatactgattctcgcagtcttctacccttttgtcgatctgatcgataactttaatcagactcacaagtatgcaccctttattatcattggcttgcacctagctctgggcatcttctccttcacgctggatacatggtctactagtcgcggggacacagctgagattcttgggtctggagctgggattgcttgcgggtcccatgtcacttataatatggggttggtactagatccctccctcgacaccttgcccctggccggccccccaattacggttactctgtttgggaaggctatcctccggattttaatcggcatggtgttcgttctgatcattcgcgatgttatgaagaagattactattcccctggcttgtaagatcttcaatatcccttgcgacgatattcgtaaggccagacagcacatggaagtggaactgccataccgttacataacctacggaatggtaggcttcagcatcacattcttcgtcccttacatcttcttctttatcggcattagttag

SEQ ID NO: 206876 - DNA, 1200 bp, Artificial Sequence
  Description of Artificial Sequence: Synthetic coding sequence
atggccgagctgctgcggagcctgcaggacagccagctggtggccaggttccagaggcgttgcggcctcttccctgcccccgacgaaggaccccgtgagaacggcgccgaccccaccgagcgagcagcccgggtaccaggtgtggaacaccttcccgccgccaacggcaaaggaggcgaggccccagccaacggtctgaggcgcgccgcggcccccgaagcgtacgtgcagaaatacgtggtaaaaaattacttttactattacctctttcaattttcggccgcactgggccaggaggtgttctacatcactttcctgccatttacccattggaacattgacccctacctatctagaagactaatcattatctgggtcctggtgatgtacattgggcaagtggccaaggatgttctgaagtggccgcgcccgtcatccccccctgtggtcaagttagaaaaaagactcatcgctgaatacggcatgcccagcacacatgcaatggcagcgactgccattgccttcaccctgctgatttccactatggaccgctatcagtacccgtttgtactgggcctggttatggctgtagttttcagtaccctggtttgtctgagccgcctgtacaccggaatgcatacagtactcgacgtgctggggggagtcttaattactgccttgctcatagttttaacatatccagcatggactttcattgattgtcttgactctgcaagtcctctcttccccgtgtgtgtcatagtcgtgccattcttcctttgctacaactatccagtgtccgattattattctccaactcgggctgacacaacgactatactagctgcaggcgccggtgtgacaattggattctggatcaatcacttttttcagttggtgtccaagcctgcggagagcctgcctgtgatacagaacatcccacccctcactacttacatgctggttctaggcctgaccaagttcgcggtagggatcgtcctcatacttttggtgcgccagctggtgcagaacctatcattacaggtcctctattcctggtttaaggttgtgacaagaaataaggaggcccggcgaagactcgagatcgaagtgccttataagttcgtgacatatacctcggtgggaatttgtgccactaccttcgtgcccatgctgcaccgttttctgggcttgccctag

SEQ ID NO: 206877 - DNA, 1062 bp, Artificial Sequence
  Description of Artificial Sequence: Synthetic coding sequence
atgggcagcctgtacagcgagtacctgaaccccaacaaggtgcaggagcattacaactataccaaggaaactctggaaactcaagagaccacctctcgccaggtggcttctgctttcattgtcattctctgttgtgcaattgtggtggaaaatctcctggtcttaattgccgtggctagaaacagcaagttccatagtgccatgtatttgttcttaggcaacttggctgcctctgatcttttagccggggtggcctttgtggccaataccctgctatcaggctccgttacactcaggctgacaccggtgcagtggtttgccagagagggctctgctttcattactcttagcgcatctgttttttccctcctcgcaattgccattgagagacacgtggcaatcgcaaaagtgaaactctacggcagcgacaagtcgtgtcggatgcttttactgattggtgctagctggttaatcagtctggtcttgggcggactgcccatacttgggtggaactgcctgggccatctggaggcgtgctccacagtcctgcccctctacgctaagcattacgtcctttgcgtcgtgacaattttctctataatcttactcgcaatcgtggcactgtatgtgagaatatactgcgtagtcaggtctagccacgccgacatggcagcaccccagactctggcactactcaaaaccgtcaccatcgttctgggcgtatttattgtctgctggctccccgccttttcaatcctattactcgattatgcttgcccagtccatagttgtcctatcttgtacaaggcccattacttttttgctgtaagcacccttaattcgctcttgaacccggtcatctacacctggcggtcgcgggatctgcggagggaggtgctgcggcctctgcagtgctggaggccaggcgtcggcgtccagggaagacggcgaggcggcacaccaggacaccatctgctacctttaaggtccagcagtagcctggagcggggcatgcacatgccgacctccccaacttttctcgaagggaatactgtggtgtag

SEQ ID NO: 206878 - DNA, 1137 bp, Artificial Sequence
  Description of Artificial Sequence: Synthetic coding sequence
atggccaccgccctgcccccccggctgcagcccgtgcggggcaacgaaaccctgcgtgagcattatcagtatgttggtaagttggctggccggcttaaggaagcctctgaaggaagcactctgacaacagtcctgtttctcgttatctgtagcttcatcgtgcttgagaatctgatggttctaatagccatatggaaaaataataagtttcacaatcgcatgtatttttttatcggtaacctcgctttgtgtgacctcttggctggcattgcatataaggttaacatcctcatgtccgggaagaagaccttctcactgagtcctactgtctggtttctgcgggagggttcaatgtttgtggccctaggagcttctacctgttcgctgctggccattgctatcgaacgtcacttaacaatgattaaaatgcgtccctatgatgctaataagcggcatcgggttttcttacttattgggatgtgttggctgatcgcctttactctgggagcgttgcctatactgggttggaattgtttgcacaatttgcctgactgttctaccatactcccactgtactcaaaaaagtatattgccttttgcatttcaatcttcactgcgatccttgtaaccatcgtgatcctgtatgctagaatctactttctggtgaagtcatcctcgcggaaggtggcgaatcacaataatagcgaaagatcaatggcgcttctcaggacagtcgttatagttgtgtctgtgtttatcgcttgttggtcgcctctcttcattcttttcttaatagatgtggcttgcagagtgcaggcctgtcccatcctgttcaaggcccaatggttcatcgttctggctgtcttaaattccgccatgaatcctgttatctacaccctggcctcaaaggagatgagacgggcatttttccgcctggtctgtaactgcctggttaggggccgaggggccagggccagtcctatccagcctgcattggatccttcacgaagtaaatcatccagttcaaacaattcctcacacagcccaaaagttaaagaggacttaccccataccgccccttcgtcctgtatcatggacaaaaacgcagctctacaaaacggcattttctgtaactag

SEQ ID NO: 206879 - DNA, 1137 bp, Artificial Sequence
  Description of Artificial Sequence: Synthetic coding sequence
atggccaccgccctgcccccccggctgcagcccgtgcggggcaacgaaacgttgagagaacactaccagtatgtcggcaaattggcgggcagattgaaagaggccagtgaggggagcacgttgactaccgtcctgttcctcgtgatttgctcgtttatcgtgctagagaatctgatggttctcattgctatatggaaaaataacaagttccataatcgcatgtattttttcattggaaatctcgctttatgcgatctcttggcagggatcgcctacaaagtgaacatcctcatgagcggcaagaaaacgtttagcttatctcccactgtatggtttcttcgcgaaggcagcatgtttgtggcgttgggcgctagtacatgctccctgcttgccattgccatcgagagacacctgactatgattaagatgcggccctatgacgccaacaagcgccaccgcgtgtttctgcttatcggcatgtgctggctcatcgctttcacactcggagcccttcccatactcggatggaactgtctccacaaccttcctgattgctccaccattctgcccctctacagtaagaaatacattgcattttgcatctcgattttcaccgctatcctggtcaccattgtgattttgtacgcccgcatctattttcttgttaaatcatctagccgcaaggtcgcaaaccacaataattcagagcgcagcatggctctccttcggaccgtcgtcattgtcgtgtccgtgttcattgcctgctggagccccctctttatcctctttttgatcgatgtggcttgccgggttcaagcttgtcccattctctttaaagcacagtggttcatcgtgcttgctgttctgaactctgccatgaaccctgttatttatacactggcgtccaaagaaatgaggagggccttttttcgactggtgtgcaactgtctggtacgaggacgcggtgcacgggcatcacccatccagcccgctttggacccaagtcgaagcaaatcttcctctagtaacaattcaagtcatagccccaaggtaaaagaagatctaccacatacagctcccagctcatgtatcatggataagaatgccgcgctgcagaacgggattttttgcaattag

SEQ ID NO: 206880 - DNA, 1155 bp, Artificial Sequence
  Description of Artificial Sequence: Synthetic coding sequence
atgaacgccaccggcacccccgtggcccccgagagctgccagcagctagccgcgggtggccattcacgcctcatcgtactacattataaccattctggtcggctggctggaaggggaggacctgaagacgggggcctgggcgcactccggggcctcagtgtggctgctagctgcctcgtcgtgctggagaatctgcttgtgctggccgctataacctcccacatgcggtccaggcggtgggtttactactgtctggtgaacataacattgtccgatttgctgaccggcgctgcctatttggcaaacgtcctgcttagcggcgcccgcactttcaggctggcacctgcccagtggttcctcagggaggggttgctgtttactgcccttgccgccagcaccttctcactactgttcactgcaggagagaggtttgcaacaatggtgcgcccagtggccgaaagcggagccacgaaaactagccgagtttatggttttattggtctgtgttggctgttggcggccctgttagggatgctcccactgctcggatggaattgcctgtgcgcgtttgatagatgcagttcactcctgcctctgtactcaaaacggtacatccttttttgcctggtgatttttgctggggtcttagcaaccattatgggactgtacggcgccatattcaggctggtgcaggcctctggtcaaaaagcccctaggccagctgcgagacggaaggcccgcagattactcaaaactgtgctcatgatcctcctcgccttcctggtgtgctggggtccactcttcggactcctactggctgatgtgtttggaagcaatctctgggctcaggaatacctgagaggtatggattggatcctggctctggcagttctcaattccgccgtgaaccctattatatacagctttagatcgcgggaagtgtgccgggccgtgctgtcattcctatgctgtgggtgtctgcgcctgggtatgaggggacccggggattgcctggccagggcagttgaagctcactcaggtgcaagcacaactgatagctccctgcgccctcgggactcgtttcgcggctcccggtctctgtcctttaggatgcgggagcccttatcttctatttccagcgttcgcagcatctag

SEQ ID NO: 206881 - DNA, 1197 bp, Artificial Sequence
  Description of Artificial Sequence: Synthetic coding sequence
atggagagcggcctgctgcggcccgcccccgtgagcgaggtgatcgttctccactacaactataccggcaaactgaggggagcaagatatcagccaggtgccggtctgcgcgcagatgccgtggtctgcttagccgtctgcgcctttattgtgctagagaacctagccgtgctcttggtactgggccgacatccacggtttcacgccccaatgttccttctcctgggcagcctgacactgagtgacctattggcaggagctgcttatgccgccaatatcctgctaagtggcccccttaccctgaagctctccccagcactttggtttgcgcgggaagggggagtgttcgtcgccctcacggcttccgtactgtcactgctcgctatcgccctggaaaggagcctgaccatggctagaagaggtccagctcctgtgagctcccgggggcgtaccctcgccatggctgccgcggcttggggcgtctccttgctgctgggcctcctgcctgcactcgggtggaattgtctgggacgcctggacgcttgcagcaccgtgctgcccctttatgcgaaagcttacgtccttttctgcgtgctggcatttgtcggtatcctcgcagccatatgcgctctgtacgcaaggatttactgccaggtgcgtgccaacgccagacggctgccggctcgcccggggaccgctggaacgactagcactagagctcgcagaaagccgcgctcactagcgctgctgcggacactctccgttgtgcttttggcattcgtcgcatgttgggggcctttatttctgctcctcctattggatgtagcgtgtccggccaggacctgccccgtgctgttgcaggcagatcccttccttgggctcgctatggctaacagcttgctgaaccctattatctacacattgacaaatcgagacttaaggcatgcactcctgcgcctcgtctgctgcggacggcatagctgtggacgggatccttcaggttctcagcagagtgctagcgccgccgaggctagcggcggcctgcgcagatgtctcccgccaggcttagatgggagcttctccggatcagagcgcagttctccccagcgggacggtttggacacaagcgggagtaccgggtcaccgggcgccccaacagccgcacgcaccctagtgagcgagccagcagccgactag

SEQ ID NO: 206882 - DNA, 933 bp, Artificial Sequence
  Description of Artificial Sequence: Synthetic coding sequence
atggagagcggcctgctgcggcccgcccccgtgagcgaggtgatcgtcctccattacaactacaccgggaagttaaggggggccagatatcagcctggcgctggccttcgggccgatgctgtggtgtgcctggccgtttgtgccttcatcgttttggagaacttggcagtcttgcttgtgctgggaaggcatccgcgttttcacgcgccaatgtttctgctgctgggaagccttaccttgtctgacttgttggccggggccgcatatgcagcaaatattttgctgtccggtccactcacgttgaaactgtcaccagccctttggttcgcccgggaggggggggtgttcgttgctctgactgcctcagtcttgagcctcttagcgatcgctctggagaggtctctgacgatggctcggaggggcccagcaccagtctcttcgagaggtcgcactctggccatggccgccgccgcctggggagtgtcgttactgctgggactcctgcctgctctcggctggaactgtcttggcagactggatgcctgtagcactgtgctcccgctctacgccaaagcttatgttttattttgcgtcctggctttcgtggggattctggctgcaatttgtgccctttatgcactggcagggttggcggcccacgcccagagaggagctcctggtctttgtgggatgctgggaccccctcttcccgcagctgtggcacggaggggtgtgccgggcgcccatctgtcttgcaccccagcgggaaggagcctgcccgggaccggacacggacaattgacctccgaacctcaccatcttcatgcccaccagcctcgcccggcgcctagggcccctgcccccggactattacgcacaccgctgcttaggcagaggcccgagtggctgccagcagtgggcgaacgcggttag

SEQ ID NO: 206883 - DNA, 1197 bp, Artificial Sequence
  Description of Artificial Sequence: Synthetic coding sequence
atggagagcggcctgctgcggcccgcccccgtgagcgaggtgatcgttcttcattataattacactgggaaacttcgcggggctcgctatcaacctggcgccggtctcagggcggatgccgtggtctgcttggcagtctgcgctttcatagtgctggagaacctggcagtcctgctggtacttggtaggcatcctaggtttcatgctcctatgttcctcctccttggctctctcactctgtccgatctcctcgcaggcgccgcttatgcagcgaacatcctgctttctggtcccctcactctgaaactgtctcccgccctgtggttcgctcgggagggtggagtcttcgtggctcttaccgcatccgtcctaagcctgcttgctatcgccctggaacgctccctcactatggcccgtagaggtcctgctcctgttagttctcgcggtcgaactttggctatggccgcagccgcttggggcgtgagtctgctcttggggctccttcccgcactgggctggaactgtttaggtaggctggatgcctgctcgacagttttgcctctgtacgcaaaggcctatgtgctgttctgtgtgctagcattcgttggcatccttgccgccatctgcgcattgtacgcgcgcatttactgccaggtgagagcaaatgctcgcaggttgcctgctaggccaggcacggcggggaccaccagcacgagggcccgtcgaaagccaagatcccttgctttactcagaactctaagtgtcgtgttactggccttcgtggcatgctgggggccactatttctgttgctgctgctcgacgtggcctgtcctgcgcgcacttgccccgtgctacttcaagccgatccattcctgggtctcgccatggccaattccctgctgaatcctatcatttacacactgaccaaccgcgaccttcgacatgctctactgcgactcgtgtgttgtgggagacattcttgtggacgtgatcccagtgggagccagcagtccgcttccgccgctgaggctagtggaggacttaggaggtgtctgccccctggtcttgacgggagtttcagcggctccgagagatccagcccccagagagacggactcgatacctccggatccacaggcagtcccggggcccccaccgctgctcggaccttggttagtgagcctgccgccgactag

SEQ ID NO: 206884 - DNA, 5016 bp, Artificial Sequence
  Description of Artificial Sequence: Synthetic coding sequence
atggacggcaacagcctgctgagcgtgcccagcaacctggagagctccagaatgtacgatgtgcttgagcctcagcagggtagaggttgcggtagttccggatctggacccggcaattccattaccgcttgcaaaaaagtgctgcgcagcaatagtttgctcgaatctaccgactattggttgcaaaatcagaggatgccctgccaaatcggcttcgtggaggacaaatctgaaaattgtgccagtgtgtgtttcgtaaatctggatgttaataaagatgagtgcagtaccgagcacctgcaacagaagttggtgaacgtttccccggacctgccaaagctgatttcctccatgaatgtgcaacaacccaaggagaacgagattgtggtgttgtcagggctggcttccgggaatctacaggctgactttgaggtgagtcaatgtccatggctgcctgatatttgcctcgtacaatgcgccagagggaaccgccccaattctactaactgcatcatcttcgagattaacaagttccttattgggctagaactggtacaggagcggcagctgcacctcgaaaccaacatcttgaagctagaagatgatactaactgttccctatcaagcattgaggaagattttcttaccgccagtgagcacctcgaagaagagtccgaggtggacgaatcaagaaatgactacgaaaacataaacgtgagcgccaacgtacttgaatcaaagcaactcaaaggagccactcaggtggagtggaactgtaacaaagaaaaatggctgtacgctctagaggataagtacataaacaaataccctacccctctgattaagaccgaaaggtctcccgagaacctcacaaagaacacagctctccagtccctggatccttcagccaaaccctcccaatggaagcgggaagcggttgggaacggaaggcaggccacacactactatcactcggaggcctttaaaggccaaatggaaaagagccaggcactgtatatacctaaagatgcatatttttctatgatggacaaggatgtcccctccgcttgtgccgtagcggagcaacgctccaacctgaacccaggtgaccacgaagatacaagaaacgccctccctccaagacaagacggcgaggtgaccacaggaaagtatgcgacaaacctcgccgaaagtgttctgcaagatgcctttatccgactgtcccaatcccagtccactttgccacaggagagcgcagtgagcgtgagtgtgggttcaagccttctaccgtcctgttattccacaaaagataccgtggtgtccagaagttggaatgagctccccaagatcgtggtagtgcaatccccagatgggtctgacgccgcccctcagcctgggatttcaagttggcctgagatggaagtgtcagtcgaaacatccagtatcctgtcaggcgaaaacagttctagacagccccaatctgccttggaagtcgcactggcttgtgcagccactgtgatcggtaccatatcctccccccaggcaacagaacgcctcaaaatggagcaggtggtgtcaaacttcccgccagggagtagcggagcgcttcaaacacaggcacctcagggactgaaggagccctccatcaacgaatacagttttccatcagctctgtgcggcatgactcaggtagcgagtgctgttgctgtctgtggcctcggcgagagggaagaagtcacgtgctccgtggccccttctggctcattgcccccggctgccgaggcctctgaagcgatgccgcctttgtgcggcttggcttctatggaacttggaaaggaggccatagcaaaagggctgctcaaagaggccgccttggtcctgacacggccaaacacgtacagtagcatcggagatttcctcgatagtatgaacagacgtattatggagaccgccagtaagtcacagaccctttgctctgaaaatgtcgtgaggaatgaattggcccataccctttccaacgtcatcctgaggcactccatcgacgaagtccatcataaaaacatgattatcgatcccaacgataataggcatagttcggaaatcttggataccttgatggaaagtaccaatcagctcctactggacgtgatttgtttcacttttaaaaaaatgagccatatcgtgagattgggggagtgccctgccgtcttgtcaaaagagacaataagaagacgggagaccgagccgtcttgtcagccgagtgaccctggggcttctcaggcatggacaaaagctacagagagcagtagttcctccccactgtccaattcccacaacacaagcttagtgataaacaatcttgtcgacggcatgtactccaagcaagataaaggcggtgtcaggccgggcctcttcaagaatcccacactacagagtcagttaagccggagccacagggttcctgatagctcgacagcaaccacctcttccaaggagatctacctgaaaggcatcgccggtgaggacaccaaaagccctcaccacagcgagaacgagtgtagggcttcctcggaaggccagaggagccccacagtctctcagagtcggtccgggtctcaggaagctgaggaatccatccatcccaacacacaggagaagtataattgcgccacatcacggatcaacgaggtccaggtgaatctttcactgctgggcgatgacttgctgcttcctgcccagagcacacttcagaccaaacatcctgacatctactgtatcacagattttgccgaggagctcgctgatactgtggtttcaatggccaccgaaatagccgccatatgtctcgataactcaagcggtaagcaaccctggttctgtgcctggaagagggggagtgaattcctcatgacacccaacgttccatgtcggtccttaaagcggaagaaggaatcccagggctccggaacagccgtgcgtaagcacaagcctccgagactctcggagatcaagcggaaaacggacgagcatcccgaacttaaagagaagctgatgaatagggtcgtggacgagagcatgaatttggaggatgtgccggattcagtgaacctttttgcgaacgaggtggccgctaagataatgaatttgacggaattctcaatggttgatggcatgtggcaggcccagggataccctagaaataggctgttaagtggagaccgctggtctcgactgaaagcatcctcctgtgagtctatccctgaggaggattccgaggcaagagcgtacgtgaatagtctcggcctgatgagtacactgtcacagcctgttagtcgagccagttccgtgagcaagcagtcgagttgcgaaagtatcaccgacgagtttagccggtttatggtgaatcaaatggaaaatgaggggcggggattcgagcttctcctggactattacgccgggaaaaacgccagctctatcttaaactcagccatgcagcaagcttgccgcaagagtgatcacctctctgtccgcccgtcttgtccaagcaaacaatccagtacagagtccatcacagaagaattttatcgctatatgctgagggacattgaacgcgactctagagagagtgcttcttctagacgatcatctcaagactggacagcagggttgcttagtcctagtcttcgaagcccagtatgccatcggcaatcttccatgccagattcacgtagcccatgttcgcgactgacagtgaacgtgccaattaaagctaacagcctggatgggtttgcccagaactgccctcaggatttcctgagcgtgcagccggtctccagtgcctcatccagcggactttgcaagtcagactcctgcctgtacagacgagggggcacagatcatattacgaatatgttgatccatgagacgtgggcttcgtccatcgaggcactgatgcggaagaacaagatcatcgtggacgacgccgaggaggcagacacggaaccagtgtctggaggcagcccttcacaggcagagaagtgtgcaaaccgtctggctgctagccgaatgtgttctggaccaaccctcctggtccaggaaagccttgactgtcccaggaaggactctgtcactgagtgcaagcagcctcccgtgagcagtctttccaaaacagctagtctcacgaaccattctcctctggactccaaaaaagagaccagctcctgccaggacccagtgcctatcaatcacaagcggcgtagcttatgctctcgcgaggtgcctctgatacagatcgaaacagatcagcgcgaggcctgcgcaggcgaaccagaacctttcctgtcgaagtcctctttactcgaagaggcagaagggcactccaacgataagaacattcccgacgtggtgcgtggaggggacacagcagtgagcgcctgtcaaattcactccgactcactcgatacacgagacgtgcccgaggccgaggcatccacggaagcacgggcccccgacgaggccccaaatccacccagctcatctgaagaatccacaggcagttggacccagcttgccaacgaggaggataatccggacgatacctcgtctttcctccaactgagcgagagatctatgagcgagcttgttgaggaaaagaagattctcaagggtcagtctgagtccactgaagcccccgccagtggccctcccactgggactgcaagccctcagaggtcattactcgtgattaacttcgacctcgagccggagtgcccagatgcagagttgcgcgcaacccttcagtggatcgcagcatccgagctggggattcctacaatttatttcaaaaagagccaggaaaatcgtatagagaagtttctcgacgttgtgcagctggttcatcgaaagtcttggaaagtgggagatatattccatgctgttgttcagtactgtaagatgcacgaggagcagaaggatggtaggctgtcccttttcgactggctcctggagttaggctag

SEQ ID NO: 206885 - DNA, 5103 bp, Artificial Sequence
  Description of Artificial Sequence: Synthetic coding sequence
atggacggcaacagcctgctgagcgtgcccagcaacctggagagctctcgaatgtacgacgtgctggaacctcagcagggacgcggctgcgggtcatcgggctctggcccgggaaacagcattaccgcctgcaagaaggtcttgagatcaaactcactgctcgagtcaacggactattggctgcaaaaccagagaatgccgtgtcaaatcggcttcgttgaggacaaaagcgaaaattgcgcttccgtctgtttcgttaatctcgacgtgaacaaggacgagtgcagtaccgagcatttgcagcaaaagcttgtgaacgtgtcgccagacctgcccaagctgatcagctcaatgaatgtacagcagccgaaagaaaatgagattgtggtgttgtccggtctggcgtccggcaatctgcaggccgactttgaagtgtcgcagtgtccgtggctacccgacatctgcctggttcagtgcgcccggggcaacagaccgaatagcacaaactgcatcattttcgagatcaataagtttctcatagggctggaactggtgcaagagaggcagttgcatctggagacaaatattctgaaattggaagacgataccaactgttcgctctccagtattgaagaggactttctgacagctagcgagcacctggaggaagagtcagaagtggacgagagtcgtaatgattacgagaatattaacgtgtctgctaacgtgctggagtcaaaacagcttaagggagcgacccaggtggagtggaactgcaataaagagaaatggttgtacgctttagaagataaatacataaataagtatcctacgccgctgattaaaaccgaacggtctccagagaatctaaccaaaaatactgccttgcagagcctggacccatccgctaagccctcccagtggaaaagggaagcggtcggcaatgggaggcaagcgacccactattatcactcggaggcgtttaaaggtcagatggagaaatcacaggccctgtacattcctaaagacgcgtacttttcgatgatggataaagatgtcccttctgcctgcgccgtagcagaacaacggtcgaatctcaaccccggcgaccatgaggacacacgtaacgctctcccaccgaggcaggatggagaggtgacaaccggaaagtacgctactaacctggcagaaagcgtgctgcaagacgcttttataagactcagtcagtcacagagcaccttgccccaagaaagcgcagtatcagtgtctgtcggaagttccctgctacctagctgctactccactaaggacacagttgtgagcaggtcatggaacgaactccccaaaatcgttgtggtgcagagcccagatggctctgacgctgcgcctcagccagggatcagctcctggcccgagatggaagtcagcgtggaaacatcgtcaattctgagcggtgagaactccagtagacagccccagagtgccctggaggtggccctcgcttgcgcggctacagtgattggcaccatatctagtccccaggcaactgaacgactcaagatggagcaggtcgtttccaatttccctcctggctcttccggcgctttgcagactcaggcgccccagggactcaaggaaccgtcaattaatgaatactcttttccgtcagccctgtgtggcatgacacaggttgcctctgctgtggccgtctgtggcctgggcgagagggaggaggtaacgtgttctgtggcccctagcggatccctgccaccagctgctgaggccagcgaggcaatgccgcccctctgcggactggccagtatggagctaggaaaggaggcaatagcaaagggtttattgaaggaggctgccctggtccttactcgccctaacacgtatagctcgataggagatttcctggattctatgaatagacgtattatggagacggcttctaagagtcagacgctgtgttcagagaacgtggtccgaaatgagctggcccataccctttccaatgttattctgcgccacagtatcgacgaggtgcaccataaaaatatgattatcgacccgaatgacaatcgacattccagtgagatattggatactttgatggagagcacaaaccagctgctgctggatgtgatctgctttaccttcaagaagatgagccatatcgtccgacttggcgaatgtccagcggttctgagtaaagaaactattagaaggagagaaaccgaaccaagctgccaaccctcagacccaggcgcatctcaggcctggaccaaggccacagagtctagtagctcctctccacttagcaatagtcataacacatccttggtcattaacaacctagtggacggtatgtactccaagcaggataagggcggagttagacctggccttttcaagaacccgaccctacagtcccagttgagccgctctcatcgagtccccgactcttccactgctacaacaagctcaaaggagatctacctgaaaggtatcgccggggaggatacgaagtctcctcaccattccgaaaacgagtgcagagcatcgtccgagggacaaaggagtcctactgtgagtcagtcacgaagcggctcacaggaggcggaggagagtattcacccaaacacccaggagaaatacaattgcgcaaccagccgtattaacgaggttcaggtgaatctgtctctactgggagatgacctactcctgccagcccagagtacactccaaactaaacaccccgatatttattgtataaccgacttcgcggaagagcttgccgacactgtcgtgtcgatggccacggaaattgctgcgatttgtctagacaacagttccgggaaacaaccatggttctgtgcgtggaaacggggttcagaatttttgatgacacctaacgttccctgtcgttctctaaaaagaaaaaaggagagccaagggagcgggactgccgtcaggaaacacaagccaccaaggctcagcgagatcaaaaggaagacggacgagcaccctgagctaaaggagaagctcatgaatcgcgttgtggatgagtccatgaacttagaagatgtcccggatagtgtcaatctattcgcaaatgaggtcgccgccaagatcatgaacctcaccgagtttagcatggtggatggcatgtggcaggcgcaggggtacccccgcaatcgcctgctgtccggggaccggtggtccagactgaaagcctcttcctgcgagagcattccagaggaggattctgaggcgagagcctatgtcaactccctgggactgatgtccacgctgtctcagcccgtgagccgcgcttcctccgtctcaaagcagagctcctgtgaatccatcacagacgagttctcacggtttatggtgaaccagatggaaaacgaggggagagggttcgaactcctgcttgactactatgcgggcaaaaatgcaagctccattcttaactctgctatgcaacaggcctgccgaaagagcgaccacttgagcgtgaggccctcttgtcccagtaagcagagtagcacagaatcaattacagaggagttttacagatacatgctacgcgatatagaacgtgattctagggaatcagcctctagccgacgctcatcccaggattggacagcaggattgctgtcccctagcttacgatctcctgtatgccatcgacagtctagcatgccagactctcggagcccctgctctcgccttactgttaacgtgccgatcaaggcaaactccttagatgggtttgcccagaactgtcctcaagactttttgtccgtccagcccgtttcttccgcctccagcagcggattatgcaagagtgactcgtgcctgtatagaagaggtgggaccgatcacatcacgaatatgctcatccacgaaacatgggcctcttctatcgaagcactcatgagaaagaacaaaatcattgtggacgacgcagaggaagcggatacagaaccagttagcggcggtagcccgtctcaggctgaaaagtgtgctaacaggctagctgcctcaagaatgtgttctgggccgaccctactcgtgcaggagtcactggactgcccacgcaaggactccgttactgaatgcaaacaaccaccggtgagcagcctgagtaaaaccgctagtcttaccaaccacagccccctggatagtaaaaaggagacctcttcatgtcaggatccagtcccgatcaaccataagcgcaggtccctgtgttccagggaagttcctctaatacaaattgagaccgatcagagggaggcttgcgctggagaacctgagcctttcctgtctaaaagctccctcctcgaagaggccgagggtcatagcaatgacaaaaatatccctgacgtggtacgcggcggcgataccgctgtgagtgcatgtcagattcatagtgacagtcttgacacccgggacgtgcccgaggccgaggcatcaacagaagctcgtgcgccagacgaagcacctaatccaccctccagctcagaggaatccactggtagttggacccagctggcgaatgaggaagataatcctgacgacacatcttctttcctccagttgagcgaaaggagcatgtccaacgggaactcaagtgccacctccagcctgggcattatggatctggacatatatcaggaaagcatgccaagctctcccatgattaacgagctcgtcgaggagaagaaaatccttaagggccaaagtgagtccacggaagcaccggcatccggccctcccaccggcacagcatcaccccagcgaagcctgctggtcataaattttgatctcgagcctgagtgtcctgatgccgaacttcgagcgacactgcaatggatcgccgcctctgagctgggaatccccaccatttattttaagaaatctcaggagaatcgcatagagaaatttttagatgtggtgcagctcgttcaccgtaaatcatggaaagtgggagacatctttcacgccgtcgtccagtactgcaagatgcacgaagaacaaaaagatggcagactctcgctgttcgactggctgctggagctgggctag

SEQ ID NO: 206886 - DNA, 789 bp, Artificial Sequence
  Description of Artificial Sequence: Synthetic coding sequence
atgctggccctggaggccgcccagctggacggcccccacttcagctgcctctatccggacggggtgttctatgatctggattcctgcaagcattccagttaccctgacagtgagggcgctcccgattcactgtgggattggacagtcgctcctcccgttccagcaacaccttatgaggctttcgacccggccgctgcagcattcagccaccctcaggcagctcagttatgttatgagcctccaacctattcacctgctggaaatctggagctggctccttctctagaggccccgggtccagggctgcccgcctaccccacagagaacttcgcgagccagacactggtgccccccgcctacgcaccatatccttcacctgtgctgtctgaagaagaagacttgccactagactctcctgctctggaagtgtccgactcagaatccgacgaggccctcgtggccggaccagaagggaaaggctccgaagccggaacacggaaaaagctgcggctttatcagtttctgctcggcttgttgacgaggggagatatgcgagagtgcgtgtggtgggttgagcccggcgcaggggtcttccagttctcctcaaaacataaggaacttttggctcgccggtggggccaacagaaaggaaatcggaagagaatgacataccaaaagctggcacgcgccctgcgcaactacgccaaaacaggagagattcggaaagtgaagcgaaagttgacatatcagttcgattccgctttactgccagctgtacgccgtgcatag

SEQ ID NO: 206887 - DNA, 516 bp, Artificial Sequence
  Description of Artificial Sequence: Synthetic coding sequence
atggccagcagcatgacctggaccgccgccagcatccccgccaccttaattcagcgaggattgctgaccctggtgccaccagcctacgccccatatccttcaccagttctgagtgaagaggaagatctgccccttgattctccggccttggaggtgtcagacagcgaatccgacgaggctttggtggctggtcccgaggggaaaggcagcgaggccgggacacgaaaaaagttacgcctgtaccagttcctgctcgggctgctgacccgcggcgacatgcgggaatgcgtatggtgggtggaaccaggcgcgggcgtttttcagttcagctccaagcataaagagctgctcgcacgacgatggggacagcagaagggcaaccggaaaagaatgacctaccagaagttggcccgagctttgcgaaactatgctaagaccggggagattcgcaaagtgaagcgaaaattgacttatcagttcgacagcgcactgttacctgccgtgcgaagggcctag

SEQ ID NO: 206888 - DNA, 747 bp, Artificial Sequence
  Description of Artificial Sequence: Synthetic coding sequence
atgacctgcgtggagcaggacaagctgggccaggccttcgaggacgcctttgaggtgcttcgtcagcactcaaccggagatttgcagtattctccggattacaggaattatcttgcactgattaaccaccggccgcatgtgaagggcaactcaagttgttatggtgtcttacctaccgaggagccagtttacaattggagaacggtcattaattcagccgcagacttttacttcgagggaaatatccatcaatcacttcagaatatcactgaaaaccaactggtgcagccaaccctgctacagcagaaagggggaaagggaagaaaaaaactcagacttttcgagtacctacacgaatcactgtacaatcccgagatggcctcttgtatccagtgggtagataaaacaaagggaatattccagtttgtgtctaagaataaagagaagcttgccgagctatgggggaaaagaaagggcaaccggaagacgatgacataccagaaaatggccagagccttgcgcaactacggccggtctggcgaaatcactaagattaggagaaagctgacttaccagttctccgaagctatactccaacgtttaagcccgagctacttcttaggtaaagaaatcttctacagccagtgtgtgcagcccgaccaagagtacctgagtttgaataattggaatgcaaattacaactacacatatgcaaattatcacgagcttaaccaccacgactgttag

SEQ ID NO: 206889 - DNA, 747 bp, Artificial Sequence
  Description of Artificial Sequence: Synthetic coding sequence
atgacctgcgtggagcaggacaagctgggccaggccttcgaggacgcctttgaagtactaaggcaacattccaccggggacttgcaatatagccctgattaccgcaactatctggcattgataaatcataggcctcacgtcaaggggaatagctcatgttacggagtgttacctactgaagaacctgtgtacaactggaggaccgtgattaattctgccgctgatttttattttgagggcaatatccatcagagtcttcaaaatatcactgaaaaccagctggtacagcccacattattacagcaaaaaggaggaaagggaaggaaaaagctgcggttgttcgagtacttacatgaaagcctttataaccctgaaatggcctcgtgtattcagtgggtagacaagaccaaaggtatttttcagttcgtgtcaaaaaacaaagaaaaactcgcagaactgtggggcaaacggaaagggaacaggaaaaccatgacctatcaaaagatggcacgagccctgcggaactatggtaggagtggtgagatcactaaaatcagacggaagctaacttatcagtttagcgaagcaattctgcagcggctctcaccatcgtactttttgggaaaagaaatcttctactcccaatgtgtacagcccgaccaggagtatctgtcactcaataattggaacgccaactataactacacatatgctaattatcatgagttaaaccaccacgactgttag

SEQ ID NO: 206890 - DNA, 2568 bp, Artificial Sequence
  Description of Artificial Sequence: Synthetic coding sequence
atgagcttcgtgcgggtgaaccggtgcggcccccgggtgggcgtgcgcaaaacgcccaaagttaaaaagaaaaaaacatctgtaaagcaggagtgggacaataccgtgacagatctgacggtccatagggctactccagaggacctagtgcgacggcatgagatccacaagagcaaaaacagagccttggtgcattgggagctccaggaaaaagctctgaagcgcaagtggcggaaacaaaagcccgaaaccctgaacctggaaaaacgacggttgtcgatcatgaaagagatcctgtccgaccagtatcaaatgcaggatgtactcgagaagtctgatcacctaattgctgccgcgaaggaactctttccccggaggcggacaggatttcccaatgtaaccgtcgctccagatagtagccaaggccccatagtggttaaccaggaccccattactcagagtattttcaatgaaagtgtcattgagcctcaggccctgaacgatgtggacggggaagaggagggcacagtgaattcccagtccggagaaagcgaaaacgaaaacgagctggataactctctcaattcgcagtcgaatacgaatacagacagatttctacagcaattgactgaagaaaatttcgaactgatcagtaagctctggactgatatacagcaaaagattgcaacacaatcccagatcaccccccccggtaccccctctagcgctctgagcagcggggaacaaagagcagccctgaacgccaccaatgctgtcaaacgtctgcagactagactgcagccagaagagtcgactgagactttggactcatcctacgtcgtgggccacgtgttaaactcccgaaagcaaaagcagctccttaacaaagttaagcgtaaacctaacctccacgcacttagcaagcctaagaaaaacatcagttcaggcagtaccacgtctgcagatttacctaaccgcactaacagtaacctggatgtcctaaagcacatgattcatgaggtggaacacgaaatggaagagtacgagcgctggaccggaagggaggtaaaggggctgcagtcgtctcaaggattaactggattcaccctgtcactggtgagcagtttgtgcaggctagtgcgttatctcaaggaatctgaaatccagctccgaaaagaggtcgaaacgagacagcagctggaacaggtgctgggggaccatagagagttaattgacgcactgacggccgaaatcctgaggttgcgggaagaaaacgccgcaactcaggcgcgtttgcagcaatacatggtcacaactgacgaacaactgattagtttgacccatgccattaaaaattgccccgtgatcaacaataggcaggagattcaggcctctgaatccggggctacaggccggagagtaatggacagccccgagagacccgtcgtgaacgcaaatgttagtgttccactgatgtttcgtgaggaagtagcagagtttcctcaggaggagctgccagtcaagctctcccaggtccctgacccccccgataacatgaatctagccaagaatttccctgcccacatatttgagccagccgtccttctcacccctccaaggcagaagtcaaacctcaagttctctcctctgcaggatgttctgcgccgcacagttcagaccaggccagccccccggctaccccccactgttgagattatcgaaaaggagcagaattgggaagagaagacactacccattgacactgacatacagaattcatccgaagagaatagactcttcacccagcgttggagagtaagccatatgggcgaggatctcgagaacaagacccaggcccctttcgttaatctgtctcaacctctgtgtaacagccatagcaatactcaacaaagccggtctcccacgtttagtgaggaattgcccgtactaggtgatggacagcagctcaggacaaacgagtcgctgatacaacgcaaagacataatgacgcggattgctgacctgacgctgcaaaatagcgccattaaggctcatatgaataacatcatagaacctcgcggggagcaaggagatggcctgcgcgaactcaataagcaggaatccgcctccgatatgacaagcacttttcctgtcgctcagtctctgacccccggtagcatggaagaacggattgcagaactcaaccgccagtccatggaagccagaggcaaactgctccagttgatcgaacagcaaaagcttgtgggtttaaacctttcccctcccatgtcgcctgtccagcttcccctgcgagcttggacagagggcgctaagaggactattgaggtctcgattccgggagcagaggccccagaaagttccaaatgcagtacagtctctccagtgagtggtatcaacacacggcgtagctctggggcaaccgggaattcatgtagtcccctgaatgccacctcaggtagcggtaggttcacccctctgaacccacgcgcaaaaatcgaaaagcagaatgaggaaggatggtttgccttatctacccatgtgtcttag

SEQ ID NO: 206891 - DNA, 483 bp, Artificial Sequence
  Description of Artificial Sequence: Synthetic coding sequence
atgagcttcgtgcgggtgaaccggtgcggcccccgggtgggcgtgaggaagacccccaaggtgaaaaaaaaaaagactagcgtcaagcaggaatgggataacacagtaaccgacctcacagtgcaccgcgcaaccccggaggatcttgtgcggagacacgaaatccacaaaagcaagaatagggcactggttcactgggagcttcaggaaaaagcgctcaaacggaaatggagaaaacaaaagccagagacgcttaacttggagaagcgcaggttaagcatcatgaaagagattctgagcgatcaatatcagatgcaagacgtgcttgaaaagtccgatcatttgatagccgctgccaaagagctttttcccagaaggagaacaggattcccgaacgtcacagtggccccagactcatctcaaggacccatcgtggtgaatcaagaccccattactcagtcaattttcaatgaatcagtctag

SEQ ID NO: 206892 - DNA, 522 bp, Artificial Sequence
  Description of Artificial Sequence: Synthetic coding sequence
atgagcttcgtgcgggtgaaccggtgcggcccccgggtgggcgtgcggaagactcccaaagtcaagaaaaaaaaaacatctgtgaaacaagaatgggataacactgtaaccgaccttaccgttcaccgggctacgcctgaagacctggtgcgcaggcatgagatccataagagcaaaaatagagctctggtgcactgggaactgcaagagaaggcgttgaagcggaagtggcgaaagcagaaacccgagaccctgaacctcgaaaagagaagactgtcgatcatgaaggagattctgtctgaccagtatcagatgcaagacgtcttagagaaaagcgaccatctcatcgcggcagctaaggagttgttccccagacgcaggacgggttttcctaacgtgaccgtcgcccccgattctagccaggggccgatcgtggtgaatcaggacccaataacacagagtatttttaatgaatctgtaatcgaaccacaggcgctgaatgacgtcgacggagaggaatag

SEQ ID NO: 206893 - DNA, 60 bp, Artificial Sequence
  Description of Artificial Sequence: Synthetic coding sequence
atgagcttcgtgcgggtgaaccggtgcggcccccgggtgggcgtgcggaaaaccccttag

SEQ ID NO: 206894 - DNA, 789 bp, Artificial Sequence
  Description of Artificial Sequence: Synthetic coding sequence
atgaagacccccttcggcaagacccccggccagcggagccgggccgacgctggtcacgccggcgtcagtgccaacatgatgaaaaagcgcacatctcataaaaagcacaggagcagtgtagggccctcaaagcccgtgagccagccacgtcgtaacattgttggttgccgcattcagcatggatggaaagaaggaaatgggcccgtcacccaatggaagggaaccgttctggaccaggtgcctgtgaacccatctctttacctgataaaatacgacggattcgactgcgtgtatggacttgagctgaacaaggacgaacgggtctcggccctagaggtcctcccggaccgagtagccacaagtcgcatatctgacgcccatttagccgacaccatgattgggaaggcagtggagcacatgttcgaaactgaagatggttccaaagacgaatggaggggcatggtcctcgctcgggctccagtcatgaacacctggttctacatcacttatgagaaggacccagtactgtacatgtaccaactactggatgattacaaggaaggcgacctgcgaataatgccggattctaacgatagcccccccgctgaacgagaacccggggaagtcgtggacagcctagttgggaagcaggttgagtatgccaaggaggacggcagcaagaggactggaatggtgatccaccaagtcgaggccaagccaagcgtgtacttcattaaatttgacgacgactttcatatttacgtgtacgatcttgtaaagacaagctag

SEQ ID NO: 206895 - DNA, 789 bp, Artificial Sequence
  Description of Artificial Sequence: Synthetic coding sequence
atgaagacccccttcggcaagacccccggccagcggagccgggccgatgccggacatgcaggggtcagtgctaacatgatgaaaaaaagaacgtcacacaaaaagcatcggtctagcgttggtccctcaaagccagtctctcagcccagacgcaatattgtggggtgtcgcatccagcatggttggaaagagggcaacggccccgttactcagtggaaaggcaccgttctggaccaggttcctgtgaatccgagcttgtatcttattaaatacgacggcttcgactgtgtttatgggttggaactgaataaggatgagcgcgttagcgcgctagaggttttgccagatcgagtggcaactagccggataagcgatgctcacttagccgataccatgattgggaaagctgttgaacacatgttcgagacagaggacggctcaaaagatgaatggaggggcatggtcctggcacgcgcccccgttatgaatacctggttctatatcacctatgaaaaagatcccgtgctgtacatgtaccaactcctcgacgactataaagaaggcgacctcaggatcatgccagactcaaacgattcaccccccgctgagagggagcccggagaggtggtggattcactcgtgggcaagcaggtcgagtacgccaaagaagatgggtccaagcgcactggcatggtgatccatcaggtggaggctaagccctctgtttatttcatcaagtttgacgatgattttcatatctatgtgtacgacctcgtaaagacttcctag

SEQ ID NO: 206896 - DNA, 1587 bp, Artificial Sequence
  Description of Artificial Sequence: Synthetic coding sequence
atggccggcagcgacaccgcccccttcctgagccaggccgacgaccccgatgatggccccgtcccaggaacacccggattgcctggcagtacaggaaaccctaaatcagaggagcccgaagtgccggaccaggagggcttgcagcgcatcacggggctgtcgccgggtagatcggccctgatcgtggcagtgttatgctacattaatcttcttaactatatggacaggttcactgtggccggggtgctgccggacatcgaacagttctttaatatcggagacagcagtagcggactcatccagacggtcttcatttcctcctatatggtgctagctcctgtgttcggttacttgggggacagatataataggaagtatctgatgtgtgggggcatagcgttctggtcacttgttactctcgggagctctttcattcccggggaacatttctggttgctgctcctgaccaggggcttggtgggagtgggggaagcttcatatagcacaattgcaccaacgctgatagccgatctctttgtggccgaccagcgctcacgcatgcttagcattttctacttcgccattcccgtgggaagtggcctcggatacattgctggctccaaggtcaaagacatggccggcgattggcactgggctctgcgagttacacccggcctaggcgtcgtcgctgttctcttgctctttttagttgtgagggaacctcccaggggggcggtcgagagacacagcgacttgccacccctgaaccctacaagctggtgggccgacctaagagccctggcccgaaacccttcttttgtcttgagttccttgggctttacagccgtcgcttttgtaaccggtagtctcgcgttgtgggctccagcgttcctcctgagatcccgcgtagtgcttggagaaactccaccctgcttgccaggagactcctgtagtagctctgacagcttgatcttcggcctcataacatgcctgaccggcgtattgggagtggggttaggtgtggagatctccaggcggctgcggcattctaaccctagggcagatcctctggtttgcgcgacagggctcctaggttccgcgccctttctgttcctcagtctggcttgcgctagaggttctatcgtcgccacatacatatttatcttcatcggcgaaacgctactttcaatgaattgggctattgtcgcggacattctgctttacgtcgtgattcctacccggaggagtaccgccgaggctttccagattgtcctgtcacacctgcttggcgacgccggctccccttatctgattggcctgatttccgacaggttgcgccggaattggccgcctagcttcctgagtgaattcagggccttgcaattcagcctgatgttgtgtgcattcgtcggggcactcggtggtgcagccttcctgggtactgccatctttattgaagcagaccgaaggcgagctcagctgcatgtgcagggccttcttcacgaggctggatccaccgatgatagaattgtcgttccccagcgggggcgatctactagggtcccagtcgcgtcagtattgatctag

SEQ ID NO: 206897 - DNA, 1368 bp, Artificial Sequence
  Description of Artificial Sequence: Synthetic coding sequence
atggaccggttcaccgtggccggcgtgctgcccgacatcgagcagttcttcaatataggggacagcagttccggactaatccagacagtgtttatctcctcctatatggtcttggcaccagtcttcggctatttgggcgatcgctacaatcgaaaatacctaatgtgtggcggcatcgccttctggtctctcgtcactctgggatcatctttcattcccggagagcatttttggcttctgctcctgacgagaggcctggtcggggtgggagaggcctcttactcaacaatcgctccaacgcttatcgcggatcttttcgtggccgatcagcgctccagaatgctgtccatattttatttcgcaatccctgttggctctggcttgggttatatcgcaggttccaaggtgaaggatatggccggtgattggcattgggcactcagggtgacccctggacttggcgttgtggcggtactgttgctgttcctcgttgtgcgagaaccgcctaggggcgccgtcgagcgccactcagacctcccccccctgaatccaacatcttggtgggcggatcttcgtgctttggccaggaatcccagcttcgtgctgtcttctctgggctttactgccgttgcttttgtgacaggcagtctggccctgtgggcccctgctttcctgctaaggagtagagtggtgctgggtgagacccctccctgcctgcccggcgattcttgttcttcctccgattcactgatttttggcttaataacatgtctcactggcgtgctcggtgtaggcctcggggtggaaatatcccggcgcttgcgtcattctaacccccgcgccgaccccctggtgtgcgccactggtctgctgggatccgccccgttcctgttcctgtcactggcttgtgccagaggctccattgtagccacatacatattcatatttatcggcgaaaccctcctgagtatgaattgggcaatagttgccgatatcctattgtacgtggtaatacctacaagacggagtacggccgaggcgtttcagatcgtgctgtctcatctacttggagacgccggttccccctaccttatcggcctgatcagcgatcgattgagacgcaactggcctccctccttccttagcgagtttcgtgccctgcagttctcgctgatgctgtgtgcattcgtgggggcactaggtggggctgcatttctcggaacagctatctttatcgaagctgataggaggcgggcacagcttcacgtccaagggttgctgcacgaagccggttctaccgatgaccgcatagtggtccctcagaggggtcggtccactagagtcccagtcgcttcagtcctgatctag

SEQ ID NO: 206898 - DNA, 1431 bp, Artificial Sequence
  Description of Artificial Sequence: Synthetic coding sequence
atggccggcagcgacaccgcccccttcctgagccaggccgacgacccagacgacggtcctgtgccagggactccaggcctccctggaagtactggaaaccctaagtcagaggagccagaggtgcccgatcaggagggtctgcagcgtatcaccggcctgtccccgggaagaagcgctctgatcgttgccgtgctgtgctacatcaacctgctgaactatatggatagatttaccgtggctggcgtgctgcccgacatcgagcagtttttcaatatcggggacagcagctccggcctgatacagacagtgttcatcagttcttatatggtcctagcacctgttttcggatacctcggcgaccgttacaacagaaagtacctcatgtgcggaggcatcgcattttggtcactggtgacgctgggaagctcctttatacccggggaacatttttggttattgctgctaaccagagggctggtgggagtcggcgaggcctcatattccacaattgccccgaccctgatcgcagacctgttcgtagccgatcagcgcagccgtatgctgagtatcttttattttgctattcccgtggggagcgggctggggtacatcgctggatccaaggtgaaagatatggccggggactggcattgggctttgcgcgtcacgcctgggcttggcgtggtggccgtccttttgctgttcttagtagtccgggagcctccccgaggagccgtcgaacggcatagcgacctgccgcctctgaatcctacctcctggtgggctgaccttcgcgctctggcccgcaacctgatctttggtctcataacttgcctaacgggcgtactgggcgtaggccttggagtggaaatctctcgtaggctgcggcattctaatccccgggccgatcctttggtgtgcgcaaccgggctcctggggagcgccccttttctcttcctgtcacttgcctgcgccagggggagcatcgtcgccacatacatattcatttttattggagagacactactgtctatgaactgggccattgtagccgatattctgctctatgtagtgatccccacaagacgaagcactgcagaagcgttccagatcgttctgtctcacctcctgggcgacgccgggagcccgtacctgatcggcttgatatcagatcgcttgaggaggaattggccaccaagttttttgtccgaatttagggcactacaattctctctcatgttgtgtgcatttgtcggcgcattaggaggggcagccttcctgggcacagccatcttcattgaggccgacaggcggcgtgctcagctgcatgtccagggcttgctacacgaagccggaagtaccgatgacaggattgtggttcctcagagggggagaagcactcgcgtgcccgttgccagtgtcctgatttag

SEQ ID NO: 206899 - DNA, 1365 bp, Artificial Sequence
  Description of Artificial Sequence: Synthetic coding sequence
atggccggcagcgacaccgcccccttcctgagccaggccgacgaccctgatgacggacccgtgcctggaacaccaggactccctggctcaactggaaacccaaagtcggaggagcccgaagtgccagatcaggaggggctacagagaatcaccggactgtctccaggacgtagcgccctgatcgtggcagttctctgttatataaatttattgaactacatggatcgtttcaccgttgctgtctttattagctcctacatggtgttggcacccgtctttggttacttaggggataggtacaataggaagtacctaatgtgcggcggtatcgcattctggagtcttgtgacactgggctctagcttcattcctggagagcacttttggctgttactactgactcgggggcttgtcggggtgggagaagcatcctactccacgattgccccgacattgattgccgatttattcgtggcggaccagcggagtagaatgctttccatcttctactttgccattcctgtgggctccggtttgggctacatcgccggatcaaaagttaaggacatggcgggagattggcactgggccttgcgagtgacacccgggcttggagtggtggccgtactgctactgttcctcgtggtgcgtgagccacctcgcggagccgtggagagacatagtgatctccctccccttaacccgacatcctggtgggctgacctgagggccctggcccggaacctgattttcggtctcatcacttgtctgactggtgtcctgggtgtgggcctgggggttgagatctccagacgactaagacactccaatcctcgggctgaccctttggtatgtgccaccggccttctgggctcagccccttttctgttcctttcccttgcttgcgcgcgggggagcatcgtggcgacatacatttttatattcattggggaaaccctactctctatgaactgggccatagtagccgacattctgctgtacgtggtgattcctacccgtcggagcaccgctgaggcctttcaaattgtattgagtcacctgttgggcgacgcagggtccccctatcttatcggcctgatctcagacaggcttcggcgcaattggccacctagcttccttagcgaatttcgtgctctgcagttttccctaatgctatgcgcattcgtgggggctcttggaggagccgctttcctaggcacagcaatctttatcgaggcagacaggaggagagcccagctacacgtacaagggttactgcatgaagccggaagtactgatgaccgcattgtcgtgccccagaggggacggtccaccagagtgcccgtggcctcagttcttatttag

SEQ ID NO: 206900 - DNA, 1650 bp, Artificial Sequence
  Description of Artificial Sequence: Synthetic coding sequence
atgatgtgcctggagtgcgccagcgccgccgccggcggcgccgaggaagaggaggccgatgcggaacgaaggcgaagaaggcggggtgcccagcggggggccggcgggtctggatgttgtggcgccagaggcgcgggcggcgctggggtcagcgctgcaggagacgaggtgcaaactctaagtgggagtgtgagacgggcacctaccggccccccaggcacccccggcacacctgggtgtgccgccaccgccaagggccccggcgcacagcaaccaaaacccgcctccctggggcgaggtcgaggcgccgctgcagccattctgagcttgggtaatgtactcaactatctagacaggtacaccgtggccggggttctgctagatatacagcagcattttggtgtcaaagaccgcggagcagggttgctgcagtccgtgttcatctgctcattcatggtggctgcccccatttttgggtacttgggtgacagattcaaccggaaggtgatcttatcatgcggcatttttttctggagtgccgtgacattcagttcgtcatttatcccacaacagtatttctggctcttagttttatcgagaggactggttggcatcggtgaggcctcttatagcacaatcgcacctacgatcatcggggatctgttcaccaagaatacccgcactcttatgttaagcgttttctactttgccattccactgggctcagggctgggatacattactggttcaagcgtgaagcaggccgcgggggactggcattgggcgctgcgggtgagtcccgttctgggaatgattactgggacgctgatactaatcttggtcccggcaaccaagagagggcacgcagaccagttgggagaccaactgaaagcacgcacgtcatggctccgggacatgaaggccctcatacgcaacaggtcgtacgtgtttagcagtctggcaaccagcgctgtcagctttgctactggggcactggggatgtggatccctctctacctccaccgagcccaggtcgtccagaaaactgcagagacatgtaatagccctccttgcggagccaaggattctctgatcttcggggcaataacctgctttacaggctttttaggagtggtgaccggagctggggccacccggtggtgtcggctgaaaactcaacgggctgatccactggtttgcgccgtgggaatgctgggatccgctatcttcatttgtctcatttttgtcgccgctaagagctctattgttggggcttatatctgcatctttgtgggggagactctgctgttcagcaattgggccatcacagccgatatcctgatgtatgtggtgattcctactagaagggccactgcagttgccctccagtccttcacgagtcaccttctaggtgacgctgggagcccatatctgatcggttttatttccgatctgatcaggcagtcaacaaaggacagccccttgtgggaatttttatctcttggttacgcgttgatgctgtgcccgttcgttgtggtgttgggcgggatgtttttcctggcaaccgcccttttttttgtttctgaccgcgccagagccgagcagcaggtgaatcagctagcaatgccgccggcatctgtgaaagtttag

SEQ ID NO: 206901 - DNA, 1158 bp, Artificial Sequence
  Description of Artificial Sequence: Synthetic coding sequence
atgctggtgtgcttccggctgtacagctggctgttcttcctgagccggggaatcgtgggaactggtagcgctagttactcaactatcgcgccaacggtgctaggcgatttgttcgtgcgggaccaacgtacaagagtgctggccgtattttacatctttatccccgtgggaagtgggctcggctatgttctcggctctgcagtcactatgctaacgggtaactggagatgggcgctccgcgtgatgccctgcctggaagcggtcgccctcatcctgctgattctcttagtccctgatccacctagaggtgccgccgagacccagggagagggcgctgtgggcggttttaggtcgtcctggtgcgaagacgtcaggtacctcggaaagaattggagtttcgtttggtccaccctgggagtgaccgcgatggctttcgtgacaggggccttgggcttctgggctccaaaatttctccttgaggccagggttgtgcacggcctgcagccaccctgtttccaggagccatgctcaaaccccgattctctcatctttggtgccctgacgattatgacaggcgtaatcggagttattctaggcgccgaggccgcccggcgatataagaaggtgatcccgggcgctgagcctttaatctgcgcgtcatctctgcttgccaccgcaccatgtctgtacctcgccctggtgttggcgccgactacactcctggcttcttacgtgttcctcgggctgggagaattgctgctgagctgcaactgggccgtggtggcagacattctgctctccgttgtggtaccacgctgcaggggtactgcagaggcccttcagattactgttggccacattctgggagatgcaggcagcccatacctcaccggccttatttcaagtgtgttaagagcacgccggcctgattcttatctccagagattccgatcgctgcaacagagtttcctttgctgcgcgtttgttatcgcactcggtggaggctgttttctgctcactgccctctacttggaacgggacgagactcgggcctggcaaccggttacaggcacccctgattccaacgatgttgactccaatgatctcgagagacagggcctgctctccggggcaggtgcttccacagaggaaccctag

SEQ ID NO: 206902 - DNA, 1539 bp, Artificial Sequence
  Description of Artificial Sequence: Synthetic coding sequence
atggccggcggcatgagcgccgagtgccccgagcccggccccggcgggctccagggccagtctcccggtccgggtcgtcaatgcccgcctcccatcactcctaccagttggtcactgcctccttggcgagcctatgtcgcagctgccgtgctgtgttatataaatcttttgaattacatgaactggttcatcatcgcgggcgtgctcctcgatatccaagaagtttttcagatctcggacaatcatgctggactgctgcagaccgtgtttgtgtcctgtttgctgctgagcgcccctgtcttcgggtatcttggcgataggcactcgaggaaagctactatgtcatttggcatcctgttgtggagtggagcagggctttcttcatccttcatttcccccagatatagctggctcttcttcctgtcgcgtggcattgtgggcaccggatccgcttcatattcgacgatcgccccaacagtcctgggtgacctgttcgtccgcgaccaacgaactcgtgttctggctgtgttctatatttttatacctgttggatccggccttggctatgtgctcggctcagcggttacgatgctgacaggaaactggaggtgggccctgagggtgatgccctgtctggaagctgttgctctcattctattgattctcctggtaccagacccccctaggggggcggcagagacccagggtgagggtgccgtgggaggttttcggtcaagctggtgtgaagacgtccggtatctgggcaaaaattggtcatttgtctggtccacgctcggcgtgacagctatggctttcgtcacaggagccctgggcttttgggctcccaagttcttgctggaggcccgggttgtccatggcctccagccaccgtgtttccaggaaccgtgttccaatcccgactccctcatttttggtgccctgacgattatgactggagtgattggcgtcatcctcggggccgaggccgcccggcgatacaaaaaggtgattcccggggctgaacctctgatctgcgcctcttccctcctcgccacagccccctgcctgtacttagcgttggtcttggcccccaccaccctgctggcttcttacgtgtttctgggactgggcgagctgctgttatcgtgtaattgggcagtggtagccgatatactgctgtccgtggtcgttccccgatgccgcggcacagcagaggcactgcagatcaccgtaggacacatcttgggcgatgccggttccccataccttaccggtcttatttcctccgtgttacgggcaagaaggccggatagctatcttcagcggttccgcagcctgcagcagagcttcttgtgctgtgcttttgtgatcgcactcggtgggggatgcttccttctgaccgccctgtacctggagagagatgaaacaagagcttggcaaccagtcaccgggaccccggatagcaatgatgttgattccaatgatcttgagagacaaggactgctgtccggagcaggagctagcaccgaggagccatag

SEQ ID NO: 206903 - DNA, 249 bp, Artificial Sequence
  Description of Artificial Sequence: Synthetic coding sequence
atgggccagaccgccctggccggcggcagcagcagcacccccaccccacaggcactctatcctgacctttcatgtccggaaggactggaggagctattaagcgcgcctccccccgacctgggcgcccagagacggcacggctggaaccccaaagattgcagtgaaaacatcgaggtgaaggaaggcggcctgtattttgaacgacggccggtggcccagtcgactgatggagctcgaggaaagcgctag

SEQ ID NO: 206904 - DNA, 792 bp, Artificial Sequence
  Description of Artificial Sequence: Synthetic coding sequence
atgggccagaccgccctggccggcggcagcagcagcacccccacccctcaagccctctacccagacctgtcctgccctgaggggctcgaggagttattatcggctcccccacccgacctcggcgcccagcgcagacacggctggaatccaaaggattgctcggagaacatcgaggttaaggagggtggcttgtactttgaacgaaggcccgtggcacagtcgacagatggcgcaagggggaagcggggatactcacggggattacacgcctgggaaatttcctggcccttggagcagcggggcacgcacgctgttgtcggcgttgctactgctttggccccactgcagacagaccattatgcggcgctcttgggcagcaacagcgagagttggggatgggatattggaagggggaaattgtatcaccagtctaaaggcccaggagctccgcagtatcccgccggtacgcagggagaacaactggaggtccccgaaagattgcttgtcgtccttgacatggaagaagggaccttgggctacgctatcggggggacctatctgggccccgcctttagaggtctcaaaggtcgcacactttacccagccgtgtcagccgtctggggacaatgtcaggtgcggatccggtaccttggtgaacggagggcagaaccacactcactgctgcacctgtccagactctgtgtgcgacataatctgggagatactcgacttggccaggtatccgctctacctctgccccccgccatgaagcggtacctgttgtatcagtag

SEQ ID NO: 206905 - DNA, 792 bp, Artificial Sequence
  Description of Artificial Sequence: Synthetic coding sequence
atgggccagaccgccctggccggcggcagcagcagcacccccacccctcaggcactgtaccctgacctaagctgtcccgagggcctcgaggagctgctgtctgcccctccgcctgacctcggagcccagcgtcggcacggctggaaccccaaggactgctcggaaaacatcgaggtaaaggaaggtggtttgtacttcgaacggcgaccggttgcacaaagcactgatggagccaggggcaagcggggctattcaagaggcctgcacgcgtgggagatctcttggcccctggaacagcgggggacacacgctgttgtgggggtagcaacagcattggcacccctgcagaccgaccactacgccgcgctcctgggttctaattctgagtcctggggttgggatatcggacggggaaaactgtatcatcagtctaaaggtcccggcgcccctcagtatccagctggaactcagggggagcaacttgaggtcccagaaaggctgttggttgtgctggacatggaagagggcaccctcggttacgccatcggcgggacatatttgggccctgccttccgagggttgaaaggacgtacgctatatccagctgtgtctgccgtttgggggcagtgtcaagttaggattcggtacctgggtgagcgtagggcggagccccattcattgttacatctgtctcgcctatgcgtaaggcataacctgggtgacacccgactcggccaggtgtcggccttgccacttccccccgcaatgaaaaggtatcttctttatcaatag

SEQ ID NO: 206906 - DNA, 1068 bp, Artificial Sequence
  Description of Artificial Sequence: Synthetic coding sequence
atggcccggcggccccggaacagccgggcctggcacttcgtgctgagtgccgcacgcagggacgccgatgctcgggcagtcgccttagcaggttccaccaattggggctatgacagcgacgggcagcattctgatagcgatagcgatcctgagtattccacattgcctccgtctataccctccgccgtccctgtcaccggggagtcattctgcgattgtgcagggcaaagcgaagcatccttttgttcatccttacacagcgcccaccgcggccgagattgtcgatgcggagaagaggacgagtactttgactgggtttgggacgatcttaataagagcagtgcaaccctactgtcctgtgacaatcgtaaggtgagcttccacatggaatacagctgcggcaccgcggccatcagggggacgaaggaactaggggaagggcagcacttttgggaaatcaagatgacaagccctgtatacggcacagacatgatggtcgggatcggtacttcagatgtagacttggacaagtatcgacacaccttctgctcattactcggcagggacgaggatagctgggggctttcctacacaggtctgttgcaccacaagggcgataaaacaagtttctctagtaggttcggccagggcagtataatcggtgttcatctcgacacatggcatggcactctaacattcttcaaaaaccggaaatgtatcggagtggcggcgaccaaactgcaaaataaaagattctatcctatggtgtgctccactgcggccaggtcctccatgaaggtgacacggagctgtgccagcgccacttcacttcagtatctctgttgccatcgcctgaggcagcttcgtccggactcaggtgacaccttagagggcctgccactgcccccgggcttaaagcaggtgttgcacaacaaactcggatgggtgctaagcatgtcctgctcccggcgcaaagcgcctgtaagtgacccccaggcagccacgagtgcccatcccagctctcgcgagccacgtccgtgccagagaaaaaggtgcaggagaacatag

SEQ ID NO: 206907 - DNA, 480 bp, Artificial Sequence
  Description of Artificial Sequence: Synthetic coding sequence
atggagtacagctgcggcaccgccgccatccggggcaccaaggagcttggcgaaggacaacacttctgggagattaagatgacatcccctgtatacggtaccctgacattcttcaaaaacaggaagtgcattggtgtagccgcaaccaaactccagaataaaaggttttacccgatggtctgtagcaccgcagcccgttcttccatgaaagttacccgtagctgtgctagcgccacgagcctacagtacctctgctgtcaccgcctcaggcaactgagacccgactctggcgatacactagagggtctgcctctcccccccggtctcaagcaggtgttgcacaataaactgggatgggttctgagtatgagttgctcccgccggaaggcccctgtgtctgatccccaagccgctacctcagcacaccctagttctcgagagccgcgtccatgccagcggaagcggtgtaggcggacttag

SEQ ID NO: 206908 - DNA, 1068 bp, Artificial Sequence
  Description of Artificial Sequence: Synthetic coding sequence
atggcccggcggccccggaacagccgggcctggcacttcgtgctgagcgctgcgcggcgtgatgcagacgcccgtgccgtggcactcgctggatctaccaactggggatacgattccgatggacagcactccgattctgactctgatccagagtattcaacactgccaccctccattccctctgctgttcctgttaccggcgagtccttctgcgactgtgcaggacaaagcgaggcgagcttttgctcctccctccattcggcccatcggggacgggactgcagatgtggcgaggaggacgaatactttgactgggtctgggacgacctaaacaagagtagtgccaccctgctctcgtgtgacaaccggaaggtcagcttccacatggaatactcttgcgggactgccgcaatacgcggtactaaggagctgggggagggtcagcacttctgggaaatcaaaatgacaagtcccgtatatggcactgacatgatggtgggcattggcacttctgatgtggacctcgacaaatataggcacacattttgcagcctccttggccgggacgaggattcctggggattgtcctatacgggcttgctgcatcacaaaggagacaagaccagcttttcttccaggtttggccaaggcagtattattggagttcacctcgatacatggcatggaacactgacattcttcaaaaaccggaagtgcattggagtggctgctacaaaactgcagaataaaagattctaccccatggtctgtagcacagccgctcggtctagcatgaaggtgacaagatcgtgtgcaagtgccaccagcctgcagtacttgtgctgtcatcgtctgcgtcagttaagacccgacagcggcgatacactcgaaggtcttccattaccacccggattgaaacaggtcctgcacaacaagcttgggtgggtcctgtcaatgtcatgctcccggcggaaggctccagtaagcgatcctcaggccgccacttcagcccatccttcttctcgagagccgaggccatgtcagaggaaacgttgtagaagaacctag

SEQ ID NO: 206909 - DNA, 822 bp, Artificial Sequence
  Description of Artificial Sequence: Synthetic coding sequence
atgggccagaagctgagcggcagcctgaagagcgtggaggtgcgggaaccagccctgcgtccggcaaagcgagagctgaggggcgccgaacccggtcgtccagcgcggctggaccagctcctggacatgccagccgctgggctggcagtgcagctgaggcatgcatggaatcccgaagaccggtcccttaacgtgtttgtcaaagacgacgatagactgacatttcaccgacaccctgtggcacaaagtaccgatggaattagaggaaaggtgggccacgctcggggcttgcacgcttggcagattaattggccagccaggcagcgtgggacgcacgccgtggtgggagtagctaccgcaagggctccgttacactccgttggctatactgccttggttggctctgacgctgaatcttggggctgggacctggggcgcagtcgcctgtaccatgacggtaaaaaccagccgggggtggcttatcctgcattcctgggtccagatgaggccttcgctcttcctgacagtttattagtggtactggatatggacgagggaactctgagttttatcgtggatggccagtacctgggggtggcgtttcgcggccttaaaggcaagaaactctatcccgtcgtatcagccgtgtggggtcactgcgaagttactatgcgatatattaacggtctggatcctgagccactcccactgatggacctatgcagacggagtatcagatcggccctagggagacaaagactccaggacatatcttccctccctctccctcagtctttaaagaattatttgcaatatcagtag

SEQ ID NO: 206910 - DNA, 1908 bp, Artificial Sequence
  Description of Artificial Sequence: Synthetic coding sequence
atggccagcagcggcatggccgacagcgccaaccacctgcccttctttttcggcaacattacaagggaggaggccgaagattatcttgttcaggggggcatgtccgatggactgtatctgttgcgtcagagcaggaactacctcggtggattcgcattgtccgtggcccacgggcgcaaggctcatcactataccattgaacgcgagttaaatggaacatacgctattgccgggggcaggacacatgcttcccctgccgacctgtgtcattaccacagtcaagagtctgatggccttgtctgtctgcttaagaagccctttaaccgcccccagggcgtccagcctaagacaggacccttcgaagacctcaaggaaaacctaatccgcgagtacgtcaaacagacctggaaccttcaggggcaggcgttggaacaagctatcatcagtcagaagccccagttggagaagctgatcgcaactaccgcccacgagaaaatgccgtggttccatggtaagatctcccgtgaagaatcggagcagatcgtgctgatcggaagtaagacaaacgggaagttcctcatcagggcacgggacaacaatggttcctatgcattatgtttgctccatgaggggaaagtgcttcactatcgcattgataaagacaagacaggtaagctgtctatcccggaaggcaaaaagttcgataccctctggcagttggtcgaacattacagctacaaggctgatggactcttgcgcgtgctcacagtcccttgtcagaaaatcggcacacagggaaacgttaacttcgggggacgaccgcagctcccaggaagccaccccgctacatggagcgcaggagggattatcagcagaattaagtcatacagctttccgaaacctgggcatcggaagagtagtcctgcccagggaaaccgccaggaatctaccgtctcgtttaatccatacgaaccagaattggctccgtgggcagctgataaaggacctcagagggaagccctccccatggatactgaggtatatgaaagtccttatgccgatcctgaggagattcggcccaaggaggtctacctggatcgaaaactgctgactctggaagacaaggagctagggtctggaaacttcggtaccgtaaaaaagggttattatcagatgaagaaggtggttaagaccgtggcagttaagattctcaagaacgaggccaacgacccggcattaaaggatgagcttctcgccgaagccaatgtgatgcagcagctcgataacccatacatagtgcgcatgatcggtatctgtgaagctgagtcctggatgctcgtgatggaaatggccgaactggggcccctgaataagtacctgcagcagaataggcacgttaaggacaagaatataattgagctggtccaccaggtgtcaatggggatgaaatacttggaggaaagcaattttgtgcatcgcgatctggctgctcgcaacgttctactcgtgactcagcattacgcgaaaatatctgactttggcctttctaaggccctcagggctgacgaaaactactataaggcacaaacacacggcaaatggccagtcaagtggtacgccccggagtgcattaactattataaattctcttctaagagcgatgtgtggagcttcggagtactaatgtgggaggctttctcctacggacagaaaccttaccggggcatgaaggggtccgaggtcaccgcaatgctggagaaaggcgagcgcatgggctgccctgctgggtgtcctcgggaaatgtacgacctaatgaacctctgctggacatacgacgtggagaatagacctgggttcgccgctgtggagctgagattgagaaactattattacgatgtggtgaactag

SEQ ID NO: 206911 - DNA, 1839 bp, Artificial Sequence
  Description of Artificial Sequence: Synthetic coding sequence
atggccagcagcggcatggccgacagcgccaaccacctgcccttctttttcgggaacataactcgcgaggaagccgaggattatcttgtgcaaggcggcatgtccgacggcctgtacctgttgagacaaagccgaaactatttgggaggctttgctcttagcgttgcccacgggagaaaggcccatcactatacaatagaaagggagctcaatggaacctatgccattgctgggggccgaacgcatgcatctcctgccgatctgtgccactaccactcccaagaaagtgacggcctggtttgcctgctgaaaaagccctttaaccgacctcaaggcgtgcaacctaagactgggcccttcgaggacctcaaagagaacttgattcgcgaatacgtgaagcagacttggaaccttcaaggccaggccctggagcaggcgataatctcacaaaaaccacagctggagaagctgattgccacaaccgctcacgaaaaaatgccttggtttcacggcaagattagcagggaggaatctgagcaaatagtactgatcggctccaagaccaacggaaagtttctgatcagggcccgggataacaacggaagctatgcactgtgtttgctgcacgagggtaaggtgttacattatcgcatagacaaggacaaaaccggaaaactctccattcccgaaggcaagaaattcgacactctgtggcagcttgtagagcattacagttataaagctgatggtcttctgagagtactcactgttccgtgtcagaaaatcggtacacagggcaacgtgaacttcggaggccgaccccagctccccggatcacaccccgctagcagtccggcccagggtaataggcaggaatctactgtgtcttttaacccatacgagcctgagcttgccccgtgggctgcagacaaaggcccccaacgggaggcactgccaatggatacagaggtttatgagtctccatatgcagatcccgaggagattagacccaaggaggtgtacctcgacagaaagctgctgacactcgaggacaaagagcttgggagtgggaattttggtacagtgaaaaagggctactaccagatgaaaaaggtggttaagaccgttgcggtgaaaatactgaaaaacgaagctaatgatcctgccttgaaggacgagctgttggcagaggcaaacgtgatgcaacagctggacaacccatatattgtgcggatgatcggaatctgtgaagctgaatcttggatgctggttatggagatggccgagctcggtccgctgaacaaatacttgcaacagaaccgacatgtcaaggataagaacatcatagagctggttcatcaggtatctatgggtatgaagtacttagaggagtcaaattttgtgcatagggatcttgccgcccgcaacgtcctcttagtgacacagcactatgccaaaattagcgatttcggactatctaaagccttacgagctgatgaaaactattacaaagcacagactcatggaaaatggcctgttaaatggtacgcccccgaatgtattaactattataaattcagcagtaaaagtgacgtttggtcattcggagtactgatgtgggaagccttcagctatggccagaagccctaccgagggatgaaagggtctgaggtcacagccatgctggagaaaggtgagaggatgggctgtccagctggatgccctcgcgagatgtacgatctcatgaacttgtgctggacctacgatgtagagaatcggcctgggttcgccgccgttgagcttcgacttaggaactactactacgacgtggttaactag

SEQ ID NO: 206912 - DNA, 1839 bp, Artificial Sequence
  Description of Artificial Sequence: Synthetic coding sequence
atggccagcagcggcatggccgacagcgccaaccacctgcccttcttctttggtaacataactcgggaggaggcagaggattaccttgtgcaaggggggatgagcgacgggctctatttacttaggcaatcccggaactatctgggtggcttcgccctcagtgtcgctcatggccgaaaagctcaccattacactatcgaacgggagttaaatggaacctatgctatcgcagggggccggacccatgctagccccgctgatctgtgtcattatcatagccaggaatccgatggcttggtgtgtctgttgaagaagccttttaatagaccgcagggcgtccagcccaaaaccgggccgttcgaggatctgaaagaaaatttgattcgcgagtacgttaaacagacatggaatcttcagggccaggctctggaacaggctattatatctcagaaaccgcaactcgaaaaattgattgctaccacagcccacgagaaaatgccctggtttcatggtaaaatttccagagaggagagcgagcaaatcgttcttatcggaagcaaaactaacggtaagtttctgattagagccagagataacaatgggtcctacgccttgtgccttctgcatgagggcaaagtgctgcattacaggatcgataaagacaaaacagggaagctgtctatcccagaaggcaagaagtttgacacactctggcagttggtggagcattactcatacaaagcggatggcctgctgagggtgctcaccgtgccgtgccagaaaatcgggactcaaggtaatgtaaattttgggggacgccctcagctgccaggatctcatcccgctagttcacctgcacagggcaacaggcaggaaagcacagtgtcattcaacccttacgaaccagagctggctccttgggcggctgataaggggcctcagcgcgaggcgctgcccatggataccgaggtgtatgaatccccttatgccgatcccgaagagattagaccgaaggaagtgtatctcgatcgcaagctcctcacactggaggacaaggaactcggctcaggcaattttgggaccgtaaaaaaaggatattatcagatgaaaaaggtggtcaaaactgtcgcagttaagatcctgaagaatgaggcaaacgacccagcactcaaagatgagcttctggccgaggccaacgtgatgcagcaactggataatccctacatcgtgagaatgatcggcatctgcgaggccgagtcttggatgcttgtgatggagatggccgagctcggcccattgaacaagtatcttcagcagaataggcatgtcaaagacaaaaacattattgaacttgtccaccaggtgtctatgggaatgaagtatctggaagaatccaacttcgtgcatcgggaccttgctgccagaaatgtgctgctggtgactcagcactatgctaaaatttccgattttgggctttcaaaggcattgcgggccgatgagaactactacaaggcccagactcacggtaagtggcccgtgaaatggtatgcaccagagtgcattaattattataagttctccagcaagagcgacgtttggagctttggcgtgctcatgtgggaggccttctcttacgggcagaaaccatacagaggcatgaagggctctgaagtgacagcaatgttagaaaagggcgaacggatggggtgccctgcggggtgccctagggagatgtatgacttgatgaacctatgttggacttatgatgtcgagaacaggcctggttttgctgctgttgagttgcgcctcaggaactactactatgacgtggtcaattag

SEQ ID NO: 206913 - DNA, 1908 bp, Artificial Sequence
  Description of Artificial Sequence: Synthetic coding sequence
atggccagcagcggcatggccgacagcgccaaccacctgcccttctttttcggaaacatcacccgcgaagaagctgaagactacctcgttcagggtggcatgtccgacgggctgtatctgctgcggcaatctcgaaattatttaggtggcttcgcactctccgtagctcacgggcggaaagcccatcattatacgattgagagagagctcaatggcacatacgcgatagcaggtggccggactcatgcatccccagcagatctttgtcactatcactcacaagagagtgatggcctggtctgtttgctaaagaagcccttcaacaggccgcagggtgtacagcctaagaccggcccttttgaggacttaaaagagaacttaattcgcgagtatgtcaaacagacttggaatttgcagggccaagcattggaacaagctatcatttcgcaaaaaccccagctggagaaactgatagcaactacagcccacgagaagatgccgtggttccatggaaaaatctcacgggaggagagcgaacagatcgtgttaataggaagtaaaacaaatggcaaattcctaattagagcccgggacaataatggcagctacgccttatgcctgctacacgaaggcaaggtgctccactacaggatcgataaggataagacaggtaaactgagtatccctgagggcaaaaagttcgataccctgtggcagctggtcgaacattattcctacaaggccgatggtttacttagggttctgactgttccctgtcagaagattgggactcaagggaatgtcaatttcgggggtagaccccagttgcccggctcccatccggccacctggtccgctgggggcatcatctcccggatcaagtcttacagttttcccaaaccaggccaccgtaagtcaagtcctgcacagggcaatcgacaggagtctactgtgtccttcaacccttatgagcctgagctcgctccgtgggcggcggataagggtcctcagcgggaggcgctgccgatggacaccgaagtgtacgagtccccttatgccgaccctgaggagatccggccaaaggaggtatatcttgatcgaaaactgcttacactggaagacaaggagctgggtagcggcaacttcggcaccgttaagaagggctactaccagatgaagaaggtggtgaagacagttgccgtgaagatcctgaaaaatgaagcaaatgacccggccctcaaggacgaattgctggccgaggcaaacgttatgcagcagctagacaacccgtatatcgtgagaatgattggtatctgcgaggccgaatcatggatgttggtgatggagatggcggagctgggtccgttaaacaaatacctgcagcagaacagacacgtgaaggataaaaacattattgagctggtccaccaggtgagcatgggtatgaaatacctagaggagtccaactttgtccatcgagacctcgccgccagaaacgtgctgcttgtgacgcaacactatgctaaaatatctgacttcggcctgtccaaggccctacgggcggatgagaactattacaaggcccagactcatgggaaatggccagtaaaatggtatgcccccgagtgcatcaattactataaattctcgtctaagagcgacgtgtggagctttggcgtcctgatgtgggaagcgttctcctacggccaaaaaccctaccgcggcatgaaggggtctgaagtgaccgcaatgctggagaagggtgagcgcatgggatgccctgcgggctgcccaagggagatgtacgatcttatgaacctctgctggacttatgacgttgagaatcgacctgggtttgccgccgttgagctaaggttgagaaattactactatgacgttgtcaattag

SEQ ID NO: 206914 - DNA, 990 bp, Artificial Sequence
  Description of Artificial Sequence: Synthetic coding sequence
atggtgagcaagagccggtggaagctgctggccatgctggccctggttttggtggtcatggtttggtatagcataagccgcgaggactccttctattttcccatcccggagaaaaaggagccctgtctgcaaggagaggcggagtcgaaagcctccaagctatttggtaactattcaagagaccagcccatcttcctgcgactcgaggattatttctgggtgaagacacccagcgcctacgaattgccttacggcacaaagggttccgaggacctcctcctcagagtacttgccattacatcttcatcaatccccaaaaatattcagtctctccgctgtcggaggtgcgttgtggtggggaatggccaccggttgcgaaacagctctttaggggacgcaattaacaagtacgatgttgtcatccggttgaataatgcccctgttgcaggctacgagggagatgtcggcagcaagacgacaatgcgcctgttctatcccgaatccgctcactttgatcctaaggtagaaaacaaccctgacacccttcttgtgctggtggccttcaaagccatggacttccattggattgagactattctcagcgacaagaagagggtgcgcaagggcttctggaaacagcctccactaatctgggatgtcaatcctaaacagattagaattcttaaccccttctttatggaaatcgctgccgacaagctgcttagcttacccatgcagcagccgaggaagatcaagcagaaacccaccactggtttgttggcaattaccctggcactgcacctgtgtgacctcgtgcacatcgccggattcggttacccagacgcctataacaagaaacagacaatccactactatgaacagataactctgaaaagcatggctgggagcgggcataatgtgagtcaagaagcgttagcaatcaagagaatgctggagatgggggccatcaagaacctgacatcgttctag

SEQ ID NO: 206915 - DNA, 1917 bp, Artificial Sequence
  Description of Artificial Sequence: Synthetic coding sequence
atggccaccggcgccaacgccacccccctggacttccccagcaagaagcggaagcgcagtcggtggaaccaggatacgatggagcagaaaaccgtgatccccggaatgccgacagtgatacctcctgggctgaccagagagcaagagagggcgtacatcgtccagctgcagatagaggatctgactaggaagttaagaaccggggacctcggcataccccctaatcctgaggaccggtcccccagccccgaaccaatctacaatagcgagggaaagagactgaacaccagggaatttcggactcgcaagaagttggaggaagagcggcacaatctgataaccgagatggtggccctgaaccctgacttcaaaccgcctgccgactacaagcctcccgctacccgggtgtcagataaggtgatgatcccccaagatgaataccctgaaatcaattttgtgggcttgctaattggcccccggggaaacacgctgaaaaacatcgagaaggagtgcaacgcgaagattatgatccgcggaaagggctctgtgaaagaggggaaggtgggccgaaaagacggccagatgctgcctggagaggacgaacctctacacgccctcgtgaccgccaacacaatggagaacgtcaagaaggccgtggagcagattaggaacatactgaaacagggcatcgagactcccgaggatcagaatgaccttaggaaaatgcagctgcgtgaacttgcaagactcaatggcaccttacgagaagatgacaaccgcattttgagaccatggcagtcatcggagacacgatccatcacaaacaccaccgtgtgtacaaaatgtggcggcgcaggccatatagcctccgactgtaaatttcagagacccggggaccctcagtctgcccaggataaagcacgcatggacaaggagtacctttccctgatggcggagctcggcgaagctcccgtgcccgcttctgtaggcagcaccagcggcccagcaactacccctctagctagcgctccaaggcccgcggcacctgccaacaatcccccacccccctccctgatgtccacaactcaaagccggccgccctggatgaacagcggaccttcagagagcagaccttatcacggaatgcacggtggtggcccaggcgggcccggcggggggcctcactcatttccgcatcctttaccctccctgaccggcggacacggaggtcacccaatgcagcacaaccccaatggccccccacccccatggatgcagccgcctcccccccctatgaaccagggtcctcatccaccaggtcatcatggcccacccccaatggatcagtacctgggttctacccctgtgggaagcggggtttaccggttacaccagggaaaagggatgatgcctccccccccaatggggatgatgccccctccccctccacctccatcaggacagcccccgccccccccttctggacctctgcctccatggcagcagcaacagcaacaaccccctccccccccaccccccagcagctccatggcgtcctccacgcccttgccatggcagcagaataccacgaccactacgacttctgccggaaccggctctattcccccctggcagcaacagcaggcagctgccgcagcatctccgggcgcgccgcagatgcagggcaacccaactatggtacccctgccccccggcgtgcagccacccctcccacctggagctcccccacctcccccaccaccacctcctggctcggccggtatgatgattccacctcgggggggtgacggcccctcccacgagtcagaggactttccaagacccctggtaaccctacccggccgacagccccagcagcgtccttggtggactggctggttcggaaaagcagcctag

SEQ ID NO: 206916 - DNA, 1920 bp, Artificial Sequence
  Description of Artificial Sequence: Synthetic coding sequence
atggccaccggcgccaacgccacccccctggacttccccagcaagaaaaggaagagatccaggtggaatcaggatacgatggaacaaaaaactgtgatacccgggatgcccaccgttattccacctggactgacaagggagcaggaacgggcctatatcgtccagctgcagatcgaggacctcacccgtaagctccgtacaggggatttaggcatccctcctaatcctgaggaccggtccccaagcccagaacccatttacaactccgaaggaaaacggctgaatactcgcgaatttcggacacggaagaagctcgaagaggagcgacacaatctgattacagagatggtggctctcaatcccgacttcaagcccccagcggactataagccacctgctactcgagtttctgacaaagtgatgatcccccaggatgaataccctgagatcaatttcgtgggcctactgatcggtccgcgcggtaacaccttgaagaacatagaaaaggagtgcaacgcaaagatcatgatcaggggtaaggggagcgtaaaagaggggaaagtcggtagaaaggacggacaaatgctcccaggggaagatgagcctctacatgctctggttacagccaataccatggagaatgtgaagaaagccgtggagcaaatcagaaatatcctcaagcaagggatcgagacacccgaagaccagaacgatctccgcaaaatgcagctgcgcgagctggcacggttgaatgggacactaagggaagacgataaccgaatacttcgcccctggcagtctagtgaaactaggtccattaccaatacaactgtttgcaccaaatgcgggggtgcaggccacatcgcgtcggactgcaaatttcagcgaccgggcgacccccagtcagctcaggataaagctaggatggataaagagtacttgtcgcttatggcggagttgggtgaggctcccgtgcctgcttccgtaggctctacaagtggacctgcaactacaccactggccagcgcgccaagaccagccgcacctgccaacaacccacctcccccctcactgatgagtaccacgcagtcccggcctccttggatgaacagtgggccttcagagagccggccctatcacggaatgcatggaggcggccctggcggccccggaggcgggccacattcttttccacatccgctcccaagcttgaccggcggacacggcggacatccaatgcagcataacccgaacggtccccctcccccctggatgcagccacctcctccccctatgaatcagggaccacatccccctggccatcacggaccccctcctatggaccagtacctcggctctacccccgtcggatctggcgtgtatcgcttgcatcagggtaaaggaatgatgccccctcccccaatgggaatgatgccgccacctccaccaccgcccagcggacagcctcctcctcccccgagtggaccactgccaccttggcaacagcagcagcaacagccacccccacctccacccccttcgtccagtatggctagctcaacccctctgccctggcagcagaatactaccacgacaaccaccagtgccggaaccggttctattcccccatggcagcagcaacaggcggccgctgcagcttctcctggagccccacaaatgcaaggcaatccaaccatggtccctctcccccccggagttcagcctcctctgccaccaggcgcacctcccccacccccccccccccctccgggtagcgctggaatgatgtacgccccccccccacccccacctccacctatggacccgtcgaattttgtgactatgatgggcatgggcgtggcgggtatgcccccatttggcatgccaccggctcccccccctccccccccacagaactag

SEQ ID NO: 206917 - DNA, 1716 bp, Artificial Sequence
  Description of Artificial Sequence: Synthetic coding sequence
atggccaccggcgccaacgccacccccctggacttccccagcaagaaacggaagaggtcccggtggaaccaggatacaatggagcaaaagacagtcatccctggaatgcccacggtgatccctcccgggctgacacgggaacaagagagagcttatatcgtgcaactccagatcgaggatctgacccgaaagctccggactggcgacctcggcatccctccaaatcctgaagacaggagtccctccccagaacccatctataactctgaagggaagcgactaaatacaagggagtttcggactaggaagaagctagaggaagaaagacataaccttattaccgagatggtggccctcaatcctgatttcaagccccctgctgattataaaccacctgcaacccgcgtctcagacaaggtgatgattccacaagatgagtatcccgaaattaacttcgtaggccttctgatcggaccgcgaggtaatactctaaagaacatcgaaaaggagtgtaacgccaagattatgattcgcgggaaggggagcgtgaaggagggtaaggtgggaaggaaggacggtcaaatgctcccgggagaggacgaacctttgcatgcgctcgttacggccaacactatggaaaatgtgaaaaaggcagttgagcagattcggaatatcctgaagcagggtatagaaaccccggaagaccagaacgatctgagaaaaatgcagctgagagagctagccaggctgaacggcacactgagagaagatgataaccgcatcctgcgtccatggcagtccagtgaaacacgttccatcacaaacaccacagtctgcacgaagtgtgggggtgcaggccacattgctagcgattgcaagtttcagcgacctggagacccccaatctgctcaggataaggcccgcatggataaagagtacctttctttgatggccgagttgggagaagccccggttcctgcctccgtgggatccacaagtgggccggcaacaacaccactagcctcagctcccagacctgcagcaccggcaaacaatcctcccccccccagcttgatgtccacgactcagtcgagaccaccatggatgaattctggccccagtgaatcacggccttatcatggcatgcatggcgggggtcccggtggaccagggggtgggccccactctttcccccatccactgccatcactaacagggggacacggaggccaccccatgcagcacaaccccaacggcccccctcctccatggatgcagcctccgcccccaccaatgaaccaaggaccgcatccccccggtcaccacggaccccccccaatgggtaagagcgtgcccgggaaatatgcatgcggactctgggggctcagtcctgcttcgcgcaagagatacgacgccgccaccacgtacggccacgatgcagcagccgccgccgccagccagtgggccgccccaacaccttccttgtggtcttcctcacccatggcgacaaccgcagccgctgcctccgcaacaccctctgcccagcagcagtatgggtttcagtacccactagccatggcagcaaaaatcccccccagggggggtgatggcccatctcacgagagcgaggatttcccgcgtccgttagtgaccctgccaggcaggcagcctcagcaacgaccctggtggacggggtggtttgggaaagcggcctag

SEQ ID NO: 206918 - DNA, 1302 bp, Artificial Sequence
  Description of Artificial Sequence: Synthetic coding sequence
atggtggccctgaaccccgacttcaagccccccgccgactacaagcccccggcgacccgggtttccgacaaagttatgattcctcaggatgaataccctgagatcaatttcgtaggcctgctgatcggcccacggggtaatacattgaaaaacatagagaaggagtgtaacgcaaaaatcatgatccggggtaaaggatccgtcaaagagggaaaagtcggtcggaaagatgggcagatgctacctggagaagacgaacctctgcatgccctggtcacagctaatactatggagaacgtcaaaaaggcggtagaacaaattaggaatatcctgaagcaaggcatcgagacacccgaagatcagaacgacctaaggaagatgcagctaagagaactcgctagactgaacggaacactccgcgaagacgataacaggattttacggccctggcagagttccgaaactcgctctatcaccaatacaactgtctgcaccaaatgtggcggcgccggccatatcgcatctgactgcaaattccagcggcccggagacccacaaagtgctcaggataaggcacggatggacaaggagtacctttcactgatggctgagctgggcgaggctcctgtacctgccagcgtggggtccacatccggtccggcaacaacccctctggcaagcgccccgcggccagcagctcccgcaaacaatccacctcccccatccctgatgtccacaacccagtcacggccaccatggatgaattcaggtccctcagagtccaggccgtaccatgggatgcacggagggggcccggggggccctgggggagggccacactcgtttccacaccccttaccttccctgacaggaggccatggtggacacccgatgcagcacaatcccaacgggccaccgcccccatggatgcaacctccaccaccgccaatgaatcagggtccccacccaccaggccatcatggccctcccccaatggaccaatatcttgggtctaccccagtagggtcaggtgtttatcgcctgcaccaaggaaaaggcatgatgcctcccccccccatgggaatgatgcccccgccacccccccctccttccgggcagccacctcccccaccgagcggccccttgccgccttggcagcagcagcaacagcaacctccgccacctccccccccttcaagcagtatggcctcctcgacgcctctgccttggcaacagagatccctgcccgctgctgcaatggcacgagccatgagggttaggactttccgggcccactggtag

SEQ ID NO: 206919 - DNA, 2022 bp, Artificial Sequence
  Description of Artificial Sequence: Synthetic coding sequence
atggccaccggcgccaacgccacccccctgggcaagctgggcccccctggactgcctccgctcccaggcccgaagggcggctttgagccgggcccacctccagcaccgggacctggagccggcctacttgcaccagggccgcccccccctccaccagtcggatccatgggtgcactgacagccgctttccccttcgcagcgcttcctcctcctccgccaccaccccctccccctccacctcagcagccacctccgcccccacctcctcctagtcccggtgctagctatccaccaccccagcccccaccccccccacctctttaccagcgagtctcaccccctcaaccgcccccgcctcaacccccgcgtaaggaccagcagccaggacccgccggtggaggcggcgattttccctccaagaaaaggaaaaggtcaagatggaaccaagacaccatggagcagaagaccgttatcccaggcatgcctacagtgatcccacccgggctgactagggaacaggaaagggcatacattgtgcagctgcagatcgaagatcttacaagaaagctgagaaccggcgatctcggtatacctcccaaccccgaagacagaagcccatctcccgaacccatctataattcggagggaaaaaggttgaatacacgtgagtttcgtacacgtaagaagttggaggaagagcgacacaaccttatcaccgagatggtggctcttaaccccgactttaagccacctgctgattataagccacccgcaacgcgagttagcgataaggtaatgataccccaggacgagtacccagagataaactttgtgggcctgttgatcggcccacgcggaaacacactcaagaatatcgagaaggaatgcaacgctaaaattatgatacggggaaagggctctgtgaaagaaggaaaggtgggccgcaaggatggccagatgctcccaggtgaagacgaaccactgcacgcacttgtgacagccaacacgatggagaacgtcaagaaagctgtggaacaaatacgcaatatactgaagcaggggatagaaacgcctgaagaccagaatgatttaagaaagatgcaactgcgagagctggcccgcctgaacggaactctgcgggaggatgataaccgaatcctgcggccctggcagtcatcagagaccagaagtatcaccaataccaccgtgtgcacaaagtgtggtggcgccgggcatattgcctcagattgtaagttccagaggcccggtgatccccaatcagcccaagataaagcaaggatggacaaagagtacctcagtctcatggctgagttaggagaggcacctgtcccagcttctgtgggctcgactagcgggccagctaccacacctctggcttctgctccgcgcccagccgctccggccaataaccctccccccccatcattaatgagcaccacacagtctcgtcccccctggatgaattccggtccaagcgaaagtcggccttatcatggcatgcatggcggtgggccgggcgggccaggaggcggaccacacagttttcctcacccgctcccttcgttgactggaggccatgggggccaccctatgcaacacaacccgaacggtccccccccaccatggatgcaacccccacctcctccaatgaaccagggtccccatccacccgggcaccacggaccgccaccgatggaccagtacctggggtctacaccggtcggatctggtgtttaccggctccatcaggggaagggcatgatgcctccccctcccatgggcatgatgcctcccccgccccctccacccagtggacaaccgccaccccctccctccggtccgctgcccccctggcagcagcaacagcaacagccgccccccccaccccccccaagctcatccatggcctctagcactcccctgccgtggcaacagcgttccctgccagcagctgctatggcacgcgcgatgcgtgtaaggacattccgggctcactggtag

SEQ ID NO: 206920 - DNA, 1842 bp, Artificial Sequence
  Description of Artificial Sequence: Synthetic coding sequence
atggagcagaagaccgtgatccccggcatgcccaccgtgatcccccccggactgacaagggagcaggagcgggcctacatcgtccagctccagatagaagacctaacgagaaagctgcgcactggtgatttgggaatccctccgaaccctgaggatcggagccctagccccgagcctatctataactccgaaggaaagcggctgaacactcgggaatttaggactagaaaaaagcttgaggaagagagacacaacctcattaccgaaatggtggctctcaatcctgacttcaaaccaccggccgattataagccaccagctactagagtgtccgacaaggtcatgattccacaggacgagtacccagagattaacttcgtgggcttacttatcggccctaggggcaatactctgaaaaacatcgaaaaggagtgcaacgcaaaaatcatgatcagggggaagggctcagtgaaagagggaaaggtgggtaggaaggatggtcagatgctgcctggggaagatgagcccctgcatgccttagtcacggctaatacaatggagaacgttaaaaaggccgtagagcagattaggaatattctgaagcagggaattgaaacccccgaggaccagaacgatctccgtaagatgcagctgcgtgagctggcacgactcaatggtactctccgagaagacgacaaccggattctgaggccgtggcaatcttcagagacgcggtccattacaaatacgacagtgtgtacaaaatgcgggggagcagggcatattgccagtgactgtaagttccagaggcctggcgaccctcagtccgctcaagataaggcgcgcatggataaagaatacctcagtcttatggcagaattaggcgaggcgccagttccagcgagtgtgggaagcacaagtgggccagcgaccactccactggcatctgccccccggcctgcggcccctgccaataatcccccaccaccgtccctcatgtctaccactcagtctcggcccccttggatgaattccgggccttctgagtcgcgtccgtaccatggcatgcacggcggaggcccaggcggcccaggtggcggcccacatagttttccgcatcctctgccctccctgacaggtggccacggtggacaccctatgcagcacaatcccaatggacctccaccgccctggatgcagccgcctccacccccaatgaaccaggggcctcatcctccagggcatcacggcccacctccaatggaccaatatctgggatccactcccgtcggctctggggtctaccgattgcatcagggaaaggggatgatgccccccccccccatgggtatgatgcctcctccaccccctccaccgtcgggccagccccctcccccaccaagtgggccgcttccaccttggcagcagcaacagcagcagccccctccccctcccccaccatcatctagcatggccagcagtactccgttgccctggcagcaaaacactaccactacaactacgagcgccgggactggctccattccaccatggcagcagcagcaagcagctgctgccgcctcaccaggggccccacagatgcaaggcaatcccaccatggtaccgctgccacctggagttcagccccccctgccacccggcgcaccaccaccccccccacctccacctcctggcagtgcagggatgatgtatgcgcctcctcctccaccgccgccgccaatggatccatctaatttcgtgaccatgatgggcatgggcgtggccgggatgccgccattcggaatgccacctgccccgccacctcctcccccccagaattag

SEQ ID NO: 206921 - DNA, 1527 bp, Artificial Sequence
  Description of Artificial Sequence: Synthetic coding sequence
atggccaagagcaacggcgagaacggcccccgggcccccgccgccggcgagagtttgtctggcactcgggaatccttagcccagggacctgatgccgcaacgaccgacgagctgagtagccttggtagtgattccgaggccaatggcttcgccgagcggcgcattgataaatttgggttcatcgtcggaagtcagggtgctgaaggggcattggaggaagtaccccttgaggttctgcgtcagcgtgaaagcaagtggctggacatgctgaacaactgggacaagtggatggccaaaaaacacaagaagatcagactgagatgccagaaagggatcccccctagcctgaggggtcgtgcttggcagtacctctccgggggaaaagtaaagctgcagcagaacccaggcaagtttgacgaattggatatgagcccgggtgaccccaaatggctagatgtcatagaaagggacttacaccgccaattcccctttcacgaaatgttcgtgagtcgcggggggcacggacagcaagatttattcagagtcctgaaagcatacaccctgtacaggcccgaagaaggctactgtcaagcccaagcgccaatagctgccgtgttgcttatgcacatgccggccgagcaggccttctggtgtcttgtccagatttgcgagaagtacctgccggggtattacagtgaaaagctggaggctattcagctggatggtgagatactcttctctcttcttcagaaagtgtcgccagtggcccataagcatttgtcaagacagaaaatcgatcccctcttgtacatgaccgaatggttcatgtgtgcattttccaggaccctcccctggagtagtgttctgcgcgtctgggacatgtttttctgtgagggcgtgaagatcatttttagggttggactcgtcctgctcaagcacgccctgggctcccctgagaaagttaaagcctgccaggggcagtatgaaactatcgaacgcttgcgttcgttatctcccaaaattatgcaagaggctttcctagtgcaggaagtggttgaattaccagttactgaacgccagattgagcgggaacacctgattcaactccggaggtggcaggagacgcggggcgaattgcagtgtcggagcccaccccggttgcatggagctaaggctattctggatgctgagccggggcccaggcctgcgttgcagccttccccgagtattagactgcccttagacgctccactgcccggatccaaagccaaacctaagcctcccaagcaggcccagaaagagcagaggaaacagatgaaaggacgaggtcagctcgagaagcccccagcccccaatcaggctatggtcgtggcagctgcaggggatgcatgcccacctcagcatgtcccgccgaaagactctgcgcctaaagattcagctcctcaagatttggccccccaagtgtccgcccatcacaggtcacaagaaagtctcaccagccaagaatctgaggatacctacctttag

SEQ ID NO: 206922 - DNA, 2187 bp, Artificial Sequence
  Description of Artificial Sequence: Synthetic coding sequence
atgcccgccggccccgtgcaggccgtgcccccccccccccccgtgccaaccgaacctaaacaacccaccgaggaggaggctagttccaaggaggattcagcaccatcaaagcccgtggtcggaattatttaccccccacccgaagtgcggaatatcgtggacaagaccgcatcgttcgttgcacgcaatggtcccgagtttgaagcgagaattagacagaacgaaattaacaatcctaagttcaattttctgaatccaaatgatccatatcacgcatactatcggcataaggtgtccgagtttaaggaaggcaaagctcagtttgtagctagaaatggccgccagtttttaacccaactgatgcagaaggagcagcgaaattaccagttcgattttctgcgcccacaacattccttgttcaattactttaccaagctggtggaacaatacaccaaaattctgatccccccaaagggcctgttcagtaagttgaagaaggaggccgagaacccaagagaagtcctcgaccaggtatgctaccgagtggagtgggctaaatttcaagaacgcgaaaggaagaaggaagaggaggaaaaggaaaaagaaagagtggcctacgcacaaattgactggcacgatttcgtggtcgtcgagacagttgacttccagcctaatgagcagggcaactttccgcccccaaccacgcctgaggagctaggcgcaagaatcctgattcaggagcgttatgaaaagtttggggagtccgaggaagtggaaatggaggtggaatccgacgaggaggatgacaaacaagaaaaagctgaggaacccccctcgcagttggaccaggatactcaggtgcaggacatggatgagggaagtgatgacgaagaggaagggcaaaaagttccgccacccccagaaacgcccatgcctcctccgttgccccctacccctgatcaagtgatcgtgcgcaaagattacgatcctaaggcatcaaagccattgcccccagcaccagctccagatgagtacttagtgtcgcccatcactggggagaaaattcccgcaagcaagatgcaggagcatatgagaatcggactgctggacccacggtggctggagcagcgagataggtcaatccgtgagaagcagtccgacgacgaggtatacgccccagggctggacattgagtcctctctgaagcagctggccgaacggaggactgacatctttggagtggaggagaccgcaatcggaaagaagatcggggaagaagagattcagaagccagaggaaaaagttacatgggacggacattccggtagcatggctaggacccagcaagccgctcaggccaatatcacgctgcaggagcagattgaggccatccataaagccaagggtctcgttcccgaggatgatactaaagaaaagatcggccccagtaaaccaaatgaaatcccccagcagcctcccccaccaagctcggccaccaacatcccatccagtgcccctcccatcacttccgtgcccagacccccgactatgcctcctcccgtgaggacaactgtggtgagtgctgttccagtgatgcctagaccaccgatggccagcgtggtcaggctgcccccaggatctgtaattgcacctatgcctccaatcattcacgcccccaggatcaacgttgtgccaatgcctccaagcgcgcctccaatcatggcccctcgccctccgccaatgatcgtgccaacagcgtttgttccggccccccctgtcgcccctgttcctgcacccgctcccatgccaccagtgcacccaccccccccgatggaggatgaaccaactagtaaaaagttgaaaactgaggactcgctgatgccagaggaggagtttcttagacgcaacaagggccctgtttccattaaagtccaggttccaaatatgcaagacaaaacggagtggaagttgaacggccaggtgctggtgttcacactgcccctgacggatcaggtgtccgtgattaaggtgaagattcatgaagctaccgggatgccagccggcaagcagaagcttcagtacgaaggaatcttcattaaagatagcaattcacttgcttactacaatatggctaatggagctgtaattcacctggcattgaaggaaagaggaggccggaagaagtag

SEQ ID NO: 206923 - DNA, 2073 bp, Artificial Sequence
  Description of Artificial Sequence: Synthetic coding sequence
atgaccctgaccatgcccaccaccgccatccccaaggtgatgcagcagcagcagcagactacccagcaacagctgcctcagaaagtgcaagctcaggtgatccaggagacgatcgtgcccaaagaacctccaccagagtttgaatttattgccgacccgccttcaatatcagcattcgacctagatgtcgtgaaactcaccgcacagttcgtggcccggaacggcaggcaattcctcactcagcttatgcagaaagagcagcggaactatcagtttgatttccttcgtcctcaacacagcctcttcaattactttactaagttggttgaacagtacactaagattcttattcctccaaaaggattattttctaaacttaagaaagaggccgagaatccccgagaggttcttgatcaggtttgttatcgcgtggaatgggctaagttccaggagcgagaaagaaagaaggaggaggaagagaaggagaaagaacgggttgcttatgctcaaatagattggcacgattttgtcgtggtagaaaccgtggattttcagcctaatgaacagggtaatttcccgcccccaacaacgcctgaagagctgggggctcgcatcctgattcaagagagatacgagaagtttggagagtcagaggaggtcgagatggaagtggagtcagatgaagaagacgataaacaggaaaaggctgaggaaccgccctcacagttagaccaagacacccaagtgcaggacatggacgaaggttccgacgatgaagaggagggtcaaaaagtgcctcctccaccagagactcccatgcctcctcctctcccacctacaccagaccaggtcattgtgagaaaggactacgacccgaaggcttccaaaccactcccccccgcaccagcccccgacgagtacctggtgtcacccataacaggtgaaaaaatccctgcttctaaaatgcaggagcacatgaggattggtctcctggatccgcggtggctggaacaacgtgacaggagcattcgggaaaaacagtctgacgatgaggtgtatgcaccaggactggatattgaatcatccctgaagcagcttgcggaacgccgcacagacattttcggggttgaggagacggctatcgggaagaagattggtgaggaagagatccagaaacccgaagagaaagtcacgtgggatgggcattcgggctcgatggcacggacccagcaagcggcccaggccaacattacacttcaggaacaaattgaagctatccacaaggccaagggactggttcctgaagacgatacaaaggagaagattggccctagtaaacccaatgaaatcccccagcaacccccccctcccagttctgccacgaacatcccatcttctgctcctcctattacttcggtccctaggcctcctactatgccacctccggtcagaacaaccgttgtgagcgcagtaccagtgatgccacgaccgcctatggccagtgtcgtcaggctgccgcccggatcagtgatcgccccgatgccccccataattcacgccccaaggatcaatgtggtacctatgcccccttccgctccccccatcatggcacctaggccccctcctatgatcgtccccaccgctttcgtccccgcacctcctgtggcaccagtgcccgcccccgctcccatgcctcctgtgcatcccccaccaccaatggaagatgagccaacctccaagaagctgaaaacagaagatagcctgatgcctgaagaagaattcctcagacggaataaaggcccagtgtcgattaaggttcaggtgccgaatatgcaggacaagaccgaatggaagctgaacggacaagtgctggtcttcacactacctttgactgaccaggtttccgtcatcaaggttaaaattcatgaagccacagggatgccggctggcaaacagaagctccagtatgagggaatctttatcaaagactccaactcgttggcttactataatatggccaacggtgctgtcatccacttggctctgaaagaaagaggcggccgaaaaaagtag

SEQ ID NO: 206924 - DNA, 900 bp, Artificial Sequence
  Description of Artificial Sequence: Synthetic coding sequence
atggacctgagcgagctggagcgggacaacaccggccggtgccggctttcttcaccagtccctgccgtctgccgaaaggaaccctgcgtgttgggagtggatgaggcgggcagaggacctgttctggggcccatggtgtatgcaatctgttactgcccccttcctcgcctggctgacctcgaagctctgaaggtcgctgacagcaaaacgctcctggagagcgagagggagagacttttcgccaagatggaggacacagacttcgtagggtgggcactggacgtactgagccccaacttgatctctacatccatgctaggccgggtgaaatacaacctcaacagcctgagccacgacaccgccaccggccttatacagtatgctctcgatcaaggagtaaacgttactcaggtgttcgttgataccgtcggaatgcctgaaacctatcaggcgaggctgcagcagtccttccctgggattgaggttaccgtgaaagcaaaggcagacgctctctacccagtggtgtctgccgcctcgatttgcgccaaagtggcccgggatcaggcagtaaaaaagtggcagttcgtcgagaaactccaggaccttgacacagactatggatcaggttaccctaacgacccaaagactaaggcctggctaaaggaacatgttgaacccgtctttgggtttccccagtttgtgagattttcatggcgtaccgctcagactatcttagaaaaggaggcggaggatgttatctgggaagattcagcttctgagaatcaggaaggcctgcggaagatcacatcttactttctcaacgagggctctcaagcaagaccgagatcttctcaccggtatttcctggaacgcggattggagtcagcgacaagcctctag

SEQ ID NO: 206925 - DNA, 3915 bp, Artificial Sequence
  Description of Artificial Sequence: Synthetic coding sequence
atggccaagatcgccaagacccacgaggacatcgaggcccagatcagagagatacagggcaagaaagcggccctagatgaagcccaaggggtgggactcgacagcacaggctactacgatcaggagatatacggaggcagtgattccaggtttgcaggctacgttacttccatcgctgccacagagctggaggacgacgatgatgattactcgagtagcaccagtctgctcggacagaaaaaacccggttaccacgctcctgttgctttgcttaacgacatcccccagtctaccgagcagtatgacccgttcgcagaacatcggccccccaagatcgcagacagggaggatgagtacaaaaagcaccgccggaccatgataatttcgcctgagcggctggacccctttgcagatggtggaaaaacccccgatcctaaaatgaacgccaggacctacatggatgtcatgcgagagcaacacctgactaaggaggaacgtgagatccgtcagcaattggccgagaaagcgaaagccggcgaactcaaagtagttaacggcgccgccgccagtcagccacccagcaagcgtaagagacgctgggaccagaccgccgaccagacacccggggcaacacccaagaaactgagtagttgggaccaggccgagacacccgggcatacccccagtctccgctgggacgaaaccccgggtcgcgctaaggggagtgaaacacctggagccacacccggatccaagatttgggacccaacgccaagccacacgccggccggggccgccacacctggcaggggcgacacacctggtcatgctacaccaggacacggaggagcgacatcaagcgcccggaaaaatagatgggacgaaactccaaagactgagagagacacacccggtcacggttccggctgggccgaaactccccgcaccgacaggggtggggattccattggcgagacccctaccccgggcgcatcgaagagaaagtcgcgatgggatgaaacgccagccagtcagatgggtggatcaacacctgtccttacacccgggaaaacaccgattggaacccctgcaatgaacatggctacaccgaccccaggacatatcatgtcgatgactcctgagcagcttcaagcctggaggtgggagagagaaatagatgaacggaatcggccactatccgacgaggaactcgatgcaatgtttcccgaaggctacaaagtcctgccgccgcctgctggctacgtgcctattaggacaccagccagaaagctgaccgctacgcctacacctctcggtgggatgacagggttccatatgcaaactgaggatcggactatgaagtccgttaatgatcagccatcaggaaatctcccatttctgaagccagacgatattcagtatttcgataagctgttagttgatgtggatgaatccaccctgtctccagaagaacagaaagagaggaaaattatgaagctgctacttaagataaaaaatggtacaccgcctatgcgtaaggcagcacttagacagatcactgacaaggctagggagttcggcgctgggcccctgttcaaccagatactgcctttgcttatgtcccccacacttgaagatcaagagcggcacctgctcgtaaaggtgattgataggatcttgtataagctcgatgatctcgtcaggccttacgtacataagattctggtagtcattgaaccactcctgattgatgaggactactatgcaagggtggagggacgtgaaattatttccaatcttgccaaagctgctgggctcgctactatgatttctactatgcgcccggacattgacaatatggatgagtacgttagaaataccaccgcaagggccttcgccgtggttgcgtccgcgctgggaattcctagtctcctcccgtttttgaaggctgtgtgtaaatccaagaagagttggcaagctagacacactggaattaagatcgtgcagcagattgctatcctgatgggctgcgctattcttccacacctgcggtccctcgtggagattatcgagcacggtctggtggatgaacagcagaaagtgcggacaatatctgcactcgcgatcgctgccctcgcagaagccgcgactccatacgggattgaatcatttgattctgtcttgaagccactgtggaaaggtatcagacagcatcgagggaaagggcttgcagcattcctcaaggcaattggctacctcattcccttgatggacgctgagtacgccaattattatactcgcgaggtgatgctcattctcattcgtgagtttcagtccccagatgaggaaatgaagaagattgtattaaaggtggtgaaacagtgttgcgggacagatggagtggaggctaactatattaaaaccgaaatcctgcccccattctttaaacacttctggcagcatcgcatggcactcgaccggaggaattaccgacagcttgtcgacacaacagtggagcttgcgaacaaagtgggagcagccgaaatcattagtcgtatcgtcgacgacctcaaagacgaagcagagcagtatagaaagatggtaatggaaaccatcgaaaaaattatgggcaacctcggcgcagcagatattgatcacaagcttgaagaacagctgattgatggcatcttatatgcatttcaggaacagactaccgaagatagtgtcatgttaaatggtttcgggacagtcgtcaatgctctgggcaagagggtgaagccgtatctgccccaaatctgcgggaccgtcctgtggcgtctgaataacaaaagcgcgaaggttcggcaacaggccgcagacctcatctctcggaccgctgtggtgatgaagacctgtcaggaagaaaagctgatggggcatctgggcgtggtactctacgagtatctcggcgaggagtaccccgaggtgttaggctctatactaggggcccttaaagcgatcgtcaatgttatagggatgcacaagatgacccctcctataaaagacctgctgccacgactgacacccatcttaaagaacaggcatgagaaggtgcaagagaactgcattgacctggtgggtaggatcgccgatcggggcgccgaatatgtatcagctagagagtggatgcggatttgcttcgaacttctcgaactgctcaaagcgcataaaaaggccatccgaagggccacagtaaatacgtttggctacatcgcaaaagccataggccctcatgacgtgctcgccacactgctgaataacctgaaggtgcaagagcgccagaatagggtgtgcaccacggtggcaatagccatcgtcgctgaaacctgtagtccattcaccgttctcccagccctcatgaatgagtatagagtgccagaactgaatgtgcagaatggagtgttgaagagtcttagctttctcttcgagtacataggagagatgggaaaagactatatctacgctgtgacgccactgctcgaagatgctctcatggacagggatctcgtccaccgccaaaccgcctccgctgtggtacaacatatgagcctgggtgtgtacgggtttggttgtgaagactctctaaaccatctcctgaattacgtctggcctaatgtttttgagaccagcccacacgtcatccaagccgtcatgggggccctggaggggctgcgagtcgcaatcgggccatgtagaatgctgcagtattgcctccaagggctattccaccccgcccggaaggtccgagatgtctattggaagatctacaactccatttatattggcagccaggacgcccttatcgcacattacccaaggatatataatgacgacaagaacacttacatcagatatgaactggactacattctctag

SEQ ID NO: 206926 - DNA, 435 bp, Artificial Sequence
  Description of Artificial Sequence: Synthetic coding sequence
atggccaagatcgccaagacccacgaggacatcgaggcccagatccgagagatccaaggcaaaaaggccgcgctggacgaagcccagggagtcggcctcgacagtacagggtattacgatcaggagatctacggaggaagcgattctagattcgcggggtacgttacatcaattgctgctaccgagctcgaggacgacgatgacgactactcatcctcgacatctctgctgggccagaaaaagcccggttaccacgcacccgtggctctgctgaatgatattccacagagcacagagcagtacgatccattcgctgagcatcggccaccaaagatcgccgatcgggaagatgaatataagaagcaccggagaaccatgatcattagccccgagcgcctcgatccgttcgcggacggcttttactcagccgcctag

SEQ ID NO: 206927 - DNA, 435 bp, Artificial Sequence
  Description of Artificial Sequence: Synthetic coding sequence
atggccaagatcgccaagacccacgaggacatcgaggcccagatcagagaaattcagggtaaaaaagccgcgctggatgaggcccaaggtgttgggctggactctaccgggtactacgatcaagagatctacggcggttccgatagccggttcgcagggtatgtgacttctatagcagccaccgaactggaagacgatgacgatgactattcttccagtactagtttactaggccagaagaagcccgggtaccacgcccctgtggctttgctgaacgatataccccagtcaaccgaacagtacgatccatttgccgagcatagacctcctaaaattgccgatcgagaggacgaatacaaaaaacatcgtcgtaccatgattattagtccggaaaggctcgaccctttcgcagacggcttttatagtgctgcctag

SEQ ID NO: 206928 - DNA, 2688 bp, Artificial Sequence
  Description of Artificial Sequence: Synthetic coding sequence
atggccaccgagcaccccgagccccccaaggccgagctgcagctgccccctccaccgccaccaggccactatggggcttgggccgcccaggaacttcaagccaagttggcagaaattggggcccccattcagggaaatcgggaggagctggtggagagactgcagagctatacgaggcagactggaatcgtgctaaatcggcccgttttgaggggcgaagatggagataaggccgctccgccaccaatgagcgctcagctaccaggaatcccaatgccaccgccgcctctgggattgccccctcttcagcctccacctccccccccgccgccccctccaggtctgggcctgggttttccaatggctcaccctcctaatttagggcctcctccccctcttcgtgtcggtgaacccgtggccttgagtgaggaagaacggcttaagctggcacagcagcaagccgccctcctgatgcagcaggaggagagggccaaacagcagggcgaccattccctgaaggaacacgaattgttggaacagcaaaagcgtgcggcggttctcctggagcaggaacggcagcaggagatcgcgaagatggggactcccgttccccggccgccccaggacatggggcagattggagttcgcacgcccctgggccccagagtagcggccccggttggacccgtcggcccaacccccaccgttcttcctatgggggcaccagttccaagaccccgtggaccaccccccccgcccggcgatgaaaatcgcgagatggacgatccttctgttggtcccaagattccacaggctttagaaaaaattctccagctcaaggaaagccgtcaggaggaaatgaacagtcagcaggaggaagaggagatggagaccgacgctagaagttccttagggcagtccgcttcagagacagaggaggacacggtttcggttagtaaaaaagaaaagaacaggaagaggcgcaacagaaaaaagaagaagaagccccagagggtgcggggagtgtctagcgaaagctccggcgatagagagaaagatagcacccgtagtagaggatctgattcccccgctgccgacgtggagatcgagtacgtgacggaagagccggaaatttacgaacctaactttatcttcttcaagcggatcttcgaggccttcaagctgaccgacgatgtgaagaaagagaaagaaaaagagcctgaaaaattggacaagcttgaaaactcagctgctcctaagaaaaaggggttcgaagaggagcacaaggactccgacgatgacagcagcgacgacgagcaggagaaaaagcctgaagctcccaagctctcaaaaaaaaagctacggaggatgaatcgatttacggttgctgaactcaagcagcttgtagcacgacccgatgttgtggagatgcatgatgtcacagcacaagacccgaagttgcttgttcatcttaaggctacacgcaatagcgtccccgtgccccgacattggtgctttaaaagaaagtacttgcagggaaagcgcgggattgaaaagcctcctttcgagctccctgatttcattaaacgcactggtatccaagagatgcgcgaggccctgcaagagaaggaggagcagaagacgatgaagtcaaagatgagagaaaaggtgcgccctaagatggggaaaatcgacattgactatcagaagttgcacgacgcgttttttaagtggcaaacaaagcctaagctgaccatccacggcgatttgtactacgagggtaaggaatttgagacccgtctgaaggagaaaaaacccggcgatttgtccgacgagctgcgaatttctttgggcatgcctgtggggccaaatgcgcacaaggtaccaccaccatggctgatcgcaatgcagcgatatgggccacctccctcttacccaaatcttaagatcccggggctgaacagcccgattcccgaaagctgtagcttcggatatcacgctggggggtggggcaaacccccagtggacgaaacggggaaaccactgtatggagatgtgttcggaaccaacgctgccgagttccagaccaagacggaggaagaagagatcgaccggacaccatggggagagctggaacccagcgatgaggagagtagcgaggaggaggaagaggaggagagtgacgaagacaagccagacgagactggatttataactccggccgactccggcctgatcactccgggcgggttctcctccgtgcccgccgggatggaaacccctgaactcatcgaattgagaaaaaagaaaatcgaggaagcgatggatggcagtgagacgcctcagctcttcaccgtccttccagaaaagcgaacagcaaccgtgggcggggcgatgatgggttcgacacatatctatgacatgtctaccgtgatgtcccgcaaaggacctgcacccgagctgcagggtgtggaggtagcactcgcaccagaggagctggagctcgacccaatggccatgacccagaagtacgaggagcatgtgcgggagcaacaggctcaggtggagaaagaggacttcagcgacatggtggccgagcacgccgcaaaacagaaacagaaaaagcggaaggctcagcctcaggatagtcgcggtggctccaaaaagtataaggagttcaagttctag

SEQ ID NO: 206929 - DNA, 2400 bp, Artificial Sequence
  Description of Artificial Sequence: Synthetic coding sequence
gccaagatggccaccgagcaccccgagccccccaaggccgagctgcagctgcctccccctccaccccctggccactatggcgcatgggccgctcaggaactccaggccaagctggcagaaatcggcgcacctatccagggcaatagggaagagctcgtggaacggttgcagagctataccagacagacaggaatcgttctgaatcgccccgtcttgcggggagaggatggcgacaaagctgcaccaccaccaatgagtgcgcagctcccaggcattcccatgcccccacccccccttgggctcccccctcttcagccacctcctccgccccctccgccccctccaggtcttggactggggttccccatggcccacccccctaacctggggcccccaccgcccctgcgggtgggcgaaccagtggctctatctgaggaagagaggcttaaactcgcccagcagcaggccgcactactgatgcagcaagaggaacgtgccaaacaaggggaccattccctgaaggagcacgagctgcttgaacagcagaagcgggcagccgtcctgctggaacaggagcgtcagcaagaggaagaggagatggagactgatgcgcgttcctcgctgggccagagtgctagtgaaaccgaggaggacactgtcagcgtcagcaaaaaggagaagaatagaaagcgccgtaaccggaaaaagaaaaagaagccccagcgcgtgcgaggcgtatcaagcgaatctagtggagatcgtgaaaaagacagcaccaggagcagagggtccgacagccccgccgctgacgttgaaattgaatacgtgacagaggaacctgaaatttatgagcctaacttcattttcttcaaacgtattttcgaggccttcaagctcaccgatgacgtgaagaaggagaaggaaaaggaaccagagaaactcgacaagctcgagaactcagctgcccccaagaaaaagggctttgaggaggaacataaggactccgatgacgactcctccgacgatgagcaggaaaaaaagccggaggccccaaagctctccaagaaaaagttgcggagaatgaatcggtttaccgtcgccgaactaaaacaactggtcgcaagacccgacgtcgtggaaatgcacgacgtcacagcccaggatcccaagttattggtacatctgaaggccacgcgcaactctgtgccagtgccacgtcattggtgtttcaaaaggaaatatctgcaggggaagagaggaatcgagaagcctcccttcgagcttcccgattttatcaagagaacaggtatccaggagatgcgtgaagcactgcaggagaaagaggagcagaaaacaatgaagtccaaaatgcgcgagaaggtaagacccaagatggggaaaatagacatcgattaccagaaactgcacgatgcgttcttcaagtggcagactaagcccaaactgactatccatggcgacttgtattacgagggtaaggagtttgagaccagattgaaagagaagaagccaggagatctgagtgacgagcttaggatttccttaggcatgccggtggggccaaatgctcacaaagtgcctccaccatggctgatcgccatgcagaggtatgggccacctccaagctaccccaacctcaagattcccggcctcaacagccctatcccagaatcttgttcttttggctatcatgctggaggttggggtaagccccctgtggacgagacaggcaagccactctacggggatgtcttcggtactaacgccgccgagtttcagactaagaccgaagaagaggaaattgatagaacaccatggggagagctggagcctagtgacgaagagtcttctgaggaagaggaggaggaggagagcgacgaagacaagcctgacgagacaggtttcatcacaccagctgatagcggccttattacacccggcggcttcagtagtgtccctgccggtatggaaactcctgagctcattgaattacggaagaagaagatcgaagaggctatggatggcagtgagaccccccagctgttcactgttctgccggaaaagaggacagctacagtcggcggggcaatgatgggttctactcacatctatgacatgagcactgtaatgagccggaaaggccctgctcccgaactgcagggcgtggaggtagctctggcacccgaggaattggagctcgatcctatggccatgactcagaaatacgaagaacacgtgcgcgaacaacaagcccaggtcgaaaaggaggacttttccgacatggtcgctgagcacgcggcaaagcagaagcagaaaaaaaggaaagcccagccccaagacagtcgtggcggttcaaagaagtacaaggaatttaaattttag

SEQ ID NO: 206930 - DNA, 3654 bp, Artificial Sequence
  Description of Artificial Sequence: Synthetic coding sequence
atgttcctgtacaacctgaccctgcagcgggccaccggcatcagcttcgcgattcacggtaatttcagtggaaccaagcagcaggagatcgttgtcagccgaggcaagatcctggaactgttgaggcccgacccaaacaccggcaaggtccacaccctgcttaccgttgaagtgtttggagtgatcagaagtctcatggctttccggttgacaggcggtaccaaggattatattgttgtgggatccgattctggccgaattgtgattcttgaataccagccgtcgaagaacatgtttgaaaaaatccaccaggagacgttcggaaaaagcggctgcagacgcatcgttcccggtcagtttcttgctgttgatccgaaagggcgcgcggttatgatctcagccattgagaaacaaaaactagtctatatactgaatagagacgccgccgccagacttacaatatccagtccgctggaggcacacaaggccaacaccttggtctaccacgttgttggggttgatgtgggattcgagaatccgatgttcgcatgcttggagatggactatgaagaggctgacaatgatcctaccggcgaagcagcagccaatacacaacagaccctgaccttttacgaactggatctgggattgaaccacgtcgtccgcaaatatagcgaaccactagaggagcacggaaatttcctgattaccgtacccggcgggagcgacggacccagtggcgttctcatctgtagtgagaattacataacctataagaatttcggtgaccaacccgacatcaggtgcccaataccgcgacgtcggaatgatctagacgatcccgaaagaggcatgatttttgtatgctcggccacgcataagacaaagtccatgtttttcttccttgcacaaaccgagcaaggggatattttcaaaattaccctcgaaacagatgaggatatggtgactgaaatccggcttaagtatttcgacaccgtacccgtagcagctgctatgtgcgtcctaaagactggtttcctctttgtcgcatctgagtttggcaatcattatctctatcaaatagctcacttaggggacgacgatgaggaacccgagttctcttctgccatgcccttggaagagggcgatacattcttctttcagccgcggcctctgaaaaatctggtgctagtggatgagctggacagccttagtccaattttattctgtcaaattgccgaccttgctaatgaagatactcctcagctttatgtggcttgcggccggggcccaaggagcagcctgcgagtcctcagacacggactggaggtgtctgaaatggcagtctcagagttgcccgggaatcctaacgccgtttggaccgtgcgtaggcacatcgaagacgagttcgacgcttacatcatagtgtcgttcgtcaatgctacccttgttctgtccatcggcgaaacagtcgaggaggtgacagattccggcttccttggcaccacacccaccctctcatgttctctgctaggcgatgatgcactggtccaggtttaccctgatggcataagacacattagagctgacaaaagggtaaatgagtggaaaacgcctggaaaaaagactattgtgaagtgtgctgtgaatcagaggcaggtggtaattgccctaacaggaggtgagctggtgtacttcgagatggatccctcgggacagttaaacgagtataccgaacgcaaggaaatgagtgccgacgtggtttgtatgagtttggccaacgtacccccaggggagcaaaggtcccgcttcttagccgtcggattggtggacaacactgtgcgaatcatcagcctggatccttccgattgtctgcagccactgagcatgcaggctctgccagcccagccggaaagcttatgcatcgtcgagatgggtggaactgaaaagcaggatgagcttggagaacgaggctcaatcggcttcctgtacctgaatatcggattgcagaacggtgttctgctccgtaccgtcctggaccctgtgactggcgacctttctgatacccgtaccaggtacttgggatcacgacccgtcaagttattcagggtgcggatgcaagggcaggaggctgtgctggccatgtcgagtaggtcttggctgtcttatagctaccagtccagatttcatctaacccccctgtcctatgaaacgctcgaattcgcgtccgggttcgcatccgaacagtgtcccgaaggtatcgtggccatcagcaccaacacgttacggattctggcccttgagaagctgggcgccgtcttcaatcaggttgctttccccctccagtatactccaagaaagtttgtgatccatccagaaagcaataatttgattattattgagacagatcacaatgcttatacggaagccacaaaggctcaaaggaagcagcaaatggccgaggagatggtggaggcagccggggaagacgaacgtgagcttgcagcagagatggctgcggcctttctaaatgagaatctaccagaatcaattttcggagccccaaaagctggtaacggccagtgggcgtctgtcatcagggtgatgaatccaatccaaggaaacaccttagatctggtacagctcgaacaaaacgaggctgccttctctgtagccgtttgccgttttagtaatactggtgaggactggtacgtgttggtcggagtggcgaaggacctgatcctgaaccctaggtccgttgccggcggctttgtgtatacctacaaacttgtgaacaatggcgagaagcttgaattcctccacaagacccccgtcgaggaggtgccagccgcaatcgctccatttcaggggcgtgttctcattggggtcggcaagctgctgcgtgtgtacgatcttggaaaaaagaagttactgcgcaaatgcgaaaacaagcatatcgccaactatatttccggcatccagaccattggccacagggttatcgtcagcgacgtgcaagagtcttttatttgggtcagatacaagcgcaatgagaaccagctcattattttcgcagatgacacataccctcggtgggtgacaacagcatcccttcttgattatgacaccgtggccggtgctgataaatttgggaacatttgcgtcgtgcggctaccgccaaacactaacgatgaagtggacgaggatcctaccggcaataaggccttgtgggatcggggtttactcaatggcgcttcacagaaggccgaagtgattatgaattatcacgtaggggagacggtcctcagtctacagaagacaactttgatccctggaggttccgagagccttgtatacacaactttgagtgggggtatcggcattctcgttccattcaccagccacgaggaccacgatttttttcagcacgtggagatgcacctcaggagcgaacacccgcccctctgcggcagagatcacttaagctttaggagttattacttccccgtcaagaacgttatagacggtgacttgtgtgagcagtttaacagcatggagcctaacaaacaaaaaaatgtgtcggaggaactagatcggacccctcccgaagtttccaagaaactggaagacatcagaacacgctatgctttttag

SEQ ID NO: 206931 - DNA, 828 bp, Artificial Sequence
  Description of Artificial Sequence: Synthetic coding sequence
atgttcctgtacaacctgaccctgcagcgggccaccggcatcagctttgccatccatggaaactttagtggcaccaaacagcaagagatcgtcgtcagtaggggaaaaattttggaactgctacgccctgatcccaataccgggaaggttcataccctgcttactgttgaagtgttcggagttattcgaagccttatggctttcagacttaccggcggtactaaagattacattgtggtgggcagcgattccggacgcatagtgatactcgaataccagcccagcaagaacatgttcgagaagatacaccaggaaacttttggtaagagtggatgcaggagaatcgttccgggccagtttctggccgtggaccccaaaggcagggctgtgatgatctctgccattgaaaagcagaagctggtgtacattctgaatagggacgcagcggcacggcttaccatctcatcaccattggaggcccacaaggccaataccttagtctatcacgtggtaggagttgatgttggattcgagaaccctatgtttgcttgcctcgagatggactacgaggaggcagacaatgatcctaccggtgaggctgctgctaacacccagcagacgttaaccttctacgaactggacttaggtctcaaccacgtggttcggaaatacagtgaacctctagaggaacatgggaatttcctcataaccgttcctggaggctctgacggtccctctggagttcttaacctgtcccccccttttcctaaggccatacccgctctgatctgtctcgactccccagtgtatttctgtacacacccctag

SEQ ID NO: 206932 - DNA, 1275 bp, Artificial Sequence
  Description of Artificial Sequence: Synthetic coding sequence
atggccgccggccccatcagcgagcggaaccaggacgccaccgtgtacgttgggggcctggatgagaaggtgtccgaacctttactgtgggaactgtttttgcaagccggacctgttgtcaatacacatatgccgaaggacagagtgaccggacaacatcaaggctatggctttgtggagttcttatccgaagaagatgccgactatgccattaaaataatgaatatgattaagttgtatggaaagccaatcagggttaacaaagcttctgcccacaacaagaacctcgacgtcggggcaaacatctttattgggaacctggaccctgagatcgacgagaaactgctctacgacaccttctccgcattcggggtgattttgcagaccccaaagattatgcgcgaccccgacaccggtaattcaaagggatatgcctttattaacttcgccagcttcgatgccagtgatgcagcaatcgaagctatgaatgggcagtacctgtgcaaccggccaatcaccgttagctacgcatttaagaaggactccaagggagaacggcatggatccgccgccgaaaggctgctcgccgcacagaatcctcttagtcaggccgaccggccgcaccaactgtttgcagacgcccccccacccccctctgctcccaatccagtagtgagttccttgggatctggcctgccaccccctggcatgcctccacctggatctttccccccccccgttcccccacctggagccctgccccccggcattcctcccgctatgcccccgcctccaatgcctcccggagccgccggtcatgggcctcccagcgcaggcactcctggagccgggcaccccgggcatggccatagtcacccccatccctttcctcccggcggaatgccccacccgggaatgtcacaaatgcaactggctcaccatggacctcacgggttggggcacccccacgcagggccgcctggtagtggaggccagcccccgcctcggccaccgcctggtatgccacatcctggccctccgcctatgggcatgccaccaaggggtcccccattcgggagccccatgggccatccggggccaatgcctccccatgggatgaggggtccacccccgcttatgccaccacacggttacactggcccgccccgtccccccccttacggctaccagaggggccccctgccccctccaagacctaccccgaggccacctgtgcccccaaggggccccctgcgtgggccgttaccgcaatag

SEQ ID NO: 206933 - DNA, 573 bp, Artificial Sequence
  Description of Artificial Sequence: Synthetic coding sequence
atgcccaaggaccgggtgaccggccagcaccagggctacggcttcgtggagttcctgtctgaagaggatgcagattacgccatcaagattatgaacatgattaagctgtacggaaaacccatcagagtgaataaggcttccgcacacaacaagaatctggacgtgggagccaatatcttcatcggcaatctcgatcccgagatagacgagaagctgctgtacgatacattcagtgccttcggggtaattctccaaactcccaagatcatgagggatcctgacacaggtaattcgaagggatatgcctttataaacttcgcgagcttcgatgcaagtgacgccgcgatagaagccatgaacggccagtacctgtgtaatcggcccattactgtatcttacgcattcaagaaggactctaagggtgagcgccacggatctgctgctgagcgtctgttggctgcgcagaaccccctcagccaagctgacaggccgcaccagctcttcgccgatgctcccccaccaccctctgccccaaaccccgttgtttcgagtctaggatcaggactgccttag

SEQ ID NO: 206934 - DNA, 2124 bp, Artificial Sequence
  Description of Artificial Sequence: Synthetic coding sequence
atgagccgggaccggttccggagccggggcggcggcggcggcggcttccatagaagaggcggcggaggcgggagaggcgggctgcatgactttcgtagcccccctcccgggatgggactgaatcagaatcgcggtccgatggggccaggccctggacagtccggcccaaagccacctatccccccccctccccctcatcagcaacagcaacagccccctccccaacaacccccacctcaacaacctcctcctcatcagccgccaccccacccccagccacatcaacagcagcaaccaccgcctcccccacaggacagtagcaagcccgtggtggctcagggtccgggaccagcccccggcgtgggctcagcccctcccgcctcttcgtccgccccaccagcgacccccccaacctcaggtgccccccctgggtccggcccgggacctacaccaacccctccccctgcggtaacatccgctcctccaggcgcccccccccctaccccaccttcatctggggtacctaccacaccaccacaggcaggcgggcctcctccacctcctgccgcagtgccaggccctgggcccggcccgaaacagggacctggccccgggggacccaaaggcggcaagatgcctggaggacctaaacccgggggaggcccagggctgtccacccccggcgggcaccccaagcctccgcaccgcggggggggtgagccccggggcggaaggcagcaccacccgccctatcatcaacagcatcaccagggcccacccccgggaggccctggcggacgatcggaggagaagatctctgattccgaggggtttaaagccaatctcagcctgttaagaaggcctggtgagaagacttacacacagaggtgtcgcctctttgtggggaacctgccagctgacattacggaagatgaatttaaacggctgttcgcaaaatatggagaacctggcgaggttttcataaacaagggaaaggggttcggcttcatcaagttggagagccgcgctctcgctgaaatcgccaaggctgagctggacgacacgcccatgagaggtagacagttgcgcgtgcggttcgctacccacgccgccgcactgagcgtacgaaacctcagtccctacgtatcaaatgagcttctggaggaagctttttctcagtttggccccatcgagcgggctgtggtgattgtagacgatcgcggaaggagtacaggtaaaggaattgtcgagtttgcctcaaagcctgcagcgcgcaaagcattcgagcgctgctcagagggggttttcctgctgacaactacaccacggcccgtgatcgtggagcctctcgaacagctcgatgacgaagacgggctgcctgaaaagctggcgcagaaaaatccaatgtaccagaaagagagagagactcctccccgctttgcacagcacggcacattcgagtatgagtattcgcaaagatggaagtccttagacgagatggagaaacagcagagggagcaggtggagaagaacatgaaggacgccaaggacaaactggaatcggaaatggaagatgcataccatgagcaccaggctaacttgctgcgccaggaccttatgcgccgccaggaagagttacgccgcatggaagagctgcataaccaggaaatgcagaagaggaaggagatgcagctgagacaggaagaggaacgacggcggcgcgaggaagagatgatgataaggcagcgggaaatggaagaacaaatgagacgccagagagaggagagttactccagaatgggttatatggaccccagggagcgcgacatgcgcatgggtgggggcggcgctatgaatatgggagatccgtacggatctggcggtcagaaattcccaccactgggaggtggggggggtatcggttatgaagccaacccaggagtcccgccggccaccatgtcaggctccatgatgggctccgatatgcggaccgaaaggtttggccagggcggcgctggccccgtggggggtcagggacccaggggtatgggtccaggcaccccagcaggctacggccgagggagggaagagtacgagggaccgaacaaaaagccgcgtttttag

SEQ ID NO: 206935 - DNA, 1875 bp, Artificial Sequence
  Description of Artificial Sequence: Synthetic coding sequence
atgaacagcggcggcggcttcggcctgggcctgggcttcggcctgacacccacaagcgttattcaggtgactaatctgtcttcagcggtcacctccgaacagatgaggactctgttttctttcctgggagaaatagaagagctgagactgtatccaccagataacgcgccattggccttttcctccaaagtatgttacgtgaagttccgcgacccctcaagtgtgggcgtggcccagcatctcactaacaccgtctttatcgatcgagctctgattgtcgtgccttgtgctgaggggaagatcccagaagaaagcaaagctctaagcctgctggcccctgctccaaccatgacatctctgatgccgggtgctggcttgttaccgataccaacgcccaatcctctcacgactctcggcgtttccctgtctagtctgggagccatcccagctgcagccctcgatcccaatattgccacattaggcgaaattccccagcccccacttatgggaaacgtggacccaagcaaaatcgatgaaatccggcggacggtgtacgttggtaacctcaactcccagaccactacagcagaccagttactggaatttttcaagcaggtcggagaagtgaaattcgtgcgtatggctggagacgagacccaacccaccaggtttgcatttgtcgagttcgctgatcagaattctgtccccagggcattggcattcaacggtgtcatgttcggcgatcgccccctgaaaataaaccactccaataatgctattgtcaaaccccctgagatgacaccccaggccgccgctaaggaactcgaggaggtaatgaagcgcgtgcgtgaggcccaatcttttatatcagctgctatcgagcccgagtctggcaagtctaatgaacgcaagggcggtagatcacggagtcatacccggtcgaagtcccgctcctcctcaaagtcccattctcgccgcaaaaggtcacagtctaagcataggtcaaggtcgcataacaggagtagaagccgtcagaaagatcggcgaagatccaagtcaccccataagaaaaggtcaaagtcacgggagcgacgcaagagtcggagcaggagtcactcccgggataaacgaaaggacaccagggagaaaatcaaagagaaggagagagtgaaagagaaagaccgagagaaagaacgggagcgcgagaaagagcgcgagaaggaaaaagaaaggggcaaaaacaaggacagagataaagaaagggagaaggatagggagaaggataaggagaaggatagggagcgggaacgggaaaaagaacacgagaaggaccgcgataaggaaaaggagaaggagcaagataaggaaaaggagagggagaaggatcggagtaaggaaatcgatgaaaaaaggaagaaagataagaagtctcgtaccccacctagaagttataatgccagtaggcgatctcgctcatcctcgcgggagcggcgccgtaggcgcagtcgcagcagctcaaggagccctaggacgtcaaagaccataaagagaaagtcatctcggagtccatcaccccggtcccggaacaagaaggataaaaagagggagaaggaacgggatcacatttcggaacgtcgggagcgggagcggtccacttcaatgagaaaaagcagtaacgaccgagacggaaaagaaaaactcgagaaaaattcaacatccctgaaagaaaaagaacacaacaaagagcctgattcctcagtgtccaaggaggtggacgataaagatgcccctcggaccgaggaaaataaaatacagcataacggaaattgccagctcaatgaggaaaatctgtcgactaagactgaggcggtctag

SEQ ID NO: 206936 - DNA, 1527 bp, Artificial Sequence
  Description of Artificial Sequence: Synthetic coding sequence
atgaccagcctgatgcccggcgccggcctgctgcccatccccacccctaaccctttaaccactctaggcgtttcactgtcatctcttggggccatccccgctgctgcattggatcccaacattgccacactaggagagatcccccagccccccttaatgggaaacgtggacccctcaaaaatcgatgagattaggcggaccgtgtatgtgggtaacctgaacagccagacaactacagcagaccagcttctggaattcttcaaacaagttggggaagtcaaattcgtacggatggcaggtgacgaaacccaacccacccggtttgccttcgtagagtttgcagaccagaattcggtgcctcgggcactagcttttaacggagtgatgtttggtgacaggccgcttaagataaatcacagcaataacgctatagtgaaaccaccggagatgacaccccaggccgcggccaaagaattagaagaagtgatgaagcgtgtccgcgaggctcagagctttatctccgccgctattgagccagaatcaggaaaatctaatgaaaggaaaggcggtcggagccgctcacataccagaagtaagtcacggagctcttctaaaagccatagccgcaggaagaggtcacagtccaaacaccggtcccggagtcacaatcgaagccgctcaagacagaaggacagaaggcgatccaaatctccgcacaagaagagatctaaatcccgtgagaggagaaaatctcggtcacgctcacattcacgtgacaaacggaaggatacacgggaaaaaatcaaggaaaaggaaagagtcaaggaaaaggaccgggagaaagagcgggagcgcgagaaagaacgcgaaaaggagaaagaacggggtaaaaacaaggatcgcgacaaggagcgggagaaagaccgcgaaaaggacaaggaaaaggacagagaaagggagcgcgaaaaagagcacgaaaaggaccgcgataaggagaaagagaaagaacaagacaaagagaaggagagggagaaggacagaagtaaagagattgatgagaagcgtaaaaaggataagaagtcgagaacccctccccgatcctacaacgccagtaggagaagtcggagttccagccgcgagcgaagacgaagacgttctaggagctcctctcggtcacctaggacttctaaaaccattaagaggaagtcgtctcggagcccatccccgcggagccgcaacaaaaaagacaagaagagggagaaggaacgagatcatatttcggaacggagggaaagggaaaggtctacaagcatgaggaagtcaagcaatgatagagatggcaaagagaaactggaaaagaactccacatcactgaaggagaaggagcacaataaggagccagacagctccgtaagcaaggaagtggatgacaaagacgctccacggacagaggaaaacaagatccaacacaatggaaactgccaactaaatgaggaaaacttaagcaccaagactgaggcagtatag

SEQ ID NO: 206937 - DNA, 231 bp, Artificial Sequence
  Description of Artificial Sequence: Synthetic coding sequence
atgaccagcctgatgcccggcgccggcctgctgcccatccccacccccaatccactgaccacactgggtgtctcactgagctctctgggcgctattccagccgccgccctagatcccaacattgccaccctgggtgagataccccagcctccactgatgggaaatgttgatcccagtaaaatcgatgagataaggagaactgtgtacgtaggaaacctgaatagccagtag

SEQ ID NO: 206938 - DNA, 1545 bp, Artificial Sequence
  Description of Artificial Sequence: Synthetic coding sequence
atgaacagcggcggcggcttcggcctgggcctgggcttcggcctgacccccacaagtgtaatccaggttactaatctatcctccgcagtaactagtgagcaaatgaggacattgttctcctttctgggggaaattgaagaacttcggctctatcctccagacaatgcgcccttggcatttagctcaaaagtgtgttacgtcaagtttagagatcctagctcagtgggggtggcccagcaccttacaaatacggtgtttatcgaccgggcgttgatcgtagtgccatgtgccgaagggaagatccccgaggaaagtaaggccctttctttactcgccccagccccaacaatgacctctctcatgcctggggccggcttactgcccattcccacccccaaccctctgaccaccctgggggtcagtctctcatctctgggagccatacccgccgccgcattagatcccaacatcgcaaccctcggcgaaataccacaaccccctctcatgggaaatgtggatccttcaaagattgacgagatccgacgaacagtttatgtgggcaacctgaattcccagactaccactgctgaccagctcctggagtttttcaagcaggtgggtgaagtaaagttcgtccggatggcaggagacgaaacccagccaaccaggttcgcattcgtcgagttcgctgatcagaacagcgtgccacgcgctttggccttcaacggcgtgatgttcggtgaccgccccctaaaaatcaatcacagcaataatgccatagtgaaaccacccgagatgacaccacaggctgcagcaaaagaactggaagaggtcatgaagagggtcagagaggcacagtcttttatttccgccgctatcgaacccgaatcaggaaaaagtaatgagcggaagggtgggaggtctcggtctcacacgagatctaagagccgctcttcttccaagtctcattccagacggaagcggtctcagagtaagcatcgttctcgctctcacaatcgctctagatcacggcagaaagataggagaagatctaaatcaccacacaaaaagcgatctaaatctcgcgagaggcggaagtcgagatcgcgctcccacagccgagataagcgcaaagacacacgggaaaaaatcaaggagaaggagcgcgtgaaagagaaggacagggagaaagaacgggaacgggaaaaggaaagagaaaaggagaaggagagaggcaaaaataaagatagggataaagagagggaaaaagatagagagaaggacaaggagaaagaccgggagagagaacgggagaaagaacatgagaaagaccgagacaaagagaaggaaaaagagcaggacaaggaaaaggagcgtgagaaggatagatccaaggaaattgatgaaaaaagaaagaaagacaagaacccagaacatcaccccggtgtaactatgcacagagaagatctggttgtccctgccgggaagggcgttggcggcggggccggtgtcttaccagatcggcaggagcaccaaaagccttag

SEQ ID NO: 206939 - DNA, 213 bp, Artificial Sequence
  Description of Artificial Sequence: Synthetic coding sequence
atgagcgagaagaagcagcccgtggacctgggcctgctggaggaggacgatgagttcgaggagttccccgccgaggactgggctggcctcgacgaagatgaggacgcgcacgtgtgggaggacaattgggacgacgacaatgttgaggacgacttctcaaaccagctgagggcagagctggagaagcacggctacaaaatggagacctcttag

SEQ ID NO: 206940 - DNA, 1077 bp, Artificial Sequence
  Description of Artificial Sequence: Synthetic coding sequence
atggccttcgcccccatgggccccgaggccagcttcttcgacgtgctggacagacaccgcgagagtctcctggccgccttgcgaagaggtggtagagaacccccgacaggaggatcccgtctcgcaagccgctttgaagatagcgtgggcctgcaaatggtgtctcattgtactacacgaaagatcaagagcgactcccctaagtctgcccagaagttctccctgatcctcaagatcttatcaatgatctataaactggtgcagtctaacacatatgccacgaagcgcgatatctattacaccgacagccagttgtttggcaatcagacggtggtggacaacatcataaacgacatctcgtgcatgcttaaagtgagtcgtagatcactgcatattctctccacatcgaaaggtctaattgcaggaaatctccgttacattgaggaagacggaacaaaggtgaattgcacttgcggcgcaacagctgttgctgtcccttccaatatccaaggaatcagaaatctcgtgaccgatgcaaagttcgtgctgatagtggagaaagatgccacattccagcggctgctggatgacaacttctgtaataagctgagtccttgtattatgattacaggaaaaggagtgccagacctgaatacaaggctgctggtgaagaaattatgggacactttccatgttcctgttttcacgttggttgacgcagatccccatggaatagagatcatgtgcatctacaaatatggatccatgtctatgtcctttgaggcacaccacctaacagtcccagccattcgctggctgggtttattgccttccgacctcaaacgactgaacgttccaaaggacagtttgattccactcacaaagagggaccagatgaagctagatagtattctccgcaggccatacgtaacttgccaacccttttggcgaaaagagatggagatcatggcggacagcaagatgaaggccgaaattcaagctttaaccttcctgagcagcgactacctgtctcgagtttatttacctaacaagctaaagtttgggggatggatctag

SEQ ID NO: 206941 - DNA, 1065 bp, Artificial Sequence
  Description of Artificial Sequence: Synthetic coding sequence
atggccttcgcccccatgggccccgaggccagcttcttcgacgtgctagatcgacacagggaatccctgttggcagccttgaggaggggtggtcgggaacctcctactggaggatctcggctggcctctcggttcgaagacagtgttggactacaaatggtctctcactgtacaaccaggaagatcaagtcggacagtccaaagtctgcacagaagttctcccttattttgaagatcctgagtatgatctataagctggtacagagcaacacctacgccacaaagcgggatatctactacaccgacagtcagcttttcggcaaccaaactgtggtcgataacatcataaacgacatctcctgcatgctgaaggtcagcagacgtagtttgcatatcctatcgacatctaagggtctgatagcaggtaacctccggtacatcgaggaggacgggaccaaggttaactgcacatgcggcgctaccgcggtagccgtgcctagcaacatacaggggattcgcaacgcaaagttcgttttaattgtggaaaaagatgctactttccagcgccttctcgacgataacttttgcaacaagctctctccatgcattatgatcacagggaagggggtgcctgatttgaacactcgacttctcgtgaagaagctctgggatacctttcacgtgccagtgttcactttagtcgatgctgaccctcacggcatagagataatgtgcatctataagtatggctccatgtctatgtccttcgaggcccaccatctaacagtgccagcaatccggtggctgggcctccttccaagtgatctgaaacggcttaatgtgccaaaagactccctgattcccctcactaagagggaccagatgaagctagacagtattttgcggagaccctatgtaacatgccagcccttttggcggaaagagatggaaatcatggcagacagcaagatgaaggccgagatacaggccctaaccttccttagcagcgattacctcagcagagtctacctgcctaacaagctcaaattcggaggctggatatag

SEQ ID NO: 206942 - DNA, 1191 bp, Artificial Sequence
  Description of Artificial Sequence: Synthetic coding sequence
atggccttcgcccccatgggccccgaggccagcttcttcgacgtgctggataggcatagagagagcctgttggccgctctgcggcgcggcggcagagaaccccccacagggggaagccgacttgcatccagttctgaagttctcgccagtatagaaaacataatacaggacattatcacatctctggctaggaacgaagctcctgcatttactatcgataacagaagcagctgggaaaacattaagtttgaggacagcgtggggttgcagatggtttcgcattgcaccacccggaaaatcaagagcgatagtcccaagtcggctcagaaattctccctcatactcaagattctctctatgatttacaagcttgtacaaagcaatacgtacgccaccaagcgcgacatttattacactgatagtcagcttttcggcaatcaaactgtggtggacaatattattaacgacatcagctgcatgctcaaggtgtctagacgttctctccacattctatcaaccagtaaaggactgatcgctgggaacttgaggtacatcgaggaggatggaacgaaagtgaattgtacttgtggggccactgcggtggcagtgccatcaaacattcagggaatccgaaaccttgttacagatgccaagttcgtgctgatcgtcgaaaaggacgccacgttccagcggctgttggacgacaacttttgcaacaagcttagtccatgcatcatgatcactggaaagggagttcccgacctcaacactcggctcctggtgaaaaaactgtgggacacatttcatgtccccgtctttaccctggttgacgctgacccacatggcattgaaataatgtgtatatacaaatacggcagtatgagtatgagttttgaggctcaccatctgacggtgcctgcaatccggtggcttgggctcctgccttccgacctgaagcgactgaacgttcccaaggactcgctcatcccccttactaaaagggaccagatgaagctcgattcaatccttcggcggccttacgtgacctgtcaaccattctggcggaaggagatggaaatcatggccgattccaagatgaaggccgaaattcaagctctgacctttctgagttctgactacctgagccgtgtttaccttcctaacaaactgaagtttggcgggtggatttag

SEQ ID NO: 206943 - DNA, 813 bp, Artificial Sequence
  Description of Artificial Sequence: Synthetic coding sequence
ctgctggccgccctgcggcggggcggccgggagccccccaccggcggttctcgactggctagcagttcagaagtgctcgcatcgatcgagaacataatccaggatatcataacttctctggcgaggaatgaggccccagccttcaccatcgacaaccgatcgagctgggagaatattaaattcgaggacagtgtcggattacaaatggtatcacattgtacaaccagaaaaatcaaaagcgactcccccaagtccgctcagaagttctccctcatcttgaagatcctgagcatgatctacaagctagtccagagtaatacctacgcaactaagcgagatatttactacactgacagccagttattcggtaatcagaccgtagtggacaacatcatcaatgatatatcttgcatgcttaaagtgagccgccgatccctgcacatattgtctaccagtaagggattgatcgccgggaatttgcgttatatcgaggaggacggcacaaaagtaaactgcacatgtggggcaacagccgtggccgtgccttctaacatacaaggcattaggataactgacgctaagttcgtgctcattgtagaaaaggacgcaacatttcagcgactgctggatgataacttctgcaataagctttcaccatgcattatgatcaccgggaagggcgtgcccgacctaaatacccgactcctcgtgaagaagctctgggatactttccacgtacctgtctttacactagtggatgcagacccccacggaatagagatcatgtgtatctataagtacggaagcatgtag

SEQ ID NO: 206944 - DNA, 996 bp, Artificial Sequence
  Description of Artificial Sequence: Synthetic coding sequence
atggagaaccccagccccgccgccgccctgggcaaggccctgtgcgccctgttgctcgccactctgggggctgctgggcagccactcgggggtgaatccatatgtagtgcacgcgccctggctaaatatagtattacatttactggcaaatggtctcagacggccttccccaaacagtaccctctgttcagaccacccgcccagtggagttctctcctcggtgctgcccacagttccgattatagcatgtggaggaagaaccagtacgtcagcaacggcctgcgcgactttgctgagcgcggagaggcttgggccctgatgaaggagatcgaagcagccggggaggccttacaaagcgtacacgcagttttctcagcccctgccgttccatctggaaccggacagacttccgcagaattggaggtccagcgtcgccacagcctggtttctttcgttgtcagaatcgtaccctcgcccgattggttcgttggtgttgattccctcgacctgtgcgatggagaccggtggagagagcaggccgctctggacttatatccatatgatgcaggaaccgattccggcttcacgttctcatcccccaactttgccaccattccccaggacaccgtcacggaaatcacttcttcttccccttcgcaccctgcaaactcattctactatcctcgactcaaagcccttccccccattgcccgagttactctggttaggttgagacagtcccctcgggccttcataccacctgcacctgtcctcccgtcccgcgacaacgagatcgtcgattccgcttccgtgcccgagactcccttggactgcgaggtgtctttgtggtcttcctggggcctgtgcggggggcattgcggtcggcttggcaccaagtcacgtactagatacgtgcgggtccagcccgcaaacaacgggtctccatgcccagaacttgaggaagaggccgagtgcgtaccagataactgtgtttag

SEQ ID NO: 206945 - DNA, 996 bp, Artificial Sequence
  Description of Artificial Sequence: Synthetic coding sequence
atggagaaccccagccccgccgccgccctgggcaaggccctgtgcgctctgctactcgccacattgggagctgccggacagcccctcggtggggaatcaatttgcagtgctcgtgccttagcaaagtacagtataacgttcacaggaaagtggtcccagacggcatttccaaagcagtaccccctgttcaggccacccgcccagtggtcatccctgctaggcgccgcccactcctctgattactcgatgtggagaaagaaccagtacgtttccaatgggctgcgagattttgccgagcggggtgaagcctgggcccttatgaaagagattgaagctgccggggaagccttgcagagcgtgcatgccgtgttttcagcccccgccgttccttccggcaccggccagacatctgcagaattggaggtgcagcggaggcatagtttggtgagtttcgtcgtccgcattgtgccctcccctgactggttcgtcggcgtcgacagcctagacctttgcgatggggaccgatggagggagcaggccgctctggacctgtacccctatgatgcaggaacagattctgggtttacttttagtagtccaaattttgccaccattccccaggacacggtcactgaaattacctcctccagcccctcccatcctgctaactctttttattaccctcgcttgaaggccctgccacctatcgcaagagtaacattggtgcgcctacgacaatcacccagggcattcataccacccgctcccgtgctgccaagtagagacaacgagatagtagactctgctagtgtgccagagaccccactggactgtgaggtaagcctgtggagctcatgggggctatgcggaggtcactgtggaaggttgggcacaaagtcaaggacgagatatgtccgtgtccagccggccaacaacgggagcccttgccccgagctggaagaggaagccgagtgtgtgcccgataactgtgtgtag

SEQ ID NO: 206946 - DNA, 186 bp, Artificial Sequence
  Description of Artificial Sequence: Synthetic coding sequence
atggagaaccccagccccgccgccgccctgggcaaggccctgtgcgctctccttctggcaaccctgggagccgctggtcagcccctaggcggagagtccatttgcagcgcgagggctctggccaagtacagtattacctttacaggtaaatggagccaaaccgcatttcccaaacaatatccctag

SEQ ID NO: 206947 - DNA, 327 bp, Artificial Sequence
  Description of Artificial Sequence: Synthetic coding sequence
atggagaaccccagccccgccgccgccctgggcaaggccctgtgcgctttactgctggccaccttgggcgccgcaggccagccgctggggggcgaatcaatttgcagcgcccgcgcactcgccaaatatagcataacctttacagggaagtggagccagaccgccttccccaagcagtaccccttatttagaccacctgctcagtggtcttcactgctcggggcagcacactcctctgattattcgatgtggaggaaaaaccagtacgtttcaaacggcctcagggatttcgccgaacgcggggaggcctgggcattgatgaaatag

SEQ ID NO: 206948 - DNA, 54 bp, Artificial Sequence
  Description of Artificial Sequence: Synthetic coding sequence
atggagaaccccagccccgccgccgccctgggcaaggccctgtgcgctttgtag

SEQ ID NO: 206949 - DNA, 27 bp, Artificial Sequence
  Description of Artificial Sequence: Synthetic coding sequence
atggagaaccccagccccgccgcctag

SEQ ID NO: 206950 - DNA, 51 bp, Artificial Sequence; identical to SEQ ID NO: 100756
  Description of Artificial Sequence: Synthetic coding sequence

SEQ ID NO: 206951 - DNA, 75 bp, Artificial Sequence
  Description of Artificial Sequence: Synthetic coding sequence
atggagaaccccagccccgccgccgccctgggcaaggccctgtgcgccctgctgcttgctaccttgggtgcgtag

SEQ ID NO: 206952 - DNA, 195 bp, Artificial Sequence
  Description of Artificial Sequence: Synthetic coding sequence
atggagaaccccagccccgccgccgccctgggcaaggccctgtgcgcgttacttctggcaacattgggggcagccggtcagcctcttggcggcgaaagcatatgtagcgcgagggcactggctaaatactcaatcacctttacagggaagtggtcccaaaccgccttcccaaaacagtatcctttattccgctag

SEQ ID NO: 206953 - DNA, 960 bp, Artificial Sequence
  Description of Artificial Sequence: Synthetic coding sequence
atggacccccagaaccagcacggcagcggcagcagcctggtggtgatccaacaaccgtcccttgattctcgacagcgattggactacgagcgcgaaatacagcctactgccatcctgagcttggaccagatcaaggccattcgcggcagcaacgaatacaccgagggcccttctgtggtgaaaaggccagcgccgcggaccgcccccagacaggaaaaacacgaaagaacgcatgagatcatacctatcaacgttaataataattatgagcatagacacacctcccacctgggccacgccgtcctcccttctaacgccaggggaccaattttaagccgcagcacatctacaggatcagccgcctcctcagggagcaattcaagtgcctccagtgaacaaggcctcttggggcgatccccacctacccgcccagttcccggccaccgctcggaacgcgccattagaactcaacctaagcaactaattgtggatgacttgaaggggtcactgaaagaagatctaacacagcataagttcatttgtgagcaatgtggaaaatgcaagtgcggggagtgcacggcgccaaggactctgcctagttgtctggcttgcaatcggcaatgtctgtgctccgctgaatccatggtggaatatggaacttgcatgtgcttagtcaaagggatcttctaccattgctccaacgatgacgaaggcgatagctactcggataatccgtgcagctgcagccagtcccattgttgtagtcggtatctctgcatgggagccatgtcgctgttcctgccttgcctgctttgctaccctccagccaaaggctgtcttaaactttgccggaggtgttacgactggatacataggcccgggtgtcggtgcaaaaatagtaacactgtctactgtaaactcgagagttgcccaagtcgaggccaggggaaaccttcttag

SEQ ID NO: 206954 - DNA, 960 bp, Artificial Sequence
  Description of Artificial Sequence: Synthetic coding sequence
atggacccccagaaccagcacggcagcggcagcagcctggtggtgatccagcaaccctccctggactcgcgacagcgactggattacgaaagggagatccaaccaaccgccatactgagtcttgaccaaatcaaagccatacgcggctctaatgaatacaccgagggtccaagcgtcgtgaaacgcccagctccacgaactgcccctcgtcaggagaagcacgagagaactcatgaaataatccctatcaacgtgaacaacaattacgaacacagacacacatcccacctgggacacgccgtgcttcccagcaatgccagagggccaatcctgtctaggtctaccagtactggatcagctgcctcgtcaggatcaaactcctctgcgagcagtgagcaggggttgctcgggcgtagccctcctaccagacccgtgccaggacatcgatccgagagggccatcaggactcaacctaagcagttaattgttgacgatttaaagggttctctcaaagaggacctgacacagcacaaatttatttgcgagcagtgcggcaagtgcaaatgtggagaatgcaccgcccctcgcacactgccttcttgccttgcgtgcaacaggcagtgtctttgtagcgctgagagtatggtggagtacggtacctgcatgtgccttgtgaagggcatcttttatcattgctctaatgatgatgagggagactcatatagtgataacccctgctcatgctcccagagtcactgctgctctcggtatttgtgcatgggggctatgagccttttcctgccctgtctcctgtgctatccgccagccaagggttgtctaaaactctgcaggcggtgttatgattggatccatcgtccagggtgcaggtgcaagaattccaataccgtgtattgcaagttggagagttgtcccagcaggggtcaggggaagccgtcatag

SEQ ID NO: 206955 - DNA, 204 bp, Artificial Sequence
  Description of Artificial Sequence: Synthetic coding sequence
atggacccccagaaccagcacggcagcggcagcagcctggtggtgattcaacagccttcactagatagtcggcagcgtttggactatgagcgggagattcagcccaccgccatactgtcactggaccagattaaggcaataaggggatccaacgagtacaccgagggcccctctgtggttaaaagacccgccccccggacgtag

SEQ ID NO: 206956 - DNA, 630 bp, Artificial Sequence
  Description of Artificial Sequence: Synthetic coding sequence
atggacccccagaaccagcacggcagcggcagcagcctggtggtgattcagcaacctagtctggattcacgccagcgcttggattatgaaagagagattcaacccactgctatcctgtcccttgaccagatcaaagccatccgcgggagcaatgagtatacggaagggccttccgtggtgaagcgacctgctcctcgcacagcacccagacaagagaaacatgagcgcacgcatgagatcatcccgatcaacgtaaataataactacgagcataggcacaccagccatctcggccacgccgttttgccgtctaatgcccgaggaccaatcctgtcccgcagtactagtaccgggtccgcggcgtcttccggttccaattcctctgccagctccgagcaggggttactgggtcggagcccccccaccagacccgtgcccggacatcgctccgagcgtgccatccgcacgcaacctaagcaactgatcgtggacgacctcaagggctctctcaaggaagacctgacccagcacaaatttatttgtgaacagtgcggcaagtgcaagtgtggggagtgtactgcccctaggacactgcctagctgcctcgcctgtaatcgacagtgtttatag

SEQ ID NO: 206957 - DNA, 108 bp, Artificial Sequence
  Description of Artificial Sequence: Synthetic coding sequence
atggacccccagaaccagcacggcagcggcagcagcctggtggtgattcagcagcccagcctcgactcgaggcagaggttagattacgagcgagaaatccagccatag

SEQ ID NO: 206958 - DNA, 948 bp, Artificial Sequence
  Description of Artificial Sequence: Synthetic coding sequence
atggaggcccgggcccagagcggcaacggcagccagcccctgctgcagacccccagagacggcggacgccagaggggtgagcctgaccctcgggacgcactgacacagcaggtgcacgtgttgtcactggaccagatacgcgctatacgaaatactaacgaatatacagagggacctaccgttgttccccggccggggctgaagcctgccccccgtccaagtacacagcataagcacgaaagactgcatggcctgcctgaacatcggcagccacctcgactccagcacagtcaggtacacagttcagccagggctccccttagtcggtccatctccacagtgagctcaggtagtcggagttccacacggacctcgacgagctcgtccagctctgagcaaaggctgctcgggagcagtttctcctctgggcctgtggccgacggcatcattagggttcaacccaagagcgagctgaaacccggagagttgaagccgctgtcgaaagaggatcttggcctccacgcatatcgatgtgaggactgtggaaagtgcaaatgtaaggagtgtacttatccccgccctcttccttctgactggatttgtgataagcagtgtctgtgtagcgctcagaatgtcatcgactatggaacatgtgtttgttgcgtgaagggtctattttaccattgttctaacgatgatgaggataattgtgctgataacccctgttcctgttctcaatctcattgctgtacacgctggtccgccatgggcgtgatgtccctttttctcccttgcctgtggtgttaccttcctgccaaagggtgcctgaaactatgccagggctgttacgaccgcgtcaatcgccccggctgccgatgtaagaactcaaacactgtctgttgcaaagtaccaaccgttccaccccggaacttcgagaaaccgacatag

SEQ ID NO: 206959 - DNA, 948 bp, Artificial Sequence
  Description of Artificial Sequence: Synthetic coding sequence
atggaggcccgggcccagagcggcaacggcagccagcccctgctgcaaacccctagggatggcggacgccaaaggggagagccagatcctcgtgacgctctaactcagcaggtgcacgtgttgagcttagaccaaattcgagcaataaggaatacgaacgagtatacagagggacctacagtggttcccaggcccggactcaaaccagctccgaggccatcaacccaacacaagcatgaacgtctgcatggccttcctgagcaccgccagcctcctagacttcagcacagccaggtgcattcaagtgcccgcgctcccctgagtcggtccatcagcacggtctcctctgggtctcgaagcagtaccaggacctccacatcttcaagcagttcggaacaaaggttacttggaagttcctttagttccggcccggtagccgacggcattatccgggtccagcccaaatcggaacttaagccgggcgaattgaagcctctgagtaaggaggatctggggctgcatgcataccgctgcgaggactgcggaaagtgtaagtgtaaggagtgtacctaccctcgacctctgcctagcgactggatctgcgataagcagtgcttatgtagcgcccagaacgtgatcgactatggcacctgtgtttgttgtgttaagggcctgttttaccactgctccaacgacgacgaggacaactgtgcagacaacccttgttcttgcagccagtcccactgttgtactcgttggtctgcgatgggcgtcatgagcttgtttcttccctgtctctggtgctacttaccagccaaagggtgcctgaaactttgccagggatgttacgatcgtgttaacagaccaggatgcagatgtaagaatagcaatacagtgtgctgtaaagttcccactgttccacctagaaattttgagaagcccacatag

SEQ ID NO: 206960 - DNA, 948 bp, Artificial Sequence
  Description of Artificial Sequence: Synthetic coding sequence
atggaggcccgggcccagagcggcaacggcagccagcccctgctgcagacaccacgtgacggcgggagacagagaggagagcccgatccacgggatgccctgacgcagcaggtccacgtgctttccctcgaccagatcagagccatcaggaacaccaacgaatacactgaggggcctacagtggtgccccggcccggcttaaagccggcacctaggccaagcacccagcataagcatgagcgcttgcacggcctcccagaacacaggcagccgccccgtctccagcattcccaggtgcactcatcagctcgtgccccactttctagaagtatttcaactgtctcaagcgggagcagatccagcacaaggacctcaactagctcatcctcctcggaacagcgacttctaggcagctcattctctagcggtcctgtcgcagatggcatcattcgcgtgcagcctaagtccgaactcaaacccggtgagttgaagcctctctctaaggaagacctgggtctgcacgcctatcgatgcgaagactgtggcaaatgtaagtgtaaagagtgtacttatcctcgacccctgccttcagactggatttgcgacaaacagtgcctctgcagtgcacagaacgtgatcgactacggaacctgtgtatgctgcgtcaaaggcctcttttaccactgcagtaatgatgatgaggacaattgtgccgacaacccctgttcctgtagccagagccattgctgcacgagatggtccgcaatgggcgtcatgagtctttttctcccgtgtctctggtgctacctccctgcaaagggttgcttaaaactatgccaaggatgttatgacagggtcaaccgacctggatgcagatgtaagaactctaacactgtttgctgtaaggttccaactgttcctcccaggaacttcgagaaaccgacatag

SEQ ID NO: 206961 - DNA, 1062 bp, Artificial Sequence
  Description of Artificial Sequence: Synthetic coding sequence
atggaggcccgggcccagagcggcaacggcagccagcccctgctgcaaactccaagagatggcggccgtcagcgaggtgaacccgatccacgcgatgccctcacccaacaggtccacgtgctgtctcttgatcaaattagggcgataaggaatacaaacgagtacactgaggggccaactgtggtgcctaggcccggacttaaaccagcccccaggccatcaacacagcacaagcacgaaaggttacatggcttacccgagcaccggcagccgcccaggcttcagcacagccaggttcactcaagtgctcgcgctcctttgtcccgatccatttctacagtgagcagcggatctaggtcctccacccggacttccacttcctcttccagtagcgagcagcgtcttttaggcagcagttttagctccggccccgttgccgatggcattattagagttcagccaaaatccgagctcaagcccggagaactgaaaccgttgagtaaggaggatctcggcctccatgcctacaggtgtgaggattgtggcaagtgtaaatgtaaggaatgcacttatcctcggcctttaccctcagattggatttgtgataaacaatgtctgtgctctgcacagaacgtaatcgactatggaacatgtgtctgctgcgtcaagggactgttttatcattgcagcaatgacgacgaggacaattgtgccgacaacccatgctcgtgcagccagtcacattgttgcacccggtggtcagctatgggcgtgatgagtctgttccttccatgcttgtggtgttaccttccggcgaaaggctgcctgaagctgtgtcagggctgttacgaccgggtcaaccgcccgggctgtcgatgcaagaactcaaataccgtgtgttgtaaagtgccaacagttccaccccgtactctgaaaaaccaacacagtattatcaaccaggagtattattctaacgaggactttttctttctattcctgatccacatttgtaatcagctgaattcgtacaatctaggtacagttaaccgtaaggtaggctag

SEQ ID NO: 206962 - DNA, 867 bp, Artificial Sequence
  Description of Artificial Sequence: Synthetic coding sequence
atggacgccgccgtgaccgacgacttccagcagatcctgcccatcgaacagctgcgctccactcacgcttctaacgactacgtggagaggcccccagcaccatgtaagcaggctctctccagtccctccttaattgttcagacacacaaaagtgactggtctctggcaaccatgcccacctctctgccgcgcagtctcagccaatgtcatcagctgcaaccgctcccccagcatctgagtcaaagcagtatagccagtagcatgtcgcacagcactacggccagtgatcagaggttgctcgcatccatcactccctctccttcggggcagtctatcatccgtactcaaccaggcgccggcgttcatccaaaggcagatggggccctcaagggcgaggctgagcagtctgccggacacccctctgagcatctgttcatttgcgaggagtgtgggcggtgcaagtgtgtgccttgcactgccgctcggccacttccctcatgttggctatgtaaccagaggtgcctgtgttcagcagaaagcctgctggattacgggacatgtttatgttgtgtcaaaggcctgttctaccactgtagtaccgacgacgaggacaactgcgctgatgagccttgtagttgcggaccctccagctgtttcgtccggtgggctgccatgtcgttgatcagcctatttctgccatgcctgtgttgctatttgccgacccgcggctgtcttcatctgtgtcagcaaggctatgatagcctccggcggcccggctgccgttgcaaaaggcatactaacaccgtgtgccgcaagattagctctggaagtgctccctttcccaaagcgcaggagaaatccgtgtag

SEQ ID NO: 206963 - DNA, 378 bp, Artificial Sequence
  Description of Artificial Sequence: Synthetic coding sequence
atggacgccgccgtgaccgacgacttccagcagatcctgcccatcgagcagctgcgaagtacacatgcatctaacgattacgtggagagacccccagctccctgtaagcaggctctgagctcgcctagtctcattgtgcagacccataagagtgattggtcgcttgcaactatgcccacaagcctgcctcggtccctctcccaatgccaccagcttcagcccctgcctcagcacctcagccagagctcgattgctagcagcatgagtcacagtaccacagctagctctaccacagccccgctgatgatgaaaactacggtcctcatgtcccccgccctcgttggcttagtgctggccctgagcgctggccagccttag

SEQ ID NO: 206964 - DNA, 969 bp, Artificial Sequence
  Description of Artificial Sequence: Synthetic coding sequence
atgctgagccccctgcccaccggccccctggaggcctgcttcagcgtccagagtaggaccagctcaccgatggagcctccgattccccagagcgccccgctcaccccaaacagcgtcatggttcagcccctgcttgacagcaggatgtctcactccaggttgcaacaccctttgaccatcttgccaatagatcaggtgaagacctcacacgtagaaaacgactacattgataatccgtccctggccttgacgaccggtcctaaacgcactcgcgggggggctcctgagctagctcctactccagccagatgcgaccaggacgtgacccaccactggatttcttttagcgggcgcccttcctctgtaagcagttcctcctctacgtcttctgaccagagactcttggaccatatggcccctccgccagtcgcggaccaggcttctccccgggcggtgagaattcagccaaaggtggtgcattgtcagccacttgatctgaaaggccccgctgtgccgccagaactcgataaacatttcctactgtgcgaagcgtgcggaaagtgtaaatgcaaagagtgcgcttcacctcgcactttaccctcctgctgggtgtgtaatcaggagtgcctttgctctgcgcagaccctggttaactacggcacctgtatgtgcctggtccaggggatcttctatcattgcactaacgaagacgacgagggctcctgcgctgaccacccgtgctcttgcagtaggagcaactgttgtgctcggtggtcattcatgggagccctctcggtggttctgccttgcttgctgtgctaccttcctgcaactggctgcgtgaagctggcacagcgcggctatgaccgcctgaggcgaccagggtgtagatgcaagcatactaattcggtgatatgtaaagctgcctctggagatgcgaaaacgtctaggcccgataaaccattttag

SEQ ID NO: 206965 - DNA, 321 bp, Artificial Sequence
  Description of Artificial Sequence: Synthetic coding sequence
atggagccccccatcccccagagcgcccccctgacccccaacagcgttatggttcagccactcctggattcacgcatgtcacatagtaggcttcagcatccccttacaattctgccaatcgaccaagtgaagacctctcatgtcgaaaacgactacatagataacccgtctctggccctgactacagggccaaagcgcacacgaggaggggcacctgaactcgcacctactcccgcaagatgtgatcaagacgtgacgcaccactggatctcattttctggacggccgtgctccgctacatgtctgcctcccgccgcctag

SEQ ID NO: 206966 - DNA, 900 bp, Artificial Sequence
  Description of Artificial Sequence: Synthetic coding sequence
atggagccccccatcccccagagcgcccccctgacccccaacagcgttatggtgcaacctctcctggatagccggatgagtcactcccgtctgcagcaccctcttacaatcctgccgatcgatcaggttaagacgtcgcatgtcgaaaatgattacatcgataatccatcccttgcccttaccacaggtccaaagcgcacacggggaggcgccccagagctagctccaaccccagcacgatgcgaccaggatgtgactcatcactggatcagtttctctggacgccctagctctgtgagcagctccagctctacttcgagtgaccagcgcttactggaccatatggctccaccacccgtcgctgatcaggctagcccccgcgctgtcaggatccaacctaaagtggtccattgtcagcctctggacttgaagggcccagccgtccctcctgaactagacaagcactttctgttgtgcgaagcttgcggaaaatgcaagtgtaaggaatgtgcatccccccgcacccttcctagttgttgggtgtgcaaccaggagtgtctgtgttccgcacagactttggttaattacggcacgtgtatgtgtctggtgcaaggtattttctatcattgcacgaacgaagatgatgaggggtcgtgtgccgaccatccttgctcttgctcccgcagcaactgttgtgcacgctggagtttcatgggagcactgtccgtggttctcccttgtttactgtgttacctccctgcgactgggtgcgtgaagctggctcagagaggatatgatcggttacggaggccaggatgccgatgcaagcacaccaacagcgttatctgtaaggccgcttcaggggatgccaagactagtcggccagataagcccttttag

SEQ ID NO: 206967 - DNA, 153 bp, Artificial Sequence
  Description of Artificial Sequence: Synthetic coding sequence
atggagccccccatcccccagagcgcccccctgacccccaacagcgtcatggtgcagccacttctggactcaaggatgagccactcccgactgcaacatccgctgacaattctgcccatcgatcaagtgaagacatcacatgttgagaattag

SEQ ID NO: 206968 - DNA, 1335 bp, Artificial Sequence
  Description of Artificial Sequence: Synthetic coding sequence
atgagcgaggagaccgccaccagcgacaacgacaacagctacgcccgagtgcgtgcagtggtgatgacgagagacgacagttctggtgggtggttgcccctcggaggctctgggctttccagtgtgacagtgttcaaagtgcctcaccaagaggaaaacgggtgcgcagatttttttattagaggggagaggcttcgtgacaaaatggtggtcctcgagtgtatgctcaagaaggacttgatttacaacaaagtcacaccaactttccatcactggaaaatcgacgataagaaattcgggttgacttttcaaagcccagctgatgcacgggcattcgaccgcggtattagacgggcgatcgaggacatcagtcagggctgccccgagtctaaaaatgaagcagaaggggctgatgacctgcaagctaatgaagaagacagttcttcttccctggtgaaggaccacctcttccagcaagaaacagttgtgacatccgagccctatcgctcttcaaacatcagaccctctcccttcgaagacttgaacgctaggcgagtttatatgcagtcacaagcaaaccagataacattcggtcaaccaggattggacatccaatccagatctatggagtacgtgcagcggcaaatttccaaggagtgtgggtctttgaagtcgcagaatcgcgtgcccttgaaatccatcagacacgtgtctttccaagatgaagacgagatagtccggatcaatccgcgcgacatcctcatcaggcgctatgccgactaccggcaccccgacatgtggaaaaatgacctggagagggatgacgcagactctagtatacagttctccaagccagactcaaagaagagtgactacctttattcttgtggcgacgaaacaaagctctcttctcccaaagacagcgtggtttttaagacacagccatcctcactcaaaattaagaagagcaaacgcaggaaagaggatggcgagagatctaggtgtgtgtattgccaggagcgcttcaaccatgaggagaacgtgcgcggcaaatgccaggacgctcctgatcccatcaaacgctgtatctaccaggtcagctgcatgttgtgtgctgaatcgatgctgtatcattgtatgagtgattctgagggggattttagtgacccttgcagttgcgacaccagtgatgataagttttgcctgcgctggcttgctttggtagcactgagctttatcgtaccctgtatgtgctgttatgttcccttaagaatgtgccatagatgcggggaagcctgtggctgctgtggtgggaaacacaaagccgccggttag

SEQ ID NO: 206969 - DNA, 1257 bp, Artificial Sequence
  Description of Artificial Sequence: Synthetic coding sequence
atgaccgaggagacccaccccgacgacgacagctacatcgtgcgggtcaaggctgttgtgatgacccgggatgattcctccggcggctggttcccacaggaagggggtggaataagccgggtgggggtgtgtaaagtcatgcaccctgagggcaacggccgctccggttttttaatacatggtgagcgtcagaaagataaattggtcgtactcgagtgttatgttcgtaaagaccttgtgtacaccaaagctaatccaacctttcatcactggaaggttgataataggaagttcggactgaccttccagtcaccggctgacgcccgggccttcgatagaggcgtgagaaaggcaatcgaggacctgatcgagggatccacaacaagctcaagtacgatccataacgaagcagaactaggcgatgacgatgtgtttacaaccgccacagacagttcctccaactcaagccagaagcgcgaacaaccgacgcggaccattagcagcccaacctcatgtgaacatcggagaatctacaccctgggacatctccacgattcatatccaaccgaccattaccaccttgaccagcccatgcctcgcccatatcgtcaggtctcgttccccgacgacgacgaggaaatagtccgcatcaatccacgagaaaaaatttggatgacaggttatgaggactatcgacatgcccctgtcagggggaagtatcccgacccttcagaggacgcagactcttcctatgttcgcttcgctaagggtgaagtccccaagcatgattataattacccatatgtggattcttcagactttgggttgggagaggatcctaaaggtagaggggggtcagtgataaagacacaacctagtcgcggcaaatcccgcaggaggaaagaggacggagaacggagcagatgcgtgtactgcagggatatgttcaatcacgaagagaacagaaggggccactgccaggacgcccctgatagtgtcagaacgtgcatacgacgcgtgagctgtatgtggtgcgctgactccatgctgtaccactgcatgagcgaccccgagggcgattacaccgacccatgcagctgcgatacctccgacgagaagttctgcttgcggtggatggccctgatcgctttgtcatttttagctccatgcatgtgctgttacctgccattgcgcgcctgctatcactgcggagttatgtgcaggtgttgcggaggtaagcacaaggccgccgcctag

SEQ ID NO: 206970 - DNA, 351 bp, Artificial Sequence
  Description of Artificial Sequence: Synthetic coding sequence
atgaccgaggagacccaccccgacgacgacagctacatcgtgcgggtgaaagccgtggtcatgacccgggacgacagctccggaggttggttcccccaggaagggggcggcatttccagagttggtgtgtgtaaggtgatgcatcctgaaggtaacggacggtccggcttcctcattcatggggaacgacaaaaggacaaactcgtcgttcttgaatgctatgtccgtaaggaccttgtatacactaaggctaaccccactttccaccattggaaggtggataaccgtaagtttggtttgacattccagagtcccgctgacgccagggcgttcgatcgtggagtgaggtag

SEQ ID NO: 206971 - DNA, 1248 bp, Artificial Sequence
  Description of Artificial Sequence: Synthetic coding sequence
atggccagccccggcagcgacagctacatcgtgcgggtgaaggccgtcgtgatgaccagggatgactctagtggggggtggttccctcaggaggggggcggcatctcgagggtgggagtctgcaaagtgatgcatcccgaaggcaatggccgctccggcttcctgatccatggggaacggcaaaaagataagctggtcgtgttggaatgttacgttcggaaggacttagtgtataccaaagccaatcccacctttcaccattggaaagtggacaatcggaagtttggactgacattccaatcacccgcagatgcgcgtgcctttgaccggggggttcgcaaggctatcgaagatctgatagagggttcaactacttctagcagcactattcataatgaggctgaactgggcgatgatgatgtttttacaacagcaactgacagttcctccaacagttcacagaaacgcgaacaacccacgcgcactattagcagtcccacgagctgtgaacaccgaagaatctacaccctcgggcatttgcatgattcttaccccactgaccactatcacctcgaccagccgatgccacgaccatatcgccaagtttccttcccagatgatgacgaggagattgtgcgcattaacccccgtgagaaaatttggatgactggctacgaggattatcgtcacgccccagtccggggtaaatatccagacccctctgaggacgcggattcgtcatatgtgagattcgccaaaggggaggtccctaaacacgactataattatccctatgtggattcaagcgacttcggattgggggaggatccaaagggccgaggggggtcagttattaagacacaacctagcagggggaaaagcagacgccgtaaggaggatggcgaaaggtccagatgcgtctattgccgggacatgttcaaccatgaagagaatagaaggggccactgtcaagatgctccagatagcgtgcgcacctgcatccgacgtgtctcctgcatgtggtgtgcagacagcatgctctaccattgcatgtctgatccggagggcgactatactgacccatgctcctgtgatacttccgatgagaagttctgtctgcgctggatggccctcatagcgttatctttcctggccccctgtatgtgttgttacctgcctttgcgagcatgctatcattgcggtgtcatgtgccggtgctgcggaggtaagcacaaagcagccgcctag

SEQ ID NO: 206972 - DNA, 1233 bp, Artificial Sequence
  Description of Artificial Sequence: Synthetic coding sequence
atggtgcgggtgcgggccgtggtgatggcccgggacgacagcagcgggggatggttgcccgtgggggggggcggactgtcccaggttagcgtgtgccgggtccgaggagcgcgacctgagggaggggcgcgacagggtcattacgtcatccatggcgagcgcttgcgggaccagaaaactacactggagtgtaccttgaagcccgggctggtgtataacaaagtaaacccgattttccaccactggagcctgggcgactgtaagttcggactcacctttcaatcgccagcagaggctgacgaatttcaaaaatccttgctggccgccttggccgccttgggtcgtggctcactgacaccgagtagctccagtagctcctccagccctagtcaggatacagccgagaccccttgtcccctgacgagtcacgtggacagcgatagcagtagcagccattctcgccaggaaactccacctagtgcagctgccgcaccaattattacaatggaaagcgcttcaggcttcggccctaccacccctcctcagcgacggaggagcagcgcacaatcatatccccccctgctgccttttaccggtataccagaaccttctgaaccgcttgctggcgccggcggactggggtggggcgggcgcggctacgaagactacagacgatccggaccacccgctccactcgcgctgtctacctgcgtagtccgttttgctaaaaccggcgccctgcggggcgccgccttgggcccgccagctgccctgcctgcccccttaacagaagcggctccacccgcacctcctgctaggccaccccctggtccaggcccttcctccgctccagccaaggctagtccagaggccgaagaagcagctagatgtgtgcattgtcgggccctattcagacgcagggcggacggcaggggggggcgatgcgcagaagcacccgaccccggaaggttgttggtccgacggctgtcatgcttgtggtgcgctgaaagccttctctaccattgcctctctgacgcagaaggtgacttctcagacccctgtgcatgtgagcctggacatccaaggcctgccgccagatgggcagcactggcggcccttagcctggctgtcccttgtctctgctgttatgcacctcttagagcttgtcattgggtagccgcccgatgcggttgtgccggctgcggcggcagacacgaagaggccgccagatag

SEQ ID NO: 206973 - DNA, 459 bp, Artificial Sequence
  Description of Artificial Sequence: Synthetic coding sequence
atggtgcgggtgcgggccgtggtgatggcccgggacgacagcagcggcggctggttacctgtgggtggtggcggcctgtcacaggtgtcagtatgccgagtaaggggcgctcgaccagaaggcggtgccagacaaggccactacgtgatccacggggaaaggctacgggatcaaaaaacaactctcgaatgtacactcaagcccgggctcgtgtacaataaggtcaacccaattttccaccattggagcctaggcgattgcaagttcggactgacgttccagagcccagccgaagcagacgagttccagaaatcgctgctggcggccctggcggcactgggcagaggtagcttgactccttccagtagtagctcttcatcaagtccatctcaggatacagccgaaaccccatgcccactgactttaagccaatattttcggcatatgctatgtccatag

SEQ ID NO: 206974 - DNA, 1725 bp, Artificial Sequence
  Description of Artificial Sequence: Synthetic coding sequence
atgtggaccttcctgggcatcgccaccttcacctacttctacaagaagttcggcgactttatcacgctagcaaaccgggaggtgttactatgtgtcctcgtcttcttgtctttagggcttgtgctttcttacaggtgtagacaccgaaatggtggcctgctgggaaggcagcaatcagggagtcaattcgccctgttttctgatattttgtccgggctccccttcatcgggtttttttgggcgaaatcacctccagagagcgaaaacaaggagcagctggaagctaggagacggaggaaaggtactaacatttcagaaactagtctgatcggcaccgcagcttgcacctccacctctagccagaatgaccccgaggtgattattgtcggagccggtgtgctcgggtccgccctggctgctgtgctgagtcgcgatggccggaaggttactgttatcgagagagacttgaaggagccagaccgcatcgtcggggagtttctgcagccaggcgggtatcacgtcctgaaggacctcggcctgggcgatactgtggagggtctagatgcccaggtggttaatgggtatatgattcatgatcaggaaagtaagtcggaggtccagatcccctatcctctgagcgagaacaatcaggtgcagagcggccgcgcctttcaccacggaagatttatcatgtcactgagaaaagctgcgatggcagaacccaacgccaagttcattgagggggttgttctacagctgctcgaggaggatgacgtggttatgggcgtacagtataaggacaaggagactggcgacatcaaggagttgcacgcacccctgacagtagtggctgatggactctttagtaagttcagaaagagcttagtgtcaaataaggtgagtgtatccagccatttcgtcggcttcttgatgaagaacgccccgcagttcaaggccaatcatgcagagctgattctggccaatccttcaccagtcctgatttatcagatttcttcctccgagacaagggttctagttgacatccgaggagaaatgcctcgcaaccttcgggaatatatggtggaaaaaatctaccctcaaatccccgatcacctgaaggaaccatttctggaagctaccgataacagccacctacggtcaatgcccgcctcttttctgcctccaagttcagtgaaaaagcgcggcgtactcctgctgggagatgcgtacaacatgcggcacccactcaccggcgggggtatgacagtggctttcaaagacattaaactctggcggaagctgctcaagggaattcccgacctctatgacgacgcggccattttcgaggccaagaagtctttttactgggctaggaaaacatctcactccttcgttgtgaatatcttggctcaagctttgtacgaactgtttagcgcgacagatgacagcctgcaccaactccgaaaagcgtgttttctgtattttaagctgggaggcgagtgtgttgccggcccagtgggtctgctgtctgttctctctcctaatcctctggtactgatcggacattttttcgccgtcgctatctacgccgtgtacttttgcttcaagtccgagccatggatcaccaaaccgcgggccctgctgtcctctggcgcagtgctgtacaaagcctgttccgtgatctttcctctaatctactctgagatgaaatacatggtccactag

SEQ ID NO: 206975 - DNA, 1440 bp, Artificial Sequence
  Description of Artificial Sequence: Synthetic coding sequence
atgctgcggcggaagggcaccaacatcagcgagaccagcctgatcggcacggctgcctgcacttccacgagtagccagaatgatcctgaggtaatcattgtgggagctggggttctcggcagcgccttagccgccgttctgtcacgggacgggagaaaagtgactgtcatagagagagacctgaaagaacctgatcggattgtaggggaatttctgcaacctgggggctaccatgtgttaaaagacctcgggctcggtgatacagtggagggactggatgcccaggtcgtcaatggttacatgatacacgaccaggagagcaagagcgaggtccagattccttatcccctctctgaaaataatcaggtgcagtcaggacgcgcatttcaccacggacggttcatcatgagcttgcgcaaagcagccatggcggagccgaatgcaaagtttatcgagggggtggtgctccagttactggaggaggacgatgtcgtcatgggcgtgcaatacaaggacaaggaaaccggcgatataaaagagcttcacgcaccactaaccgtcgtggctgacggcctgtttagtaaatttcgtaagagcctcgtgagcaacaaggtgagcgtttccagtcattttgtggggttcttgatgaaaaacgcccctcagtttaaagccaaccatgctgagctcattctagccaatccatctcctgtcctgatttaccagatctcatcctccgagactcgggttcttgtggacatccgcggtgaaatgccacggaatttgcgcgagtacatggtggaaaagatttacccacaaatcccggaccatcttaaagagccattcctggaggctactgacaactcccacctgcgaagcatgcccgcaagcttcctcccaccatccagcgtgaaaaagaggggagtccttcttctcggcgacgcctacaacatgcgacacccccttaccgggggagggatgaccgtggctttcaaggatatcaaactgtggcgcaaactccttaagggcattcctgacctctacgatgacgctgccattttcgaagccaaaaagagtttttactgggctaggaaaacttcccattcctttgtggttaatattctggcccaagctctatacgaactgttctccgcgaccgatgattctttacaccagctcaggaaagcttgctttctgtactttaaattgggaggagagtgtgtagccggccccgttgggctgctgtcagtgctgagtccgaatccactagtgcttattggacacttcttcgcggtggctatctatgccgtgtacttttgtttcaagtcagagccctggattacaaagccacgggccctgctgtccagcggggcggtcctgtacaaggcctgctcagtcattttcccgcttatttactctgagatgaaatatatggtacattag

SEQ ID NO: 206976 - DNA, 1140 bp, Artificial Sequence
  Description of Artificial Sequence: Synthetic coding sequence
atgatccacgaccaggagagcaagagcgaggtgcagatcccctacccactatcagaaaacaaccaggtgcagtctggcagagcctttcaccacggccggttcatcatgtctcttcgcaaggctgctatggccgaaccgaacgcaaagtttattgaaggggtggtcctccaactcctggaggaagacgacgtggtaatgggggtgcagtacaaggacaaggaaacaggagatatcaaagaactgcacgctcctctgacagtggtcgccgacggccttttctctaaattcaggaagagcctcgtgagtaataaagtctccgtcagctcacactttgtgggtttcctcatgaaaaacgctccccagttcaaggccaatcacgccgaattaatattggcaaacccttctcctgtgctgatttaccagatttcttctagcgagactcgggtcctcgtcgatatacgtggggaaatgcctaggaacttaagggagtacatggtggagaagatctatccacagatacccgaccatctgaaggagccatttttggaggctaccgacaactcacacctgcgcagcatgccagcctcttttctgcctccctctagcgttaaaaagaggggagtgttactgctcggagatgcctacaatatgcggcatcctctgacagggggcgggatgacagtcgcatttaaggacatcaaactctggcgtaaacttctcaagggaatacccgacctgtacgacgatgccgccatctttgaggccaagaagtccttctattgggcaagaaaaacctcgcactcatttgtcgttaatatacttgcccaagctttatacgagcttttttcagcgactgacgatagcctgcaccagctgagaaaggcatgtttcttatatttcaagctgggtggagaatgtgtggctggtcctgtgggtctgttatccgtgttatcccccaacccactcgtactcataggccacttttttgcggtagctatttacgccgtgtatttctgtttcaaatcagagccctggattacgaagcctagagctctactttcgtccggagcagtgctctacaaggcttgcagcgtgatctttccacttatctactctgaaatgaagtatatggtccactag

SEQ ID NO: 206977 - DNA, 822 bp, Artificial Sequence
  Description of Artificial Sequence: Synthetic coding sequence
atgaagaagacccagacctggatcctgacctgcatctacctgcagctgctattgttcaacccactcgtgaaaacagagggcatctgtaggaaccgcgttactaataacgtgaaggatgtgactaaactggttgcaaatctgccgaaggattacatgatcactttgaaatatgtgcccgggatggacgtgcttccgtctcactgctggattagcgaaatggtggtgcagttatccgattccttgactgacttgcttgataaattcagcaacatcagcgaaggcctttccaactacagcatcatcgacaaactggtgaatatcgttgatgacctggtggaatgcgtgaaggagaattccagcaaggacctcaaaaaaagttttaagtccccagagcccagactttttactccagaggaattctttaggatcttcaataggtcgattgatgcttttaaagacttcgtggtcgcatcagaaacaagcgactgtgttgtatcctcaaccctgtctccagaaaaggactcgcgtgtgagcgtgacaaagccatttatgctgccacccgtagccgcttcctccttacgcaatgacagcagcagctctaaccgaaaggccaaaaaccctcctggggacagttccctgcattgggccgccatggccctccccgctttatttagtcttataatcggattcgccttcggggcgctgtactggaaaaagcggcagccctccctgacaagagctgttgagaatattcagataaatgaggaggataatgagatcagcatgcttcaagagaaagaaagagagttccaagaggtttag

SEQ ID NO: 206978 - DNA, 2100 bp, Artificial Sequence
  Description of Artificial Sequence: Synthetic coding sequence
atgcggctgcggcggctgggccagggcggccggtgctaccggggcctgtggccgctcagacacactagaccctggtctagtcccggagaatacgaatgggagtacgacgaggaagaggaaaaaaatcagcttgaaattgagcggctggaggagcagctgagcattaacgtttacgattacaactgtcatgtggatctgattaggctcctccgccttgagggagagctgaccaaagttcggatggcgcggcaaaaaatgagcgagattttccccctgactgaggagctctggctcgaatggttacatgacgagatctccatggctcaagacgggcttgatcgagaacatgtgtacgatctgttcgagaaagccgtaaaggactatatttgtcctaatatctggctggagtatggccagtatagcgtgggtggcatcggccaaaaaggaggactggaaaaggtccgtagtgttttcgagagagctctctcatccgttggcctgcacatgactaaaggcctcgccctttgggaagcttacagggagttcgagtctgccattgtcgaggccgcaaggctcgagaaggtgcattccttgtttcgccgacagctggcgatccctctgtacgatatggaggcgactttcgcagaatacgaggaatggtccgaggacccaatacctgagtcagtgatccagaattacaacaaggccttgcagcagctcgagaagtacaaaccctatgaggaggccctcttgcaggctgaggccccacggctggctgaatatcaggcttacattgacttcgaaatgaaaattggcgatcccgcgcggatccagctcattttcgagcgggcgctggtggagaactgcctcgtgcccgacctgtggattagatactcccagtacctggatcgccaactgaaggtgaaagacttagtgctatcggtgcataatagggctattcggaattgcccctggacagttgctctctggtcccggtacttactggcgatggagaggcatggagtggatcatcaggttatttccgttaccttcgagaaagctttgaatgccggctttatccaggctactgactacgtggagatctggcaggcctacctggactatctccggcgccgcgtggactttaagcaggacagttctaaagagcttgaagaactccgggctgcgttcacacgagccctggagtatctgaagcaagaggtggaggagcgctttaacgagagtggcgatccatcatgtgtgatcatgcaaaactgggcaagaatagaggctcgcctttgcaataacatgcagaaggctcgggagctttgggattccattatgacgaggggcaatgctaaatacgcaaatatgtggctggagtattataacctggagagagcccacggcgacacacagcattgccgtaaggctctgcaccgagctgtccagtgcacttccgactaccctgaacacgtgtgcgaggtgctgttaaccatggaacgcacagagggaagtctggaggattgggatattgcagttcaaaagacagaaacgcggctggcgagggtcaacgaacagaggatgaaagctgctgagaaggaggctgcccttgttcagcaggaggaagaaaaggctgagcagcgcaagagagcacgagccgagaagaaagcactgaagaaaaagaaaaagatccggggtccagagaaaaggggcgcggacgaagacgacgagaaggagtggggagatgatgaagaggcgtttcaaactcaaaaaggccgtgaacaacatccatgtagctggaggaacacgaagtgccggtcatccagtagggctcgctgggaaatgtgctgccggcgctgcggcgctccattcgaggcagaaggagaaggctcacttcctgaggagggtcatgcacagggagccgccagacagcaacagggacagcaccacaggttgtgtcagcaacccgcactccaacatgctggagctggccacgaggcacaggcaacattgagaggcctgtgggggggaggccccgacccaacacatttgcagcaaccctgggggtttcccagattgcttttgcgcggagtgtag

SEQ ID NO: 206979 - DNA, 2784 bp, Artificial Sequence
  Description of Artificial Sequence: Synthetic coding sequence
atggccaccgccgccgagaccagcgccagcgagcccgaggccgagagcaaggcaggcccgaaagccgatggagaggaggacgaggtgaaggctgcccggacacgccgcaaagttctgtctcgtgccgtcgcagctgctacctacaagacaatgggccccgcttgggatcagcaggaggagggggtctctgagtcggacggcgatgaatacgccatggcttcttcagctgaaagctcccctggggagtacgaatgggaatacgatgaggaagaggagaaaaatcagctcgaaatcgagcgcttggaagaacaattgtcgatcaacgtatacgattacaactgccatgtggacctcatccgcttactgagacttgagggggaattgacgaaagttagaatggcccgacagaagatgagcgaaatcttccctctgactgaggagctgtggctggagtggctgcacgacgagatcagtatggcgcaggacgggttagaccgggagcatgtatatgaccttttcgagaaagccgtgaaggattacatctgtcctaatatatggctggagtacggtcagtacagcgttgggggcatcgggcagaaaggagggctcgagaaggtcaggtcggtcttcgagcgcgctcttagctctgtaggcctccatatgacaaagggcctcgccctttgggaagcatacagagagttcgagagcgcaatcgtggaggctgccaggctcgagaaggtgcacagcctgttcagacggcaactcgctatacctctctacgacatggaggccacttttgctgaatatgaggagtggagtgaggatcctatccctgagtccgtgattcagaattataacaaagccctgcaacagttggaaaaatacaaaccatacgaagaggcgttgttgcaggctgaagcacctcggttggccgaataccaggcctacatcgatttcgaaatgaagataggcgatccagcgcggatccagcttatcttcgagcgcgctctcgtcgaaaattgtcttgtgcctgacttatggatccgctatagtcagtatttggaccgccagttaaaagtgaaagatctagtgctttctgtgcataatagagcgattcgaaattgcccatggacggtggccctgtggtctcggtacctgctggcgatggaaagacacggagtggaccaccaggtcatctcagacagctccaaggagctggaggagttgagggcagcctttacgcgcgctttggaatatctgaaacaagaggttgaggagaggttcaatgagagtggagatccctcatgtgtgatcatgcagaactgggccaggattgaggcacggttgtgcaataacatgcagaaggccagggagttgtgggattcgatcatgacccgtggtaacgctaagtacgcaaatatgtggttagaatattacaacttggaaagagcccatggtgatactcagcactgtagaaaggccctccatcgagcagtgcagtgtacctcagactatcccgaacacgtttgcgaggtgctgctgaccatggagcgaactgagggtagcctggaggattgggacattgccgtccaaaaaacagagacccggctggccagggtgaacgagcagcggatgaaggccgctgagaaagaggccgcgctcgttcaacaggaggaagagaaagcagagcaaaggaaaagggcgcgcgccgagaaaaaagctctgaaaaagaaaaagaaaatccgagggcccgagaagcggggcgcagacgaggacgatgagaaagagtggggcgatgatgaagaggagcagccgagtaagcggaggagggtagagaacagcattccagccgccggtgaaacacagaacgtggaggtggccgccgggccagctggaaagtgtgctgccgtggacgtggaaccaccatccaaacagaaagagaaagcagccagtctcaaaagggatatgccaaaggtgctccatgattcaagcaaagactcaattactgtttttgtttcaaatttaccatactccatgcaggagcctgatactaagctgcggccactgtttgaggcttgtggggaggtggtgcagataaggccaatcttttcgaaccgcggcgacttccgaggatattgctacgtcgagtttaaggaagagaaaagcgccctgcaggctctcgaaatggaccgtaaaagcgtggaagggcggcccatgttcgtgagcccttgcgtggataagtctaagaaccccgatttcaaggtatttcggtactctacttctttagagaaacataaactctttatttctggactgccattttcttgcacaaaggaggagttagaagaaatatgcaaagctcatggaacagtgaaggacttgcggctggtcactaatcgggctggaaagccaaaaggactcgcatatgtagagtatgaaaacgaatcgcaggcttctcaagccgttatgaaaatggacggcatgacaatcaaggagaatattattaaagtcgcaatatctaatcccccccaacgcaaggtgcccgagaaaccagagactcgaaaagcccccggcggcccaatgttgcttccccagacatatggtgctagaggtaaaggacggacccagttaagcctcttgccacgtgccctgcagcgtcccagtgccgctgcccctcaggctgaaaatggtcctgcagctgctcctgcagtggccgcgcctgcagcaactgaggcccctaaaatgagcaacgccgactttgccaaactctttctcaggaagtag

SEQ ID NO: 206980 - DNA, 1587 bp, Artificial Sequence
  Description of Artificial Sequence: Synthetic coding sequence
atggagcggcacggcgtggaccaccaggtgatcagcgacagcagcaaagagcttgaagagttgcgggcagcctttacccgcgctctggagtacctaaagcaagaagtagaagaaaggttcaacgagagcggggacccaagctgcgtgattatgcagaactgggcccggatcgaggccaggctgtgcaacaacatgcaaaaggctagagagttgtgggattctattatgacccgtggcaacgccaaatacgccaatatgtggctggagtactacaatctggagcgggctcacggggatacacaacattgccgaaaagcactgcatcgtgccgtccagtgtacaagcgattatcccgagcacgtctgtgaggtcctgctcaccatggaacgcacagagggaagcttggaggactgggacatcgccgtgcagaaaacggaaacccgactggcgcgggtaaatgaacagcggatgaaagcggcagaaaaggaggccgccttagtccaacaggaggaagaaaaagctgaacagcggaaaagagctagggcagagaagaaggccctgaagaaaaagaagaaaatccgggggcccgagaagaggggcgcggatgaagacgatgagaaggaatggggggacgatgaagaagaacaaccctccaagcgtagacgcgttgaaaactccatccctgccgccggcgagacgcagaacgtcgaggttgcggcgggcccagctggcaaatgcgcggcagttgacgtggagcctccctcaaagcaaaaggagaaggccgcttctctaaagagagatatgccaaaagttctgcacgacagttctaaagactccatgcaagagccagacacaaagttgcgccccctgtttgaggcttgcggggaagtggtgcagatccgccccattttttctaataggggagactttaggggctactgctatgtggaattcaaggaagaaaagtctgctctccaggcactggagatggatcgaaagtctgtcgagggccggcccatgttcgtgtcaccgtgtgtcgataagagcaagaatcctgattttaaggtgttccggtactctacaagcctggaaaaacataagctgttcattagcgggcttccatttagttgtactaaggaagaactcgaggaaatctgtaaagcccatggcaccgtgaaggatctgcgactggttaccaatcgagcaggcaagcccaaaggactagcgtatgtagaatacgagaacgaatcccaggcaagccaggcggtgatgaaaatggatggcatgactattaaggagaacattatcaaagtcgccatctctaatccaccgcagaggaaggtaccggaaaagcctgaaactcggaaggccccaggcggccccatgctgctcccacagacgtacggggctcgtggcaagggacgcactcagctgtcgttgttaccacgcgcattgcagcggccctctgcggccgctccacaggccgaaaacggccccgccgccgccccagcggtggccgctcccgcagcaacagaagcccctaagatgtccaacgcagatttcgcaaagctattcttgagaaagtag

SEQ ID NO: 206981 - DNA, 390 bp, Artificial Sequence
  Description of Artificial Sequence: Synthetic coding sequence
atggccaccgccgccgagaccagcgccagcgagcccgaggccgagtctaaggctggtccaaaagccgatggtgaggaggacgaagtgaaggccgccaggaccagaagaaaggtccttagccgggcggtcgccgccgcaacttacaagacaatggggcctgcgtgggaccagcaagaggaaggagtgtcagaaagcgacggcgatgagtatgcgatggcgtcaagtgccgaatctagccctggcgagtatgagtgggaatacgacgaagaagaggagaagaatcagctggaaattgaacggcttgaagagcaggtcggaccaggagtggggtcgggccatctgcccgtattccaggtgctgggatcgccatgcccaggtccaccgccctag

SEQ ID NO: 206982 - DNA, 330 bp, Artificial Sequence
  Description of Artificial Sequence: Synthetic coding sequence
atggccgccagcgccgcccggggcgccgccgccctgcggcggagcataaaccaacccgtggcattcgtgcgccggatcccgtggaccgcagcatcttcacagctgaaggagcacttcgcccagtttggtcatgtgagacgttgtatccttcctttcgataaagagacagggttccataggggcctcggttgggttcagttttcgtctgaggagggcctgcggaacgcccttcagcaggaaaaccatatcattgatggtgtcaaggtgcaagtccatacaagaagacctaaactcccacaaacttctgacgatgagaagaaagacttctag

SEQ ID NO: 206983 - DNA, 894 bp, Artificial Sequence
  Description of Artificial Sequence: Synthetic coding sequence
atggccaagtggctgaacaagtacttcagcctgggcaacagcaagacaaagtcccctccacagcctcctcggcccgactacagagaacagcgcagaaggggtgaaagaccctctcagccaccccaggctgtgccacaagcctcatcagcagccagcgcctcctgcggaccagccaccgcttcttgcttttcagcttcatctgggtcactaccagacgacagtggttctactagcgatcttattcgagcatatagggctcagaaggaacgcgattttgaagatccctataacggtccaggttctagcttgcgcaagcttcgggcaatgtgtaggctggattattgcggaggatccggcgagcctggtggcgttcagcgagcctttagtgctagctctgctagcggcgcagccggttgctgttgcgcgagttctggggccggggccgccgcatcaagctccagctccagtgggtcaccgcacctataccggtcgagcagtgaacgaagacctgccacgccggcggaagttcgctacatctcacctaaacaccgtctcatcaaggtggaaagcgctgctgggggcggtgccggtgatcccctcggcggggcctgtgcgggagggcggacatggtctcctaccgcttgcggcggcaagaagctcctgaacaagtgtgctgcgtccgctgcagaagagtcaggggccggaaaaaaggataaagtcacgatagcggatgattatagtgacccattcgatgctaaaaacgatctgaaatcgaaagccggcaagggggagtccgccggctatatggagccttatgaggcccagaggatcatgaccgggctgcaggaagcctggaggcattcccccagtggatgctttccggtgggcccctag

SEQ ID NO: 206984 - DNA, 1530 bp, Artificial Sequence
  Description of Artificial Sequence: Synthetic coding sequence
atggccaagtggctgaacaagtacttcagcctgggcaacagcaagactaaatcacctcctcagccccctcggcccgattatcgtgagcaacgcaggcgcggtgaacgcccaagccaacctccccaggcagtcccccaggccagtagtgctgcctctgcaagttgcgggcctgctacagccagttgcttctcagcttccagcggatcactgccggacgattctggctcaacttccgacctcattagggcttacagagctcagaaagagagagactttgaggacccctacaatggccctggtagctcactccgaaagttgcgggccatgtgccgtctggactattgtggcggcagcggagaacccggaggcgttcagagggctttcagcgctagttccgcatccggggctgccgggtgctgctgcgcgtcttcaggggccggcgctgccgcttcctcgtcctcttctagcggcagtcctcatctgtatagatccagttctgagcgacgacctgcaactccagctgaagtgaggtatatctccccgaaacatcgcctgattaaagtggagtccgccgcaggggggggtgccggcgaccccttgggaggggcatgtgcaggtgggagaacctggagccctaccgcgtgcgggggaaagaagctcctcaataagtgcgccgctagtgccgcagaagaaagtggcgctggaaagaaagacaaagttactattgctgacgattactccgatccgttcgacgctaagaacgatctgaagtcaaaggccggaaaaggcgaaagcgccggctacatggagccctatgaggcccagaggatcatgaccgagttccagcgccaggaatccgtcagatcccagcacaaaggcatacagctctacgataccccatacgagccggaaggccagtccgtcgacagcgatagtgaatccacagtgagtccccggctccgagagagtaaactgccccaggacgacgaccggcccgctgatgagtacgaccagccatgggaatggaacagagtgacaattccagcacttgccgcacaatttaatggaaatgaaaaacgacagtcatcacccagcccctcccgggacaggcggcggcagctgagagcccctggaggaggattcaagcctataaagcacgggtcaccagagttttgtggtatccttggcgagcgggtcgaccccgctgtccccctggagaaacaaatctggtaccatggcgcaatatccagaggtgatgccgaaaaccttctacgtctctgcaaggaatgttcctatctggtgaggaactcccagacaagcaagcacgattatagcttgtccctgaggagcaatcagggttttatgcatatgaaattagccaaaacgaaggagaagtatgtgctcggacagaacagcccacccttcgactctgtgccggaggtgatacattattacaccacccggaaactgcctatcaagggcgccgaacacctcagcttgctttaccctgtggctgtgaggactctgtag

SEQ ID NO: 206985 - DNA, 1080 bp, Artificial Sequence
  Description of Artificial Sequence: Synthetic coding sequence
atgcaggccgccgccctgcccgaggagatccggtggctgctggaggacgcagaggagtttctggcagaaggactgaggaatgagaatctgagcgccgttgcccgggatcaccgggaccacattctaagaggttttcagcagattaaagcaagatactattgggattttcagccacaagggggtgacattggtcaggatagctcagacgacaatcattctgggaccctcggactgagccttacgtcggatgccccatttcttagtgattaccaggatgaaggaatggaggacattgtcaagggagctcaagagctggacaacgtcatcaagcaaggctacctcgaaaaaaaaagcaaggaccactcctttttcggatctgagtggcaaaagcgatggtgtgtggtgtcacgggggcttttttactactatgccaacgaaaagtccaaacagccaaaaggtaccttcttgatcaaaggttacggggtgcgaatggctccccatctgcgccgtgacagtaaaaaagagagctgttttgaactgacatctcaggacaggcgatcctacgaatttactgccacttccccagccgaggcacgcgactgggtggatcagatttcattcttgctgaaggatctgtcctcgcttactattccctatgaggaagacgaggaagaagaagaaaaggaggaaacctacgacgacatagacggctttgactctccttcctgtggcagccagtgtaggccaactattctgcccggcagtgtgggcattaaagagcctacggaagagaaagaagaagaggatatctacgaggtcttacccgacgaggaacacgacttggaagaggacgagtcagggacgcgcaggaagggtgtcgactatgctagctattatcaaggattatgggactgccacggggaccagccagatgaactctcattccagcgcggcgacctcatcaggattctgtccaaggagtacaacatgtatggttggtgggtgggtgagctcaatagtttggtgggcattgttcctaaggagtatctgaccaccgcctttgaggtcgaggagagatag

SEQ ID NO: 206986 - DNA, 831 bp, Artificial Sequence
  Description of Artificial Sequence: Synthetic coding sequence
atgggcaacagcatgaagagcacccccgcccccgccgagcggcccttacctaaccctgaaggcctggactcagactttctggccgtcctttctgactatccaagtcccgatatctctccccccatattcaggcggggtgagaagttgagagtgatttccgacgaaggtggctggtggaaagcaatatccctaagcacgggaagggagagctacattccaggcatatgcgtcgccagagtgtaccatggatggctatttgaggggctaggccgcgataaagctgaagaattactccagttgcctgacactaaggtgggaagcttcatgattcgggaatctgagaccaagaagggattctacagtctgtctgtcaggcacaggcaggtgaagcactaccgcatttttcgcctgccgaataactggtactacattagtccacgactgacttttcaatgccttgaggatctcgttaatcactactccgaggtcgctgacggtctgtgttgtgtgctcactaccccatgtctgacccagagtacggccgctcccgcagttcgcgcatcctcatcaccggtaaccctgaggcagaaaacagtggactggcggcgagtgtctcgccttcaggaggacccagagggaactgaaaatcctctgggagttgacgaatccctgttctcgtatggacttcgcgagtccattgccagctacctgagccttacatctgaggataataccagttttgaccgcaagaagaaatctatttctctgatgtacggcggctctaagaggaaatctagtttttttagttcccccccttattttgaggactag

SEQ ID NO: 206987 - DNA, 882 bp, Artificial Sequence
  Description of Artificial Sequence: Synthetic coding sequence
atgctgcaccggctgtgggccagccccgccgcccccggcaagaagaaagaaatgggcaacagcatgaagtccacccccgcacccgctgagcgcccgttgccaaaccctgaggggctggactccgattttctggctgtactcagcgactatcccagtcctgatatttctccacctatctttcgccgtggcgagaagctgcgggtaatcagcgatgagggcggctggtggaaggcgatctcactgtcaacaggccgggagtcatacatccctgggatttgcgtggcccgggtgtatcacggatggttgtttgaggggctcggacgagataaggccgaagagttgctgcagctgccagacaccaaggttggcagtttcatgatacgcgagagcgagacaaagaaagggttttactcactgagcgtgcgacaccgccaggttaagcattaccgcatttttagattgcctaacaactggtactatatctctccaagactgacctttcaatgtctcgaggacctcgtgaatcactatagcgaagtcgcagatggcttgtgctgcgtactgaccaccccatgtctaacccaaagtactgcggctcccgctgtgagagcctccagtagtcccgtgaccttgagacagaagactgtcgattggcgtagggtctctcgcctgcaggaggaccccgaaggaaccgagaacccactcggtgttgatgagagcctttttagctacggattgcgggaatccatcgctagctacctatccctaaccagtgaggataatacatcctttgaccgaaagaaaaagagcatctcattaatgtacggcggaagcaaacgcaaatcatcttttttttcttctccaccttactttgaggactag

SEQ ID NO: 206988 - DNA, 951 bp, Artificial Sequence
  Description of Artificial Sequence: Synthetic coding sequence
atgctgagcaagctgggccacagccccctgggcggcctgcgggccaggctgacatttccagtatgccttctttaccacaggctgtgggcctcccctgcagcacccggcaagaagaaagagatgggcaattcaatgaaaagcactcctgccccagctgaaaggccactccctaacccggaaggtctggattcggattttctggcagtgctgtctgactacccctcacctgatatttctccgccaattttcaggaggggagagaaactgcgggtgatcagtgacgaaggcggctggtggaaggctatcagcctttcaacaggtagggagtcttatatacctggcatttgtgtggcccgggtttaccatgggtggctgttcgagggccttgggcgggacaaagcggaggaactgctgcagcttccggacacaaaggtggggtcattcatgattcgggagtctgaaacaaagaaggggttctatagcctttccgtgagacatagacaggttaaacactaccgcatattcagactgcctaacaattggtactacattagcccaagactcacattccaatgtctggaagatctcgtcaatcattatagcgaggtagcagacggactgtgctgcgtgcttactacaccatgcctaacgcaaagcaccgcggcccccgctgtgagagcatcatcgtcacctgtaacactgcgacaaaaaaccgtggattggaggcgggtgagtcggctgcaggaggatcccgaagggaccgagaatcctctgggagtggacgagtccctcttctcctatgggttgcgggaatctattgcttcctatctgtcacttaccagtgaggacaatacatccttcgaccgcaaaaagaagagcatttccttaatgtatgggggaagcaagagaaaatcaagttttttctctagccccccgtactttgaggactag

SEQ ID NO: 206989 - DNA, 276 bp, Artificial Sequence
  Description of Artificial Sequence: Synthetic coding sequence
atgggcaacagcatgaagagcacccccgcccccgccgagcggcccctgcccaatcctgaggggttggactccgacttccttgcagttctttctgattatccctcacctgacatatcccctcccatttttcgacgtggggagaaactgcgtgtgatcagcgacgagggagggtggtggaaggctatctctttgtccaccggtagggaatcttacatcccaggtatttgtgtcgctagggtgtaccacgggtggttattcgaagggctgggcaggtag

SEQ ID NO: 206990 - DNA, 45 bp, Artificial Sequence
  Description of Artificial Sequence: Synthetic coding sequence
atgggcaacagcatgaagagcacccccgcccccgccgagcggtag

SEQ ID NO: 206991 - DNA, 150 bp, Artificial Sequence
  Description of Artificial Sequence: Synthetic coding sequence
atgggcaacagcatgaagagcacccccgcccccgccgagcggcccttgcccaaccccgaggggctggactcagattttctagccgtgctaagtgattatcccagtcccgatatcagtcctccaatcttcaggaggggagagaagctctag

SEQ ID NO: 206992 - DNA, 477 bp, Artificial Sequence
  Description of Artificial Sequence: Synthetic coding sequence
atgggcaacagcatgaagagcacccccgcccccgccgagcggcccctgccaaaccctgaaggacttgatagcgactttcttgcggtgctgagcgattacccgagcccagacatttctcccccaatcttccgccggggggaaaagctccgtgtcatttcagatgaaggtgggtggtggaaggccatcagtctgagcacaggccgggaatcttatataccaggtatctgcgttgcgcgcgtgtatcatggctggctatttgagggactaggccgggataaggcagaggagttactgcaacttcccgatactaaggtgggatcatttatgatccgagagtcggagacaaagaaaggcttttactctctaagtgtcaggcataggcaggtaaagcattaccgcatatttagactacctaacaactggtattacatctctccgagattaacatttcagtgcctcgaggacctggttaattag

SEQ ID NO: 206993 - DNA, 123 bp, Artificial Sequence
  Description of Artificial Sequence: Synthetic coding sequence
atgggcaacagcatgaagagcacccccgcccccgccgagcggcccctccccaatcccgagggcttggactctgactttttggcagttctgtctgattacccttctcccgacatctcaccttag

SEQ ID NO: 206994 - DNA, 786 bp, Artificial Sequence
  Description of Artificial Sequence: Synthetic coding sequence
atgggcagcctgcccagccggcggaagagcctgcccagccccagcttgtctagcagcgtgcaagggcagggacctgtaaccatggaagccgagcggtccaaagcaacggctgtcgccctgggctcctttcccgccggcggaccggctgagctctccttacgtctgggagagcctctgacgattgtgtcggaggacggcgattggtggactgtcctgagtgaggtctctggacgggaatacaacatcccctccgtccatgtagctaaggtgtctcacgggtggctctacgaaggtctgtccagggaaaaggccgaggaactcctcctgctgcccggcaaccccggtggagcctttctgatccgcgagtctcagacccgtcgaggctcctactcattgagcgtcagactgagccggcccgcttcatgggaccgcatccgccactatcggatccactgtcttgataatggttggctgtacatctccccgagattgacattcccatcactccaggctctggtggaccactacagtgagctggctgatgatatctgttgcctcctcaaggagccgtgtgttctgcagagggccgggcccctcccgggcaaggacatcccactcccggtcactgtgcaacggacaccattaaactggaaggaattagattcctctcttctgttttccgaggccgcgacgggtgaggagtccctgctgagcgaaggactgcgagagtccctcagtttctacatttcattgaacgacgaggcagtgagcctagatgatgcctag

SEQ ID NO: 206995 - DNA, 633 bp, Artificial Sequence
  Description of Artificial Sequence: Synthetic coding sequence
atgggcagcctgcccagccggcggaagagcctgcccagccccagcctgagcagctctgtgcagggtcaggggccggtgacgatggaggctgagaggtccaaagccacagccgtcgccctgggaagctttccagccggggggccagcggagttgagtctgaggctgggagaaccccttacaattgtgtccgaagacggcgactggtggactgtgttgtcagaggtctctgggcgtgagtataatattccaagtgtgcacgtcgccaaggtgagtcacggctggctgtatgaagggctgagcagggagaaggcagaggaactcctgttactcccgggaaaccccgggggcgctttcctaatccgggagagccagactcggcgcggatcatactcactgagcgtgcgcctttcccgaccagcctcatgggatagaattagacactaccggattcactgtctggacaatgggtggctgtacatatcgcctcgtttgactttcccttctttacaggctctggtggaccattattctgaaggttggcctgctccctggcaggggtacacacctacctgcgattgtgccgaggacacaactcaactcgagcgcgctggtcagctgccaccagtattttag

SEQ ID NO: 206996 - DNA, 3840 bp, Artificial Sequence
  Description of Artificial Sequence: Synthetic coding sequence
atgaccctgaccgagcggctgcgggagaagatcagccgggccttctacaaccacgggctgctatgcgcatcttacccaattcccatcattctgttcacagggttttgcatcctagcatgctgctatcccctcttaaaactccccctgcccggtactggacccgttgagtttacaacacccgttaaagactacagtccacctccagtggattctgatagaaagcagggggagcctacagaacagccagagtggtatgtcggggcgccggtggcatatgtgcagcagatttttgtcaagtccagtgtgtttccctggcataaaaatctgttagccgttgacgtcttcaggagccctttgtcgcgagccttccagctggtcgaggagatcagaaaccacgtgctgagggacagtagcgggattagatccctggaagagttgtgtctgcaggtgaccgacctcctgccagggttacgaaaactgcgaaatcttctcccagagcatggctgcctcttacttagtcccggtaatttctggcaaaatgattgggagagattccacgccgacccagacattatcggcacaattcaccagcatgaacctaaaacattgcagaccagcgcaaccctcaaggatttgttgttcggggtcccaggaaaatactctggagtatctctctatactagaaagagaatggtcagctatacgatcaccctcgtgtttcaacattatcatgcaaagttcctagggagcttgcgcgcccgccttatgctgttgcacccttcacctaattgttcattaagggccgagtccctcgtgcatgtacatttcaaggaggaaataggcgtcgctgaactaattcccctcgtgactacctatatcattctgtttgcatacatctactttagtacacgcaagatcgatatggtcaaatctaaatggggcctcgcgctggcggctgtcgttacagtcctgtcatccctcctgatgagcgtcggcttgtgtacactttttgggctgaccccaaccttgaatggcggagagatcttcccgtatctggtggtggtgattggcttggagaatgtgctggtcctgactaaatcagttgtgtcgacccccgtggatttggaagtgaaattacggatcgcgcaaggcctgtcttcggaaagctggtctatcatgaaaaatatggctactgagctgggtatcattctcatcgggtatttcactttagtcccggcaattcaggaattctgcctgtttgctgtggtaggattggtgtctgacttctttctgcagatgctcttcttcaccaccgttctttccatagacatccgccgcatggagctagccgacctgaataaacggctgcccccagaggcgtgtctgcctagcgcgaaaccagttggtcagcccacaaggtatgagagacagctagccgtaaggccgagcacccctcatacaataactttacagcctagctcctttcggaacttacgactaccaaaacgcctaagagtcgtgtatttcctggctcggactcgcctggctcaaaggctcatcatggcggggacagtggtgtggatcggcatcctggtctataccgacccggcgggactgagaaattatttagccgcccaagtcacagagcaatcaccgctgggggaaggcgcgctcgcaccaatgccggtcccctcaggcatgctcccccctagccaccccgaccctgcctttagtatttttcccccagacgcgcctaaattgcccgaaaaccagacgtcaccaggtgaaagccccgagcgaggcggcccggcggaggtggtacatgattcgcccgtcccagaggtgacttggggaccggaagatgaggagctttggaggaagttgtcgtttagacactggccaacgctgttctcttactataatatcaccctggctaagagatacatttctttactcccagtgattccggtgactctgcggttgaatccaagggaggcattagagggtagacatccgcaggatggccgcagtgcttggccgcctccaggcccgataccagctggtcactgggaagcaggcccaaaaggaccaggtggagtgcaggcccacggcgatgtaaccttatacaaagttgcagctctggggctcgcaacgggcattgtcctcgtgctgctcctgctgtgcctttatcgcgtgctatgcccccggaactatggccaactcgggggcggccctgggaggcggaggagaggcgaactgccatgcgatgactacgggtacgctcctcctgagactgagatagttcctttggtgctgaggggacacctgatggatatcgaatgcctagcgtcagacggcatgttattagtcagttgttgccttgcaggacacgtgtgtgtctgggacgcacagacgggggattgtctcactaggataccacgcccaggacggcaacgtagggattcaggcgtgggcagcggactcgaggcccaggaaagctgggagaggctgagcgacggtggcaaagccggacccgaggaaccaggggactcccccccacttcgtcaccgcccccgaggccctcccccaccctcccttttcggcgaccaacccgatctgacctgtctcatagacacgaatttttctgcccagccccgtagctcacagcctactcagcccgaaccccgacaccgagcagtgtgtgggcgctctcgagacagtcccggctacgatttttcatgtctcgtgcagcgcgtgtaccaggaggaaggccttgccgctgtctgtacgcctgccttgcgaccaccttcaccaggtccagtattgtcacaagctcccgaagatgaggggggtagcccagagaaaggctccccttccttagcctgggcaccgtctgccgaaggtagcatttggtcccttgagctccagggaaatttaatcgttgtgggccgaagtagcggaagacttgaggtgtgggacgccatagagggcgtactgtgttgctcaagcgaggaagtctcctctggaattaccgccctggtgtttcttgataaaaggattgttgcggcccgtctgaatggatcactcgattttttttccctggagacccacacggccctgagccccctgcagttcagaggaacacctggcaggggtagttccccggcgagcccggtgtacagttctagtgacacagtggcttgccatctcacccatactgtaccctgtgcacaccagaaaccgattactgctttaaaagcagcagctggcaggctagtaaccggctcacaggaccataccctgcgcgtattcagactggaagacagctgctgcctgtttacattacagggtcacagtggggccatcaccactgtatacatcgaccaaacaatggtcctggctagcggaggccaggacggcgcaatctgcttgtgggatgtgttgacggggtctcgcgtcagtcatgtctttgctcacaggggcgacgtgacaagcttaacctgtactacctcctgtgtgatttcttcaggcctagacgacctgatcagtatttgggatcggtctaccggcattaagttttactccattcagcaggatctgggatgtggcgcctctttgggagtcattagcgataatttactcgtgacgggcggacagggctgcgtgagcttctgggatcttaactatggtgatctgctgcagaccgtgtatttggggaaaaattccgaggcccagcctgcgagacagatcctggtcctggataatgctgctatcgtttgcaatttcggcagtgaactgagcctggtttacgttccgtccgtgttggagaaattagattag

SEQ ID NO: 206997 - DNA, 2316 bp, Artificial Sequence
  Description of Artificial Sequence: Synthetic coding sequence
atgaccctgaccgagcggctgcgggagaagatcagccgggccttctacaatcacggcctgctgtgcgcctcataccctatccccatcatactttttaccgggttttgcattttggcctgctgttaccccctcctgaaactgccactccccggcacaggccctgtcgaatttacgacccctgtcaaagattactctcccccccccgtggactctgaccgcaaacagggtgaacccactgagcaacctgagtggtacgtcggagcaccagtagcctacgtccaacaaattttcgtcaagtcctccgtgtttccctggcataagaacctgctggccgtagacgtgttccgctctcctctatccagggccttccaacttgttgaagagatccgaaaccacgttctgagggatagtagcggcatccgaagccttgaggagctttgtttgcaagtgactgaccttctacctggcttaaggaagcttaggaatctgctacctgagcacgggtgtctactgctatctcctggcaatttctggcagaatgactgggaaaggttccatgccgaccccgatataatcggtaccatccatcagcacgagcccaagacattacagacctcagccacactgaaagacctgctgtttggagttcccggcaagtactcaggggtctctctgtatactcgcaaaagaatggtgagttacaccatcaccctggtctttcagcactatcatgccaagtttctagggagcctgcgcgcaagactcatgctgcttcatccttcccctaattgctcccttcgcgccgagagcttggtgcatgtgcacttcaaagaagagataggcgttgccgagctgatcccactggtgacaacttacatcattctttttgcatacatctatttttctacacgcaagatcgatatggtgaagtcaaaatggggtcttgctctcgctgctgtggtgacggtgttgagtagtttgctgatgtcagtcgggctctgtaccctgtttggcctgactccaacactgaatgggggggagatctttccatatcttgtggtggtcatcggactcgaaaacgtgctggtactaacaaaatcagtcgtgtccactcctgtcgacctggaggtgaaattgagaattgctcaggggctgtcaagcgaatcatggtcaatcatgaagaacatggcaacagagctcgggatcattctgattgggtattttactctggtcccagctatacaggagttttgtctgttcgcagtggtaggcctggtatcagatttttttctgcaaatgctgtttttcacaacagtgctcagcatcgatatcaggcgaatggagctcgctgacctgaacaaacgactacctccagaagcttgtcttccatccgctaaaccagtcggccaacctactcgttatgagcgaagctcaggccgtttggaagtgtgggatgccatcgaaggcgtgctgtgctgctcttccgaggaagtgagctcgggaattactgcactagtttttctggataaacgcatcgtggccgcgcggctgaacggatctcttgacttcttctccctggagacccataccgccttgtctcccctgcagttcagggggactcccggccgaggcagctccccagctagtccagtctattccagttctgacactgttgcttgtcacctgacacataccgttccctgtgctcaccagaagcctataaccgcgctcaaagcagcggccggacggctggtgacagggagtcaggaccacactctgcgcgtattccgactcgaggactcgtgctgtctgtttaccttgcaagggcacagcggggccatcaccaccgtttacattgatcaaaccatggtccttgccagtggcggacaagacggcgccatctgtctgtgggatgtactgactgggtcgcgggtctcccacgtgtttgcccatcgcggcgacgtcacctctctgacatgtacaacgagctgtgtcatttcctcggggctggatgatctcatttctatttgggatagatcaactggcattaagttctactctatccaacaagatttgggatgcggggcttcgctgggcgtaatctctgataaccttctggttacgggtgggcagggctgcgtgagcttctgggatctgaattatggagacctactgcagacagtttatttaggcaaaaactctgaagctcagccagctcgacagatcctcgtgttagataacgctgcgatagtgtgtaacttcggctcagagctctcactggtttacgtacctagcgtactggagaagctggactag

SEQ ID NO: 206998 - DNA, 2718 bp, Artificial Sequence
  Description of Artificial Sequence: Synthetic coding sequence
atgaccctgaccgagcggctgcgggagaagatcagccgggccttctataaccatgggctgttatgtgcctcttacccaatcccaattattctaattggctatttcaccctggttccagctattcaggaattctgcttgttcgctgtggttgggcttgtctctgacttttttctccaaatgctgttcttcacgactgttctgtcaatcgacatcagacggatggaacttgccgacctcaacaagcggcttccaccggaggcctgtttgccttctgcaaaacctgtcgggcagcctacacgttacgagcgccagcttgctgtccgtccctcaacgcctcacacgattacactgcagccttctagttttcgcaatctccgcttacctaaacggctgcgagtcgtttattttcttgctcgcaccagactagctcaacgactgatcatggctggcactgttgtctggattggtattctggtgtacacggatcctgcaggactccgaaattacttagcagctcaggttaccgaacaatcccctttgggagagggggctctggcaccaatgcccgtgcccagcgggatgctcccaccaagtcaccctgaccccgctttcagtattttccccccagacgcccctaagctgccagaaaatcaaacaagccctggcgaaagccccgaaagaggcggccccgctgaagtagtacacgactctcccgtcccagaggtgacgtggggaccagaggacgaagagctctggagaaagctcagtttcagacactggcctaccttgttttcctattacaatatcaccttggccaaacggtacataagcttgctccctgtgattcccgtaaccctacgtttaaacccccgggaggcactggagggcaggcatccccaggatggcagaagtgcttggccacctcctggtccgatccccgctggccactgggaggccggtcctaaaggtcccggaggagtgcaggcccacggcgacgttaccctgtataaggtagcagctctcgggctggctacaggaattgtgctggtgctgttacttctgtgtttatacagagtactgtgccctcgcaactatgggcagctgggcggaggacccgggagacgcagaagaggcgaactgccgtgcgacgactatggttacgctcctccggaaaccgagattgtcccactggtgttgagaggtcatctcatggacattgaatgtctcgccagcgatggtatgctgctagtgtcttgctgcctagccggacacgtctgcgtgtgggatgcgcagactggcgactgtctgactcgcataccaaggcctgggcagaggcgggacagcggcgttggcagtggcctggaggcccaggaaagttgggaacggttgtcagacggaggcaaggcggggccagaggagccaggggacagtccacctctgcgccaccgaccacgcgggcctcctcctccatccctcttcggtgatcaaccagacctaacatgcctgattgataccaatttttccgcccagccaaggagttcacagcctacacagcccgagccacgccacagagccgtgtgcggccgctccagagattccccaggctacgacttctcttgcctggtacagcgagtgtatcaggaagaggggctggctgctgtgtgtacacccgctctccgccctcccagccctgggccagtccttagccaagcccccgaggatgaaggtggaagccccgagaaaggtagcccctccctcgcgtgggccccctctgcagagggcagcatctggtcactggagctccaaggaaacctaatagtggttggcaggagctccggtaggctcgaagtgtgggacgctattgagggagtcctatgctgttccagtgaagaggtctctagtgggattacagccttagtcttcctcgataagcggatcgtcgccgcaaggctcaacggctccttagactttttttccttggagactcatactgccctgagcccattgcagttcagagggactccaggaagaggaagcagtcccgcaagccctgtgtactccagctctgacaccgtagcgtgccatctgactcacactgttccatgcgcgcaccaaaaacccatcacagctctgaaagctgccgctggccgactggtcaccggatctcaagaccacacattacgagttttcagattggaagacagttgttgcctttttacgttacagggccactctggcgccattaccactgtctatattgatcagaccatggtgctagcctctggaggtcaggacggcgcaatttgcctgtgggatgtcctgaccggctcgcgcgtgtcacacgtgttcgcgcacagaggcgacgtaaccagtttaacatgcaccacgtcttgcgtaatctcctccggactggacgacctgatatctatctgggacaggtcgactggcatcaagttctacagcatccagcaggacctcggctgcggagctagtctgggcgtcatttctgacaacctgctggttacaggcggtcaggggtgtgtgtcattttgggatctgaactacggggatctgctgcaaactgtctatctcggaaaaaactccgaagcccagcccgcaaggcagatcctagtcttagacaacgccgcaatcgtttgtaatttcggctctgagctgagtctggtatatgtgcctagcgttctggagaagcttgattag

SEQ ID NO: 206999 - DNA, 1059 bp, Artificial Sequence
  Description of Artificial Sequence: Synthetic coding sequence
atggtgaagagcaagtggggcctggccctggccgccgtggtgaccgttttatcttccctcttaatgtcagtgggattgtgcactctgttcggactcaccccaactctgaacggcggggagatctttccctatctagtcgtagttattggactggaaaatgtgcttgtactcacgaagtccgttgtctctacccctgtggacctagaagtcaaactgagaattgcgcagggattgtctagtgagtcctggtcaatcatgaaaaatatggccaccgaactcggcattatcctcatcggctacttcaccctggtgccggccatccaggagttttgtctctttgctgtcgtggggttggtgtccgacttctttctgcagatgctttttttcactaccgtgctgtctatagatatccgtcggatggaactcgctgacctgaacaagcgactgccccccgaggcgtgtctgccttcagcgaagccagtcggtcaaccgacacgatatgagcggcagctagcagtcaggccctctaccccccacaccatcacgctgcagccaagcagctttcggaatttgcgcctacctaagagactacgcgtcgtgtactttcttgcccctactggcgctcacacctgctgggccttagggtccaggactcagggaccgcgatggggagctggaccttggcgacgtcatgcagtacagggcggtggagcaggtcctggacaccgacatcggctgggagccgccgccgcgctccccctcccacgcgccatgcctgctcagctcagagccgcaggctggtgggctcgcgctgcagaagcgaggggcgcagcactccggaggcttagactttgtgctacacgagatggagaccgcgcggcttgtgctgcgagaccaccccacggtcaccgggttccgggccagcggcgccacgccgccggtgagctcctgccgggaaggccaagacttagggtgggtcgggccgatcgggggctgccaaacgcacattccgcaccccgacaggcagcacccggacaatggcgggggcagagagcctag

SEQ ID NO: 207000 - DNA, 411 bp, Artificial Sequence
  Description of Artificial Sequence: Synthetic coding sequence
atgaccctgaccgagcggctgcgggagaagatcagccgggccttctataatcacgggcttctgtgtgccagctatcctatccctatcatcctgtttacagggttttgcattctcgcttgttgttatccactcctcaagttgcctcttccaggcacggggccggtggagttcactacgcccgtgaaagattactcaccaccaccggtagacagtgataggaaacagggggagcctacagaacaacccgaatggtacgtcggagcccccgtggcctatgtgcagcagatcttcgtcaaatcctcagtttttccttggcacaagaacctgctggcagtggatgtctttcgctctccccttagcagagcgtttcagcttgtggaagagatcaggaaccacgtccttagagattag

SEQ ID NO: 207001 - DNA, 3072 bp, Artificial Sequence
  Description of Artificial Sequence: Synthetic coding sequence
atgctgctgcaccccagccccaactgcagcctgcgggccgagagcctagtgcatgtgcatttcaaggaggaaattggggtggccgaacttatccccctcgttactacctatattatcctgtttgcatatatatactttagcacccggaagatcgatatggtgaaaagcaagtgggggcttgctttagccgccgtggtgacagtactgagctcactactgatgtctgtggggctgtgcactttattcggactgactcctaccctgaatggaggtgagatttttccataccttgtcgtggtgatcggactggaaaacgtgctggtcctaaccaagagtgtggtctccactcccgtggacctcgaggtgaagttacgcatcgcccaggggctgagttctgaatcttggtctattatgaaaaatatggcaaccgagttgggtatcatccttattggctactttacactagtccctgcgatccaggagttctgcttatttgccgtggttggtctggtaagtgatttttttttgcagatgttgtttttcacaacggtgctctccattgatattcggcgcatggaactcgccgaccttaacaaacgcctgccacccgaagcgtgtctgcctagcgctaagcctgtagggcagcctactaggtacgagaggcaactggcggttcggcccagtactcctcataccatcaccctgcagccttcaagttttagaaatttacgcttgcccaagcgactaagagtggtgtactttttggctcgcacccgcctggcacagcgacttatcatggctggcaccgtggtctggatagggatactcgtgtatacagaccctgcaggactgcgcaactatctggcagcccaggtaacagaacagagccctctaggggagggagctttggcacccatgccagtgccaagtggaatgctacctccgagtcaccccgaccctgccttctcaatattcccccctgacgccccaaagctgcccgagaatcagacctcgccgggcgagtcccccgagcgtggcgggcccgcagaagtcgtgcatgacagccctgtgcccgaggtcacatggggccctgaggatgaggaactatggcgcaagctcagctttcggcactggcctaccctgttctcctactataatatcactctggccaaacgctatatcagcctgttgcctgtaattccagtcactctccggctcaaccccagggaggctctggaaggtcgccacccccaagacggtcgcagtgcctggcccccacccgggccaattcccgctgggcactgggaagcgggaccaaaggggccaggcggagttcaggcccacggggacgtgaccctctacaaagtggctgccttggggctcgccacaggaatcgtgcttgtgctgctcctgctgtgtctataccgagtgctgtgcccccgcaattacggtcagctcgggggcggacctggaagaagacgccggggagaactgccatgcgacgactatggatacgcccctccagaaactgagatcgtgcctctggtcctacgtgggcacttaatggatatcgaatgtctggcctccgatggaatgttgctggtcagctgttgtcttgctggtcatgtctgcgtttgggatgcccagacaggggattgcctgactcgaatcccacgtcccggacaacgtcgagattctggcgtgggctcgggcctcgaggcacaggaaagctgggagcggttgagcgatggcggtaaagccggacctgaagagcccggtgactccccccccctcaggcaccggcctaggggccccccccctcctagtctttttggggaccagcctgatctcacatgccttatcgatacgaacttctcagctcaacccagatcatcccaaccaacccagccggagccccgacatcgcgccgtatgcggacgaagccgcgattcccctggttacgacttctcatgtctcgtgcagcgagtctatcaggaagagggtctcgccgctgtgtgtacgcccgccctgaggcccccatcacctggacccgttctctcgcaagctcctgaggatgaagggggctcccccgagaaagggtctccatctctcgcatgggctccatcagccgaggggagcatctggagccttgaactgcagggtaacttgatcgttgtcggtcgttcttctggccggcttgaagtctgggacgccattgaaggagtgttatgctgttcttcagaagaagtgtctagtggaataactgccttggtcttcctggacaaacggattgtggccgcccgccttaacggatccctagacttctttagcctggaaacccataccgctctctccccgctgcaattccgggggacacccgggaggggatctagtcccgccagcccggtgtactcatccagcgatactgttgcatgccacctgacccatactgtgccatgcgcgcaccagaagcctatcactgctctcaaagcagctgctggccggctggtgaccgggtcacaggaccacaccttaagagtctttcgcctggaggactcgtgctgcctgtttactctccaggggcatagcggagctatcacgaccgtttatatcgatcaaaccatggtcctggcctctgggggtcaggatggggccatctgtctctgggatgtgctgactggctccagagtctcgcatgtgttcgcacataggggggatgtcacgtccttgacatgcacaaccagctgtgtgatcagtagcggtctggacgaccttattagcatttgggataggagtacgggcatcaaattttatagtatccagcaggatctaggttgtggcgcaagtcttggggttatttccgataatttactggtgaccgggggacagggatgtgtgtcattctgggacctgaactatggagacctgctgcagaccgtgtatctcggaaaaaattctgaagctcagcccgcaagacagatcctggtgctcgacaatgccgcaatcgtgtgcaatttcggatcggagctttctctcgtgtacgtacccagtgtgctggagaaactcgactag

SEQ ID NO: 207002 - DNA, 267 bp, Artificial Sequence
  Description of Artificial Sequence: Synthetic coding sequence
atgaccctgaccgagcggctgcgggagaagatcagccgggccttctacaatcatgggctgctgtgcgcttcctaccctattccaattatcctgttcactggattctgtatactggcttgttgttatccgcttctaaagctccctttgcccggaacaggccctgtggagttcaccacccctgtcaaggattactcaccaccaccagttgactctgacaggaagcaaggtgaaccaacggaacaacccgaatgggtgggaactcgatag

SEQ ID NO: 207003 - DNA, 399 bp, Artificial Sequence
  Description of Artificial Sequence: Synthetic coding sequence
atgaccctgaccgagcggctgcgggagaagatcagccgggccttctataaccacggacttttgtgcgcttcataccctattcccatcatattgtttactggcttctgtatactggcctgttgttaccccttgctgaaactcccgctgccagggactggacccgtggagttcacaacccccgtgaaggattactccccccctccagttgactcagataggaaacagggtgaacccaccgaacagcctgaatggtacgtcggggcaccagtggcctatgtgcagcaaattttcgtgaagtcaagcgtgttcccatggcacaaaaatttgctagccgtggatgttttccgctctcctctttcacgcgcatttcagctcgtcgaagagatcagaaatcactag

SEQ ID NO: 207004 - DNA, 2661 bp, Artificial Sequence
  Description of Artificial Sequence: Synthetic coding sequence
atgaagaacatggccaccgagctgggcatcatcctgatcggctacttcacgctagtgcccgctatccaggagttctgcctgtttgctgtggttggcctggtcagcgacttttttcttcagatgctgttctttactacagtattatcgatcgacatcagacggatggaattagctgacctgaacaagcgcctgccacccgaagcctgtctaccatccgcaaaaccagttggccagcccaccaggtatgagcggcagctcgctgtgagaccgtccacaccccataccatcacactccagcctagtagcttcagaaatctgcgcctgccaaaacgactcagagttgtgtacttcctcgcccgtactagacttgctcagaggctaattatggctggcactgtggtgtggatagggatcctggtctacaccgaccctgcaggcctccgcaactacttggccgcacaagtgaccgaacaatccccacttggtgaaggggccctcgcccccatgccggtgccaagtggtatgttacccccatcccacccggacccggccttttctatttttccccccgacgcacctaagctacccgagaatcagacctcacccggcgagtccccagaaaggggaggcccggctgaagttgtgcacgattcccctgtgcctgaggtgacatgggggccagaggacgaggagctgtggaggaagctgagtttccggcattggcccaccttgttcagttactataacattacgctggctaagaggtacattagtctattgcccgtcatcccggtcacactaagactaaatcctcgtgaggccctggaaggtagacaccctcaagacggccggtccgcctggccccccccaggtccaatccccgcgggtcattgggaggcaggtccaaagggaccaggcggggtacaggctcacggggacgtcaccctctataaagtcgctgcactgggactggccacaggcatcgttctggtcctcctcctactgtgcttatatcgcgtcctgtgccctaggaattacggccagcttggtgggggccccggccggcgccgcagaggcgagttgccttgtgatgactatgggtacgcaccccctgaaacagagatcgtgcctctcgtgctgagaggtcatttgatggacatcgagtgtttagccagcgatggcatgctgctcgtgagttgttgcctggcggggcacgtgtgcgtctgggacgctcagaccggagattgcctgactaggattccccggccaggacaaaggagggatagcggcgttggcagcggactggaggcgcaggaatcttgggagaggctaagcgacggaggtaaagcaggaccggaagagccgggggacagcccgcctctgaggcacagaccaaggggacccccacctccctcgctatttggagaccaacccgacttgacctgtcttatcgacacgaatttttctgcacagccacgttcctcccagccgacacagcccgaaccccgacaccgagccgtttgtgggcgctcacgtgattccccaggttatgacttcagttgcttagtacaaagagtgtatcaggaggaggggctggcagccgtgtgcacgccagctctccgaccccccagcccagggcctgtgttatcacaggcgcccgaagacgaggggggctcgcctgagaagggcagtccgagtctcgcatgggccccctcagccgagggttccatctggtctctggagctccagggcaatctgatagtcgtgggtcgaagttctggccgcctagaggtatgggatgccatcgagggagtgctgtgttgtagcagtgaagaagtcagtagtggaatcacggccctggtgttcctggacaaaagaattgtggctgcaaggcttaatggatcattggacttcttcagtctggagactcatactgcactgagccctctccagttccgtggtacacccgggagaggtagttctcctgcttcccctgtctactcctcgtctgacactgtggcgtgccacttaacccacaccgttccctgcgcccaccagaagccgattaccgccctcaaagccgcagcaggaagactggtcacagggagccaggaccatacgctgcgcgtcttccggctggaggattcttgctgcttgttcactcttcaggggcactccggggccatcacaactgtctacatcgatcaaaccatggtacttgcgtcaggagggcaggatggagcaatttgcctgtgggatgtcctaaccggttcccgtgtgtcacacgtattcgctcaccgcggcgatgtcaccagtctgacgtgtaccaccagctgcgttattagtagtggcctcgatgacctgatttccatttgggacagatcaacaggcatcaaattttactcaatccagcaggacctaggctgcggagccagcttaggggttatctccgataaccttctagtgacaggggggcaagggtgtgtgtctttctgggatctaaactatggcgacctgttgcagaccgtttatctggggaagaatagtgaagcgcagcctgcgagacagattctggtgctcgataacgccgccatcgtgtgtaacttcggaagtgagctctccctagtgtacgtgccctccgtgctcgaaaaactggactag

SEQ ID NO: 207005 - DNA, 792 bp, Artificial Sequence
  Description of Artificial Sequence: Synthetic coding sequence
atgctgctggcctgggtgcaggccttcctggtgagcaacatgctgcttgctgaagcctatgggtcaggcggatgcttttgggacaatggtcatttataccgggaggatcagacctcgcctgctccagggctgaggtgtctcaactggttagacgcccagtctggactggcgtcagcgccagttagtggagccgggaaccacagctattgccgcaacccagacgaagacccccgggggccctggtgctatgtttccggcgaggccggcgtgccggaaaagaggccctgcgaagatcttcgctgccccgaaaccaccagtcaggccctccccgccttcactaccgagatccaggaagcttcagagggccccggagcagatgaggtccaggtgttcgcccctgcaaatgccctcccggcacgtagcgaggccgctgctgtacagcctgtaattggaatctcccaacgagtgcggatgaactcaaaagagaagaaggatctcggaaccctagggtatgttcttggcatcactatgatggtcatcatcatagccatcggtgccggtattatcctgggatatagctacaaaagggggaaggacctgaaagagcagcacgaccaaaaggtttgtgagcgcgagatgcaaagaatcacactccccctgtctgcatttaccaaccctacttgtgaaatcgtcgacgaaaagactgttgtcgtgcatacatcacagacaccggtcgatccacaagaaggcacaacaccactgatgggacaggctggtacacctggtgcctag

SEQ ID NO: 207006 - DNA, 1176 bp, Artificial Sequence
  Description of Artificial Sequence: Synthetic coding sequence
atgtacagcatgatgatggagaccgacctgcacagccccggcggcgcacaagccccaacgaatcttagcggacccgccggggcagggggagggggcggaggaggaggcggcggtggtggcgggggcggggcgaaagcaaaccaagatcgagttaagagacccatgaatgcattcatggtgtggagtcgcgggcagagaaggaaaatggcgcaggaaaaccctaaaatgcacaatagcgaaatatctaaacggcttggtgcagaatggaaagtgatgagcgaggctgagaaaagaccatttattgatgaagcaaagaggctgcgagccctgcatatgaaggagcacccagattataaatacagacccaggcgcaaaaccaaaacactgctcaaaaaggataaatattccctggcgggtggacttcttgcggcgggtgctggtggagggggcgctgccgtggctatgggggtaggggtgggcgtaggcgccgccgccgttggtcagagactcgaatccccgggtggtgctgccggagggggatacgcccatgttaatggctgggctaacggggcataccccggcagtgtggcagccgccgcagcagctgctgcgatgatgcaggaggcccaattggcatatggccagcaccctggagccggaggcgcacaccctcacgctcaccccgcccatccccatcctcaccaccctcatgcccacccacacaatcctcagccaatgcaccgctacgacatgggggccttgcaatacagcccgatttcaaactcccagggatatatgtcagcttcaccgagtggctatggaggcctgccatatggcgccgcggctgcagctgccgcggcagctggcggagctcatcagaactcagctgtggccgctgccgctgctgcagcggctgcctcctccggggccctgggcgcacttggatctttggtgaagagtgagccatccggctcacccccagccccagctcattcccgggccccgtgtcctggggaccttcgggaaatgatcagcatgtacctcccagctggcgaagggggcgatcctgccgctgcggccgccgctgccgcccagagtagattgcattctctgccccagcactaccagggggcaggggccggtgtgaacggaaccgtgccgctcactcatatatag

SEQ ID NO: 207007 - DNA, 1326 bp, Artificial Sequence
  Description of Artificial Sequence: Synthetic coding sequence
atggtgcagcaggccgagagcctggaggccgagagcaacctgcccagagaagcattagataccgaggaaggcgagttcatggcttgtagcccagtggccctggacgagtccgatcccgactggtgtaagacagcaagcggccatatcaagcggcccatgaatgcatttatggtgtggagcaaaattgaacgaagaaagatcatggagcaaagtccagacatgcacaacgctgagatcagtaaaagactcgggaagcgctggaagatgcttaaagactccgagaagatccccttcatacgggaagccgagagactgagactgaaacacatggcggattaccccgattataagtaccgcccccgcaagaaacccaagatggatcctagtgctaagccatccgcatcccagtcccctgagaagtctgcggcaggtgggggcggcggatcggccggcggcggagccggcggggccaagacgtctaaagggtcttccaagaaatgcggcaaacttaaagcacccgcagcggctggcgcgaaggcgggagccggcaaggcagctcagagtggtgattacggcggggctggtgatgactatgtccttggctcactgcgggtcagcgggtctggcggggggggtgccggcaaaactgtcaaatgtgtgtttctggacgaggacgatgacgacgacgacgacgacgatgaactccagctgcagattaagcaggagcctgacgaggaggatgaggagcccccccaccagcagcttctccagccacccggacagcagccgtctcagctgctgaggcggtacaatgtcgctaaagtgcccgcttccccaacactgagcagctcagccgaaagccctgagggggcttctttatacgatgaggtccgagccggggcaacatccggcgctgggggtgggtcccgactttactactcttttaaaaacataactaaacagcatccaccacccctagctcagcctgccttgtcccctgcctcttccaggtccgtcagcacaagcagtagctcatccagcggcagcagctccgggtcttcgggtgaagatgctgacgatttaatgttcgacctctcgctgaacttttctcagtctgctcattctgcgagcgaacagcagctcggcggcggagccgccgctggaaacctgtccctcagtctggtcgacaaggacttggatagtttctcagaaggcagtcttggctctcattttgagttccctgactattgcacgccagaattaagcgaaatgatagcaggcgactggctcgaagcaaacttcagcgatcttgtgttcacatattag

SEQ ID NO: 207008 - DNA, 948 bp, Artificial Sequence
  Description of Artificial Sequence: Synthetic coding sequence
atggtgcagcagcggggcgcccgggccaagcgggacggcggccccccaccgcccggccctggaccggccgaagaaggagcccgggagcctgggtggtgtaaaacacctagtggccatatcaaaagacctatgaatgcattcatggtgtggtcccagcacgaacgacgaaagatcatggatcaatggccagacatgcacaacgctgaaatctccaaacgcttaggaagaagatggcagctcctccaggacagcgagaagattccattcgtgcgcgaggcggagaggttgagattaaagcatatggctgactatccagattacaagtacagacccaggaagaagagcaagggcgcaccagcgaaagcacggccgagaccccctggaggcagtggcgggggatcgagactgaagccaggaccacagctgcccggacggggagggcgcagagcggccggcgggcctctcggaggcggagcagcagccccagaggacgacgatgaggatgacgacgaggagctgctagaggtgagattggtagaaacaccggggagagagctgtggcgcatggtccctgccggcagggccgcaagaggccaggccgaacgagcccagggaccgtcaggggagggggctgctgccgcagctgcagcttcacccactcctagcgaggacgaggagcctgaggaagaggaagaagaagccgccgccgccgaggaaggggaagaagagaccgtagcttcaggcgaggagtccctaggcttcctctcgaggctcccccccgggccagcaggtttggattgctctgctctggatagagacccggacctgcagcccccctccggaacatcccacttcgagttccctgactattgtacacccgaagtgacggagatgatcgcaggtgattggaggccctcttctatagccgatctggtattcacatactag

SEQ ID NO: 207009 - DNA, 948 bp, Artificial Sequence
  Description of Artificial Sequence: Synthetic coding sequence
atggtgcagcagcggggcgcccgggccaagcgggacggcggccccccacctccggggcccggaccagccgaggaaggggctcgcgagccaggctggtgcaagaccccatctggccacatcaaacggcctatgaacgcttttatggtgtggtctcagcacgagagaaggaagattatggaccagtggcctgacatgcacaacgctgagatctccaagaggcttggcaggcgctggcaactgcttcaggattccgaaaagattcctttcgtcagagaagccgagcggctccgacttaagcatatggccgattatcccgactataaatacagacctcgcaagaagtctaaaggagccccagccaaagcaagaccacgcccacctggaggtagcggcggcggctcgcgactgaaacccggacctcagttgccagggagaggtggccgacgggctgccggaggtcccctgggggggggtgcagccgcccctgaggacgacgatgaggatgacgacgaggaactcctggaagtgagactggttgaaacaccaggccgtgaactgtggcgtatggtgccagctggtagagctgccagaggtcaggccgagagagcccagggaccaagcggagagggcgcagcagccgctgcagcagcatctcccactccatctgaggacgaggagcccgaagaagaggaagaggaagcagccgccgcagaagaaggcgaggaggaaaccgtcgctagtggtgaagagtcacttggcttcctaagtaggctgccaccgggcccagcaggactggattgctcagctctcgatagggatcccgacctacagccaccttccggcactagccactttgaatttcccgattattgcaccccagaggtgaccgaaatgatcgccggtgactggagaccatcctcaattgcagatctcgtgtttacatactag

SEQ ID NO: 207010 - DNA, 1869 bp, Artificial Sequence
  Description of Artificial Sequence: Synthetic coding sequence
atgagcatgcggagccccatcagcgcccagctggccctggacggcgtcgggacgatggtgaactgcacaatcaaatccgaggagaaaaaggaaccttgccatgaggccccccagggctccgcaacggctgccgaaccccagccaggagaccctgcccgcgcctctcaagacagtgcagacccccaggcccccgcccaggggaatttcagaggcagctgggattgctcaagtccggaaggtaacgggtcacctgagcctaagcgacctggagtctccgaggcagcttccggaagccaggagaagctagatttcaatcggaatttgaaagaggtcgtgccagccatcgagaaactgctgtcgagcgactggaaagagagattcttagggagaaactccatggaagccaaagatgtcaaaggcacccaggaatctctggccgagaaggagctgcagttattggtgatgattcaccagttgtccaccttgagggaccagctgttaacggcacattctgaacagaaaaacatggctgcaatgttgttcgagaagcagcaacagcagatggagttggctcggcagcagcaagagcagatagccaagcaacagcagcagctcatccagcaacaacacaaaatcaatctcctgcaacagcagatccagcaggtgaatatgccttatgtcatgatcccagcttttccgccaagccatcagcccttgccagtaactcccgactcacagctcgctctaccaatccagccaattccttgcaaaccagtggagtaccctttgcagctattacacagtcccccagctcccgtcgtgaagcgccccggcgctatggcgacacaccaccccctccaagaaccgagccagccactcaatctgactgcgaagccaaaagcaccagagcttcccaacacgtcgtcttctcctagcctgaagatgtcaagctgtgtcccacggcctcctagccacggaggccctacgcgagatctccagtcttcccctcccagtttgcctctaggtttcctgggagaaggcgacgctgttacaaaggcaattcaggacgctaggcagctactgcatagtcatagcggtgctctggacgggtccccaaatacaccgttccggaaagacctgatctcactcgactctagccccgcgaaagagaggctagaggatggatgtgtgcaccccctagaagaagctatgttgtcttgcgacatggacgggtccaggcatttcccagagagtcgtaattcatcccatattaaaaggccgatgaacgccttcatggtatgggcaaaggacgagcggcggaaaatcctgcaggccttccccgatatgcacaatagttctatatctaagatcctcggatcaagatggaaaagtatgacaaaccaggaaaagcagccatattacgaggagcaggcgcgcctgtccagacaacacctcgaaaagtatcccgattacaagtataagccccgcccaaaaaggacttgcatcgttgagggcaagcgcctccgggtaggcgagtacaaggcgctcatgcgtacacggcgccaagatgctcgccagagctatgttattccacctcaagccggccaggtgcaaatgagctcctctgacgtcctctatccacgggctgccgggatgccactggctcagccactggtagagcactatgtgccgcggtcgctggacccaaatatgcctgtgattgtcaatacctgttccctgagggaggagggcgaggggactgatgatcggcactccgtggccgacggcgaaatgtaccgatattctgaagacgaagacagcgagggggaggaaaagagtgacggagagctagtagttcttaccgactag

SEQ ID NO: 207011 - DNA, 174 bp, Artificial Sequence
  Description of Artificial Sequence: Synthetic coding sequence
atgagcatgcggagccccatcagcgcccagctggccctggacggcgtaggtacgatggtgaactgcactatcaagagcgaggagaaaaaggagccttgtcacgaagcaccacagggcagtgccactgcagccgagccccagccgggggacccagcaagagctagccaggattag

SEQ ID NO: 207012 - DNA, 543 bp, Artificial Sequence
  Description of Artificial Sequence: Synthetic coding sequence
atgagcatgcggagccccatcagcgcccagctggccctggacggcgtcggaactatggttaattgcacaatcaaatccgaggagaaaaaagagccctgtcacgaagcccctcaaggatctgccaccgctgccgaacctcaaccaggcgatcccgctcgggcaagtcaggacagcgctgacccacaagctcctgcgcagggaaacttccgggggtcctgggattgttcttcccctgaaggaaatggatcccctgagcccaaacgcccgggcgtttcagaggccgcctcagggagccaagagaagctggatttcaataggaatctcaaagaagtggtccccgctattgagaaactgctgtctagcgactggaaggaaagattcctggggcggaattctatggaggccaaggatgtcaaagggactcaggagtcattggccgaaaaggaactccaactgttagtcatgatccaccaacttagtacactcagagaccagcttctgactgcccattcggagcagaagaatatggccgccatgctatag

SEQ ID NO: 207013 - DNA, 723 bp, Artificial Sequence
  Description of Artificial Sequence: Synthetic coding sequence
atgagcaagcccagcgaccacatcaagcggcccatgaacgccttcatggtatggtcacgcggccagcggcgtaaaatggctcaggaaaatcctaaaatgcataactccgaaatcagtaagagattaggtgcggaatggaagctgttgtcagaggccgagaagcgtccctatattgatgaggccaaaagacttagagcccagcatatgaaagagcaccccgattacaagtacagaccccgaagaaaaccaaaaaatctgctgaagaaagatagatacgtttttccactaccttatctcggggacaccgaccctttgaaggccgccggacttcctgtcggtgcttctgacggactacttagcgcaccagagaaggcgcgcgcattcctgccgcctgcctcagcaccctactccctgcttgatcccgcacagttcagctcatccgccatacaaaagatgggagaggtaccccacacactggccaccggcgccctcccctatgcctctactttaggatatcagaacggcgcctttggtagtttgtcatgtccgtctcagcacacgcatactcatccttctccaacaaacccaggttacgtcgtcccatgtaattgtacggcgtggtccgcaagcacgttgcagcctccggtggcttatatactcttccctgggatgacaaaaacaggcattgatccctactcaagcgcccatgctacagccatgtag

SEQ ID NO: 207014 - DNA, 702 bp, Artificial Sequence
  Description of Artificial Sequence: Synthetic coding sequence
atggccctgcccggcagcagccaggaccaggcctggagcctggagccccctgccgcaacagccgcagcgagtagtagctccggcccacaggaacgtgaaggcgctggtagtcccgccgcacctggtactctcccactggaaaaagtcaagagaccgatgaacgcttttatggtttggagcagtgcccagaggagacagatggcgcagcagaatccgaaaatgcacaactctgagattagcaagcgtctgggtgcgcagtggaaactgctagatgaggatgaaaagcgcccctttgtagaggaggcgaaaaggctgcgggcgaggcatctgcgtgactatccggactacaaataccgccctcgacgcaaagccaaatcctccggggcagggccgtccaggtgcggccagggtcggggtaacctggcctccggagggccactctgggggccaggatacgccactactcagccctcacgaggcttcggttaccgccctccatcatattctactgcgtacttgcccggaagctatggcagtagccactgtaagctcgaagctccatccccttgtagcctgccccaaagcgatcctcgcttacagggggagctactcccgacttatacgcactacctgcctcctggtagtcccaccccttacaatccccctctcgcaggcgcccctatgcccctcacacacctctag

SEQ ID NO: 207015 - DNA, 702 bp, Artificial Sequence
  Description of Artificial Sequence: Synthetic coding sequence
atggccctgcccggcagcagccaggaccaggcctggagcctggagcctccagccgccacagctgccgcttcctcttcttcagggccccaagaaagggagggggccggctcacctgctgccccaggcacactaccccttgaaaaagtcaaaagacctatgaatgctttcatggtttggtcctcagcccagcggaggcagatggcacaacagaatcccaagatgcataattcggaaattagcaaaaggctgggagcacaatggaagttgctggacgaggacgagaagaggccgtttgtagaggaggctaagcggctcagagccagacaccttagagactaccccgactacaagtatagaccacgccgcaaagccaaatcttcaggggccggtccctcccgttgcggccagggcaggggcaacctagcatcagggggcccattgtggggcccaggatacgcaaccacacagccatctaggggatttggatataggccacccagctactccacagcctacctcccaggctcctatggctcgtcccactgcaaattggaagcacctagtccatgtagtcttccgcaatctgaccctcggctccaaggtgagctgctgcccacatatactcactatctgccccccgggagtcccaccccttacaatcctccccttgctggagcaccaatgcctctgacacacttatag

SEQ ID NO: 207016 - DNA, 1245 bp, Artificial Sequence
  Description of Artificial Sequence: Synthetic coding sequence
atgagcagccccgacgccggctacgccagcgacgaccagagccagacccagagtgcactgcccgcagtgatggcaggactcggaccctgtccatgggcagaatcactgagtcctatcggcgacatgaaggtgaaaggagaggcaccggcaaattcaggcgcacctgcaggggcagcaggccgcgccaagggcgaaagccggatcaggcggccgatgaacgctttcatggtctgggccaaggacgagaggaagaggctagcacagcagaatcccgatctgcataacgcagaactgagcaaaatgctgggcaagtcctggaaagcactgaccttggcagaaaagcgccccttcgtggaggaggcagaacgcctgagggtgcagcacatgcaggatcatcctaattacaagtatcgcccaagaaggagaaagcaagtgaagcggctgaagagggtagaaggcgggttcctgcacggactcgcagagccacaggccgctgccctcggccccgaaggggggcgggtggccatggatggtctcggcttgcagttccccgagcaggggtttcctgcagggccccccttgttaccgccacacatgggtggccactatcgcgattgccagagcctgggcgcccctcccctagacgggtatccgttgcctacacccgacacctcccccctcgacggagttgaccctgatccggcatttttcgcggctcctatgcccggggattgccctgccgcaggaacctattcatacgcccaggtgtccgattacgcggggccccctgagccacccgccgggcctatgcacccacgcttgggccctgagcccgctggccccagcatccctggtctgctggcccccccttctgccctgcatgtttactacggcgccatgggctcacctggcgccgggggaggacgcgggtttcagatgcagccccagcaccagcaccagcaccagcaccagcaccatccaccggggcccggacagccgtcgcctccaccagaagcactaccatgtagagacgggactgacccttctcagccagctgaactgctcggcgaagtggataggactgagtttgagcagtacttacacttcgtgtgtaaacccgagatgggccttccttatcaggggcacgattccggtgtgaacctgcctgattcccacggcgctatcagttctgtggtttccgacgcgtcttcggccgtctactactgcaactacccagacgtttag

SEQ ID NO: 207017 - DNA, 1155 bp, Artificial Sequence
  Description of Artificial Sequence: Synthetic coding sequence
atgcagcggagcccccccggctacggcgcccaggacgacccccccgcccggcgcgactgtgcatgggcacccggccacggagctgcagcagataccagagggctcgccgccgggcccgcagccttagccgcacctgccgctccagctagccctccaagtccccaacggtcgccgcccaggtcccccgagcccggaagatacggtctgtcccctgctggaagaggagagagacaggccgccgatgaatcacggatccgtcgcccaatgaacgcattcatggtatgggctaaagacgagcgtaagcgcctggcacagcaaaaccctgatttacacaacgccgttttgtctaagatgcttggaaaagcatggaaagaacttaacgcagccgaaaagcgacccttcgtagaggaggccgagcggttaagggtgcagcacctgcgtgaccatcccaactacaagtatcggccccgaagaaagaagcaagcgcggaaggccaggcggcttgagcccggtctgctgcttcccggactggcccctccacagcctccacccgaacccttcccggcagcttctggctcagccagagcttttagagagctgccgccactgggcgcagaattcgatggcttaggacttcctactcccgaacggtcaccactcgacggattggagcctggagaagcagccttcttccctcccccagcagcaccggaagattgcgcactgcggcccttccgggctccttatgcaccaactgaattgagccgggacccaggaggatgctatggggcgccgcttgccgaggcgctgcgaaccgcacctcctgccgcacccctggccggcctctactatggaacactggggaccccaggtccatatccaggtcccctgtccccaccaccagaggcccccccattggaatctgctgaacctctgggtcctgccgctgatctgtgggcagacgtggatctcacagagtttgatcagtacctgaattgctcaagaacccgacccgatgcgccggggcttccctaccacgtggccctcgcaaaacttggtcctcgagcaatgagttgccctgaagagagtagcttgatcagcgcactgtcggacgctagttctgccgtgtactactctgcttgtatcagtgggtag

SEQ ID NO: 207018 - DNA, 831 bp, Artificial Sequence
  Description of Artificial Sequence: Synthetic coding sequence
atgagcaagcccgtggaccacgtgaagcggcccatgaacgccttcatggtctggtcaagggcgcaacggcggaagatggctcaggaaaatccaaagatgcacaactccgagatcagtaagcggctcggggctgaatggaagctgcttaccgagagcgagaagcgcccttttatcgacgaagctaagaggctccgtgcgatgcacatgaaggagcacccagactacaagtacagacctaggagaaagccgaaaaccctgctaaagaaagacaaattcgcatttccggtgccctacggtttgggaggagtggcagatgctgagcatcccgccctcaaggcaggagccggtctgcacgccggggccggaggcgggctggtccccgaatcattgcttgctaatccagagaaggccgccgccgcggctgcggctgctgctgccagagtgtttttcccgcagtcagcggccgccgccgcggctgcagccgctgcagcggcagcgggcagcccatactcactcctcgacctcggatcaaaaatggccgaaatttcatccagcagcagcgggctcccttacgcttcctctctggggtacccgacagccggggccggagccttccacggggcagccgcagcagctgcagcagccgctgccgccgccgggggccacacccacagccatccttcacctggtaacccaggatacatgataccttgcaactgcagcgcatggccctctccgggtttgcagccccccctcgcttacatcctgttgccaggtatggggaagccacagctggacccctaccctgccgcatatgcagcagcgctctag

SEQ ID NO: 207019 - DNA, 1341 bp, Artificial Sequence
  Description of Artificial Sequence: Synthetic coding sequence
atgcggcccgtgcgggagaacagcagcggcgcccggagcccccgggtgccagctgatctggcacgatccatcttaatatctctgcccttccctccagatagcctcgcacaccgccctccatcgtctgctccaacggaaagtcaaggactgttcacagtggccgcgcccgcccccggagcaccttctccacccgccactctggcccacctcttacctgcccctgctatgtacagcttactcgagactgagctcaaaaacccagtggggacgccgactcaggccgcaggaaccggcggcccagccgccccagggggggctgggaaatcgtctgcaaatgctgccggtggcgcaaatagcgggggaggcagttcaggcggggcctcaggaggcggtgggggtactgaccaggatagagtgaagaggcccatgaatgcgttcatggtgtggtctcggggacagcgcaggaaaatggctctggagaaccctaaaatgcacaactcggagatctctaagagactgggtgccgattggaaactccttacggatgcagagaaaaggccatttattgatgaagcaaaacggttgcgtgccgtgcacatgaaggagtaccctgactacaaataccggccaagacgcaaaaccaagactctcctgaaaaaagacaagtattctctgccttctggtctgttgccccccggggctgcggcggcggcagcagcagccgccgccgcagctgcggccgctagtagccctgtaggggtcggccagcggcttgatacctatactcatgtcaacggctgggcaaacggggcatactcattggtacaagagcagttgggctacgcccaacctccttcaatgtcctctcctccccctccccctgcactcccaccgatgcatcgttacgacatggcagggctccagtatagccccatgatgcccccaggcgcccagtcctatatgaacgtcgctgctgctgcagcagcggcgagcggttacggaggaatggcaccatctgctactgcagctgcagcggctgcctacggtcaacagcctgctaccgccgccgccgccgcagcagccgccgccgcgatgtccctcgggcccatggggagtgtcgtgaaaagcgagccgtcatcaccgccccctgccattgctagccactctcagcgcgcctgccttggtgacctgcgcgacatgattagtatgtatctccctcctggcggggacgcagcagacgccgctagccccctgcctgggggtcggctccacggagtccatcaacactatcagggtgccgggaccgctgtaaacgggacagtccctctgacacatatctag

SEQ ID NO: 207020 - DNA, 2253 bp, Artificial Sequence
  Description of Artificial Sequence: Synthetic coding sequence
atgagcagcaagcggcccgccagcccctacggcgaggccgacggcgaggtcgcgatggttacatcaagacagaaggtcgaagaggaggagagtgatggattacctgccttccatcttcccttacatgtgagttttcccaataagccccattctgaggaattccagcctgtttctctcctcacacaagagacatgcggtcacagaacgcctacttctcagcataacactatggaagtagatggtaacaaggttatgtctagcttcgcaccgcacaatagctcaacctctccccaaaaggccgaggaaggcggcaggcagtctggggaatccctgtcctccaccgctttagggacccctgagaggaggaaaggatcccttgctgatgtcgttgacaccctcaagcagaggaaaatggaggaactaattaaaaatgaaccagaagagaccccctccattgagaaacttctaagcaaggattggaaggataagcttctagcaatgggaagtggcaacttcggagaaatcaaaggaacccccgagtctctggccgaaaaggaaagacagctcatgggcatgattaaccaattgacttctttacgagaacagcttctcgccgctcatgacgaacaaaaaaagcttgctgcatctcaaattgagaagcagcggcaacaaatggagctggccaaacagcagcaggagcaaattgctcgtcagcagcagcagctgttacagcaacagcataaaattaacctgttacagcagcagatccaagtgcaaggacagctcccccccctgatgatcccagtcttcccgccagaccagaggacactggctgcagccgcgcagcagggattccttctgccccccggcttctcctataaggccggttgcagtgacccatatcccgtccagctgatccctaccaccatggctgcagccgccgctgcaacccctggactgggccccctccagctgcagcagttgtacgctgcccagttagctgctatgcaggtaagccccgggggtaaactccccggtatcccccagggcaatctgggagctgcagtgtctcccacttctattcacacagacaaatcaaccaactctccacccccgaagagcaaggatgaggtagcccaaccactgaatctgtcagcaaagccaaagacaagtgacggaaagtcaccaacgtcaccaacaagtcctcatatgcccgctctgaggatcaattcgggggcgggccctctgaaagcttcggttcctgctgcgctagcatctcccagcgctcgggtgagcaccatcggctacttaaacgaccatgatgccgtcactaaagccattcaggaggctcgccaaatgaaggagcaactgcgacgggagcaacaggtgctcgacggcaaggtagccgtcgttaatagtttgggccttaacaattgcaggacggaaaaagaaaagacaacgctggagtcccttacacagcagctggccgtgaaacaaaacgaagaaggcaagttctcccatgctatgatggatttcaatctatctggcgatagcgacgggagtgcgggcgtgagtgagtcccgtatctatcgggagagccggggacggggatcgaacgaaccccacatcaagaggccaatgaacgcctttatggtctgggccaaagacgagagacgaaaaatactgcaagccttcccggacatgcacaactccaatatctccaaaatcttgggctcaagatggaaggccatgacaaatctggagaaacagccctattacgaagaacaggccagactgtcaaagcagcatctcgaaaagtaccccgattacaaatacaagcctcgccccaagcggacctgcctcgtggacggcaaaaagcttagaattggagagtacaaggcaatcatgcgcaaccggcgacaggagatgcggcagtacttcaacgtcgggcagcaggcccagattcctatagccacggctggggtagtctatcccggcgctatagctatggccgggatgccttccccacatttaccctccgagcactcttctgtctcatctagcccggagccagggatgccggttattcaaagcacatacggagtcaagggagaggagccacacatcaaagaggagatacaggccgaagacatcaatggagagatctacgatgagtacgacgaagaggaggatgatcctgatgtcgattatgggagcgattctgaaaaccacatagcaggtcaagccaactag

SEQ ID NO: 207021 - DNA, 1929 bp, Artificial Sequence
  Description of Artificial Sequence: Synthetic coding sequence
atgagcagcaagcggcccgccagcccctacggcgaggccgacggcgaagtcgcaatggtgactagtagacagaaggtagaagaggaggagtctgacgggcttccagccttccacttgcccctacacgtgagcttcccgaataagccccactctgaagagttccaacctgtgtcccttttgactcaggaaacatgcgggcacaggactcccacttctcagcacaacacaatggaggtggatgggaacaaagtgatgtccagcttcgcacctcataatagctccacaagtccccagaaggctgaggaggggggccggcagtctggggagtctctttcgagtaccgcactaggcaccccagaacgcaggaagggcagcctggccgacgtcgttgataccctcaaacagcgtaagatggaagagttgattaagaatgagccagaggagacaccaagcattgagaaactgctgtcaaaggattggaaggataagctactggctatgggatctggaaatttcggagaaattaaagggacacctgagtccctggccgagaaagaaagacagttaatggggatgatcaatcagcttacctctcttagagagcagttgttagcagcgcacgacgaacagaagaaactcgccgccagccaaatagagaaacaaaggcagcagatggagctcgcaaaacagcagcaggaacagatcgcgcgtcaacagcagcagctgttacagcagcagcacaaaattaatctgttgcagcagcagatccaggttcagggtcagctaccgcctctgatgattcccgtgtttcctcccgaccaacgcacattagctgctgccgcccagcaaggatttttactgccccccggctttagctacaaagccggctgttcagacccgtacccagtgcagctaattcctactactatggcggccgctgcagccgccacccctggtctcgggcccctgcaacttcagcaactgtatgctgcccagctagccgccatgcaggtttcccctggtggaaaattaccaggcatcccccagggcaatcttggcgctgcagtatccccaaccagcatccatacagacaaatccactaactcacccccccctaagtctaaggagaagacaaccctggagagtttgacacagcagctggccgtgaagcagaatgaagaaggaaaattcagccatgctatgatggactttaatttgtccggggacagtgacggtagtgctggagtatcagagagccggatataccgagaaagccgcgggagaggctctaatgaaccccatataaaaagacctatgaacgcctttatggtgtgggctaaggatgaacgaaggaaaatcctccaggccttccctgacatgcacaattccaatatttccaagattctgggaagtagatggaaagctatgactaatttggagaaacagccctactatgaagaacaggctcggctgtccaaacagcaccttgagaagtatcccgattacaagtataaaccgcggcctaagcgcacttgcttagtggatggtaaaaagctgcggatcggcgagtacaaagctatcatgcggaatcgccgtcaagagatgcgccagtacttcaacgtcggccagcaggctcagattcccatcgctacagctggggtcgtttacccgggcgctatagcaatggccgggatgccctctccacatcttccgagtgagcacagctcagtcagcagttcgcctgagccgggcatgcctgtcatccagagcacatatggagtcaagggcgaagagccacacattaaggaagaaatacaggctgaggatatcaacggggagatttacgacgagtacgatgaggaagaggatgacccagatgtggattatgggtctgattccgaaaaccatattgccgggcaggcaaattag

SEQ ID NO: 207022 - DNA, 1134 bp, Artificial Sequence
  Description of Artificial Sequence: Synthetic coding sequence
atgcacgacgaggtggcccagcccctgaacctgagcgccaagcccaagacatctgacggaaagtctcctacctccccaacctccccacacatgcccgcccttagaatcaattccggagcaggaccactcaaggcctctgttccagcggctcttgcatctccatcagctagggtgagcacgatcggatacctgaatgatcacgacgcagtgacgaaagccattcaagaagcccgccagatgaaagagcaattgagacgagaacaacaagtcttggacgggaaggtagccgtagtcaatagtctggggctcaacaactgtagaaccgaaaaagagaaaaccaccttggagagcctgacgcagcagcttgcggtgaagcagaacgaagaggggaagttctcccacgcgatgatggattttaacctcagcggtgacagtgacggatccgcaggggtgagcgagagccggatataccgcgagtccagaggccgcggcagtaacgaaccccatattaaacggcctatgaacgccttcatggtctgggccaaagacgaaaggcgcaaaattctacaggcctttcctgacatgcacaactctaacatctctaaaattcttggctccagatggaaagccatgactaacctggagaagcagccatattacgaagagcaggcaaggctctcaaagcagcacctggagaagtaccccgactacaagtataaaccccggcccaagcgtacatgcttagtagatggaaaaaagctgcggataggcgagtataaggcaatcatgcgtaacagacggcaggaaatgcgacagtactttaacgtaggtcagcaggcgcagattcctattgcaaccgccggtgtagtttatcctggcgccatagccatggcaggcatgccctctccacacctcccgtcagagcacagcagcgtttcaagctctccggaacctggaatgccggtgatccaaagcacgtacggtgtcaagggcgaagagccgcacattaaagaagagatccaagctgaggacataaacggcgaaatctatgatgaatacgacgaggaggaagacgatcctgatgtcgattacggcagcgattctgagaaccatatagcagggcaggctaattag

SEQ ID NO: 207023 - DNA, 1764 bp, Artificial Sequence
  Description of Artificial Sequence: Synthetic coding sequence
atgagcagcaagcggcccgccagcccctacggcgaggccgacggcgaggtggctatggtgaccagtcgccagaaagttgaggaggaggagagtgacgggcttcctgccttccacttacccctgcatgaggttgatgggaacaaggtaatgagtagcttcgctccccacaacagctcaacctcaccacagaaggcagaagagggagggcggcagtccggagagtccttgtccagtacagcccttggaacccctgagagaaggaagggctcccttgctgatgtggtcgacactttaaagcagcgaaagatggaagagctgatcaaaaacgaacctgaggagaccccaagcatcgagaaactgctgtctaaggactggaaggataagctgctcgctatgggcagcggaaacttcggcgaaattaaaggcacgccagaaagcttggccgaaaaggagagacagttaatgggcatgatcaatcagctcacttcccttagggagcagcttctggcagcccatgatgagcaaaaaaaactcgcggcttcccagattgaaaaacaaaggcagcagatggaacttgccaaacaacagcaggagcagatcgcccgtcagcaacagcagttgctgcagcaacagcataagataaacttgcttcaacagcagatccaagtgcagggacaactgccacccctgatgatcccagtcttccccccagatcagcggactctagccgccgccgcgcagcagggctttcttctgcctcccggattctcctataaggcggggtgcagcgacccttaccctgttcagttaatccctacaacaatggctgccgccgcagcagcaacgcccgggctcggaccgttgcagctccaacagctctacgccgctcagctcgccgcaatgcaagtatcaccgggcggcaagctgcccggaattcctcagggtaacctgggagcagcagtaagcccaactagtatccatacagacaagtcaactaactctccaccccctaagtcaaaggacgaggtagcccaacccttgaatctctctgccaaacctaaaaccagcgacggcaagtcaccgaccagccccacgagcccacatatgcctgcgctgcgcatcaattcgggcgctgggcccttgaaagcatccgtgcccgccgccctcgcttcacccagtgctcgggtttcaaccatcggatacctgaatgatcacgatgccgtcactaaggcaattcaggaggctcgccaaatgaaagaacaactgcggcgcgaacagcaggtgcttgacggtaaggtggccgtagtaaactcccttggcctcaataactgccggactgagaaagagaaaactaccttggagtccctcacccagcagttggcggtgaaacagaacgaggagggcaagttctcccacgccatgatggatttcaacctcagcggggactctgatgggagcgcaggggtgtccgagtcccgcatctaccgcgaaagccgtggccgcggctcgaatgaaccccatataaagagacccatgaacgccttcatggtttgggcgaaagatgaacgccgcaagatcctacaagcttttccggacctgggatttctgtgcgtttgtatgtacgttatcatggttcttatcatagggataacgctcgatcattgcgagctaaatccacatttgggaatgaaatcacacatcctgccctccgactggtctaggaataacctggatcttgatttcgcacttcagatgactacctag

SEQ ID NO: 207024 - DNA, 2292 bp, Artificial Sequence
  Description of Artificial Sequence: Synthetic coding sequence
atgctgaccgaccccgacctgccccaggagttcgagcggatgagcagcaaacgccccgccagtccttacggcgaagccgatggcgaagtagccatggtcacgtctagacagaaggtagaggaagaggaaagcgacgggctccccgcatttcatttgcctctgcacgtgagctttcccaacaagccacactctgaggagttccaacctgtgtcactgctgactcaggagacttgtggccaccgcactccgaccagccagcataacactatggaagtcgacgggaataaggtcatgtcctcatttgcacctcataattcgtccacctccccacagaaggcggaggaaggcggaagacagtccggtgagagcctgagttccacagctctgggcacccctgagaggaggaaaggatccctggctgacgttgtcgatacacttaaacagaggaaaatggaggaactcataaagaatgagcctgaggaaactccctcaattgaaaagcttctcagtaaggattggaaggataaactgctcgccatggggagcgggaatttcggggagatcaagggaactccagagtcacttgcagagaaggagcggcagctgatgggtatgatcaatcagctcacctccctacgcgagcagctattggcggcccatgatgagcagaagaagctggcagcctcccagattgaaaagcagaggcagcagatggaattggcgaagcagcagcaggaacagatcgctcgtcagcagcagcaactgttgcagcagcagcataaaatcaatctcctgcaacagcagatccaggtgcaaggccagctgcctcctctgatgatccctgtgttcccccccgaccagaggaccctggctgccgcagctcagcaggggtttctactgcctcccggcttctcttataaggccgggtgttctgacccatatcccgtgcagctgatccctacaaccatggcggcggctgctgccgctaccccaggccttggtccactgcagttgcagcagctgtatgccgcccagctagcagccatgcaagtctcgcctggcggcaaactgcccggcataccacagggcaatctgggagcggcggtctccccaacatcaattcacaccgacaagagcaccaattccccccctcctaaaagtaaggacgaagtggcccagccacttaatttgagtgccaagccaaaaacctctgacggtaaaagcccaaccagtcccactagtcctcatatgccggctctccggattaactcaggcgctggccctcttaaggccagcgttccagctgcactggcatctcctagtgcgagagtctccactatcgggtatctgaacgaccatgatgcagtgacaaaggccattcaagaagctagacagatgaaggaacagctgagaagggaacagcaggtccttgacgggaaggttgctgtggtgaactccctgggcctgaacaattgcagaacagagaaagagaagacaacgcttgaatctctgacgcagcaactagctgtgaaacaaaatgaggagggtaagttttcccatgccatgatggacttcaacctatccggagactccgatggctcagcgggcgtatctgaatcgaggatttacagagaatcacgcggtagaggctctaatgagcctcacatcaagcggcccatgaacgccttcatggtatgggcaaaggatgaaaggcgcaaaattcttcaggcgttccctgacatgcataattccaatatcagcaagatactcggcagccgctggaaggcgatgacaaacttggagaagcagccctactatgaagaacaggcaaggctgagcaagcagcacctggaaaaatatcccgattataagtacaagccaagaccaaagaggacttgtttggttgatgggaagaagctaagaattggcgaatacaaggcaatcatgagaaataggagacaagaaatgagacagtattttaatgtgggacagcaggcccagatccccattgcgaccgccggtgttgtataccctggagccatcgcgatggccgggatgcctagcccacaccttccctcggagcattcttccgtgtcttctagtcctgagccaggcatgccggtcatccaatccacctacggcgtcaagggcgaagagccccacattaaggaggaaatccaggccgaagatatcaatggagagatatatgatgaatacgatgaggaagaggacgacccagatgttgactacggctcggatagcgagaatcatatagccggacaggccaattag

SEQ ID NO: 207025 - DNA, 1929 bp, Artificial Sequence
  Description of Artificial Sequence: Synthetic coding sequence
atgagcagcaagcggcccgccagcccctacggcgaggccgacggcgaagttgctatggtgactagtaggcagaaggtggaggaggaggaatctgatgggctgccggccttccacctgcctctccacgtgtcgttccctaacaaaccacactcagaagagttccagcctgtaagtctgctaacccaggagacctgtggtcacaggacaccgacttcacagcataataccatggaagtggacgggaataaggttatgtcctcattcgcaccgcacaactcaagcacatctcctcagaaagctgaggagggcggtaggcagtctggcgagagcctgagttccacagctctggggaccccagagcgtagaaagggctctctcgcggatgtggtggacactctcaagcagcgcaagatggaggagttgatcaagaatgaacctgaggaaaccccgagcatcgaaaagttgctatcaaaagattggaaagacaaactgctggctatgggaagtggaaatttcggggagattaaggggacccctgagtctctggccgaaaaggagcgtcagttgatgggcatgattaatcagctgacatcactgagggagcagctgctagccgcccacgacgagcagaagaaactagctgcttctcaaatcgagaagcagaggcagcagatggagctcgccaaacagcagcaagaacaaatcgcgcgtcagcaacaacagcttttgcagcagcaacataaaataaatttgctgcaacagcaaattcaagtgcaaggccagcttcctcctctgatgattcctgtttttccccccgatcagagaacactcgctgctgcggcacagcagggattcttgttaccacccggtttttcatacaaggcagggtgctctgacccctatccagttcagctgatccccacgactatggccgccgctgccgccgctactcccgggctgggccccttgcagttacagcagttgtatgccgcccaactagccgcaatgcaagtgagccctggcgggaagctgcccggaattccacaaggcaatcttggggccgccgtcagcccgactagcatacacacggacaaatcaacgaacagcccaccccctaaatccaaagagaagacaaccttagagagtcttactcagcagctggccgtcaagcagaatgaggagggaaagttctcccacgctatgatggactttaatcttagcggcgattcagacggctcagccggcgtctctgagagccggatctatcgcgaatctcgggggagaggttcaaacgaacctcatatcaaaaggccgatgaatgctttcatggtctgggcgaaagatgagcgtcggaagatccttcaggctttccctgacatgcacaactctaacatttcaaaaatcctaggatcccgatggaaagccatgaccaacctggagaaacagccttactatgaggaacaggccagactgtccaagcagcatctggaaaagtaccctgactacaagtataagcctcgcccgaagagaacttgcctggtggacggaaagaagctgcggattggggagtacaaggccattatgcggaaccggcgacaagagatgaggcagtattttaatgttggccagcaagcacagatcccaattgctacagccggagtcgtgtatcctggcgccatcgcgatggctggtatgccctcacctcatctgccatcagaacatagctctgtgtctagcagtcctgagccagggatgccagtgattcaatctacatatggcgtgaagggggaagaaccccatattaaagaggagattcaggctgaggatattaacggcgaaatatacgatgagtacgatgaagaggaggatgacccggatgtggactacggcagtgactccgaaaaccatatcgcagggcaagctaactag

SEQ ID NO: 207026 - DNA, 2253 bp, Artificial Sequence
  Description of Artificial Sequence: Synthetic coding sequence
atgagcagcaagcggcccgccagcccctacggcgaggccgacggcgaggtggcaatggtgacctccaggcagaaagtggaggaggaagagtccgatggcctgccggcttttcacctgcccttacatgtctcctttcctaacaaaccccattccgaggagtttcaacctgtgagtctgttgactcaagaaacctgcggccatcgaacaccaacctctcaacataacaccatggaagtcgacgggaataaggtcatgtctagctttgccccacacaacagctcgacaagtccacaaaaagccgaagagggaggacgccagtctggtgaatctctgagcagtaccgccctgggcacccctgagaggcgaaaaggttcactggctgatgtggtggatacactgaaacagcgcaaaatggaggaactgatcaaaaatgagccagaagagacaccaagcatcgaaaagctgctgagtaaggattggaaggacaagctcctggccatgggctcaggcaacttcggagagattaagggaactcctgaaagtctggccgagaaggagaggcagcttatggggatgatcaaccagctgaccagcctgagagagcagttgctggctgcccacgacgagcagaaaaagctggccgcatcacagatcgagaagcaaagacagcaaatggagctcgcaaagcaacaacaagagcagattgcaagacagcagcagcaactcctgcagcaacagcataagatcaacttactgcaacagcagatacaggtgcagggacagttgcctccccttatgatccctgtattcccacctgatcagagaactttggccgctgctgctcagcaggggttccttcttcctccgggcttttcatacaaggccgggtgttcggatccttaccctgtgcagctcatcccaacaaccatggctgcagcagccgctgccactccaggtctgggacctctgcagctccagcaattgtacgctgcccagctggcggccatgcaggtgtcacctggcgggaagctgcctggcatcccgcagggcaacctgggtgccgcagtttctccaacctcaattcatacggataaatcaaccaattcaccacccccaaagtccaaggacgaagttgctcagcctctcaatctgtccgcgaagcccaaaactagtgatggaaagtcacctactagtccgacctctccccacatgccagctctgcggattaactccggagccgggccgctgaaagcctccgtccccgccgcccttgcctccccaagtgcccgcgtcagtaccatcgggtacctgaacgatcatgatgcggtcactaaggcaattcaggaggctagacagatgaaggaacagctccgtagagagcaacaagtgctagacggtaaggtggctgtggtgaactcccttggactgaacaattgcaggactgaaaaggagaagacaacattagaatcactcacccaacagctggccgtgaaacagaatgaggagggcaagttttcacacgctatgatggactttaacctgtctggtgactcggacgggtccgcaggagtgagcgagtctcgaatctaccgggagtccagaggccggggctccaacgaaccccatataaaacggcctatgaacgcgttcatggtctgggctaaagacgagcgcaggaaaatcttacaggccttccctgacatgcataacagcaatatcagtaagattttgggatctcgctggaaagcaatgaccaatctcgagaaacagccttactacgaagagcaggcccgtctgtccaaacagcatctggagaaatatcccgactacaagtataagcctaggcccaagcggacatgcctggttgacgggaaaaaacttaggattggggagtataaagctatcatgagaaatcgcagacaggaaatgcggcagtacttcaatgtgggtcagcaagcccagattccaatagctaccgcaggtgtcgtctaccccggcgcgatagccatggcgggtatgcccagcccacacttgccgagtgaacacagttccgtaagcagcagcccagagcctggtatgccagtgatccagtcaacttatggcgtgaagggcgaagagccccacattaaagaagaaatccaagcagaggatattaacggcgaaatatacgatgagtatgacgaggaggaagacgaccccgatgttgactatggaagtgatagcgagaatcatattgccggtcaggccaactag

SEQ ID NO: 207027 - DNA, 2427 bp, Artificial Sequence
  Description of Artificial Sequence: Synthetic coding sequence
atgagcagcaagcaggccaccagccccttcgcctgcgccgccgacggcgaagatgctatgacccaggatcttacctcgcgcgaaaaagaggagggatccgaccagcacgtggccagtcatcttcccctgcacccaatcatgcacaacaagcctcactccgaagaactgcccacactcgtttcaactattcagcaggatgctgactgggactctgtgttgtcgtcacagcagagaatggaatctgagaacaataagctgtgctccttatatagtttcaggaatacatccaccagtccccataagccagacgaaggtagtagggaccgcgagatcatgacgtcggtgacttttggtactcctgagagacggaaaggatcccttgctgacgtcgtagatacgctgaaacagaagaagctggaggagatgacgcgcaccgaacaggaggattcttcctgtatggaaaagctcctgagtaaggattggaaggagaaaatggagaggttaaatacgagcgaattactgggtgagataaaggggactccggagtccctggcagaaaaagagaggcagcttagcactatgattacacagctgatttccttgcgggagcagctgttagcagctcatgacgagcagaagaaactcgccgctagccagattgaaaaacagcggcaacaaatggatctggcccgccagcagcaggagcagattgcgcggcagcagcaacagctgctacaacagcagcacaaaatcaatttgctgcaacagcagattcaggtacagggccacatgcccccacttatgatcccaattttcccacacgatcagaggacgttggccgctgccgcagcagcccaacaggggtttctgttcccacctggaatcacctacaagcctggggacaactaccccgtccaatttatcccatctacgatggccgccgccgccgcgagtggcctgtcccctctgcagttacagaagggacacgtgagtcacccacaaatcaaccaaagattaaagggactcagcgatcgattcggacgaaacttggacacttttgagcacggaggaggtcactcctataaccacaaacagattgaacagctgtatgcagcacagctcgcttcaatgcaggtttctcccggcgcgaagatgcctagcactccacagccacctaacacagctggcacggtctcacccactgggatcaagaacgaaaagcgcgggacctcaccagtaacccaagtcaaggacgaggcagcagctcagcctttaaacctttcttctcgacccaaaacagctgagccagtaaagtctccaacctcccctacccagaatctgtttccagcctcaaagacctcacctgtgaacttgcccaacaagtcaagcatcccttctcccatcggtgggagtctgggtaggggctcaagcctcgacatactgagcagtttaaactcccccgcattgtttggggaccaggacacagtgatgaaggccatacaggaggcacgtaaaatgagagagcagatacagagagagcagcagcaacagcagccacatggtgttgatggtaagctatctagcataaataacatgggtttgaattcctgcaggaacgagaaagaacggactagatttgagaacctgggccctcagctgaccggaaaatctaacgaggacggcaagttaggcccaggggttatcgatttgacgaggcccgaagacgcagagggaggagctaccgtagctgaagcccgcgtgtaccgagacgctcgtggacgcgctagcagcgagccgcacatcaagcgccctatgaatgcgtttatggtgtgggccaaagacgagcgccggaagatcctccaggcgtttcctgacatgcataactcgaatattagcaaaatattaggtagccgttggaagtcgatgagcaatcaggaaaagcaaccttactatgaagaacaggccaggctgagcaaaatacatctggaaaaataccccaactacaagtacaaaccaaggcccaagagaacatgcatagtggatgggaagaagttacgtataggggaatacaaacagctgatgaggtcgcgtcgccaggagatgagacagttcttcaccgtcgggcagcagcctcagatccccatcaccaccgggactggcgtggtttaccctggtgctattactatggccacaaccacacccagtcctcagatgactagcgattgtagttccactagcgcatcgcccgagccctcactgcctgtgatccaatctacttacggaatgaagactgatggtggaagtcttgcgggaaacgagatgattaacggagaggacgagatggaaatgtacgatgactacgaagatgatccaaagtccgactacagctctgagaacgaggcccctgaagccgtgagcgccaactag

SEQ ID NO: 207028 - DNA, 2487 bp, Artificial Sequence
  Description of Artificial Sequence: Synthetic coding sequence
atgagcagcaagcaggccaccagccccttcgcctgcgccgccgacggggaggacgctatgacacaggatttaacctctagagagaaagaggaaggcagcgaccaacacgtagcctcccacttacccctacatccaatcatgcataacaagccacatagcgaggagctccccacgctcgtctccaccatacagcaggacgcagattgggacagcgtgttgtctagccaacagcgcatggagagcgagaataataaactgtgtagcctctactctttcaggaacactagtacctcgcctcacaagccagacgaaggctcgagggaccgggaaataatgacaagtgtgacatttggtacccccgaacgcaggaaggggagtctggccgacgtggtggatacactgaaacaaaagaagctcgaagaaatgaccaggacggagcaggaggatagcagttgcatggaaaaactcctttccaaggactggaaagaaaagatggagagactgaataccagtgaactgctcggtgaaattaagggtactcccgaaagtcttgcagagaaggagaggcaactgtccaccatgatcacacagctcatcagcctgcgggagcagctgttagctgctcacgacgaacagaaaaagcttgcagccagtcagatagagaaacagagacagcaaatggacctcgcgaggcaacagcaggaacaaatcgcgcgacagcagcaacagctgctccagcagcagcacaaaatcaatctccttcaacagcagatacaggttcaaggccatatgcccccccttatgattcccatcttccctcacgaccagcgcaccctcgcagcagctgctgcagcacagcagggattcttgtttcccccaggcattacgtataagccaggggacaattacccggttcagttcattcctagcaccatggctgccgccgcagctagtgggctctcacccctgcagttgcagaaaggccacgtgtctcacccacagattaatcagcgcctaaaaggcttgtcggatagattcggaaggaatttggatactttcgaacatggcgggggacactcttacaaccataagcagatcgagcaactgtacgccgctcagctcgcgtccatgcaggtcagtcccggagccaaaatgccttccaccccccagcctcctaataccgctggtactgtatccccaactggcattaagaatgagaagcgggggacttcccctgttacccaagtcaaagacgaagcggctgctcagccactgaatctcagctccaggcctaagaccgccgagccagtgaagtccccaacctctcccacacagaatctgttccctgctagcaagacatccccggtaaatcttcccaacaaaagttctattccatcaccgattggcggctccctggggaggggctcatctctcgatatcctttcctccttgaattccccggccctgtttggagatcaggacacggtaatgaaggctatccaggaggccagaaagatgcgggaacagatacagcgggagcagcaacagcagcagccacacggtgtggacggaaaactgagctcaatcaataatatggggcttaactcttgtcggaacgagaaagagcgcactagatttgagaatctgggcccacaacttacaggaaaatccaatgaggacgggaagttgggccctggcgtcattgacctgactagaccagaggacgccgaggggtctaaagccatgaatggatcagcagcgaagttgcaacagtactattgttggccaaccggtggcgctacagtcgcggaagcccgggtttatagagacgcccgtggcagagcatcatccgagccacacatcaaacgcccaatgaacgcattcatggtttgggctaaggatgaacgcaggaagatcctgcaagcatttcccgacatgcacaacagtaatatatccaagatattgggatccaggtggaagtcaatgtcaaaccaggagaaacaaccatattacgaggagcaggccagactgtccaagattcatctggaaaagtatcccaactataagtataagccacggcctaaacgcacttgtattgtggatggaaagaagctgagaatcggagagtataaacagctgatgagatctcgcaggcaggaaatgagacagttttttactgttgggcagcagccacagattcctatcacgacaggaactggcgtggtttatccgggcgccattacaatggcaactacaacaccgagcccacagatgacctccgattgttccagcacctctgccagccctgagccctctttgccagtgatccaatccacatacgggatgaagacagatggcggctccctcgccggcaatgaaatgatcaacggcgaagacgaaatggagatgtacgacgactacgaggacgaccctaagtcggattacagctccgagaatgaggcaccagaggcggtgagtgcaaactag

SEQ ID NO: 207029 - DNA, 2427 bp, Artificial Sequence
  Description of Artificial Sequence: Synthetic coding sequence
atgagcagcaagcaggccaccagccccttcgcctgcgccgccgacggagaggatgctatgacacaggatttaactagtcgagagaaggaagagggaagcgatcagcatgttgccagtcacctgccattacacccaattatgcacaacaaaccgcatagtgaagagctccctacacttgtgtccactatccagcaagatgcagactgggacagcgtactctcatctcaacaacggatggaatccgaaaataacaaactgtgttcattgtattctttccgtaataccagcacttccccccacaagcctgacgaggggagtcgcgatcgtgagattatgaccagcgttactttcggaacccccgagcgtcgcaaagggtctcttgcagatgtggtggacacattgaagcaaaaaaaactggaggagatgactagaaccgagcaggaggacagttcgtgcatggaaaaactcctttctaaagactggaaagagaagatggagcgactgaacacatccgaattattgggagaaatcaaggggactccagagtcgttagcggaaaaggagagacagttgagcaccatgattacacagcttattagcttgagggaacagcttctagcggcacatgacgagcaaaaaaagctggctgcctctcaaattgagaaacagaggcaacagatggatttggcgagacaacaacaagagcagatcgccagacagcagcagcaactgctacagcagcaacacaaaattaatctgctgcaacagcagatccaggtgcagggacatatgcctccgcttatgatcccaatctttccccacgatcagcgcaccctggctgccgctgcagcggcacaacaagggttcctgtttccgcccggtatcacctacaaaccaggagataactatccagtgcagttcatcccgagcaccatggcggcagcggccgcttcggggctgtctccgctgcaactgcagaaaggacatgtcagccatcctcagattaatcagcgcttgaaaggactgtctgacaggttcgggcggaatctcgacaccttcgagcatgggggagggcattcatataaccacaagcagatcgagcaactgtacgcagcacagctggcctccatgcaggttagcccaggagcaaaaatgccttcgacaccccagcctcctaatactgccgggacggtgtctcccaccggcatcaaaaacgaaaagcgagggaccagccccgtgacccaggtcaaggatgaagccgccgcccagcctctgaatctttcctcgaggccgaaaacagccgagcccgtgaagtctccaacttcaccaacccagaacctgttcccggcctccaaaacttctcctgtgaacctgccaaacaagtctagcatcccgagcccgatcgggggctccctcgggcggggatctagccttgatattctctcttcactgaactctccagcactctttggggatcaggataccgtgatgaaagcaattcaagaggcacggaagatgcgcgaacagatccagcgtgaacagcagcaacagcagccgcatggcgttgatggaaagctatccagcatcaataacatggggctgaatagctgcaggaatgaaaaggagaggacgcgctttgagaatcttgggcctcagctgaccggcaagagcaacgaggacggtaagctagggcctggcgtgattgacttaactcgtccagaggatgcagagggtggcgctacagtggcggaagcccgtgtgtatcgagatgcgaggggacgcgcgagttcagaaccccatattaaacggccaatgaacgctttcatggtgtgggccaaagatgagcggagaaagattctgcaagctttccccgatatgcataactccaatatcagcaagatcttggggtctcgctggaagagcatgagcaatcaggagaagcagccctattatgaggagcaagcccggctcagcaaaattcatttggaaaagtaccctaactacaagtataagcctcgccctaaacgaacatgcatcgtggatgggaaaaagctgagaataggcgagtataaacagctaatgcggtcccggagacaggagatgagacagttttttacagttggtcagcagccccagatccctatcaccaccgggacaggtgttgtatacccgggggccatcacgatggcaactaccacccctagcccccaaatgacttccgattgctccagcaccagcgcttctccagagccgagcctgcccgtgatccagagcacctatggcatgaagacagatgggggaagcttggccggtaatgaaatgattaacggcgaagatgagatggaaatgtacgacgactacgaggatgaccctaagtcagattatagctccgagaatgaggcacccgaggctgtcagtgctaactag

SEQ ID NO: 207030 - DNA, 420 bp, Artificial Sequence
  Description of Artificial Sequence: Synthetic coding sequence
atgagcagcaagcaggccaccagccccttcgcctgcgccgccgacggagaagacgctatgactcaggatctgacgtcgcgcgagaaagaagaaggcagtgaccagcacgtggcgagccacctgccactgcacccaatcatgcataacaagccccattcagaggaactgccaacattggtctcaacaatacagcaggatgccgattgggactccgtattgtcatcgcagcaacgcatggagtcagaaaataacaaactgtgcagcctctattcctttcgcaatacgagcacaagcccacataagccggacgaagggtctagagatagggagattatgactagtgtgacctttgggacacccgagcggagaaagggcagcctagccgacgtcgtagacactttgaaacagaaaaagctgtag

SEQ ID NO: 207031 - DNA, 2406 bp, Artificial Sequence
  Description of Artificial Sequence: Synthetic coding sequence
atgagcagcaagcaggccaccagccccttcgcctgcgccgccgacggggaggacgccatgactcaggacctgacatctcgggagaaagaagaggggagcgaccagcacgtcgcaagccatctgcctttgcaccctatcatgcataataaaccgcactctgaagagctgccgacattggtttctactatccagcaggatgcagattgggatagtgtactctcaagtcagcagcgcatggagtccgaaaacaataagttatgcagcctgtacagcttcagaaatacctcaacgagcccccacaagccagatgagggttccagagatagggaaattatgacatccgtgacattcggcacccccgagcgtagaaagggtagcctcgcagacgtggtggatactctgaaacaaaaaaagctggaggaaatgacaaggaccgaacaggaagactccagctgtatggagaagttattgagcaaggactggaaggagaaaatggagaggcttaatacatctgagctactaggggagattaaagggacgccagaatctcttgccgagaaagagagacagctgtctacaatgataacacagctcataagcctgagggagcagctactggccgcccacgacgaacagaagaagttagcggcaagccagattgagaaacagcggcagcagatggatcttgctcgccaacagcaagagcagatcgctaggcagcaacagcagctcttgcagcagcagcacaaaatcaatctgctgcagcagcagatacaggtgcaaggccacatgccgcctcttatgatccccatcttcccccatgaccagcgtaccctggctgccgcagcggctgcacagcagggatttctgttcccccccggaatcacgtacaagcccggtgacaactacccagtgcaatttatcccttccacaatggccgccgcagccgcatcaggtttatctcccctgcagttacagcaactatacgccgcccagttggccagtatgcaggtgagccctggcgccaaaatgccttcgacacctcaacctccaaacaccgcggggacagtttctccaaccggaattaaaaatgaaaagcggggcacgagtccagtgacacaggtcaaggacgaggcagccgcccaacccttaaacctgtcctctagacctaaaaccgcagaacccgtcaagtcccccacttccccaacccaaaatctctttcccgcctctaaaacatcccccgttaacctccccaacaagtctagcattccaagccctatcgggggctctcttggcagaggttcgtcgctgggaaagtggaaatctcagcaccaggaggagacgtacgagcttgacatcctgtcttctctgaattcccctgccctcttcggggatcaggacacagtgatgaaagccatccaagaagcgaggaagatgcgtgagcagattcagagggaacagcagcaacagcagccacatggagtggatggtaaactgagctcaattaacaatatggggctgaattcatgccgaaatgagaaggaacgcacaagattcgagaatctcggtccacagctgacaggaaaaagcaacgaggacggaaagctcggaccaggcgtcatagacctcaccagacccgaggacgcagagggctcaaaggccatgaacggtagtgctgccaagcttcaacaatattactgctggcctaccggaggtgcaaccgtggcagaagcccgcgtctatagagatgcccggggcagagcttcttccgagccccatattaagcgccccatgaatgcgttcatggtatgggccaaggacgaacgccggaaaatcctgcaagcttttcctgatatgcataattccaacattagcaagatcctcggcagccgatggaaaagcatgagtaaccaggagaagcagccttactatgaggagcaggcacgtctgagtaaaatacacctcgagaaatacccgaactacaagtacaaacctcgacccaagcgaacctgtatcgtggacggtaagaagctccggattggtgagtataaacaactgatgcgatctaggcgacaagaaatgcggcagttcttcacagtgggtcaacagccgcagatacccataacaactggcacgggcgtcgtttatcctggagctattactatggccacgactactccctccccccaaatgacctcagactgcagctccacctccgcctcgcctgaacccagcctacccgtgatccagagtacctatggcatgaaaactgacggggggagcttagcaggtaatgagatgatcaacggcgaggatgagatggaaatgtacgatgattatgaagacgatcccaagtctgattacagctctgagaacgaggcccctgaagccgtttcagcaaactag

SEQ ID NO: 207032 - DNA, 2487 bp, Artificial Sequence
  Description of Artificial Sequence: Synthetic coding sequence
atgagcagcaagcaggccaccagccccttcgcctgcgccgccgacggtgaggacgccatgactcaggacttaacaagcagagaaaaggaggaaggcagcgatcagcatgtcgcttcccacctgccactacatcctatcatgcacaataagcctcattcagaagagcttccaacactggttagcacgatccagcaagacgccgactgggactcagtgttatcaagccagcagcgtatggaatccgagaataataagctatgctctctgtattctttccgaaatacgtccacctcgccacacaagcctgatgaaggcagccgggaccgagagattatgacttctgttacgttcggcacccctgagaggagaaaaggaagcctcgccgatgtagttgatacgctcaagcagaaaaaacttgaggaaatgacccggacagagcaggaggattcatcttgtatggaaaaactgcttagcaaggactggaaggagaaaatggaaagactaaatacgagtgagttgctgggtgaaatcaagggcactccagaatcccttgctgagaaagagcgccaactaagtacaatgattactcagcttatcagcctccgggaacaactcctggctgcacacgacgaacagaagaaacttgcagcctctcagattgagaagcagcgccagcagatggacttggcgaggcagcagcaggagcagatagctcgacagcagcagcaactgctccaacagcagcataagattaacctgttgcagcagcagatacaagtccagggacacatgccaccccttatgattccgatcttccctcatgaccagaggacgctcgccgccgccgctgccgctcagcagggcttccttttcccacccggcatcacatataagccaggtgacaactaccctgtccagtttataccatccactatggccgccgcggccgccagtggcctaagtccgctgcaactgcagaaaggacacgtctcacaccctcagatcaaccagagactgaaaggcctgagtgacaggttcggtagaaatttggacacattcgagcacggcggcggacactcatataaccataagcaaattgagcaactgtatgcagctcagttagctagcatgcaggtgtctccaggcgccaagatgccatctacaccccaaccgcccaatacagcaggcactgtgagtccaaccggtattaagaacgaaaagagaggcacaagtccagtcacacaggtgaaagatgaagcagcggcccagccgctaaacctgtcctccagacccaaaactgctgagcccgtgaagtcccccaccagtcccacacagaacttatttcctgctagcaagacctccccagtgaacctgcctaataaatccagcatacccagtccaatcggcggttccctgggcaggggttcctcattggatattctgagcagtctgaatagccctgccctgttcggagaccaagacaccgttatgaaggcaatccaagaagcacgaaaaatgcgtgagcagattcagcgcgaacagcagcagcagcagccccatggcgtcgatgggaagttgtctagcatcaataacatgggtctgaattcttgccgcaacgagaaagaacgaacccgcttcgaaaaccttggcccgcagctgacaggcaaatccaatgaagatggtaaactgggtcctggcgtcatcgatcttacgcgccctgaagatgcggaaggttccaaagctatgaacggctccgcggctaaactgcagcagtattactgctggccaacaggaggagcaacagttgccgaggctagagtctatagggacgcgcgaggacgagcttccagtgaaccgcatatcaagcggccgatgaacgcattcatggtctgggctaaagatgaaagacgcaaaatcttacaggcttttccagacatgcacaactctaacattagcaagatccttgggagcaggtggaagagtatgtctaaccaggagaaacagccatattatgaagaacaggctagattgagcaaaatacatttggaaaaatatcctaattacaagtacaaacctcggccaaaacgaacctgtattgtcgatggcaagaagttgcgaatcggggagtacaaacaactcatgcgtagccgacgtcaggaaatgcggcagttctttacagtcggacagcaaccccagattcctatcacaacggggacaggcgtcgtgtaccctggcgccattacgatggccacaacgactccctcaccacagatgactagcgactgttcttcgacatcagctagtccggaacctagcctgcccgtcatccagagcacatacggaatgaaaacagacggaggcagcctcgcaggaaatgagatgattaatggcgaggatgagatggaaatgtatgatgactatgaggatgacccaaagagcgattattcctctgagaatgaggctcctgaagcggtctcagcaaattag

SEQ ID NO: 207033 - DNA, 240 bp, Artificial Sequence
  Description of Artificial Sequence: Synthetic coding sequence
atgagcagcaagcaggccaccagccccttcgcctgcgccgccgacggcgaagacgccatgacacaggatctgacatcccgggagaaggaggagggatcagatcaacatgtggcgagccatctgccgctgcaccctataatgcataacaagccgcattccgaggagctcccgaccttagtatcaacaatccagcaggatgctgactgggactccgtgctgagctcacagcaacgcatgtag

SEQ ID NO: 207034 - DNA, 480 bp, Artificial Sequence
  Description of Artificial Sequence: Synthetic coding sequence
atgagcagcaagcaggccaccagccccttcgcctgcgccgccgacggcgaagatgctatgacacaagatctgacaagcagggagaaagaggagggatctgatcagcacgtggcttcccacctgccccttcatcctatcatgcataataagccacacagtgaagagttaccgaccctcgtgtctacgatccagcaggatgccgactgggatagcgtgctctcgagtcagcagcgcatggaaagtgagaataataaactgtgctccctctacagctttcgcaacacttccacttctccccataaaccggatgaggggtcccgagatagggagatcatgacttcggtgaccttcgggactcccgaaagacggaaggggtccctagccgatgtggttgatacactcaagcagaagaaactcgaagagatgacccgcactgaacaggaggattcttcatgtatggagaaattactttcaaagtag

SEQ ID NO: 207035 - DNA, 2415 bp, Artificial Sequence
  Description of Artificial Sequence: Synthetic coding sequence
atgggccggatgagcagcaagcaggccaccagccccttcgcctgcgctgccgatggcgaggacgccatgacgcaggatctgacctcccgcgaaaaggaagaagggagtgatcaacacgtagcctcccatctgcccctgcatcccataatgcataataagccgcactcagaagagctacccacattggtctccacgatccagcaagacgctgattgggactccgtgttgtcatcacagcagagaatggaaagcgagaacaataaactgtgcagcctgtattcattcagaaacaccagtacaagcccacacaaacctgacgagggaagcagagacagagagataatgacctccgtgaccttcggcacgccagagagaagaaaaggatcccttgctgatgtagttgatacactgaaacagaagaagttagaggagatgacccgtaccgaacaggaagatagctcttgcatggagaaactcttgtccaaggattggaaagaaaaaatggaaaggctgaacacgtccgaattgctaggtgagattaaaggcactcctgagagcctggctgagaaagagcgacagctgtccaccatgatcacccaacttatcagccttagggaacagttacttgccgcacacgatgagcaaaagaaattggccgccagtcaaatcgagaaacaacgacaacagatggacctggctagacagcaacaagagcagatcgcacgccaacaacagcagctgttacagcaacaacataagataaatctgctgcaacaacaaattcaagtccaaggccacatgcctccgctcatgattcccatttttccccacgaccaaaggacgttggctgccgcggcggcagcccagcagggtttccttttccctcccggcatcacttataagccaggcgataactaccctgttcagtttataccgagtaccatggcagctgccgcagccagcggcctgtcccctctccaactgcagcagctgtatgccgctcagctggcgtctatgcaggtgagccccggtgcaaagatgcccagcacaccccaaccccccaacaccgcaggcactgtgtcccccactggaatcaagaatgaaaaacgtggcacttctccagtcacacaagtaaaggatgaggccgccgctcagcccctgaacctgtcttcacggccgaagactgccgagcctgtgaagagccctaccagccccactcagaatctgttccctgcaagtaaaacatccccggtgaacctgcccaacaaatccagcattccttctccaatcggaggcagtctcggacgcggctcatctctcggaaagtggaagtcgcagcatcaggaggaaacctatgagctcgacattctctctagcctcaactcgccagccctctttggggaccaggacacggtcatgaaggctattcaagaagcaagaaaaatgagggagcagatccagcgtgaacagcagcagcagcagccgcatggggtggacggcaaactttcaagcatcaataacatgggccttaactcttgcagaaacgaaaaggaaagaacacgatttgaaaacttgggcccccagttgacagggaaaagtaacgaagacgggaagcttggcccaggcgtaattgacctcacaagaccagaagacgctgagggcagcaaagccatgaatggcagtgccgccaagctgcagcagtattactgctggcccaccgggggtgctaccgtcgccgaggcgcgggtataccgtgacgccagggggcgagccagctctgagccccacatcaagcgccctatgaacgccttcatggtttgggctaaagatgaaagacgcaagattctgcaggctttccccgatatgcacaacagtaacattagcaaaatactggggagtagatggaaatccatgtccaaccaggagaagcagccatactacgaagagcaggcacgccttagcaagattcatctggagaagtatccgaactataaatacaaacctcgacccaaacgcacctgtatcgtcgacggcaaaaaactcaggatcggcgagtataaacagctgatgcgctcacgccgccaggagatgcgacagttcttcactgtgggtcaacagccacaaatcccaataactaccggcaccggcgtcgtctaccctggtgctataaccatggcaactactacaccatcaccgcagatgacgtcagactgcagctctactagcgctagtcctgaaccctccttaccggttattcagtctacctatggcatgaaaactgatgggggtagcttagcaggtaatgaaatgatcaacggcgaagacgagatggaaatgtacgacgactatgaggacgatcctaaatccgactactcttctgagaacgaggccccggaagccgttagcgccaattag

SEQ ID NO: 207036 - DNA, 1167 bp, Artificial Sequence
  Description of Artificial Sequence: Synthetic coding sequence
atggccagcctgctgggcgcctacccctggcccgagggcctggagtgcccggcactggacgcagagctatctgatgggcagagccctcccgccgtcccacgcccccctggcgacaagggctcagaatcaaggatcagacgacccatgaatgccttcatggtgtgggcgaaggatgaaaggaaacgacttgccgtacagaaccctgatttgcacaatgcagaactgagcaagatgctaggcaagagctggaaagccctaacattgagccagaagcgcccctatgtggacgaagccgaacgactacgcctgcagcatatgcaggactaccctaactacaaatacagacctaggagaaagaagcaggcaaaacggctgtgcaagcgagtggaccccgggttccttcttagcagcctatctcgcgaccaaaacgcactgcctgagaaacgctctggctcacggggcgcacttggcgagaaggaggatcgaggggaatactccccgggaacagccttgccatctcttagaggctgctatcatgagggccctgcggggggtgggggtggtgggacaccttcctctgtggatacctacccttatgggttaccaaccccacctgagatgtctcctctggacgtgctcgaaccagagcagaccttttttagctcaccatgtcaggaagagcatgggcaccccaggcgaattccacaccttcctggccatccctattctcccgaatacgctcccagccccttacactgttcacaccctctcgggtcgttggccctcggccagagccctggtgtgtccatgatgtctcctgttcctgggtgccccccatccccagcgtattattctcctgcaacgtaccacccccttcattctaatctccaggcacatctcgggcaactctctccaccccctgaacacccagggtttgacgccctggatcagctcagccaggtcgaactccttggggacatggatcggaatgagttcgatcaatatctgaatacccctgggcatccagattctgctactggcgctatggcactgtcaggtcacgtgcccgtctcccaggtgacacctactgggccaacagagacatcgctcatttccgttttggctgacgccaccgcaacttattacaatagctactctgttagctag

SEQ ID NO: 207037 - DNA, 1323 bp, Artificial Sequence
  Description of Artificial Sequence: Synthetic coding sequence
atgagcatgctggccgagcggcggcggaagcagaagtgggccgtggacccccagaacacggcttggagcaacgacgactctaaattcggtcagcggatgctggagaagatgggatggtccaagggcaaaggactgggggctcaagaacagggtgccacagaccacatcaaagtccaggtgaaaaataaccatctggggctcggcgccactattaacaatgaggacaattggatagcacaccaggatgattttaaccagctcctggccgaactgaatacctgccacggtcaggagactactgacagctctgacaaaaaggagaaaaaatctttttctctggaagaaaagtcaaagatctccaagaatagggtgcattacatgaaattcactaagggcaagagttggaaggccctcactttgagtcaaaagagaccatacgtggatgaggccgagcggctacgattgcagcatatgcaggattaccccaactacaagtatcgacctcgccgcaagaaacaggccaagagattgtgcaagagagttgatcccggattcttgctgagttctttatcgcgggaccagaacgccctgccagaaaagaggtcaggcagcaggggagccctcggcgaaaaagaggaccggggagaatacagtcctgggacagcactcccaagcctccgtggttgctaccacgaggggccagctggtgggggaggtggcggcaccccctcatccgtggatacatacccttatggcctccccacaccccccgagatgtcgcccttggatgttctggagcccgagcaaacctttttttccagtccctgccaagaagagcatggacaccccagacggatacctcacctccctggccacccttacagtcctgaatacgctccctcgcctttacactgttcccacccgctgggcagtttggcactgggccagtctcctggcgtgtcgatgatgagtccagttccgggctgtccaccaagcccggcctattactctcctgccacgtatcaccctctgcactctaatctccaggcgcatttgggacagctgtctcctcctcccgagcaccctggcttcgacgctctggaccaactctctcaggtggaactgctaggtgacatggatcgcaacgaattcgaccaataccttaacacccccggacaccctgattctgctaccggagctatggctctgtcagggcatgtccctgtttcccaagttaccccaactgggccaactgagacgtccctgatctctgtgctagctgacgctactgctacttactacaacagttattctgtgagttag

SEQ ID NO: 207038 - DNA, 1341 bp, Artificial Sequence
  Description of Artificial Sequence: Synthetic coding sequence
atgctggacatgagcgaggcccggagccagcccccctgcagcccctcaggaaccgcgtctagtatgagccacgttgaagacagcgattcagacgccccacctagtcccgcagggtcagagggcttgggccgggcaggagtcgcagtgggcggggcccggggcgaccccgccgaagccgccgatgagaggtttcctgcgtgtattagagatgcggttagccaggtcctcaaagggtatgattggtcactcgtgcccatgcccgtaaggggaggaggaggaggggcactgaaagctaaaccccacgtgaagaggcctatgaatgccttcatggtatgggcccaagccgccaggcgcaagctggcagatcaatatccccatctgcacaatgccgaactgagtaaaacccttggaaagttgtggagactgctttccgaatcagagaaacgcccctttgtggaagaagcagagcgcctgcgtgttcagcataaaaaggaccatccagactacaagtaccagccacgccgaagaaagtctgccaaagccggacacagcgacagcgactcgggggccgaactggggcctcaccccggcggcggcgcagtgtacaaggccgaggctgggttaggggacggccaccaccacggggatcataccggacagactcacggccctcctacacctccgacgaccccaaagaccgagctccagcaggccggggccaaaccggagctcaagctggaaggcaggcgcccggtcgatagtggacggcagaacattgacttcagcaatgtcgatataagtgaattgtccagcgaggtaatgggcaccatggatgcatttgacgtgcacgaatttgaccagtacctccctctaggcggacccgcaccccctgagcctgggcaggcttacggcggagcttatttccatgcgggagctagcccagtttgggctcataaatcggctcctagcgcttccgccagtcccacggaaaccgggccacctcgtccacatattaaaaccgagcagccaagtccgggacactatggtgatcagcccagaggaagtcccgactatggtagctgtagcgggcagagttcagctactcctgccgccccggcagggcccttcgccggttctcagggtgactacggagatcttcaggcaagctcctattacggtgcctatccaggctacgcccccggcttataccagtacccctgttttcactcgccacggagaccatacgcatccccgctattgaatggtctggccttgccaccggctcactctcctaccagtcattgggaccagcctgtgtataccaccctcactagaccctag

SEQ ID NO: 207039 - DNA, 1530 bp, Artificial Sequence
  Description of Artificial Sequence: Synthetic coding sequence
atgaacctgctggaccccttcatgaagatgaccgacgagcaggagaagggactctctggcgcaccctccccaaccatgagcgaagactccgcgggaagcccctgccccagcggctcgggttctgacacggagaatacccgacctcaggagaataccttcccaaagggtgagcccgacctgaaaaaagagagtgaagaagataagttcccagtgtgcattagggaggcggttagccaggtgctgaaggggtacgattggacactcgtaccaatgccggtgcgggtgaatgggtcctcgaaaaacaaacctcatgtgaaaaggccgatgaacgccttcatggtatgggcccaggctgcccgccgcaaactggcagatcagtatccacaccttcataatgccgagctgagtaaaactttgggaaaactatggcggcttcttaatgagtctgagaagcggccttttgttgaagaggcagagagactccgagtgcagcataagaaggatcatcccgactacaagtaccagccccggcgccgcaaatccgtgaagaacggccaagccgaggccgaagaggccacagagcaaactcacatatcacccaacgcaatatttaaggccttgcaggccgattctccacacagctcctcaggcatgtctgaggtccactcccccggagaacattctggccagtcacagggcccaccgaccccgccaacaactcctaaaactgatgtgcagcccggcaaggctgatctgaagagagaaggaaggccactgcccgaaggtggcagacagccccctatagactttcgggatgtggacatcggtgaactgtcttccgacgttatcagcaatatagagacttttgacgtgaacgaattcgatcaatatttgcctcccaatggccatcccggagtgcccgcaacccacggacaggtgacctacaccggctcttatggcattagtagcactgcagctacacccgcctcagctggtcacgtctggatgtctaagcaacaagcccctccccctccccctcagcagcccccccaagccccccccgcaccccaggcccccccgcagccacaggccgcacctccccaacaacccgctgcaccgccccagcaacctcaggcccatactctgacgacattgtcttctgaacccggacagtcccaaaggacccacattaaaactgaacagctgtccccatcacattactctgagcagcagcagcacagccctcagcagatcgcttattccccgtttaacctgccacactacagtccttcatatccaccgattacccggtctcagtacgactacacagaccaccagaattcaagtagttattacagtcacgcagctggccagggcactggcctgtatagcacattcacatacatgaaccccgcccagcggccaatgtacacccctattgcggacacttctggcgtgccctcaatccctcagacacacagcccacagcattgggaacagcctgtgtacacccagttgaccaggccatag

SEQ ID NO: 207040 - DNA, 1338 bp, Artificial Sequence
  Description of Artificial Sequence: Synthetic coding sequence
atgaacctgctggaccccttcatgaagatgaccgacgagcaggagaagggcctgtcaggtgcacccagtccaactatgtctgaggattccgcaggctccccctgcccctccggatctggttctgatacagagaacacccgcccacaagaaaatacatttcccaaaggtgaacctgatctgaaaaaagaatccgaggaggataaattcccagtgtgtatcagagaagccgtgtctcaagtgcttaaggggtatgactggacacttgtgccaatgccagtgcgcgtgaacggatcctcgaaaaataagccccatgtgaagcggcccatgaacgcttttatggtatgggctcaggctgcccgcaggaaactcgccgaccaatacccacatttacacaacgctgaactaagcaagacactcggaaagctttggcgcttgctgaatgagtcagagaagcgcccatttgtcgaggaggcggagcgtctgcgtgtccagcataagaaagatcatccggattacaagtaccagcctaggcgccggaaatctgttaaaaatgggcaggccgaggccgaggaagccaccgagcagactcacatatccccaaacgctatttttaaggcactgcaggctgatagcccccacagctcctctggtatgagtgaagtgcatagccccggcgaacacagcggccagtctcaggggccacccaccccccccactacacccaagaccgacgtgcaacctggaaaagcggacctcaaaagagaaggtagacctctgccagaaggggggcgccagcctcccattgacttcagagacgttgatattggcgaactttcttctgacgtgatatcaaatatcgagacgtttgatgttaacgaatttgaccaatatctccctccaaatggtcacccaggagttccggcaacccacggacaagtcacatacactggctcctacgggatcagctccaccgccgccaccccagcttcggccgggcacgtgtggatgagcaaacagcaggcccccccccccccaccacagcaacatagtcctcaacagattgcatactcgcctttcaatctcccccactacagcccgagctaccctcccatcactcggagccagtatgattatacggaccatcaaaattcttccagttactactcacacgccgcaggccagggcaccggtctgtactctactttcacctacatgaatcccgctcagcggcccatgtatactccaatagccgacacttcaggcgtcccgtctattcctcaaacccacagtccccaacattgggagcagcctgtgtatacacaattgacaagaccatag

SEQ ID NO: 207041 - DNA, 273 bp, Artificial Sequence
  Description of Artificial Sequence: Synthetic coding sequence
atgcggggctacctggtggccatcttcctgagcgccgtgttcctgtactacgtgctacattgtattctatgggggaccaacgtctactgggtggctccagttgagatgaagcgtcgcaataaaatacagccttgtttgagcaagcccgcgttcgcttccttgctttcacagtcctcagcttacatcctgcggaagggaatcgaggagttgaaccagactagtatcctgtttacccaggtgagctctgtgtctcccttttccgtctgtgggtag

SEQ ID NO: 207042 - DNA, 273 bp, Artificial Sequence
  Description of Artificial Sequence: Synthetic coding sequence
atgcggggctacctggtggccatcttcctgagcgccgtgttcctgtactacgtcctgcactgtatcctctggggtacaaatgtctattgggttgcacctgtagagatgaagaggaggaataagatacagccttgtctgagtaagccagcgttcgcgtccctgctatctcagtcgagtgcctatattctgcgaaaggggatcgaagaactgaaccagacgtccattttgttcacgcaggtgagctcagtctccccattttcggtctgtggctag

SEQ ID NO: 207043 - DNA, 1335 bp, Artificial Sequence
  Description of Artificial Sequence: Synthetic coding sequence
atgggcctgctggtgttcgtgcggaacctgctgctggccctgtgcctgtttctggtacttggcttcctctattatagcgcctggaaacttcacctcctgcagtgggaggaagacagctctaagtactcccactccagctctcctcaggagaagcctgtggccgacagtgtggtactgtccttcgatagtgcagggcaaactttaggatccgagtatgacagacttggttttctgctgaatctcgattctaagctgtcaccgcgcactctctgtaccgtagtgttcggccttgactgtatactggaaagccctggcgagcctaaaaagctcttaatgcccgcatcccaccctctcgagatcttgaagagcttaagcgaggatactgctttcgccctgggttttctgaagcttcctagacccgcggaactggccaccaaatatgccaacttctctgaaggggcatgcaagcctggctatgcatccgctctcatgacagccatcttcccccgattctctaaaccggctccaatgtttctagatgacagctttagaaagtgggctcgcattcgcgagttcgttcctccgttcggaataaaaggccaggataatctgatcaaagctatcctcagcgttaccaaggagtatcgcttaacccctgctttggactcactccggtgccgccggtgcatcatcgtgggcaatgggggcgtcttggctaataaatcactggggagtcgtattgacgattatgacatagttgttaggctcaatagcgctcccgtcaaaggattcgagaaggatgtgggcagcaaaacaactcttaggatcacctatcctgagggcgccatgcagcggcccgagcagtacgaacgtgattcgttatttgttctggcgggtttcaaatggcaggacttcaaatggctcaagtacattgtgtacaaggagagagtgagtgcgtctgatggcttttggaaaagtgtggcgactagggtacccaaagagccccccgagatccgcatcctgaacccgtattttattcaagaggctgcttttacgctgatcgggctgccatttaataatggcttgatgggtagagggaacatacccacccttgggtccgttgccgtaactatggcgcttcacggctgcgatgaggtggccgtggcaggcttcgggtatgacatgtcaactcccaacgccccactgcactattatgagacagtgcggatggctgccatcaaagaaagctggactcataacattcagcgcgagaaagaattcctgcgaaaactcgttaaggcccgggtgatcaccgacctgtccagtggtatctag

SEQ ID NO: 207044 - DNA, 468 bp, Artificial Sequence
  Description of Artificial Sequence: Synthetic coding sequence
atgggcctgctggtgttcgtgcggaacctgctgctggccctgtgcctcttcttggtactgggctttctttactactctgcctggaagctccacctcttgcagtgggaagaggactccaactccgtcgtgctctctttcgactcagccggccaaacgctcggctcggagtatgaccggttgggatttcttctgaacctagacagcaaactaccagccgaattggctacaaagtatgctaactttagtgaaggcgcctgtaaacctggctatgctagtgctttgatgacagccatatttccgagattttccaagccagctcccatgttcttggacgactcattcagaaagtgggcaaggattcgcgagttcgtcccacccttcggtatcaagggacaggtcctcgatgctcagtacccagctcgtgagagggtgagcgccgaggctggggaatcttcaagacaccactag

SEQ ID NO: 207045 - DNA, 1035 bp, Artificial Sequence
  Description of Artificial Sequence: Synthetic coding sequence
atgggcctgctggtgttcgtgcggaacctgctgctggccctgtgccttttcctcgtcttaggcttcctgtactactccgcttggaagctgcacctgcttcagtgggaggaggactccaacagtgtcgtgttgtctttcgacagcgccggacagactctcggctctgagtacgacaggctgggctttcttcttaacctggactcaaagctgttttccaagcccgctccaatgttccttgacgattcatttaggaaatgggcacgcatccgggaatttgtgccgcccttcggcatcaaaggccaggacaatttaattaaggccatcttatcagtaaccaaggagtatagattgacgcccgctttggacagcctgcgatgtcgcaggtgcattatcgtcggcaatggaggcgtgcttgctaataaatctctgggctcaagaattgatgattatgatatagtcgttagactaaactctgcccctgtcaagggttttgaaaaagacgtaggatctaagaccacattacgcataacgtatcccgagggagccatgcagcgtcccgagcaatatgagagggactcattgtttgtccttgccggcttcaagtggcaggattttaaatggcttaagtatatcgtgtacaaggagcgagttagcgcttcagacggattctggaagagcgttgctactcgcgtgcccaaggaaccacccgagatccggatcctgaatccctatttcatccaggaggctgcttttactctgatagggctgccctttaataacggcctgatgggcagggggaacattcccactctgggttcggtggctgtgaccatggcacttcatggctgtgacgaagtggccgttgccggattcggttacgatatgtctacccctaatgctccactgcactactacgagacagtgcgaatggcagcaatcaaggaaagctggacccacaacatccagcgggaaaaggagttcctgcggaagctagttaaggcccgggtgatcaccgacctgagctccggcatttag

SEQ ID NO: 207046 - DNA, 687 bp, Artificial Sequence
  Description of Artificial Sequence: Synthetic coding sequence
atgggcctgctggtgttcgtgcggaacctgctgctggccctgtgccttttcctggttctgggttttctgtactattcagcatggaaattgcatctgctgcaatgggaggaagacagtaagtacgatcggctgggattcctgttgaatctcgattccaagcttccagctgagctcgcgacgaagtacgctaattttagtgagggggcatgtaagcccggttatgccagcgcactgatgacagccattttcccacgcttcagtaagcctgcccctatgtttctcgatgattccttcagaaagtgggctcgaatccgcgaattcgtccctcctttcgggataaagggccaggataacctaatcaaggccatcctgtcagtgacaaaggagtatcgactgaccccagctctcgatagcttacggtgccggaggtgcattatcgtggggaacggcggagttcttgctaacaagtccctaggcagtcggattgacgattatgacatcgtggtgcgggtgcatcgaatggcctcaggcaatctctggcctttggaatgccccagatctccactcaggttcgaatcttcgacacacattagcagtcgccgtcccccgtctccttctttagcctgcccctcaacaatggcttcatgggctgggggcacgtccctccccttggctgtttggcagtag

SEQ ID NO: 207047 - DNA, 1173 bp, Artificial Sequence
  Description of Artificial Sequence: Synthetic coding sequence
atgggcctgctggtgttcgtgcggaacctgctgctggccctgtgcttgttcttagtgcttggattcctgtattactctgcctggaaactgcacttgctgcagtgggaggaggactcctcgaagtactctcactcctcttccccacaggagaaaccagtggctgacagcgttgtactgagctttgatagcgctgggcagacactcgggagcgaatatgatcgccttggcttcctattgaacctggatagcaagctgcccgcagaactcgcaacgaaatacgcaaacttttctgagggtgcatgcaaacccggttacgcgagcgcactgatgaccgccatctttccacggttctccaagccagcccccatgtttcttgatgacagctttcggaaatgggcccgtatcagagaattcgtacctccattcggcattaaggggcaggacaacctcataaaggcaatcctatccgtgaccaaggagtatcgtctgacaccagccctggattccctcaggtgccgacgttgcataatagtgggtaacggaggggttctggcaaacaagagtctgggatcccgaatcgatgattatgacatagtcgtccgattgaacagtgctcctgtgaaaggattcgaaaaagacgtggggtccaagaccacgctgcggattacctacccagaaggggccatgcagagacccgagcagtacgaacgagactccttattcgtcttggccggattcaagtggcaggacttcaagtggctcaaatatattgtctataaagagagggtgagcgcaagcgatggcttttggaagtccgttgctacacgcgtgcctaaggagcccccggagatcaggattctgaacccatacttcattcaagaggcagccttcaccctgatcgggcttcccttcaataatggcctgatgggacggggcaacattccaaccctgggcagcgtcgccgtcactatggccctgcacggctgtgatgaagtcgctgtggctgggttcggatacgatatgtcaacacccaacgcccccctccattattatgagactgtgagaatggcagctatcaaggagtcttggacacacaacatccagagggagaaagaattcctgcggaagctggtgaaagcgagagtcatcacggatctcagtagcgggatatag

SEQ ID NO: 207048 - DNA, 1242 bp, Artificial Sequence
  Description of Artificial Sequence: Synthetic coding sequence
atgggcctgctggtgttcgtgcggaacctgctgctggccctgtgcttatttctggtcttgggcttcctgtattattctgcatggaagctacacctgctgcaatgggaagaagactcaaagtatgaccgcctgggctttctcttgaacttggactcaaaactgagcccacgcactctgtgtacagtcgtgtttggcttggattgcattttggagtcaccaggcgagcctaagaagttattgatgccagccagtcaccctctggaaattctgaagtccctctccgaagataccgcctttgccttggggttcctgaagctccccagacctgccgagctagcaacgaagtacgcaaatttttctgagggagcgtgcaaaccaggttacgccagcgcccttatgacagctatcttccctaggttctccaaacccgcccctatgttcctcgatgacagtttcagaaagtgggctagaatcagagagttcgtaccccctttcgggataaagggccaggataatctgattaaggcaatactgagcgtcacgaaagagtataggctgactcctgcactcgatagcctccggtgccggcggtgtatcatagtggggaatggcggcgtgctggccaataaatctctgggctcccggatcgacgactacgatattgtggtcaggttgaactccgcccccgttaagggttttgagaaagatgtggggtctaaaaccaccctgaggattacttaccctgaaggtgccatgcagaggcccgagcagtacgagcgagactcgctgttcgttctagctggctttaaatggcaggactttaagtggctcaagtacattgtttataaagaacgggtgtccgcatctgatggcttctggaaaagtgtggcaacccgcgtgccgaaagagccccccgagattagaatacttaatccttactttatacaggaggcagcctttaccctgatcgggttgcccttcaacaacggtctgatgggtaggggtaacatccccacactcggcagtgttgccgtgaccatggccttacacggctgtgacgaggtggcagttgccggatttggttatgatatgagtactcccaacgctccattgcactattatgaaacagtgagaatggcagccataaaagaatcctggacccataacatacagcgggagaaagaattcttaaggaagttggtcaaggctagagttattaccgacctgagttcgggcatctag

SEQ ID NO: 207049 - DNA, 834 bp, Artificial Sequence
  Description of Artificial Sequence: Synthetic coding sequence
atgggcctgctggtgttcgtgcggaacctgctgctggccctgtgccttttccttgtgctgggatttctgtactattcggcgtggaagcttcatctgctgcagtgggaagaggatagcaactcggtagtcttgagttttgatagcgctggccagaccctaggaagtgaatacgacaggctgggatttctgttaaacctagactctaagttgcctgctgagcttgctacgaagtatgctaattttagcgagggggcttgcaagccaggctatgcctccgcacttatgacagctatctttccaagattcagtaaaccagcacctatgttcctggacgacagcttcaggaagtgggccaggatccgtgaattcgtccctcctttcggcatcaaggggcaggacaatctgatcaaagccatactctctgtgacgaaagagtatcggctaaccccggctctggactctctccgctgcagaaggtgtatcattgttggtaacggaggagtactcgcaaacaaaagccttggcagtcgtatcgatgattacgatattgtcgtgcgccttaatagcgccccagtcaagggattcgagaaagacgtaggctcaaagactacactgaggattacctaccccgagggagcaatgcagcgacctgagcaatatgagcgggacagtttgtttgtgttagctggatttaaatggcaagatttcaagtggctaaagtacattgtttataaagagagggtgtcctggacccacaatatccagcgcgaaaaagaattcctcaggaagttagttaaggctcgagtgatcacagacttgagcagcgggatctag

SEQ ID NO: 207050 - DNA, 1128 bp, Artificial Sequence
  Description of Artificial Sequence: Synthetic coding sequence
atgggcctgctggtgttcgtgcggaacctgctgctggccctgtgcctgtttctggtcctcggctttttgtactatagcgcatggaagctgcacttgctgcagtgggaagaggacagcaactcggtggtgttatcttttgattcagctggtcagacgctgggcagcgaatacgacaggctcggctttctgctgaatctggattctaaattacctgctgagctcgctaccaagtacgctaacttcagcgaaggagcatgcaaaccaggctacgccagcgcccttatgactgcaatcttcccgaggttctcaaaacctgctcctatgttcctggacgactccttccgtaagtgggccaggatccgagagttcgtccctccctttggcataaaaggacaagataatctgataaaggcgattcttagcgtgacgaaagagtacagactgacacctgcccttgacagtttgcgctgtcgtcgctgcataatcgtgggaaacgggggggtgcttgcgaacaaaagcctgggtagccgcatcgacgactatgatatcgttgtccggctgaacagcgcccctgtgaagggtttcgagaaggacgtcgggtcaaaaaccacactccggataacctatcccgaaggagccatgcagcggcccgaacagtacgaacgggactcactctttgtgctggctggatttaagtggcaagacttcaagtggctgaaatacattgtttataaagaacgagtctcggcctccgatgggttttggaaatctgtggcaacaagggttcctaaagaaccaccagagatacgcatcctaaacccgtactttatccaggaggctgcttttacgctcatcggcctgccatttaacaacggattaatgggccgcgggaatatcccgactctcggatctgttgcagtcacaatggcactacacggatgtgatgaagtggctgtggccggattcgggtacgacatgtctacacctaacgccccactgcactactacgagaccgtgcggatggcagcaatcaaagagtcatggacccacaacatccaacgtgaaaaagaatttcttcggaaactcgttaaagcacgggtcattaccgacctttctagcgggatatag

SEQ ID NO: 207051 - DNA, 1080 bp, Artificial Sequence
  Description of Artificial Sequence: Synthetic coding sequence
atgggcctgctggtgttcgtgcggaacctgctgctggccctgtgcctgttcctggtgttgggatttctctactatagtgcctggaagctacatctgctccagtgggaagaagattctaaatatgacagattgggcttcctgctgaacttggattcaaaattgccagcagagctcgctacgaagtatgcaaatttttcggagggcgcctgtaagcctggatacgctagtgcccttatgactgcaatattcccgagattctccaagccagctccaatgttcctcgatgatagttttcgaaagtgggcgagaatccgggagtttgtaccaccgttcgggatcaagggacaagacaacctcatcaaggcaatcctgtctgtgactaaagagtatcgattgacaccagcgctggattcgctgcgatgcagacggtgcataatcgtgggtaacgggggagtcttggcgaacaagtcattgggatcaaggatcgatgattatgacatcgtggtccggctaaatagtgctcccgtcaagggcttcgagaaggacgtgggaagcaaaacaacacttcggatcacataccccgagggagcaatgcagagacccgaacagtacgagcgcgacagcctctttgtgctggctgggtttaagtggcaagatttcaagtggcttaagtatattgtctataaggaacgtgtttctgccagcgacggcttttggaaatctgttgccaccagggttcctaaagaaccgccggaaatcagaatcctgaatccatattttatccaggaagccgcattcactcttatcgggctcccatttaacaatggtctgatggggcgtggcaacataccgacactgggatctgtggctgtaacgatggcgctacacgggtgcgatgaagtggctgttgccgggtttgggtatgatatgtctacaccgaatgcccccctgcactattacgagacggttaggatggcggctattaaggaatcttggacccacaacatacaaagagagaaagagtttctgaggaaactggtgaaggcccgcgttatcacggacctctcaagtgggatttag

SEQ ID NO: 207052 - DNA, 1335 bp, Artificial Sequence
  Description of Artificial Sequence: Synthetic coding sequence
atgggcctgctggtgttcgtgcggaacctgctgctggccctgtgcctgtttctggtcctcggtttcctgtactattcagcatggaagcttcacctcctacagtgggaggaggattccagtaagtactctcattcttcttcaccacaggaaaaaccggtggccgacagcgtggtcctgtcattcgactcagctggccagacgctgggttctgagtatgaccggctcggtttcctgctgaacttagattccaagctctccccaaggacactgtgtacagtggtctttgggctggattgtattttggagtctcctggtgaaccaaaaaagctgctgatgccagcatcacacccgctcgagattcttaaaagcctcagtgaagatacggcatttgccctgggctttctgaagcttcccagacctgccgaactggctactaaatatgcgaatttctcagaaggtgcatgtaaacccgggtatgcctccgccctcatgactgccatctttcccaggttctccaaaccagcccctatgtttctagatgattcctttcggaagtgggcgcggattagagaattcgtgcccccattcggaatcaaaggccaggataatctaattaaggccatactttctgttacaaaagagtatagactcactccggccctggacagtcttagatgccgccggtgtattatagttggcaatggcggcgttctcgccaacaaaagcttaggaagtagaattgacgactatgacattgtggtgcgtctgaactctgccccggttaagggcttcgaaaaggacgtcggatcaaaaacaactctgaggattacctaccccgaaggcgccatgcagagacctgagcagtacgagcgtgacagcctgtttgtcctcgccggatttaagtggcaagattttaagtggctgaagtatatcgtgtacaaagaacgtgtgagcgccagcgacggcttctggaaatcagtggccacccgcgtgcccaaggaacccccggagatccgaatcctgaatccctattttatacaggaagcagccttcaccctgataggtcttccttttaacaatgggctgatgggcagggggaacatccccacattgggttcggtcgccgtgactatggccctccacggctgtgacgaggttgctgtcgcaggattcggctatgatatgagcacacctaatgctccattacactactacgaaacagttcgcatggctgccattaaggagtcttggacccataatattcagagagagaaagaattcttgagaaaactcgtcaaggcccgcgtgattacagatctgtccagcgggatctag

SEQ ID NO: 207053 - DNA, 513 bp, Artificial Sequence
  Description of Artificial Sequence: Synthetic coding sequence
atgggcctgctggtgttcgtgcggaacctgctgctggccctgtgcctgttcctcgtgctgggatttctgtactactcagcctggaagctccacctcttgcagtgggaggaggacagcagtaaatattcccactcatctagcccccaggaaaaaccggtagctgatagcgtggttctcagcttcgattccgccggccagacgctgggaagcgagtacgatcgcctggggttcctcctcaatctggattcaaaactaccggccgaactcgccacaaaatatgcaaacttcagcgaaggggcatgcaagcctggttacgcctcagccctgatgacagctatcttcccccggttcagtaagccagcccccatgtttctcgatgacagcttcaggaagtgggcaaggatcagagaattcgtacccccgtttggaatcaaaggacaggtgcttgacgcccagtaccctgcccgagaacgcgtctctgccgaagccggcgagtcgtcacgccaccactag

SEQ ID NO: 207054 - DNA, 468 bp, Artificial Sequence
  Description of Artificial Sequence: Synthetic coding sequence
atgggcctgctggtgttcgtgcggaacctgctgctggccctgtgcctttttctggtactcggatttctgtattattctgcttggaagctccacttgcttcagtgggaagaagacagcaattccgtagttttgtccttcgatagtgcaggtcaaaccctgggctccgagtacgatcgactaggcttcctcttaaacctcgactctaagttacccgctgagctggctacaaaatacgcaaacttctctgaaggagcatgtaagccagggtatgcctccgctttaatgactgctatctttcccaggttctccaagcctgcgccaatgtttctagacgattcgtttaggaaatgggcacgaattcgcgagttcgtccctccatttggcattaagggccaggttctcgacgcccagtacccagcgcgagaacgagtgtccgccgaggccggcgagagctcaagacaccattag

SEQ ID NO: 207055 - DNA, 561 bp, Artificial Sequence
  Description of Artificial Sequence: Synthetic coding sequence
atgggcctgctggtgttcgtgcggaacctgctgctggccctgtgccttttcctggtgttgggcttcctttattatagcgcttggaaactgcacttactgcagtgggaagaggacagcaactctgttgttctctccttcgacagtgccggccaaactttgggcagcgaatacgatcggctgggattcctccttaatctcgattctaaacttccggctgaattggcgaccaagtacgccaatttctctgagggcgcctgtaaacctggctacgcctctgctttaatgaccgcgatcttccctcgctttagcaagcctgcccctatgttcttggatgactcttttaggaagtgggcccgcattcgggagttcgtccctccctttggcattaaaggacaggacaatctcattaaggcaattctttccgtcaccaaggagtataggctcacaccagcgcttgacagccttcgttgccgcagatgcatcatcgtggggaacggaggagttctggccaacaagtcattgggcagcaggatcgacgactatgacatcgtggtgagatag

SEQ ID NO: 207056 - DNA, 558 bp, Artificial Sequence
  Description of Artificial Sequence: Synthetic coding sequence
atgggcctgctggtgttcgtgcggaacctgctgctggccctgtgcctgttcctagtgcttggtttcttatactacagcgcttggaagctgcatctacttcaatgggaagaagacagcagtaagtatagtcactcttcctcgccacaggagaagcccgtagctgaatacgatcgtctcggctttctcctcaatttagattctaagctgcccgccgaactagccacgaagtatgccaatttcagtgagggagcatgtaagcccggttacgcttcggctctcatgacagctattttcccccgcttctctaagccagcccctatgttcctggatgattctttccgcaaatgggctcgcatccgagagttcgtgccaccattcggcatcaagggccaagacaacttaatcaaagccatcctcagcgtgacaaaggagtacaggctgaccccggctctggattctctgcgttgccgtaggtgtattattgtgggcaatgggggcgtgttggccaataaatctctggggtcaaggattgacgactatgatatcgtcgtaagatag

SEQ ID NO: 207057 - DNA, 606 bp, Artificial Sequence
  Description of Artificial Sequence: Synthetic coding sequence
atgggcctgctggtgttcgtgcggaacctgctgctggccctgtgcctgttcctagtcctgggattcctgtattactccgcctggaaattgcatctcctgcagtgggaagaagatagcagtaaatattctcactcgagcagcccgcaagagaagcctgtggcggagtatgaccggcttggtttcttgcttaatcttgacagcaagttaccggcagaactggctacaaaatacgctaatttcagcgaaggagcttgcaaacctggttacgcctcagctttaatgaccgctatttttcctcgcttcagcaaacccgcccctatgtttctggacgactctttcagaaagtgggctcgcatcagggaattcgtccccccttttggaatcaaggggcaggacaacctgatcaaagcaatcttgagcgtgactaaggagtatagattgacacccgcacttgactctctgcgctgtcggcgctgcattattgtcggaaacggcggggtattggctaataaatccctgggatctcgcatcgatgattacgatatagtggtttcaccgggacgcactatatccagtgagagaaagtccttttgtgggagttggtag

SEQ ID NO: 207058 - DNA, 1290 bp, Artificial Sequence
  Description of Artificial Sequence: Synthetic coding sequence
atgggcctgctggtgttcgtgcggaacctgctgctggccctgtgcctgtttttggtgctgggctttctatattattctgcctggaagctccatctgctgcagtgggaggaggactcaaactctgtggtgcttagtttcgactctgcaggacagacccttggctcagaatacgaccggctgggatttctgttgaacttggatagtaagctctccccacgcaccctgtgcaccgtagtgttcggcctcgactgtatactggaatcacccggggagccaaaaaagctgcttatgccagcatctcaccctctggagatcctgaaatcactgagcgaggatactgcgtttgccttgggatttctgaagcttcctcgccccgccgagctcgctacaaaatatgcaaatttttctgagggggcttgtaagcctgggtacgcaagtgcactgatgaccgctatattcccacgattttcaaagcctgccccaatgttcctggacgactcatttaggaaatgggcacgaattcgggagtttgtaccaccttttggaatcaaggggcaggataatttgataaaggccatattgagcgtgaccaaagaatataggctgacccccgcgcttgactcactcaggtgtaggagatgcattattgtggggaacgggggagtgctggctaacaagtccttaggttcaaggatagacgattatgacatcgttgttcggctgaactctgctcccgtcaagggctttgaaaaagacgtcggatccaagactactctgaggataacttatcccgaaggcgccatgcagaggcccgagcagtacgagcgtgacagcttgttcgtgctggctgggtttaagtggcaggattttaagtggttgaagtacattgtgtataaagagcgggtgtcagcttccgacggtttttggaaaagtgtggctactcgagtgcccaaggagcctccagagatacgtattctgaacccttactttatccaggaggcagctttcacactgataggactgccgttcaacaacgggctaatgggaagaggcaatatcccaacgttgggaagcgtggcagtcaccatggcccttcatggatgtgatgaggtggccgtcgctggtttcggctacgacatgtccactcctaatgctcctctacattattacgagacggtcagaatggccgctattaaagagtcatggactcataatattcagcgtgaaaaagaattcctgcgcaaactcgtgaaggcaagagttataaccgacctctcaagcggcatttag

SEQ ID NO: 207059 - DNA, 1038 bp, Artificial Sequence
  Description of Artificial Sequence: Synthetic coding sequence
atgggcctgctggtgttcgtgcggaacctgctgctggccctgtgcctgtttttggtgttgggattcctttactactccgcctggaaacttcacctgctccaatgggaggaggactccaactcggtcgtcttgtcgtttgattctgccggtcagactcttggttcggagtacgacagattaggcttcctcctcaatctcgactccaaactgccagcagaactggccactaagtatgctaacttcagtgaaggcgcctgcaaaccagggtacgcttccgccctgatgacagcaatattcccccgtttttcgaaaccagctcccatgttcctggacgattcctttcgtaaatgggcccgtattcgggagttcgtgcctccttttggaattaaggggcaggacaacctgataaaagccatcctgtccgtgactaaggagtaccgcctcactcccgcgctggacagccttagatgtcggaggtgcatcattgtgggtaatggcggagtcttggccaataagtcactaggcagcagaatcgatgactacgatattgttgtaaggcttaattccgccccagtaaaaggctttgaaaaggatgtgggcagcaagaccactttacgcattacgtatccggagggagccatgcagaggcctgagcagtacgaacgggacagtctctttgtgctagcaggtttcaagtggcaggattttaaatggctcaaatacattgtgtacaaagaacgcgtggaggcagcctttaccttaatcggcctacccttcaacaatgggcttatgggtagagggaacattcctactctgggctccgtagccgtaacaatggctctgcatgggtgtgatgaggtggctgttgctggatttgggtacgacatgtccacacctaatgctcctcttcactactacgaaactgtcagaatggccgccataaaggaatcctggacccacaatatccagcgggaaaaagaatttttgaggaaacttgtgaaggctcgtgtcatcaccgatctatcgtctggaatttag

SEQ ID NO: 207060 - DNA, 1242 bp, Artificial Sequence
  Description of Artificial Sequence: Synthetic coding sequence
atgggcctgctggtgttcgtgcggaacctgctgctggccctgtgcctctttttggtgctgggtttcctgtattactctgcgtggaagctccacttgctgcagtgggaggaggattcgaaatacgaccgtttaggcttcctgctgaatctggacagcaagctttcccccagaacactgtgtacagtcgtgtttgggctcgactgcatactcgaatcccccggcgagcccaagaaactgttaatgcccgctagtcaccctctggagatcctcaagtccctgagcgaagacaccgctttcgcgctcgggttcttaaaactgccccgaccagctgagctggctaccaagtacgctaacttcagcgaaggtgcctgcaaaccagggtatgcctctgccttaatgacagctatcttcccccgcttctctaaacccgcaccaatgttcttggatgacagcttccggaagtgggcccggatacgcgagttcgtccccccttttgggataaaggggcaggacaacctgatcaaggcaattctcagtgtaactaaggaatatcgtctgacgcccgcactggacagtctccgatgcaggcggtgtattattgtgggtaacggcggcgtgctagccaataagtccctggggtcaaggattgacgattacgacatcgtagtgcgactgaacagcgcccccgtcaaggggtttgagaaggacgtaggttcaaaaaccactctccgcatcacttaccctgagggggccatgcagagacccgagcagtacgagagggatagcctgttcgtattagctggattcaagtggcaggattttaaatggctgaagtacatagtttacaaggagagagtcagtgcgagtgatggcttttggaaaagtgtagctacccgtgtacctaaggaaccacccgagatcagaatactgaacccttactttatccaggaggccgcgttcacattgattgggcttcccttcaacaatgggcttatggggagaggaaacattccgaccctggggtctgtggccgtcacaatggccctgcacggctgtgatgaggtggcggtggcagggttcgggtatgacatgtccacgccaaacgcccctttacattactacgagactgtacgaatggccgctatcaaggagtcttggacccacaacatccaacgcgagaaggaattcctgcgcaagttggtgaaggcccgagtcatcacagatttatcttccggaatatag

SEQ ID NO: 207061 - DNA, 1035 bp, Artificial Sequence
  Description of Artificial Sequence: Synthetic coding sequence
atgggcctgctggtgttcgtgcggaacctgctgctggccctgtgcttgttcctggtacttgggttcctgtactatagtgcctggaaattgcatctgttacagtgggaggaggattctaattccgtcgttctgagtttcgacagtgctggccagacactggggagcgaatacgaccggttgggttttttgctgaacctggattctaaattattctcaaagcccgctccaatgttcctggatgatagcttcaggaaatgggcgcgcattcgggagttcgtgccgccctttggcattaaaggccaggataatctcattaaggccatcctgagcgtgaccaaagagtaccggctgacccctgcccttgactctctaagatgcagaaggtgtatcattgtgggcaacggcggggtcttggccaacaaaagtctgggctcccggatcgacgactatgacattgtcgttcgactgaacagcgctcccgttaaaggattcgaaaaagatgtcggttctaagacgacactgcggatcacctatcctgaaggcgccatgcaaagaccagagcagtatgaacgtgactcactgtttgtgctggccggcttcaagtggcaggacttcaagtggctgaagtacatcgtatataaggaaagggttagcgcatctgatggcttctggaaaagcgtcgccaccagggttccaaaagaaccgccagagatccggattctgaatccttatttcattcaggaagccgcgttcaccctgattggcctccccttcaataacggactgatgggacgcggaaacatcccaacacttggatcagtggctgtgaccatggccctgcacggatgcgacgaggtagctgtcgctggttttgggtacgacatgtcgacacctaatgccccactgcactactatgagactgttagaatggccgctatcaaggagtcctggacacacaacatccagagggagaaagagttcttgagaaagctcgtgaaagcacgggtcatcaccgacttgtcctcaggtatctag

SEQ ID NO: 207062 - DNA, 1290 bp, Artificial Sequence
  Description of Artificial Sequence: Synthetic coding sequence
atgggcctgctggtgttcgtgcggaacctgctgctggccctgtgcctcttcctggtcctgggctttctttattacagcgcatggaaattacatctgcttcaatgggaggaagacagcaattctgtcgtactttctttcgactctgcaggacagactctcgggtcagagtatgacagactgggctttctgctgaacctcgattctaaactgagccccaggaccctgtgcactgtggtctttggactcgattgcattcttgagtcgcctggtgagcccaagaagctgctcatgccagcctcccacccgctggaaattctgaaatccctgtccgaggacacagcattcgctctgggcttcctgaagcttccgcgccccgcagagctggctaccaaatacgccaactttagcgagggggcctgcaaacctggatacgcctccgccctgatgacagcaatattcccccggttctcaaagcccgcccccatgtttttggacgactcatttaggaagtgggcaagaattcgggagttcgtgcccccctttggtattaaaggtcaggataacttgattaaagctatcctcagtgtgactaaggagtacagactcaccccagctttagactctcttaggtgtcgccgatgcataatcgtaggcaatggaggcgtgcttgccaataagtcccttggatccaggatagatgactatgacatagttgtgcggcttaattcagcacccgtcaagggcttcgagaaagacgttggttcaaagactactctgcgcattacgtatcccgagggagccatgcagcgccctgaacagtacgaaagagattctttatttgtgttagcaggatttaaatggcaggacttcaagtggcttaaatatattgtctacaaagagcgcgtgagcgcatctgacggcttttggaaaagcgtcgccacgcgtgttccaaaagagcccccagagatccggatcctcaacccctactttatccaggaagcggcatttaccctgatcggcctgcccttcaacaacggcctcatgggacgggggaacatccctacgctggggtccgtggccgtgacgatggcgctgcacggctgcgacgaggttgccgtagcgggcttcggatatgacatgagcacgcccaatgcccctctgcattattacgagaccgttcgtatggcagctatcaaggaatcctggacgcataatattcagcgggagaaagaatttcttagaaagctcgtcaaagccagagtgatcactgatctgtccagcggaatctag

SEQ ID NO: 207063 - DNA, 456 bp, Artificial Sequence
  Description of Artificial Sequence: Synthetic coding sequence
atgggcctgctggtgttcgtgcggaacctgctgctggccctgtgcctgttcctagtgctcggcttcctgtattacagcgcgtggaaacttcatctgctgcagtgggaggaggactccaactccgtagtgcttagctttgattccgcgggacagacactgggctctgaatacgaccgcctagggtttctgctgaacctcgacagcaaattacctgccgaactggccacaaagtacgctaatttctccgaaggagcatgtaagccaggatatgccagtgcacttatgacagccatttttcctcgatttagtaagcctgcaccgatgtttctggatgacagcttcaggaaatgggccagaataagggaattcgtgccccctttcggaattaaggggcaggagtgcatcggttggctgctggagatttgcggccacagttccgcccaaggcgcaccatag

SEQ ID NO: 207064 - DNA, 561 bp, Artificial Sequence
  Description of Artificial Sequence: Synthetic coding sequence
atgggcctgctggtgttcgtgcggaacctgctgctggccctgtgcctttttttggtgttggggttcctatactacagtgcttggaaactgcacctgttacaatgggaggaagactcaaaatacgacaggctgggcttcctgctcaatcttgactctaagctccctgccgagctcgcaactaaatacgccaattttagtgaaggagcctgcaaacccggatatgcctcggctctcatgactgccattttccctaggttctctaaaccagcgcctatgtttcttgatgacagcttcaggaagtgggcccggatccgggaatttgtacctcccttcggtatcaaaggccaggataatctgatcaaggcaatactatccgtgacaaaagaataccggctcacccctgctttggactctctccgatgtcgaaggtgcattatcgtcgggaacgggggggtcctagcgaacaaatccctggggtcgaggatagacgattatgacattgtagtctctccaggtcgcaccatcagcagcgaacgtaaaagtttttgcggttcttggtag

SEQ ID NO: 207065 - DNA, 420 bp, Artificial Sequence
  Description of Artificial Sequence: Synthetic coding sequence
atgggcctgctggtgttcgtgcggaacctgctgctggccctgtgcctgttcctcgtgcttggcttcttatattactctgcttggaaactgcacctcctccagtgggaagaagattcaaagtatgataggctcggatttctgcttaacctggacagtaaactgccagccgagctggccacaaaatacgctaactttagcgagggtgcttgtaagcccggttatgcttcggcactcatgaccgcgatatttcctcgattctctaagcccgcccccatgttcctcgatgacagtttcaggaaatgggcgagaattcgtgaatttgtgcccccctttggtatcaaaggccaagtcctggacgctcagtaccccgctagagaaagggtgtccgctgaagcgggagaaagttcgagacaccactag

SEQ ID NO: 207066 - DNA, 306 bp, Artificial Sequence
  Description of Artificial Sequence: Synthetic coding sequence
atgggcctgctggtgttcgtgcggaacctgctgctggccctgtgcttgttcctggtgctgggcttcctgtactattcagcgtggaagctgcacctcctgcagtgggaggaggatagcaaatatgaccgtctaggcttcttgttaaatctcgatagtaaactaccagccgaactggccaccaagtatgccaatttctctgaaggagcttgtaagcctggttatgcctctgcattgatgaccgcgatcttccctcggcctgggcgcaccatttctagcgaaaggaaatccttctgcggaagctggtag

SEQ ID NO: 207067 - DNA, 786 bp, Artificial Sequence
  Description of Artificial Sequence: Synthetic coding sequence
atgggcctgctggtgttcgtgcggaacctgctgctggccctgtgcctctttctggtcctgggcttcctatattactctgcgtggaaactccatttgcttcagtgggaggaggatagtaaatacgatcgcttgggcttcctgctaaatctcgactcaaaattgcccgccgaactggctacaaaatatgccaatttttcagaaggggcctgcaaacctgggtacgcaagcgctctgatgaccgccatcttcccccgattcagtaagccggcccccatgtttctggatgattccttccggaaatgggcccgcatacgggagttcgttcccccgtttgggattaagggccaagataatttgattaaagctatcctatcagtcactaaagaataccgcttgacacctgctctggacagcttgcgatgtagacgatgtatcatcgtgggtaacggtggagtcctggccaacaagtcactaggatctagaatcgatgactatgacattgtggtgcgcctgaatagtgcaccagttaaaggattcgagaaggacgtgggaagcaaaacaaccctccgcataacttacccagagggagcaatgcagcgccctgagcagtatgagagagatagtcttttcgtactggccggatttaaatggcaggacttcaagtggctgaagtacatagtgtataaagaacgtgtctcatggacccacaatattcagcgggagaaagaatttcttcgaaagttggtgaaggcacgggtcattactgacctgtcttcaggcatttag

SEQ ID NO: 207068 - DNA, 834 bp, Artificial Sequence
  Description of Artificial Sequence: Synthetic coding sequence
atgggcctgctggtgttcgtgcggaacctgctgctggccctgtgcctctttctcgttcttggctttttgtattactcagcctggaagctccatttgctgcagtgggaggaagattcaaactctgtagtattgtcgtttgatagcgccgggcagacattgggctctgaatatgacaggcttggcttcctcttaaatctggacagtaaactgcccgccgagttagctaccaagtatgccaattttagcgagggggcgtgtaagcctgggtatgcgtcggctttaatgactgctattttcccccgcttctccaaaccagcgccaatgttcctcgacgattcgttccgcaaatgggccaggattcgcgagttcgtgccgccgtttggcattaagggtcaggacaatctaatcaaagcaattctctccgttaccaaggaataccggctgacccctgctctggattccctgcggtgtcgaaggtgcattatagtggggaacggaggtgttctagccaataaatcgctgggctcccgcatcgacgactacgacatcgtagtgagactaaattcagccccggtgaagggctttgagaaagatgttggatctaagacaacgctgcgcattacttaccctgagggcgcgatgcaaagacccgaacagtatgaaagggactcactgttcgtccttgccggcttcaagtggcaggacttcaagtggctgaagtatattgtctataaggaaagggtgtcgtggacccacaacattcagcgagagaaagagttcctgcgaaaattggtcaaggcccgggtgatcactgacttgtcttctggaatctag

SEQ ID NO: 207069 - DNA, 513 bp, Artificial Sequence
  Description of Artificial Sequence: Synthetic coding sequence
atgggcctgctggtgttcgtgcggaacctgctgctggccctgtgcctattcctggtgcttggctttctgtattattccgcttggaaattgcatctgttgcagtgggaggaagattcctcaaagtacagtcactccagcagcccccaggaaaaacccgtggccgactctgtggtgctgtctttcgattccgctggccaaaccctggggtccgagtatgaccggctcggtttcctgctgaacctggactccaagctccccgcggagcttgctaccaaatatgcaaactttagtgagggagcgtgtaagccgggttacgcaagcgccttaatgacggctatttttccaaggttcagtaaacccgccccaatgtttctcgacgacagcttccggaagtgggctagaattcgggagtttgttccaccctttggaataaaagggcaggtgctggatgctcaatatcccgcaagagaaagggtgagtgccgaggctggagaatcttctcgccaccattag

SEQ ID NO: 207070 - DNA, 642 bp, Artificial Sequence
  Description of Artificial Sequence: Synthetic coding sequence
atgcggaccagcgccgagtacttccggctggccctgagcaagctgcagagctgcgacctgttcgacgaattcgacaagatgaacaatggcccagtgctggggcatgaagaggaggtgggaaggaggactacttttaggcttttttatcctgagtcagtcttctcagaccctatccacaatgatcctaacacaacggtgattctgactgcattcaaaccacatgatctgagatggctgttggagcttcttatgggtgacaaaattaataccaatggtttctggaaaaaaccagctctgaacttaatttacaaaccttaccagattaggattctcgacccctttattattaggaccgccgcctatgaactgctccactttcccaaggtctttccaaaaaaccagaagcccaagcaccctaccacaggtataattgctattactttggccttctatatttgccacgaagttcaccttgcaggcttcaagtacaatttttccgatctgaaaagtcccctccattattatggtaacgccactatgtccctcatgaataagaatgcttatcataacgttactgcggagcaacttttcttaaaagacatcattgaaaaaaatttagtaatcaatctcacccaggattag

SEQ ID NO: 207071 - DNA, 996 bp, Artificial Sequence
  Description of Artificial Sequence: Synthetic coding sequence
atgcggggctacctggtggccatcttcctgagcgccgtgttcctgtactacgtattacattgcatactttgggggacaaatgtgtattgggtggcaccagtggagatgaagaggaggaacaaaatccaaccttgtctgtcaaagccagctttcgcttcattactcaggtttcaccaattccatccttttctttgcgccgccgattttcgtaagatagcctctctgtacggtagcgataagtttgatttaccttatggaatgcgcacttctgccgaatatttccgtttagccttatccaaacttcagtcctgtgacttatttgacgaattcgacaatatcccctgcaaaaaatgcgtcgtcgtcgggaacggcggagttctgaagaacaaaacattgggagagaagatagattcatacgacgtgattattagaatgaacaacggccccgtgctgggccatgaggaagaagtcggccggagaactacttttaggcttttctacccggagagtgtgtttagcgatcccattcacaacgacccaaatacaacagtgatactcaccgcttttaagccacatgacctgcgctggctgctggaactgttaatgggggataaaatcaacaccaatgggttctggaagaagcccgccttgaatctgatctataagccttatcaaatacggatcttagatccattcattattcgcaccgctgcctacgagctgctgcatttccccaaggtgtttcctaagaaccagaaaccaaagcacccaacgacggggattatcgccattacgctggccttttacatttgtcacgaagtccatctggctggctttaagtacaattttagcgatttaaaaagccctttacattactatggcaacgccactatgtcactgatgaacaaaaacgcctaccacaacgttacggcagagcagctgtttctcaaagatatcattgagaaaaatctcgtgatcaacctgacacaagattag

SEQ ID NO: 207072 - DNA, 996 bp, Artificial Sequence
  Description of Artificial Sequence: Synthetic coding sequence
atgcggggctacctggtggccatcttcctgagcgccgtgttcctgtattacgtgttgcactgtattctctggggcaccaacgtttattgggtggcacccgtggagatgaagcgacggaataaaattcagccctgcctgagcaagcccgccttcgcttccctcctcagattccatcaattccaccccttcctgtgtgcggccgattttcgcaaaatagcatctctgtatggcagtgacaagtttgacctcccttacgggatgagaacctctgccgagtacttcaggctggccctgtctaaactgcagagttgtgatcttttcgatgagttcgacaatattccctgcaagaaatgcgtggtggtgggcaatggcggagtgctgaagaacaaaaccctgggcgaaaaaatcgactcctatgatgtgattatccgaatgaacaatgggcccgtgctgggtcatgaagaggaagtgggcagaaggactaccttcaggcttttttatccagagtccgtcttctccgatcccatccacaacgaccccaataccaccgtaattcttacagcgttcaaaccccatgatttaagatggctccttgaactgctaatgggcgataagattaacactaatggtttttggaagaaacccgcactcaatcttatctataagccatatcagatccgaattctcgatccctttattatcagaaccgccgcatatgagcttctgcactttcctaaagtgttccccaagaatcagaagccaaaacatcctactaccggtataattgcaatcacactggcattttacatatgccacgaggtgcaccttgcaggttttaaatacaactttagcgacctgaagtcccccctgcactattacggtaacgctacaatgagcctgatgaacaaaaatgcctaccacaacgtcaccgctgaacagttatttcttaaggacatcatcgaaaaaaatctcgtaatcaatctgacccaggactag

SEQ ID NO: 207073 - DNA, 696 bp, Artificial Sequence
  Description of Artificial Sequence: Synthetic coding sequence
atgcggggctacctggtggccatcttcctgagcgccgtgttcctgtattatgtgttgcactgcattctctgggggaccaacgtctactgggttgctccagttgagatgaaaaggagaaacaaaattcagccctgtctgtcgaagcccgcttttgcaagtctgcttcgattccaccagtttcaccccttcctctgtgctgccgattttagaaaaatcgctagtctatacgggtcggacaagttcgacctgccgtatgggatgcggaccagtgccgaatacttcagactggctctgtctaagctgcagagctgcgacttattcgacgaattcgataatattccttgtaaaaaatgcgttgtcgttgggaatggcggggtcctgaaaaataaaactcttggggaaaagatcgattcttatgatgtgattattagaatgaacaacggtccggtactgggacacgaagaggaggtgggcagaaggactacgttcaggcttttctacccagagagtgtttttagtgacccgatccacaacgaccctaacacaacggtgatcctcaccgccttcaaacctcacgacctgagatggctacttgaacttcttatgggtgataagattaacactaatgggttttggaagaagcccgccttaaatctcatatataaaccctaccagattagaattcttgatccctag

SEQ ID NO: 207074 - DNA, 741 bp, Artificial Sequence
  Description of Artificial Sequence: Synthetic coding sequence
atgcactgccgggactgcgccctggtgaccagcagcggccacctgctgcactcgcgccaaggatcacagatcgatcagactgagtgtgtcatacggatgaatgatgcacctacgcggggttacggtagagatgtcggcaatagaacatctctgcgggttatcgcacatagctctattcagcggatccttaggaacagacacgatctgcttaacgtgagccagggcacagtgttcattttctggggcccctcctcctatatgaggcgggacggcaaagggcaggtctataataatctgcacctgctgagccaggtgttgccccgcctcaaagccttcatgatcacacgacataaaatgctgcaattcgacgaactctttaaacaagaaaccgggaaagacagaaagatcagcaatacatggctgagtaccggctggtttaccatgaccatcgctctggagctatgcgatcgcattaacgtgtatggcatggtccctcccgacttctgtcgtgatcctaatcatccaagcgttccctatcactattacgagccattcggcccagatgaatgtaccatgtacctgagccatgagagaggtagaaaaggctcacatcacaggttcattaccgagaaacgcgttttcaagaattgggcaaggacatttaacatacattttttccagcctgattggaagcccgagtcgctggccatcaaccatcccgagaacaagcctgtcttttag

SEQ ID NO: 207075 - DNA, 1011 bp, Artificial Sequence
  Description of Artificial Sequence: Synthetic coding sequence
atgaagaccctgatgcggcacggcctggccgtgtgcctggccctgaccaccatgtgcaccagtttactcctcgtctacagtagcctgggcggtcagaaagagcgccctccccagcagcagcagcaacagcaacagcagcagcaacaggcttccgccactgggtccagccagcctgcagcggagtcatctactcagcagaggccaggagtccccgctggaccacggccgttagatggctacttgggtgtggccgatcacaaacctctgaaaatgcactgtcgagactgcgccctggtcacgtcctccgggcatcttctgcactccagacagggctcacagattgaccagaccgagtgcgttattagaatgaatgacgctcctacccgggggtacgggcgcgatgtcgggaaccgcacatccttgcgtgttattgcccatagttctatccagcgtatcttgagaaacagacatgatttacttaatgtatcccagggaacagtgtttatattttggggtcctagtagctacatgaggagagatggtaaagggcaagtatataataatttgcacctccttagccaagtgcttccacggctgaaagctttcatgatcacccgtcacaagatgctgcaatttgacgaactgttcaagcaggaaaccggcaaagacagaaagatctctaacacatggctgagcacggggtggttcacaatgaccattgccctggaactctgcgaccggataaacgtgtacggcatggtcccccccgatttctgccgagaccccaaccatccaagtgtcccctatcactattacgagcctttcggtcctgacgaatgcactatgtatttaagtcacgagaggggccggaagggtagccaccacaggtttataacagaaaaacgcgtattcaagaattgggcccggactttcaacatccacttcttccagcctgactggaaacccgaatctctggccatcaaccaccccgagaacaaaccagtattttag

SEQ ID NO: 207076 - DNA, 1275 bp, Artificial Sequence
  Description of Artificial Sequence: Synthetic coding sequence
atgagcgaccacggcgacgtgagcctgccccccgaggaccgggtgcgtgccctgagccagctcggttctgctgtggaggtcaacgaagacattccacctcgtaggtacttcagatctggggttgagatcatccggatggcatctatttattctgaggagggcaatatcgagcacgcttttatactgtataacaagtatatcactctttttatagagaaattacctaagcatagggattacaagagcgcggtcattcctgagaagaaggacaccgttaagaaactgaaggaaatagctttcccaaaggctgaggagcttaaggccgaacttctcaaacgttacaccaaggaatacactgaatacaacgaggagaaaaagaaagaggctgaagaactggcaagaaacatggctattcagcaggagttggaaaaggaaaaacaaagagtggcccaacagaagcaacagcagctggaacaggagcagtttcacgcatttgaggagatgattcggaaccaggaactcgagaaagagagactcaagattgtacaggaattcggaaaggtagatccaggacttggcggacctctggtacccgatctggaaaaaccttccctagatgtattccctacactcactgtctcatcaatccagcccagcgactgccacactacggttcggcctgcaaaaccccctgtggttgaccggagcttgaaacccggtgctctctccaattccgaatcaattcccacgattgatggcttgagacacgttgtcgtgccaggcaggctctgtcctcagttcctgcagctcgcctctgcaaatacagcgaggggagtcgaaacctgtggcatcctgtgtgggaaattaatgaggaatgagtttaccatcacacatgtgttgatacctaagcaaagcgccgggagtgactactgtaatacagaaaacgaagaagaactgtttctgatacaggaccagcaagggctcatcacactcggctggatccacactcatcctactcaaaccgcattcctatcttctgtggatcttcacacacattgctcctaccagatgatgctgcccgaaagtgtagccattgtatgctctcccaagttccaagagacagggttttttaagttgaccgatcatggtctcgaagagatcagctcctgtcggcaaaaagggtttcacccgcactcaaaggatccacccctgttttgtagctgttctcatgtgaccgtagtcgacagggctgtcaccatcaccgatcttagatag

SEQ ID NO: 207077 - DNA, 1275 bp, Artificial Sequence
  Description of Artificial Sequence: Synthetic coding sequence
atgagcgaccacggcgacgtgagcctgccccccgaggaccgggtgcgagcactgtctcagctggggagtgcggtggaagtgaatgaagacataccacccaggcgatactttagatcaggagtggagatcatacggatggcatcaatatactctgaagagggcaacattgaacacgcatttattttatacaacaaatacatcacactgtttattgagaagcttcccaagcaccgcgactacaagagcgccgtgatccccgagaagaaagacacagtcaagaaactgaaagagattgcatttccaaaggcagaggagctgaaggctgagcttctgaagagatacaccaaggagtatacagaatataacgaagaaaaaaaaaaggaggcagaggagctagcccgcaacatggccatccagcaagagttagaaaaagaaaaacaaagggtggcccagcagaagcagcaacaactcgaacaggaacagttccacgcctttgaggagatgattcggaaccaggaactggagaaggagaggttgaaaatcgtccaggagttcggaaaggtcgatcctgggctcggaggacctctagtcccagaccttgagaaacccagcctcgatgtgttcccgacgctgaccgtgtcttccatacagccttctgattgccatactaccgtgaggccagcaaagcctcctgtggtggacaggtcgctgaagccaggtgcgctgtcaaactcggaatcaatcccaacaattgacggtctgaggcacgttgtggtgccgggacgcctctgcccccagttcttgcaactggccagcgctaataccgcgcgcggagtggaaacgtgtggcattctatgtggcaagctgatgaggaacgaatttactattacacatgtgttgatcccaaaacagagtgcgggctccgactattgtaacaccgagaatgaggaggaactatttcttattcaggaccagcagggcctgatcactctcggctggatccatacccacccaacacagaccgcattcctgtccagcgtggacttacatacacattgtagttatcagatgatgctccctgaatctgtcgcgattgtatgttcaccaaagttccaggaaacgggatttttcaagctcactgatcatggactggaggaaatatcgagttgtcgccagaagggctttcacccccactccaaagatcctccgctcttctgcagttgttcccacgttaccgtggtggatagggcagtgaccatcactgatttgcgctag

SEQ ID NO: 207078 - DNA, 1275 bp, Artificial Sequence
  Description of Artificial Sequence: Synthetic coding sequence
atgagcgaccacggcgacgtgagcctgccccccgaggaccgggtgcgagccctttcccagctcggctcagctgtcgaggtgaacgaggacataccgcctcggcgatattttcgatccggtgtggagattatccggatggccagtatctatagcgaagagggcaacatcgaacatgcttttatcctgtataacaaatacattaccctcttcatagaaaagctaccaaaacatcgagactataagagtgccgttataccagaaaagaaagacacagtgaaaaaattgaaggaaatcgccttcccgaaagctgaggaattaaaggccgagctgctaaagcggtacactaaagaatacaccgaatacaatgaggagaagaaaaaggaagccgaggagctcgccaggaatatggccatacagcaggagctggagaaggaaaagcagcgagtcgcccagcagaagcaacagcaactggagcaggagcagttccatgcatttgaagaaatgattagaaaccaggagctcgaaaaggagcggttgaaaattgtacaggagttcggcaaagtcgaccctggcctcggaggcccacttgtgccagatctagaaaagccttctcttgacgtctttccaaccctgacagtgagctcaatccagccaagcgattgtcacaccactgtccgcccggctaagccaccagtggttgaccgatcacttaaacccggcgccctgagcaatagcgagagtatcccaaccatagacggtctaagacatgtggttgtgcctggtcggttgtgcccacagttcttacaattggcgtcggcaaatacggcccgtggcgttgaaacatgcgggatcctgtgtggcaaactaatgcggaatgagttcacgatcacccatgtactcattcctaagcagagcgctggaagcgactactgtaacaccgagaacgaagaggagcttttcctaatacaggatcagcaggggttgattacgctcggctggatacacacgcatcccacccagaccgctttcctatcctccgtggatctccatacccactgctcttaccagatgatgctgccagagtctgtggccattgtgtgctcccccaaatttcaggagacagggttcttcaagttaactgaccatggcttagaggaaatttcttcttgccgccagaaaggatttcatccccattccaaagaccccccccttttctgctcctgctctcacgtgactgtggtggatcgggccgttaccattaccgatctcaggtag

SEQ ID NO: 207079 - DNA, 1275 bp, Artificial Sequence
  Description of Artificial Sequence: Synthetic coding sequence
atgagcgaccacggcgacgtgagcctgccccccgaggaccgggtgagggccctgtcccagctgggcagtgctgtcgaggttaacgaggatatccctccaagacgctactttcgtagtggcgtggaaattatccggatggcttcaatttacagcgaggagggaaacatcgaacatgcgtttattctgtacaataagtacattacgctgtttatcgagaaactgcctaaacatagagactacaaaagtgcagtgataccagaaaagaaggataccgtgaagaaactcaaggagatcgccttccctaaggcagaggaactgaaggcggagctgcttaaacgctacaccaaggaatataccgaatataatgaagaaaaaaagaaagaggctgaagaactggccaggaatatggccatccaacaggagctcgaaaaagaaaaacagcgtgttgcccagcagaagcagcagcagctggagcaagagcagttccacgcctttgaggagatgataaggaaccaggaactcgagaaagagaggttaaagattgtccaagagttcggcaaggtcgaccccggtttggggggtcctcttgtccctgacctcgaaaagccctctctggacgtgttccccacactgacagtttcctcaattcagccatccgattgccacacaactgtgagacctgctaagccgcctgtggtagacagatctttaaaacctggcgccctgagcaactctgagtctatacccactattgacggacttcggcacgtcgtcgttccagggaggctgtgcccacaattccttcagcttgcctcggccaataccgctagaggtgtggaaacctgtggtattctgtgcgggaaacttatgcgcaatgagttcaccataacacacgtgctgatccccaaacagtccgcagggtccgattattgtaacacagaaaatgaggaggagctgttcctcattcaagatcagcagggcctgatcacacttggctggattcatacccaccccacacagacggctttcctctccagtgtagacctccacacgcattgttcataccagatgatgcttccggaaagtgttgcaattgtgtgcagccctaaattccaagagaccgggtttttcaaattgaccgaccacggacttgaggaaatctctagctgtcgccagaaaggctttcacccccactctaaggatccgcctctgttttgctcctgttctcacgtcactgttgtggatcgcgccgtgacaattaccgacctgcgttag

SEQ ID NO: 207080 - DNA, 492 bp, Artificial Sequence
  Description of Artificial Sequence: Synthetic coding sequence
atgagcgaccacggcgacgtgagcctgccccccgaggaccgggtgagggccctgagccagttggggtctgctgtggaagtaaatgaagatataccacctagaaggtactttaggtccggggtcgagattatccgtatggcgtcaatatactctgaggaagggaacatcgaacatgcctttattctttacaacaaatacataacgttattcattgaaaagctgcctaagcaccgggactacaaaagcgctgtgattcccgaaaagaaggacaccgtcaaaaaactcaaagaaatcgccttccctaaggctgaggagttgaaagccgagctgttgaagaggtatacaaaggaatatacagagtacaatgaagagaagaaaaaggaggccgaggagctggcgagaaatatggctatccagcaggagttggaaaaagaaaagcagcgggtggcccaacagaaacaacaacagttggagcaagagcagtttcattag

SEQ ID NO: 207081 - DNA, 957 bp, Artificial Sequence
  Description of Artificial Sequence: Synthetic coding sequence
atgagcgaccacggcgacgtgagcctgccccccgaggaccgggtgcgggcgttatctcagctggggtctgccgtagaagtgaacgaggacatcccacccagaagatattttcggtccggcgtggagatcattcgaatggcaagcatctacagtgaggagggcaatatcgagcacgcttttatcctgtacaacaaatacatcactctcttcatcgagaagcttccaaaacatagagattataagagcgcggtgatccccgaaaagaaggataccgtcaagaagttaaaggaaattgctttcccaaaagcagaagaattaaaggccgagctgctcaagagatacacaaaggaatataccgaatataatgaggaaaaaaaaaaggaggccgaagagcttgcacgaaacatggcaatccagcaggagctggaaaaagagaagcaacgagtggcacagcagaagcagcagcagttagagcaggagcagtttcacgcctttgaagaaatgatacgtaaccaggagctcgagaaagagcgattgaagattgttcaggagttcgggaaggtggatcctggtctgggtggccccctggtgccagacttggaaaaaccttccctcgacgtcttccctacactgactgtgagcagtatccagccgtccgactgtcatacaacagtgcgaccggccaagccacccgttgtagataggagtttgaaacccggggcactaagcaattccgaatccattcccacaattgacggcttgaggcatgttgttgtgcccggacgattgtgtcctcaattcctgcagctagcttccgctaacacagcaagaggcgtggagacttgcggtattctgtgtggtaagctcatgcgcaacgaattcacaatcacccacgtacttattcccaagcagagcgccgggtccgattactgtaacactgagaacgaagaggaatag

SEQ ID NO: 207082 - DNA, 414 bp, Artificial Sequence
  Description of Artificial Sequence: Synthetic coding sequence
atgagcgaccacggcgacgtgagcctgccccccgaggaccgggtgcgtgccttgtcccagttgggctcagccgtggaagttaacgaagacataccaccccgacggtatttccggtccggagtggagattatccgcatggcctctatctattccgaggagggaaacattgaacacgcctttatactgtacaataagtacatcacactattcatcgagaagctccccaagcatagggattataagtccgcagttattccggaaaaaaaggacaccgttaagaagctgaaggaaatagcatttcccaaagctgaagaactgaaggcagaactgctcaaaagatacacaaaggaatataccgagtataatgaagagaagaagaaggaggctgaggaactggcccggaacatggcatag

SEQ ID NO: 207083 - DNA, 1047 bp, Artificial Sequence
  Description of Artificial Sequence: Synthetic coding sequence
atgagcgaccacggcgacgtgagcctgccccccgaggaccgggtgcgagctctttcccaacttggcagcgccgtcgaggtgaatgaggatatacccccacgccggtatttccggtctggcgttgagatcattcgaatggcgtcgatatatagtgaggaaggaaatatagagcatgcatttatcctgtacaacaaatacatcacgctgtttattgagaagctccccaaacacagggactacaagtcagcagtgatcccggaaaagaaagacacggtaaagaaactgaaggaaatagcctttcctaaagccgaagagcttaaagccgagctcttgaaacgatacaccaaggagtacactgaatacaacgaagagaagaagaaagaggctgaagaactcgcccggaacatggcaatccagcaggaattagagaaggagaaacagcgtgtcgctcagcagaaacagcagcagctagagcaagagcagttccacgcttttgaagaaatgattcggaatcaagaactcgagaaggagcgcttaaagattgtgcaggaattcggaaaagtggatccggggctgggagggcccttggttcctgatctagaaaagccttccctggatgtcttccccaccctgaccgtgtcatcaatccaaccgtcagattgccatactaccgtgagacctgctaaaccacctgtcgttgatcggagtctgaaaccgggcgcattgagcaattccgagtctatcccgactatagacggactcaggcacgttgtcgtgccaggacggctatgcccacagtttctgcaactggccagcgctaacacggcacggggcgtggaaacttgtggcattctgtgtggcaagctgatgaggaatgagtttactataacccatgtgctcatacccaagcagagtgcaggtagtgattattgcaataccgagaatgaggaggagttgtttctgattcaggaccaacaggggcttatcacactggggtggatacacgttgaaacgctgtggtctcttaaaagccttcacgcaccttag

SEQ ID NO: 207084 - DNA, 813 bp, Artificial Sequence
  Description of Artificial Sequence: Synthetic coding sequence
atgcggcagcagcagctggagagcgagcagttcctgttcttcgaggaccagctgaaaaagcaggaactggcacgaggacaaatgcggagtcagcagacatccggattgtctgaacagatcgacggcagtgcgctctcctgtttcagcacgcatcaaaacaattccttactgaacgtcttcgctgaccaaccaaataaaagcgacgcaacaaattacgcctcacactctcctcctgtgaatcgtgctctcacaccagcggctacgctttcagccgtacagaacctcgtagtggaaggtctcagatgtgttgtcctcccagaggacctctgtcacaagttcctccaactagcagagagcaatacagtgcgcggtatagagacttgcggcattctatgtggaaagctgacacacaacgagttcaccatcacgcacgtcatcgtcccaaagcagtcagccgggccggattactgcgacatggaaaacgtcgaggaacttttcaacgtgcaggatcagcatgacctgcttactcttggctggattcacacccacccaacccagaccgctttcctgtcttctgtggaccttcatacccattgcagttatcaactgatgctgccagaggcaatcgccattgtatgcagcccaaagcacaaagataccggcatctttcgactgaccaacgccggcatgctagaggttagcgcttgtaagaaaaaggggtttcacccccacactaaggagcctcgactattctccatatgcaaacatgttctggtcaaagacattaaaattatcgtcctagatctgagatag

SEQ ID NO: 207085 - DNA, 1311 bp, Artificial Sequence
  Description of Artificial Sequence: Synthetic coding sequence
atggaccagcccttcaccgtgaacagcctgaagaagctggccgccatgccagaccacaccgatgtatctctatctcccgaggagagagtgagagcgttgtcgaagctcggttgcaacattactatatctgaagacatcacacctcgtcgatactttcggagcggcgtggaaatggagcggatggcttcggtgtatttggaggagggcaaccttgagaacgctttcgtgttgtacaataagttcatcacactgttcgtggagaaactcccgaaccatcgggattaccagcagtgtgcggtgccggagaagcaagatatcatgaagaaactcaaagaaattgcctttcctcgtactgacgagcttaaaaatgatttactcaagaaatataacgtcgaataccaggaatatcttcaatcaaaaaataaatacaaggccgaaattctgaagaagctggagcatcagaggctcatcgaagcagagcgcaagaggatcgcacagatgcgccagcagcagctagagagtgaacagtttctattctttgaggaccagctgaagaaacaggagctggctagaggccaaatgagatcccagcaaactagtggactcagcgagcagattgacggatctgcgctgagctgcttctctacgcatcagaataactccctactgaacgtgttcgctgaccagcccaataaaagcgacgcaaccaattacgcctcccactcaccccccgttaacagggctctcaccccggcagcaacacttagcgcggtgcagaacctggtggtagagggccttagatgcgtggttctgcctgaggatctgtgtcataaatttttgcagctggccgaatccaacaccgttcgcgggattgaaacttgtggcatcctgtgcggtaaacttacccacaatgaattcaccatcactcatgtcatcgtgcccaagcagagcgccggcccagactattgcgatatggaaaacgtggaagaactgttcaatgtccaagaccagcatgatctcttaacacttggttggatccacactcaccctacacagaccgcatttctgtctagtgtggatcttcatacccactgcagctatcagttaatgctgcctgaagcgattgctatcgtgtgttcccctaagcataaagataccggaatatttagactgactaacgccggaatgcttgaggtctcggcctgtaaaaagaaagggttccaccctcacacaaaagagccaagacttttcagtatctgcaaacacgtcctcgtcaaggatattaagataatcgtgctggatttgagatag

SEQ ID NO: 207086 - DNA, 1311 bp, Artificial Sequence
  Description of Artificial Sequence: Synthetic coding sequence
atggaccagcccttcaccgtgaacagcctgaagaagctggccgccatgcctgatcatacagacgtgtcattgtcccctgaggaaagagttagggctcttagtaagctgggatgcaatatcacaataagcgaagatattacgccccgccggtatttccgatctggcgtagaaatggaaagaatggcaagcgtctatcttgaggagggaaatctggagaatgcttttgtgctttacaacaagttcattacgctatttgtcgagaaactgccaaatcatcgcgactatcagcagtgcgcggtgcccgaaaaacaggatatcatgaaaaaactgaaggagatagcattccctcgcacagatgagctgaagaatgacctgctaaagaagtacaacgtggaataccaggaatacttgcagtccaagaataaatataaagcagagattttgaagaagctggagcatcagagattgatcgaggccgaaaggaagagaattgctcagatgcggcaacaacagctcgagagtgaacagttcttgtttttcgaggatcagctgaaaaagcaagaactggccagggggcagatgcgaagccagcagacctcaggactttcagagcagatcgacggcagtgcactttcatgcttttcaactcatcagaacaactccctactgaacgttttcgccgatcagcccaacaagtcagacgccaccaattatgcttcacacagtccccctgtcaaccgcgcattgacgcccgctgccacactgtctgcagtgcagaatttagtcgtggagggtttgcgatgcgtggtgctcccggaggatctctgtcacaaatttctacagctcgccgagtcaaatactgtgcggggtatcgagacctgcggcatactgtgtgggaagttgacgcataatgagtttactattactcacgtgatagtgccaaagcagtcagctggacccgattactgcgacatggagaatgttgaggagctgttcaatgtacaggatcaacacgacttgcttactctcggatggatccatactcacccaactcaaacggcatttttgtctagtgtggacctccatacccactgtagctaccagctcatgctaccagaggccattgccattgtctgtagccctaagcataaggacacaggaatttttcgactaacaaatgccggtatgctggaggttagcgcttgcaaaaaaaaaggtttccatccgcatacgaaagagcccagactgtttagtatttgtaaacacgtgctggtcaaggacattaaaataattgtgctcgatttgagatag

SEQ ID NO: 207087 - DNA, 1386 bp, Artificial Sequence
  Description of Artificial Sequence: Synthetic coding sequence
atggaccagcccttcaccgtgaacagcctgaagaagctggccgccatgccagatcatacagatgtcagcttgtctcctgaggaaagggtgagagccctgtctaaactcggctgcaacatcaccatttctgaagacatcacgcctaggcgctacttccgctcaggtgtcgaaatggagaggatggcttctgtgtacctcgaggaaggtaacttggagaacgcattcgtgttatataacaaattcattacattattcgtagaaaagttaccaaatcatagggactatcagcagtgcgcggtgccggaaaagcaggacatcatgaagaagcttaaggaaattgccttcccacggacagatgaactcaaaaacgacctattaaagaagtacaacgtggagtaccaagagtacctgcagtccaaaaataagtataaggcagagatcttaaaaaaactggagcaccaacgtttgatcgaggcagaacgcaagaggatcgcccagatgaggcaacagcagctggaatcagagcagtttctgttcttcgaagaccaattgaagaagcaggagttggcacgcggccaaatgcggtcacagcagacatctgggctgtcagagcaaatcgacggctctgccctgtcttgcttttccacccaccaaaataatagccttttaaatgtctttgctgatcagcccaataaatccgacgctaccaattacgcatctcacagcccaccggtaaacagagcattgacccctgctgcaacactgtcagcagtccagaacctggtagtggaggggctgaggtgcgtcgtgcttcccgaggatttatgccacaagttcctgcagctcgctgaatcaaacactgttaggggaatcgaaacttgtggtatattgtgtgggaaactcacacacaatgagtttacaataacccatgtgatagttccaaagcagtcggccggacctgattattgtgatatggaaaatgtggaagaactgttcaacgtgcaagaccagcacgacttgttgacgttaggctggattcatacacatccaactcagacagccttcttgtccagtgtggatctccacacacactgctcctaccagttgatgcttccagaggcaattgctattgtgtgttctcctaaacataaagatactgggatcttcaggctgactaacgcagggatgctagaagtgagcgcatgtaaaaaaaaaggttttcaccctcacactaaggagcccaggttgttttctatacaaaagttcctttcaggcattatcagtgggaccgcactggagatggagcctctcaagattgggtacgggcccaatggtttcccactgctgggaatcagcagaagttccagtcctagtgaacagttatag

SEQ ID NO: 207088 - DNA, 267 bp, Artificial Sequence
  Description of Artificial Sequence: Synthetic coding sequence
atgagcatcatggaccacagccccaccaccggcgtggtgaccgtgatcgttatactgattgctatcgccgcactcggtgccttgatcctcgggtgctggtgttacctgcgtctgcaaagaatcagccaatcggaggacgaagaatctattgtgggagacggcgaaaccaaggagcccttcctgctggtgcagtactcggccaagggcccatgcgtcgagcgaaaggccaagcttatgaccccaaacgggcccgaagtgcacggctag

SEQ ID NO: 207089 - DNA, 744 bp, Artificial Sequence
  Description of Artificial Sequence: Synthetic coding sequence
atgctgcagaacagcgccgtgctgctggtgctggtgatcagcgcctctgctacacacgaggccgagcaaaatgactcggtgtcacctagaaaaagtagggttgctgctcagaactctgcggaggtagtaaggtgtttgaactcggcgcttcaggtgggctgtggcgccttcgcatgtttggaaaatagcacttgtgacacagacggtatgtacgatatctgcaaatctttcctctacagcgctgccaaatttgatactcaggggaaagcgttcgttaaggagtccctgaagtgcatagcgaatggagtcaccagcaaagtgttcctcgctatcaggagatgcagcacctttcagagaatgattgcagaagtgcaggaagaatgttacagtaagttaaatgtgtgcagcatcgcgaagaggaaccctgaggctatcactgaggttgtccagctgcccaaccatttttcaaaccgttattacaatcgactggtgagatccctgctcgaatgtgatgaagataccgtttccacaatccgggatagcctaatggaaaagattgggcccaacatggccagcctctttcatattctgcagaccgaccactgtgctcagacccaccctcgagcggacttcaaccggcgtcgtacaaacgaacctcaaaaactgaaggtgctgctgcgcaatctaagaggcgaagaggattccccatcccatataaaacgcacctcacatgaaagcgcctag

SEQ ID NO: 207090 - DNA, 537 bp, Artificial Sequence
  Description of Artificial Sequence: Synthetic coding sequence
atgtacgacatctgcaagagcttcctgtacagcgccgccaagttcgatacccagggaaaagcctttgtgaaggaatcccttaaatgcattgccaacggggtgacaagcaaagtctttctcgcgattcgccgctgttccaccttccagcggatgatagcagaggtacaggaagaatgctactcgaaactgaacgtctgtagcatagcgaaaaggaatcccgaagctataaccgaagtggtgcaactgcctaatcatttctcgaacaggtattacaatagactagtgcgtagccttcttgagtgtgacgaagataccgtatccacaatccgcgactccttgatggagaaaattggccccaatatggcttctctgtttcatatccttcagacagatcattgcgcccagacacacccccgagccgacttcaaccggcggcgcacgaacgagccacagaaacttaaagtgctcctgcgtaatctaaggggcgaggaagactcaccttcacacattaagcgaacctcgcatgagtccgcttag

SEQ ID NO: 207091 - DNA, 537 bp, Artificial Sequence
  Description of Artificial Sequence: Synthetic coding sequence
atgtacgacatctgcaagagcttcctgtacagcgccgccaagttcgacactcagggtaaggcatttgttaaagaaagcctgaagtgcatagctaacggcgtcaccagcaaagtgtttctggccattcgaagatgttccacatttcagcgcatgatcgctgaagtccaggaggagtgctattctaaattgaacgtgtgtagtatcgctaagcgcaatccagaggccatcacagaggtggtgcaattacctaaccatttttctaatagatactacaatcgcttagtaagatcccttctagaatgcgacgaggataccgtctctacaatcagagactcactaatggaaaagataggcccaaacatggcgtcacttttccatattctccaaactgaccattgcgcccagactcatcctcgcgctgatttcaaccgtagacggacaaatgagccgcagaagctgaaagtgcttctgagaaaccttcgcggcgaggaggactccccatcacatataaagcgtacaagtcacgagagcgcttag

SEQ ID NO: 207092 - DNA, 2733 bp, Artificial Sequence
  Description of Artificial Sequence: Synthetic coding sequence
atggccagcagcgcccagagcggcggcagcagcggcggccccgccgtgccgacggtgcagagagggattatcaaaatggtgttatcaggatgtgctattattgtccgcggacagccgcgaggggggcctccacctgaaaggcagattaacctaagcaatatcagggcaggaaatttagcccgacgcgccgccgccactcaaccagatgccaaagataccccagatgaaccatgggcctttcccgctagggaattcctccgtaagaaacttatcgggaaagaggtatgctttacaatagagaataagactcctcaaggaagagagtacggaatgatatatcttggaaaggacacaaatggagagaacattgcggaaagtcttgtggccgagggccttgcaacaaggagagagggaatgcgagccaataacccagagcagaataggctgtcagaatgtgaggaacaggcaaaggccgccaaaaagggcatgtggtccgagggcaatggaagtcataccatacgagatctgaagtacacaattgagaacccgcgtcatttcgtcgacagtcaccaccagaagcccgtgaatgcgattatcgagcacgtgcgtgacggttctgttgtccgcgctctgctgctcccagattactaccttgtgacagtgatgctcagcggcattaaatgccctacattccggcgggaagcagacggaagtgaaacacccgagccgtttgccgcggaggccaagttctttaccgaatcaagactcctccagagagacgtccaaataattcttgaatcttgccataaccaaaacatcctgggaaccatcctgcatccaaacgggaatattaccgagctgcttctcaaagaaggtttcgctaggtgtgtggactggtccatcgccgtttacaccagaggggctgagaagctgcgtgccgcagagcggtttgcaaaagaacgacgcctccgaatctggcgcgattatgtagctcccactgcgaacttggatcaaaaggacaaacaattcgtagcaaaggtgatgcaggtgttgaatgccgatgcaatcgtagtgaaattaaattccggtgattataaaactatacacctgagttccatcaggccccctcggctcgaaggagaaaatacacaggacaaaaataagaaactgcgtccattatatgatatcccatacatgttcgaagcgagagagttcctcaggaaaaaactgattggaaagaaagtgaatgttacagtggactacatcagacccgcctctccagccaccgaaacagtgcccgctttctctgagcgtacgtgcgcaactgttacaattgggggcattaacattgccgaggctctcgtgagcaagggtcttgccacggtgattcggtataggcaagatgatgaccagcgctcaagtcactacgacgaactgttggccgcagaagcgagagctatcaagaacggcaagggtctgcattctaaaaaggaggtcccgatccatagggtcgccgacataagcggcgacacccagaaagcaaagcagtttctgccttttcttcagagagccggaagaagcgaggctgtagtcgaatacgtattctctggttccagactcaagctctacttacccaaagagacgtgtctcattactttcctgctcgcggggattgagtgtccacggggcgcccgaaacctacccggtctggtacaggaaggcgaacccttctccgaggaagctaccctgtttactaaagagcttgttctgcagcgagaagtggaggtcgaggttgaaagcatggataaagcaggcaactttatcggctggctgcacatagatggcgccaacctgagcgtgctcctggtggagcacgccctgagtaaagtgcacttcactgctgaacgttcctcatactataagtctcttctatcagctgaagaggcggctaaacagaagaaggaaaaagtgtgggcccattacgaagaacagccggtggaggaggttatgcccgtgctggaggagaaggaaaggagcgcatcatataaacccgtttttgtgactgaaatcactgatgacctgcatttctatgtgcaggatgtggagacagggacccaactggagaagctgatggaaaacatgcggaatgatatcgccagccacccgcctgtggaaggttcttatgcaccacggcggggagaattctgcatagcaaagttcgtcgacggtgagtggtaccgagcccgcgtcgagaaagttgaatccccagcaaaaattcacgttttttacattgactacggtaaccgggaagtactgcctagcaccagactgggcacactcagccccgctttcagcacacgagtgctgcccgcccaagctactgaatatgcatttgctttcattcaggtcccacaggatgacgatgctcgtactgacgccgttgactcagtggtgagggacattcagaatactcagtgcctgcttaatgttgagcacctttctgccggatgtccacatgtgacattgcaattcgctgacagtaaaggtgacgttggcttggggcttgtgaaagaaggcctggtcatggtcgaagtccggaaggagaaacagttccagaaggtgattactgaatacctcaacgctcaggaaagcgctaaaagtgcacgcctgaacctttggagatacggagattttcgcgctgacgatgctgatgagtttggatactcacgctag

SEQ ID NO: 207093 - DNA, 2703 bp, Artificial Sequence
  Description of Artificial Sequence: Synthetic coding sequence
atggccagcagcgccgtgcccaccgtgcagcggggcatcatcaagatggtgctgtctggttgtgcaatcatcgtgcgagggcagccccgcggaggccctccacccgaaaggcaaatcaacctaagcaacatccgcgccggcaacctggccagacgcgctgccgccacccagcccgacgccaaggacacacctgacgagccatgggcctttccggctagagagttcttgaggaaaaaattgatcggcaaggaagtctgttttacaatagaaaacaagacaccccagggtagagagtatggtatgatctacctgggtaaggacaccaatggcgaaaacatagcagaatccctagtggctgagggactggccacacgcagggaagggatgagagccaataacccggaacaaaaccgcctttctgaatgtgaagagcaggctaaggctgccaagaaggggatgtggtccgaagggaacggatctcacaccattcgcgacctgaaatatacgatcgagaacccccgtcactttgtggactcccaccaccagaaaccggtcaatgctataattgagcacgtacgagacggaagcgtggttcgggcgcttctactgcccgactactatttggttacagtgatgctttcagggatcaaatgtcctaccttccggagggaggctgatggatccgaaactcccgagccgttcgccgccgaggccaagttttttactgaatctcgtctgctccaaagagatgttcaaatcatactggaaagctgccacaatcaaaatatccttgggactatcctgcaccccaatggcaacatcacagaacttctgttgaaagaggggtttgctcggtgtgtggattggagcatcgccgtctacacccgcggcgccgagaagctccgcgctgctgaaagattcgctaaggaaagacgtctaaggatatggagagactatgtcgcccctaccgctaacctcgaccagaaggacaagcagtttgttgcaaaggtaatgcaggtgttaaacgcggacgctatagtggtgaaactcaactcaggcgactataaaacaattcatctgtccagcatccgtcctccgagactggagggcgaaaatacccaagacaagaacaaaaaacttcgtccactttatgacatcccctatatgttcgaggctagagagttccttagaaaaaagctgattgggaaaaaagttaacgttactgtggattatatacggcccgccagccctgctactgagactgtgcccgccttttctgagcgcacatgtgctaccgtcactatcggcggaattaacatcgccgaagccttagtgtcaaaaggattggcaaccgtgattcgctaccggcaggacgacgaccaacgctctagtcactacgacgagttgcttgctgctgaggccagggctataaagaatggcaaggggctccatagcaaaaaggaggtgcctatccaccgggtggcggatatttcaggcgatacccaaaaagccaagcagtttctgccatttctgcaacgggccggtcggagcgaggcggttgtggagtatgttttctccggaagtagactgaaattatatctcccaaaagagacctgccttatcacattcctgctcgccggcatcgaatgtcctagaggcgcacggaaccttccgggactggtacaggaaggcgagcctttctctgaagaagctactctctttaccaaggagctggttctgcagcgggaggttgaagtggaagtggagagcatggataaagctggtaactttatcggttggctccatatagatggcgcaaatcttagtgtattacttgtggagcacgctctgagcaaagtgcacttcacagcagagaggagctcatactataaatcgttactctcagccgaggaggcagccaagcaaaaaaaggaaaaagtgtgggcccattatgaggaacagcctgtggaggaagtcatgccagtgcttgaggagaaagagaggtccgctagctataagccagtcttcgtgacagagataactgatgatctgcacttttatgtccaggacgttgagactgggacccagctcgagaaactcatggaaaatatgagaaacgacattgccagtcacccccccgtggagggcagctatgccccccgacgcggagagttctgcatcgcaaagtttgtcgacggggaatggtatcgggccagggtggagaaagtggagagccctgcaaagatccatgtgttctatatagattatggcaacagagaagtgctgccctcaacgaggctggggactctttctccagcattctccactagggtactgcctgcacaagccaccgagtacgcctttgctttcattcaggtgccccaggatgacgacgctagaacagatgctgtggattcagttgtgagagacatccagaacacacagtgtctgcttaatgttgagcatttgagcgccggatgcccacatgttaccctgcaatttgctgatagtaaaggcgacgttggactgggcttagtgaaagaaggcctcgtaatggttgaggtacggaaagagaaacagtttcagaaagtgattaccgaatacctcaatgctcaggaatctgccaagtccgcaagactgaatctgtggaggtatggtgatttccgggcagacgatgccgatgagttcggctattcccggtag

SEQ ID NO: 207094 - DNA, 705 bp, Artificial Sequence
  Description of Artificial Sequence: Synthetic coding sequence
atgaaccacctgcccgaggacatggagaacgccctgaccggcagccagtcttcacatgcctccttgcgtaacatacactctatcaaccccacgcagctaatggcgcgcatcgaatcttacgagggccgcgagaaaaaaggtatcagtgacgtccggcgcaccttttgcctttttgtcaccttcgacctactctttgtcaccttactatggattatagagcttaatgttaatggcgggattgagaataccctcgaaaaggaggtgatgcagtatgactactactctagctacttcgacatctttctcttagccgtcttcaggtttaaagtgctcatactggcgtatgctgtatgcaggcttagacactggtgggcgattgcactgacaaccgcggtcacaagtgcttttctgctcgcaaaagtgatattgtccaagctcttttcccaaggtgcatttgggtacgtgttgcctattatcagctttatcttagcttggattgaaacttggttcctggactttaaagtccttccccaggaggctgaggaggagaatcggctgctgatagttcaagacgcatccgagagagcagcgttgatacccggtggactgagcgatggccagttttacagcccacctgaatctgaggccgggtcagaggaagcagaggagaaacaagattcagagaagccactgctagagctctag

SEQ ID NO: 207095 - DNA, 705 bp, Artificial Sequence
  Description of Artificial Sequence: Synthetic coding sequence
atgaaccacctgcccgaggacatggagaacgccctgaccggcagccagtcatcacacgccagcctgaggaatatacattctattaatccgacacagcttatggccagaatcgagtcatacgaaggacgtgagaaaaagggaatttctgacgtgcggagaaccttctgtctgttcgtgacctttgatctgctgttcgtgacgttattatggatcatcgaactgaacgtgaatggcgggatcgagaatacattggagaaagaagtgatgcagtatgattactattcatcctattttgatatcttcttgttagctgtttttagattcaaggtcctgatattggcctacgccgtctgcagactgcggcactggtgggcgatcgccctgacaaccgcagtgaccagcgcattcctgctggctaaggtgatcctatcaaagctttttagccaaggtgccttcggttacgtcctgccaatcatttcctttattctggcttggattgaaacttggttcctcgatttcaaggtccttccccaggaggccgaagaggagaatcgcctcctgattgtgcaggacgcgtctgagcgcgcagcgcttatcccaggaggtttgagcgatggtcagttctattctccccccgaaagtgaagcaggctcggaggaggccgaggagaaacaggattccgaaaagcccctcctggagctgtag

SEQ ID NO: 207096 - DNA, 621 bp, Artificial Sequence
  Description of Artificial Sequence: Synthetic coding sequence
atgaaccacctgcccgaggacatggagaacgccctgaccggcagccagagttcccatgccagtctgcgcaatattcacagcatcaaccccacacaactgatggcccggattgaaagctacgagggtcgagaaaagaagggaatatctgacgtgaggaggacgttctgcctttttgtcacatttgatctcctgtttgttaccctcctctggattattgagcttaacgttaacggcggcatcgaaaacaccctggaaaaagaagtgatgcaatacgattactatagcagctacttcgacatcttcctgctagccgtcttcagattcaaggttctgattttagcctacgccgtatgcagattgaggcactggtgggccattgcattgacaacggctgtaacaagtgcctttttactcgccaaggttatattatcaaaactgttttctcagggcgcgttcggttatgtgttgcctatcatctcttttatcctggcatggatcgagacgtggttcctcgacttcaaggtgctgccacaggaagccgaggaggagaaccggttactgatcgtgcaggatgcatctgaacgcgcagctcttatacctgggggactaagcgacgggtag

SEQ ID NO: 207097 - DNA, 555 bp, Artificial Sequence
  Description of Artificial Sequence: Synthetic coding sequence
atgaaccacctgcccgaggacatggagaacgccctgaccggcagccagtcatcccacgccagtctccgtaatattcacagcatcaatccaacacaactgatggcacggattgaaagctatgaagggagggaaaaaaaggggatctcagacgtgaggaggacattctgtctgtttgtcaccttcgacctcctatttgttacccttctatggattattgagcttaacgtgaatggaggaattgagaataccctcgaaaaggaggtaatgcagtatgactattacagctcttacttcgacatctttctactggcagtctttaggttcaaagtacttatactcgcttacgcagtctgcaggttgcgccattggtgggctatcgcactcactactgccgtgacatctgccttcctgttggcaaaggtcatcttatccaagcttttctcccagggtgcctttggatatgtgctgccgataatcagttttatcctcgcttggattgaaacttggttccttgacttcaaggtcctacctcaggaagccgaggaagagaactag

SEQ ID NO: 207098 - DNA, 519 bp, Artificial Sequence
  Description of Artificial Sequence: Synthetic coding sequence
atgaaccacctgcccgaggacatggagaacgccctgaccggcagccaatcctcacacgcatctctccggaatatccatagcatcaacccaacacaactgatggccagaattgagtcctatgaggggagagagaaaaaaggcatctccgatgtcaggagaacattttgtctgtttgtcacgttcgatctcttattcgtaactctgctgtggataatagagttaaacgtaaatggaggtatcgagaataccctggaaaaggaggtaatgcagtatgactattactcctcttattttgacatctttctgctggcagtgtttagattcaaggtgcttattcttgcctacgctgtatgtaggcttcgccattggtgggccattgcattaaccactgccgtcacgtccgctttcttgctggcgaaagtaatcctctccaagctgttcagccagggcgctttcggatacgtgctgcccattataagcttcatcctggcctggatcgagacttggttcctggactag

SEQ ID NO: 207099 - DNA, 684 bp, Artificial Sequence
  Description of Artificial Sequence: Synthetic coding sequence
atggagaacgccctgaccggcagccagagcagccacgccagcctgcggaacattcacagcatcaatcccacccagctcatggctcgcatcgagtcatatgagggacgtgagaaaaagggcatttctgacgtgcggcgcaccttctgcctgtttgtcactttcgacctactattcgttactctgctctggattatagagctgaacgtaaacggcggcatcgagaacaccttggaaaaagaagtgatgcagtacgactactacagtagttactttgacattttcctgctggccgtcttccgcttcaaggtgctcatcttggcctatgcagtgtgcaggctgaggcactggtgggccatagctttaaccactgccgttacatctgcatttctgttggctaaagtcattttgtcgaaactgttttctcagggagcattcgggtatgtgctccctatcatttcctttatcctggcttggattgagacctggttcctcgatttcaaggtgctgccccaagaagcagaggaggaaaatagattactgatcgtccaggacgcctccgaaagagccgctctcattcctggaggcctttccgatggccagttttacagcccacctgaaagcgaggctggaagcgaggaggcggaggagaagcaagattcagaaaagcccctcctcgaactctag

SEQ ID NO: 207100 - DNA, 1338 bp, Artificial Sequence
  Description of Artificial Sequence: Synthetic coding sequence
atgagcaagctgccccgggagctgacccgggacctggagcggagcttgcctgctgtggcaagcctcggaagttctctgagccatagtcagtctttgtcgagccatttactccccccccctgaaaagcggcgagcgataagcgacgtccgccgcactttttgcctcttcgttaccttcgacctgctatttatatcgttactctggatcattgagcttaatacaaacacaggcatcagaaaaaacctcgaacaggagattatacagtataacttcaaaacctctttctttgacatcttcgtgctggctttttttcgcttttcgggcctcttgctgggatatgccgtgcttcgcttgcgccactggtgggtaatcgccgtgacaacactggtgagcagcgcttttctgatcgtgaaagttattctatcggagctcctgtcaaaaggtgcatttggatacttgctcccaatcgtgagcttcgttttagcgtggttggaaacttggtttctcgacttcaaggtcctcccccaggaagccgaagaggaaagatggtatctggccgcccaagtcgctgtggcacggggacctctgctattttcaggagctctgtccgagggtcagttttattctccccccgaatcttttgccggatccgataacgaaagtgatgaagaagtcgccgggaagaaaagtttcagtgctcaagaacgggaatatatacgccagggcaaggaggctacagcagttgtagaccagatactggcccaggaggagaattggaaattcgagaaaaacaatgagtacggcgatacagtatacacaattgaggtgccttttcatggaaagacattcattcttaaaaccttcctcccttgcccggcagagcttgtctatcaggaggtgatcctccagcctgagaggatggtcctatggaacaagacagtgaccgcctgtcagattctgcagcgtgtcgaagacaacacactgatttcatacgatgtatctgctggtgctgcaggcggcgtagtgagccccagggactttgtaaatgtgcgtagaattgagcgccggagggatcgctacctgtcttctggcatcgctacatcccattcggcaaaaccgcccacccataaatacgtgaggggagagaatggtccgggcggtttcattgtcctgaagagcgcatctaatcctcgagtatgtacgtttgtttggatcttgaatactgatctgaaggggcggctgcctcgctatctcatccatcagagcttggctgctactatgttcgagttcgcattccacttgaggcagcggatatctgaattgggcgctagagcttag

SEQ ID NO: 207101 - DNA, 1284 bp, Artificial Sequence
  Description of Artificial Sequence: Synthetic coding sequence
atgagcaagctgccccgggagctgacccgggacctggagcggagcctcccggccgtcgcctccctcgggagcagcctcagccatagtcagtccctttcttctcacctgctgcctcccccggaaaaaaggcgggcaatctctgatgtgaggagaacgttctgcctattcgtcaccttcgatctgcttttcattagcctcctgtggatcatcgagctgaacacgaataccggcatccgtaaaaatctcgagcaggagattatacagtacaatttcaagacgtctttctttgacatctttgtactggccttcttccggttttccgggttgctcttaggttacgcagtcttgcgactgagacattggtgggtgatcgcactgctcagcaagggggcgttcggctatttgctcccaatcgtctctttcgtgttagcctggttggagacatggttcctggactttaaagtgcttccacaagaagccgaagaggaacgatggtatctcgccgcccaggttgcggtggctcgcggacctctcctctttagcggtgccctgtcagaggggcaattttacagccctcccgaatcttttgccgggtcagataacgagagtgatgaagaagttgctgggaaaaagtctttcagcgcccaggagcgggagtacattaggcaaggaaaggaagctacggctgtggtggatcaaattctcgcacaagaagaaaactggaagttcgagaaaaacaacgaatacggtgatactgtgtacactatcgaggtccccttccacgggaagacttttattcttaaaactttcctgccctgtcccgctgagctagtgtaccaggaggtgatcctccagccagagagaatggtcctgtggaacaagactgtgaccgcatgccagatattgcagcgggtcgaagacaacactctgatcagctacgacgtgtccgcgggcgccgcagggggagtcgtctcaccaagagattttgtgaacgtgcggagaatcgagcgccgacgagatcgatatctgtcttctgggattgccaccagccacagtgctaaaccgcccacacacaaatacgtccgtggtgagaatggtccagggggtttcatcgtcctgaaaagcgcatcaaatccaagggtatgtacattcgtgtggatacttaacacagacctcaagggtaggctgcctcggtacctgatccaccaatctctggccgctacaatgttcgagttcgcatttcacctgagacagcggatatccgaattgggggcacgcgcctag

SEQ ID NO: 207102 - DNA, 591 bp, Artificial Sequence
  Description of Artificial Sequence: Synthetic coding sequence
atgagcaagctgccccgggagctgacccgggacctggagcggagcctacccgccgtggcctccttaggaagcagcctgtcacactcccagtccctgagttctcacctgttacccccaccagaaaagcgtagagccatctctgatgtcaggcgtactttttgcttgttcgtgacattcgacttgttgtttatttccctattgtggattatcgaacttaacactaacacaggcattagaaagaatttggaacaggaaatcattcagtataatttcaaaacctcctttttcgatatcttcgtactggccttttttagattctctggtctgttactcgggtacgcagtgctgaggctgagacactggtgggttatcgccgtgactaccttggtcagctcggcattcctgatagtcaaagtcatcttgtccgagctgctgtctaaaggagctttcggatatttacttcctatcgtgagcttcgttttggcatggcttgaaacttggtttttggacttcaaagtattgccccaggaggccgaagaagaacgttggtatctcgccgctcaggtggccgtggctagagggcctttatag

SEQ ID NO: 207103 - DNA, 1338 bp, Artificial Sequence
  Description of Artificial Sequence: Synthetic coding sequence
atgagcaagctgccccgggagctgacccgggacctggagcggagcctacctgctgttgcgtccttaggatcctccctctctcatagccagagcctgtcctcgcacctgctgccccctcccgaaaagaggagagccatttctgacgtgcggcgtacattctgtttgtttgtaacattcgacctcctttttatatccctgctgtggattattgagcttaacaccaatacagggattcggaaaaatctcgagcaagaaatcattcaatacaatttcaagacctctttctttgacattttcgtccttgcctttttccggttctctggactcttgctcgggtatgccgttctccgactccgccactggagcagaaggtggtgtcctgtgcacagttcactctcccgttcttcctccctgagttgcagtgctaaaggccatctcgctacatgtagcccttcatcactgctgtcatcacccgggtggcgcccaggatccctcacttctaagagctaccctaggaaacttaagagaagcgattcagctccgccgggatatctggcggcccaagttgccgtggcccggggccctttgctgttttcaggagccctgtctgaggggcagttttactcccctccggaaagcttcgctggtagcgataatgagagcgatgaggaagttgccggcaaaaagagcttctctgcccaagagagggagtacatccggcagggcaaagaggcgacagccgtggtggaccagatcctggcacaagaggagaactggaagtttgaaaagaataatgaatacggagacaccgtctacacaattgaagtgcccttccatggcaaaactttcatcctgaaaactttcctcccatgcccggcagagctcgtgtatcaggaggtgattctgcaaccagaacgcatggtgctttggaataagaccgtcacagcatgtcagatactgcagagggtggaggacaacactttaattagttacgatgtctccgccggcgccgcaggtggtgtcgtgtcccccagggatttcgtgaatgtaagaagaattgagcgccgtcgcgaccgctacctaagttctggaattgccaccagtcactctgctaaaccccccacacataaatatgtgcgtggggagaatggacctggaggctttattgtcctaaaatctgcttctaatccccgcgtgtgcacttttgtgtggatactcaacacagacctcaagggacgcctccctagatacctgattcaccaatcactggccgccaccatgtttgagtttgcgtttcatttacgacaacggatctccgaactcggtgctagagcttag

SEQ ID NO: 207104 - DNA, 618 bp, Artificial Sequence
  Description of Artificial Sequence: Synthetic coding sequence
atggagggcctgagcgacgtggccagcttcgccaccaagctgaagaacacgctgatccagtaccattcaattgaagaggacaagtggcgggtagccaaaaagaccaaggatgtgaccgtgtggcgcaagccttcagaggagtttaacggctacttatataaggctcaaggcgtgattgacgacctcgtctattccatcatcgatcacatcagaccaggcccctgccgtttggattgggattctctcatgacaagccttgatattctggagaactttgaggaaaattgctgtgtgatgcgatacacgacggccggacagctctggaatattatatctcccagagagttcgtcgatttttcatataccgtgggatataaagagggactgttgtcatgcggtatttcactcgattgggacgagaaacgccccgagtttgtgcggggctacaatcacccctgcggctggttctgcgtgccattaaaggataaccccaatcaatcattacttacaggctatatacaaacggacctccgtggcatgatcccacagtccgcagtagacacagccatggcgtcaacactcaccaacttctacggggacctgcgtaaagcgctctag

SEQ ID NO: 207105 - DNA, 576 bp, Artificial Sequence
  Description of Artificial Sequence: Synthetic coding sequence
atggagggcctgagcgacgtggccagcttcgccaccaagctgaagaacacacttatccagtatcactctattgaggaggataaatggagggttgctaagaaaacgaaagatgtgaccgtctggcgtaaaccttccgaggagttcaacggatatctctacaaagcacagggcgtcattgatgatctcgtgtactcgattatcgatcacattaggcctgggccatgcagactggattgggattctctcatgacctctctggatatactcgagaactttgaagagaattgctgtgtgatgcgatacactacagcaggtcagctgtggaatatcatatctccccgggaattcgtcgatttctcctacaccgtgggatataaggagggtcttttaagctgcggcatttcactggattgggacgagaagaggcctgaatttgttcgtggttataaccacccttgcgggtggttttgcgttcctctgaaggataatcccaaccagtctttgctgaccggctatattcagactgacctccgcgggatgattcctcagagtgctgtagataccgccatggcatag

SEQ ID NO: 207106 - DNA, 642 bp, Artificial Sequence
  Description of Artificial Sequence: Synthetic coding sequence
atggaccccgccctggccgcccagatgagcgaggccgtggccgagaagatgctgcagtacaggagggatactgcaggatggaaaatatgtagagaaggaaacggcgtctccgtgagttggagaccaagcgtggaattcccaggaaacctgtaccgcggagaaggaatcgtgtatggcacgctagaggaggtgtgggactgcgttaagcccgctgtcgggggactccgggtcaagtgggatgagaacgttacgggcttcgagattattcagtcaattacggacaccctctgcgtaagtcggacctccacaccctccgccgctatgaaattaatttctccccgggactttgttgacctcgtgttagttaaacggtacgaggatgggacaatttctagcaatgctacacacgtcgagcatcctttgtgcccccccaaaccgggatttgtccgcggattcaatcacccttgcgggtgcttctgcgaaccactccctggtgagccaaccaagacgaatctggttaccttttttcacacggatctgagcggatatctcccacaaaatgtggtggacagtttcttccccagaagcatgacccggttttacgccaacctgcagaaggcggtcaagcagttccatgagtag

SEQ ID NO: 207107 - DNA, 663 bp, Artificial Sequence
  Description of Artificial Sequence: Synthetic coding sequence
atggacttcaaggccatcgcccagcagaccgcccaggaggtgctgggttacaatcgcgacacaagcggatggaaggttgtgaaaacttctaagaaaatcaccgtcagctcaaaggccagcagaaagttccatggtaacctttacagggtggagggcatcatcccagaatccccagcaaagctgtctgattttttgtaccagacaggtgatcgcatcacatgggataagagcttgcaagtatataacatggtacaccgcatcgactcagatactttcatatgccacactataactcaatccttcgcagtcggctcaatatcaccacgcgacttcattgatttagtgtatattaaaagatatgaagggaacatgaacatcatctcttctaagagtgtagactttcccgaatatccccccagctctaactatatcagaggctataatcacccttgcgggttcgtctgctcccctatggaagagaatcccgcttactccaagctggttatgttcgttcagaccgaaatgcggggcaagctaagcccatcaattatcgagaagaccatgccctccaatctggtgaactttatcctgaatgcgaaggatggcatcaaggcacataggacaccttcaagacgcgggtttcatcataacagtcattcttag

SEQ ID NO: 207108 - DNA, 3072 bp, Artificial Sequence
  Description of Artificial Sequence: Synthetic coding sequence
atgaccctgaacaactgcgccagcatgaagctggaggtgcacttccaatccaaacagaacgaagatagtgaggaagaagagcaatgtaccatatcttcacattgggctttccagcaagaatccaagtgttggtcgcccatgggatctagcgatctgcttgcgccaccttcaccgggcctacccgcgacatctagctgcgaatccgtcctcacagaactgagcgcaacatcgcttccagtcatcaccgtatctttgccaccagaacccgccgatctcccccttcctggacgggctccctcctcttcagaccgccctctcctgagccccacacaagggcaggagggcccccaagataaggccaagaagcgtcatagaaaccgctccttcctgaaacacctggagtccctgagacgaaaggaaaaatctggtagtcagcaggccgaacctaagcattcccctgccacttccgaaaaagtgagcaaggcctcttctttcaggtcatgccgtgggtttctcagcgcaggcttttacagagcaaaaaattgggcagccacttccgctgggggatccggggctaatactcgcaaggcctgggaggcctggccagtggcatccttcaggcacccacaatggacccacagaggagactgtcttgtgcacgtgccgggagaccacaaacccggaaccttccctcgatccctgtctatcgagagtttgtgtccggaggacgggcatagattggccgattggcagcctgggcgccgttggggttgcgaggggcgtagaggaagctgcggcagcactggcagtcacgcttccacctacgataaccttcccgagctttaccccgccgagccagtgatggtgggagctgaagcagaggacgaagatgacgaagaaagcggtggatcgtacgctcacctagatgatatcttacagcatgtctggggccttcagcaacgcgtggagctttggtcccgggccatgtacccagacttgggacctggtgatgaagaggaagaggaagccacaagttcagtcgagatagccacggtggaagtgaaatgccaggctgaggctctgtcccaaatggaagtacccgcccacggcgaaagtcccgcctgggcacaggcagaggtgcagcctgccgtgctagctccagcgcaggcccccgccgaggccgaacctgtggctcaagaagaggctgaggccccggccccggcaccggcccccgcccctgcccaggattcggagcaggaagctcattctgggggcgagcctaccttcgctagttcattgtctgtcgaggagggtcacagtatctctgacaccgtggcgtcatctagtgagcttgacagctcaggcaactcaatgaatgaggccgaagccgctgggccgttggctgggttgcaggcgtccatgcccagggagagacgagactcaggggtgggagctagtctcaccaggccttgccgaaagctccggtggcacagctttcagaatagtcaccgcccttccttgaactcggagtccctggagataaaccgccagtttgccggacagattaacctactgcataaaggatcgctattgaggcttacagctttcatggaaaagtatacagttccccacaaacagggctgggtgtggagtatgcccaagttcatgaggaggaataagacccctgattatagagggcagcatgtattcggtgtgccccctctgatacatgtgcagcgcactggtcaaccgctaccccagtccatacagcaagctatgcggtacctccgctcccaatgtctcgaccaggttggaatttttcgcaaaagtggcgtcaagtcacgcattcagaacttacgacagatgaacgagacaagtccggataacgtatgctacgaggggcagtccgcctacgacgttgccgacctgctaaaacaatacttccgcgaccttcccgaacctatctttaccagtaagctgactacgacctttctccaaatctatcaactgctccctaaagaccagtggctcgctgccgcccaggcagccactctgctgctaccagacgagaaccgagaagttttacaaacactcctatactttctgagcgatatagcctcagccgaggaaaatcagatgaccgccggcaatctggccgtctgcctcgcgccctccatcttccacctcaacgtttcaaagaaggactcaccaagcccccgaatcaagagtaagcgatcactgatcggaaggccaggtccacgggacctctctgataacatggcagcaacccagggactgtcccatatgattagcgactgtaaaaagctgttccaggttccccaagacatggtgctccagctatgcagttcgtatagtgccgcggagctgtccccccctggtcccgcgctcgcggaactcagacaggcccaggccgccggggtttcactgtctctgtatatggaggagaacatccaggacctgctcagggatgcagccgagcgtttcaaaggatggatgtccgtgcctggcccccagcacactgaactggcatgccggaaagcccccgatgggcaccctctccgcttgtggaaggcttctacagaggtagccgctccacctgccgtcgtactgcaccgcgtgcttagggagagggccctttgggacgaagacctgttacgggcccaggtgttggaagcactaatgcccggagttgaactctatcattacgtgacagatagcatggccccccacccatgccgagactttgtggtcctgcgaatgtggcgatctgacctcccgcgagggggatgcctgttggtgagtcagagcctcgacccagagcagccggtcccagaaagcggtgtcagagctctgatgttgaccagccaatacttgatggagccatgcggcctgggccgcagccgattgacacacatctgtcgcgctgaccttagagggaggtctccagactggtacaataaggtcttcggccatctctgcgctatggaagtggcgaagatacgagatagcttccctactttacaggccgcgggccctgagacaaagctctag

SEQ ID NO: 207109 - DNA, 3072 bp, Artificial Sequence
  Description of Artificial Sequence: Synthetic coding sequence
atgaccctgaacaactgcgccagcatgaagctggaggtgcacttccaatccaaacagaacgaggattctgaggaagaagagcagtgtaccatttcttctcattgggcgttccagcaggagtctaagtgttggtctccaatgggctcaagcgatctcctcgcccctcccagcccgggactccccgccacctcgtcctgcgagagcgtcctgacggaactgagcgctaccagcctaccagtgattactgtttccctaccacctgagccggccgatctgcctcttcctggcagggcccccagtagctccgaccgcccactgctgtctccgacacagggccaggaaggaccacaagataaggcaaagaagaggcataggaatcgaagtttcctcaagcacctcgaatcacttcgcagaaaggaaaagtctgggtctcagcaggccgagccaaagcacagtcccgcaacgtccgagaaagtcagtaaagcatcctcctttaggagctgtcgcggtttcctgagcgcgggtttctacagggcgaagaattgggctgccactagcgcgggcgggtccggagcgaataccaggaaagcctgggaagcctggcccgtggccagcttccgccacccacagtggacgcaccggggggactgcctggtgcatgtacccggcgatcacaaaccaggcacttttccaaggtccctaagtatcgagtccctctgccctgaggatggacacaggctcgctgactggcagccaggaaggcggtggggctgtgaaggacggcgtgggagttgcggaagtaccggaagtcacgcaagcacctatgataatcttccagaattatatcctgccgaacctgtgatggtcggcgctgaagccgaagatgaagatgacgaggaaagtggaggatcatacgcccacctggacgatattctgcaacacgtctggggcctgcagcaacgcgtcgagctgtggtcaagagccatgtatcccgacctgggcccgggcgatgaagaggaagaggaggctacgtcctccgtggagatagccacagtggaggttaagtgccaggcggaagctctcagccagatggaggtgcccgctcacggtgagagcccagcttgggcacaagcagaggtacagccagcagtgctcgctccagcccaggctcctgctgaggcggagcccgttgcgcaggaggaagccgaagctccggccccagccccggcacctgcccctgctcaggactcagagcaggaggcgcattccggtggggagcccacttttgcttcttccctgtcagttgaggagggacattccatcagtgatactgtggctagcagttcagaactggattcctccgggaatagtatgaatgaagctgaagccgccggaccactggcaggtctgcaggccagcatgccacgtgagcgcagggactcgggggtgggggccagtctgactaggccttgccggaagctgaggtggcattccttccagaattcccacagaccttcgctgaattcagagagtctggagattaatcggcagtttgcagggcaaattaacctgcttcacaagggctccttactaaggctgacagcttttatggaaaagtacactgtaccgcataagcaagggtgggtctggtcaatgcccaagttcatgcgtcggaacaagacacctgattaccgaggccagcacgtgttcggggtcccgcctcttattcacgtgcaaagaaccggacaacctctcccccagagtatccagcaggctatgcgctatctgaggagtcagtgtctggaccaggtgggaatcttcaggaagtcgggcgttaagagtaggatacagaacctacgccagatgaatgaaacatcaccggacaatgtgtgttacgagggtcagagcgcatacgatgtggcagatctcctaaagcagtactttagggatcttcctgaaccaatttttacatcaaagctgaccacaacctttctgcagatctaccaacttctgccgaaagatcagtggctggcagctgctcaagccgctacactgctcctgccagacgagaacagagaagtactccagactttgctgtatttcctgtccgatatcgcgtctgccgaagaaaatcaaatgactgccggtaatttggcagtttgtctggcgcctagcatattccacttgaacgtgagcaagaaagattccccaagcccccgcattaaatcaaagaggagtctgattggccgcccgggccctcgggacctgtcagacaacatggccgctacacagggcctgtcacacatgatctccgattgcaagaagctctttcaggtgcctcaggatatggtactgcagctgtgttccagttatagcgccgccgaactgtcccccccaggtcccgcacttgctgaactgaggcaggcacaggctgctggcgtgtccctatcgctgtatatggaggaaaatatccaggatttactgagggacgctgccgagcggtttaagggttggatgagcgtacctggacctcagcataccgagttggcctgtcggaaggctcccgacggccaccccctgcggctgtggaaagcctccacagaggtcgctgcacctcccgccgtagtgctgcatagagtgctgcgggagcgggccttgtgggatgaagatttgctgcgggcacaggtgcttgaagcacttatgccaggcgtagaactctatcactacgtcaccgacagcatggctcctcatccctgcagagattttgtggtgctcaggatgtggcggtctgacttgccaaggggaggttgcctgctggtctcccaatccttggacccggagcagccagtgccagaaagcggcgtgcgagctttaatgctaactagccagtatctcatggaaccttgcggcctcggtcggtccaggctgacgcacatttgcagggccgatttaaggggtcggagcccggattggtacaataaggtgtttggccatctgtgtgcgatggaagttgcaaaaatccgagattcgtttccgacgttacaagccgcagggcccgagaccaagctgtag

SEQ ID NO: 207110 - DNA, 3312 bp, Artificial Sequence
  Description of Artificial Sequence: Synthetic coding sequence
atgcccctgctggacgtgttctggagctgcttccggaaggtgaagtgtttccccctgctgcaggtaaaaaaaaacgctgaagcagaggctaagcgggcctgtgagtggctgcaggctaccggatttccacaatacgtgcagctctttgaggaagggtcctttccgttggatatcggcagtgttaaaaagaaccacggattcttagatgaagactctctgggagcgctgtgtcgcagattgatgaccttgaacaactgcgccagcatgaaactggaggtacactttcagtctaaacagaacgaggacagcgaagaggaagaacagtgcacaatctcaagccattgggcgttccagcaggaaagtaaatgttggtctccaatgggttcttccgacctgctcgcaccaccatcgcccggtctcccagcaacttcaagttgtgaaagtgtgctgaccgagctctccgccacaagtttacccgtcattactgtatccctgccccctgagcccgccgatttgcccctcccaggccgcgcaccttcttccagcgatcgtccactcctttcccctacacagggccaggagggcccccaggacaaagctaaaaaaagacaccgaaatagatccttcctcaagcacctagaatctctcaggagaaaggaaaagtcaggcagccaacaggcggagcccaaacacagtcccgcaactagcgaaaaggtctcaaaagctagcagtttcaggagctgccggggtttcctgtctgcagggttctatcgcgctaaaaattgggctgccaccagcgccggcggctctggcgctaatacaagaaaagcatgggaagcctggcccgtcgccagctttcgccacccacagtggacacataggggagattgtctggtccacgtccccggtgaccataaaccggggacattcccaagaagcctgtccattgaatctttgtgccctgaggatggccaccgtcttgcggattggcagccgggacggcgctggggttgcgaggggcggcgcggctcctgtggaagcactggttcccatgcaagtacatacgacaacctgccagagttgtacccagcggagcctgtcatggttggcgcggaagcagaagatgaggacgatgaggagagtggtgggagctacgcgcacctcgacgatatcttacagcatgtatggggcctgcagcagagagtggaactgtggtccagagctatgtaccctgacttgggtccaggagacgaggaggaagaagaggcgacatccagtgtggaaatcgccacagtagaagtgaagtgccaagctgaagctctttctcagatggaggtgcctgcccacggagagagcccagcctgggcacaggccgaagtacagcctgcagttctcgcacctgcgcaagccccagcagaggccgagcccgtggcacaagaagaggcggaagcgccagcgccagctcctgccccagctccagcccaggattccgaacaggaggcacatagcgggggtgaaccaaccttcgctagttcactgtcagtggaagaggggcactcaatttctgataccgtcgcttccagcagtgagcttgacagctctgggaacagtatgaatgaggctgaagctgctggaccactggccgggctccaagccagcatgcctcgcgaaaggagagactcaggtgttggggcctctttaacccggccatgccgcaaactgcggtggcattcttttcagaattcccataggccaagccttaactcagagtccctggagatcaaccgacagtttgccggccagataaacctactacataaagggtcattactgcgcttgacagccttcatggaaaaatacacggtacctcacaaacagggctgggtctggagcatgccgaagtttatgaggcggaataaaacacctgactataggggacagcatgtcttcggcgtaccgcctctcatccacgtgcagaggaccgggcaacctttaccccagtctattcagcaagcaatgcgctatctacgctcccagtgtttggaccaggtcggcatttttcgcaagagtggagtgaagagtcgaatccagaatctgagacagatgaacgagactagtccggataatgtttgctacgagggacaatccgcttacgacgtcgccgacctgctgaaacagtattttcgggatctgcccgagcctatcttcacctccaagttgactaccacatttttgcaaatttatcagctcctgccaaaggatcagtggttggccgcggcacaggccgccaccttactgctcccggatgagaacagagaagtgttgcaaaccctgctttatttcttgtcagacatcgcctccgctgaagagaatcagatgacagccggtaatcttgcagtatgcctcgccccatcgatcttccacctgaatgttagtaaaaaggattccccctcccccagaataaagtcaaagagaagcctgataggaagacccgggccaagggatctgagcgacaacatggctgctacacaggggctgtctcacatgatctccgactgcaaaaagttatttcaggtgccacaggatatggtcctgcagctctgctccagctattcagctgccgaactgagccctcccggaccagcccttgccgaactgcggcaagcccaggccgccggcgtttctttaagtctgtacatggaggagaatattcaggatctgctacgcgacgccgcggagcggtttaagggttggatgagcgttcctggcccccagcacactgaactggcttgtaggaaagcaccagatggccatcccctgagactttggaaagcctccaccgaggtcgccgcccctcctgctgtcgtgctacatagagttctgcgagaacgtgcactgtgggacgaggatctgctgcgcgcacaggtgctggaagcattaatgccaggcgttgagctgtatcactatgttacagactccatggctccacacccttgcagggatttcgtggtcctaagaatgtggaggtccgatctcccacgcgggggctgcctactagtgagtcagtcattagaccctgagcagccagtgcccgagtctggcgtccgggcattaatgctcacctcgcagtatcttatggagccttgcgggctcgggcgatcaagactgacccatatttgcagggccgatctgagaggaagatctcccgattggtacaataaggtgttcggtcacctctgtgctatggaggtggccaagatacgagatagtttccccaccctgcaggccgccggacctgaaaccaaactgtag

SEQ ID NO: 207111 - DNA, 159 bp, Artificial Sequence
  Description of Artificial Sequence: Synthetic coding sequence
atgcccctgctggacgtgttctggagctgcttccggaaggtgaagtgctttcccctgctccaggtcaaaaagaacgctgaagcagaagccaagagagcatgtgagtggttacaggctacagggttcccccaatacgttcaacttttcgaaggagggtag

SEQ ID NO: 207112 - DNA, 189 bp, Artificial Sequence
  Description of Artificial Sequence: Synthetic coding sequence
atgaagttcctggtgttcgccttcatcctggccctgatggtgagcatgatcggcgcggatagctccgaggaaaaattccttagaaggattgggcgatttggctacggttatggaccctaccaacccgtgcctgaacagccactctatcctcagccgtaccagcctcagtatcagcaatacacattctag

SEQ ID NO: 207113 - DNA, 159 bp, Artificial Sequence
  Description of Artificial Sequence: Synthetic coding sequence
atgaagttcctggtgttcgccttcatcctggccctgatggtgagcatgatcggcgctgactcatctgaggagtacggatatggcccttatcagcctgtgccagaacagccactgtaccctcaaccataccaacctcagtaccagcagtacactttttag

SEQ ID NO: 207114 - DNA, 843 bp, Artificial Sequence
  Description of Artificial Sequence: Synthetic coding sequence
atgcggtggttcctgccctggaccctggccgccgtgaccgccgccgccgccagtactgtgttagctaccgccttgagtcctgctcccacaactatggatttcaccccagctcccttggaggataccagcagccgtccacagttttgtaagtggccctgcgagtgcccacctagcccacctagatgtcccctgggtgtctctctgataaccgacggttgcgaatgctgcaaaatgtgtgcccagcagctgggagataactgtaccgaagcagctatctgtgaccctcatagaggcctttattgcgactactcaggtgacaggccacggtatgcaatcggagtgtgcgctcacgcggtgggggaggtggaggcatggcaccgaaattgtatcgcgtataccagtccctggagtccgtgctctacttcctgtggtctcggggtatctaccagaatttccaatgtgaatgcccagtgttggcccgagcaggaaagtaggctatgcaatctccgtccgtgtgacgtcgatatccataccctgataaaggcagggaagaaatgcttggccgtgtaccaacctgaggcttccatgaactttacactcgccggttgcatatctaccaggagctatcaacccaagtactgcggggtttgcatggacaacaggtgctgcataccctataagtcaaaaaccatagatgtgtcgtttcagtgccctgacggtctgggtttcagccgccaagtgctgtggattaatgcatgtttttgcaacttgagctgcagaaatcccaatgacatcttcgcagacctcgaatcataccccgacttttccgagatcgctaactag

SEQ ID NO: 207115 - DNA, 507 bp, Artificial Sequence
  Description of Artificial Sequence: Synthetic coding sequence
atggccaagaccgccatggcctacaaggagaagatgaaggagctgtcgatgctgagcttgatatgtagctgcttctaccctgagcctcggaacataaacatatacacctacgacgatatggaggtgaaacaaattaataagcgggcgagcggccaggcgtttgagctgatcctaaagcctccttctccgaaaaagaaggatctgtcccttgaagagattcagaagaaactcgaagcagccgaggagcgccgcaagtcccaagaggcccaagtccttaagcaactagccgaaaaaagagagcatgaacgggaggttttgcaaaaggccctcgaggagaacaataactttagcaagatggcggaggagaagctcatactcaagatggagcagattaaagagaaccgggaggctaacctcgcagctattattgagagacttcaggagaaggagaggcacgcggccgaggtccgccgaaataaggagctgcaggtggagctctctggctag

SEQ ID NO: 207116 - DNA, 564 bp, Artificial Sequence
  Description of Artificial Sequence: Synthetic coding sequence
atggccaagaccgccatggcctacaaggagaagatgaaggagctgtccatgctatcactgatctgtagctgtttctaccctgaacctcgaaacattaatatctacacatacgacgatatggaagtcaagcagataaataagagagcaagtgggcaggcttttgagctgatcttgaagcctccctcgcctatctctgaggccccccggactctcgccagtcctaagaaaaaggatcttagccttgaggaaatccagaaaaagctcgaagccgctgaagagcggcggaagtcacaggaagcccaagtccttaagcaactcgccgaaaaacgggaacatgaaagagaggtcctccaaaaagcattagaggaaaacaacaacttttcgaaaatggctgaagaaaaactgattcttaagatggagcagattaaagaaaatagagaggcgaatctggcggctatcattgagagactgcaagagaagctcgtcaagtttatttcgtccgagctgaaagagtcgatagaaagccagttccttgagctgcagagagagggggagaagcagtag

SEQ ID NO: 207117 - DNA, 543 bp, Artificial Sequence
  Description of Artificial Sequence: Synthetic coding sequence
atggccagcaccatcagcgcctacaaggagaagatgaaggagctgagcgtgctgagtctcatatgcagttgcttttacactcagccccatccaaacactgtttaccaatatggtgacatggaggtgaagcagttggacaagcgcgcctccggccagtcctttgaggttatcctgaagagcccttccgacctgtctcccgaatcgcccatgctgtcttccccacccaaaaaaaaagacactagcctggaggagctccagaaaagacttgaggccgcggaagagcgccgcaaaacacaggaagctcaagtgctcaagcagttggccgagcggcgagaacacgagagagaggtgttgcacaaagctctagaggagaacaacaacttttcacgccaggcagaggaaaagttaaattacaaaatggagctgtctaaagaaatccgggaagcccaccttgcggccctgcgtgagcgcttgcgggagaaggagctgcacgctgccgaggtcaggaggaataaggaacaaagagaagaaatgagtggatag

SEQ ID NO: 207118 - DNA, 510 bp, Artificial Sequence
  Description of Artificial Sequence: Synthetic coding sequence
atgaaggagctgagcgtgctgagcctgatctgcagctgcttctacacacaacctcaccccaacaccgtttatcaatacggcgacatggaggtcaagcagctggacaagcgagccagcgggcagagttttgaggttatcctgaagagcccttccgatctgtcacctgagagccctatgttatcctccccgcccaagaaaaaagacacaagtctcgaagaactacagaaacggcttgaagctgccgaagagcggagaaaaacccaggaagctcaggtcctgaagcagctcgcggagcgacgggagcatgaacgcgaagtactccacaaggcacttgaggaaaataacaactttagccggcaagctgaggagaagttgaattacaaaatggagttgtcaaaggagataagagaagctcaccttgcagccctaagagagagactgcgggagaaagaactgcatgcagctgaggtgaggcgaaacaaggaacagagagaggagatgtccggttag

SEQ ID NO: 207119 - DNA, 1422 bp, Artificial Sequence
  Description of Artificial Sequence: Synthetic coding sequence
atgttcagcgtgcagctgagcctgggcgagcagacctgggagagcgaaggctcatcaatcaagaaggctcagcaggctgttgcaaacaaggccctcacggagagcactttgcctaaaccagtccagaagcctcctaagtcaaacgtgaataacaatccaggcagcatcacgcctacagtagagctgaacggcttggcaatgaagagaggagagccagccatctatcgccccctggatccaaaaccatttcccaactatcgtgcgaattataacttcagggggatgtacaaccagcggtaccactgtcccgtaccaaaaatcttttacgtgcaactaactgtgggcaacaatgagttctttggagagggcaagacgaggcaagccgctagacacaatgccgctatgaaagctcttcaagctctgcagaacgaacctatacccgagaggtcgccacagaatggtgagtcaggaaaagacgtggatgacgacaaagatgcaaacaagtcagagatcagtcttgtgtttgaaattgcgctgaagagaaatatgcccgtttcctttgaggtcatcaaggagagcggacccccccatatgaaatccttcgtgaccagagtttcagttggagaattcagcgcggaaggagagggaaactcaaagaaactcagtaaaaagcgtgccgccaccacggtgcttcaggaactgaagaagctgcctcctctgcccgttgtcgagaaacctaaactgtttttcaaaaaaagaccaaagactatcgtgaaggctggaccagagtacggccagggcatgaaccctatttcccggctcgctcagatacagcaagccaagaaggaaaaagaacccgattatgttctgttatcagagcgcggcatgccacgccgtcgagagttcgtcatgcaggtgaaagtgggcaacgaggttgcaactggaaccgggcctaacaagaagattgccaaaaaaaatgccgctgaggcaatgttgctgcagctgggctacaaggccagtacgaacctccaggaccagctggagaagacaggagagaacaagggctggagtggtccaaagcccggctttcccgagccaaccaacaacacccccaagggcatcctccatctctccccagatgtgtaccaggaaatggaggcaagcagacacaaagtaatcagcggtaccactttgggatatctgtcgcccaaggatatgaaccagcccagctctagcttcttctcaatcagcccgacaagtaattcatccgccactattgcccgggaactgcttatgaacggtacatccagcactgccgaagcaatcggcctgaaggggagcagcccaacaccgccttgcagccccgtgcaaccatcgaagcagctagagtacctcgcaagaattcaaggattccaggtttag

SEQ ID NO: 207120 - DNA, 1515 bp, Artificial Sequence
  Description of Artificial Sequence: Synthetic coding sequence
atgaagcggggcgagcccgccatctaccggcccctggaccccaagcccttcccaaactatcgcgctaattataattttcgaggaatgtacaaccagaggtaccactgtcccgtgcctaaaattttttacgttcaacttactgtggggaacaatgagttcttcggcgagggcaaaacccgccaagctgctcggcataatgccgccatgaaagcattacaagccctacaaaacgaacctatccctgagcgctccccacagaacggcgagtccggcaaggatgtcgacgatgataaagacgcaaacaagtccgaaataagtcttgtgttcgagatcgccctgaagcgaaatatgccagtcagttttgaggtgataaaagaatccggtccccctcacatgaaatcattcgtgaccagagtctctgtgggagagtttagcgcagaaggtgaaggcaacagcaagaaactgtccaagaagagggctgccacaacggtgctccaggagctgaaaaagctcccccccctgccagtagtagagaagcccaagctgtttttcaagaaaagaccaaaaaccatcgttaaagccggtccagagtatgggcagggtatgaaccctataagtcgcctagcccagattcagcaggctaaaaaggaaaaggagccagattacgtgttgctgagcgagagaggtatgcctcgccggcgcgaatttgtgatgcaagttaaggtaggtaacgaggtggcaaccggcacaggccctaataaaaagattgcaaagaaaaatgccgcggaagcaatgctgctgcaactcggatataaggcatcaacaaaccttcaggatcaattagagaaaacaggggaaaataaaggctggagcggccccaaacccggattccccgagcctactaacaacaccccgaaaggaatcctgcatctcagtcccgatgtttatcaagagatggaggctagccgccacaaggttatctccggcaccacactgggatacttgtctccaaaagatatgaaccaaccttctagtagtttcttttccattagccccacgagcaacagcagcgcaacaattgctagagagctgctgatgaatgggacatcgtccaccgccgaagcgatcggtctgaaagggtccagccctacaccaccctgctcgcctgtccaacctagcaaacagttggagtacctcgcccggatccaaggatttcaggtccattattgcgatcgccagtccggtaaggaatgtgtgacctgcctgactctcgctccagttcagatgaccttccacgctataggcagctccattgaggccagccatgaccaggcggctttgtcggcgctcaagcagttctctgagcaggggctggaccccattgacggggccatgaatatcgagaagggatccctggagaaacaggccaagcacctacgcgaaaaagccgataacaatcaggcccctcctggctctatcgctcaggattgcaagaaaagcaactctgctgtgtag

SEQ ID NO: 207121 - DNA, 1197 bp, Artificial Sequence
  Description of Artificial Sequence: Synthetic coding sequence
atgaaggccctgcaggccctgcagaacgagcccatccccgagcggtctcctcagaatggggaatcaggaaaggatgtcgacgacgataaagacgcgaacaaatcggaaatatctttagtgttcgaaatcgccttgaagcgcaacatgccggtatcctttgaggtgatcaaggagtctggcccaccccacatgaagagttttgtcaccagagtgtcagtgggggaatttagtgccgagggggagggtaattcaaagaaactgagtaagaaacgtgctgctaccacggtgcttcaggagctgaaaaagctcccaccgttgccagtcgtggagaaaccaaagctattcttcaaaaaacggccgaagacgattgtaaaggcaggtcctgaatacggccagggtatgaatccgattagtcgattggctcaaatccagcaggctaagaaggaaaaagagccagattacgtgctgttatcagaaaggggtatgcctcgccgccgcgaattcgtgatgcaggtgaaggtgggaaatgaagtggccacaggcacagggcccaataaaaagatcgctaagaaaaacgccgccgaagctatgctgcttcagttgggttataaagcatctaccaatctgcaggatcaactggaaaaaacaggagaaaacaaaggttggtccggtccgaagcccggctttcccgagccaacaaataacaccccaaaaggaatcctgcacctgtcccccgacgtataccaagaaatggaagcctctcggcataaggtcatttctggaactacattgggttatctaagtccgaaagacatgaaccagccaagttcgtctttcttcagtatctcacccacttcgaattcaagtgccaccatcgccagagaacttctgatgaatggaacaagtagcactgccgaggcaatcggactcaagggctcaagcccaacacccccctgcagcccggtgcaaccctccaagcaacttgaatatcttgcacgaattcagggattccaggcggctttgagcgcacttaagcagttctctgaacaggggctggaccctatagatggtgccatgaacatagagaaaggttccctggagaaacaggccaagcacctgagggaaaaagcggataacaatcaggccccccctggcagcattgcacaagattgtaagaaaagcaattcggccgtttag

SEQ ID NO: 207122 - DNA, 1440 bp, Artificial Sequence
  Description of Artificial Sequence: Synthetic coding sequence
atgctgcagatcaaccagatgttcagcgtgcagctgagcctgggcgagcagacttgggagtctgagggctccagtattaagaaggctcagcaagccgttgctaacaaggcgctgacggaatccacattacccaagcctgtgcagaaacctccaaagtccaacgtgaataataatccaggctctatcactccaactgttgaactgaacggtcttgccatgaaaagaggagaaccagccatctataggcccctggacccgaagcccttccctaattaccgggctaattacaatttcagaggcatgtacaaccaacgataccattgtcccgtaccgaaaattttttacgtccaactcaccgtggggaacaatgaattcttcggagagggaaagaccagacaggcagccaggcataatgccgctatgaaggccctccaagcgctccagaatgagccaatccctgagcggagtccccagaacggagagtctggcaaggacgttgacgatgacaaggatgcaaataagtcagagatctctctcgtgtttgagattgctcttaaaaggaatatgcctgtctccttcgaggtaatcaaagaaagtggcccccctcacatgaaaagcttcgtcaccagagtttctgtgggtgagtttagcgcagagggggaagggaactcaaaaaaattgagcaaaaagagggcagccacaaccgttctgcaggaactgaagaagttaccaccccttccagtcgtcgaaaaaccaaagctgttcttcaagaagagacccaagacaatagtcaaggcaggccccgagtatgggcagggaatgaatcccatttccaggctggctcaaatccaacaagctaagaaagaaaaggagccagattatgtcctcttgtctgagaggggcatgccccgaagaagggaattcgtgatgcaggtcaaagtgggaaatgaggtcgctactggaactggtcctaataagaaaattgccaaaaaaaatgccgccgaagccatgctgctgcagctgggatacaaggcatcaaccaatctgcaagatcagctcgagaagacaggcgaaaacaagggatggtctggacccaagcccggtttcccggagcctaccaataacacgccgaagggaatcctccatctcagtcccgatgtgtatcaggagatggaggcctcacgccacaaggttatctctgggacgactctggggtacctttcaccaaaggatatgaaccagcctagttcctctttcttctcaattagtccaacgagcaactcttcagccacgatagcgagggaactcctaatgaatgggacctcaagtaccgcggaagccatcggattgaaaggatcctcccctactcccccctgctcccctgtccagccatctaagcagctggagtacctggccaggatacagggcttccaggtgtag

SEQ ID NO: 207123 - DNA, 615 bp, Artificial Sequence
  Description of Artificial Sequence: Synthetic coding sequence
atgctgcagatcaaccagatgttcagcgtgcagctgagcctgggcgaacagacttgggaaagcgaaggatccagcataaagaaggcccagcaggccgttgctaacaaagcccttacggagtctaccctgccaaaacccgtgcaaaaaccgcctaagtctaatgtgaacaacaacccaggcagtatcacccctacagtggaattgaacggtctcgcaatgaaacgtggcgagccagctatctatcgtccgttggatcccaagccctttcctaactacagagctaattacaatttcagaggaatgtataaccagcgataccattgtccggttccaaaaatattttatgtccagttgacagtgggaaataacgaattcttcggtgaaggcaagacccgccaggcggcaaggcataatgctgctatgaaagccctgcaggcattgcagaatgagccaattcctgaacgaagccctcagaacggcgaatcagggaaagatgttgacgatgacaaggacgccaacaaatccgaaatctctttggtcttcgaaatcgcacttaaacggaacatgcccgtgtcatttgaagtgataaaggagagcggacccccacacatgtag

SEQ ID NO: 207124 - DNA, 195 bp, Artificial Sequence
  Description of Artificial Sequence: Synthetic coding sequence
atgctgcagatcaaccagatgttcagcgtgcagctgagcctgggcgagcaaacttgggaaagcgaggggtcatctatcaaaaaagcacagcaagccgtagccaataaggccctgaccgagagtactctcccgaagcccgtgcagaagccccccaagagtaacgtgaacaataatccagggtccatcaccccttag

SEQ ID NO: 207125 - DNA, 1440 bp, Artificial Sequence
  Description of Artificial Sequence: Synthetic coding sequence
atgctgcagatcaaccagatgttcagcgtgcagctgagcctgggcgagcaaacatgggagtctgaaggatcaagtatcaagaaagcccaacaggccgtggctaataaggccctgactgaaagcaccctacccaaacctgtacagaaacctccaaagtctaatgtgaataataacccgggctccattacgccaacagtggaactgaatggtctagccatgaaacggggggaacccgcaatctaccgtcccttagatcctaaaccattcccgaactacagggccaactacaatttcaggggcatgtataaccagcgataccattgcccagtgcccaaaatcttttacgtccagcttaccgtgggtaacaacgagttctttggtgagggcaagacccgtcaagctgcccgacacaacgccgcaatgaaggctcttcaggccctgcaaaacgaacccatccccgaaaggtcgccacagaacggtgaatcagggaaagacgtcgacgacgacaaggatgctaataagagtgagattagtctcgtattcgaaatcgctctgaagcgaaatatgcctgtctcatttgaagtcattaaagagagcgggccaccacacatgaagtccttcgtgactcgcgtgagtgtcggagagttcagcgccgagggcgagggcaactccaagaagttgtccaaaaagagagcggcaacaaccgtgctacaggagttgaagaaactcccgcccctgcccgtcgttgaaaagcccaaactctttttcaaaaagaggcccaaaactatcgtaaaggccggccctgaatatggacagggcatgaatccaattagtagactggcgcaaatccagcaggccaaaaaagagaaagaaccagattatgtcctcctcagtgagaggggaatgccccgacgcagagagtttgtgatgcaagtgaaggtaggaaatgaggttgctactgggactggccccaacaaaaaaatcgcaaagaagaatgctgcagaggctatgctgctgcagctggggtacaaggccagtactaatctccaggatcagctggagaaaacaggggagaacaagggatggtcagggccgaagccaggatttcctgaaccgaccaacaatacacccaaggggatcttgcatctctcccccgacgtctatcaggaaatggaggcttctcgacataaagtcatttcagggacaacactgggctatttatcacccaaagacatgaatcaaccttcctccagcttcttttctattagtcctaccagtaactcgagcgccaccattgcaagagaactgctcatgaacggcacttcgtctacagctgaggctattgggcttaaaggcagtagtcctacacccccatgcagtcctgtgcagccatctaagcaactcgagtaccttgctcggatacagggattccaggtgtag

SEQ ID NO: 207126 - DNA, 1617 bp, Artificial Sequence
  Description of Artificial Sequence: Synthetic coding sequence
atgctgcagatcaaccagatgttcagcgtgcagctgagcctgggcgagcagacctgggaaagtgagggaagctctatcaagaaggcccagcaggccgtggcaaacaaggctttaaccgaaagcacattgccaaaacctgtgcaaaaaccccccaagtctaacgttaacaataatcccgggagcattactcctaccgtcgaacttaacgggctcgcaatgaagcggggggaacctgctatctaccgcccactggacccgaagccctttccaaactacagagcaaactataattttcgaggcatgtataatcagaggtaccactgcccagtccctaagatattttacgttcagctgaccgtgggtaacaacgaattctttggggaggggaagacgagacaggcggccagacacaacgccgccatgaaggcactccaagccctccagaacgaaccaattccagagcgctctccacaaaacggggagagcgggaaagatgtggatgatgataaagacgccaataagtctgaaatctccttagtgtttgaaatcgccttgaagaggaacatgccggtgagctttgaggtgatcaaggagtctggaccaccccacatgaaaagcttcgtaacccgcgtctctgtgggtgaattttccgcagagggtgaaggcaactccaaaaaactctctaagaagagggccgccactacagtcctccaggagctgaagaagctgcctcctctgccggtcgtggaaaagcccaaacttttcttcaaaaaacgacctaagaccatcgtgaaggccggacccgagtacggacagggaatgaatcccatttccagactggcccagatccagcaagccaaaaaggaaaaagagccagactatgtcctgctgtcagagcgcggcatgcccagacgtagagagttcgtgatgcaggtgaaggtggggaacgaggtcgccacaggcaccggacccaacaaaaagattgctaaaaagaatgcagcagaggccatgctgttgcagctgggctataaggcctcgactaatctccaggaccagctggaaaaaactggagaaaacaagggttggagcgggccgaaaccaggcttcccagaaccaacaaacaatactcccaaaggcatcctgcacctgagcccagatgtttaccaagagatggaggcaagccgccataaggtaattagcgggactaccctcggatatctctcacccaaagacatgaaccagccctccagttcctttttttccatttcccctacttcaaactccagcgccacaattgccagggagttgctgatgaacggcaccagtagcaccgcagaagccatcggtttgaaggggagctctcccactccaccgtgcagccctgtgcagccaagtaagcaactcgagtacctggcaagaattcaggggtttcaagccgccctctcagccctcaaacaattctccgaacagggactggatcctatcgatggagccatgaatatcgaaaaaggatccctcgagaaacaggcgaagcatctgcgggagaaagcggataacaatcaggccccgcccggatccattgctcaggactgcaaaaagtccaacagcgcggtctag

SEQ ID NO: 207127 - DNA, 318 bp, Artificial Sequence
  Description of Artificial Sequence: Synthetic coding sequence
atgctgcagatcaaccagatgttcagcgtgcagctgagcctgggcgaacaaacctgggaaagcgagggtagctccattaagaaggcgcagcaggccgtggccaacaaggccctgacagagagcactctccccaaacccgtgcaaaaaccgcccaaatctaatgtgaacaacaaccctggatctattacccccacggtggaattgaacggtcttgccatgaagaggggagaacctgcaatttaccggccacttgaccctaaacctttcccaaattacagggcgaactacaacttccggggcatgtacaatcaacggtag

SEQ ID NO: 207128 - DNA, 1713 bp, Artificial Sequence
  Description of Artificial Sequence: Synthetic coding sequence
atggccaaccccaaggagaagaccgccatgtgcctggtgaacgagcttgcacgttttaatagggtgcaaccccagtacaaactgctcaatgaaaggggtcctgctcactccaaaatgttctcagtccaactgtctctgggggaacaaacttgggagtcagaaggctcatcaattaagaaggcacagcaggctgttgcaaacaaggctctcactgaaagcacactgcctaagccagtgcagaagccgcctaagagcaatgttaataacaaccctggatctattacgccaaccgtcgaactgaacgggctcgctatgaagaggggcgagcctgccatctatagacctctggacccgaaaccatttcccaactaccgtgcgaattacaattttagaggaatgtacaaccagaggtaccattgtcccgtgcccaaaattttctacgtccagctaaccgtgggtaataacgaattcttcggcgaaggaaagactcgccaagcggcacgccataacgctgcaatgaaagcacttcaggcactgcaaaacgagcccattcccgagcggtcaccccagaatggggagtcaggtaaggacgtggatgatgacaaagatgccaataaaagtgagatcagcttagtcttcgagatcgctcttaaaaggaatatgcccgtaagcttcgaagtgatcaaggaatccggccctccacatatgaaatcttttgtgacccgtgtctccgtcggcgagttcagcgccgagggagaaggtaattcaaaaaaattatcaaaaaaaagagccgctacaactgtcttgcaagagctcaagaagttgcccccactgcccgtcgtcgaaaaaccgaagctcttctttaaaaagaggcctaagaccattgtgaaagccgggcctgaatacgggcagggcatgaatcccatcagtcggctggcacaaatacaacaagctaagaaagagaaggaaccagattatgtgctgctttccgagcgaggtatgccccgaagacgggaattcgtgatgcaagtaaaagtaggaaacgaagtggctaccggaacaggccccaataaaaagatcgcaaagaaaaatgctgcagaggctatgctgctccagctgggctacaaagcctccacgaatctacaggatcagctggaaaagactggagaaaataaaggttggtccggaccgaagccgggctttcccgaaccaaccaacaatacgcctaaaggcatcctccatctttcccctgacgtctaccaggaaatggaggcttctaggcacaaggtgatctccggaactacacttgggtaccttagcccaaaggatatgaatcaaccaagcagcagctttttcagtatcagtccaacctcgaactcctctgccacaatagctcgagagctgttaatgaacggaacctcatctacggctgaggcgatcggactgaagggctcctcgcctacccccccttgctcccctgtgcagccatctaaacagttggaataccttgctcgcattcaagggttccaagcagctctgtccgctctaaaacagttcagcgagcagggcctagacccgatcgacggcgccatgaacatcgagaaggggtcacttgagaagcaggcaaaacacttgagagagaaggccgataacaatcaggccccaccgggcagcatagcccaggattgcaaaaagtcaaatagtgctgtgtag

SEQ ID NO: 207129 - DNA, 1044 bp, Artificial Sequence
  Description of Artificial Sequence: Synthetic coding sequence
agcctgctgaccaacgacgccagcagcgagagcatcgccagcttctccaagcaagaagtaatgagctcgttccttcccgagggtggctgctacgaactgttaactgtcattggtaaaggattcgaagatctgatgaccgtcaatttggccagatacaagcccacaggagaatacgttacagtgcggcggataaacctggaagcatgctctaacgagatggtcacatttcttcagggagaattgcatgttagcaagctcttcaaccatcctaatatcgtgccatacagggccactttcatcgctgacaacgaactgtgggtggtgacatcctttatggcatatggttcagcaaaggatctgatatgcacacatttcatggacggtatgaatgaactggccattgcctacattctacagggcgtactgaaagcgctggattatattcatcacatggggtatgtccatcggagcgttaaggcgtcccacatcttgatctccgtcgatgggaaagtctacttaagcggactaagatcgaatctgagtatgattagccacggacagaggcagcgtgtcgtgcatgacttccctaaatattctgtaaaggttctcccatggctctcaccggaagtgctgcagcagaatttgcaaggttatgatgcaaaatctgatatttactccgtgggaatcacggcttgtgagttggctaacggccatgtcccattcaaggacatgcccgccacccagatgctgcttgaaaagctgaatggcaccgtaccctgcttgttggatacctccactatacccgctgaagagctcacgatgtccccaagccgctctgtggcaaatagcggcctctctgacagcttaaccacatcaactccccggccgtctaatggcgactctccctctcacccctaccacagaacgttcagtccccacttccaccactttgtggagcagtgcctgcagagaaacccagatgcccggtatccgtgctggccagggcccggactgagggagtctcggggatgctccgggggttag

SEQ ID NO: 207130 - DNA, 1296 bp, Artificial Sequence
  Description of Artificial Sequence: Synthetic coding sequence
atgagcttcctggtgagcaagcccgagcggatccggcggtgggtgagcgaaaaattcatcgtagagggactgcgcgatttggaactgtttggggaacagcccccaggtgatactcgtcgtaagaccaacgatgcatcttcagagtccatcgccagtttttcaaagcaggaggttatgtctagcttcctgccagaaggaggttgttacgaactgctgaccgtaattggcaagggatttgaggatctcatgactgtcaacctggctagatacaaacccaccggcgagtacgtcaccgtcaggagaattaaccttgaagcttgcagtaatgagatggtcaccttccttcagggagagctccacgtgtcaaaactattcaatcaccccaacattgtgccatatagagccacattcatcgctgacaacgagctatgggttgtgacgagttttatggcttacggtagtgccaaagatctgatctgtacacattttatggatggaatgaatgaactggcaattgcctatatcctgcaaggggtgctgaaagcactggattacatccaccatatgggttacgtgcaccgctccgtgaaggccagtcacattttgatttccgtcgacggcaaggtctacctttccggcctccggtccaacctgagtatgatctctcacggccagcggcagcgcgtggtgcacgacttccctaaatactcagttaaggtgcttccgtggctgtcccctgaagttctgcaacagaacctccaaggttacgacgccaagtctgatatttatagcgtgggcatcaccgcatgtgagttagccaatggccatgtccctttcaaggacatgcctgcaactcagatgctgctcgagaagttgaatggaacagtcccatgcctgctagatacctccaccatacccgctgaagaattaacgatgtctccgtccagaagtgtcgccaactctggcctgtccgatagtctcaccactagtacaccgaggccatccaatggggattcgccttcccatccatatcaccgaacattcagccctcactttcaccactttgtagaacagtgcctgcagaggaacccagacgctcgcccttctgcctctaccctgttaaaccactctttttttaagcagatcaagcgcagggccagtgaagccctgcccgagctgctccgtcccgtcaccccgatcactaattttgagggatcccaatctcaagatcactcaggtatctttggattggtgaccaatcttgaggaattggaggtagacgattgggagttctag

SEQ ID NO: 207131 - DNA, 1122 bp, Artificial Sequence
  Description of Artificial Sequence: Synthetic coding sequence
atgagcagcttcctgcccgagggcggctgctacgagctgctgaccgtaatcggaaagggattcgaagacctgatgactgtgaacctcgctaggtataagcccacgggggagtacgtgacagttcgtagaataaacctggaagcttgctctaatgagatggttaccttcctccaaggcgaactgcacgtgagtaagctgtttaaccacccaaacatcgtcccatatcgggccacattcatcgccgacaatgagctgtgggtcgtgacaagctttatggcgtatggctccgccaaggatcttatttgtactcattttatggacggtatgaacgaacttgccatcgcctatatcttgcagggggtgctcaaggctctggattatatccaccacatgggatacgtgcacaggtccgtaaaggcctcccacatcttaatctctgtcgatggtaaagtatatctaagcggtctgaggagcaatctgtccatgatctctcacggacagcgccagcgggtggtgcacgattttccgaagtattcagttaaagtcctcccttggctgtcccctgaggttcttcagcagaatctacaagggtatgatgcgaagtcagacatatattccgttggcatcacagcatgtgaactggctaatggtcacgtgccattcaaggatatgcccgcaactcagatgctgctcgagaagctgaatggcaccgtgccatgcctgcttgataccagcacgatacccgccgaggagcttactatgagcccgtctcgcagtgtggcaaattcaggactgtccgactccctgactacctctaccccacggccatcaaatggagacagtccttcacatccttaccaccgcactttttcacctcactttcatcactttgtggagcagtgtctccaaagaaatcctgacgcacgtccatctgctagtactctgctcaatcatagcttcttcaagcagatcaaacgtagagcctccgaggcactgccagagctcttacgtccagttacacctataaccaacttcgagggctctcagtctcaggatcactctgggatttttggcctggtcaccaatttagaggagctagaggtggacgattgggaattctag

SEQ ID NO: 207132 - DNA, 1047 bp, Artificial Sequence
  Description of Artificial Sequence: Synthetic coding sequence
atgagcttcctgaccaacgacgccagcagcgagagcatcgccagcttctccaaacaggaagtgatgagtagcttcttgcctgagggcggttgctacgaactgctcaccgtaatcggaaaaggctttgaagatctcatgacggtgaacctggccaggtacaagcccactggagagtatgtcactgttcggagaatcaacctggaggcttgctcaaacgagatggtaacatttttacagggcgagcttcacgtctccaaactctttaaccacccgaatattgtgccttatagggcaacttttattgctgacaacgagttgtgggtggttactagctttatggcatacggatccgccaaggacctgatctgcacccactttatggatggaatgaatgagttagctatagcgtacatccttcaaggtgttctgaaagctctcgattatatccaccacatgggttacgtccatcgcagcgttaaagcctctcacattctgatctctgttgacggaaaagtgtatctgtcaggcctaaggagtaacttgagtatgatcagtcacggtcaacgtcagcgcgtcgtgcatgactttcccaaatatagtgtcaaggttctgccttggctgagcccagaagtcctgcagcagaatctgcagggatacgacgctaaatctgacatatactctgtgggaattaccgcatgtgaactggccaatggccacgtgccttttaaggatatgcctgcaacccaaatgctgcttgaaaagctgaatgggacggtaccctgcctgctggacaccagcacaatacctgccgaagagctgacgatgtcacccagccggtctgttgcaaacagcgggctgtccgatagcctgacaacgtccacccccagaccctcaaacggggactctccttctcacccataccatcgcaccttcagtccgcatttccaccacttcgtggagcagtgtctgcaaagaaacccagacgcccggtacccttgttggcccggccccgggctgcgggaatctaggggttgttccggcggctag

SEQ ID NO: 207133 - DNA, 900 bp, Artificial Sequence
  Description of Artificial Sequence: Synthetic coding sequence
atgagcttcctggtgagcaagcccgagcggatccggcggtgggtgagtgagaaatttatcgtcgagggcttacgcgaccttgagctgtttggcggcaagggcttcgaggatctgatgaccgtaaacctggcgcgttataaacccactggggaatacgtcacagtacgtaggatcaacttggaagcttgcagcaatgagatggtgacgtttctccagggggagctacacgtaagtaagcttttcaatcatcccaacatcgtcccatacagggctacattcatcgctgataatgagctgtgggtcgtcactagcttcatggcatatgggtccgcaaaggatttgatttgtacccacttcatggacgggatgaacgagttggcgattgcctatattctacaaggagtactcaaggcactcgattacatacaccatatgggatatgtgcataggagcgtgaaggcgtcgcatattctcatttccgttgatgggaaagtttacctttccggtctgagaagcaatctgtcaatgattagccatggccaacgtcaacgggtagtgcatgatttccctaaatattccgtcaaggtcctgccttggttatcccctgaggttcttcaacaaaatctacaggggtacgacgcgaagtctgacatctactcggtcggtatcaccgcttgtgaattggccaacggccatgtcccgtttaaggacatgccagccacacagatgcttctggagaagctgaacggcacagtcccttgtctgctggatacatccactatccctgccgaagagctgacaatgtcgccatctcgcagcgtcgcaaactccggtctgtctgactctctgaccaccagcactcccagacctagcaatggaccagtgcccgcgccttcctag

SEQ ID NO: 207134 - DNA, 1257 bp, Artificial Sequence
  Description of Artificial Sequence: Synthetic coding sequence
atgagcctgctggactgcttctgcaccagccggacccaggtggagtcactgaggccagagaagcagagtgagaccagcatacaccagtacctagttgacgagcccacactttcatggagcaggccttctactcgcgcatctgaagtactctgtagcacaaacgtgtcacactacgagcttcaagtggaaatcggcaggggcttcgataatttgaccagtgtgcatttagcccgacatacccctaccggcaccctagtgactataaaaataaccaacctagagaattgtaacgaagagaggctgaaggcacttcagaaggccgtgatcttgagccacttcttccgccatcctaacattacaacttattggacggtgtttactgttggaagctggttgtgggtgatttctccttttatggcgtacggttctgctagccagctcctcagaacctatttccctgaaggtatgtccgaaacactgataaggaatattctgtttggagctgttaggggcctaaattatctgcaccagaacgggtgcattcacagaagcattaaagctagccacatcctgatcagtggtgacggtctggttactctgtccggtctctcccatctccattccttggtgaaacatggacagagacacagggcggtatatgatttcccgcagttcagcacctctgtgcaaccgtggctgagtccggaactgctaagacaggacctgcatggatacaacgtcaagtcagacatctatagcgtaggtatcacagcatgcgagctggcttcaggacaagtgccctttcaagacatgcatcgcactcaaatgttgctccagaagcttaagggaccaccatactccccgctggacatcagcatattccctcagtccgaaagtcgtatgaagaattcccaaagcggggtggactctggcatcggagaatccgtgctcgtgagcagtgggacccacaccgtgaattccgaccggctgcacaccccctcaagcaaaaccttcagccccgccttcttcagcctcgtgcagctgtgcctccagcaggaccccgagaagcggccttctgccagttcgcttctcagtcacgtcttttttaaacagatgaaggaagaaagccaggactccatactctcgctgttgcctcccgcctacaacaagccttctatatccctgccccccgtactcccctggactgaacccgaatgtgacttcccagacgaaaaggattcatactgggagttttag

SEQ ID NO: 207135 - DNA, 1134 bp, Artificial Sequence
  Description of Artificial Sequence: Synthetic coding sequence
atgagcctgctggactgcttctgcaccagccggacccaggtggagtccctgcggcccgagaagcagtctgaaacgagtattcatcaatacctggtggacgagccaacactctcctggagtaggccatccactcgtgcctcagaagtcctgtgctctaccaacgtcagccattatgaactacaagtagaaatcggaagaggctttgataacttaacctctgtacacctcgctcgtcatacgcctactggtacactggtcacaatcaaaataactaatttggagaattgcaatgaagagcggttgaaagcgctacagaaagcagtaatcctgagccatttttttaggcatcccaatataaccacatattggactgtctttacagtcgggtcttggctctgggtgatctctccattcatggcctatgggtcagcgtcacagctgcttcgaacctacttcccagagggcatgagtgaaacactcattcggaatatcctgttcggagctgtccgcggactgaactacttgcaccagaacggatgcatccacagaagtatcaaagcctcccatattctcatctccggagatgggctcgtaactctgtctggactgtcccatctacattctctggtcaaacatggccagcggcacagagctgtctacgattttccacagttctctactagtgtgcagccatggttatcccccgagctgttacgccaagacctgcacggctataacgtgaagtctgatatttatagcgtaggcatcacggcttgcgagctcgccagtggccaggttccattccaagacatgcatcgcacacagatgctactacagaaactcaaagggcctccctactctcccctggacatatctatattcccgcagtctgaatcccgcatgaagaactctcaaagcggagtagactccggaatcggggagagcgtgctcgtgtccagcggtacccataccgtgaatagcgaccgccttcacacgccaagctctaaaacattctctcccgctttctttagcctagtgcagctgtgtctgcaacaagaccccgaaaaacgtccatccgccagctccctgctgtcccacgtcttttttaaacaaccctattttgagttcttatag

SEQ ID NO: 207136 - DNA, 843 bp, Artificial Sequence
  Description of Artificial Sequence: Synthetic coding sequence
ctgggctactgcagcgccagccagctgctgcggacctacttccccgaaggtatgtctgaaacccttatacgcaatattctcttcggagcagtcagaggccttaactacctacaccaaaacgggtgcatccataggtcaatcaaggcatctcacatcctgatctccggcgacgggctcgtcaccctctctgggctgtcccacctacactccctcgtaaagcatggacagcgacatagggctgtgtacgatttcccgcagttctccacaagtgtccagccttggctgtcgcccgagctactgcgccaggacctgcatgggtacaatgtcaagtctgacatttactctgtgggcatcacggcttgtgagctggctagcgggcaggtcccatttcaagacatgcaccgaacccagatgctcctacagaagctgaagggccccccgtattcccctttagacatttccatcttccctcagtctgagagtaggatgaagaattcccagtccggggtcgattcgggcattggcgagtccgtgctggtgtcatctggcacccacaccgtgaatagcgaccggctgcataccccctcaagtaaaacttttagtcctgctttcttctccttggttcagctctgcctgcagcaggacccagagaaaaggccctcagcatcctctttactcagccacgtgttcttcaagcagatgaaggaagaatctcaggacagcattctttcacttcttcccccagcatacaataagccgtctatttcccttcctccagtgctcccttggaccgaaccagaatgtgatttccccgacgagaaggacagttattgggagttctag

SEQ ID NO: 207137 - DNA, 1257 bp, Artificial Sequence
  Description of Artificial Sequence: Synthetic coding sequence
atgagcctgctggactgcttctgcaccagccggacccaggtggagtcgctgcggcccgagaaacaaagcgagacctctatacaccaatacctcgtggacgaaccgacacttagttggagtcgaccttctaccagggcttccgaggtactgtgcagtacaaatgtgtcccattatgaacttcaggttgagatcgggagggggttcgacaatctgacatcggtccatctggctcggcatacccctacaggcactttagtgacaatcaagatcaccaacctagagaattgcaacgaggagcggctgaaggcgctacagaaggcggtgattctcagccatttctttcgccatcctaatattaccacatattggacggtgtttactgttggaagttggctctgggttatttcgcccttcatggcatatggtagcgcatctcaactgttgaggacatacttcccagaggggatgtccgagactctgataaggaatattctgtttggagcggtgagaggcctgaattatctccatcagaacggatgtattcaccgcagtatcaaggcctctcatatcctgatatccggcgatgggctggtgaccctttccggcctcagccacctgcactcactggtcaagcacggacagaggcaccgtgcggtgtacgactttccacagttctctacctctgtgcagccctggctgagtcccgagctgcttcgacaggacctgcacgggtacaatgtcaagtccgatatttacagtgttggcataactgcatgtgaactggcctctggacaggtgcccttccaggatatgcatagaacccagatgctgttgcagaagctgaaaggacctccttactctccactggatatcagcatctttccacagtcagaatcacggatgaaaaacagccagtcaggtgtagattctggcattggggaatctgttctggtgtctagcggaacacacacagttaactccgatcgcctgcataccccgtctagcaagaccttttcccctgcatttttttcccttgttcagctttgtctccagcaagaccctgagaagagaccctctgctagctcccttttatctcatgtcttcttcaaacagatgaaggaggagagccaggacagcattcttagcctgctgccccccgcgtacaataaaccatccatcagcctgccacccgttctgccttggactgagcccgagtgcgacttcccagatgaaaaagactcatactgggagttctag

SEQ ID NO: 207138 - DNA, 1260 bp, Artificial Sequence
  Description of Artificial Sequence: Synthetic coding sequence
atggagagcatcagcatgatgggcagccccaagagcctgagcgagacatttctcccaaacggaattaatgggatcaaagacgcgaggaaggtgacagtgggggtgattgggtccggcgactttgccaaatctctgacaatcaggctgataaggtgtggttatcacgtagtgatcggctcccggaacccaaaattcgcgtcggagtttttcccccatgtggtcgatgtgacacatcacgaggatgctctgacaaaaacaaacatcatcttcgttgccatacaccgcgagcactatactagtctgtgggatctacggcatctcctggtcggaaaaatccttatcgatgtttccaacaacatgaggatcaaccagtacccggagagtaacgcagaatacctggcctctcttttccccgattctctgattgtaaagggatttaacgtcgtcagcgcctgggctttacagctagggcccaaagatgcctcacggcaggtatacatctgttctaataacatacaggctcgtcaacaggtgatcgagctagcgcgccagctgaatttcattcccatagacctgggcagtctttccagcgcgagagagatcgaaaacctacccctgcgtctgttcacgctgtggaggggccccgtggtggtggctatctccctggccaccttctttttcctatactctttcgtcagagacgtgattcatccctacgccaggaatcaacagagtgacttctacaagatacccattgagattgtgaataaaacgctccccattgtggctattaccctgctctctctagtctacctcgctgggttgttggcggccgcataccaattgtactacgggaccaagtataggcgttttcccccgtggttagagacatggctacagtgtagaaagcagctgggccttctcagttttttcttcgccatggtccacgtcgcctattctctctgcctgcctatgcgacgctcagaacgttatttattcctcaacatggcttatcagcaagtacacgctaacatagagaatagttggaatgaagaggaagtatggaggatcgaaatgtacattagtttcggtattatgtctctaggcctgctcagtctcctcgctgttaccagcattccttctgtgagcaatgcactcaattggagagagttttcattcatccagatattttgtagtttcgcagacacccaaacggaactcgaactcgaattcgttttcctgctgaccctgcttttatag

SEQ ID NO: 207139 - DNA, 1473 bp, Artificial Sequence
  Description of Artificial Sequence: Synthetic coding sequence
atggagagcatcagcatgatgggcagccccaagagcctgagcgagaccttcttgccaaatgggatcaatgggattaaggacgcaaggaaagttaccgtaggggtgattggcagcggcgattttgctaagtcactcacgattagattgatacggtgcggataccacgtcgttatcggctccagaaaccccaaattcgccagcgaattttttcctcatgtggtagatgtaacacaccacgaagatgcccttacaaaaacaaacatcatctttgtggcaattcacagggaacactacacttccctctgggatctgcggcatctattagtaggcaaaatactgatagacgtgagcaataacatgagaattaatcagtatcctgaatcaaacgctgagtaccttgcgtccctgtttcctgacagcctgatagtgaaagggttcaacgtggtttccgcatgggcgctgcagctggggccaaaagacgctagtaggcaggtctatatttgcagcaacaatattcaggcccggcaacaggttattgagctcgccaggcagctcaatttcataccaattgatctggggagcctgtcttctgccagggagattgaaaacctaccgttacgcttgtttacactttggcgcggacctgtcgtggtggcgatctctctcgcgactttcttttttctgtacagcttcgtgcgggacgtgatccatccctacgctaggaaccagcaatccgacttctacaagattcctatcgagatagtgaataaaacacttccaatcgtcgccatcaccttactgtcgttggtgtacctggccggcttgcttgcggcagcgtaccagctctattacggtacaaaatatcgcagattcccaccgtggctcgaaacatggcttcaatgtcgaaagcagctcgggctcctgtccttcttttttgcaatggtacacgttgcttatagtctgtgtttacctatgaggcggagtgaaaggtatttatttttaaatatggcctaccagcaggtgcatgccaatatagagaatagctggaatgaagaggaggtttggcgcattgagatgtacatatcattcgggattatgagtctggggctcctgtctttgctggcggttacctctattccttctgtcagcaatgcactcaattggagggaattctcttttatccaatccacacttggatacgtcgccctgctgatctctacgttccacgtgctcatttatgggtggaaaagggcattcgaagaggaatactataggttctacactccgcctaacttcgtcctggccttggtgctaccgtccatcgtgatactaggtaaaattatactcttcttgccctgtatttcgaggaagctgaagcgcataaaaaaggggtgggaaaaatcacagtttctggaggagggaatgggtggaactataccgcacgtatctcccgagcgtgtgaccgtgatgtag

SEQ ID NO: 207140 - DNA, 1473 bp, Artificial Sequence
  Description of Artificial Sequence: Synthetic coding sequence
atggagagcatcagcatgatgggcagccccaagagcctgagcgagacatttcttcccaatgggataaatgggatcaaagacgccaggaaggtcaccgtgggggtgattgggtccggggacttcgcgaaaagcctcaccatcaggctgattcgctgcgggtatcatgtggtgataggtagccggaatcccaagttcgctagcgagtttttcccgcacgtggtagacgtgacccatcatgaggatgctctgacaaagaccaatattattttcgtcgctatccaccgtgagcattacacatcactgtgggacctgcgccatctactggtgggaaagatattaatcgatgtgtcgaataacatgcgcataaatcagtatccagaatcaaatgctgaatacctcgcaagcctatttcccgacagcctgatcgtgaaaggttttaatgtcgtgtcagcatgggccctccagttagggcccaaagacgccagtagacaggtatacatttgttctaacaacatccaggcccggcagcaggtaatagaactggctcggcaattaaactttatcccaatcgacctcgggagcctcagctctgcgcgtgaaattgagaacctgcccctcaggctgtttacactatggcgcggccctgtcgtggtcgccatttctcttgctacatttttttttctctactcattcgtccgggacgttattcacccctacgcgcgaaaccagcagtccgatttttataagattcccattgagatcgttaacaaaactctgccaattgtggccatcacattactgagcctggtgtacttagcgggcttgctggctgccgcctaccagctttattatggtacgaaataccgaaggtttcccccctggctagaaacctggctgcaatgccggaagcagctagggctgttgtcgtttttttttgctatggtccacgttgcatacagcctgtgcctgcctatgaggagaagcgaaagatacttgtttctgaatatggcctaccagcaggtgcacgccaatatcgagaacagctggaatgaggaggaggtatggcgcattgagatgtatatctcttttggcatcatgagcctgggactccttagtctgctggctgttacttctattccatcagtatcaaacgctcttaattggagggagttttccttcattcagagcacactgggatatgtggctctgctcatctccacgttccacgtgctaatctatgggtggaagcgcgccttcgaagaagagtattatcggttttataccccacctaatttcgtcctcgccctcgtcttgcccagtattgtcatcctgggtaagataatactgtttttaccttgtatctccagaaagctgaagcgcatcaagaaggggtgggaaaagtctcagttcctcgaagagggcatgggtgggactattcctcatgtcagcccagaacgagtgaccgtcatgtag

SEQ ID NO: 207141 - DNA, 1473 bp, Artificial Sequence
  Description of Artificial Sequence: Synthetic coding sequence
atggagagcatcagcatgatgggcagccccaagagcctgagcgagacgttcctaccaaacggaatcaatggcatcaaagacgctcgcaaggtcactgtgggcgtgataggatcaggagacttcgccaaatctctcaccatccgtctgatccgctgtggctaccacgttgtgattggatctcgcaacccaaagtttgcaagtgaattctttccacatgttgtggacgtcacgcatcacgaggatgcacttacaaagaccaacattatcttcgtcgcaatacatcgggagcattacactagcctgtgggatctgcggcatctcctcgtggggaagattcttatcgacgtatccaataacatgcggattaaccagtacccagagtccaatgctgaatacttggccagtctgtttcccgattcactgatcgtgaaagggttcaacgttgtatcagcctgggccctgcaactgggacccaaggacgcatctaggcaggtgtatatttgttcaaataacatccaggccagacaacaggtcattgagttagccaggcagttgaatttcattcccatcgaccttggatcgctgtcttctgccagagagatcgagaatctccctctccgcctttttacactgtggaggggccctgttgttgtcgcgatctcgctggccacatttttctttctctatagctttgtgcgggatgttatccatccctatgcccggaaccagcagagcgacttctacaagatccctattgagattgttaataaaacacttcctatagtcgcaatcaccctcctttctctggtgtacttggctgggttgcttgcagctgcctatcagctgtactatggcactaagtacagaagattccctccctggctggagacctggcttcaatgtaggaagcaactgggactcctcagcttttttttcgctatggtgcacgttgcctacagcctgtgtttgccaatgcggcgcagcgagcggtacctcttccttaacatggcctaccaacaggtgcatgccaatatagaaaacagttggaacgaagaagaagtgtggcgcattgagatgtatatcagttttggtatcatgtctctgggtctactgtctttgctggcggtgacaagtatcccatcagtgagcaacgccttgaactggagagagttctcgttcatccagagcacactgggttacgtggcattgctgatatccactttccatgtgctgatctacgggtggaagagagcattcgaagaggagtattataggttctacacaccccccaacttcgtcctggcccttgtactgccttccattgtgatactggggaaaattattctattcctgccgtgtatcagtcggaaactgaagaggattaaaaagggatgggagaaatcccagtttctggaagaaggcatgggaggcaccatcccgcacgtgtccccagagagagtcaccgtgatgtag

SEQ ID NO: 207142 - DNA, 1365 bp, Artificial Sequence
  Description of Artificial Sequence: Synthetic coding sequence
atggagagcatcagcatgatgggcagccccaagagcctgagcgagacattccttccgaacgggataaacggaatcaaggatgccagaaaagtgacggtgggtgtgataggatcaggcgattttgccaaatcactcactatccgactgatcagatgcggataccatgtggtcatcgggagtcgtaatcctaaatttgcctctgaatttttccctcatgtggtagatgtgactcatcatgaggatgcccttactaaaactaacataatcttcgtcgccatacatagagagcattacacatccctttgggacttgcgccacctgctcgttggtaaaatcctgatcgacgtatccaacaacatgcgcatcaatcagtaccccgaatccaatgccgaatatctggcatccctgttccctgactccctaatcgtgaagggtttcaatgtggtatcggcctgggctctccagttgggccccaaggatgcaagccgacaggtgtatatttgcagcaataacattcaggctaggcagcaggttattgaactggctcggcagcttaactttattcctatagatctgggctctctctcttccgctagagagatagaaaatttgcctctgagactattcactttgtggcggggcccggtggtggtggcgatatctctcgccacatttttcttcctgtattcctttgtcagagatgtgattcacccctatgctagaaatcaacagtctgatttttataagatccccattgaaatcgtcaacaaaaccctgcccatcgtggccattaccttattgagtctcgtttatctcgccggactcctcgccgccgcctatcaactgtattatggcacgaaatataggcgctttccaccttggctggagacctggctgcaatgccgcaagcagctcgggctgctctctttctttttcgcgatggtccacgtggcatacagcttgtgtctaccaatgagacgctctgaacgatatctttttctgaacatggcataccagcaggttcacgctaacatcgaaaatagttggaatgaggaggaagtctggcgcattgaaatgtacatcagcttcggtataatgagcctgggccttttatctctactggccgtgaccagcattccaagtgtgtcaaatgcactaaactggagagagttttcctttatccagtcaacgcttgggtatgtcgccctgctgatctcaacttttcacgttctgatctacggctggaagagggcctttgaggaggaatattacagattttacacaccaccaaacttcgtgttagctctcgtgctgccaagcatcgtgatattagatctcttacagttatgtagatatcctgactag

SEQ ID NO: 207143 - DNA, 1365 bp, Artificial Sequence
  Description of Artificial Sequence: Synthetic coding sequence
atggagagcatcagcatgatgggcagccccaagagcctgagcgagactttcctcccaaacggaattaatggtataaaggacgctcggaaggttactgtgggggtcatcggatctggcgactttgctaagtcgttaacaatccgcctcattcgatgtggctaccatgtcgtgattggttctaggaatcctaagttcgctagtgagtttttcccgcatgtggtcgatgttactcaccatgaggacgctcttaccaagactaacataatctttgtcgcaatacatagagagcactacactagcctgtgggatctgcgccacctcctggttgggaagattcttattgatgtgtcaaacaatatgaggattaaccagtacccagaatctaacgctgaatatctcgcatcactctttcccgattctctcatagtcaaaggattcaatgtcgtcagcgcttgggcactacagctgggcccaaaggatgcaagccgccaggtgtacatctgttccaacaatatacaagcccggcagcaggttatcgaactcgctaggcaattaaactttattcccatagacctcgggtccttgtcaagcgctagagagatagagaacctgcccctaaggcttttcacactctggagaggccctgtggtggtggccatttcgttagctactttcttcttcctatattcctttgtgcgcgacgtgattcacccgtacgcaagaaatcagcagtcagacttttataagatccctattgagattgtcaataagactttgccgattgtggccatcacactattgtccctcgtatacctggcagggttgctagctgcggcgtatcagctgtactacggcaccaagtataggagatttccaccttggctcgagacctggttgcagtgcagaaaacagctgggtctcctctcctttttcttcgcaatggtccacgttgcatattctctgtgtttaccaatgcggcgatccgagaggtacctctttcttaacatggcctaccaacaggtgcacgcaaacatcgagaatagctggaacgaagaggaggtttggcggattgagatgtacataagttttggcatcatgagtctgggactgctgagtctccttgccgtgaccagcatcccctctgtgtcgaatgccctgaactggagagaattttcatttatccagtcaaccctaggctatgtggccctgcttattagcacctttcacgtgcttatttatgggtggaagagagccttcgaggaggagtactacaggttttatacacctccaaactttgtgctggctcttgtattgccatctatagtgatactggatcttcttcagctctgtcgttatccggattag

SEQ ID NO: 207144 - DNA, 1365 bp, Artificial Sequence
  Description of Artificial Sequence: Synthetic coding sequence
atggagagcatcagcatgatgggcagccccaagagcctgagcgagacctttctgcccaatggcatcaacggtatcaaggacgcaagaaaagtgaccgttggagttattggatctggggacttcgccaaatcgctaaccatacgtctaatacgttgcggttaccatgtagtgataggttctcgcaacccaaaattcgcgtccgagttcttccctcatgttgtggacgtcacccaccacgaagacgctctgactaagactaatatcatatttgttgcaattcaccgggagcattacacgtccctctgggacttaagacatctcttggtggggaaaatcttaatcgacgtatccaataacatgcgaattaatcaatatccagagagcaacgccgagtacctcgcgagccttttccccgattccctgattgtgaagggctttaacgtggtgagcgcttgggcactccagctgggtcccaaagacgcgtctcgccaagtatatatctgttccaataacattcaggccaggcagcaagtgatagagttagcacgacaattaaatttcatccccatcgatctcggaagtctgtcctcggcaagggaaattgagaaccttcccctgagactctttacactttggcggggtccagtcgttgtggctattagtctggcaacgtttttcttcctgtacagtttcgtccgcgacgttatacacccttatgcgagaaaccaacagtccgacttttataagatccctattgagattgtcaataagaccctgcccattgttgctatcactcttctcagcctagtatacttagctgggctacttgccgcggcttaccaactgtattacggcacaaaatacaggcgattcccgccctggctcgaaacatggcttcagtgccgtaaacaactaggcttactgagctttttcttcgcaatggtgcatgtcgcttattccttatgcctccccatgcggaggagtgagcgctatctgtttttgaatatggcgtaccagcaagtgcacgcaaatattgagaattcctggaacgaggaggaagtgtggaggatagaaatgtacatcagctttgggatcatgagtctcgggctgctgtctctactagccgtgactagcattccctccgttagcaacgccctgaattggcgcgagttcagcttcatccagtctacactggggtatgtggctctgctcatttccacctttcacgtcttaatttacggttggaaacgcgcttttgaggaagaatattaccggttctatacacctccgaacttcgtgctcgccctggtcctaccttctatcgttatcctggacctgctgcagctctgccgatatcctgactag

SEQ ID NO: 207145 - DNA, 267 bp, Artificial Sequence
  Description of Artificial Sequence: Synthetic coding sequence
atggagagcatcagcatgatgggcagccccaagagcctgagcgagacgtttttgcctaatggtatcaacggcatcaaggacgcccgcaaggtgaccgtcggcgtaatcgggtcaggcgatttcgccaagagcttgaccattagacttatcaggtgcggctaccacgtggtgatcggatcacgtaacccaaagtttgcaagcgagttctttccacatgtcgttgacgtgacgcatcacgaagacgcactcacaaagaccaacatctag

SEQ ID NO: 207146 - DNA, 549 bp, Artificial Sequence
  Description of Artificial Sequence: Synthetic coding sequence
atggagagcatcagcatgatgggcagccccaagagcctgagcgagaccttcctacccaatggtatcaacggcataaaagatgctcgaaaagtcacggtcggcgttatagggtccggcgactttgctaaatctctcaccattcgtctgatccgttgcggttaccacgtggtgataggtagcagaaacccgaagtttgcatctgagttttttccgcacgtggtagatgtgactcaccacgaggacgctctaaccaaaacaaacataatttttgtggccattcatcgggagcactacacctccctgtgggatttacggcaccttctggtgggaaagatcctgatcgacgttagtaacaacatgcggattaatcagtatcctgaaagtaacgctgaatacctggccagtctctttcccgactcccttatagtcaaaggttttaatgtggtctctgcatgggcgctgcagctcggccccaaagacgcctctaggcaggtctacatttgttctaataatattcaggcaaggcaacaggtcatagagctcgcgtag

SEQ ID NO: 207147 - DNA, 1467 bp, Artificial Sequence
  Description of Artificial Sequence: Synthetic coding sequence
atgcccgaggagatggacaagcccctgatcagcctgcacctggtggactccgattcttctttagctaaggtccctgacgaggctcctaaggttggaatcctgggcagcggtgacttcgcgcggagcttggccacacgactggttggttctgggttcaaggtcgtcgtgggtagccgaaatcctaagaggacagctcggctcttccccagtgcagcccaggtcaccttccaggaagaagctgtttcttcccccgaagtgatcttcgtagccgtgtttagggagcattacagctccctgtgtagtcttagcgatcagctggctggtaagatcctggtggatgtgagcaatcccacagagcaggagcacctacagcaccgcgagtcgaatgccgaatacctggcctccctgttccccacatgtactgtcgttaaggcttttaatgtaatttctgcatggactctgcaggcaggcccacgagacggaaacagacaggtgcccatttgtggggatcaaccagaggctaaacgcgcagtgagcgagatggccctggctatggggtttatgcccgttgatatggggagtctggcatcggcctgggaagtggaagccatgccacttaggctgcttccagcctggaaggtgcctacgttactagccctgggtttgttcgtgtgcttttatgcctacaattttgtgcgggatgtgttgcagccttacgtccaggaatctcagaacaagttcttcaaactgccagtgagtgtggtgaacaccacattgccttgcgtagcatatgttctgctcagtcttgtgtatctgcccggcgtgttagcggcggccctccagctcagacggggtaccaagtaccagagatttcctgactggctggaccactggctccaacacagaaaacaaatcggtctgctaagcttcttttgtgcagctttgcacgccctttactctttctgcctgccactgaggcgggcgcaccggtatgacttggtgaatctggccgttaaacaggtgctggctaataaatctcacctgtgggtggaagaagaagtgtggagaatggaaatatacctgtcccttggagtgttagccctcggtacattatcgttactggccgtgacatcgcttccttccatcgccaactcactgaattggcgggaattttcttttgtgcaatcctccctcggtttcgtggccctggtgctgtcgacgctgcacactctcacatacgggtggacccgggcgttcgaagagtcccgatacaagttttaccttcccccaaccttcactctgacactcctggtcccctgcgtcgtaattttagctaaagccctgttcctgctgccctgcatttcgcgtcggctggcacgaattcgccgcgggtgggagcgcgagagcacgatcaagttcactttgccaacagatcatgccctagcagagaaaacctcacacgtatag

SEQ ID NO: 207148 - DNA, 1467 bp, Artificial Sequence
  Description of Artificial Sequence: Synthetic coding sequence
atgcccgaggagatggacaagcccctgatcagcctgcacctggtggattccgatagtagccttgccaaggtgcctgacgaagcacccaaggtcgggatcctcggctcaggggatttcgctcggtcccttgctacacggctggtggggagcgggttcaaggtcgtggtcggtagtcgaaaccctaaacggaccgctcgcctgtttcccagcgctgcccaggtaacttttcaagaagaggcggtgtcctccccggaggtgatttttgtggccgttttcagagaacactattccagcctgtgcagccttagtgatcaactggccgggaaaatacttgttgatgtgtccaatcctaccgagcaggaacatcttcagcatcgggaatccaacgccgagtatcttgcctctctgttcccgacttgcacggtggttaaagcctttaatgttattagcgcctggactttgcaggccgggcctagggatggtaacagacaggtgccaatttgcggcgatcagcccgaagctaagagggctgtgagcgaaatggcattagcgatgggcttcatgcctgtggatatggggtccctggccagtgcgtgggaggtagaggcaatgccacttcggctcctgcccgcatggaaagtgcccaccttgctggcattgggtctcttcgtgtgtttttacgcctacaatttcgtcagggacgttctgcagccctacgtacaggagagtcaaaacaaattttttaaactgcctgtgagtgtagtgaatacgaccttaccctgtgtagcttatgtgttactgtctctcgtttacctgccaggggttctggcagcagccctccagttgcggcggggtacaaagtatcaacggtttcccgattggcttgaccactggctgcagcataggaaacagattggcttgctctctttcttttgcgccgccctgcatgcgctctattcattttgtttgcccctgcgaagggcccaccgttacgatctggtgaacctggccgttaagcaggtactggcaaacaagtcccacctttgggttgaagaagaggtctggcgaatggagatctacctaagcctgggcgttttagccctcggtacccttagtctcctcgctgttacttcactcccgagtattgcaaattcacttaattggcgggagtttagtttcgtgcaaagctctctcgggttcgttgccctggtgctgtccaccctgcatacactgacgtacggttggactcgagctttcgaggagtctcggtataagttctatttgcctccaacatttaccctgactcttttggtcccttgcgtcgtcattttagcgaaagctctattccttctgccttgcatctctagaaggctagccagaattcggcggggctgggagagagagagtaccataaagttcactctacccacggatcatgcacttgctgaaaagacaagccatgtgtag

SEQ ID NO: 207149 - DNA, 1467 bp, Artificial Sequence
  Description of Artificial Sequence: Synthetic coding sequence
atgcccgaggagatggacaagcccctgatcagcctgcacctggtggattcagatagtagtctggctaaagtccccgatgaggcccccaaagtgggcattctcgggagtggcgatttcgcgcggagcctggcaactagactggtcggaagcgggtttaaggtcgtcgtgggaagccgcaaccccaagaggacagcccgcttgtttccatcagccgctcaggtgacttttcaggaagaagcagtatcgtcaccagaggtgatcttcgtcgcagtgttcagggaacattacagctcactctgttccctctctgatcagcttgcgggcaagattctggtagacgtgtctaatcctaccgagcaggaacacttacagcaccgggaaagtaatgccgagtacctggccagcctcttcccgacatgcaccgtcgtaaaggctttcaatgtgatttctgcctggaccttacaagctggtcccagggatggcaaccgtcaggttcccatttgtggggaccagcccgaggccaagagagccgttagtgaaatggccctcgcaatgggattcatgcccgtggatatgggctcccttgccagcgcctgggaagtcgaagcaatgcccctgaggctgttaccagcatggaaagtgcccaccttgctcgccctgggactgtttgtgtgcttttacgcatataacttcgtgcgcgacgttctgcagccctacgtccaggagtcccagaataaattcttcaagttgcctgtgtccgttgtaaacacgaccttgccctgtgtggcctacgttctcctgtcgttggtttacctccctggggttctggccgctgccctgcaattgagaagaggtactaagtatcagaggttcccagattggcttgaccactggctacagcatcgcaaacaaatcggattactgtcttttttctgcgccgcactccacgccctctattcattttgcctgcctctacggcgggcacataggtatgacctggtaaatctagctgtaaagcaggtcttggccaataagtctcacctgtgggtggaagaagaggtctggcgtatggagatatacctctccctgggtgtgttggccctgggtaccctgagcctgttggcagtgactagcctgccctctatagctaatagtctcaactggagagagtttagttttgtgcagagtagtctgggatttgtggccctcgtcttatccaccctgcataccttgacctatggttggactcgcgcctttgaagagagccggtacaagttttacttacctcctacatttacacttacccttctggttccctgcgtggtgattctggcaaaggccctgttcctgttaccctgtatctcacgccggttggccagaatcagacgagggtgggagcgggagtctacgatcaagttcactctccctaccgatcacgcattagcggagaagacctcgcacgtgtag

SEQ ID NO: 207150 - DNA, 1467 bp, Artificial Sequence
  Description of Artificial Sequence: Synthetic coding sequence
atgcccgaggagatggacaagcccctgatcagcctgcacctggtggactctgactcatcgttggcaaaggttcccgacgaagctcctaaggtgggcattctcgggagcggagatttcgcccgatccctggccactaggctggttggatccggcttcaaggttgtggtaggttctcgaaatccaaaaaggacagcacgcttattcccctctgcagcacaagtaacattccaagaagaagcggtctcttcccccgaggtcatttttgtggccgtttttcgagagcactactcctcactgtgcagcctctccgaccagctagccggaaaaatcttggttgacgtgtccaacccgactgagcaggagcatctgcaacacagagagtccaacgcagaatatctagcgagcctcttcccaacctgcacggtcgtaaaggccttcaatgtaattagcgcctggactctgcaggccggaccacgggacggtaaccggcaggtgccgatctgcggggatcagccggaagctaaaagagccgtgagcgaaatggccctggccatgggattcatgccagtggatatgggatcattagcaagcgcctgggaagtggaagctatgccactgagacttctccctgcttggaaagttccgactttgctggccttagggttattcgtttgtttttatgcatataatttcgttcgagatgtgttacagccatacgtccaagagtcccagaacaagttcttcaaactgcctgtatcggtggtgaatactacgctgccttgtgtggcatacgtgctgctttctttggtgtatctcccaggagtgctggctgccgccctgcagctgcgcaggggcaccaagtaccagcgcttccccgattggttggatcactggcttcagcaccgaaagcagattggcttactgtccttcttctgtgcggccttgcatgcattatactccttctgcttaccactcagacgagcacataggtatgacctagttaatctggcggttaaacaggttctcgccaacaaaagccacttgtgggtcgaagaagaggtgtggagaatggagatatatcttagcctgggagtcttggcactgggtactctctcactgctggcagtaacatccctgcccagtattgctaacagtctgaattggcgtgaattcagctttgttcagtcatccctgggatttgtcgccctggtcctaagcaccttgcacacactgacctacgggtggaccagagccttcgaggaatcaagatacaaattctaccttcctccaaccttcaccctcaccttgctggtcccctgcgtcgtcatccttgccaaagctctgttcttgcttccctgtatctccagaaggctggcccgcattcggagggggtgggaacgagagtccactatcaaattcactctgccaacagatcatgcactggctgaaaaaacctctcacgtctag

SEQ ID NO: 207151 - DNA, 1497 bp, Artificial Sequence
  Description of Artificial Sequence: Synthetic coding sequence
atgagccaccagcccgccgtggccaccaagatgcccgaggagatggataagccattgattagtctacacctggttgacagtgattcatctctggccaaggttcctgacgaagcccccaaggtgggtatcttgggttctggtgatttcgccaggtccctagcaactcgtctggtgggttctggatttaaagtggtcgtgggcagccgtaatccaaagaggactgctcggttatttccatcagccgcccaggtgacctttcaggaagaggccgtgtcctctcctgaggtgatttttgttgccgttttccgggaacactactcaagcctctgttctctgtccgatcagttggccggaaagatcctggtggatgtgagcaatcctactgagcaggaacatctacaacaccgcgaatcgaatgccgaatatttagcctcgttattccctacctgcacagtggtgaaggctttcaatgtgattagtgcctggacactgcaggccggccccagagatggaaaccgtcaggtccctatctgcggagatcagcctgaagccaagcgggccgtgagtgagatggcgcttgcaatgggttttatgccagttgacatgggtagcctggcttccgcctgggaagtggaggcgatgccgcttcgcttgctgcccgcttggaaggtaccaaccctcctcgccctgggcctcttcgtctgcttttacgcgtacaactttgtacgggacgtcttacagccgtacgtgcaagagtcacaaaataagttttttaagctgcctgttagcgtcgtcaatacgacattgccgtgcgtggcttatgttctgctgtccctggtgtacctgccgggggtgctggccgcagcccttcaattgagaagaggaactaagtaccagcgctttcctgactggctggatcactggctgcagcaccgtaaacagatcggcttgctttcttttttttgcgcagcactgcatgcactatattctttctgccttccactgcgacgggcacacagatacgaccttgtgaatctcgctgtgaagcaagtactggccaataagagccacctttgggttgaagaagaagtatggcggatggaaatttatctgtcactgggagtgctcgccctcgggactttgtccctgctcgccgtgactagtcttccatcaatagctaattcactaaattggagggaatttagtttcgttcagtccagtctcggtttcgtggccctggtgctgtctactctccacactctgacttacggctggacgagagcattcgaggaatcccggtacaaattctatttacctcctacattcaccttgactctgctcgttccctgtgtggtgatcctggccaaagctctctttttacttccttgcatctccaggaggttggcacggatacgaagaggatgggaaagggaaagtaccatcaagtttacacttccaactgatcacgcattagctgagaagacctcacacgtctag

SEQ ID NO: 207152 - DNA, 1374 bp, Artificial Sequence
  Description of Artificial Sequence: Synthetic coding sequence
atgcccgaggagatggacaagcccctgatcagcctgcacctggtggattcggattcctccctagcaaaggtgccagacgaggcccctaaggtcggaatactggggtccggtgacttcgcccgcagcctagccacccgtctggtggggtccggcttcaaagtagtcgtgggaagcaggaacccaaagcgcaccgcgaggttattcccctccgctgcgcaggtgacatttcaggaggaagcagtgtcgtctcccgaagtgatttttgtggctgtctttcgtgaacactattcaagcctttgttccctttctgatcagctcgctggaaaaatcttggtggatgtaagcaaccccacagagcaggaacacctccagcaccgggagtcgaacgccgaatacttagcctccttattcccaacctgcaccgtggtcaaggcttttaatgtgattagtgcctggacactgcaagccggaccgcgggacgggaatcgccaggtgcccatctgtggagaccaacctgaggctaagcgggccgtgagtgaaatggcgctcgccatggggttcatgccggtcgacatggggtctctcgcaagcgcgtgggaagtcgaagcaatgcctcttagactgctgcctgcttggaaagtgccaaccctgctcgctcttggtttatttgtgtgtttctatgcatacaacttcgtgagagatgttctccagccgtacgtccaggaaagccaaaataagttttttaagctccccgtgagtgttgtaaacactacactgccctgtgtggcatacgtccttctgagtttggtgtatctgcctggagtcttggcagctgcactacagctcagacggggtacgaagtatcagagattccctgattggctcgatcactggctccagcatagaaagcaaatcggtctcctttcttttttttgcgcagctctgcacgcactctatagcttctgtttgccgttaagaagagcccacagatacgatctagtgaacctggctgtgaagcaggtcctggctaacaagtcccatctttgggttgaggaagaagtgtggaggatggagatttatctgtctctcggtgtgctcgccctgggcacgctgagcctattggcggtcaccagtctgccgtcaatcgcaaattccctgaattggcgtgaattcagcttcgtacagtgtgtggcaactagttcagctggaaacacaggcagtggaaccagacgacccgagtctcagtcccaggacccgcaccttccagccccacatcaccaaacatcttttctcgggccaaggtccttttgttgttccctggtgccggtcagcacgccatatggccaccaggaggatttgtcatggacccggtag

SEQ ID NO: 207153 - DNA, 1467 bp, Artificial Sequence
  Description of Artificial Sequence: Synthetic coding sequence
atgcccgaggagatggacaagcccctgatcagcctgcacctggtggactcagatagcagtcttgctaaggtgccagacgaagctccaaaagtggggatcttggggtcaggagactttgcccggtcactcgccactagacttgtcggctcaggcttcaaggtggtcgtgggaagcaggaaccctaaaagaaccgcccggctctttccatctgcagcacaagtaaccttccaagaagaggctgtgagctctcctgaagtgatcttcgtcgcagtatttcgcgaacactactcttctctatgctctctttccgatcagctcgcgggcaaaatattggttgatgtgtcaaatcccaccgaacaggaacacctacaacatagagagtccaacgcagaatatcttgcttcactgttcccaacgtgtactgtggtgaaggcatttaacgttataagtgcttggaccttgcaggcaggacctcgagacggaaacagacaggtgcctatctgcggcgaccagcccgaggccaagcgcgccgtctccgaaatggccctcgccatgggattcatgcccgtggatatgggctcattggcctccgcctgggaggtggaggctatgccgttgcgcctcctgcctgcctggaaggtcccgacgctactggcactcggtttattcgtgtgcttctacgcctataacttcgtccgagacgtactgcagccctacgtgcaagaaagccaaaataagttcttcaaactgcccgtgtccgtcgtgaacactaccctcccatgcgtggcatatgtactcctctcacttgtgtacctgcccggcgtgttggctgccgcactgcaactccgccgaggaactaagtaccagaggtttcccgattggcttgaccactggctacagcaccgaaagcaaattggccttctgtcatttttttgcgcagcacttcacgctctttatagcttttgtcttccactgcgacgcgcccaccgctacgatctggtcaacctcgccgtgaagcaggtgctggccaataaatcacacctttgggtcgaggaagaagtgtggagaatggagatctacctgtccctgggcgttctcgcactcgggaccctgagcctcctggccgtcacatcactgccttcaatagcaaacagcttgaattggcgcgaattcagcttcgtacagtcaagtctcggttttgtggctcttgtgttgtcaacactccacaccctcacctacgggtggactcgagcatttgaagagtccagatacaaattttaccttcccccaacctttaccctgactcttctggtgccttgtgtcgtgatcttggccaaagcactgttcttgctgccttgcatttcccgccgcttggcgcggatacggcgcgggtgggagagggagagcacaattaagtttacactccccactgatcacgctctcgcagagaagacaagtcacgtttag

SEQ ID NO: 207154 - DNA, 1374 bp, Artificial Sequence
  Description of Artificial Sequence: Synthetic coding sequence
atgcccgaggagatggacaagcccctgatcagcctgcacctggtggacagtgactcatccctggcaaaggtcccagacgaggctcctaaggttggaattctgggaagcggtgattttgctcgttccctcgcaacccgcttggtggggagtggctttaaggtagtcgtggggagtcggaatccaaagcgcacggctcgcttgttcccatcggccgcgcaagtgactttccaagaagaagccgtatctagtcctgaagtcattttcgtagctgtgttccgagagcactattccagcctgtgctctctgtcggaccagttggcaggcaagatcttggtcgatgtcagtaacccaacagagcaagaacatctacagcacagggagtcaaatgcagaatacttggcttcgctttttcctacatgcaccgttgtgaaggcttttaacgttatcagtgcatggactctccaggcgggccctcgggacggaaatcgacaggtaccaatctgcggcgatcagcccgaagccaagagggccgtctctgaaatggcgttagctatgggattcatgcccgtggacatgggatctctggcctccgcgtgggaggtggaagcaatgcccttacgattacttccagcctggaaagttcccaccctactggccctcggactctttgtctgtttctatgcgtataacttcgtacgcgacgtccttcaaccttacgttcaggaatcacaaaacaagttttttaaattacccgttagcgtggttaacactaccttgccatgcgtagcttatgtgctcctttctctggtatatctgccgggcgtcctggccgccgccctccagctacggcggggaactaagtaccagcgcttccctgactggttagatcattggctccaacaccgaaagcagatcgggcttctgagtttcttttgtgctgcactgcacgccttgtattccttttgccttcccttgaggcgggcgcatcgttacgatttagttaatctggctgtgaaacaggtgctggccaataagagccatctgtgggtggaggaggaagtgtggcgcatggagatctacttgtcgttgggagtgttagccctgggcactctctctttactggctgtgacatcccttccaagcatcgccaattctctaaattggagagagttttcctttgtccaatgtgtcgctacatcttccgccggcaacaccggtagcggaacgcggagaccagagtctcagagccaggatccacacctgcctgccccacaccaccaaactagcttcctgggtccccgttccttctgttgctctctggtgccagtctcaacaccctatggccatcaggaagatctgtcttggacgaggtag

SEQ ID NO: 207155 - DNA, 432 bp, Artificial Sequence
  Description of Artificial Sequence: Synthetic coding sequence
atggagatctacctgagcctgggcgtgctggccctgggcaccctgtctttgctggccgtgacctccctgcctagcatcgctaattctctgaattggagggaattttccttcgtgcagtcctcactgggttttgtagccctggtgctcagcacgcttcataccctgacctacgggtggacccgtgcattcgaagaatccagatacaaattttatctgccaccaacattcacattaactttacttgtcccttgcgtcgttatccttgcgaaagccttgtttctcttgccctgcatctctcggcgattagcccggattcggagagggtgggagcgtgagagtactattaagttcacacttcctaccgaccatgcattgtctccattaggttttctgttcctggtggtacagtcaggaattaccgtgtgtaagtag

SEQ ID NO: 207156 - DNA, 852 bp, Artificial Sequence
  Description of Artificial Sequence: Synthetic coding sequence
atggagaagacctgcatcgacgccctgcccctgaccatgaacagctccgaaaagcaagaaacggtatgcatttttgggacaggcgacttcggacggagtctggggctgaagatgctccaatgtggctattccgtcgtgtttggcagccgcaacccacagaagacaacacttttgccttccggcgccgaggtgctgtcatattctgaggcagccaagaaatcgggaatcatcatcattgctatccatcgagaacactatgacttcctgactgaactcacagaggtgcttaatggaaaaatcttggtggatatcagtaacaacctaaaaatcaaccaataccccgagagtaacgcggaatacctcgcccaccttgtgcctggggcgcacgttgtgaaagcctttaacacgattagtgcctgggccctacagtccggagctctggatgcaagccgccaggcaatattgaagaaggagaaccctttcagcacttcctcagcatggctgagcgactcttatgtggcacttggcattcttggtttttttttgtttgtgttattaggcatcaccagcctccctagtgtgtccaatgctgtgaattggcgggagttcagattcgtacagtctaaactaggctacctcactctgatactgtgcacagcacatactctggtttacggcggcaaacggttcctgagtccctccaatctgcgatggtaccttccggctgcttatgtcctggggttaatcatcccctgcacagtactggtcatcaagtttgtcctcatcatgccatgtgtcgataacacacttacccggatcagacagggctgggaacgaaatagtaagcattag

SEQ ID NO: 207157 - DNA, 1380 bp, Artificial Sequence
  Description of Artificial Sequence: Synthetic coding sequence
atggagaagacctgcatcgacgccctgcccctgaccatgaacagctccgaaaaacaagaaacggtatgtatctttggcacaggagacttcggcaggtctctaggcctgaagatgctacaatgcggatactccgtggtgttcggtagtaggaatcctcaaaaaacaaccctcttgccctctggggccgaggtgctctcttacagcgaggccgccaaaaaatccgggatcatcattatcgccatacatcgagagcactacgattttctgactgaattaaccgaggttctgaacggcaaaatcctggtggacatcagcaataacctgaagatcaaccagtaccctgagagcaacgcggagtatctggcccatctggttccaggggctcacgtcgtcaaggcttttaatactatttctgcttgggccttgcagagcggagccctggacgcatcgaggcaagttttcgtatgcgggaatgatagcaaagcaaagcaacgagtgatggacattgtgaggaaccttggactgactcccatggatcagggttctctcatggccgccaaagagatcgaaaagtacccgctccagctcttccctatgtggcgttttccattctacctcagtgcagtgctttgcgtcttcctgttcttctattgtgtcattagagatgtgatctatccgtatgtctatgaaaagaaggacaacacattcagaatggcaatatccattcccaatcgaatttttccaataaccgcacttaccctcctagccttggtgtacttaccgggggtgatcgccgctatcctgcagttataccgcggaacgaaatatagaagattccccgattggctcgaccactggatgctgtgtagaaagcaactgggcctcgtggcactcggattcgcttttctgcacgtcctctacactctggtgatccccattcgctactatgttcgttggcggctgggcaatttgactgtcacacaagccattcttaagaaagaaaaccccttctcaactagttctgcctggttgagtgacagctacgtagcattgggaatattaggcttttttttgttcgtgctcctcggcataacctcactgcctagcgtgagcaatgctgtgaattggcgagagttccgattcgtgcagtccaagctaggctacctgactttaattctgtgtacggctcatacgctggtgtacggggggaagcgattcttgtccccatccaatctccgttggtaccttcccgccgcctacgtattggggctgatcattccttgcaccgtcttagtcattaagttcgtgttaatcatgccgtgtgtagataatacactgacgcgcatcaggcaaggatgggagcggaacagtaagcattag

SEQ ID NO: 207158 - DNA, 1080 bp, Artificial Sequence
  Description of Artificial Sequence: Synthetic coding sequence
atgcccgcccacctgctgcaggacgacatcagcagcagctacaccaccacaaccaccattacggctcctcccagccgggtcctccagaacggcggagacaagctggagacaatgcccttgtacctggaggatgacattagaccggacatcaaggatgatatctatgatccaacctataaggataaagaaggcccatcccctaaagttgagtacgtctggagaaatattattttaatgagcctcctccacctgggcgcgctgtacggtataacactgattccaacatgtaaattttatacttggttgtggggtgtcttctactatttcgtaagcgccctcggtatcactgccggagcccatagactgtggtcccaccgttcgtataaggctcgtctgcctttgcgtcttttcctaattattgcgaacacaatggcgtttcagaacgatgtttacgaatgggccagggatcaccgcgcccatcataaatttagcgagacccacgccgacccacacaactcaaggcgtgggttctttttctcccacgtcggttggttgcttgtacgcaagcaccccgccgtgaaggaaaagggcagcacattagatttatctgatctggaagccgaaaaactcgtgatgtttcagagacgatattacaagcctggcctattgatgatgtgtttcattctccccactttggtaccctggtacttctggggcgagacctttcagaactccgtatttgttgccaccttcctgcgttatgctgttgtcctgaacgccacctggttagtcaacagcgctgcacacctcttcggttataggccctatgacaaaaatatttctccgcgggaaaacatccttgtgagcctgggggccgtgggagagggattccataactatcaccactccttcccttacgactatagcgctagcgagtaccgatggcacatcaattttacgactttttttatagactgcatggcagcgctcggactggcttatgatcgaaagaaggtgtcgaaagccgcgatcttagctaggattaaacggacaggtgacgggaattacaaatccggctag

SEQ ID NO: 207159 - DNA, 729 bp, Artificial Sequence
  Description of Artificial Sequence: Synthetic coding sequence
atgcccgcccacctgctgcaggacgacatcagcagcagctacaccacaacaacaactatcacagcccctccttcccgagtacttcagaatgggggcgacaaactcgagaccatgccgctgtacctcgaggatgatatccgaccagacatcaaggatgacatctacgaccctacctataaagacaaagaagggccatccccgaaggtggagtacgtttggcggaacattatattaatgagtctgttacacctgggggccctttatggcatcacactgattccaacttgcaagttttacacatggctgtggggcgttttctattatttcgtttcggcgttaggcatcacagccggggcgcaccgactgtggagccacagatcatataaagcaagactgcctctccgactgtttcttattatcgccaacactatggcttttcaaaatgatgtatacgagtgggccagagaccatcgggcacaccataagttcagcgagacacacgcagacccgcataacagcaggcgcggctttttcttcagccacgtgggatggctcttggtaagaaaacatcctgctgttaaagagaagggctctaccctggacctctcggacttagaggcagagaagctagtaatgttccaaaggcggtactacaagcccggcttgcttatgatgtgttttatcctccctaccctggtcccctggtacttttggggggaaacgttctag

SEQ ID NO: 207160 - DNA, 813 bp, Artificial Sequence
  Description of Artificial Sequence: Synthetic coding sequence
atggcctgccggccccggagccccccccggcaccagagccggtgcgacggcgatgcctcccctccgagccctgcacgctggtctttgggacgcaaacgtcgggcagatggcagacggtggcggccagaggatgccgaagaagctgagcacagaggcgccgagcgaagacccgagtcatttacaacccccgagggccccaagcctcgctctcgctgtagtgactgggcatctgccgttgaggaggatgaaatgcgcacccgggtgaataaggaaatggcacggtacaaaaggaagctactgatcaacgactttgggagagagcgcaaatcttcttcaggctcctcagatagtaaggaatccatgagcacagtgcccgccgacttcgagactgatgaatcagtactcatgagacggcagaaacagattaactacggtaagaatactatcgcgtatgatagatacattaaggaggtcccacgacatctccgccagcccggtatccaccctaaaacccctaacaaattcaaaaaatactctcggagatcctgggatcagcagattaagctttggaaagttgccctccacttctgggatcctccggccgaggagggctgtgacttgcaggagattcacccagtcgatctggaaagcgctgagtcctcctcagagccgcaaacctcttctcaagacgactttgacgtctatagcggtacacctacgaaagttcgacatatggacagtcaggttgaagacgaatttgacctcgaggcgtgcttgacagagcctctccgagacttttccgccatgagctag

SEQ ID NO: 207161 - DNA, 5328 bp, Artificial Sequence
  Description of Artificial Sequence: Synthetic coding sequence
atggccctgagcctgtggcccctgctgctgctgctgctgctgctgttattgctcagcttcgcagtcacactcgctcctaccgggccccactctttggatcccggactctcatttctgaaatcactcctttcaaccctggaccaagcccctcaagggagcctctctcgtagtcggttcttcacttttctcgctaacattagcagtagcttcgagccaggaaggatgggtgaggggccagtcggcgaacctccgcccctgcagccgcctgccctccggttgcatgactttttggtcacactaagggggagtcctgactgggagcctatgctaggactcttgggtgatatgctagctttactgggacaagaacagaccccacgggacttcttggtgcatcaagcaggcgtgctcgggggactagtggaggtgttgctcggggcattggtgcccggcggcccaccgactcccacgagaccaccctgtacacgggatgggccctcagattgtgtgttggccgcggattggctccctagtctgctgctgctcctggagggaacgcggtggcaggccttagttcaggtccagccatccgtggacccaaccaacgccacaggccttgacggcagggaagccgctccccacttcctacaagggctgctggggttactgacacctaccggggagttagggtcaaaggaagctctgtggggaggccttctgcggacagtaggcgctcccctgtacgccgcctttcaagagggcttgctgagggtgacacactcgctccaagacgaagtgttttcaatactcgggcagccagagcctgacaccaatgggcagtgccaaggcggtaacttgcagcagttactgctgtggggcgttagacacaatctgagttgggatgtgcaggcactggggtttctatccggctccccccctccaccacctgctttgctgcactgcctctccacgggcgtcccactcccgagagcctcacagccttccgcccatatttcaccaagacagaggcgggccataaccgtcgaggccctttgtgaaaatcatctaggacccgccccaccctacagcataagcaacttcagcatccaccttttatgccagcataccaagccagctacgccgcagccgcatccaagcaccaccgccatttgtcagacggccgtctggtatgcagtctcttgggccccgggtgcgcagggttggcttcaagcctgtcacgatcagtttccagacgaatttctcgacgccatttgctctaatctctccttctcagcactctcgggatctaatcgccgtcttgtcaaaaggctgtgtgccgggttgctgccaccgcccactagttgtccagagggtctcccaccggtcccacttacaccagatatcttctggggatgcttcctggagaacgaaaccctctgggctgaaagattgtgcggggaggcctccttacaggctgtacccccttcaaaccaggcctgggtacagcatgtctgtcagggaccgacaccagacgtcacagccagtcctccatgtcatattggcccgtgtggcgagcgttgtcccgacggcggatctttcctagtcatggtgtgtgcgaacgacacaatgtatgaagttctagtcccgttctggccatggttggccggccagtgcagaatttctcggggtggcaacgacacctgtttcctcgaggggttgctgggtcccttacttccgtccctgccccccttggggccctcccctctgtgtctcacccctggtcccttcctcctgggtatgctctcacagctcccaagatgccagtccagcgtccctgcacttgcccaccctacgaggctgcattatctcctgcggttgctgacatttctgttagggcccggagcgggcggagccgaggcccagggcatgctgggaagagcgttgcttttgtccagtctccctgacaactgtagcttttgggacgcatttcgtcccgaggggcggcgctcggtgttgcggaccatcggcgaatatctggagcaggacgaggagcagcctacacccagtggttttgagccaacagtgaaccccagcagcggaattagtaagatggaactgctagcttgctttagtcctgtgctgtgggacctgctgcagagagaaaagagcgtgtgggcactccaaattttagtgcaagcatatctgcatatgcccccagaaaatttgcagcagttagtactgtccgccgagagggaggccgctcagggttttttaacccttatgctgcagggaaaactccaagggaaactccaggtaccaccttctgaggagcaggccctcggacgtctaacagccctgttgctccagcggtatcccaggctcacgagccaactctttatcgacctgtcacctctcatccctttcctggccgtgtctgatttaatgaggttccctccgtctcttttagctaacgactccgtccttgccgccattcgggattactccccaggaatgaggcccgagcagaaggaagcactggccaaaaggctcctggcgccggagttgtttggcgaggtgcccgcctggccgcaggagctgctgtgggctgtcctgcccctactcccacaccttccgcttgaaaattttctgcagttgtcaccgcatcagattcaggcccttgaagattcgtggcctgccgcagggctgggcccgggccatgctcggcacgtcttgcgctcgcttgtcaaccaaagtgtgcaggacggcgaggagcaggtgcgtcgtctgggcccccttgcctgtttcctgtctcccgaagaactgcagtctctcgtgcccctttcagacccaaccggacccgtcgagcgcgggctcctggagtgtgcagccaatggaactttgtccccggaaggtcgcgtcgcctacgaactactcggtgtgcttcggtcttccgggggggcagttctgagccccagagagcttagggtgtgggcccctctgttcagccagctcggcctgcggtttctgcaggagcttagcgagccccagcttcgggctatgctgcctgtccttcaaggcacatccgtgaccccagcccaggcggtcttgctgctgggtagactcctgcctaggcacgacctcagtctcgaggagctgtgctcactccatcttctcctccctggtctttctccccagactctgcaagccatccctcgccgggttttagtaggggcctgctcctgcctggcaccagagctgagccgtttatcagcctgtcagacagctgctctgctccagacttttagagtaaaggatggtgtgaaaaacatggggaccaccggcgctggtcccgctgtgtgcatccccggccagcccatccccacaacgtggcccgattgtctcttgccgctcttgcctcttaagcttctgcagttggatagcttagccctgctcgcaaatcgccgacggtattgggagcttccttggagcgaacagcaggcacagtttttgtggaaaaaaatgcaggtccccaccaatctgaccctccggaaccttcaggccctggggacactggcagggggcatgtcatgcgaattccttcaacagatcaacagcatggtggattttctcgaggttgtgcatatgatctatcagctgcccacacgcgtgagaggttccttaagggcttgcatatgggcagaactacaaagacgcatggctatgccagaaccagaatggacaaccgtcggcccagaacttaatgggctcgattccaagctgttgctggatcttccaattcagctaatggaccgcctctctaacgagtctataatgctggttgtggaattggtccagagggcccccgaacagctcttggcactgacccctctgcaccaggctgccctggccgagagggctcttcaaaacttagctccaaaagaaaccccagtgtccggagaggttctggagacgcttgggcccttggttgggtttttggggacagaatctaccagacaaattcctctgcagattctgttatcacacctcagccaactgcagggcttttgtctcggagaaacctttgcgactgagctgggttggttactgcttcaggaatctgtgctaggcaagccggaactgtggtcgcaagacgaggtcgaacaagctggccggttggtcttcacactgtcaaccgaagcaattagtcttatccctagagaggccctgggaccggaaacactcgaacgactattagaaaagcagcaatcctgggagcagtcgagagtgggtcagctttgtagagaaccacagctcgcagctaaaaaggctgccttggtggctggggtggtgagaccggcggctgaggacctgcctgagcctgtccccaactgcgccgatgtgcggggcacctttcctgctgcatggagcgcaactcaaatcgcagagatggagttgagcgattttgaggattgtttgacattgtttgctggcgacccaggcctgggcccagaagaactccgagctgctatggggaaggccaagcagctctggggaccacctcgtggcttcaggccagaacaaatcttacagttaggaagactattgattggcctgggcgatcgcgaacttcaggaactcattctggttgactggggggtgctgagtacacttggacagatagatggatggtccacaacacagcttaggattgtggtttccagcttcttgcgacagtcaggccggcacgtatcccacctcgattttgtccacctgactgcccttgggtacaccctgtgtggccttcggcccgaggagctgcagcacattagttcctgggaattcagccaggcggcactattcctgggcactcttcacctgcagtgcagcgaggagcagttagaagtgctcgcccacttgcttgtcctgcctggtgggtttgggccaatcagcaactgggggccagagatcttcactgagattggcaccatcgctgccgggatcccagatctcgctctctcagctctcctcaggggccagatccagggggttacaccgctggctatctctgttataccccctccaaagttcgccgtggtcttctcccctatccagttatcctcattaacatccgctcaggccgtcgcggtcaccccagagcaaatggcttttctatctccagagcagaggcgcgccgtggcttgggcccaacacgaaggcaaagagtcacctgaacagcagggcaggtccacagcctggggcctacaggattggtccaggccctcatggtctttggtcctgacaatttctttcttgggccacctgctgtag

SEQ ID NO: 207162 - DNA, 1056 bp, Artificial Sequence
  Description of Artificial Sequence: Synthetic coding sequence
atggccctgagcctgtggcccctgctgctgctgctgctgctgctgttgctgctctctttcgccgtgacacttgctcccacgggaccccattccctcgacccagggttatctttcctgaagtctctcctgtccacactggatcaggccccgcagggatccctatcgcgatcgcgcttcttcactttcctggccaacatctctagtagctttgaacctgggaggatgggtgagggacccgtgggtgaaccccccccgcttcagccccccgctctgagactgcacgacttcttggtgacgttacgcggctctccggactgggaaccaatgctgggtctgttgggagacatgctcgcccttctgggccaagagcagaccccacgggatttcctggttcatcaggcaggagtcctaggaggattggtggaggtcctgcttggcgcgctggttccaggtgggccacctacgcctacccagccaccgtgtacccgggacggaccttccgattgtgtgctcgccgccgattggcttccatcgctgcttcttctcctggaagggaccaggtggcaggcgctggtgcaagtacagccaagcgtggatcccaccaatgcaaccggccttgatggtcgcgaggctgcccctcacttcctgcaggggctgctgggcctgctaaccccaaccggcgagctgggctcaaaagaggctctgtggggaggactgttgcgcactgtaggggcacccctgtatgctgcctttcaggaggggctgctcagggtcacacactccttgcaggacgaggtattcagcattctagggcagcccgagcccgacactaatggccaatgccaaggagggaacctacagcagctgttactatggggcgtgcgccataatctatcatgggacgtacaggcccttggcttcttatcggggagtcctccaccccctccagcactgctgcattgcctgagtacaggcgtacccttgccccgtgccagccagccctcagcacacatttccccgcggcagagaagggcaataactgttgaggcgctgtag

SEQ ID NO: 207163 - DNA, 5328 bp, Artificial Sequence
  Description of Artificial Sequence: Synthetic coding sequence
atggccctgagcctgtggcccctgctgctgctgctgctgctgctgctgctgctgtcctttgccgtgactctggcccccaccgggccacactctctggatcccgggctaagttttctgaagagtctcctgagcacacttgaccaggctccacaggggtctctgtcccggagccggttttttacatttctggccaacatctctagctcattcgagccagggcggatgggtgaaggacctgttggagagccgcctcccctgcagcctcctgcgctgcggctgcatgacttcctggtgaccctccgcggctcaccagattgggagcccatgctgggacttctgggcgacatgctggctctcctgggccaggagcagacccctagagactttctggtgcatcaagctggcgtgttgggggggttggtggaagtgctcttaggtgctttggttcccggcgggccgccaacaccgactcggcctccctgtacacgagatggacctagcgactgcgtgctggcagctgactggctacccagcctgctgctgctgctcgagggaacaaggtggcaggcgctcgttcaagtgcagccgtctgtggatcccaccaacgccactggactggatggcagggaggcagctccccactttctccaaggcctcttaggattgctaacaccaaccggtgagctgggctctaaggaggctctgtggggcgggctgctgcgcactgtcggtgcacctctttatgcagcttttcaggagggactcttgcgcgtcacacactcgctccaggatgaggtctttagtattttgggtcagcctgagccagacaccaacggtcaatgtcaagggggaaatctccagcagctgctgctttggggagttaggcacaacctcagctgggatgtccaggctcttggattcctgagcgggtcaccccctcctcccccggctttgttgcattgcctgagtaccggggtgcctcttccccgcgcttcccagccatcagcacatatttctccccgccagcggagagccatcacagttgaggccctgtgtgaaaaccatttggggcccgcgccaccatactcaatttccaacttcagcattcacctgctatgtcagcacactaagccggctaccccgcaaccgcacccctcaaccaccgccatttgccaaacggctgtgtggtatgccgtcagctgggcacccggagcacagggctggttgcaagcctgtcacgaccaatttcccgacgagtttctggacgccatctgctctaacttgagtttcagtgccctatccggcagtaatcgccggctggtgaaaagattatgcgctggtcttctcccaccacctacatcatgtcctgagggtctgccaccggtcccactcactccagacatcttttggggctgtttccttgagaacgaaacgctgtgggctgagcgcctatgtggcgaggccagcttgcaggctgtgccacccagtaatcaggcatgggtgcaacacgtttgccagggcccgacaccagatgtgacggcaagtcccccatgccatatcggaccgtgtggcgaaaggtgtcctgacggcgggagtttcttggtcatggtttgtgctaatgataccatgtacgaagtgctcgtccccttttggccctggcttgccggtcagtgccgaatatcccgaggcgggaatgacacttgtttcctcgagggccttctcgggcccctgcttccatccctccctccgctgggaccctctcccctatgcctgactccaggtcctttcctcctggggatgttgtcccagctacctaggtgccagagctccgttccagcgctggctcatcccacgagacttcactatctgcttaggttactaactttcctgctcggccctggcgcaggcggcgccgaagcccagggtatgctgggcagagcactcttgctctcttctctcccagataattgctctttttgggacgccttccgccctgagggccgtcggagcgtactcaggaccatcggagagtacctcgagcaggatgaagaacaaccaacaccatcaggatttgagcctactgtgaacccatccagcggtatcagcaaaatggagctcctggcttgtttctcacccgtgctctgggatttgctccagcgggagaagagcgtctgggctctgcagattctagtccaggcttacctgcacatgcctcccgagaatcttcagcagttggtgttatccgctgagcgagaagcagcacaaggcttcctcaccctcatgctccaaggcaaactgcagggcaagctgcaggttccccccagcgaggagcaggctctggggcgtctcacagcattattactgcagagatacccccgcctaaccagccagctctttatcgatctaagtcctctgatacccttcctcgccgtctctgatttgatgcgatttcctccctccctcttggccaatgattcggtgctagccgccatacgtgattattcccccggaatgaggcctgaacagaaggaggctctcgctaaaaggttacttgcaccggaattgttcggggaggttccagcctggccacaagaattattgtgggccgtgttgcccctcctcccacaccttccacttgaaaacttcctacaactcagtccccatcaaatacaggcgctcgaggacagctggcccgctgccggactgggtccaggtcatgcgcggcatgttttacggtcactggtgaatcagagcgtgcaggacggcgaggagcaagtgagaaggctggggccacttgcctgtttcctgagcccggaggaacttcaatccctagtcccactctcagaccccacgggcccggtggaacgcggcctgctggagtgcgctgctaatgggaccctgtcacccgagggccgcgttgcttatgagctgctgggcgtactgcgcagtagcggcggagctgtactgtctccacgcgagctacgggtttgggccccgctgttttctcagctcgggctccgctttctgcaggaactgagcgagccccagctgagagccatgctgccagttctccaggggacctccgtcactccggcccaggcggttctgctcctcggcagactgctaccccgccatgacctgtctctagaggaattgtgtagtctgcatcttttgctgcctgggctttctccacagacgctgcaggctatccccagacgcgtcctggtgggtgcctgttcctgcctggcaccggagttgtccaggctgtcagcctgtcagactgcagccctcctgcagacctttagagtaaaagatggcgtgaagaacatggggactactggtgccggtccagccgtctgtatcccggggcagcctattccgaccacttggcctgactgtttactgccgttgctcccgctgaaactgcttcagcttgactctctcgctttgctggctaatagacgccgctattgggaactgccttggtcagagcaacaggcacaatttttgtggaagaaaatgcaggtgcccacaaacttgactctgcggaatctgcaagccctcggtactttggccgggggcatgtcatgtgaattcctgcagcaaataaactccatggttgattttctggaggtcgtacatatgatatatcagctccctacccgggtgcgcgggtcgctgcgagcttgcatttgggccgagcttcagcgtcggatggctatgcctgaacccgaatggacaaccgttggtcctgaactcaacggccttgactccaagctgctgttggatttgcctatccagctaatggatcgactttccaacgaaagcatcatgctcgtcgtcgagttggtgcagagagctccagagcagctcctcgccctgacgccactgcaccaagcagcactggctgagcgagctttgcagaacctggctcccaaagaaacccccgtcagtggcgaggtgctcgagacacttggacccctcgtgggattccttgggaccgaaagtacaagacagatccctctgcagattctcctttcgcacctgagccagctgcaagggttctgcctcggggaaacctttgctaccgaactggggtggctgcttcttcaggagtctgtgctcggaaagcccgagttgtggtctcaggacgaggtggagcaggcaggaagactggttttcacacttagcacagaagccatttctctgattcctagggaggccctaggccctgagactctggagcgtctgctggagaaacagcagtcttgggagcaaagccgggttggacagctctgccgtgagcctcagctggcggctaagaaggctgcactggttgcgggcgtcgtacggcccgccgctgaagacctacccgagccggtgccgaactgcgcggacgtccgtggcacattccctgcggcgtggtccgcaacacagatagccgaaatggagctatcggacttcgaggactgcctgactctgtttgccggcgacccagggcttggacctgaagaacttcgggcagccatggggaaggccaagcagctctgggggcccccgcgcgggtttcgaccagagcaaattctccagctgggcaggctgctcataggactgggtgaccgtgagcttcaggagttgattctggttgactggggcgtcctttctacgctgggtcagatcgacgggtggagcaccacgcaacttcgtattgtcgtctcttccttcttgagacagtctggccgccacgtatcacacctggatttcgtacacctcacagcactcggctacaccttgtgtggactcaggcccgaagaactgcagcacatctcctcctgggagttcagtcaggcagctttgtttctgggcacactgcatctgcaatgttcagaagagcagcttgaagtgcttgcccatctccttgtgctccctggaggattcggcccaatatcaaactggggccctgaaattttcacagagatcggaactatagccgcaggtatcccagatctcgcgttgtccgcgttgctgagggggcagatccaaggcgttaccccactggccattagcgtgattcctccacccaaattcgcagtagtgttctcaccaattcagctcagttcccttaccagcgcccaggctgtggccgtaactccagaacagatggcattcctgagtcctgaacagcgccgcgcagtcgcctgggctcaacatgaggggaaggagagccctgaacagcagggaagatccacagcctggggcctccaagactggagtcggccctcatggtctttggtcctgacaatcagtttcctcgggcacctgttgtag

SEQ ID NO: 207164 - DNA, 1056 bp, Artificial Sequence
  Description of Artificial Sequence: Synthetic coding sequence
atggccctgagcctgtggcccctgctgctgctgctgctgctgctgctgcttctcagctttgcagtgacattggctccaactggcccacactctcttgatcccggcctgagtttcctcaaatccctgctctccactcttgaccaggcaccccagggctccttgtctcggtctaggttctttacttttttagccaacatatcatcttccttcgaaccaggaagaatgggcgaaggcccagtgggagagcctccacccttgcaaccacctgctcttcgtctgcacgacttcctcgtgacactacgtggtagccctgattgggagcctatgctgggactacttggcgacatgttagcccttctggggcaggaacaaacgccccgagacttcctcgtacatcaagcaggcgtactggggggattggtggaagtgctactgggagccctagtccccggcggcccacccacccccacccgaccaccatgtacgagggatggcccatcagattgcgtgctggccgcagactggctgcctagtctgctgctgctgctggagggaactaggtggcaagccttggttcaggtacaaccgagcgtcgatccaaccaacgcaacaggccttgatggaagggaggctgcaccacacttccttcagggactgctgggcctattaacacccactggagaactcgggagtaaggaggctctctgggggggccttctgcgcacagtaggtgctcctctttacgctgcctttcaggaaggcctcttaagggtcacccactcgctgcaggatgaagtgtttagtattctcgggcagcctgaaccagacactaatggccagtgccagggaggcaacttgcaacagcttctcctgtggggtgtccggcataacctgagttgggacgtacaggccctggggtttttgtctgggtccccaccccctccacccgcgctgttgcactgtctgtctaccggcgtgcccctgcctagggcaagtcagcccagcgcccacatttccccaaggcagcggcgggccataaccgtcgaagctctgtag

SEQ ID NO: 207165 - DNA, 2100 bp, Artificial Sequence
  Description of Artificial Sequence: Synthetic coding sequence
atggccctgagcctgtggcccctgctgctgctgctgctgctgctgcttttattaagtttcgctgtcactctggcccctacagggccacattccctcgatcctgggctctcattcctgaagagtcttctgagcacattggaccaggctccccaggggagcttaagcagatcaagatttttcaccttcttagccaacatctctagcagctttgagcctggcaggatgggggaggggcccgtgggtgagcctccgccattacagcctccggccctcaggttacatgatttcctggtaactctaagaggctcaccagactgggagcccatgttgggactgttgggggatatgctggccttgctaggacaggagcagaccccgcgtgactttttagtgcaccaggccggcgtgctgggcggactggtggaagtgctgctgggggccttggtcccaggcggtccgcctactcccacccaacctccttgtacgcgcgacggcccatcggactgcgtacttgccgccgattggctgcccagtctgctgctgcttctagaagggacaaggtggcaagcacttgtccaagtgcaaccatctgtggatcccacgaacgctaccgggttggatgggagagaagctgccccacactttctgcagggactgctgggtttactcaccccgactggggaactcgggtccaaggaggcactgtggggcgggctgctccgcaccgtaggcgctcctctgtatgcagcatttcaagaagggctgctaagggtgacccattctctgcaggatgaggttttttccatactaggtcaacccgaacccgataccaatgggcagtgccagggagggaacctgcaacagctgctgctgtggggcgttcggcataatctctcctgggatgtacaggcccttgggttcctgtccggtagcccaccaccaccacccgcactcctacattgcttgtccacaggagtccctctcccacgcgctagtcagccaagcgcgcacatttcccctcggcagcgtcgggcgattacagtggaggcgctctgtgagaatcatctcgggcccgcgccgccttacagcattagtaatttctctatccatctactctgtcaacacactaagcctgccacaccccagccccacccctcgactaccgccatttgtcagaccgctgtttggtatgccgtgtcctgggcgccgggtgcccagggttggttgcaggcatgccatgaccagttcccagacgaattcctagacgccatctgtagtaacctctcattttccgccctcagtggaagtaacagacggctggtcaagaggctttgcgcaggtctgctgcccccgccaacctcctgcccggaaggcctgcctccagtgccactcactccagacatcttctggggatgcttcctggaaaatgaaacgttatgggctgagcgactctgcggcgaggcgtctctgcaggctgtccctccttctaaccaggcgtgggtacagcatgtctgccagggaccaactcctgacgtgacagcttctccgccttgtcatattggaccctgcggcgaacgttgccccgacggcggctcctttctcgtgatggtctgcgctaatgacacaatgtacgaggttctcgtacctttttggccctggttggccggccagtgtaggatttcgagaggaggcaacgatacctgcttcttggaaggcctgctggggcccctcctgccgagcctcccacctttgggacccagtccactttgcctaaccccagggccctttttactcggcatgctgagtcagttgccaaggtgccaatcctcagtcccagccctggcccatccaacaaggctccactacctgcttcgactgctgactttcttactgggaccaggagccggtggggcggaagcacagggcatgctgggccgggcccttctcctcagcagcctacctgacaactgctccttttgggatgcattcaggccagagggaagacgcagtgtcctcagaacaattggggagtacaataagatgcggagctcgcagcctcaccaggctttaaatccactcagcacccctgcactcgtatag

SEQ ID NO: 207166 - DNA, 3009 bp, Artificial Sequence
  Description of Artificial Sequence: Synthetic coding sequence
atggagctgctggcctgcttcagccccgtgctgtgggacctgctgcagagagagaagtctgtgtgggcgctccagatattagtgcaggcctatctccatatgcccccagagaacctccaacagctggtgttgtcagcggagagggaggccgcacagggatttctaacgctgatgctccaaggcaaactgcagggaaaattgcaggtcccaccgtctgaggaacaggccttaggcaggcttacagccctgctgcttcagagataccctcggctcaccagccagctgtttattgatttaagtcctttgattcctttcttagcagttagcgacctgatgcggttcccaccttccctcctggcgaatgatagtgtccagcaaggctaccgcgggtctgaagaaaacagtctggaagaggacaaaggactgcgtccaatgaccccacggtctctggccgctattcgcgactactcccctggtatgcggccggagcaaaaggaggctctggccaaacgccttctggcgcccgaactattcggcgaggtgcctgcatggccacaggagctgctttgggccgtcttaccccttctgccgcatctccctctggaaaactttctgcagctcagtccccatcagattcaggctcttgaagatagctggcccgctgctgggctgggcccgggacacgctcgtcacgtgcttcgaagtttggtgaatcagagcgtccaggatggagaagaacaagtcagaaggctaggtcctctagcctgcttcctgtcccctgaagaactgcagtctctggtccctttgtctgaccctaccggtcctgtggagagagggctcctggagtgtgccgccaacggcaccctctcccccgaggggcgtgtggcctacgagctcctaggggtgctgcgaagttctggtggtgccgttctgagccctagggaacttagggtctgggcgcctctgttctcccagctgggccttcgattcctgcaggagctttcagagcctcaactgcgcgccatgctgccggttctgcagggcactagtgtgacgcccgctcaggcggtgcttctcttaggaagacttctgccacgccacgatttgcttcagctggactcacttgctctattggccaatcggaggcgctattgggagctcccttggagcgagcagcaagctcagtttctgtggaagaagatgcaagtcccgacgaacctgacccttaggaatctacaggccctgggtacgctggccggcggaatgagttgcgagttcctgcagcagatcaattcgatggtggatttcctcgaggttgtgcacatgatttatcagcttcccactcgagtacgcgggtcactgcgagcctgtatatgggctgaactgcagcgccgcatggctatgccggaaccagagtggaccacagttggacctgaactgaacggcttggacagcaaactgcttttagacctacctatccaattaatggacaggttgtcaaatgagagcattatgctggtagtggagctagtgcaacgagcccccgagcagctactagcgttgacccctttacaccaggctgccctggctgagagggcacttcagaatctggcaccaaaagaaacaccagtgagcggggaagtattagagacccttggtcctctggtgggattcctcggcacggaatctacgagacagatcccactgcagatactcctgagccatctatcacaactccagggattctgcctgggcgagacatttgcaacggagctgggatggctcttgctgcaggaaagtgtattagggaagcctgagttgtggtctcaggatgaagttgaacaggctggccgtttagtgtttactctctctaccgaagcgattagcctcatccccagggaggccttaggtcctgagacgctggagcggctgctggagaagcaacagtcgtgggaacagtcacgcgtgggacaactgtgccgggagccccagctcgctgcaaagaaggcagctcttgtcgctggcgtggtgagaccagccgccgaggatctacccgagcccgtgcccaactgcgctgatgtgcgcggcactttccccgcagcatggtcagcgacgcaaatagctgagatggagctttctgatttcgaggactgcctcactttgtttgccggagacccaggactcggacccgaggaactcagagctgccatgggcaaggccaaacagttgtgggggccgcctcgtggttttcgcccagagcagatcctgcagctgggacggctcctgatagggctcggcgatcgcgagcttcaagagctgatcctggtcgactggggtgtgctcagtacattgggtcaaattgacggttggagtacaacacagctcaggattgtggtgagcagctttctgaggcaaagcggccgccacgtctcacacctggacttcgttcatctgaccgccttagggtataccctctgcggactgaggccagaggaattgcagcacatttccagctgggaatttagccaggctgctctcttcctcggtacactccatcttcagtgctcagaggaacagctcgaggtgttggcccatctgctcgtgctgccgggagggtttggcccaatatccaactgggggcctgaaatttttactgagatcggtacaattgccgccggtattcccgacctggctctctcagccctgctgcgtggacagattcagggggttacccccctggccatcagcgtaatcccgccccctaagttcgcagtcgtcttttcccccattcagctgtcgtcactgacatcggcccaagcagtggccgtgacccctgaacagatggccttcctcagtcctgagcagcgccgggccgttgcctgggcccagcacgaggggaaagagagccccgagcagcaagggcgcagtaccgcatggggcctccaggattggtcccgcccaagttggtcacttgtgcttacaatcagcttcctcggtcacctattatag

SEQ ID NO: 207167 - DNA, 1890 bp, Artificial Sequence
  Description of Artificial Sequence: Synthetic coding sequence
atgttccgggaccaggtgggcgtgctggccggctggttcaagggctggaacgagtgcgaacagacagtcgctcttctctccttgctcaaacgcgtgtctcaaacacaagcacgctttttgcagctctgtttggagcactcgctggccgattgtgctgagcttcatgtgctcgagagagaggccaattcccccggcattatcaaccaatggcaacaggagtcgaaagacaaggtgatatccctgctcctaacccaccttccattgctgaagccaggaaacctcgacgctaaagtggagtacatgaagttattacccaaaatcttggcccattccattgaacataatcagcatatagaggagtcaagacagctgcttagttatgcattgatccatcccgccacttccctggaagacaggtccgccctggctatgtggttaaaccatttagaggataggacatcgacgagctttggaggtcaaaaccgggggagaagcgacagcgtagactacggacagacacattattatcaccagagacagaattcagacgataagctgaatgggtggcagaactcacgggattcaggtatttgtatcaatgccagcaattggcaggacaaatctatgggatgtgaaaatggtcacgtgcctctgtactcgtcctcttcggtccccaccactatcaacactattggaacttcaacgtccacgaatgtgcccgcctggctcaaatcactcagactccacaaatatgccgctctttttagtcaaatgacctacgaagaaatgatggctcttacagaatgccagttagaggcccaaaatgtgacaaagggcgctcgtcataagatcgtcatctctatccagaaactaaaggaacggcagaatcttctcaagtcactggagcgcgatataatcgagggtggctccttacgtatccctctccaggaactgcatcagatgattctgacgccgattaaagcctatagcagtccatccaccaccccagaggccaggcggcgagagccgcaggctccccgccaaccctccctgatgggcccagaatctcagagccctgactgcaaagatggagccgctgcaaccggggccacggcaactcctagcgcaggagcaagtggcgggctgcagcctcaccaattatcatcatgcgacggcgagcttgcagttgcacctcttcccgagggagatctccccggccagttcacacgggttatgggcaaggtgtgtacccagcttcttgtgtcccgaccagacgaggagaatattagctcctatctacagctgatcgacaaatgtcttattcacgaagccttcacggagactcagaaaaagcgtctgctttcgtggaagcagcaggtccagaaattattccgatcatttcctaggaagacactgcttgacatctccggctacagacaacagagaaaccgaggcttcggccagtcaaattccctacctacggcaggttcagtgggaggcgggatggggcgacgaaaccccagacaataccagataccaagtcgtaatgtcccctcagcacggctggggctgctcggaacatctggattcgtaagctcaaaccaaagaaacactactgccacgcctacaataatgaaacagggacgtcagaatctgtggtttgctaatcccggcgggtctaactccatgccatcaagaacgcacagctcagtgcaacgtacaaggagtctgccagtgcacacatccccccaaaatatgctaatgtttcagcagccagagtttcagctgccggtgactgagcccgatatcaataatcgattggaatcactttgtttgtcgatgactgaacacgccttaggcgacggagtcgatcgtacctccactatttag

SEQ ID NO: 207168 - DNA, 1893 bp, Artificial Sequence
  Description of Artificial Sequence: Synthetic coding sequence
atgatgttccgggaccaggtgggcgtgctggccggctggttcaagggttggaacgaatgtgagcagactgtagcattactgtccctgttgaagagggtatcccaaacccaggcccgatttctgcaactttgtctggaacactccctggccgattgtgctgaactgcatgttctggaacgagaggctaatagtccagggattatcaaccagtggcaacaggaaagtaaagacaaggttattagtctgttgctgacccacctgcctctgctgaagccaggtaatctggatgccaaggtcgaatatatgaagcttctgcctaaaattctcgcccatagcatagaacacaatcaacacatcgaggaaagccgacagcttttatcctatgctctgattcaccccgccaccagcctagaggaccgctctgctctggcaatgtggctgaatcacttggaggatcgtacttctacctcttttggaggacagaaccgcggcaggagtgacagtgtcgactatggtcagactcactactaccaccagaggcaaaactccgatgacaaactcaacggctggcagaatagccgtgactctggcatatgcataaatgcatccaattggcaggataagtccatgggctgcgaaaacggacacgtgcctctgtactcctcttcatctgtcccaaccaccattaacaccataggaacctcaacttccactaacgtccccgcgtggctgaagtctttacggcttcataaatacgcagccctgttttcgcagatgacctacgaggagatgatggctctaacagaatgccaactggaggcccagaatgtgacaaaaggtgccagacataaaatcgtaatttcaattcagaagctcaaggagaggcaaaacctgctcaagagtttagagagggacataattgaaggtggtagcttgcggattcctctgcaggagctgcaccagatgatccttactccaataaaggcttactcctcaccatccacaacgccggaggccaggagacgggagcctcaggcacctaggcaacctagcctgatgggaccagagtctcaatcccctgattgcaaggatggagcggcggccacaggcgcaactgctacaccaagtgccggtgcctccggtggccttcaacctcatcagctcagttcctgtgatggggaattagcagtggcccccttgccggagggggacttgccgggtcagttcaccagagtgatgggaaaggtgtgcacacaactcctcgtgagcaggccggatgaggagaacatatcatcatacctgcaactgatagataagtgtctcattcacgaagcctttaccgaaactcagaaaaaacggctgctgtcctggaagcaacaggtacagaagctgtttcggagttttccacggaaaaccttgctggatattagcgggtataggcaacagcgcaataggggattcggtcagtctaattctctacccacagcaggatcagtcgggggaggcatgggccgacgaaatcctcgacagtaccaaattccctctcgaaatgtccctagcgctaggctcggactgctcgggacatccggatttgtctcaagcaaccagcgaaacaccaccgccacgccaactatcatgaaacaggggagacagaatctttggtttgcaaacccagggggcagtaactccatgccgagccgcacacacagttccgtacagagaactcgatctcttcctgtacataccagcccacaaaacatgcttatgtttcaacaaccggagtttcagctgcctgtaacagagcccgacatcaataaccgcctcgagagcctgtgtttgagtatgaccgagcacgccctgggtgacggtgtcgatagaacttctaccatttag

SEQ ID NO: 207169 - DNA, 2154 bp, Artificial Sequence
  Description of Artificial Sequence: Synthetic coding sequence
atgttccgggaccaggtgggcgtgctggccggctggttcaagggctggaacgagtgtgaacagaccgtcgccctgctgagcctgctcaaaagagtgagccagacacaagctaggttcctgcagttatgtcttgagcacagtctagctgattgtgccgagctccatgtgctggagcgtgaagcaaattcgcccgggattattaaccagtggcagcaagagagcaaggacaaagtgattagcctgctgttaacacatctgcctttgctcaagcccggcaacctggacgcaaaagtggaatatatgaaacttttacctaagatcttggcgcactctatcgagcacaaccaacacatagaagagtccaggcagctgctaagttacgcattgatccaccccgccactagtttagaagaccgatctgctctggcgatgtggttaaatcatctagaggatcgaacatcgacttcatttggaggccagaacagaggcaggagtgactccgtggattatggtcaaacacattactatcaccaacggcagaactctgacgacaagttgaacggttggcagaacagccgagacagcgggatctgcatcaacgcttctaattggcaggacaagagtatgggctgtgagaatggtcatgttccactgtacagttcttcgtctgtgccaaccaccattaacactattggcaccagcacgagcactatcctcagtgggcaggctcatcactctccactgaagagatctgttagcctcaccccaccgatgaacgttccaaaccagcctctcgggcatgggtggatgtcacatgaggatttgcgggctcgtgggcctcagtgcctgcccagcgaccacgctccgctgagcccccagagctctgtggccagctcagggtctgggggcagcgagcatctggaagaccagacaaccgctagaaatactttccaggaggagggaagcggaatgaaggacgtgccggcatggctgaaaagcttaaggctgcacaaatacgcagctttattttcccagatgacctatgaggagatgatggctctgactgagtgtcagcttgaagcccagaacgttacgaagggcgcgcgccataaaattgtcatcagtatacaaaagctgaaagagcggcaaaacctattgaagtccttggagagggacatcatcgaaggcggctctttgagaattccactgcaggaactccaccagatgatattgacgcccattaaagcctattcctccccatccactacccccgaggcacgcaggcgggaaccacaggctccccgacagccaagcctcatggggcctgaaagtcaaagccccgactgcaaagacggggctgccgctacaggggcaactgccaccccgtccgccggggcctctggaggcctgcagccacatcaattatccagctgcgatggcgagctggctgtcgcacctctccctgagggagacctgccaggacagttcacacgagtcatgggaaaggtatgcactcagttactggtgagccgccctgatgaagagaatattagcagttaccttcagctgattgataaatgcttaatccacgaagcctttacagagactcagaaaaaacgcttactctcatggaaacagcaggtgcaaaaactattcagatcattcccacggaaaacactgcttgatatttctggctaccgccaacagcggaaccgggggtttgggcagtccaattcattgcctacggccggtagtgtcggcggtgggatgggccgtcggaatcctcggcagtaccaaatcccgagtcgaaatgtgcccagtgcacgcctcggtttgcttggtacttccggcttcgtttcctctaaccagcgtaacaccacagctactcccaccatcatgaagcagggtaggcagaacctgtggtttgccaaccctggagggtcgaattctatgccttctagaacccacagctctgttcagcgtacacgtagcctgcccgtacacactagtccccagaacatgttgatgtttcaacaacccgaattccagctgcccgtgaccgagcccgatattaacaacagacttgaaagcctttgtctgtccatgactgagcatgctcttggagatggggtggataggacctccaccatctag

SEQ ID NO: 207170 - DNA, 2157 bp, Artificial Sequence
  Description of Artificial Sequence: Synthetic coding sequence
atgatgttccgggaccaggtgggcgtgctggccggctggttcaaggggtggaatgaatgtgagcagaccgtggccctgctttcattgctcaaacgcgtgtcacagacacaggcacgcttcttgcagttgtgcctggaacactctttggccgactgtgcagaactgcatgtgctcgaaagggaggctaactcccctgggataattaatcagtggcagcaagaatctaaggacaaggtgatctccttgcttctgacccatctcccactgttgaagcccggtaatctcgatgctaaagtagaatatatgaaactcttaccaaaaatccttgctcacagcatcgagcataatcaacacatcgaagagagtaggcagctactatcctacgcacttatccaccctgccacaagtctggaagaccggtctgccctcgctatgtggctcaatcatctggaagacaggacttcgactagcttcgggggccagaacaggggccgctcggactctgtcgattatggacagacccattattaccaccagcggcagaactctgacgacaagctgaacggttggcagaacagcagagattcaggcatctgcatcaatgcctctaactggcaggacaagagtatgggatgcgagaacggacacgttccattatatagctctagttcagtgccgactaccataaacacaattgggaccagtacgtctacaatcctctccggacaggcccaccattccccgcttaaacgctccgtgtcgctcaccccccctatgaatgtccctaatcagccgctgggccacggctggatgagccatgaagacctgagagccaggggcccacagtgtctccctagcgaccatgccccactgtccccccagtcttccgtggcttcgtccggctccgggggcagcgagcatctcgaggaccagaccacagcccgcaatacttttcaagaggaggggtccggcatgaaagacgtaccagcctggcttaagtctttgagactgcataaatatgccgccctcttctcgcaaatgacttatgaggaaatgatggccttgacggagtgtcagctggaagctcaaaacgtgacaaaaggggcgcgccataaaatcgtgattagtattcagaaactcaaagaaaggcagaacttgctgaaatcccttgaacgagatatcatcgagggaggtagtctgagaatcccattgcaggaactccatcagatgatcttaaccccaatcaaggcgtacagttctccatcaactactccggaagcccggcgaagagagcctcaggctccgaggcagccttcactgatggggccggagagtcaatccccggactgcaaggacggcgccgctgctactggtgccacagctacaccaagtgccggcgcatcaggcggcctgcagccgcatcagttatcatcctgtgatggggagcttgccgtcgctccccttcctgagggcgacctgcccggacagtttacccgcgtgatgggtaaagtctgcacccagctactggtgtccagaccagatgaagagaatatctcctcttacctccagctcattgacaagtgtctgatccacgaggctttcacagagacacagaagaagcgtctgctgtcttggaaacagcaggtgcaaaaactcttcagatccttccccagaaagaccctgcttgatattagcggctaccgccaacagcgcaaccgcggttttggacagagcaacagtctaccaacagctgggtcagttgggggaggcatgggaagaaggaacccaaggcagtaccagattccatccagaaatgtgcccagcgcccgtcttgggctcttaggaaccagcggtttcgtaagctctaatcagcggaacactacagccactcctacaatcatgaagcaaggaaggcagaatctatggtttgccaatcctggaggttctaactctatgcctagtagaacccacagcagtgtgcagcgtaccaggagcctcccggttcacacgtcaccacagaacatgcttatgttccagcaacctgaatttcaactcccagtgaccgaaccagatataaacaaccgcctggaatctctctgcctgtctatgaccgaacacgcgctaggagatggggtggatcggacttctacaatctag

SEQ ID NO: 207171 - DNA, 2157 bp, Artificial Sequence
  Description of Artificial Sequence: Synthetic coding sequence
atgatgttccgggaccaggtgggcgtgctggccggctggttcaagggttggaacgagtgtgagcagaccgtggcattgctatctctcctgaaaagagtctctcagacccaggccaggttcctacaactttgtctcgaacacagtctggctgactgtgccgaactgcacgtactagagagagaagctaattcccccgggattataaaccaatggcaacaagaaagcaaagacaaagtgatcagcctgttgctcacccatttacctttattgaaaccagggaatctcgatgctaaggtggaatacatgaagttactgcctaaaatactcgcacattctattgaacacaaccagcacattgaagaatcacggcagcttctgagctatgccctaatccaccctgctacgagtctggaggatcgctccgcactcgctatgtggctgaaccatctcgaggacagaacttcaaccagttttggcggccagaaccgggggcgtagcgactcagtagattacggccagacgcattattatcaccagcgccagaatagcgatgataaactcaacggatggcaaaactctagggactcaggaatatgtatcaacgccagtaattggcaggacaagagcatggggtgtgaaaacggccacgtgccactgtattcgtcctcatctgtgcccacaaccattaatacaatcgggacttccacgagtaccatactgtccggccaggcacatcattcacccctgaagcggtccgttagccttacccctcccatgaacgtgccaaaccagcccctgggacatggatggatgagccacgaagacttgagggctagaggacctcagtgtctgcctagcgaccacgctccgctttcaccacagagctctgtggcatcttccggttctggggggtctgagcacttagaggaccagacaacggccaggaataccttccaggaggaggggtcaggtatgaaagatgtcccagcatggctgaaatcactgaggctgcataagtatgcagccttgttctcacagatgacttacgaggagatgatggctctcaccgagtgccagctggaagcccagaatgttaccaagggcgcccgccacaagatagtgatcagtattcaaaagctgaaggagagacaaaatctgctgaaatcgctagaacgagacattatcgagggaggtagcctaagaatcccgttgcaggagctgcatcaaatgatacttactcccatcaaagcatactcctccccttctacaaccccggaagcaagacggcgggaacctcaggctcctaggcagcccagcttaatgggaccagaaagtcagagcccagactgcaaagatggggccgctgctacgggtgctacagcaacaccttcagctggtgcctcaggtggcctccagccccatcagctgagctcctgcgatggagagcttgctgtggccccactgccagaaggcgatctccccggccaatttacacgagtaatgggtaaggtatgtacgcagctgctagtgtcccggccggacgaggagaacatctcatcctacctccagttaatagataagtgccttatccatgaagctttcaccgaaacacagaagaagcgcctccttagttggaaacagcaggtacaaaagttatttcgttcctttcctagaaagacacttctggatatcagtggatacaggcagcagaggaatcggggtttcggccaatcaaattccttacctactgctggaagtgtggggggaggaatgggcaggcggaacccacggcaataccagattcctagcaggaatgtgccgtcggctaggctgggactgctggggactagcgggttcgtgtctagcaaccaaagaaatacaacggctacccctacaattatgaagcagggcagacagaacctatggtttgctaaccctggcggaagtaacagcatgccctccaggacccattcgagtgtgcagcgcactcggagcctccccgtgcacactagcccccaaaatatgctgatgttccagcagccggaattccagctccccgtgacagagccagacattaataatcgcctggagagcctctgtttgagcatgactgagcatgcattgggggacggagtcgatagaacgtcaacgatatag

SEQ ID NO: 207172 - DNA, 1038 bp, Artificial Sequence
  Description of Artificial Sequence: Synthetic coding sequence
atgatcctgacccccatcaaggcctacagcagccccagcaccacccccgaggccagacggcgggagcctcaagccccccgccagccatcactgatgggccccgagtcccagagtcctgattgcaaggatggtgcggcagccacaggcgcgaccgcaaccccgtcagctggagcttctggtggtctgcagccccaccagctgtccagctgtgatggggagttagcagtggcccctctgccagaaggcgatctgcctggtcaatttaccagagtgatgggaaaagtgtgtacccagctgcttgttagtagacctgacgaggagaacatctcaagctatctccagctcatagataaatgcctcatccatgaagctttcaccgaaactcagaagaaacggctgctgagttggaaacagcaagtacaaaagctcttcagatctttcccacggaagacactcctggatatcagcggatatcgtcagcagcgcaatcggggattcgggcagtctaactctctgcccaccgccggctctgtagggggcggtatgggcagaagaaacccccgtcagtatcagattccgtctcgcaatgtcccaagtgcacgtctggggttgttgggcacctccgggtttgtctcgagcaaccagcggaacaccaccgctacccctacaatcatgaagcagggccggcagaatctgtggttcgctaaccccggcggttctaactcaatgccctcaaggacccactctagcgtgcaacgcactcggtctctgcctgtccatacaagcccccagaacatgctgatgttccagcaacccggatcacaggtgcactctggactgtgtctgaccgatctccgcggctggctcagcctgtcaggtgcccccagcatgcctgccttgacagtgccgaagagttcacaaggggagtttcaactgccagtaaccgaacccgatattaataaccgcttagagagcctgtgcttaagtatgacagaacatgctctgggagacggggtggataggactagtaccatatag

SEQ ID NO: 207173 - DNA, 981 bp, Artificial Sequence
  Description of Artificial Sequence: Synthetic coding sequence
atggccggccccaaccagctgtgcatccggcggtggaccaccaagcacgtcgccgtttggctcaaggatgaaggcttcttcgaatacgttgatatcctgtgcaataaacatagactagacggcatcacattgttaacactgaccgaatacgacttgcgttccccacccctggaaattaaagtcctgggtgacattaaacggctcatgctgtctgtcaggaagctacagaaaattcatattgacgtattggaggagatgggttataactctgattcacctatggggagtatgacaccttttatatccgcgctgcagtctaccgattggctgtgcaatggtgagctgtcccacgactgcgatggacccatcacagatctgaatagtgaccaataccagtacatgaatgggaagaataaacactctgtgagaaggttggaccccgagtactggaagaccatccttagttgcatctatgtatttatcgtctttggttttacctcatttattatggtcatcgtccatgagcgcgtgccagatatgcagacctatcccccattgcctgacatctttctggactctgtcccacggattccttgggcctttgcaatgacagaagtttgcgggatgattctctgctatatctggctgttggtgctcctgctgcacaagcatcgttcaatccttctaagacggttatgctcccttatgggtaccgtgttcctgctgcgctgttttaccatgttcgtaacctcactctctgtgcctgggcagcatctccagtgtaccggaaagatctatgggtcagtgtgggagaagctgcacagggctttcgctatttggtccggctttggcatgaccctgacaggtgtgcacacatgtggcgattatatgttttctgggcacacggtcgtcctgacaatgctaaacttcttcgtgaccgagtgcaaataccttttcagcgcatccatgcggatacggtag

SEQ ID NO: 207174 - DNA, 1437 bp, Artificial Sequence
  Description of Artificial Sequence: Synthetic coding sequence
atgcccgcccggagccggcaccggccccggctgcacagcggcagccccccccgagcgcctccaccccccctagaggccctgcattcgggcgaagcaggccgggccccagattcagatgggggaagcgacgctgacagcgaggtgggtcctggcagccccactcggaccgcagaggctgccgaggaggagatggcaggtccgaatcagctgtgtatcaggaggtggactaccaagcatgtagctgtgtggcttaaggatgaaggcttcttcgagtatgtggacattctctgtaacaaacacaggcttgacggcatcacactgctgacactgactgaatatgatctgaggagcccacccttagaaattaaggtgctgggcgacattaagagattaatgctcagtgtgcggaaactccaaaaaatccatatcgacgtgctggaggagatggggtacaactcagactccccaatggggagtatgacgccctttatttcggctttacaaagtacagactggctctgcaacggcgagctctcacatgactgtgacggtcccatcacagatcttaattctgaccagtatcagtacatgaacggcaagaacaagcattcagttcgtcggctggacccagagtactggaaaaccatcctctcctgcatctatgtcttcattgtgttcggttttacctccttcattatggtcatcgtccacgagcgagttcctgatatgcagacctacccaccactgcctgacatattcttggattcagtcccacgaatcccatgggcgtttgctatgacagaggtttgtggcatgattctgtgttacatttggctactggttctgctactacacaaacacagatcaatcttgcttcgtcgtctgtgcagtctaatgggtactgtgtttcttcttaggtgcttcacaatgttcgtgacctcactgtccgtcccgggtcagcacctgcaatgtaccggaaaaatttacggatccgtgtgggagaagctgcatcgggcttttgcgatttggtccggatttggtatgacactgacgggagtgcatacatgtggcgattacatgtttagcgggcataccgttgtgttaacaatgctaaacttctttgttaccgagtatactccccgatcatggaacttcttgcacaccttgagctgggttcttaacctgttcggtatcttttttattctggcagcccatgagcattactcgattgatgtattcattgcattctacattacaactcgcctcttcctctactaccatacactggcaaatacgcgggcctaccagcagagcagacgggcgcgcatttggttcccaatgttcagcttttttgaatgcaatgttaatggtactgttccgaacgagtattgttggccttttagcaagccagcaattatgaaaagactgattggatag

SEQ ID NO: 207175 - DNA, 765 bp, Artificial Sequence
  Description of Artificial Sequence: Synthetic coding sequence
atggccggccccaaccagctgtgcatccggcggtggaccaccaagcatgtggcagtgtggctgaaggatgaggggttctttgagtacgtggacattctatgcaacaagcatcggctggacggaatcaccttactgacactcaccgaatacgacttgaggagtccacctctggagataaaggtcctaggcgatataaaaaggcttatgttgagcgtgaggaaactgcaaaagatacacattgacgtccttgaagaaatgggttataactccgacagtccaatgggctccatgactcccttcatttccgctctccaatcgactgattggctctgtaacggtgagctatctcatgactgcgacgggcctataacggatctgaatagcgatcagtatcaatatatgaacggcaagaataaacactctgtgaggaggctcgatcccgaatactggaagactattttgagttgcatttacgtatttatcgtcttcggatttacaagcttcattatggtgatcgttcacgaaagggttcccgacatgcagacctaccctcccttgcccgacatctttctcgatagcgtgcctcgaatcccctgggcattcgccatgacagaagtatgtggcatgattttgtgttacatatggctgttggtgctcttactgcataagcaccggagcattctgctgcgtcgcctctgtagtttaatgggaacagtgttcttgcttcggtgcttcacaatgtttgtcacatccctgtccgtctag

SEQ ID NO: 207176 - DNA, 1248 bp, Artificial Sequence
  Description of Artificial Sequence: Synthetic coding sequence
atggccggccccaaccagctgtgcatccggcggtggaccaccaagcacgtggccgtctggctgaaagatgaagggttctttgaatatgtcgatatactgtgcaacaaacaccggctggatggcattacattactgacccttactgagtatgacctgcgttctccaccgctggagataaaggttctaggcgacatcaagcgcctcatgcttagcgtccggaagctgcaaaagattcacatcgacgtacttgaggaaatggggtataactccgatagtcccatgggatctatgactccctttatcagcgctctccagagcaccgattggttatgcaatggggagctgagccatgattgcgatggtccaatcactgatctgaattcagatcagtatcagtacatgaatggcaaaaacaaacatagtgtaagacgccttgaccctgagtattggaaaacgatccttagttgcatctatgtgtttatcgtgtttggcttcacctcctttattatggtgatagttcacgaacgggtcccagacatgcagacttacccacctctgcctgacatcttcctggacagtgtacccaggatcccttgggcctttgcaatgactgaggtttgtggaatgatcctgtgctacatttggctactggtactcctgcttcacaaacacaggtcgatactcctaagacggctgtgtagtctgatgggaactgtgttcctgcttaggtgttttaccatgtttgtcaccagtctgagcgtgcctggccagcatctgcaatgcacaggaaagatctacggcagtgtgtgggagaagctgcatcgcgcctttgcaatatggtctggattcggcatgacactgaccggcgttcacacgtgtggagattacatgttcagtgggcacacagttgtgctgactatgttgaacttctttgtgaccgagtatacccccaggagctggaactttctgcacaccctgtcttgggttctaaatctgttcggcattttctttatactcgctgcacacgaacactacagcattgacgtattcattgccttctacatcacaaccaggctctttctctattatcataccctggccaacactagggcgtatcagcagagccggcgggcaagaatatggtttcccatgtttagtttcttcgaatgcaacgtcaacggtacagttccaaatgagtactgctggcccttctccaagccagctatcatgaagcgtctcatagggtag

SEQ ID NO: 207177 - DNA, 4770 bp, Artificial Sequence
  Description of Artificial Sequence: Synthetic coding sequence
atggccaagcagctgaacctgcccgagaacaccgacgactggaccaaggaagacgttaaccagtggcttgaatcacacaagatagaccagaagcaccgggaaattctgaccgagcaggacgttaatggagcggtgttaaaatggctcaagaaggaacacctggtggacatggggatcacacacggaccagccattcaaattgaagaattatttaaggagctgcggaagacggctattgaggatagcatccaaaccagcaaaatgggcaagccttccaagaacgcacctaaagaccagactgtgagccaaaaggaaaggagagaaacttcaaaacagaagcagaaaggcaaagaaaaccccgatatggcaaaccccagcgctatgtctacaacggctaaagggagcaaatcattgaaggtagaacttatcgaagataagatagactatacaaaagagcgtcagcccagcatcgacttaacctgtgttagttatcccttcgatgagttctctaacccttatcgttacaaattagatttctcactccagccagagacgggccctggcaacctcattgaccccatccatgagttcaaagcattcaccaataccgcaaccgccacagaagaggacgtcaagatgaagttctcaaatgaggtcttccggttcgcctcggcatgtatgaattctaggaccaacggtacaattcatttcggagtgaaggacaaacctcatggaaagatcgtgggtattaaggtgaccaatgatacaaaagaggccctcattaaccattttaaccttatgattaacaagtatttcgaagaccatcaggtacagcaagcaaagaagtgtatcagggagcctcgatttgtggaagtccttctccccaatagcactctgtccgacaggttcgtcatcgaagtagacatcattccccagttcagcgaatgtcagtatgattactttcagataaaaatgcagaactacaacaataagatctgggagcagtctaagaagttttcactattcgtacgagacgggacctccagtaaggatatcaccaagaacaaggttgattttcgggcgttcaaggccgatttcaaaactctagccgaatctcggaaagccgctgaagagaagtttcgcgccaagactaataagaaggaaagggaaggcccgaagctggtgaagctgttaacaggcaatcaggacttactcgataatagctattatgaacagtacattctggtcaccaacaaatgtcaccctgaccagaccaaacatctggacttcctcaaggaaataaagtggttcgcagtactggaattcgacccagagagcaacatcaacggggtcgtgaaagcttataaggagtcccgggtggctaacctccacttcccttctgtgtacgtagagcaaaaaaccacccccaatgagaccatttctacactgaacctgtatcatcagccaagttggattttttgtaacggccgtctcgatctggactcagagaagtataagccgttcgatccctcttcatggcagagagaacgcgccagtgacgtgaggaagcttatcagctttcttacccacgaagacatcatgccccggggtaaattcctggtcgtgtttctgctcctgagttctgtagacgacccgagagaccccctgatcgaaacattctgtgcgttctaccaagatttaaaggggatggagaatatcctgtgcatctgtgtgcatccccacatttttcaggggtggaaagacctgctggaggcacgcctgataaaacaccaggacgaaattagtagtcagtgtatcagcgcccttagcttggaagagattaacggaaccattctcaagctaaagtcagtcactcagtcgagtaagaggctactcccttcaattggactgtcaacagtgctgctgaagaaagaggaggacattatgacagcgctcgagataatttgcgagaacgagtgtgaggggacgctgctagaaaaagacaagaacaagtttctggaatttaaggcttccaaggaggaagacttttacagagggggtaaggtgtcttggtggaatttctatttcagttctgagagttattctagcccttttgtgaagagggataagtatgaaaggctcgaagcgatgatacaaaactgtgccgactccagcaaaccaacgtcaacaaagattatccatttataccaccatccgggctgtggtggcacaaccctggccatgcatattctgtgggaactccgcaagaaatttaggtgcgcggtcttgaaaaacaaaactgtagatttttccgagataggggagcaggtcacaagtctcatcacatacggcgccatgaaccggcaagaatacgtgcctgtgctcctactagtggacgactttgaggagcaagacaacgtctatttgctgcaatatagcattcaaaccgcaatcgccaagaaatacatccgttacgaaaagcccctggtcatcatactgaattgcatgcgctctcagaaccctgaaaagagtgccagaatccccgacagcatcgcagtgattcagcagctgtcacccaaggaacaacgggcattcgagctgaaactgaaggagattaaggagcagcacaaaaactttgaagacttttacagctttatgatcatgaagacaaacttcaataaggagtacatcgaaaacgtagttaggaatatcctgaaaggacagaacatctttaccaaagaagctaagctcttctcctttcttgccctactgaatagctacgtacctgatacaaccatttcactgtcccagtgcgagaaatttcttgggatcggaaacaaaaaagctttctggggaaccgaaaaatttgaagataagatgggtacctactccacaattctcatcaaaactgaggttatcgaatgcggcaattactgcggagttcggatcattcacagtctcatcgctgaattctcccttgaggaactgaagaaaagctaccacctgaataagagccagatcatgctggatatgctgacagagaatttgttctttgacaccggtatgggcaagagcaaatttttacaggacatgcacactctgctgctcacacgacaccgggacgaacacgaaggagagaccggaaattggttcagtccattcatagaagcccttcacaaagatgaaggtaatgaagctgtcgaagcggtgctgttggagagcattcaccgcttcaacccgaacgcgtttatctgccaagctttggccagacatttttatattaagaaaaaggacttcggtaacgccctgaactgggccaagcaagctaaaatcatcgaacccgacaacagctatatatccgatacactggggcaggtgtataaatccaagatcagatggtggattgaagagaacgggggcaacggaaacatctcggtggacgaccttattgccctcctggatttagctgagcacgctagctctgcctttaaggagagccagcagcagtcagaagatcgggagtatgaggtgaaagagaggctgtaccccaagtccaagagacgctatgacacctacaatatcgcagggtaccaaggggaaatcgaggtggggctgtataccattcagatcctgcagcttatcccattttttgacaataagaacgagttgagcaagcgctatatggtgaacttcgtctcaggatcctcggatattccaggcgacccgaacaacgaatacaagctggcattgaaaaactacataccctaccttactaagctgaagttcagcttgaaaaaatctttcgacttcttcgatgagtactttgtgttgctgaagcccaggaacaatattaaacagaacgaggaggccaaaactagaagaaaggtcgctggatactttaagaagtatgtggacatcttctgtctcctcgaagagtcccagaacaacacggggctgggatccaaattctcagagcctctccaagtcgaacgatgtagaaggaatctagtcgctttgaaagccgacaagtttagtggcttgctggagtacctgattaagtcacaagaggacgctatctccaccatgaaatgtatcgtaaatgagtacactttcctgttggaacagtgtacagtgaagatccagtcaaaagagaagctaaatttcatcctggccaacattatcctctcttgtatccagcctacatcgcggctagttaagccagtggaaaagcttaaggatcagcttagggaagtcctacagcctattgggttaacttaccagttctccgagccctatttcctggcgtctctcttgttttggcccgagaaccagcagctcgaccaacacagcgaacagatgaaggagtatgcacaagcccttaagaattcgtttaagggccaatacaaacacatgcaccgtaccaaacaacccatcgcgtactttttcctggggaagggtaaacggctcgagaggttggtgcacaaaggtaaaatcgaccagtgttttaaaaagacgcctgatatcaacagcttgtggcagtcaggcgacgtatggaaggaagaaaaagttcaggaactgctgcttagactgcaagggagggccgaaaataactgcttatacatcgaatacggcatcaacgagaaaatcactatcccgataacacccgcgttccttgggcagttgagatctggacggtcaatagaaaaagtctccttttatcttggctttagcattggaggccctttagcctatgatatcgagatcgtgtag

SEQ ID NO: 207178 - DNA, 3852 bp, Artificial Sequence
  Description of Artificial Sequence: Synthetic coding sequence
atggccaagcagctgaacctgcccgagaacaccgacgactggaccaaagaagacgttaatcagtggcttgagtcgcacaaaatcgatcagaaacaccgggaaatccttacggaacaggacgtgaatggggccgtgctgaaatggcttaaaaaggagcacctggtggatatgggcattacgcacgggcctgctatacagattgaagaacttttcaaggagctgagaaaaactgctattgaggacagtattcaaaccagtaaaatgggcaagcccagcaaaaacgccccaaaagaccagaccgtctcacagaaggaaaggagagaaacctctaagcaaaaacaaaaaggaaaagaaaaccccgatatggccaaccccagtgctatgagtacaaccgccaaggggagcaagagtctgaaggtagaattgatcgaggacaagatagattataccaaggaaaggcagccctctattgacttgacatgcgtgagctacccattcgatgagttcagcaacccttaccggtacaagttggacttcagcttgcagcctgagaccgggccaggcaacttgatagaccctatccatgaattcaaggcatttacaaacactgcaactgcaacagaggaggatgtcaaaatgaaattctctaacgaagtgttcaggtttgcgagcgcatgtatgaactcccgcacaaacggcacgattcacttcggcgtgaaggacaagcctcatgggaaaattgtgggaattaaagtgaccaacgatactaaggaggccctcataaatcattttaacctcatgattaataagtactttgaggaccaccaggttcaacaagccaaaaagtgtatacgtgagccccgattcgtagaagtcctcttgccaaactcaaccctgagcgaccgtttcgtgattgaggtggatattatcccgcagttttcggagtgccagtacgattattttcaaatcaagatgcaaaattacaacaataagatctgggagcaatctaagaagttttccctgttcgtccgggatggaacaagctcgaaggacattactaaaaataaagtggacttccgggcattcaaagcagatttcaagactttggcggagtcacgcaaagccgctgaggaaaagttccgcgcaaagaccaataagaaggaaagggagggccccaaactggtcaagcttctcaccggtaaccaggaccttctggataatagttattatgagcagtacatccttgtgaccaataagtgtcaccctgaccagaccaagcacttggatttcttgaaagaaattaagtggtttgccgtgctcgaatttgaccctgagtctaacattaatggagtagtcaaagcttacaaagagtcacgtgttgcaaatcttcacttccccagtgtctatgtggagcagaaaacaactccaaatgagactattagtacattgaatttgtaccaccagccatcttggatcttttgtaatggcagactggatttggattctgaaaaatacaaaccgtttgatccttcctcctggcagagagagagggccagcgacgttcgaaagctaatatcatttttgacccacgaggacatcatgcctagagggaagttcctcgtggtctttctgcttctgtccagcgtggatgacccaagggaccctctgatagaaaccttctgtgcattttaccaggatttgaagggcatggaaaatattctatgtatctgtgttcatccccacatcttccaaggctggaaagacctgctcgaagcccggttaatcaagcatcaggacgagataagctcccaatgtatctctgcccttagtttagaggagattaacggcacaattcttaagcttaagtccgtgactcagagctcaaagagattgcttcctagtattggccttagcaccgtcctgctgaagaaggaagaggacataatgacggccctggaaattatttgcgaaaatgaatgtgaaggaaccctgctcgagaaggacaaaaacaagttcctggagttcaaagctagtaaggaggaagacttctaccgaggaggcaaagtgtcttggtggaacttctatttctcctctgaatcatactcctctccctttgttaaacgcgataaatatgaacggcttgaagcaatgatccaaaactgcgcagattcttctaaaccgacctccacaaagattatccacctttatcaccaccccggatgcggtggcaccaccctcgcaatgcacatcctgtgggaattaaggaagaagtttagatgcgccgttttgaaaaataagaccgtggacttcagtgaaatcggggagcaggtcacctccctgatcacatatggagcaatgaacaggcaggagtatgttcccgtattgctgctggtggacgactttgaggagcaggacaatgtatatctcctccaatacagtattcaaactgccatcgccaagaaatatattagatatgagaagccgctggtcatcattcttaattgtatgcgctctcagaaccccgagaagtccgctaggatccctgactcaattgccgtcatccagcagctatccccgaaagagcaaagagcattcgagctgaagctcaaagagattaaggagcagcacaagaatttcgaggatttttactccttcatgatcatgaagactaattttaacaaagagtacatagaaaatgtggtgaggaacatccttaaaggtcagaatattttcaccaaggaggccaagctttttagcttcctggctctgctgaactcctacgtccccgacacaacgatctctttgagtcagtgcgagaagttcctgggaataggaaacaagaaagctttctgggggactgaaaagtttgaggataagatggggacatacagtacaattctgattaagacagaggttatagaatgtgggaactactgtggcgtgcgaattatacacagcctcatcgcggaattttccctggaggaactgaaaaagagctaccacttgaataagtctcaaatcatgctcgatatgctcacggaaaacctcttctttgatactggcatgggcaagtccaaatttctgcaggatatgcacacactgttactcactcggcaccgagacgagcacgagggggagacggggaattggttctccccgtttattgaagccttgcataaggacgaagggaatgaagccgtggaagcggtccttctggagagcatccaccggttcaacccaaacgcctttatatgccaagcactggccagacatttctacatcaagaagaaggactttggtaacgctctgaattgggccaaacaggccaaaatcatcgaacccgataacagctacatatccgacactttgggccaggtgtataaatccaagatccgatggtggatcgaggagaatggaggcaacggcaacatttctgtggatgacctgatcgctttgctggacctggcagaacatgccagctccgccttcaaggagagccaacaacagagtgaagaccgggagtatgaagtcaaggaacgcctctaccccaaaagtaagcggcgttacgatacctataacattgcaggctatcagggcgaaatcgaggtcggtctgtatacaattcagatcctgcagctgatacctttcttcgacaataagaatgagctgagcaaaagatacatggtgaacttcgtcagcggctcatctgatatccccggggatcccaacaatgaatataaactggctctaaaaaattacatcccctatctgactaaattaaagtttagtctgaaaaagtcctttgacttttttgacgagtacttcgtactgttaaagccgaggaacaactag

SEQ ID NO: 207179 - DNA, 4755 bp, Artificial Sequence
  Description of Artificial Sequence: Synthetic coding sequence
atgagcaagcaggtgagcctgcccgagatgatcaaggactggaccaaggagcacgtgaagaaatgggtcaatgaggatctcaagatcaacgagcagtacgggcaaatacttctttccgaggaagtgacgggcctggtgctgcaggagctaacagagaaggaccttgtggaaatgggcctgccgtggggccctgccctgctaattaagcggtcatacaacaagctgaactcaaaatctcccgaatcagacaatcacgatcccgggcaattggacaacagcaaacccagcaaaacagaacaccagaagaatccaaaacacaccaagaaagaggaggaaaatagcatgtcaagtaacattgattacgacccaagagagatacgggatattaagcaagaagagagtatcctgatgaaggaaaacgtcctggatgaggtagctaacgctaaacacaaaaaaaaaggcaagctgaaaccggagcagttaacttgtatgccgtatccattcgatcaattccatgactcacatagatacatcgaacattacaccctgcagccagagaccggggcattgaatctcatagatccaatccacgagttcaaagccctcactaataccgagaccgcaacagaagtggacattaagatgaaattcagtaatgaggtgtttaggtttgcaagcgcatgcatgaactctagaacaaatggcacaattcatttcggcgttaaggacaagccccacggggagattgtcggtgtgaagatcacatccaaagctgcgtttatcgaccattttaacgtgatgatcaaaaaatatttcgaagagtccgagatcaatgaggccaagaagtgcataagggagcctcgctttgttgaggtgctcctacaaaataacacacctagcgacagattcgtcattgaggtggatactatacccaagcacagtatttgcaacgacaagtatttctacattcagatgcagatttgtaaagataagatctggaagcagaatcaaaacctctcattgttcgtccgggaaggcgcctccagtcgggacatcttggccaacagtaaacagagggacgtagatttcaaagcctttttacagaaccttaagagtctagtggccagccgaaaggaggcggaggaggaatacggaatgaaagccatgaagaaagagtccgaaggacttaagttggtgaagctcttaatcggtaatcgggacagcttggacaatagctattacgactggtatatcctcgtgaccaacaaatgtcaccccaaccagatcaagcatctggattttctgaaggaaataaagtggttcgccgtgttagagtttgatcctgaatcgatgattaatggtgtcgtgaaggcctataaggagagtagggtcgccaatttgcattttcccaatcagtacgaggataagacgaccaacatgtgggagaaaatttctaccctgaacctctaccagcaaccttcttggattttttgcaacgggcggtcagatctgaagtcagaaacctataagccactggagcctcacttatggcaaagagagagagcatctgaggtccggaaactcattctctttctcactgatgaaaacatcatgactaggggaaagttcctggtggtgttcctgttgctgtctagtgtggagagtccaggtgacccactcattgagactttttgggctttttaccaggcacttaaaggcatggagaacatgctgtgcataagtgtgaacagtcatatctaccagcggtggaaggatctgctacagacgagaatgaagatggaggatgagttaacaaaccacagtatatctaccctaaatatagagcttgtgaactccacgatactgaagctcaaaagtgttaccaggagttctagacgctttcttcctgcacgtggaagctcatcagtgatccttgaaaaaaaaaaagaggacgtgttgactgctctggaaatcttgtgcgagaacgaatgtacagaaacggatatagaaaaggacaagagtaaattcctggagttcaaaaagtccaaggaagagcatttttacaggggtggtaaggtctcctggtggaatttctactttagttccgaaaactacagttctgacttcgttaaacgggattcgtacgagaagcttaaggacctcatccactgttgggctgaaagtccgaaaccaattttcgccaaaatcatcaatttgtaccatcaccctgggtgcggcggcacaacccttgctatgcacgtgctctgggatttgaagaaaaacttcagatgtgcagtattgaagaacaaaacaaccgactttgcggaaatcgccgagcaggttataaacctggtaacctatcgggccaagagtcatcaggattatattccagttttgctgctagtggatgactttgaggaacaagaaaacgtgtattttctccagaacgctatccatagcgtgttggctgagaaggatcttagatacgagaagaccttggtgattatcctcaactgtatgcggtctaggaaccctgatgagagtgctaagctggcagactccattgcactgaactatcaacttagctccaaggagcagcgggcatttggtgctaaactgaaagaaatcgaaaagcagcataaaaactgtgaaaatttttactcatttatgattatgaaatccaacttcgacgagacatacatcgagaacgtggtccgaaacattctgaaaggccaagatgttgactcaaaagaggcccagttaatcagttttctagctttactctcttcttacgttacagatagtactatctctgtgtcccaatgtgagatttttttgggaataatctacacaagcaccccttgggaaccagaatcactcgaagataaaatggggacttactcaacactgctcattaagactgaagtcgccgagtacgggaggtacaccggggttcgcattatccaccctttgattgccttgtattgcctgaaagagctcgagcgttcgtaccacctggataaatgccagattgctcttaacattctggaggaaaatttgttttacgacagtgggatcgggcgcgacaagttccagcacgatgtgcagacattgctgctgactaggcaacgcaaagtgtacggagatgagacagacacgcttttctcacctctcatggaagcactccagaacaaagatatagagaaggtattatccgctgggtcccggagatttccacagaacgcttttatctgccaagctctggctcggcatttctacatcaaggagaaggactttaataccgctctcgactgggcaaggcaggcaaaaatgaaagcacctaaaaatagctacatttctgacacattgggtcaagtctacaaatccgaaatcaagtggtggcttgacggtaacaaaaactgcagatctattaccgttaacgaccttacccaccttctggaagctgctgagaaagccagtagggccttcaaagaatctcagagacagactgatagcaagaactatgagacggaaaactggtctccgcaaaaaagccaaagacgctatgatatgtacaatacagcttgttttttgggcgagattgaggtaggcctgtataccatccagattctccagctgacgccgttctttcacaaggagaatgagctgtccaaaaagcatatggtccagttcctgtcagggaagtggactatacccccagaccctcgcaacgaatgttatttggcattgagcaaatttacatcccacctaaaaaacctccagtcagatctgaaaaggtgctttgacttcttcatcgactacatggtgcttctgaaaatgagatacactcagaaagaaatcgcagagattatgctttctaaaaaggtgtcccgatgttttcgcaaatacacagagctgttttgccatttggatccctgcctgcttcagagcaaggagtcccagctgctccaggaggagaactgccggaagaagctcgaagcattgcgagctgacagattcgctgggttgcttgaatatttgaatcctaactataaggacgctacaaccatggagtccatcgtcaatgagtacgcttttctgctccagcaaaactcaaaaaaacctatgacaaacgagaagcaaaacagtatccttgccaatatcatcctgtcgtgcttaaaacccaactctaagctcatacaacctttgacaacattaaaaaagcagctgcgggaagtactccagtttgtcggcttatcccaccagtatcccgggccttacttcttggcttgtcttctcttctggcctgagaatcaggagctggatcaggacagtaagcttattgagaaatacgtgtccagcctcaatcggagcttcaggggacagtacaagcgtatgtgccggtccaagcaggcatcaaccctgttttacctcgggaaacggaaggggctgaactcgatcgtgcacaaagcaaagattgagcagtactttgataaggcccagaataccaatagcctgtggcactctggtgacgtctggaaaaagaacgaagtcaaagacctgctgcggaggctcactggtcaggctgagggcaagctgatttctgtagagtacggcaccgaagaaaagatcaagattccagtgatttcagtgtattcaggcccccttcggtctggacgcaatatcgaacgcgtgtccttttatctgggcttttcaatcgaggggccccttgcatatgatatcgaggtaatatag

SEQ ID NO: 207180 - DNA, 1221 bp, Artificial Sequence
  Description of Artificial Sequence: Synthetic coding sequence
atgagcaagcaggtgagcctgcccgagatgatcaaggactggaccaaggagcacgttaagaagtgggtgaacgaggacctgaagatcaatgaacagtatggtcaaatcctactgtcggaggaggttacaggcctggtccttcaggaattgactgagaaggatctcgtcgagatgggattgccatggggacccgctctacttattaagcggtcttacaacaagctgaattcgaaaagccccgagtctgacaaccatgaccccggacagctggacaattccaagcccagcaaaactgagcaccagaagaacccaaaacacaccaaaaaggaagaagagaattccatgtcctctaacatcgattatgacccaagggagatacgagatattaaacaggaagagtcaatcttgatgaaagagaacgttctggatgaagtggccaacgctaagcataagaagaagctggaggcgctcagggctgaccggttcgctggccttctggagtaccttaatcctaactataaagatgccacgacaatggagagcatcgttaacgagtacgcttttctgctccagcagaactctaaaaaacctatgactaacgagaaacagaattccatcctggccaatatcatcctctcttgcctgaaaccaaactccaagttaatccagcccttgactacgctcaagaaacagttgcgcgaggtgttgcagttcgtagggcttagccatcagtatcccggaccttatttcctggcttgtcttctgttctggcccgagaatcaggaactggaccaggacagcaaactgattgagaaatatgtgagttctttgaacaggagcttccgggggcagtacaaacggatgtgtagatcaaagcaagcctcgactctgttttatctcggtaaacgcaagggtttgaattcaattgtgcacaaggctaagattgagcaatactttgacaaggcccaaaatacaaacagcctttggcacagtggcgacgtgtggaagaaaaatgaagtgaaagatctcctgcgacggctcactggacaggccgagggcaagctgatcagcgtggaatacggcaccgaggagaaaatcaaaatacctgtgatttcagtctattccgggcccctgagatctgggcggaatatagagagagtgagcttttacctgggatttagcatcgaaggaccgttggcatatgatatcgaggtaatttag

SEQ ID NO: 207181 - DNA, 4755 bp, Artificial Sequence
  Description of Artificial Sequence: Synthetic coding sequence
atgagcaagcaggtgagcctgcccgagatgatcaaggactggaccaaagagcacgtcaagaagtgggtcaatgaggaccttaagattaacgagcagtatggccaaatcctcctgagcgaggaggttacaggcctcgttttgcaggaactgaccgagaaagatttagtcgaaatgggactcccatggggaccagctcttctaatcaaacgtagctataataaactcaattctaaaagccctgaatcggataaccacgatccggggcagctcgacaacagcaagccctctaagactgaacatcaaaagaatccgaaacacactaaaaaggaggaggagaacagcatgagctccaatattgattacgatcccagagaaatacgtgacattaagcaagaggaatcaattctgatgaaggagaatgttctcgatgaagtcgcaaacgcaaagcataagaagaagggaaagcttaagccagaacaacttacctgcatgccatacccatttgaccagtttcacgactctcaccggtatatagagcactacacattacagccagagacaggcgctcttaacctcatagaccctattcacgagttcaaggccctgacaaatactgagaccgctacagaagtggatattaagatgaaattcagcaatgaggtgttccgatttgcatcagcatgtatgaattctcggaccaacggcacaattcacttcggggtgaaagacaagccacatggggagatcgtgggggttaagatcacaagcaaggccgcctttatcgatcactttaatgttatgattaaaaagtactttgaggagtcggaaataaacgaagcaaagaaatgtattagagaacctcgctttgtggaggtattgctgcagaataacactccatctgatcggttcgtgatagaggtggacaccattcctaagcattctatttgcaatgacaagtatttctacatccagatgcaaatatgcaaagataagatttggaagcaaaatcagaatctctcgctgttcgtgagggaaggagctagtagtagggacattcttgccaattctaagcaacgggatgttgactttaaggcattccttcagaacctgaaaagcctggtggcatctcgcaaggaggcagaagaggagtacggcatgaaagccatgaagaaagagagcgaagggcttaagctcgtgaagctcctgattggaaaccgggatagtctggacaactcatattatgattggtacattttggtgaccaacaagtgccaccccaatcagattaaacacttggatttcttgaaagaaattaaatggtttgccgtgttggaatttgatcccgagtctatgataaatggtgttgtgaaggcttacaaggagagtcgtgttgccaacctgcacttccctaaccagtatgaggataaaacaactaacatgtgggaaaaaatttccactcttaatctttatcagcagccttcatggatattctgcaatggacggtctgatctcaaatccgagacctataaacccctggagccacacttgtggcaacgcgaacgagcatctgaggttcggaaactgatcttattcctcacagatgaaaacatcatgacacgggggaagttcttagtagttttccttctgctgagctccgttgagtctcctggcgatccgctgatcgagaccttttgggcgttctatcaggctctcaaggggatggagaatatgctgtgcatctctgtgaacagtcacatctaccagcgatggaaagatcttttacagaccagaatgaagatggaggacgaactaaccaaccactcaatctccactctgaacatcgagctcgtaaactctaccatcctcaagctcaagtcagtcacacgcagttcaagaagattcctgcccgctcgcgggagtagttccgtgattctggagaaaaagaaggaagacgtactgacggcgctggagattctgtgtgaaaacgaatgtactgagaccgacattgagaaggacaagagtaaatttctcgaattcaaaaagagtaaagaggaacatttttacagggggggaaaggtgtcctggtggaacttttatttttccagtgaaaattattcttctgacttcgttaaacgtgattcctatgagaagctaaaagacctgatccactgctgggccgagtccccaaagcccatttttgctaaaataattaacctgtatcaccatccgggctgcggcggtacgacccttgctatgcacgtcctgtgggatctaaaaaagaattttaggtgcgcggtcttgaagaacaagaccactgattttgccgagattgcagagcaggttataaatctggtaacataccgagccaagtctcatcaagactacatccccgtgcttctgttggttgacgactttgaggaacaggaaaatgtgtatttcctgcagaatgcaattcactcagtacttgctgagaaggacctccgctatgagaaaactttggtaatcatattgaactgcatgcgctcgcgcaaccctgacgagtcggcaaagctggcagattcaatcgcactgaactaccagcttagctctaaggaacagagagccttcggcgccaaactgaaggagatcgagaaacagcacaagaactgcgagaacttctactcattcatgatcatgaaatcaaactttgacgaaacatatatcgagaacgttgtaaggaacattctaaaaggccaagatgtggacagtaaagaagcccaactcatatcatttctcgccttgctgagcagttacgtgaccgattccacgataagtgtgagtcagtgtgagatctttttgggcatcatctacactagcacaccctgggaacctgaatcccttgaagataagatggggacctattcgacactgttgatcaagaccgaagtggcagaatacgggcgttacactggcgttagaattatccatcctctgattgcgctgtattgcctgaaggagttggaacggagttaccacctggataagtgccagattgctctcaacatcctggaggagaacctattttacgactctggcatcgggcgtgataagtttcaacacgatgtgcaaaccctcctgctgactcgtcaaaggaaagtttacggcgacgagacagacactctgtttagtcctctgatggaagccctgcagaataaagatatagaaaaagtgctcagcgctggcagtcgacggtttccccagaatgccttcatctgccaggccctggcgaggcacttttacatcaaagagaaagacttcaacaccgcactggattgggcccgccaagcaaagatgaaggcaccaaaaaattcttatatcagtgacacactggggcaggtatacaagtccgaaataaaatggtggctagatggcaataagaattgtcgcagcattactgtgaacgacctgactcatctgttggaggcagccgaaaaggcgtcacgggccttcaaagagagccagcggcaaacggatagtaagaattacgagactgagaactggagcccccaaaaatcccaaaggcgctacgatatgtataacaccgcttgtttcctgggagagattgaggtgggtctgtacacaatacagatcctccaacttacgccattctttcacaaggaaaacgagctgtctaaaaagcacatggtgcagttcctcagtgggaagtggaccattccaccagatcctagaaatgagtgctatctggccctgagcaagttcacttcccatctgaaaaatctccaaagcgacctcaaacgctgtttcgacttcttcatagactatatggtgctgctcaagatgcgatatacccagaaggaaattgccgaaatcatgctgagtaaaaaagtgagccgttgcttcagaaagtatacagagctcttctgtcatctggacccttgtctccttcagagcaaggaaagccaactgctccaggaggagaattgtaggaagaagttggaggcccttcgagcagatcggtttgccggactcttggaatacttaaaccctaactacaaagacgctacaaccatggagtctattgtgaacgagtacgccttccttctgcaacagaactcaaagaagcccatgacgaacgaaaagcagaatagtatcctggccaatattatcctgtcttgcttaaaacccaatagcaaactcattcagcctctgactacccttaaaaagcaactaagggaggtgctacagtttgttggactgagccaccagtacccaggcccctatttcctggcttgtctgttattctggccagagaaccaggagctggatcaggattctaagctaatcgagaaatatgtttcctccctgaatcgatcgttcagaggacagtacaagcggatgtgccggagcaaacaggcttccaccttgttttacctgggcaaacgcaagggcttgaactccattgttcacaaagccaagatcgagcagtacttcgacaaggctcagaacacaaactccctgtggcattccggagatgtgtggaagaagaacgaggttaaggatttgctgaggcgacttaccggacaggccgaaggcaaactcattagtgtcgaatacggcacagaagagaaaattaagatccccgtgatttccgtgtacagcgggccactccgaagcggtaggaatatagagcgcgtcagcttctatctgggattcagtattgagggacccttggcctatgacattgaagtgatctag

SEQ ID NO: 207182 - DNA, 213 bp, Artificial Sequence
  Description of Artificial Sequence: Synthetic coding sequence
atgagcaagcaggtgagcctgcccgagatgatcaaggactggaccaaggagcacgtcaaaaaatgggtgaacgaggatttgaagattaatgagcagtatggccagatccttctgagtgaggaggtcacaggacttgtcctgcaagagctcacagaaaaagatttagttgagatggggctaccctggggccctgctctgctcataaagcgctag

SEQ ID NO: 207183 - DNA, 4755 bp, Artificial Sequence
  Description of Artificial Sequence: Synthetic coding sequence
atgagcaagcaggtgagcctgcccgagatgatcaaggactggaccaaagagcacgtgaaaaagtgggtcaatgaggatctgaagataaatgagcaatatgggcagatccttctgtccgaagaggtcacaggactggtgttacaggagctcaccgagaaggacctggtggaaatgggtctgccttggggcccagcgttgctgatcaagcgcagttataataaacttaattcaaagtctccagagtccgacaatcatgaccctggccagctggataatagcaagccatcaaagacagaacatcagaaaaaccccaaacatacaaaaaaagaagaagaaaattccatgtcttcaaatattgattatgaccccagagagatccgcgacataaagcaggaggagtctatcctgatgaaggagaacgtgctggacgaagtggccaacgctaaacataagaagaaaggcaagctgaagcccgaacagctgacttgtatgccttatccattcgatcagttccacgacagccatagatatatcgagcactacaccctacagcccgaaacaggggcgctcaatttgattgatccgattcatgagtttaaggcacttacgaatacggaaactgccactgaggtcgacatcaagatgaaattttctaacgaagtttttcggtttgctagtgcttgtatgaactcccggaccaacggtactattcactttggtgtcaaagataaaccgcacggggagatcgtaggcgtgaaaatcaccagcaaggctgcattcatcgaccactttaacgtaatgattaaaaaatactttgaggagtcggaaatcaatgaggccaagaaatgcattagagaacctcggttcgtcgaggtgctgctccagaacaacactccaagcgacaggttcgtgattgaagtcgacacaatcccaaaacactcgatctgcaatgataaatacttttacatacagatgcagatctgtaaggacaagatctggaagcagaaccagaaccttagcctctttgtgagggaaggagccagctctcgcgacatcctggctaactctaagcagagggacgttgatttcaaggcatttctgcaaaaccttaaatccctggtggccagccggaaggaggctgaagaagagtacggcatgaaggccatgaaaaaggagagcgaaggcctgaagctggtgaagttactgatcgggaaccgcgattcattagacaacagctactacgactggtacatattggtgaccaataagtgtcatcccaatcagatcaagcacttagacttcttgaaggagataaaatggtttgctgtgctagaattcgaccctgaatcaatgatcaacggagtcgttaaagcctataaagagtctagagtcgccaacctccattttcctaatcaatacgaggacaagaccacgaatatgtgggagaagatctccaccctgaatctctaccagcagccttcgtggatattttgcaacggccgaagcgaccttaagagcgagacatacaaacccttagaaccccatctctggcaacgcgaacgcgcttccgaggtaagaaagctgattctgttccttaccgatgaaaatatcatgaccagaggcaaatttcttgtggtgttcctgcttctcagctccgtggaatctccaggggatcccctgatagagacattttgggcattctaccaggcactcaaggggatggagaacatgctctgcatctcagtaaattcccacatttatcagcgctggaaagacttgctccagactcgaatgaaaatggaggatgagctgacaaaccactccattagtacactgaatattgaacttgtaaattccaccattcttaaattgaagagcgtgactaggtcatcacgacggtttctccctgctcgcggatcctcttcagtcatacttgaaaaaaagaaagaagacgttctgaccgcactggagatattatgcgaaaacgaatgcacagagacagatatcgagaaggacaagagtaaattcctcgaatttaagaagtctaaggaagagcatttctaccgtggaggcaaggtgagctggtggaacttttacttttcttcagagaattattccagcgacttcgttaaacgcgactcctacgaaaagctgaaagacctgatccactgctgggctgagtctcctaagccaatcttcgctaaaattatcaatttataccaccatcccgggtgcggcggcaccaccctcgcaatgcatgtgctttgggatctcaagaagaactttcggtgtgccgtcctgaaaaataagactaccgatttcgccgagatcgccgagcaggtgattaatttagtcacctatcgcgccaagtcccaccaggactacatcccagttttgctgcttgtggatgactttgaagaacaggagaacgtctactttctgcagaatgccatccattctgtgctcgcagaaaaagatctgcgctatgaaaagacattggtcattattctcaattgcatgcgatctcgaaatccagatgagtcagctaagttggctgactccattgccctgaactaccagttgagcagtaaagagcagagagcatttggtgccaagctgaaggagatcgaaaaacaacataaaaactgtgagaatttttatagcttcatgatcatgaagagcaactttgacgaaacatacatagagaatgttgtgcggaacatcctgaagggtcaggacgtcgacagcaaagaggcccagttgatctcctttctcgccttgttatcctcttatgtgacggatagcacgataagcgtgtcccagtgtgagattttcctcggcatcatttacactagtaccccttgggagcctgaatccctcgaggataaaatgggtacctacagtaccctgctgatcaagacggaagtggccgaatatggtaggtatacaggagtgaggatcatccacccgctgatagccttatactgcctcaaggagctggaaagatcttatcacttggacaaatgtcaaattgccctgaatatactcgaggagaacttgttctacgattctggtatcggaagagacaagttccagcatgatgtgcagaccctactgcttaccaggcagagaaaagtgtacggggatgaaactgacactctgttttctccacttatggaagccctgcagaacaaggatatcgagaaagtactttcagccgggtctaggcgcttcccccagaatgctttcatttgtcaagctttggctagacacttttacataaaggagaaggacttcaatactgccttggactgggctcggcaggccaaaatgaaggctcccaagaactcttacatatccgatacgttagggcaggtctataagtccgagattaaatggtggctggatgggaataaaaattgtcgctccatcaccgtgaacgatctgacccacctcctggaggcagctgagaaggcttctagggcgttcaaggagagccaaagacagaccgacagcaaaaactatgagaccgagaactggtcgccccagaagtcccaacggagatatgacatgtataatactgcatgctttctgggagagatagaagtgggcctgtatactattcagatccttcagctgactccgttttttcataaggaaaatgagttgagtaaaaaacacatggtccagttcttgtcaggtaagtggaccataccaccggaccctcggaatgaatgctatctggccttgtcgaagtttacgtcacatctgaaaaacctccagtctgacctaaaaagatgctttgactttttcatcgactatatggttctgctcaaaatgcggtatactcagaaagagatcgccgaaataatgttgtccaaaaaggtatcacggtgttttagaaagtacacggaattgttttgccacctcgacccttgccttctccagagcaaggagagtcaacttcttcaggaagaaaactgccgcaagaagctcgaggcgctcagggcagacaggttcgcaggtcttttggagtacctcaacccgaactacaaggacgccaccaccatggagagcattgtgaacgagtacgcttttctactgcaacagaacagcaagaagcctatgactaatgagaaacagaattccatattggcaaatatcatcttatcctgcttaaaaccaaacagtaaactcatccaacccctcacaacactgaagaagcaacttcgggaagtgctccaattcgtgggcctgagtcaccagtaccctggtccatacttcttggcctgtctgctgttttggcccgagaatcaagagctggaccaggattcaaaacttatcgagaagtatgtgtcctcattgaatcgaagctttcgtggccagtacaagcgcatgtgtagatcaaaacaggcctcgacactgttctacctaggaaagcggaaaggtctcaatagcattgtgcataaggcaaagatcgagcagtacttcgacaaggcgcagaacactaattcactgtggcactctggagatgtgtggaagaagaacgaggtgaaagatctattgagacgtctgaccgggcaggcagagggaaagcttatctccgtggagtatggaacagaggaaaaaattaagattccagtaatcagcgtatattctggccccctcagatctggccggaacatagagcgggtttctttctacctcggcttcagcattgagggaccattggcctatgacatcgaggtcatatag

SEQ ID NO: 207184 - DNA, 213 bp, Artificial Sequence
  Description of Artificial Sequence: Synthetic coding sequence
atgagcaagcaggtgagcctgcccgagatgatcaaggactggaccaaggaacacgtgaagaaatgggttaacgaggacctcaaaataaatgaacagtacggccagattctcctcagcgaggaggtaactggactcgtgctgcaggagttgacagaaaaggatctggtggaaatgggcctaccttgggggccggcgctcctgattaagcgatag

SEQ ID NO: 207185 - DNA, 213 bp, Artificial Sequence
  Description of Artificial Sequence: Synthetic coding sequence
atgagcaagcaggtgagcctgcccgagatgatcaaggactggaccaaagaacatgttaaaaaatgggtgaacgaggacctgaagataaatgagcagtacgggcaaatcctcctgagcgaggaagtaacgggcttggtgcttcaagagctcactgaaaaggatttggtggaaatgggccttccgtgggggccagctctcttgatcaaacgctag

SEQ ID NO: 207186 - DNA, 213 bp, Artificial Sequence
  Description of Artificial Sequence: Synthetic coding sequence
atgagcaagcaggtgagcctgcccgagatgatcaaggactggaccaaggagcacgttaagaagtgggtaaacgaggatctgaagattaacgagcaatacggtcagatcctgcttagcgaggaggtcactggattggtcctccaagaactcacagagaaagacctggtagaaatgggccttccttgggggcctgccctactcattaagcgatag

SEQ ID NO: 207187 - DNA, 957 bp, Artificial Sequence
  Description of Artificial Sequence: Synthetic coding sequence
atggccccctgggccgaggccgagcacagcgccctgaaccccctgagagctgtgtggctgactctcaccgctgcatttctgctaacgttgctcctgcaactcctgccacccgggttgctgcccgggtgtgcaatctttcaggacctaattagatacgggaagacaaagtgtggtgagccgtcccgacctgcagcttgtcgcgcttttgacgtgcccaagagatatttcagccacttctacataatttctgtgctctggaatggcttcctgctctggtgcttgactcaaagcttgttcctcggcgccccttttccgtcttggttgcatggactactgcgcatccttggcgccgcgcagttccagggtggtgaactcgcactgtccgcctttctagtcctggtgtttctctggctgcacagcctgcgacggctgtttgagtgtctctacgtgtctgttttcagcaacgttatgatacatgtggttcagtactgcttcggcctggtgtattatgtcctggtcggtctcaccgtcctgtcacaggtccccatggacgggaggaacgcctacatcactggaaagaacctcttaatgcaggccagatggttccatatcctcggtatgatgatgttcatttggagttcggctcaccagtataagtgtcacgtgatcctcgggaaccttcgcaaaaataaagccggcgtggtcatccattgtaaccataggattcctttcggggactggttcgagtatgtgtctagcccaaattatctcgccgaactcatgatctatgttagcatggcagtgaccttcggatttcacaatctcacatggtggcttgtggtaacgaatgtcttcttcaaccaggcgctctctgccttcctctcacaccagttttacaaaagcaagttcgtgtcttaccctaagcacaggaaagcttttcttcccttcctcttctag

SEQ ID NO: 207188 - DNA, 711 bp, Artificial Sequence
  Description of Artificial Sequence: Synthetic coding sequence
atgacccggtgccccgccggccaggccgaggtggagatggccgagctttatgttaaacctggaaacaaagagagggggtggaatgacccacctcagttttcctatggtttacagacccaagccgggggtcctaggcgctcactgctgacaaagagggtggctgccccacaagacggaagtccacgcgtacctgctagcgaaacatcacctggaccgccccccatgggtccacctccgccctcctctaaagccccccgcagtcctcccgtgggttcagggcctgcttcaggcgtcgaacctacgagcttccctgtcgaatcagaggccgtgatggaggatgtacttagacctctggagcaagccctggaggactgtcgaggacatacccgcaagcaggtgtgtgatgacatttctaggcgcctggctctgctacaagagcagtgggccgggggaaaactgtcaattccagtgaagaagcggatggctctgcttgttcaggagttgagttcccaccggtgggacgctgctgatgacatccatcgcagtttaatggtggatcacgtaactgaggtgagccagtggatggtcggcgttaaacggcttatagcagagaaacggtccctcttctctgaagaggctgcaaacgaagagaagtcagcagccacagcagaaaagaatcacacaatccctggcttccagcaggcttcctag

SEQ ID NO: 207189 - DNA, 681 bp, Artificial Sequence
  Description of Artificial Sequence: Synthetic coding sequence
atggagggctgcgtgagcaacctgatggtgtgcaacctggcctacagcggaaagttggaggagctcaaggaatcaattctcgcagataaaagtctagccacaagaaccgatcaagattctaggaccgcattgcattgggcttgttcggccggacatacagaaatcgttgaatttctacttcagctcggcgtgccagtaaatgataaagacgacgccggatggtcgcctctacatatagccgcctccgctggacgggatgagattgtgaaggcgctgctgggaaagggagcccaggtcaacgcagtgaaccagaacgggtgtacccctctccactatgcagccagcaagaataggcacgagatcgctgtgatgcttttggaggggggagctaatcctgatgccaaggaccattacgaggccacagccatgcaccgagctgctgctaagggcaacctgaaaatgatacacatcctcctctattacaaggcctcaacaaatatccaggataccgagggcaacacccctctccacttagcctgcgacgaggagcgcgtcgaagaggctaagttactcgtgtctcaaggcgccagcatctacattgaaaataaagaagagaagacccctctgcaggttgccaagggcggattaggtctgatactgaaaaggatggtagagggctag

SEQ ID NO: 207190 - DNA, 780 bp, Artificial Sequence
  Description of Artificial Sequence: Synthetic coding sequence
atggccaccgccaccggcgtggccgaggagcggctgctggccgcccttgcttatttgcagtgcgccgttggttgtgctgtattcgctagaaaccgtcagaccaacagcgtgtatggtaggcatgccctgccttctcatcggctcagagtcccggcgcgcgcagcctgggtggtgcaggaactcccctctctggccctgccactgtatcagtacgcttccgagtcagccccgcgactcagatccgcgccgaattgcatccttcttgcaatgtttcttgtgcattatgggcacagatgtctcatttacccctttctaatgcgcgggggtaaacctatgcccctgctggcctgtacaatggccatcatgttctgcacttgtaatggctaccttcaaagccgatacttatcccactgcgctgtgtatgccgacgactgggtgacggacccccggtttctcataggcttcgggctctggctaaccggaatgcttataaacattcactccgatcacatattaagaaatttaaggaaaccaggtgacaccggatacaaaattccgagggggggacttttcgaatacgttaccgctgctaattatttcggggagataatggagtggtgcggatatgcactcgcttcctggtcagtgcagggcgctgcattcgctttcttcactttttgcttcctgagtggcagagctaaggaacatcacgaatggtatctgcggaagttcgaagaataccccaaattccgcaagattataatcccatttctcttttag

SEQ ID NO: 207191 - DNA, 585 bp, Artificial Sequence
  Description of Artificial Sequence: Synthetic coding sequence
atggagcacgccgcccagccctggcggtggcagcggcggcggggctggaggcggagtgcttgttggccaagatcccccacatgtagcgcaccatgggctgcccgaagctcaagggccatcgtgcgacgaactcagtgcactgctgcgacgcgttgtcccgctacagggagcgagtgtcgtagaggaccacctgggtggtgcaggagttgcccgcgatggccctgtcggagcacctcaacgcctgcctcccctcccagagtgagcgctgcccgccctaccgctagttcttggccctgcagtagcagcactactggcatcgggaatgtgggtatgcaagccctggctgtctgtctccaccctaaatgtcaaccgatggtgcccatcgtatgcccggacctgaaccatgactccaagacccaaagagaaattgcgggtatcagatgctcatatagccttctgggcaataccgccgctagccggagaattccaactagcctgatgacccagcacctcaatgcccacttgctggcgaatacatgctttgcagtgaaccagtatgaggtttttctgggagttctggcctag

SEQ ID NO: 207192 - DNA, 639 bp, Artificial Sequence
  Description of Artificial Sequence: Synthetic coding sequence
atggagcacgccgcccagccctggcggtggcagcggcggcggggctggcgacgtagtgcatgctggcccagaagccctacttgttcagccccatgggccgcacgctcaagcagggctattgtcagacggacccagtgcaccgcagctacgaggtgtcctgccaccggcagcgaatgtagacgggggcctccaggctggtgtcgctcatgtccgcggtggccctgccggtccacaagcaccccagcttctccacctagagtgtcagctgcccgccccacagcatcttcatggccatgtagttctagtacgactggcattggtttcggattatggctaacgggaatgctgattaatatccatagcgatcacattctcaggaacctgagaaaaccaggggacacaggctacaagataccacgcggcgggctgtttgaatatgtgacagcggcaaactacttcggggagatcatggagtggtgtggttatgccctagcaagctggtctgtgcaaggggctgcattcgccttttttaccttctgtttcctctctggacgggcaaaagaacaccacgagtggtatctgcggaaatttgaggagtacccaaagtttcgcaagatcatcattccatttctgttttag

SEQ ID NO: 207193 - DNA, 858 bp, Artificial Sequence
  Description of Artificial Sequence: Synthetic coding sequence
atgctgctggccaccttcaagctgtgcgccggcagcagctaccggcacatgagaaacatgaagggtctgagacagcaggcagtcatggccatctcgcaggagttgaatcggagagccctaggcggccccactccgtctacctggattaatcaggtccgccggcggagcagcttgctggggtcccggctggaggagaccctgtacagtgaccaggagttggcctacttgcagcaaggtgaagaagccatgcaaaaggccctgggtattctgtcaaatcaggaggggtggaagaaggagtcccagcaggacaacggcgacaaagttatgtcaaaagtggtgccggatgtggggaaagtcttccggctcgaagttgtcgtggatcagccaatggagcgcctatacgaggaactcgtggaaagaatggaagcgatgggtgagtggaaccccaatgtgaaggaaattaaggtgttgcaaaagatcgggaaggacacctttataacccatgagttagccgccgaagccgccggtaatctggtcgggccccgggatttcgtgagcgtaaggtgtgccaagagaagaggttcaacttgcgtgctcgcagggatggcaacagattttgggaatatgcccgaacagaagggggtgatcagagcggaacacggcccaacttgcatggtactgcaccccttggcaggatcaccctctaagactaagctgacatggctcttgtctatcgatctgaagggatggttacccaaaagcatcattaaccaggtactctctcagacacaggtagattttgctaatcacttgcggaagaggctcgaatcccatccagcctctgaagcccggtgttag

SEQ ID NO: 207194 - DNA, 744 bp, Artificial Sequence
  Description of Artificial Sequence: Synthetic coding sequence
atgctgctggccaccttcaagctgtgcgccggcagcagctaccggcacatgcgtaatatgaagggttctcggctggaggagactctttacagtgatcaagagctcgcttatctccaacaaggtgaagaagcaatgcaaaaggcgctggggattctgagcaatcaagagggttggaagaaggaatctcaacaggataatggagataaagtgatgtcaaaagtggtgccggatgttggcaaagttttcaggttagaggtggtcgtcgaccagcccatggaaaggctgtacgaggagttagtagaaaggatggaagcaatgggagagtggaatcccaatgtgaaagaaattaaagttctccagaagattggcaaggatacttttatcacccacgagctcgccgccgaggcagcgggcaatctcgtcggcccgagggactttgtttctgtgcgttgcgccaagcgacgtggttccacctgcgtgctcgctggtatggcaactgactttgggaacatgccagaacagaagggagtgatccgagctgagcacggtccgacgtgcatggtcctccatccattggctggatctccttccaaaactaaattgacttggcttctctctatcgacctcaaggggtggctgcccaagtctatcattaatcaggtcttgagccaaacccaggtggacttcgctaaccacttaagaaagcggctggagagccaccccgctagcgaggcacgttgttag

SEQ ID NO: 207195 - DNA, 969 bp, Artificial Sequence
  Description of Artificial Sequence: Synthetic coding sequence
atgagcagcagcccctgggagcccgccaccctgcggcgggtgttcgtggttggagtcggaatgaccaaatttgtaaagccaggagctgaaaattctcgggattacccagacttggctgaggaggccgggaaaaaggcactagcagacgcacagatcccctacagcgccgttgatcaggcctgtgtagggtatgtctttggcgtggccgagtgcgttctggcactcgggttcgagaagatgtccaagggctcgctgggcattaaattctccgacaggacaatccccacagacaagcacgtcgatctgctcattaataagtatggcttgtccgctcatccggtggctccgcaaatgttcggctatgccggcaaggagcacatggagaaatatggtactaagattgaacattttgctaagatcggatggaagaaccacaagcacagcgtaaacaatccgtattcacagttccaggacgagtactccctcgacgaggtcatggctagtaaagaggtcttcgactttttaactattcttcagtgctgccccacttcagatggagcagccgctgcaatactcgcttcagaggctttcgttcagaagtacggtctccagtcaaaggcagtcgagattcttgcccaggagatgatgaccgatttgcccagcagctttgaagagaaatccatcatcaagatggtgggatttgatatgtctaaggaagcggcacggaagtgttacgaaaagagtggtctgacaccaaacgatattgatgtcattgaacttcatgattgcttctccacgaacgaactcctaacatacgaggccctgggactgtgtcccgagggacagggggcaacccttgttgacagaggggacaatacctatggggggaagtgggtgattaatccctcaggaggtctgatcagcaaaggccaccccctgggggctacgggaggccattcctgctcctag

SEQ ID NO: 207196 - DNA, 1644 bp, Artificial Sequence
  Description of Artificial Sequence: Synthetic coding sequence
atgagcagcagcccctgggagcccgccaccctgcggcgggtgttcgtggtaggcgtgggaatgacaaagttcgtaaaacctggagctgagaactcgagagattaccccgatctggctgaagaagcagggaaaaaggctcttgccgatgcccagattccatattcagccgttgaccaggcttgcgttggctatgtgtttggcgactctacgtgtggccaacgagccatttatcactccctgggtatgacgggtattcccatcattaatgttaataataactgcgcaacaggatccacagccctgttcatggctaggcaactgatccaggggggggtggcagaatgcgtgctcgctctgggctttgagaaaatgagcaagggatctctcggaatcaagttttctgatcgaacgatacctaccgacaagcacgtagaccttttaattaacaaatacggcctcagcgcccacccggtcgccccacagatgttcggctatgccggcaaggaacacatggaaaaatacgggaccaaaatcgagcattttgccaagatcggttggaaaaatcacaaacactctgtgaacaacccctactcccagtttcaggacgagtactcactggacgaggtaatggcatccaaggaggtcttcgactttctgacaatcttgcagtgttgtcctaccagcgatggtgctgcggccgcaattctagccagtgaggcctttgtgcaaaaatatggccttcagtccaaagctgtggagatcctggcacaggagatgatgaccgacctgcccagcagttttgaagagaagagtattataaaaatggtgggctttgacatgagtaaagaagctgcccgtaagtgctatgaaaagagcggcctcactccaaatgatatcgacgtaattgagctgcacgactgcttctccaccaatgagctgttaacctatgaggctctgggtctatgccccgaggggcaaggcgcaaccctggtggatcgcggggacaacacttatggcggcaaatgggtaatcaacccttccggaggcttaatttcaaaaggccacccattgggtgctacgggacttgcacagtgtgctgaactttgctggcagctgaggggagaggcgggcaagcgtcaggtgccaggagcaaaggttgccctgcaacacaacctaggcatcgggggcgctgtagtggttaccctgtataaaatgggcttccctgaggccgcgtcatccttccggactcaccagatcgaggccgttccgacgtctagtgccagcgatggcttcaaggctaacctcgtatttaaggagattgaaaagaagctggaggaggaaggcgaacaattcgtgaagaaaataggggggatcttcgcatttaaggttaaggatgggcctggaggcaaagaggccacttgggtcgtggatgtgaaaaatggaaagggaagcgtgctccccaatagcgataaaaaagctgactgtaccatcacgatggctgattcagacttcctcgctttgatgaccggcaaaatgaaccctcagtcagccttctttcaggggaagctaaaaattacaggcaatatgggtctcgccatgaagctacagaacctgcaattgcagccagggaacgcaaagctttag

SEQ ID NO: 207197 - DNA, 1572 bp, Artificial Sequence
  Description of Artificial Sequence: Synthetic coding sequence
atgagcagcagcccctgggagcccgccaccctgcggcgggtgttcgtggtcggggttggcatgaccaagttcgttaaacccggggcggagaactcgagagactatcctgatctcgccgaggaggcgggcgactcgacatgcggacagagggcaatctatcattcactgggaatgactggtataccaataattaatgtaaataataactgtgccacgggctcgacagccttgttcatggcccgccagttgattcagggcggcgtcgccgagtgcgtgctggctctcggattcgaaaagatgtcaaaggggtccctgggaatcaaattcagcgatcgcaccatcccaaccgacaaacacgtggaccttctgataaacaagtacggtcttagtgcccacccagttgccccccaaatgtttggttatgctggcaaggaacacatggaaaaatatggaaccaaaattgaacatttcgccaaaattggctggaaaaatcacaaacactcagtgaacaatccctactcccagttccaggatgagtactccctggatgaggtgatggcctcaaaggaagtattcgatttcttaaccattttgcaatgctgtccaacttctgacggcgcggccgctgcgatactggcatcggaggcgtttgtccaaaagtacggcctgcaaagtaaagctgttgagatcctagcacaagaaatgatgacagaccttccctcttcctttgaggagaaatcaattatcaagatggtgggatttgatatgtcgaaggaagctgcacgcaagtgttatgagaaaagtggtctgacacccaatgatattgacgtgattgaactgcatgactgttttagtacaaacgagttactgacttacgaggctctcgggctctgcccagaaggacaaggagctaccctggtggacagaggtgacaatacctacggaggtaagtgggtgattaatccgagtggcgggttaatttccaaaggtcaccctctcggcgccactggcctggcacagtgtgctgaactctgctggcagttgaggggagaagccggcaagagacaagttcctggggccaaggtagccctgcagcataaccttggcattggcggggcggtagtagtgacactgtataaaatggggttccctgaagccgcatctagtttccgcactcatcagatcgaagccgtccctacatcaagcgcttctgatgggttcaaagccaatctagtcttcaaagagattgagaagaaattggaggaagaaggcgagcagtttgtgaagaaaataggagggatattcgctttcaaagtgaaggatgggcccggtgggaaggaggcaacatgggtcgtggatgtgaagaacgggaagggttcagtactccccaactccgataagaaggctgattgtaccatcacgatggctgactctgattttctggcgctcatgaccggtaaaatgaatccccagtctgcctttttccagggcaagctcaaaatcaccggaaacatgggcctagctatgaaacttcaaaatttgcagttgcaaccaggaaatgcgaagttgtag

SEQ ID NO: 207198 - DNA, 180 bp, Artificial Sequence
  Description of Artificial Sequence: Synthetic coding sequence
atgggcttccccgaggccgccagcagcttccggacccaccagatcgaggccgtgcccacttcatccgcgtcagatggtttcaaagccaatctcgtattcaaagagattgagaaaaagctagaagagatcaggcgcctgaccgctcaatctcagtggctgactcagacgagctggctatag

SEQ ID NO: 207199 - DNA, 423 bp, Artificial Sequence
  Description of Artificial Sequence: Synthetic coding sequence
atgggcttccccgaggccgcccggacccaccagatcgaggccgtgccaactagctccgcttccgacggctttaaggccaatctcgtgtttaaggagattgagaagaaacttgaggaggagggcgaacagttcgttaagaaaataggcggcatctttgcgtttaaagtgaaagacgggccaggcggcaaggaggccacttgggtggtggacgtgaaaaatgggaaggggtccgtgctccccaactctgataagaaagcagattgtacaatcaccatggcagactccgatttccttgctttgatgaccggcaagatgaacccacaaagcgccttcttccaaggaaagcttaagatcacgggaaatatgggcctagcgatgaaactccaaaacctccagctacaacctggcaacgctaagctctag

SEQ ID NO: 207200 - DNA, 432 bp, Artificial Sequence
  Description of Artificial Sequence: Synthetic coding sequence
atgggcttccccgaggccgccagcagcttccggacccaccagatcgaagctgtaccaaccagtagtgcctctgacggctttaaggcaaatttagtgtttaaggagatagagaaaaagctggaggaggagggggagcagttcgtgaagaaaatcggcggaattttcgctttcaaggtgaaggatggccctggcggtaaagaggctacttgggtcgtggatgtgaaaaatgggaaagggagcgtgctacctaactccgacaaaaaagctgactgcaccatcactatggccgactctgactttctggcgctcatgacaggtaaaatgaacccacagagcgccttttttcagggcaagctcaagattacaggcaacatgggactcgctatgaaactgcagaacttacagctgcaaccagggaacgctaagctgtag

SEQ ID NO: 207201 - DNA, 180 bp, Artificial Sequence
  Description of Artificial Sequence: Synthetic coding sequence
atgggcttccccgaggccgccagcagcttccggacccaccagatcgaggccgtacccacctctagcgccagcgacggctttaaggccaacctggtctttaaggaaattgaaaaaaagcttgaagaaatcagaagactgacggcccagagtcagtggctgacacagaccagttggttgtag

SEQ ID NO: 207202 - DNA, 1401 bp, Artificial Sequence
  Description of Artificial Sequence: Synthetic coding sequence
atgaccggcatccccatcatcaacgtgaacaacaactgcgccaccggatcaaccgccctatttatggcaaggcagctgattcaaggcggtgttgcggagtgcgtgctcgccctgggattcgaaaagatgtcgaaggggagtctgggcatcaagtttagcgatagaactatccccactgacaagcatgtggacctactgattaacaagtacggattgtcagctcaccccgtggctccccagatgttcggctacgccggcaaagagcatatggagaaatacggaacgaaaatcgagcattttgctaagatcggctggaaaaaccacaagcactccgtgaataatccctactcccagtttcaggacgaatactccctcgacgaggtcatggcctcaaaagaagtttttgactttcttactattctgcaatgttgtcctacttcggacggtgctgcagcagcgattctggcctcagaggctttcgtccagaaatacgggctacagtcgaaggcagtggagattctggcacaggaaatgatgaccgacctaccttcatcttttgaggagaagtcaattattaagatggtggggtttgatatgagtaaagaagccgcgcgaaagtgctacgagaaaagcggactcacccccaacgacattgacgtgatcgaactgcatgactgtttttctacaaacgagctgctcacatacgaagctctgggtttgtgtccagaaggccaaggggcgactctcgtggatcgaggcgataacacttatggtggaaaatgggtcattaaccctagcggtggacttatctcaaaagggcaccccctgggagctaccggcctggcacagtgtgccgaactttgctggcagctgagaggcgaggcgggcaagcgccaggttccaggtgctaaagtggccctgcagcataacctcggcatcggcggcgctgtggtggtgaccttgtataaaatgggcttccccgaagccgccagcagtttccgcactcatcaaatcgaggctgtaccaacatcctccgctagtgatggcttcaaggcgaatttagtgtttaaagaaatcgagaagaagctcgaggaagagggcgaacaattcgttaaaaaaatcgggggtatcttcgccttcaaggtcaaggacgggcccgggggaaaagaagccacatgggtcgtggatgtgaaaaacggcaaaggcagtgtcctacctaacagtgacaaaaaagcagactgcaccattacaatggcagatagtgatttcctcgccctgatgaccggaaagatgaacccacaaagtgctttcttccagggtaagctgaagattaccggaaatatgggcttagccatgaagctgcaaaatctgcaactccagcctggaaacgccaagttgtag

SEQ ID NO: 207203 - DNA, 1512 bp, Artificial Sequence
  Description of Artificial Sequence: Synthetic coding sequence
atgagcagcagcccctgggagcccgccaccctgcggcgggtgttcgtggtgggggtgggcatgactaagttcgtcaagcctggtgccgagaacagccgggactatccagacttggcagaggaggcaggaaagaaggcccttgccgatgctcaaataccatatagcgcagtagatcaggcatgcgtgggctacgttttcggcgttgccgaatgtgtactggccctagggtttgagaagatgtccaaaggatcccttggcatcaaattctcagataggacaatccctactgacaagcacgtggatcttctgatcaacaagtatggactatcagcgcaccccgtggctccccagatgtttggctatgccggcaaagagcacatggagaagtacggtacaaaaatagagcattttgccaaaattggatggaaaaatcataagcacagtgtcaacaacccctatagccagtttcaggacgaatactcactcgacgaggtcatggcgtcaaaggaggtgttcgatttcctgacgatccttcaatgttgtccaacatccgacggtgctgcggccgcgattttggcttcggaagctttcgtccagaaatacggcctgcagagcaaagcagtagagatcctggcccaggaaatgatgacagatctgcccagctcatttgaggagaaaagcatcatcaagatggtgggcttcgatatgtctaaggaggcagcccgaaagtgctatgagaagtccggtttaactcctaacgacatcgacgtgatcgaactgcatgactgtttttccacaaacgagctgttgacttacgaagctttgggcttgtgtcctgaaggtcagggggctaccctggtcgatcgcggggacaatacgtatggaggtaaatgggtgataaatcccagtggcgggctcatcagcaagggacatcctcttggtgcgactggactggcccaatgtgccgaactgtgctggcagctcaggggcgaagccgggaaaagacaggtgcccggagctaaagtggctctgcaacacaatttgggcattgggggagccgtggtggtgaccctctacaagatgggttttccagaagcggccagttcttttcgaacccaccagatcgaggccgtgccaacttcaagcgcgagtgacgggtttaaagcaaacctcgtatttaaggagatcgagaaaaaactggaggaggaaggtgaacagtttgtgaagaaaattggcggcatctttgccttcaaagtgaaggatggtccgggcggcaaggaagccacatgggtcgtggacgtcaagaatgggaagggaagcgttcttcctaattcagacaagaaagccgactgtacgataacaatggcagacagcgatttcctggcactgatgacgggcaaaatgaatccccagtctgcattctttcaggggaaattgaagatcacgggaaacatgggtctcgcaatgaagctacaaaacttacaactgcagcctgggaacgcaaaactgtag

SEQ ID NO: 207204 - DNA, 1653 bp, Artificial Sequence
  Description of Artificial Sequence: Synthetic coding sequence
atggtgggcgaggagaagatgagcctgcggaaccggctgagcaagtccagagaaaatccagaggaggatgaagatcaaagaaaccccgcgaaggagagtctcgagacgcccagcaacgggagaattgacattaagcagttgattgccaaaaaaatcaagctaactgccgaagcggaggagttaaagcctttcttcatgaaggaggtcgggtctcatttcgacgattttgtgaccaatctgattgaaaagtcagcttcattagataatgggggctgtgccctcacaacattcagcgtgctggagggtgaaaagaacaatcaccgagccaaggacttgagggctcctcccgaacaggggaagattttcattgcaagaagatcacttctcgatgaactgctggaggtagatcacatcaggaccatctaccatatgttcattgcacttctgatcctcttcattttgtctaccctcgtcgttgactatatcgacgagggacgacttgtgttagaattctccctcctgagctacgccttcgggaagtttccaacggtcgtgtggacttggtggattatgttcctcagtacctttagcgtcccatacttcctgtttcagcattgggcaacagggtacagcaagagttcacacccactgatccggtccctgttccacggattcttgtttatgatcttccagatcggagtgctgggattcggccccacctatgtagtgctggcttacacactgcctcccgctagccggttcattattatttttgagcaaatccgctttgtgatgaaagctcactcctttgtcagagaaaacgtcccacgagtgttgaattccgccaaggaaaaaagttccactgtgccgatcccaaccgtcaaccagtacctctatttcctctttgctccaacactgatctaccgcgactcatatccgcgcaaccctacagtccggtggggctatgtggctatgaagttcgctcaagtctttgggtgcttcttctatgtctactatatttttgaaaggttgtgcgcacctctcttcaggaacataaagcaggaacccttcagcgcccgtgtactagttctatgcgtttttaactcgatcttgccgggcgtgctgatccttttcctcacatttttcgcctttctgcactgctggctaaatgctttcgcagagatgttgaggttcggggatagaatgttctataaggactggtggaatagtacttcttacagcaattactacaggacatggaacgtagtagtgcacgattggctgtattactacgcatataaggacttcctgtggttttttagtaagagattcaagtctgcagccatgctggcagtctttgccgtatctgctgtagttcatgaatacgcccttgcagtttgcttgtcgtttttttacccagtgctctttgttttatttatgttcttcggcatggctttcaactttatcgtgaatgacagtcgaaagaagccgatctggaatgtcttgatgtggacttcactgtttcttggcaatggggtgctgttatgcttttatagccaggagtggtacgctagacagcactgtcctctgaagaaccctacattcctggattacgttcgcccacgctcttggacttgcaggtacgttttctag

SEQ ID NO: 207205 - DNA, 783 bp, Artificial Sequence
  Description of Artificial Sequence: Synthetic coding sequence
atggtgggcgaggagaagatgagcctgcggaaccggctgagcaagagccgtgagaaccccgaggaagacgaagaccagaggaatcccgctaaagagtccctggaaacaccttccaatgggagaatcgacattaaacaactgatcgccaaaaagattaagctcaccgccgaggctgaggagttgaaacccttcttcatgaaggaggtcgggtcccatttcgacgatttcgtgaccaacctgatagagaaaagcgcgagtcttgataacggcgggtgcgcccttacaacgttctctgtgctcgaaggtgaaaaaaataaccatcgcgcgaaggacttaagagctccccctgagcagggtaagatatttattgctcgccggtctcttctggatgagctcctggaagtggatcacatacggaccatttatcatatgtttattgccctgctgatcctgtttatcctgtcgactctggttgtggactatattgatgaagggcgcctggttcttgaatttagcctccttagctatgccttcgggaaatttcccacggtggtctggacttggtggataatgttcctgagtacattttccgtgccctatttcctgtttcaacactgggccactggctattccaaatcttcccatcccttgattcgaagcctttttcatgggttcctgtttatgatcttccagataggcgtgttaggatttggtcccacctacgttgttctcgcatacactctgcctccagcatcacggttcatcatcattttcgagcaatag

SEQ ID NO: 207206 - DNA, 861 bp, Artificial Sequence
  Description of Artificial Sequence: Synthetic coding sequence
atgaaggcccacagcttcgtgcgggagaacgtgccccgggtgctgaatagcgctaaagaaaaatcctctaccgttcctatcccgaccgtgaaccagtatctgtatttcctctttgctcccactctgatatatagggacagctacccccggaatcccactgtccgctgggggtacgttgctatgaaattcgcacaggttttcgggtgttttttctatgtgtactacattttcgagcggttgtgtgcacccttgtttcgcaatatcaagcaagaaccttttagcgccagggtgctggtattatgcgtatttaactctattctaccgggcgtgctgatccttttccttacattcttcgcctttctccattgctggctgaacgcgtttgccgaaatgcttcgcttcggcgatcgaatgttctacaaagattggtggaattcaactagctacagcaactattacagaacttggaacgtcgtggtacacgactggttatattattatgcttataaagacttcctctggtttttcagcaagaggttcaagtctgcagctatgctggcggttttcgccgtgagcgcggttgtgcatgagtacgctctcgccgtgtgtctgtctttcttctaccctgtgttgttcgtactcttcatgttcttcggtatggccttcaatttcattgtaaacgactcgaggaaaaaacccatttggaacgtgctgatgtggacatctctgtttctggggaatggggtcctcctgtgtttctattcccaggaatggtacgccaggcagcactgcccgctaaaaaacccgacctttcttgactacgtccgccccaggtcttggacgtgtcgttatgtcttttag

SEQ ID NO: 207207 - DNA, 1458 bp, Artificial Sequence
  Description of Artificial Sequence: Synthetic coding sequence
atgaaggaggtgggcagccacttcgacgacttcgtgaccaacctgattgagaagagcgcctctcttgataacgggggctgtgccctgactaccttctcagtattggagggtgagaagaataaccaccgtgccaaggatcttagggcccccccagaacaaggcaagatctttatcgcgcgacggtcccttctggacgaactgctggaagtcgatcatattcgcactatctatcatatgttcattgcgctactgatcctgtttatcctatccacactggttgtcgactatatcgatgagggcaggcttgtgctcgaattttcgcttctctcctacgccttcggtaaattcccaacggtcgtgtggacctggtggataatgtttctcagtacattcagtgttccctacttcctttttcaacattgggcaaccggatacagcaaatcctctcatcccctgattcggtccctgtttcacggctttctttttatgatttttcagataggagtcttggggttcggacccacttatgttgtgcttgcctatacgctaccaccagcatccagattcataatcatttttgagcagatccggttcgtcatgaaagctcatagtttcgttcgagaaaacgtcccgcgtgtgctaaatagcgctaaggagaagagcagtactgtgcctatcccaaccgttaatcagtatctgtactttctgtttgctccaactttgatataccgcgattcttaccctcgtaaccccaccgtccgctggggatacgtggccatgaaatttgcccaagtatttggttgtttcttttatgtttattacatcttcgagcggctctgtgcacccctgttcaggaatattaaacaggagcctttttccgcaagagtgctagttctctgcgtgttcaattccatactgcctggtgtgcttatcctgttccttacctttttcgccttccttcactgttggctgaacgcctttgccgagatgctgagattcggtgatcgtatgttttacaaagattggtggaatagcaccagctattcaaactactacagaacttggaacgttgtcgttcatgactggctgtattattatgcgtacaaagatttcctgtggtttttttccaaacggtttaaatcagccgcaatgctggcggtttttgctgttagcgccgtcgtccatgagtacgccctggccgtgtgcctatcttttttttaccccgtgctgtttgtgttgttcatgtttttcggcatggcttttaattttattgttaatgactcacgtaagaaaccaatctggaacgtgttgatgtggactagtctgtttttggggaacggggtgcttttatgcttttatagtcaggaatggtatgctagacagcattgcccactgaagaaccctacctttctggactatgtccgacctcgcagctggacctgccgttacgtcttctag

SEQ ID NO: 207208 - DNA, 1479 bp, Artificial Sequence
  Description of Artificial Sequence: Synthetic coding sequence
atggagctgaagcccttcttcatgaaggaggtgggcagccacttcgacgattttgtcaccaacctcatcgagaagtcagcttccctggataatggcggatgtgcgctcacaaccttcagcgtcctagagggggagaagaataaccacagggctaaagacctccgagcccctccagagcaggggaagattttcatcgctaggcgctcgctgcttgacgagctgctggaagtggaccatatacgcactatctaccacatgttcattgccttgcttattctgttcatcttgtctaccttggtggtggactatatagacgaaggaaggttagttctggaatttagcttgctctcttatgccttcggaaagttccccactgtggtttggacgtggtggatcatgtttctgagtaccttcagtgtcccctattttttgttccagcactgggccacaggctattccaagagctcccaccccctaattcgatccctcttccatggatttctctttatgatattccaaataggcgtactgggctttggacccacttacgttgtactggcctatacattgcccccagcctctcggttcatcatcatttttgaacagataaggtttgtgatgaaggctcactctttcgtgcgggagaacgtgccccgcgtcctaaactcggcaaaagagaaatctagcacagtcccaatcccgacagtcaaccagtacctgtattttttgttcgcccctacacttatatatcgggattcataccctcgtaaccccacagttcgatgggggtatgtggccatgaagttcgctcaggtcttcggctgcttcttctacgtgtactacattttcgaaaggctgtgcgcccctctgttcagaaatatcaaacaggaaccattcagtgcacgagtcctcgtgttgtgcgtgttcaattccatactgccaggggtcctcatcctcttccttacattttttgccttcctacactgctggctgaatgcttttgccgaaatgctccggttcggggatagaatgttctataaggactggtggaattcaactagctattcgaactactatcgtacttggaacgtggtggtccacgactggctgtactattacgcctacaaagacttcctctggtttttttccaagcgctttaagagtgctgcgatgctcgcagtgttcgctgtgagtgccgtcgtgcacgaatatgccctggcggtgtgtttaagttttttctacccagtgctgttcgtgctgttcatgttttttggaatggcgtttaactttatcgtcaacgactcacggaagaagcccatttggaatgttctaatgtggacctcactgtttcttgggaacggcgtcctactgtgcttctatagccaggaatggtatgcaagacagcattgccccctcaaaaacccgacattcctggactatgtgaggccccgctcctggacctgtcgctatgtgttttag

SEQ ID NO: 207209 - DNA, 1569 bp, Artificial Sequence
  Description of Artificial Sequence: Synthetic coding sequence
atggagcccggcggcgcccggctgcggctgcagcggaccgagggcctgggcggtgaaagagaacgtcagccatgtggcgacggtaataccgagacacaccgggcgcccgatcttgtgcagtggacacgacatatggaggccgtgaaggctcaactcttggagcaggcacaaggccaactgcgagaactcctggaccgggcgatgagggaagccattcaatcctaccccagtcaagataagccacttccccctccacctcccggctcgttgagtaggactcaagaacccagcctcggcaagcaaaaagtttttattatccggaaatcgcttctggatgagttaatggaagtccagcactttcgaactatataccatatgttcatcgctggtctatgtgtgttcattattagtactctcgctatcgattttatcgatgagggccgcctgctgctggagttcgacctgctgatattctcttttggacaattacccctcgccttggtgacttgggtgcctatgttcctatctacactgctcgcaccataccaggccctgagattgtgggcccggggcacctggactcaggccacaggcctcggatgcgcactcttagctgctcatgccgtggtcctttgcgcactgcctgtgcacgtcgctgttgaacaccagctgccgcccgcctctcgttgcgttcttgttttcgagcaagtgcgctttttaatgaagtcttactcgttccttagggaggcagtgcccggcacattgcgggcccgtcggggagaggggatccaggcacccagtttcagctcctatctgtactttcttttctgccctacactcatctatagagaaacctaccccaggaccccttacgtccgttggaactacgtggcaaagaactttgcccaagccttgggatgcgtgctttacgcctgcttcatcttaggccgcttgtgcgtaccagtcttcgctaatatgtcaagagagccgtttagcacaagagccctggtgctgtcaatccttcatgccactctgccgggaatctttatgctgttgctgatcttcttcgcatttctccattgttggttgaacgcctttgctgagatgctcaggtttggagaccgcatgttctatcgagactggtggaattccacatctttcagcaactactaccggacttggaatgtcgtcgtccacgactggttatactcctatgtttatcaggacggccttagactgttgggtgcccgcgctagaggtgtagccatgctcggtgtcttccttgtgtcagcagtggcccatgaatatatcttttgttttgtgttgggctttttttaccctgtgatgctgattctctttcttgtgatcggcggtatgctcaattttatgatgcacgatcagaggaccggacccgcttggaacgttctgatgtggaccatgctttttctagggcagggcattcaggtttctctgtactgccaagagtggtatgccaggaggcactgcccattgccccaagccactttctgggggttggttaccccgcggagttggtcatgtcatacttag

SEQ ID NO: 207210 - DNA, 3426 bp, Artificial Sequence
  Description of Artificial Sequence: Synthetic coding sequence
atggacgacagcggcgagctgggcggcctggagaccatggagacccttacagaactaggagacgagctgactctcggagacatcgatgagatgcttcagtttgtctccaaccaggtaggagagtttccggatttgtttagtgagcagttatgctcaagctttccaggcagtggaggaagcggttcctctagcggcagttccggaagctcatcttcatcctctaacggaaggggctcatcaagtggcgccgtagatccctctgttcagaggagctttacccaggtgaccctcccatcctttagtccaagcgccgcgagccctcaggcccctaccctgcaggtgaaggtgtcccctactagtgtgcccactaccccgagagctactccaatattgcaaccaagacctcaaccacaacctcagccgcagacccagctgcagcagcagactgtcatgattacacccacattcagcactactccacagactagaatcatacaacagcctctcatctaccagaacgctgccaccagcttccaagtgcttcagccgcaggtacaatccctcgtaacctcttcacaggtgcagcccgtgaccatacagcaacaggtccagactgtccaggcgcagagagtgctcactcagaccgcaaacgggaccctgcaaactctcgccccagctacagtgcaaaccgtcgctgccccccaggtacagcaagtgccagtgctggtccagcctcagattattaaaactgactctttggtgctcacaactctcaaaaccgatgggtcacccgttatggcggccgtccagaatcccgccctgacggctctgaccacaccgatccaaacggccgcgttacaagtgcccacactggttggaagctctggaaccatcctaactaccatgcccgtgatgatgggccaagagaaggtgccaattaaacaggtccccggcggagtaaaacaactagaacctcctaaggaaggggagcgtagaaccacgcacaatattatcgagaagagatacagatcatccatcaacgacaaaattattgagctgaaggatctggtgatgggcactgacgcaaagatgcataaaagtggcgtcttacgtaaagcaatcgactatattaagtacctgcagcaggttaaccataaacttcgacaggagaatatggtgttgaaattagctaatcaaaaaaataagctgctgaaaggtattgatctggggtccctggttgataatgaagtagatttgaaaatcgaggactttaaccagaatgtgttactgatgagtcctcccgcgagtgattcaggctcccaggcaggcttcagtccttacagcatagacagcgaaccaggtagtccactcctggatgacgccaaggtaaaggacgagccagattctccaccagtcgctctcggcatggtggataggtccaggatcctgctttgcgttctgacctttttgtgcttgagtttcaacccactgacatcccttctacagtggggcggggcccatgattctgaccagcacccacacagcggcagcgggagatccgttctgtctttcgagagcgggtctggcggttggttcgactggatgatgcctaccctgctgctatggctagtgaatggcgtcattgtcctgtctgttttcgtaaaactgttagttcatggcgaacccgtcatacggccccattccagatcgagtgtaacgttttggcgacaccgaaaacaggctgatctggatctggcacggggcgatttcgccgctgctgccggtaacctccaaacatgcctcgctgtcctgggaagggccctacccacgtcccgtctggatttggcatgttctctatcttggaatgtcatccggtatagcctgcagaagctgagactagtcagatggctcctgaaaaaggtgttccagtgtaggagggctactccagctaccgaggcaggattcgaagatgaggccaagacgagcgctcgggatgccgccctggcataccatagattacatcagctgcacatcaccggcaaattgcccgccggaagcgcatgttccgacgtgcacatggctttgtgcgcagttaatcttgctgaatgtgctgaggagaagatcccccctagcacattggtagaaatccacttgaccgcagcaatggggcttaaaactcgatgtggcgggaaactcgggtttctagcgtcttatttcctgtcccgcgcccagtcactctgcgggcccgaacacagcgccgtgcctgacagcctgaggtggctgtgccacccactgggacaaaagttcttcatggagcgctcctggagtgtgaaatcggcggctaaggaaagcctgtactgcgcccagcgcaaccccgccgatcccattgcccaggtgcatcaggccttctgtaaaaatctcttagaacgggcgatcgagtccttggtgaagccacaggccaagaagaaggctggtgatcaggaagaggagagctgtgaattctcttccgcgctggagtacctgaagctgctacactcctttgttgattcagtgggcgtcatgtctcccccgctatctagatcctccgtgctgaagtcggccctggggccagacatcatttgcaggtggtggacttcagcaatcacagtggcaatctcctggctgcagggtgatgatgcagccgtgcggagtcatttcactaaggtagaaagaatccctaaagccttggaggttactgaaagccccctagtgaaggccatcttccacgcctgcagggccatgcacgcatccctgcctggcaaggccgatggacaacaaagttctttttgtcattgcgagcgggcctccggacacttgtggagctcccttaacgtgtccggggcaacaagcgaccccgcgcttaaccacgtggttcagttgttaacatgcgacctgttgttatctctgaggacagcattatggcagaagcaggctagcgcgagccaggccgtgggagaaacctatcacgcgagtggcgccgagttggctggatttcaaagggacctggggagcctgcgtcgcctcgcacactcgtttcggcctgcatacaggaaagtttttcttcacgaagctactgtgcggcttatggctggagcctctccaacacgtacccatcagctgctcgaacactccctgaggaggaggactacccagtctactaagcacggcgaggttgatgcttggccgggacagagagagagagcaaccgcaatactcttggcctgccgccatctgccgctcagttttctgtcatcacctggtcagcgtgccgtgctcctagccgaagccgcaaggacactggagaaagttggcgaccggagatcatgcaatgattgtcagcagatgatagtgaagttaggtggcggaactgcgatcgccgcgagctag

SEQ ID NO: 207211 - DNA, 2055 bp, Artificial Sequence
  Description of Artificial Sequence: Synthetic coding sequence
atggacgacagcggcgagctgggcggcctggagaccatggagaccttaaccgaactaggcgatgagcttacactgggagacattgacgagatgcttcagtttgtgtcaaaccaggttggtgagtttccagacttgttttccgagcagctgtgtagttcctttcccggcagcggcggtagcggatcctcatccggcagttccggaagcagcagcagctcgagcaacggtagaggaagcagttcaggtgctgtcgatccctcagttcagcgaagctttacccaggtgacactgccaagcttctcacccagcgcagcttctccccaggcccctactctgcaggtgaaagtgtctccgactagtgtacctactacccctcgggccacccccatactacaaccacggccacagcctcagccccagccgcagacccaactccaacagcaaacggtcatgatcactccaacgttttccaccacaccccagacccgaatcattcagcagcccttaatctatcaaaacgctgccacctccttccaagtcctccagcctcaggtgcagtcgctggttaccagttcacaggtccaaccggtgaccattcaacaacaagtccagaccgttcaggcccagcgcgtactgacccagacagctaatggcaccttgcagaccctggctccagccaccgtacaaaccgttgctgcgccccaagtgcagcaggtgccagtgctcgtgcagccccaaatcatcaagacagactcattggtgcttactacactgaaaactgatggttctcctgtcatggctgccgttcaaaacccagccctgacagctttgactacccccattcagaccgccgccttacaggtcccaacgcttgtgggaagtagtggtactatccttacaacaatgcccgtcatgatgggccaggaaaaggtgcccatcaaacaggtgcctggcggggtgaaacagctggagcccccgaaagagggagagcggcgaacaactcacaatatcattgagaagagatacagaagttccatcaatgataaaattatagagctcaaagacctcgtcatggggactgatgccaaaatgcataagtctggtgtgttaagaaaggccatcgattacattaagtatcttcagcaggtgaaccacaagctccggcaggagaacatggtcttaaagctcgctaatcagaagaataaactgctcaaggggatagatttaggtagtctggtcgataacgaagtggaccttaagatagaggattttaaccagaacgtccttctcatgagcccaccagcctccgattcgggatcccaggccgggttcagtccttattcgattgacagtgagcctggatcccccttgctagatgacgcaaaggtgaaagatgagcctgattctccccctgtggcactgggcatggtggaccgtagtcggattctgctttgtgtgttgacattcctctgcctgtctttcaatccacttacctcactgctgcaatggggaggtgcccatgacagcgaccagcacccccactctggcagcggacggtccgtattgagcttcgaatccggaagtgggggatggtttgattggatgatgcccacgctgctcctttggctggtcaacggggtcatcgtcctctccgtgttcgtaaaactgcttgttcacggagagccagtgatcaggccccactcaaggtcaagtgttactttctggaggcaccggaaacaggcagacctggacctggctcgcggcgtgtacggtaagaagtctggcgcaactcactccattgaagaagagttgaacattcacatctcaagaggcactcgcacccggacactgctgtctagtcggagattctgttcctgttgtaggcaaccaaccaatctccctggcagctttggacccggtaccgcgcacctccctccaggcccaggcctacagccccttttggaacgggatccactgcaacccgcagaagctacacccggcgccttggcagctcaagagtctctgcctgtaccagcgggccacgcttcacactag

SEQ ID NO: 207212 - DNA, 3309 bp, Artificial Sequence
  Description of Artificial Sequence: Synthetic coding sequence
atggacgacagcggcgagctgggcggcctggagaccatggagaccttgacggagctgggagatgaactgactctcggagacattgatgagatgctccaattcgtcagtaatcaagttggagaattcccagacctgttttctgagcagctttgctcaagctttccaggatcgggcggctcaggttcctcctctggcagctcagggagcagctcctctagctccaatggtaggggctcttcgtcgggggcggtagacccctctgtgcagcgctcctttacacaggtgaccctgcccagcttctctccgtcagccgcttccccacaagctccgaccctacaagtcaaggtgagccctacatcggtgcccactactcctcgggccaccccaattctgcagcctcgccctcagccccaaccacagccacagacccaattacagcagcagactgtgatgattacccctaccttctccacaactcctcaaacacggattattcagcagcccctgatctatcaaaacgctgcgacgagttttcaggtgttacagccccaagtgcagtctcttgtcactagtagccaagtccagcccgtgaccatccagcagcaagtccaaactgtccaggcccagcgggtgctgacccagaccgctaatggcaccttgcagactctggctcctgcaactgtgcaaaccgtcgcggctccgcaggttcagcaggtgcctgtgctcgtacagcctcagataattaaaacagactcgctcgtgttgactacactgaagacagacgggagtccagttatggcagctgtccaaaacccagctctgaccgcccttacaacaccaatccaaacagctgctctgcaagtcccaacactagtcggcagttccggcacaattttgactacaatgccggtgatgatgggccaagagaaggtacccatcaagcaggtgcctgggggcgtcaaacagctcgagccaccgaaagagggtgagaggcgtaccactcataacatcatcgaaaagaggtacaggagctcaatcaacgacaaaattatcgagctgaaagatctggtgatggggaccgacgctaaaatgcacaagtccggggtgctccggaaagcgatcgactacatcaagtacctacaacaggtgaatcacaagctccggcaggaaaatatggtcctcaagttagcgaatcagaagaataagttgctcaagggaatcgatctgggctcactcgttgataatgaggtcgacctgaagatagaggacttcaatcagaacgtcttgctcatgtctccccctgctagcgattcaggatctcaggcaggattttctccttactccattgactctgagcccggttccccactcctcgatgatgcaaaagtgaaggacgagcctgactcaccaccagtggctcttgggatggtggatcggtcccgcattctgctttgcgtgttgacctttctttgcctgtcatttaacccactcaccagtttgctgcaatggggaggggcccacgacagtgaccaacacccccatagcggaagcgggcggagcgtgctcagctttgagagtgggagcggaggctggttcgactggatgatgcctacccttctgctgtggctagtcaacggggttattgtgctgtcggtattcgttaagctgctcgtacacggagagccggtgattagaccccattccaggtcctccgtgaccttctggcggcatagaaagcaggccgacctggaccttgctagaggcgacttcgccgcagctgcaggtaatctgcagacatgcttggccgtgctcgggagggctcttccaacaagtcgcctggacttggcttgttctctcagctggaacgtgataaggtactctctgcaaaagctcagactcgtgcgctggctactgaagaaagtgttccaatgtcgacgggccaccccagctaccgaggctggctttgaggatgaagctaagacgagcgcacgagacgccgcattggcttaccacaggcttcaccagctgcacataacagggaaactcccagcgggctcggcctgcagcgatgttcacatggccttgtgcgcagtgaatctcgccgaatgcgccgaggagaaaattcccccaagcaccttggtggagatccacctaacggctgctatggggttgaagacacgctgcggcgggaaactgggcttcctggcctcctattttctgtctagagcacagagcctctgtggccctgagcactctgccgtgcccgattccctccggtggctgtgccacccactgggtcagaaatttttcatggagaggagctggagcgtgaagtcagcagctaaagaaagtctgtactgtgcccaaagaaatcctgccgatcctatcgcccaggtacatcaggctttttgtaagaatctgttggaaagggcaatcgaatcgttagtcaagccgcaggcgaagaaaaaagctggagaccaggaagaggagtcctgcgaattttcatcagctctcgagtatctgaaattgctccactcctttgtggactctgtgggcgtcatgtcacccccattgtcccggtctagtgtgctgaagtccgccctagggcctgatataatttgtagatggtggacctctgctataactgttgctataagctggctgcaaggggatgatgccgcggtgcgcagccattttacaaaggtggaacgcattcccaaggccctagaagtaacagagagcccgctcgtgaaagctatcttccatgcatgtcgggcaatgcacgcatcccttcctggaaaagcagatggtcagcaatcatccttttgtcactgtgaaagggcgtccggacatctgtggtcatccctgaacgtatctggggctacttctgatccggccctgaatcacgttgtgcagttgctgacctgcgacctcctgctttctttgaggactgcattatggcagaagcaagcgtcggctagtcaagcggtgggagagacgtatcatgctagcggagccgaacttgctggctttcagcgagacctaggtagcttgaggcgactcgctcactccttcagacctgcctaccgcaaagtgtttctccatgaggctaccgtgaggctgatggcaggcgcctcgcctacccggacgcatcagttgctcgagcatagtttgcggagacggaccacacaaagcaccaaacacggggaggtcgatgcgtggcctggacagcgtgaaagagctactgccatactgctggcctgccgccacctccctttgtcatttttgccctgcctgcagccgtcctag

SEQ ID NO: 207213 - DNA, 648 bp, Artificial Sequence
  Description of Artificial Sequence: Synthetic coding sequence
atgcacgccagcctgcccggcaaggccgacggccagcagagcagcttttgccattgcgagagggcctccggacacttatggtcatccctgaatgtgtccggggccacatctgatcctgcactgaaccatgtcgtgcaactgctcacttgcgaccttctactgtccttacgtaccgccctgtggcagaagcaggcctctgcttcacaggccgtgggggagacatatcacgcaagcggagccgagctcgctggtttccagagggacttagggtccctgagacgtctggcacattcctttcgtcccgcttatcgaaaagtgttcttgcatgaggcaacggtgcgccttatggcaggggcaagtccaacacgcacacaccaactgctagaacacagcttaagaagacggacgacccagtccactaagcatggagaagtggatgcctggcccggacagagagaaagggccacagcgatactgctcgcctgtaggcacctgcctctgagctttctgtcttcccccgggcagcgcgcggtcctcctggctgaagcggcccgaactctcgagaaagtgggcgaccgacgatcctgcaacgactgccaacaaatgatagtgaagctgggggggggaaccgccattgctgcctcgtag

SEQ ID NO: 207214 - DNA, 900 bp, Artificial Sequence
  Description of Artificial Sequence: Synthetic coding sequence
atggacctggtgctgcgggtggccgactactacttcttcaccccctacgtttatcctgctacctggccagaagacgacattttccgacaggcaatctcattgttgatcgtgaccaacgttggggcttacatactgtactttttttgtgcgacactttcttactatttcgtgttcgatcatgccttgatgaaacaccctcaatttttaaagaatcaggttagacgcgaaattaagtttacggtacaggcgctaccatggatctccattctgactgtggcattgttcctgctggagatccgggggtattccaagctgcacgacgatctgggggaattcccttacggactgtttgaattagtcgtctctatcatctcttttctattctttaccgacatgtttatatactggatccacagggggctccatcaccgtttagtgtataaacgacttcataagcctcatcacatttggaagatccctacgcctttcgcaagtcatgctttccatccgatcgatggctttctccagagtcttccctaccatatatacccattcatctttcctctgcataaagtggtatatctttctctgtatatactggttaacatctggacaatttcaatccatgacggggacttccgcgtacctcaaatcctccagccttttataaacggctctgcacaccacacagaccaccatatgttttttgactacaactatggccaatactttaccttatgggaccgcattggaggatcatttaagaacccaagctcttttgagggtaaggggcccttatcctatgtcaaagaaatgacagagggaaagcggtcatcgcattcaggcaatggatgtaagaatgaaaagctcttcaacggcgaattcaccaagacggagtag

SEQ ID NO: 207215 - DNA, 900 bp, Artificial Sequence
  Description of Artificial Sequence: Synthetic coding sequence
atggacctggtgctgcgggtggccgactactacttcttcaccccctatgtgtacccggcaacgtggcctgaggatgacatctttcgccaagcaatctcactcctcattgtcactaacgtcggcgcatacattttatatttcttttgtgccacactgtcgtattatttcgtgtttgatcatgctctaatgaagcatcctcagtttctcaaaaatcaggtgaggagagagataaaattcactgtgcaggctctgccgtggatatctatactgaccgtcgcactattcctgctcgagatccgcggctattccaaacttcacgacgacctgggcgaattcccctatggcttattcgagttggtggtttcgataattagtttcctgttttttaccgatatgtttatttactggatacatcgtggtcttcaccatcgcttagtgtataaaaggctccataagccccatcatatctggaagatccccacaccttttgcctctcatgcttttcacccaattgatggctttttgcagagcctgccctaccacatctacccgttcattttccctttgcataaagtggtgtacctctctctctacatactcgtgaacatctggaccatcagcatccacgacggcgattttcgcgttccacagatactacagcccttcattaacggcagcgcacaccacaccgaccaccacatgtttttcgattataattacgggcagtacttcacactgtgggatagaatcggaggctccttcaagaacccgtcaagcttcgagggaaagggccccctcagttatgttaaagaaatgactgaagggaagaggagtagtcacagcggtaacggctgtaaaaatgaaaaactgtttaacggagagttcaccaagactgaatag

SEQ ID NO: 207216 - DNA, 192 bp, Artificial Sequence
  Description of Artificial Sequence: Synthetic coding sequence
atggagggcgccggcgccggcagcggcttccggaaggagctggtgagtcggctgctccacttacatttcaaggacgacaaaactaaggaagcggccgtgaggggagtgcgccaggcacaagccgaagacgctctacgcgtggacgttgaccaactcgagaaagtgctgcctcagcttttgctggacttctag

SEQ ID NO: 207217 - DNA, 246 bp, Artificial Sequence
  Description of Artificial Sequence: Synthetic coding sequence
atggagggcgccggcgccggcagcggcttccggaaggagctggtgtcacgcctgctccacctacatttcaaagatgataaaacaaaagttagcggtgatgccctacagctgatggtggaattactaaaggtcttcgtcgtagaagccgcagtaaggggagtccgccaggctcaggccgaagacgctcttcgcgtcgatgtggaccagctggaaaaagtgttgccacagctcctcctggatttctag

SEQ ID NO: 207218 - DNA, 2121 bp, Artificial Sequence
  Description of Artificial Sequence: Synthetic coding sequence
atgggcggcaagggcggcggcgacacccggggccccgtgctgttcccctgccagttggcccaggccctctcaccgcgccgtgcgttccctcgggagctgaaagagaaagggcagagaatgtcctcacagccagcaggtaaccaaactagcccgggagctaccgaggattactcctatggatcatggtacattgacgagcctcaggggggggaagagctccagcccgaaggggaggtccctagctgccacacatccatacctccaggcctctatcatgcttgcctcgcttctctttctatcctagtcctccttttgttggcaatgctggtccggcgcagacagctctggccagattgcgtccggggacgacctggactgccatcaccggtagacttcttagctggggatcgccccagagctgtgccagctgccgtgttcatggtgctgctctcatccctctgcctgctgctgcctgatgaagatgcactcccatttctcacgctggcctcggctccaagccaagatgggaaaaccgaagctccccggggcgcatggaagattctgggactgttctactatgccgctctgtattacccactggccgcatgcgccaccgcaggccatactgctgcacacctgttgggctctactttgtcttgggcccacctgggagtccaggtgtggcagcgagcagagtgtccacaagttcccaagatttacaaatactattctctgctagcaagtttgcctctgctgctgggattgggctttttgagcctgtggtatccggttcaattggtcaggtcatttagccgcagaacgggtgcggggagtaagggcctgcagagcagctactccgaagagtatctgcgtaaccttctgtgcagaaagaagctggggtcttcataccatacctctaagcacggtttcttgtcctgggccagggtctgcctacgtcactgcatctataccccacaacccgggttccacctgcctctcaaactcgtgttaagcgcaaccctcactggaacagccatatatcaggttgccttgttactactggtcggcgtggttcccacaattcaaaaagtgcgtgcaggagtcacaaccgatgtgtcctacctcctggcaggcttcggaatcgtgttaagcgaagacaaacaggaggtggtcgaattagtcaagcaccacttatgggctctcgaagtctgctacatcagtgctctggtgctgtcctgcctgcttaccttcttagtactgatgaggtcgttggtaacccacaggacaaaccttcgagctcttcaccgcggggccgcactggatttgtcacctctccatcgaagtccccaccctagccgccaggccatattctgttggatgtcgttctccgcttatcagactgcctttatctgcctcggactcttggtacagcagatcatctttttcttggggacaaccgctctggcctttctggttctcatgcctgtgctgcacggccgtaacctgttgctcttccggtcactagaatccagctggcctttttggctgaccttggccttagcagtgatcctacagaacatggccgcacattgggtgttcctcgagacccacgatggtcaccctcagttgacgaaccgaagggttctctacgcagctacctttctgctattccccctcaatgttctagtgggtgccatggtcgccacttggcgcgtcctcctgtccgctctatataatgcaatccacctgggacagatggatctgtccttgttgcctccacgggccgcaactcttgatcctgggtattatacctatcgcaactttctaaagattgaggtctcacagagccatcctgctatgacagccttctgctctcttctcctccaggcccagtccctgcttccaagaacaatggccgcaccccaggactccctccgacccggcgaagaagatgagggaatgcagcttctgcagactaaagattcaatggccaagggcgcccgccccggagcaagccggggacgggctaggtggggtttggcgtataccctgttacataacccaaccctccaggtcttcaggaagactgccctgctcggggctaatggggcacagccctag

SEQ ID NO: 207219 - DNA, 2004 bp, Artificial Sequence
  Description of Artificial Sequence: Synthetic coding sequence
atgagcagccagcccgccggcaaccagaccagccccggcgccaccgaagactactcttatggctcctggtatatcgacgaacctcaagggggagaagagctgcagcctgagggggaagtgcccagttgccacacatctatcccaccagggttatatcatgcctgcttggccagtctttctatattggtcctactgctgctggctatgctggtaaggcgaaggcagctatggccagactgcgtgcgcggccggcccggtctcccctcccctgtggactttctggccggcgaccgcccccgggcggtgcctgcggcagttttcatggtgctgctgtccagtttgtgtctgctgttgcccgatgaggacgcacttccttttttgacgctcgcatccgcgccttcccaggacggcaagactgaggccccccgaggggcgtggaaaattcttgggcttttttactatgctgcgctctactaccctctggccgcctgcgccactgctggtcatactgcagctcacctgttaggctctacgttaagttgggcacatctgggagtacaagtttggcagagggccgagtgtccccaggtgcctaagatctacaagtattactcactcctggcttctctgccactattgctggggctcggctttctgtctctctggtatccagtacagctggtcagatccttttctaggagaactggggctgggtcgaaaggtttgcagtccagctatagtgaggaatatctgagaaacttactgtgcagaaagaagctcggcagctcttatcacacttctaaacacggctttctgtcctgggccagggtgtgcctgagacactgtatatataccccacagcccggttttcatttgccactgaagctggttctgtccgccacactcactgggacagccatatatcaggtggctctgcttctgctggtgggcgtggttccaactattcagaaagtcagggccggggtgacaaccgatgtcagctatctgctcgcaggtttcggtatcgtcctgtccgaagacaagcaggaggtggtagagctcgtgaagcaccacttgtgggcccttgaagtgtgctatatctctgcccttgtgctgtcctgtttactgacttttctggtgctgatgcggtccctggtgacgcatcgaacaaacttgcgggccctgcataggggggcagctctggaccttagtcccttacatagatccccacaccccagtcggcaagcaatcttttgctggatgagcttttcagcctaccaaaccgccttcatatgcctcgggttactcgtgcagcagatcatattcttcctcgggactacagccctggccttcctggtgctcatgccagttctccatgggagaaacctcctgttattcaggagcctcgaatcttcctggccattctggttgacactggccctcgcagtgatactgcaaaacatggccgctcattgggtgttcctcgagacccacgatggtcatcctcagttgacgaacaggcgagtgttgtatgccgctacatttcttctgtttcctctaaacgtgctggtcggcgccatggtcgctacatggagggtcttgttatctgctttgtataacgctatccacctcggccagatggacctatccttgttaccccctcgtgccgctactcttgatcccggttattacacttatcgaaacttcctgaaaatagaggtgtcgcagagccacccggcaatgactgcattctgctctctgctccttcaggcccagtcactcctgccccggaccatggcggcaccacaggactcacttcgccccggtgaggaagatgagggtatgcagctgctgcagaccaaagattctatggccaaaggcgcgcggccaggggcctcccgcggccgagctaggtggggcctcgcttacacactgctgcacaaccctacactacaggtgtttcggaagacggcgcttctcggtgccaatggagcacagccatag

SEQ ID NO: 207220 - DNA, 2004 bp, Artificial Sequence
  Description of Artificial Sequence: Synthetic coding sequence
atgagcagccagcccgccggcaaccagaccagccccggcgccaccgaggactattcttacggctcttggtatatcgacgagcctcagggcggcgaggagctgcagcccgagggagaggttccgtcatgtcatacaagcattcctccggggttgtatcatgcgtgcttggccagtctctctatattggtgcttctcctgctggctatgctcgttagacggcgccaactctggcctgattgtgttaggggacgacctggactgccctcccctgtcgacttccttgccggcgatcggcctagagccgttcctgcagcagtgttcatggtcctgctgagcagtctgtgtctgcttctacctgacgaagatgccctcccctttcttacccttgcatctgcgccgagccaggacggaaaaactgaagctccaaggggagcttggaaaatacttggccttttttattacgccgccctttattacccactagccgcctgtgcaacagccggacacacagccgcgcacctcctcgggtcgaccctatcctgggctcacctaggtgttcaggtgtggcagagggccgaatgcccgcaggtaccgaagatctacaaatactactctttactcgcatcactgccgctcctgctcgggctgggcttcctctccctgtggtaccccgtgcaactcgtgcggtcattttcacgacggaccggtgccgggagcaaaggtctgcagagctcatatagcgaagagtacctgcgaaatctcctgtgcagaaagaagttgggctccagttaccatacttctaagcacgggtttctctcttgggcccgggtatgcctgcgccactgcatctacacaccacaaccaggatttcacctccctctcaaattggtcctaagtgccactctgaccggaacagccatatatcaggtggctcttctgctcttagtaggtgtggtaccaactattcagaaggtgcgggcaggcgttaccaccgatgtaagctatctacttgccgggttcgggattgtgctgtccgaagacaagcaagaggtcgttgagctggtaaagcaccacctgtgggcactggaggtgtgttacatctcggccctggtgctcagttgcttgttaacatttctcgtcctgatgagaagtcttgttacccaccgcacaaacttgcgtgccttgcaccgcggggctgcattggacctctctccactccaccggtccccccatcctagtcgccaggccattttttgctggatgtctttcagcgcctaccaaacggccttcatctgcttgggtctgctagtgcagcagattatcttttttctgggcaccactgctctcgcttttcttgtactaatgcctgttctgcatggcagaaaccttttgctctttagatccttggaatctagttggcctttctggctgacactggccctcgctgtgattctccaaaacatggcagcccattgggtctttctcgaaacgcatgacggacaccctcagttaacaaatagacgggtcctttacgcggcgaccttcctgctcttccctcttaacgtgctggtgggagccatggtggccacgtggagagtcctattgagtgctctgtataacgcgattcacctcggacagatggacctcagcttgctgcctccacgggccgcaacgctggaccccggctactacacctacagaaacttcttgaagatagaggtgtcccagagccacccagctatgactgccttttgctccctcctcttgcaggcacagagccttctccctcggaccatggcggctccccaggattctctgcggcccggcgaagaagatgaaggaatgcagctgctgcaaaccaaagactctatggcaaagggtgcaagacctggtgccagtcggggacgggcccgatggggcttggcctatacactgcttcacaatcccactcttcaggtcttccgaaagacggcgctactgggtgccaatggggcccagccttag

SEQ ID NO: 207221 - DNA, 1800 bp, Artificial Sequence
  Description of Artificial Sequence: Synthetic coding sequence
atgctggtgcggcggcggcagctgtggcccgactgcgtgcggggcagacctggactgccctctcccgtcgattttttagctggggatcgtccgagggccgttcccgccgcagtgttcatggtcctgcttagcagcctatgcttgctgctgcctgacgaggacgccttgccctttttgaccctcgctagcgctccttctcaggatggcaaaaccgaagcccctcggggcgcctggaagatcctcggactgttttactatgcagctctgtattacccgctggccgcctgtgcaacggctggtcacaccgccgctcatctcctggggagcacactgtcatgggcccatcttggtgtgcaggtgtggcagcgcgctgagtgtcctcaggtgccaaaaatctacaaatactattcactcctggctagcctcccactgctgcttggactgggctttctgagcctctggtaccccgtacaactagtccgctcattctctcggcgaacaggcgccgggtctaaaggcctccagtctagttactccgaggagtatctgcgcaatttgctgtgccggaaaaagttaggatcctcttaccacaccagcaaacatggatttctgtcctgggccagagtctgtcttcgccattgtatttacaccccccaacccggattccatctacctctcaagctcgtgttatccgcgactctgaccggaacggccatttaccaggtcgccctgttgttattagtgggcgtagtgcctactatccagaaggttagggccggcgtgaccacagatgtttcctacctcctcgcgggctttggaattgtgctgagtgaggataagcaggaggtggttgagctggtgaaacaccacctgtgggctctggaagtgtgctacatttccgctctcgtactcagttgcctgctgacttttttggtgttaatgagaagtctggtcactcaccgaaccaatctgcgggcactgcatcgcggcgctgccttggatttgtcacccctccatcgttctccccacccatcgcgtcaggccattttctgttggatgtccttctcagcgtaccagaccgccttcatatgcctgggcctgctggtccagcagataattttcttcctgggaactactgccctggcattcttggtgctcatgcctgtgctgcacggaagaaaccttctcctctttcggtcactggaatccagctggcccttttggttgaccctggccttagccgttattttgcagaatatggctgcacattgggtgtttctggaaacgcatgatggccatccccagcttacaaatagaagagttctgtacgcagctacctttctgctttttcctcttaatgtgctcgtaggcgctatggttgctacctggagggtcctcctctcagcactgtacaatgctattcacctcggacaaatggacctgagccttcttcccccgcgtgccgccaccctcgatcctggctattatacatataggaacttcctcaagattgaagtgtctcagtctcacccagcgatgaccgccttctgctcccttttattacaggcccagtccctattgcccaggacaatggcagcgccccaggattctcttaggccaggagaagaggacgaaggaatgcagctgctgcagacgaaggattctatggctaaaggggcacggccgggtgcgtcacgcggacgggcacgctggggccttgcctacacccttctgcacaaccccacactccaggtctttcgcaagaccgccctacttggcgctaacggtgcccagccttag

SEQ ID NO: 207222 - DNA, 1977 bp, Artificial Sequence
  Description of Artificial Sequence: Synthetic coding sequence
atgagcagccagcccgccggcaaccagaccagccccggcgccaccgaagattattcctatggctcatggtacatagatgagccccaggggggcgaagagctgcagcctgaaggggaggtgccttcttgtcatacaagcatcccccccggcctgtaccacgcctgtctagcaagtctcagcatactcgtattgttactgcttgcaatgctggtgcgcaggagacagctctggccagactgcgtgagaggaagaccaggactaccccgccccagagccgtgcctgctgcggtgtttatggttctactctcttctctatgtctcctattacccgatgaggatgccctcccattcctgacgcttgcttctgcaccgtcacaggacggaaagacagaggcacccagaggcgcctggaagatcctcggcctattctactacgcagccctgtattaccccctcgctgcctgcgctactgctggtcatactgccgctcacttgctcggcagcacactgtcgtgggcccatctaggcgttcaggtctggcagcgcgcagagtgtcctcaggtgccaaagatttataaatactattccctgctggcttccctgccactcctgctgggattagggttcctgagcctatggtaccccgtacaattagtccgatcctttagtcgccgtaccggtgccggtagtaagggcctgcaatcttcttattcagaggagtacctgcggaacctcctttgcagaaaaaaactgggaagcagctaccacaccagtaagcacggatttctgagctgggctcgagtgtgcctgagacactgtatctacactccgcagccaggctttcaccttccacttaagttggtgttgagtgccactcttacagggactgcaatataccaagtagccctattgcttctcgtcggcgtggtgccaacaatccagaaggtgcgcgccggcgtgacaacagacgtctcctaccttctggccggttttggtatcgtcttgagcgaggacaagcaggaggtggtcgagctggttaaacaccacctgtgggccttggaagtgtgctacatttctgcccttgtcctgtcatgtctcctcacatttctcgtcctgatgcggtcccttgttacacaccgtaccaacctgagggcgctgcacaggggagccgctctagatctgtccccactgcaccgaagtccacatccaagccggcaggctattttttgttggatgtcattttctgcctatcaaacagccttcatttgtttgggactgcttgtgcaacagattatattttttttggggaccaccgcgctggccttcctagtcctcatgccagtgctacatgggcgtaacctgctgctcttcagaagtctcgagagctcttggccattctggttgacactggccttggccgttatcttgcagaatatggcagcccattgggtgtttctggagacccacgatggacatccacagctgacgaatagaagagtgctctacgcagcgaccttcctgctgttccctctgaacgtactcgtgggggctatggtcgctacatggcgagtactactgagtgctttatataacgccatccatttaggtcaaatggatctgagcctgctcccccctagggcagccaccctggacccagggtactatacgtatcgaaatttcctgaaaatcgaagtgagtcagtcccaccctgcgatgactgctttctgctctttactccttcaggcgcaatctttgttgcctagaacaatggctgccccacaggactccctgagaccaggcgaagaagacgaaggtatgcaactgctgcagactaaagacagtatggcaaaaggtgcacgccctggggcatctcgcgggcgggcaagatggggtttggcgtatacactattgcacaaccctactctgcaagtctttagaaaaactgcactgctaggggccaacggggcccagccttag

SEQ ID NO: 207223 - DNA, 480 bp, Artificial Sequence
  Description of Artificial Sequence: Synthetic coding sequence
atgagcagccagcccgccggcaaccagaccagccccggcgccaccgaagattattcatatggaagttggtacattgacgagcctcagggcggcgaagagctgcaacccgagggcgaggtgccatcatgccatacgtctatccctccaggcctgtatcatgcgtgcctggcgtcgttatcaattttagtactgctgcttcttgccatgcttgtacgaagacggcagctttggcccgattgtgtgcgaggccgacccggccttccaagtcctgtcgattttcttgctggcgatcgcccaagggctgtgcccgcagccgtctttatggtgctgcttagttcactctgtctgctgctgcccgacgaagatgccctgccatttctaaccctggccagtgcgcctagccaagacgggaagaccgaggccccaagagggaacttgcctaagatcacagagcttcgcctggtccgcgcctggatctag

SEQ ID NO: 207224 - DNA, 2121 bp, Artificial Sequence
  Description of Artificial Sequence: Synthetic coding sequence
atgggcggcaagggcggcggcgacacccggggccccgtgctgttcccctgccagctagcccaagcgctgtcacccaggcgagcctttcctcgcgaacttaaagagaagggccagcgcatgagctcccagcctgccggaaatcagacctcacccggcgcaacagaggactactcatacggttcgtggtacatcgatgaaccccaggggggtgaggagctccagccagagggcgaagttccatcctgccatacatccatcccaccagggctgtaccatgcctgcctggcctctttgtccattctcgttcttctcctgctcgcaatgcttgttaggagaaggcagctctggcccgattgtgtacgggggcgacccgggcttccttcacctgtggattttttggctggggaccgacctcgcgcggtacctgccgccgtgtttatggttttgctaagtagcttgtgtctgttactgccagacgaagatgctctacccttcctaactctggccagcgcaccctcccaggacggcaaaacggaagcacccagaggcgcctggaaaattctgggcctgttctactacgccgccctctattacccactggccgcctgtgccactgccggccataccgcagcgcacctgttgggatctacactatcgtgggcacacctgggggtgcaggtttggcagcgagccgaatgccctcaggtaccaaagatctacaaatattatagcctgcttgcaagcctgccgctgctgcttggcctgggctttctgagcctgtggtatccggtgcagctggtgcggtctttctcgcgccggactggcgctggatctaaggggctccaatcatcctactccgaggaatacctacggaatctgttatgccgtaaaaagcttggttcaagttatcacacatcaaaacacggatttcttagctgggcccgggtctgtcttcggcactgcatttacacgccgcaacctggatttcacttaccactaaaactcgtcctgagtgccaccctcactggcacagctatctaccaagtcgcactgctgcttctcgtgggagtggtaccaaccatccagaaggtgcgtgctggggtgacaaccgatgtgagctacctgctggctggattcggcattgttttgtcagaggataagcaggaagtggtggagctcgttaaacatcacctgtgggccttggaagtctgctatattagcgccctagttttaagctgtctcttgacctttttggtgctgatgcggtcgctggtgacgcatcgcaccaaccttcgggccctgcacagaggggcagctctcgacctgagccctcttcatcgttccccccacccttcccgccaagcaattttttgttggatgtcttttagcgcttatcagacggcgttcatttgcctgggcttgctcgtgcaacaaatcattttctttctgggcaccaccgctcttgctttcctggtactgatgcccgtgctgcacggacgcaacctgctgctttttcgatccctcgagtcgagctggcccttctggctcaccctcgccctggctgtcatactccagaatatggctgcccattgggtatttttagaaacccatgacggacaccctcagctgaccaataggagagtactgtacgccgctacttttttattatttcctctcaacgtgcttgtgggtgcaatggtggccacctggcgtgtacttctgtcagccctgtacaacgcgattcaccttggtcagatggacctgagcctgttgcctccacgagcagctacactcgatcccgggtattacacatacaggaactttctgaaaatagaagtttctcagagccaccctgccatgactgctttctgtagtctcctcctgcaggctcagtctctattgccacgtaccatggcagcccctcaggacagtttgcgccctggtgaggaggacgagggaatgcagctgctgcagactaaggacagcatggctaaaggcgctcgaccaggcgcatcaagagggcgggcacgctgggggctggcttacacattgctccataatcccaccttacaggtcttccggaagaccgcccttcttggagccaatggcgcacaaccatag

SEQ ID NO: 207225 - DNA, 2115 bp, Artificial Sequence
  Description of Artificial Sequence: Synthetic coding sequence
atgcagatccggctgctgcgggccgagctggtggtgcccctgtggcagtttatccgacagtggccacccggcagcgatgggtggggccaaatggaagagaaggggcagaggatgagcagtcaacctgctggaaatcaaacatctcctggagcgaccgaagattatagctatggcagctggtacatagacgaaccccaaggcggcgaggagctgcagcccgaaggcgaagttccctcctgccacacatccatcccacccggactataccatgcttgtctggccagtctgtccattctggtactcttgctgcttgccatgttagtgcgcaggcgtcagctctggcccgattgtgtccgcggaagacctggcctgccatccccagtggatttcctagctggagataggccacgtgccgtcccagctgcagtctttatggtgctcctatctagcctgtgtctgcttcttccagatgaagacgctctgcctttcctgacacttgcctccgcgccatcacaggatggtaagacagaagcgccgagaggcgcgtggaaaattctaggcctgttttattacgctgctctgtactaccccctcgctgcatgtgccaccgccggccacaccgccgcccatctcttaggatctacactgtcctgggctcacctgggcgtgcaagtgtggcaacgcgcggaatgtcctcaggtacccaaaatatacaaatactacagtcttctcgcgtcccttcccctgctcctgggcctgggattccttagcctctggtaccctgtgcagcttgtgagatctttctcccgtaggacaggcgctggatctaaggggcttcagtcgtcatactccgaagaatacctgcggaatttgttatgccgcaagaagctgggtagttcttatcatactagtaaacacggttttctaagttgggcacgggtgtgcctcagacactgtatatataccccgcagcctggattccatctcccactgaagctagtgctatctgcgacattgacaggaaccgcaatctatcaggtggcactgctactgctcgtcggcgttgtacccaccatacagaaggtgagagctggcgttacaactgacgttagttatctgctagctggtttcggaatcgtgctgtctgaagataagcaagaagtggttgagctagtaaagcaccatctgtgggcacttgaagtctgctacatctctgctctggtgctgagttgccttcttacttttctggtgctgatgagaagcctcgtcactcaccgtactaacctgagggctctccatcgaggcgccgctctggatttatcccctctccataggtccccgcatcccagtcgccaagccatcttttgttggatgagcttttccgcatatcagaccgcttttatctgtctcggtctgctggtgcagcagataatcttctttctggggacgaccgcccttgcattcctcgtgctcatgccagtgctgcatggaaggaatctgttgttgtttcgtagtctggaaagcagctggcctttctggctgaccttggcgctggcagtgatcctccagaacatggccgctcactgggtattccttgagactcacgacggacatccacaacttacaaaccggagggtcctttatgccgcaacattcctcctgttcccactcaatgtgctggtgggggccatggttgcaacttggagggtgctactgagtgcactatataatgctattcacttggggcagatggatttgagcctgctgcctccaagagcagcgactctcgaccccggatactatacctataggaactttctcaaaatcgaggtttcacagtcccatcctgccatgaccgctttctgttcgctactgttgcaagcccagtccttgttgcctcggactatggccgcccctcaagattcactgagacccggcgaagaagatgagggaatgcaacttttgcaaaccaaagacagtatggcaaaaggggcaagacctggggcaagccgtgggcgtgcaagatggggccttgcctacaccttgctgcacaatccgaccctgcaggtgtttagaaagaccgcactgcttggcgctaatggcgcacagccatag

SEQ ID NO: 207226 - DNA, 1674 bp, Artificial Sequence
  Description of Artificial Sequence: Synthetic coding sequence
atggccgccggcaccagcatgagccccgacgaggacgccctgccctttctgacactggcgagtgcgccctcccaggacgggaagacggaggcacccagaggggcatggaaaatattaggattgttctactacgcagctctctactacccactggcagcatgtgcaaccgccggacacacagctgctcacctcctcggtagtactctgtcttgggcccacctcggggttcaggtttggcagagagcggaatgcccccaggtaccaaagatctataaatattatagtcttctggcatctctgccgctgcttctcggactgggctttctttcactgtggtaccccgtacagctggtgcgttctttcagccgacggacaggcgctggcagcaaagggctacaaagttcctatagcgaagagtacctgcggaacttgctgtgtcggaagaaactcggctctagttatcacacctccaaacacggttttttatcctgggcgagagtgtgcctgaggcattgtatttatacacctcagccaggtttccacctgcccctgaagctggtcctttcagcaacactgaccgggactgcaatctatcaggtggctctactcctgctggtgggggtagtgcctaccatccaaaaggtgagggcaggggtgacaactgacgtaagttacctcctggcaggatttggcatcgtgctgtccgaggataagcaggaggtggtggaactcgttaagcaccacctttgggctctggaagtgtgctacatttccgctctcgttctcagttgcctgctgacctttctggtgctgatgcggtccctcgtgacccatcgaacaaacctgcgggcccttcatcgcggggccgcactggacctttctcctttgcaccgaagccctcaccccagtaggcaggcaatcttttgctggatgagcttctctgcgtatcagactgcctttatttgtctcggtctactggttcagcaaatcatcttctttctcggcactacagctctggcctttcttgtgcttatgccagttctacatggaagaaacttgttgctgtttcgttcgctggagtcatcgtggcctttctggctcacattagcactggcggtgattttacaaaacatggccgctcattgggttttcttagaaacacacgatggccacccccagctgactaaccgaagagttctctacgccgcaactttcttgctctttccactaaatgtgctcgttggggccatggtggccacgtggcgcgtgctgctctcagccctgtataatgcaattcacctggggcagatggacctttctctactccccccccgcgccgctactctggaccctgggtattacacttacagaaactttctaaaaatagaggtttcacagagtcatccggcgatgaccgcattctgctctctcctgcttcaggctcagtctctcctgcctcgcacaatggccgccccccaggatagcttgcgccctggggaagaagacgaggggatgcaactgctgcagaccaaagacagcatggcaaaaggcgctcggccaggtgctagtagggggcgggcccgctgggggctggcgtacacgctgttgcacaatcccacactgcaggtctttcggaaaacagcccttttgggagctaacggagcccagccatag

SEQ ID NO: 207227 - DNA, 1431 bp, Artificial Sequence
  Description of Artificial Sequence: Synthetic coding sequence
atgggcaagctgcggctgcaggagatctacaagtactacagcctgctggccagccttccgttgctgctcggcctcggctttctgtctctctggtatcctgtgcagttggtaagaagtttctctcgaaggactggcgcaggcagtaagggtttgcagtcgtcgtatagcgaggaatacctacgcaatttgttgtgcaggaaaaagttgggttctagctaccatacaagcaaacacggcttcctttcgtgggctcgcgtgtgcctgcggcattgcatttacaccccccagccggggtttcatctgccactgaaactggttctgagcgctacactgacagggactgcaatctatcaagttgccctgctactcctggtgggagttgtgcccactattcaaaaggtgagggccggagtcaccacagatgtaagctacttgctggcgggattcggaattgtcttaagcgaagataaacaggaagtagttgagctcgtcaagcaccacctttgggccttggaagtctgctatatcagtgcacttgtgctctcatgtctgctgacattcttagttctgatgcggagcttggtcacccacagaacgaatctgagggctctgcacaggggagcagccctcgacttaagtccactgcaccgctcaccccacccttctagacaggcaattttttgctggatgagtttttccgcttaccagacggcattcatctgcctgggactcttggtccaacagattatcttcttcttaggcacaacagcacttgcctttctggtcctaatgcccgttttgcacgggcgaaacttgttgctcttcagaagtctcgagagctcatggcctttctggctgacacttgcgctggcggttatccttcaaaacatggccgctcactgggtgttcctggagacgcatgacggacaccctcaactgaccaacaggcgcgttctatacgccgcaacctttcttctgtttcccctgaatgttttggtgggggccatggtggcaacttggcgggtgcttttgtccgccctgtacaacgccatccatctcgggcagatggacctgagtttgctgccaccgagagccgctactttagatcccggctactacacatacagaaacttcttgaagattgaggtgtcacagtcccatcccgccatgactgccttctgtagcctgctgctccaggctcagagtcttctgcccagaactatggccgcacctcaagactccctccggcctggagaggaggacgaagggatgcagcttctgcagaccaaggacagcatggccaaaggggcaaggccaggagcctccagaggtagagccaggtgggggctcgcctacaccctgctacacaatcctacgttacaggtcttccgcaagaccgcacttcttggggcaaacggcgctcagccctag

SEQ ID NO: 207228 - DNA, 993 bp, Artificial Sequence
  Description of Artificial Sequence: Synthetic coding sequence
atgggcaagatcgacgtggacaagatcctgttcttcaaccaggagataagattgtggcaactaatcatggccacaccggaggaaaactctaatcctcacgaccgcgcaactccccagctgcccgctcagctgcaagagctggagcatagggtggcccgccggaggctctcacaggctcgccaccgcgccactttggccgcgctgttcaataatctgagaaaaacagtgtattcccagtcggatctgatcgcaagcaagtggcaagtgcttaacaaggcaaagagtcacatacctgagctggaacagactttggacaacctccttaagcttaaggctagcttcaacctggaagacggacatgcctccagtctcgaagaggttaagaaagaatacgcatcaatgtactctggcaatgactcctttcctcagaatggatcttccccctggtacctgaatttctacaaacagacaatggatctcctaacgggctccggtatcataactccccaagaggccgccctgcccattgtgtcagccgccatcagccatctgtggcaaaatctctcagaggagcgaaaagcgagtttgcggcaagcctgggcccagaaacatagaggcccggccacccttgccgaggcatgtagggagcctgcctgtgccgaagggtccgtcaaagacagcggtgttgattctcagggggcttcgtgcagcttggtttcaactcccgaagagatactcttcgaggacgccttcgacgttgcgtctttcttggataagagcgaagttcccagcacaagtagctcttcttccgttctggccagttgtaaccccgaaaacccagaggaaaaatttcagctgtacatgcagatcatcaactttttcaaagggctctcttgcgcaaacacccaagttaagcaggaggcatccttcccagtggacgaggaaatgatcatgctgcagtgtaccgaaacattcgatgacgaggatttatag

SEQ ID NO: 207229 - DNA, 882 bp, Artificial Sequence
  Description of Artificial Sequence: Synthetic coding sequence
atgggcttccccgccgccgccctgctgtgcgccctgtgctgcggcctgctggctccggctgccagagcaggctattcagaggaacgctgctcctggaggggaagtgggctgacgcaggagcctggatctgtgggacagcttgccctcgcctgtgccgagggggccgttgaatggttataccccgctggcgctctgagactaacgttgggcggtcccgatcctcgggccagacccggcatagcatgcctgcgcccagtccggccgtttgccggcgcacaagtgtttgctgaaagggccggaggagcactggaactcttgctagctgaaggccccggaccagctggagggcgctgtgtgcgctggggtcctcgggagcgccgggctctgtttctacaggccaccccacaccaggacatctcacgtagggtggcagcatttcggttcgagctcagagaggatggacgtccggagctgccaccgcaggcccatggattgggcgtagacggcgcatgcaggccgtgttccgatgccgaactattacttgcagcttgcacctctgactttgtgatccatggcatcatacacggagtcacgcacgacgtggagttgcaggaatctgtgatcacagtggtcgcagctcgggtattgcggcagacaccaccccttttccaggctggtaggtctggcgaccagggccttacctcgatcagaaccccactgaggtgtggcgtccatccgggcccgggaacgttcctgtttatgggatggagcagattcggtgaagcccgcttgggctgtgcacccagattccaggaatttagacgagcatacgaggccgccagagcagcgcatctgcacccatgcgaggttgccctacattag

SEQ ID NO: 207230 - DNA, 1197 bp, Artificial Sequence
  Description of Artificial Sequence: Synthetic coding sequence
atgctgggccggagcggctaccgggccctgcccctgggcgacttcgatagattccaacagagttcctttgggtttctcggatcacaaaaaggctgcctctccccagagcgcgggggagtgggtaccggtgcagacgtcccacaaagctggcccagttgtctctgtcatggattgatttcctttctcggcttcttgctattattagtgacattcccaatttctgggtggttcgccctgaaaattgttcccacttacgaacgaatgattgttttcagactaggccggatccgcaccccgcaggggcccggcatggtgctgctgctgcccttcattgactccttccagcgcgtggacctccgtactagagcttttaacgtgcctccttgtaaactagccagcaaagatggggcagtgctctcagtgggagcggatgtccaattccgcatctgggatcccgtgctgtctgtcatgacagtcaaagacctcaacaccgccacccgcatgaccgctcagaatgccatgaccaaagctttactaaaacgtcccctccgcgaaattcagatggagaaacttaagatcagtgaccagctcctactcgaaattaacgacgtaacaagggcctggggtctggaagttgatcgagttgaactggccgttgaggctgttcttcagccaccacaggactcccctgctgggccaaacctcgactccacactgcagcagctcgcgcttcatttcctcggagggtccatgaatagcatggccggaggagccccctcccctggccccgctgatacagtcgaaatggtcagcgaagtggagcctcctgctccccaagtgggggcccgcagctcaccaaagcagccactggcagagggactactgaccgcgctgcaacccttcctgtccgaggctctggtgagccaggttggcgcgtgttaccagtttaatgtggtgttaccttctggaacccagagcgcttactttttggatctgaccacagggaggggtagggtgggacacggcgtcccggatggaattcctgacgttgtggtggaaatggccgaagctgatctcagagccctgctgtgtagggagctgaggccactgggggcatacatgagcggccggctcaaagtaaaaggtgatctggcaatggccatgaagttagaagccgtcctgcgcgctctgaagtag

SEQ ID NO: 207231 - DNA, 1047 bp, Artificial Sequence
  Description of Artificial Sequence: Synthetic coding sequence
atgctgggccggagcggctaccgggccctgcccctgggcgacttcgatcgcttccagcagtcctcgttcggatttttgggcagccagaagggatgccttagtcctgaaagagggggggtggggacaggcgccgacgttccccaatcgtggccaagctgcctctgtcacggcctcatttccttcctgggttttctccttttgctcgtgacctttcccatatctggatggttcgcactgaaactagcgagcaaggatggtgcagtgctcagcgttggcgctgacgtccaattccggatttgggaccccgtgctgtccgtaatgaccgttaaagatctgaatactgccactaggatgacagcccagaacgccatgaccaaagccctgttaaaaagacctctcagggagattcagatggaaaagttgaagatatccgaccaactcctgcttgaaattaatgacgtgacaagggcctggggcctggaggtggacagggtcgagctagccgttgaggcggtgctacagcctccgcaagactcacctgcaggccccaacttggatagtacacttcaacagctcgccttgcactttctcggaggaagcatgaattccatggctggaggagccccaagcccaggtccagcggataccgtggagatggtcagtgaggtggagccccctgcccctcaggtgggcgcccgatcttcccctaaacaacccttggctgaagggcttctgaccgccctacaaccatttctgtccgaggccttggtgtctcaagtcggcgcctgctatcagtttaacgtggtgcttccatccggcactcagtcagcttacttcctagacctcaccactggccgaggtcgcgtcgggcatggcgtccctgatggtatccctgacgtggtggtagagatggctgaggcggacctcagagccttgctgtgtagagagctgagaccgctcggtgcatacatgtcaggcaggctcaaggtgaagggcgatctcgctatggcaatgaagcttgaagccgtgttgagagctctaaagtag

SEQ ID NO: 207232 - DNA, 984 bp, Artificial Sequence
  Description of Artificial Sequence: Synthetic coding sequence
atgctgggccggagcggctaccgggccctgcccctgggcgacttcgatcggtttcagcagtcctcctttggcttcttgggttcacagaaggggtgcctgtcccccgagagagggggggtaggcactggggccgatgtgccacagtcatggcctagctgtctttgtcacgggcttatatcctttctagggtttcttcttctcctggtgactttcccaatttctgggtggtttgcactgaagatcgtgcccacttacgagcgcatgatagtcttcaggctgggtcgcattcggacccctcaaggacccgggatggtgctgctcttgccattcatcgacagcttccagcgagtggaccttagaactcgcgcgtttaacgtgcccccctgtaagctcgctagtaaggacggtgccgtgcttagcgttggagctgatgtgcagtttcgcatttgggatcctgtactgtcagtaatgactgttaaagatctgaacacagccacccgcatgaccgctcagaatgccatgacgaaagcgctgttgaaaaggcccctccgggagatacagatggagaaactcaaaatttctgatcaactcctactagaaattaacgatgtaacaagagcgtggggtctggaggtcgatcgagtcgagctggctgtggaagccgtacttcagcccccacaagattccccagccggccccaacctggactctaccctacagcagttggctctgcacttcctcggtggaagtatgaactccatggctgggggtgcaccctccccagggccaggtcgcggtagggtgggccatggagtgcccgacgggattccagacgttgttgtagaaatggccgaggccgacctgcgagccctgctttgccgggagcttcgtcctctgggagcttatatgagtggtagattaaaggtgaagggcgatctcgccatggctatgaaactcgaagctgtcttgcgagccttgaagtag

SEQ ID NO: 207233 - DNA, 1068 bp, Artificial Sequence
  Description of Artificial Sequence: Synthetic coding sequence
atgcccgacgtgccccagagctggcccagctgcctgtgccacggcttgatcagcttcctgggatttttgctcctgctggtcacctttccaatttctggctggttcgccttgaagattgtcccaacctacgaacggatgatagtgttccgactggggcgcattaggactccacaggggccaggcatggtgttgttactgcctttcatcgactctttccagcgggtggacttgcgaactcgggcattcaatgtccccccttgtaagctcgcatccaaggatggcgccgtgttgtccgtgggcgcagacgttcagtttaggatatgggatccggtgctgtcagtgatgactgtcaaagacctgaacaccgctactagaatgacagcgcagaatgcaatgaccaaggcactactgaaacggccactccgggagattcagatggaaaagctgaaaatttctgatcaacttctactagagatcaacgacgtcactcgggcatggggactggaggtggaccgcgtggagttggccgtcgaagccgtccttcagcccccccaggattcaccagcagggcctaatctggatagcaccctacagcagctggccctacacttcctgggcgggtctatgaactccatggcgggaggagcccccagccccgggcctgataccgttgagatggttagcgaagtcgaacctccagcacctcaggtaggggcacggtcatcacctaagcagcccctagctgaggggcttttgacggctcttcagccatttctctcagaagcactggtcagccaggtgggggcttgctaccagttcaacgtagtgttgccatccggcacccagtccgcctatttcctcgacctcaccaccggcagaggaagggtcgggcatggagtgccagacgggattcccgacgtggtcgtcgagatggccgaagccgatctacgagcgctgctgtgcagagaactgaggcccttaggggcttacatgagtggcagactgaaagttaagggcgatctggccatggcaatgaagctggaggccgtactacgcgctctgaaatag

SEQ ID NO: 207234 - DNA, 933 bp, Artificial Sequence
  Description of Artificial Sequence: Synthetic coding sequence
atgatcgtgttccggctgggccggatccggaccccccagggccccgggatggtactgctcctcccttttattgacagtttccagcgcgtagacctaagaacgcgcgcctttaatgtcccaccttgcaagctcgcgtctaaagacggtgccgtgctgtcagtaggagcggacgtacagtttaggatatgggatcctgtgctgtccgtgatgacggtgaaggatttgaatacggcaacccgcatgacggcccaaaacgcaatgactaaagctctccttaaaagacccttgagggagattcagatggaaaagctcaagatctctgaccagcttttgttagagatcaacgatgtgacaagagcctggggcctggaagtggatcgagtggagttggctgtggaagccgtgctgcaaccccctcaggacagtccagccggccccaatctggatagcaccctgcagcagttggctctgcattttcttggaggttcaatgaatagcatggctggcggggcccccagcccaggccccgacaccgtggagatggtgagcgaggtcgagccaccagccccacaagtgggcgctagatccagccccaaacaacccctggctgaaggactgcttacggcactccagccctttctgtcagaggcattggtgagccaggtaggggcctgttaccagtttaacgtcgttttgcctagcggaacacagagtgcttattttctcgatctgacgaccggccgagggcgggttgggcacggcgtgcctgatggaattcccgatgtcgtggtggaaatggccgaagctgatttgagggcattgctctgcagggaactgaggccacttggtgcctacatgtctggtcgtcttaaggtgaagggcgatcttgcaatggccatgaaattagaggccgtcctgagagctctcaagtag

SEQ ID NO: 207235 - DNA, 1044 bp, Artificial Sequence
  Description of Artificial Sequence: Synthetic coding sequence
atgctgggccggagcggctaccgggccctgcccctgggcgacttcgaccgctttcaacagtcttcctttggtttcctgggaagtcaaaagggatgcctctcacccgagagaggaggagttgggactggtgcggatgtgcctcaatcctggcctagttgcttatgtcacggtctgattagctttctgggctttttgctccttctggtgacatttcccatttcagggtggtttgcgttaaaactcgctagtaaggatggcgccgtcctgtctgtcggtgcagacgtgcagtttagaatttgggatccggttctgagcgtgatgactgtgaaggacctcaataccgcaactagaatgacggcgcagaacgctatgacaaaagcgcttctcaaaaggccccttagggaaatccaaatggaaaagctcaaaatttcggaccagctcttgctggagataaacgatgtcacccgggcttgggggttggaggtggatcgcgtcgaactggctgtcgaggcagtgctccagccaccgcaggactctcccgcgggccccaacctggattctactttgcagcagctggcgctgcactttctcggtggctctatgaatagtatggcaggaggggctcccagtcctggcccggacacggtcgagatggtgtctgaagtcgagcccccagcacctcaggtaggggctcgttcttctcctaaacagccactggccgagggcctgctgaccgctctgcagccatttttgtccgaggccctggtgtcccaggttggtgcttgctatcaatttaacgtcgtgcttccaagtggtacacagagtgcatactttctggatctgacaacaggcaggggacgcgtgggccatggtgtgcccgacggaattcctgatgtcgtggtggagatggccgaagctgacctcagagccttattgtgtcgcgagctgcgtccgcttggcgcatacatgtcaggtcgactgaaagtaaaaggtgatctcgctatggccatgaagcttgaagctgtgctccgtgccctgaaatag

SEQ ID NO: 207236 - DNA, 1071 bp, Artificial Sequence
  Description of Artificial Sequence: Synthetic coding sequence
atgctggcccgggccgcccggggcaccggcgccctgctgctgcggggctcattgctggctagtgggcgggctcccaggagggcttcctctggcctgccgcggaacaccgtcgtgcttttcgtgcctcagcaggaagcatgggtggtggagaggatggggcggttccatcgtatcctcgagccaggactgaatattctgattcccgtcctggatcgaattaggtatgtgcagagtctcaaggagattgtgattaacgtgcctgagcagtccgcagtgaccctcgacaatgtcacactgcagatcgatggagtgttgtatcttcgcatcatggacccgtataaagctagctatggagtcgaagacccagagtatgcagtgactcagctggcccagactactatgaggagcgagctcggcaagctgagcctggataaagtgtttagggagcgggaatcactcaacgcttcgatagtggacgctattaatcaagccgcagactgctggggcatccggtgcctgcgatacgagattaaggatatccatgttcccccgcgagtgaaggaatcaatgcaaatgcaggtcgaagcagaacgccgtaagcgcgccacagtcttagagtccgagggtacaagggagtcagccataaacgtggccgaaggtaaaaagcaggctcagatcttagcatcagaggcagaaaaggcagaacaaatcaatcaggcagctggagaggcgtcggccgttctggcaaaagctaaagccaaggctgaggctataagaattctggcggcggcattgacccagcacaacggcgatgctgccgcctccctgaccgtggccgagcagtacgtgtctgcattctccaaactggcaaaagactccaacaccatactgctgcccagtaatcccggcgatgtgaccagtatggtagcacaggctatgggagtttacggtgcccttactaaggcaccagtaccaggaacgccagatagtctcagctccggcagcagccgcgacgtgcagggcacagatgcatctttagatgaggaactggatcgggtgaagatgagttag

SEQ ID NO: 207237 - DNA, 936 bp, Artificial Sequence
  Description of Artificial Sequence: Synthetic coding sequence
atgctggcccgggccgcccggggcaccggcgccctgctgctgcgggggtccttgctagcctcaggtcgagcgccacgccgggctagcagtgggctgcctcgcaacacagtcgtgttgtttgtgcctcagcaggaggcgtgggttgtggagagaatgggcaggttccatagaattttggaaccagggcttaatatcctgattccggttttggatcggattaggtatgtccagagtctgaaagaaatcgtgattaatgtgcctgagcagagcgctgtgacactggataatgttactctacagattgacggcgtcctctacctacgcatcatggacccctataaggcctcctacggggtcgaggatccagagtacgcagttacacagctggcccaaacgaccatgcggagtgaactgggtaaactgtccctcgacaaagtcttccgggtggaagcagagcggagaaagagagccaccgtgctggagtccgaaggcacccgcgagagcgctatcaacgtcgcagaaggaaaaaagcaggcccaaattctcgcctcagaggctgaaaaagctgagcaaatcaaccaggcagctggggaggcctcggccgtgctcgccaaggcaaaagcgaaagcagaggccataagaatactggcagcggcccttacccagcacaacggtgacgccgcagctagtctaacagtggccgagcaatacgtaagcgcgttctccaaactggccaaagacagcaataccatcttactgccgtcgaaccccggcgacgtcacctctatggtggctcaagcgatgggggtttacggagccttaaccaaggctcctgtgccgggcacacccgattctcttagctcggggtcctctcgcgatgtgcaagggacagatgcaagtttagatgaggaactcgacagggtgaagatgtcctag

SEQ ID NO: 207238 - DNA, 876 bp, Artificial Sequence
  Description of Artificial Sequence: Synthetic coding sequence
atggacagccgggtgagcagccccgagaagcaggacaaggagaacttcgtgggtgttaataataaacgattaggtgtttgtgggtggatcctgttttcccttagcttcctgctggtcataatcacctttcccatttctatctggatgtgtctaaaaataataaaggagtacgaacgggccgtagtgttccgacttggccgcattcaggctgacaaagcaaagggccctggactcatactggttttaccatgtatagacgtcttcgtaaaagtcgacctgcgcaccgtgacgtgtaacatccctcctcaggaaatcctgaccagggactcagttaccacacaggtggacggtgtggtctactaccgaatctattcagccgtgtccgctgtcgctaatgtcaacgacgtccaccaagccacatttctgctcgcccagaccaccctcagaaatgtcttggggactcagaccctatcacaaatccttgctgggcgcgaggaaattgcacacagtatccagaccctgctggacgatgccaccgaactgtggggaattagagtcgctcgagtcgagatcaaggatgttcggattcccgtgcagctgcaacggtccatggccgccgaggccgaagccactcgcgaagctcgcgcaaaggtcctcgctgcagagggcgagatgaatgccagtaaatcactgaagtctgctagcatggtgctggccgagagcccaatagctcttcagctgagatacctacagacgttgagtacggtcgcaactgagaaaaatagcacgattgtgtttccactcccaatgaacatattggaaggcataggaggtgtctcctacgacaaccacaaaaagctgccgaataaggcctag

SEQ ID NO: 207239 - DNA, 849 bp, Artificial Sequence
  Description of Artificial Sequence: Synthetic coding sequence
atgaacagccggggcgagctggtgggcgtgaacaacaagcggctgggagtgtgcgggtggatcctcttttctttgtcattcttactcgtcattatcaccttccccatcagtatttggatgtgcttaaagataatcaaggagtacgaacgcgccgtagtttttcgtctgggacgaattcaggccgataaagccaagggccccggacttatcctcgtgcttccctgtatcgatgtgtttgttaaagtggatctcagaacagtgacctgtaatatcccccctcaggagattctgacacgggatagcgtgacgacacaggtcgatggtgttgtgtattacagaatctatagcgctgtgagcgcagtggcaaatgttaacgacgtacatcaggccacctttcttctggctcagacaacgttgagaaacgtcctgggaacccagacactgtctcagatcctggccggaagagaagaaatcgcacatagcatacagactctgctggatgacgccacggaactttggggaatcagagtggcacgggtggagattaaggacgttcgaatccccgtccagcttcagaggtccatggcagccgaggcagaggccacacgggaagctagagctaaggtgcttgcagcggaaggagagatgaatgcgtctaaaagcttgaagagcgcttccatggtgctggctgagtctccgattgctttacagttacgttatctgcagacgctatccacagtggcaaccgaaaaaaacagtacgatagtgttccccctgccaatgaacatcctcgagggcattggaggggtgagctacgacaatcacaagaagctgcctaataaggcctag

SEQ ID NO: 207240 - DNA, 2970 bp, Artificial Sequence
  Description of Artificial Sequence: Synthetic coding sequence
atggcccggcccgtgcagctggcccccggcagcctggccctggtgctatgtcgcctcgaggcccagaaagccgcaggcgccgctgaggaacccgggggacgggccgtcttccgagcatttagaagggcaaatgcacgttgtttttggaatgcaaggttggccagggccgcttctagactcgccttccagggatggctccgacggggagtcctattggttcgcgcacctcctgcttgtcttcaggttcttcgggacgcctggcgtcgccgggcactgcgacccccacggggatttcgtatacgggccgttggagacgtctttccagtccagatgaaccccattacccagagtcaattcgtgcccctgggcgaggtgctctgttgtgctatctctgatatgaacaccgcccagatcgtggtaacccaggaatccctgctggagagactgatgaagcactacccaggcattgctataccatccgaagatatactttatacaaccctggggaccctcatcaaggaacggaagatctatcatacgggcgaggggtacttcattgtcaccccacagacctactttattacaaacacaaccactcaggagaacaagcggatgctgccgagcgacgagagcaggctgatgcctgcgtcaatgacatacctggtgtcaatggagagctgtgccgagtccgcacaggagaatgcagctcccatcagccactgccaaagttgtcagtgcttcagggatatgcacacacaggacgtgcaagaggccccggttgcagccgaggttactcgcaaatcgcatcgcggcctgggcgaatctgtctcttgggtccagaatggtgcagtgtctgtctcagctgagcatcacatctgcgagtccactaagccacttccctatactcgtgataaagaaaagggaaaaaagtttgggttttcactcctgtggcgctctctatccaggaaggagaaacctaagacagagcatagttccttttcagcccagtttccaccagaggaatggcccgtgagagatgaagacgacctggacaatattcctagagacgtcgaacacgagatcataaaaaggatcaatccaatccttacagtcgataatctgatcaagcatactgtcctgatgcagaaatacgaagagcaaaaaaagtataatagccagggaacctccactgatatgctgactattggccataagtatcccagcaaagagggcgtgaagaaaagacaggggctctctgcgaagcctcaaggacagggccactcaaggcgcgacagacacaaggcacggaaccagggatcggaatttcagcctgggagcatcagattagaaaaacatccaaagctgcccgccacccagcctatacccagaattaaaagtcccaatgagatggtcggccagaagcctctgggggaaataacaactgttctggggtctcacctgatctataagaagaggatcagtaatccgtttcaggggttaagccacagaggtagcaccatctccaaaggccataagatacagaagactagcgacttaaagccaagtcagaccggtcctaaggaaaagccctttcagaaacctagaagcctcgactcaagtagaatcttcgatggcaaagccaaagagccatacgcggagcaaccaaatgataagatggaagcggagagcatctatatcaacgatcctacggtcaagccaattaacgatgacttccgcggacatttgttctcacacccacaacaatccatgttgcaaaatgatggcaagtgctgtcccttcatggaatctatgttgaggtacgaggtatacgggggcgagaacgaggttatccctgaggtcttgagaaagtcacattcacactttgataagcttggagagaccaaacagactccccattccttgccttcacgcggagcatcgttctccgaccggaccccgagcgcctgcagattagtggataataccattcatcaattccagaacctcggtttgctggactatccagtcggggtgaatccattgcggcaggctgcaagacaagacaaggactccgaggaactgctccgaaagggattcgtgcaggatgccgagactacctccctggaaaatgaacaattgagcaacgacgaccaagcactttaccagaatgaagtagaagacgatgatggagcctgtagctcactctaccttgaggaggacgatattagcgagaacgacgacctgagacagatgctcccaggccattcccagtactcttttacaggcggtagccagggcaatcaccttgggaaacaaaaggtaatcgagcgatccctaacagagtacaatagcactatggagagagtggagagccaggttttgaagagaaatgagtgttataagcccacgggcctgcacgccaccccaggcgagagccaggagcccaacctgtccgcagagtcttgcggcttaaactccggtgcccaatttggattcaattatgaggaggagcccagtgttgccaagtgcgtgcaagcaagcgcgccagcggacgagaggatatttgactattattctgctagaaaagcctcgttcgaggcagaggtcattcaggacaccataggagataccggcaagaagccggcctcctggtcccagtccccacaaaatcaagagatgagaaagcatttccctcagaagttccagctgtttaacacatcccacatgcccgtccttgcccaggacgttcagtatgagcactcacacttggaggggaccgagaaccactccatggccggagactcaggcatagactcccctagaactcagagtctcgggagcaacaacagcgtgattctggatggtctgaagcggcggcaaaattttctacaaaacgtcgaggggacaaaaagttcgcagccactcaccagcaactctctgctgcccctgacaccagttatcaatgtttag

SEQ ID NO: 207241 - DNA, 510 bp, Artificial Sequence
  Description of Artificial Sequence: Synthetic coding sequence
atggcccggcccgtgcagctggcccccggcagcctggccctggtgctttgtaggttggaggctcaaaaagcagcaggcgccgctgaagagccgggtggacgggctgtgtttcgggctttcaggcgcgccaatgcccgttgcttctggaacgcacggctcgccagagctgcctcccgcctggcatttcagggctggctcagacgtggggtcttgctggtgcgcgcccctccggcttgtctgcaggtgttgcgcgatgcctggagacgcagggctctgcgccctccacgcggctttagaatccgcgccgtaggcgacgtgtttcccgtgcagatgaacccaatcactcagtcacaatttgttcccctgggtgaggtgttgtgttgtgccattagtgacatgaataccgctcagatcgttgtgactcaggagagcctgctggagcgtctgatgaaacactacccagggcaccgcgtctgggacctgatcatccagtcattctggatggactag

SEQ ID NO: 207242 - DNA, 684 bp, Artificial Sequence
  Description of Artificial Sequence: Synthetic coding sequence
atggcccggcccgtgcagctggcccccggcagcctggccctggtgttatgtcggctagaggcacagaaggcagccggagcagccgaagagcccggggggcgcgccgtttttcgggccttccgcagggctaacgcgagatgtttctggaatgcgcggctggcccgcgctgcttccagactcgcatttcagggatggcttagacgaggcgtgctcctcgtcagagcccctcccgcctgtctgcaggtgctgcgcgatgcatggcgccgacgggccctgagaccccctcgaggctttagaatacgcgcagtgggtgatgtatttccggtgcagatgaaccctattacccaaagccaattcgttccattgggagaagttttgtgctgtgcgatttctgacatgaacacagcccaaatcgtggtcacgcaggagagcctgctcgagcgacttatgaaacattacccggggattgccatcccgtcggaagacattctatatactacactgggcacactgataaaggagcggaagatctatcacaccggagagggctacttcatcgtgaccccacagacttactttatcaccaatacaaccacccaggagaataaaagaatgcttccatctgatgagtcccggctcatgcctgcatctatgacatacctcgatacagagagcggcatatag

SEQ ID NO: 207243 - DNA, 2970 bp, Artificial Sequence
  Description of Artificial Sequence: Synthetic coding sequence
atggcccggcccgtgcagctggcccccggcagcctggccctggtgttatgtcgtctggaagcccaaaaagctgctggcgctgcagaggaaccagggggcagggctgtctttcgcgccttcaggcgggcaaacgccaggtgcttttggaacgcccgactcgcgcgtgcagcgtccaggctggcttttcagggttggctgaggaggggggtcctcttggtgcgcgctccccctgcatgtctgcaagtgctgcgcgatgcctggcggcggagggccctgaggccacccagaggtttccgtattcgcgccgtgggtgatgtcttcccagtgcagatgaatccgattacccagagccagttcgtgcctcttggcgaagtactatgctgcgccatctcagacatgaatacagcccagatcgtggttactcaggaaagcctgctggagagattaatgaagcactatcctgggatcgctattccttcagaagacattctgtataccactctggggacattaattaaggaaaggaaaatataccataccggtgagggttactttattgttacgccccaaacctactttatcacaaacactacaacccaggagaacaaacgcatgctccccagcgacgaatcccgactgatgccagcctctatgacgtatctggtttcgatggaaagctgcgccgagagcgcccaagagaacgctgcccccatttcacactgtcaatcctgtcagtgttttcgggacatgcatactcaggatgtccaggaagcaccagtcgcagcagaagtcactcggaagagccacagagggctaggcgaaagtgtgagttgggttcaaaacggtgctgtgtcagtctctgccgaacatcacatctgtgaatcaaccaaacctttgccatataccagagataaggagaaaggtaaaaaatttggtttttccctcctatggcgcagtttatccaggaaggagaagccaaagaccgagcactcttccttctcagctcagttccctcctgaggagtggcctgtgcgagacgaggacgacttagacaacatcccaagggacgtggagcatgagatcatcaaaaggatcaatcctatcctgaccgttgataacctgattaaacacacggtgcttatgcagaagtatgaagagcagaaaaagtacaactctcaggggacgtcaacggatatgctgaccattggtcacaaatacccctccaaggagggtgttaagaagcggcagggcttatccgccaagccgcaaggacaagggcacagcaggcgagaccggcacaaggcccgcaatcaaggttctgagtttcagcctggaagcattcggcttgagaagcatccaaaactccccgcgacccagcccatacctcgcatcaagtctcccaacgagatggtcgggcaaaagccactcggcgagatcacgactgtgctgggctcacacctcatttacaaaaagagaatctctaatccttttcaaggactgagccatcgtgggagcaccatcagtaaagggcacaaaatccagaaaacgtcagacttgaagcctagccagaccgggccaaaggagaaaccatttcagaagccacggtccttagactccagcaggattttcgatggaaaggccaaggagccctatgccgagcagcccaacgacaagatggaggcggaaagcatctatatcaacgatcctaccgtgaagccaattaatgacgactttcggggacacctattctcccacccacagcagtcaatgctgcagaatgacggaaagtgttgtcctttcatggagtcaatgctgcgctacgaggtgtatggtggcgagaacgaagtgattccagaagtgcttagaaagagtcactcgcatttcgacaagcttggagaaaccaagcaaacccctcactcactcccgagccgcggggcatctttctctgaccggacgccgtccgcctgccgactcgtcgacaacacaatacatcaattccagaacctgggcctactggattaccccgtgggagtcaatccgctgcgacaggcggcgcggcaagacaaggactctgaagagctgctcaggaagggcttcgtccaggacgccgagacaacttctctggagaatgaacagttgagcaacgacgatcaggccctctaccaaaacgaggtggaggacgacgacggagcctgttcttctctttatctggaagaggatgatatttccgaaaacgatgacctgagacaaatgctaccaggacatagccaatacagtttcacggggggcagccaggggaaccacttgggcaagcagaaagttatagaaaggagtttaacagagtataacagtacaatggagagggttgaatcccaagtgcttaaacgcaacgaatgttacaagcctactggtcttcacgcaaccccaggcgagtctcaggagcccaatcttagcgcagaatcctgcggtctcaatagcggtgcccagttcggatttaattacgaggaagagccaagtgtggctaaatgtgtgcaagcctcggcccctgctgacgagcgcatattcgattactacagtgcccggaaagcctccttcgaagccgaagtaatccaggacactataggcgatactggtaagaagcctgccagctggtcccagtccccccagaatcaggagatgaggaaacatttcccgcagaagttccagctgtttaacaccagccatatgccggttctagcccaagatgtgcagtacgagcactcacacctcgaagggacagaaaatcactcaatggctggggattctggaatcgactcccctaggactcaatccctgggcagtaataactctgttatactcgatggcttaaagcgccgccagaactttcttcagaatgtggagggcaccaaaagcagtcaaccactgacctcgaatagtctgctgcctctaacacctgtaattaacgtgtag

SEQ ID NO: 207244 - DNA, 2640 bp, Artificial Sequence
  Description of Artificial Sequence: Synthetic coding sequence
atgaaccccatcacccagagccagttcgtgcccctgggcgaggtgctctgctgtgcaatttccgatatgaataccgcgcagatagtcgtgacacaggagagtctgctcgaacgcctcatgaagcattaccctggcatcgctatccccagtgaggatattctgtatacaactcttgggacgctgattaaggaacgaaagatctaccacaccggggaaggatacttcattgtgactccccagacctattttatcaccaatacaacgacccaagagaacaagagaatgctgccctccgatgagagtcgcttgatgcctgcaagcatgacatacttggtttctatggagtcttgtgctgagtcagctcaggagaacgcagctcccatttctcactgccaatcctgccagtgcttccgtgatatgcacacccaggatgtgcaggaggctcctgtggccgccgaagtaacgagaaagagccaccgtggcttaggtgaatctgtgagctgggtgcagaacggagctgtaagcgtttcagctgagcatcatatttgtgagtctaccaagccccttccctatacccgcgacaaagaaaagggcaaaaaattcgggttttcactcctgtggcggtctttgtcacgtaaagaaaaaccaaagactgagcactcgtcgtttagtgcacagtttccaccagaggaatggcctgttcgcgacgaggatgatttggataatatccctcgcgacgtggagcatgaaataatcaagcggatcaacccgatcttgacagtggacaatttgatcaagcacacggtccttatgcagaaatatgaggagcagaaaaaatacaactcacaaggtacaagtacagatatgcttacaatcgggcataagtacccgtccaaggaaggggtgaagaaacggcaaggtttgtctgctaagccacagggacaaggtcattcgcgtcgcgataggcacaaggcccgcaatcagggtagtgaattccagcctggttcaattagactagaaaagcaccctaagctcccggccacgcagcccatcccccgcattaaaagccctaatgaaatggtgggacagaagcccctcggggagatcacgaccgttctcggctcccacctaatctataaaaaacgaatatccaacccgtttcaggggttatctcaccgcggtagcaccattagtaaagggcacaagatccagaaaacctccgatcttaaaccgtcgcagaccgggccaaaagaaaagcctttccagaaaccacgctcacttgattcatctcgcatcttcgacggtaaggccaaggaaccctatgctgagcagcctaatgataagatggaagccgagagcatctacatcaatgacccaaccgttaaaccaatcaacgatgacttccgtggccacttgttcagccacccacaacagtccatgctccagaacgacggcaaatgctgtcccttcatggaatctatgctaaggtacgaggtgtacggaggcgagaacgaggtgattcctgaggttctgcgaaaaagccacagccatttcgataagctgggtgaaacaaagcagactccccattctttgcccagtaggggggcctccttctctgaccgaacgccgtcagcctgtagattagtggataacactatccatcagtttcagaacctggggctgctggactaccccgtcggggtgaaccccctaaggcaggcagccaggcaggataaagatagcgaggaactcctcagaaaagggtttgtgcaggacgccgagacaaccagcctagaaaacgagcaactctctaacgatgaccaggcactataccagaacgaagtggaggacgatgacggagcctgttccagcctatatctggaggaggatgacatctcagagaatgacgatctgagacagatgctgcccggacacagccagtacagttttacgggaggcagtcagggcaaccaccttggcaaacagaaagtgatcgagaggtctctgacggaatacaactctactatggagcgcgtcgagagccaagtgctcaaacgcaacgaatgctataaaccaactggacttcacgcgacccccggggagagccaagaaccaaacttgagtgccgaaagctgtggcctgaacagtggagcccagttcggatttaattacgaggaggagccttctgtggccaagtgtgtgcaggcttccgcaccagctgatgaacggatctttgactattactccgctaggaaagcaagctttgaagcggaagtcattcaggacacaatcggcgatactgggaagaaacctgcctcatggtctcagagtccccagaatcaggaaatgcggaaacattttccccagaagttccaactctttaatacttcccacatgccagttctggctcaggatgtacaatacgagcacagtcatctggaaggaacggagaatcattccatggctggggactccggcatcgatagcccccgcactcagtccctgggttctaacaacagtgtaattctggatggactaaagcggcgccaaaactttcttcagaacgtcgagggcaccaaatcctcacagcccctgacgtccaacagcctcctccccctgacgccagtgattaatgtgtag

SEQ ID NO: 207245 - DNA, 4179 bp, Artificial Sequence
  Description of Artificial Sequence: Synthetic coding sequence
atggtggagcccggccaggacctgctgctggccgccctgagcgagtcgggaatttctccaaatgatctatttgacattgatgggggtgatgctggccttgctactccaatgcccaccccaagtgtccagcagtctgtgcctctgtcagcattagaactgggcctggaaacagaagcagctgtccctgtgaagcaggaacccgaaacagtgcccacacctgccctgttaaacgtgagacagcctccttctaccaccacctttgtgctgaatcagattaatcatttaccaccactgggctcaaccattgtgatgacaaaaacacctccggtaacaacaaaccgacaaaccatcaccctgactaagttcatccagaccacggcatccaccaggccttccgtaagtgctcctacagtgcgtaacgcaatgacctcggctccttcgaaagaccaggtacagctaaaagatctcctaaagaataactctcttaacgaactgatgaaactgaaacctccagccaatatagcccagcctgtggctacagctgccaccgatgtgagcaatggtaccgttaaaaaggaatcatccaacaaggagggtgcccggatgtggataaacgacatgaagatgagatcattttcccccaccatgaaagtgcctgtggtcaaagaagatgacgagcccgaggaggaggacgaggaagaaatgggacacgccgaaacatacgcggaatacatgccaatcaaactaaagatcgggctcagacatcctgatgccgtggtcgagacctcttctctgagctcagtaacaccgccagacgtgtggtataagacatcaatctccgaagagactatcgataacgggtggttatccgccctccagttggaagccatcacctacgccgcccagcaacacgagacgttcctccccaatggggatagagcaggcttcctcatcggtgacggtgctggggtcgggaaagggaggaccatcgctggaattatctacgaaaattacctcctgtcacgcaagagagcactatggttttccgtatcaaatgatttaaagtatgacgcagagcgggacctgcgagacatcggcgccaaaaacattctggttcatagtctcaataagtttaaatatggaaaaatcagctccaagcataatgggagcgttaagaagggagtgattttcgctacctattcttcactgatcggtgagagtcagagtggaggaaagtacaagaccagactgaagcagcttctgcattggtgcggcgatgacttcgatggggtgatcgtgttcgacgagtgccacaaggccaagaatctctgccccgtcggatccagcaaacctacaaagaccgggctcgctgtgctggagctgcagaacaagctgccaaaggcgcgagttgtctacgccagtgctactggcgcctccgaacctagaaatatggcttatatgaatagactgggtatttggggcgaaggcacaccattcagagagtttagcgatttcatccaggcagtggaaaggcggggagtgggggctatggaaattgtggccatggacatgaaactacggggaatgtacatcgcccggcaacttagttttaccggcgttaccttcaaaattgaggaggttctcctcagtcagtcctacgtgaagatgtataacaaagctgttaaactgtgggtgattgcccgcgaaagatttcagcaagcggccgacttgattgacgccgagcagcgtatgaagaagtctatgtgggggcagttctggtccgctcaccagaggtttttcaagtatctgtgcatcgccagcaaggtgaagagagtcgtgcagctggctagagaagagattaagaatggcaagtgcgttgttatcgggctacagtcaacaggagaagctaggactttggaggccctcgaagagggcgggggggaactcaacgattttgtgagcacagctaagggagtgttgcagtcccttatcgaaaagcatttccctgctcccgaccgcaaaaaattgtattctctgctcggcatcgacttgaccgcacccagcaacaatagctcccctagggattcaccctgcaaagagaacaaaatcaagaagagaaagggggaagagatcactagggaggccaagaaggctcgtaaggtgggggggctcactggatcctccagtgatgatagcgggagcgagtcagacgcctccgataacgaggagtccgattacgaaagctccaaaaatatgagctccggtgatgacgatgatttcaacccgttcctggatgagtctaatgaggatgacgagaatgacccttggctgatcagaaaagatcacaagaaaaataaagaaaaaaagaagaagaagtctattgatcccgatagtattcaatcagccttactcgcgagcggcctgggtagcaagcgcccaagcttttcatccacacccgtgatctcacccgcacctaacagtaccccagctaatagcaataccaacagcaattccagcttgattacatcccaggacgccgtggagagagcacaacaaatgaagaaagaccttttagacaagctggagaaacttgctgaagacctgccccctaacacactggatgagctgatcgatgaactcggagggcctgaaaacgtggctgaaatgaccgggcgcaaaggacgtgtcgtgagtaatgatgatggtagtatttcatacgaatccagaagtgagctggacgtccccgttgagatacttaacataaccgagaagcaacgcttcatggatggagataagaatatcgcaataatcagcgaagccgccagcagcggaatcagtctgcaggctgacagacgcgcaaaaaaccaacgaagacgggtgcatatgaccttggagctgccctggtccgccgatcgcgccatccagcagttcggacggacccatcggtccaaccaggtaaccgctcctgagtacgtcttcctaatttcagagttagctggggaacagaggtttgcgagcatcgttgccaagcgactggagtctctcggagccctgacacacggggatagacgcgccactgagagccgcgatcttagtcggttcaacttcgataacaaatacggaagaaacgccctagaaattgttatgaagtccattgttaatctagattcacctatggtttcgcctccccctgactacccgggcgagttctttaaagatgtgcggcagggattaataggagttggactgatcaacgtggaggaccggtcaggcattcttacactggacaaagactacaataatataggtaaattcctcaaccgtatcttaggaatggaggtccatcagcagaacgcactgttccaatacttcgcagacaccctgacggctgtggtccaaaacgctaaaaagaatggccgctatgatatggggatactagatctagggagtggagacgagaaagtgagaaagagtgatgtcaagaagtttttaacacctggatactcaacatcggggcacgtggaactgtacacaatctctgtcgagagaggcatgagctgggaggaagcaactaaaatctgggctgagctcaccggtccggatgatggattttacctcagcctacagattcggaacaataagaagacagccatactggtgaaagaggtcaaccctaagaagaaactttttctcgtgtataggccgaatacagggaaacagctcaaactggagatctacgcagatttgaaaaaaaagtacaaaaaggtcgtgagcgatgacgccctgatgcactggttagaccagtacaatagcagcgcagatacgtgtacccatgcctactggcgggggaattgcaagaaggctagcctggggctagtctgcgaaattggcctgagatgccgcacgtactatgtcctgtgcggtagcgttttgagcgtctggaccaaagttgaaggagtcctggcaagcgtctcaggcacaaacgtaaagatgcaaatcgtacgattaagaacagaagacgggcagcgaattgtcgggttaattatccccgctaattgcgtctcacctctggtaaaccttctgtcaacaagcgatcagtctcagcaactggctgtccagcagaagcagttgtggcagcagcaccatccacagagtatcactaatttgagtaatgcttag

SEQ ID NO: 207246 - DNA, 4182 bp, Artificial Sequence
  Description of Artificial Sequence: Synthetic coding sequence
atggtggagcccggccaggacctgctgctggccgccctgagcgagtccggaattagcccaaatgatctattcgatatcgacgggggagacgccggtctcgccacacctatgcctacaccttcagtacagcagtctgtgccccttagcgcactggagcttgggctcgaaaccgaagccgccgtccccgtcaaacaggagcccgaaaccgtccccacgcctgccttactaaatgtccgccagcaacccccaagcactaccacttttgtgctgaaccagataaatcacctccctccgctcggcagcaccatagttatgacaaaaacacctccggtcaccactaatcgccagaccattactctcacaaaattcatccagacaactgcttccacacggccgtctgtgagtgcccccaccgtccgaaacgccatgacttctgccccctcaaaggaccaagtacaactgaaagatttactgaagaacaattcgctaaatgaactcatgaaactgaagccaccagccaacattgctcagcccgtagccacagccgccaccgatgtttcaaatggaactgtaaagaaagagtcatccaataaagagggcgccaggatgtggattaatgacatgaagatgcgcagcttttctcccaccatgaaggtgcctgtggtgaaggaagacgacgagccggaggaagaagacgaagaagaaatgggccatgccgagacctatgcagagtacatgcccataaaactgaagataggtctgcggcacccagatgcagtagttgagacctcgtcgctgtcttcagtgactcccccagacgtctggtacaagacatcaatttcagaggaaaccatcgataatggctggctgtccgctctgcagcttgaggcaataacctatgccgcgcagcagcatgaaacattcctcccaaacggcgaccgggcagggttcctgatcggcgatggtgctggtgtcggcaaggggcgaaccatcgctggcatcatatatgaaaactacctgctctcccggaagcgagccctgtggttcagtgtgtctaatgacctcaaatatgacgccgagcgcgacctccgcgatattggtgcaaaaaatattttggtgcactccctgaataagttcaagtatggaaagatctcttctaagcacaatggttctgtcaaaaaaggggtgatttttgcaacatatagcagtctgattggtgagagccagtcgggcggaaagtacaagacacgcctcaaacaactcctccactggtgtggagatgactttgatggcgtgatagtgttcgacgaatgtcataaggccaaaaatctttgcccagtcggcagtagcaaacccaccaagactgggctggccgtgctcgaactccagaacaagctgcctaaggctagggtggtgtacgccagtgccaccggtgcatcagagccccgaaatatggcctatatgaaccggctcgggatctggggggagggaacacctttcagggagttttccgacttcattcaggccgtcgaacgacgcggcgtcggagccatggagatcgttgcgatggacatgaaactgcgaggaatgtacattgcccggcagctctctttcaccggggttacattcaaaattgaagaagtgttgctgagtcagagctacgtgaaaatgtataataaggccgtgaaattatgggtcatagctcgtgaaaggtttcagcaggccgctgacttaattgacgctgagcagaggatgaaaaagagtatgtggggccagttctggagtgctcatcagaggttcttcaaatacttgtgtatcgcgtcgaaggtgaaacgggtcgtacagctggctcgcgaggaaattaagaacggcaaatgtgtcgtcatcggcctgcaatccactggtgaggctaggacattggaagccctggaggaaggtggcggagagctgaacgactttgtttcaacagcaaaaggtgtgctccaatcattgatagagaagcacttcccagcgccagaccggaagaagctgtatagcctcctgggaatagacttgactgctccctctaacaattcctcacctcgagacagcccctgcaaggagaacaagattaagaagaggaagggcgaggaaattactcgcgaggccaagaaggctcgcaaggtcggagggcttaccggatcctcaagcgacgatagcgggagtgaaagcgatgcatcagacaacgaggaaagtgactatgagtcttccaaaaacatgtcttccggggacgatgatgatttcaatcccttcctggatgaaagcaacgaagatgacgaaaacgacccatggttgatccggaaagatcataagaagaacaaagagaagaaaaaaaagaaatctatcgacccggactcaattcagtccgctctcctggccagcggcttgggctccaaacggccgtcattctcaagcacccccgtcatcagccccgctccgaacagtacgcctgctaatagcaatacaaactctaactcaagcctcatcaccagtcaagatgcagtagaacgtgcacaacagatgaaaaaggacctactcgataaacttgaaaagctggccgaagacctgcctcccaataccttggacgaactcatcgacgagttaggaggccccgagaacgtagccgagatgacggggagaaagggcagggttgtctcgaatgacgatggtagtatatcttatgagagcaggtccgaactggatgtccccgtcgagatactgaacatcaccgagaaacagcggtttatggacggcgataagaatattgccattatcagcgaagcggccagttcaggtattagtctacaagccgatagaagagccaagaaccagagaaggagggttcacatgaccctcgaacttccatggtccgctgatcgcgcaatacaacagttcggacgcactcaccggtctaatcaggtgactgctcccgagtacgtctttctgatttcagagctggcaggcgaacaacgattcgcgagcatagtcgcaaaaaggctggagagcctgggtgctttgacacatggggaccgccgcgcgaccgagagccgcgacctgtcacggtttaatttcgacaataaatatggcagaaatgccctggaaatcgtgatgaagtctatcgtgaatttggatagtcccatggtgtccccgcctcctgattatccaggggaattcttcaaagacgtccgccagggactaatcggcgtcggactcatcaatgtggaagataggtccggtatactcacactggacaaggattataacaacattggcaaattcctgaatcgtattttagggatggaggttcatcaacagaacgccctcttccagtatttcgctgatacgctgactgcggtggtgcagaacgctaaaaagaacggaaggtacgatatgggcatcctggatttgggctcaggcgacgagaaggtacgaaagagcgatgtaaagaaatttctgacacccggatactctactagtgggcacgtcgagctctacacaatttctgtggagcgcggaatgtcctgggaagaggccacaaagatctgggctgaactaaccggccctgacgatggattctacctctccttgcagataagaaataataagaaaactgccatcctagttaaagaagtcaacccaaagaaaaaactgtttttagtgtatcgtcccaatactggaaagcaactcaaactggaaatttacgcggatctaaagaagaaatacaagaaggtggtaagcgatgatgcccttatgcactggctagatcagtacaattcatcagcagatacctgtactcacgcttattggcgcggaaactgtaaaaaagcctctttggggttggtctgcgagattgggctgagatgtaggacttactatgtgctctgcggcagcgtgctatcagtgtggaccaaggtcgaaggggtcctggccagtgtttctggtacaaatgtcaaaatgcaaatcgtcagactgcggaccgaggacggccagcggatagtgggcctcattattcctgcgaactgcgtctctccacttgtgaacctgttatctacaagtgatcagtcgcagcagctggccgtgcagcagaagcaactgtggcagcagcatcacccacagtctatcactaatctttctaatgcctag

SEQ ID NO: 207247 - DNA, 2199 bp, Artificial Sequence
  Description of Artificial Sequence: Synthetic coding sequence
atggtggagcccggccaggacctgctgctggccgccctgagcgagtccggcatctcccctaacgatttgtttgatattgacggaggggacgccggtcttgccacaccaatgcccacaccatccgtgcagcagtctgtgccactgtctgcattagagttagggcttgagaccgaggccgccgtacctgttaaacaggagccagagacagtgcctacgccggccctcctgaatgttcggcagcccccttctacaaccaccttcgtcctcaatcagattaaccacctgcccccacttgggagcaccatcgtcatgacaaaaaccccccccgtaaccactaaccggcagacaatcacactgacaaaattcattcagacaaccgcatccactagacctagcgtttcagctccgacagttagaaatgcaatgaccagtgcgccctccaaagaccaagtgcaattgaaagacctgttgaaaaataacagtctaaacgagctgatgaagctgaagcccccagccaacatcgctcagcctgtcgccaccgctgcgaccgatgtgtccaatggtaccgtcaagaaggagtcaagtaacaaggaaggggcgagaatgtggatcaacgacatgaaaatgagatccttcagtccaactatgaaggtgcctgtcgttaaagaagacgatgagccagaagaagaagacgaggaggagatggggcacgccgaaacttacgccgagtacatgcccattaaactaaagatcggcctgagacatcccgatgccgtggtggagacgtcgtcactctcgtccgtgactcctcctgatgtctggtacaagacatcaatctccgaggaaacaattgacaacgggtggctgtccgccctgcagctggaagctataacgtacgctgctcagcagcatgaaacatttttacccaatggcgatcgggccggatttctcattggggacggagcaggtgtaggcaagggccgcactattgcagggattatatacgaaaactacctgttatcccgaaagcgcgcgctctggttttcagtatctaatgacttaaaatacgatgctgagagggacctgcgggacatcggcgcaaaaaacattcttgtgcactctttgaacaaattcaaatacggaaagatttctagtaagcacaatgggtctgtgaaaaaaggagtgatatttgcgacgtactcctctctgataggggaatcgcagtctggaggcaaatacaagacaagactcaaacagctgctgcattggtgtggcgacgatttcgacggtgtgatcgtgtttgatgagtgccacaaagctaaaaacctgtgtcccgtgggctcaagtaaaccaaccaagacagggctggcggtgctggaattgcagaacaaactccctaaagctcgagtggtatatgcctcagcaaccggcgcttcagagccgagaaatatggcatacatgaaccggttaggaatttggggggaagggacccctttcagagaattttccgatttcatccaggccgtggaaagaagaggcgtcggagctatggaaattgtggcaatggacatgaagctgcgtggaatgtatatcgcacggcaactgagcttcaccggagtcaccttcaaaattgaggaggtgttactgtcacagagctatgtgaaaatgtacaataaagctgtcaagctatgggtcatcgctcgtgagcgctttcagcaagcagccgacctcatagacgccgaacagagaatgaagaagagcatgtggggccaattctggtccgcacaccagagattcttcaaatacctgtgcatagcctctaaagtgaaacgcgtcgtacagttggcaagggaggaaattaagaatgggaaatgcgtggtcatcgggctgcaatccactggtgaagccaggaccctcgaggctctagaggaaggcgggggagaattgaatgactttgtgagcacagctaaaggggtgctccagagccttatagagaaacactttcccgcccccgaccgaaaaaagctgtactctctcctgggtattgacctgacggcaccttcaaacaattcctctcctcgggactccccgtgcaaagagaataagattaagaagcggaaaggagaggagattactcgtgaagccaagaaagcacggaagatgtccctcatgcgcatgatgaagatggtgtcatcatag

SEQ ID NO: 207248 - DNA, 1632 bp, Artificial Sequence
  Description of Artificial Sequence: Synthetic coding sequence
atggagcaggtgaacgagctgaaggagaagggcaacaaggccctgagtgtggggaacatcgacgatgccctgcaatgttattctgaagccatcaagctcgatcctcacaaccacgtgctttatagcaatcggagcgcagcctacgctaaaaagggggattatcagaaggcctacgaggatggttgtaagacagttgatctgaagcctgactggggcaaaggatactcaagaaaagcagccgctctggagtttttgaaccgcttcgaagaagccaaaagaacctatgaagaggggttaaaacacgaagccaacaatccccagctgaaagaggggctgcagaacatggaggctagactggccgagaggaaattcatgaacccattcaacatgcctaacctgtaccagaagctcgagagcgaccccagaaccaggacacttctgtctgacccaacttatcgggagttgattgagcagctccgcaacaagccttcggatctgggtacaaaattgcaggacccccgcataatgaccaccctgtctgttctgctcggagtcgaccttggttcaatggatgaagaagaagaaattgccacgccacctccccctccccctccaaagaaagagaccaagcctgagccaatggaggaggacctcccagaaaacaagaagcaagccctaaaggagaaggagctagggaacgatgcatataaaaagaaagattttgacacggctttgaaacactatgataaggctaaagagttggatcctactaatatgacatacatcaccaatcaggcggccgtgtatttcgagaagggggactataacaagtgcagggaattgtgtgagaaggccattgaagtgggacgtgaaaacagggaggattatcgacagattgcaaaggcatatgccagaattggtaactcttacttcaaggaagagaagtataaggacgccatccatttctacaataagtctttggccgagcatagaacacctgacgtgctgaaaaaatgtcagcaagctgaaaagatactaaaggagcaggaacgcttagcatacatcaaccccgatcttgcattggaagagaagaacaagggcaacgaatgtttccagaaaggcgactacccccaagctatgaagcactatacggaagccatcaagcgcaatcccaaggacgcaaagctatactcaaaccgggctgcttgttacacaaaattactggagttccagctggcgttgaaggactgcgaggagtgcattcagctcgagccgaccttcatcaaaggctacaccagaaaagctgcagcgctggaggctatgaaggactatacaaaggccatggacgtttaccagaaggctttggacctggatagctcctgtaaggaagctgctgatggttatcagcggtgcatgatggcacaatacaatagacatgattccccagaagatgtgaaaagaagggcgatggccgatcccgaggtacaacagatcatgtcagatccggcgatgagactaattctggaacagatgcagaaggatccgcaggcgttaagcgaacaccttaagaacccagtgatcgcccaaaaaatccaaaaactgatggacgtcgggttgatcgccatacggtag

SEQ ID NO: 207249 - DNA, 1359 bp, Artificial Sequence
  Description of Artificial Sequence: Synthetic coding sequence
atgaaccggcagctggtgaacatcctgaccgccctgttcgccttcttcctggagacaaaccatttcagaaccgcattctgcaaggaccacgactcaaggagcgggaagcagccctctcagaccctatccccgtcagatttcttagacaagctgatgggtaggacttccgggtacgacgcccggatcaggccaaactttaagggcccacctgttaacgtcacttgcaatattttcattaattcgtttgggagcgttactgagaccaccatggactatcgagtgaatatctttctacgccaacagtggaacgattcccggctggcctattccgaatatcccgacgacagcctggatcttgacccctctatgctcgactctatatggaagcctgacctgttctttgccaatgagaaaggcgcaaactttcacgatgtcacaactgataacaagctattacgcatttcgaaaaatggaaaggtcctatactctatcagactcaccttgacgttaagttgtcctatggatctaaagaatttccctatggatgtacagacatgcacaatgcagctggagagttttggttatactatgaacgacttgatatttgagtggctgtccgacggccctgtccaggtcgcggagggattgacacttcctcagtttatcttgaaggaggagaaagagctcggctattgtaccaagcattataacaccggaaaatttacttgcatagaggtgaagttccatctggaacgtcagatggggtactaccttattcaaatgtacattccctcccttcttatcgtgattctgagctgggtgtccttctggattaacatggatgccgcaccagctcgtgtggctctgggaattacaacagtactgacaatgactacccagagcagcgggtccagagcctcgttgcccaaggtatcttacgtgaaggcgatcgatatctggatggctgtgtgtctcctttttgttttcgctgctctgttagagtatgccgccgtgaacttcgtgtctagacaacacaaagaattcctgaggcttaggaggcgtcaaaagcggcagaataaagaagaagatgtgacccgggagtcgagattcaatttttccggttacggtatgggccactgtctccaggtgaaagatggcaccgccgtcaaggccacccccgcgaatcccctgcctcagcctccgaaggatggggatgctattaagaagaagtttgtggatagagccaagagaatcgacacaataagtagagccgcctttcctctggcgtttttgatctttaacattttttactggatcacttataaaataattaggcacgaggacgtccataaaaaatag

SEQ ID NO: 207250 - DNA, 3489 bp, Artificial Sequence
  Description of Artificial Sequence: Synthetic coding sequence
atgaacggccaccaccagcagaacggcgtggagaacatgatgctgtttgaggtggtgaaaatggggaaatccgccatgcagagtgtggtggatgactggatagagagttacaaacacgatagggatattgccctattggacttaataaacttctttatacagtgcagtggctgtaaaggcgtagtaacggccgagatgtttcgccatatgcagaatagcgagataatccggaagatgactgaggagttcgatgaggatagcggggactatcctcttacaatggcaggcccacagtggaaaaagtttaagagttctttttgcgagttcatcggagtgctagtgcgccaatgtcagtattccataatctatgatgagtacatgatggacacagtcattagcctcctgactggccttagcgattcccaggttcgggcatttcgccatacttcgaccctagctgcaatgaagttaatgaccgctctggttaacgtggctctgaatctatccataaatatggacaacacccagcgtcagtatgaagcagagcgaaataaaatgatcggaaagagagcgaacgagagactggagctcttgttacagaagcggaaggaactccaggagaatcaggatgagattgagaatatgatgaacgccatctttaaaggtgtatttgtgcaccgatatagagacgcgattgccgagatccgcgccatctgtatagaggaaattgggatctggatgaagatgtacagcgacgcttttctgaacgatagctatctgaaatatgtgggttggactatgcacgataaacagggcgaggtgcgcctaaagtgtctcacggcactgcagggcctgtattacaataaagagctgaattccaagctggagctattcacctcccggtttaaggaccggattgtgtccatgactctcgacaaggagtacgatgtcgccgtgcaggccatcaagttgctaacactcgtcctgcagagcagcgaggaagtgctgactgccgaagactgcgaaaacgtttaccatttggtttactccgctcacagacccgttgccgttgcagccggcgagtttctgtacaagaagttgttttctagaagggatccggaggaagatggcatgatgaagaggaggggccggcaaggtccaaatgctaatcttgtgaaaaccctggtttttttctttctggagagcgagctccacgagcatgctgcctatcttgtggactccatgtgggattgtgcaacagagcttctcaaggattgggagtgtatgaattctctgttactggaggagcctctgtccggagaagaagcactcaccgaccggcaggagagcgctctaatagagatcatgctgtgtacaataaggcaggccgctgagtgccacccacctgtaggaaggggtaccgggaagcgggtactgaccgccaaggagaaaaagactcaactggacgaccgcacgaaaattactgagctcttcgcggtggcgttaccacaacttctagccaagtatagcgtcgacgccgaaaaagtaaccaacctgctccagctgccccagtacttcgacttagagatctataccacggggcgtttggagaaacatttagacgctttgttgaggcagattaggaacattgtggagaagcatactgacacagacgtcctcgaagcctgttctaaaacttaccatgctctctgtaatgaggaatttaccatctttaatagggtcgacatctccagatcgcagctaatcgatgagctcgctgataagttcaaccgtctgctggaagacttcctccaggaaggtgaagagcccgatgaggatgacgcctaccaggttttatccacactcaaaagaataaccgcatttcataacgcccatgatttaagcaaatgggatctgttcgcatgcaattacaaactgctgaaaaccggtattgaaaacggagacatgccagagcagatcgtgatacacgccctgcagtgcactcattacgtgatactatggcagctcgccaagatcaccgagtcgtcttctacaaaggaagacttgctccggctgaagaaacagatgagggtcttttgccaaatttgccagcactatctgactaacgtcaacactacagtcaaggagcaggcgttcacaatactgtgtgacattctgatgatattctcccaccagataatgtctggagggagggacatgctagaaccgttggtttatacacctgattcctctctccagtctgaactcctgtcctttattctcgatcacgtattcatagaacaagatgacgacaataactcagccgacggccagcaggaggatgaggcgagcaaaatcgaagccttgcacaagaggcgaaatcttctggctgcattctgcaagctaattgtgtataccgtggtggaaatgaataccgcagctgacatatttaagcagtatatgaaatattataatgattatggagatattattaaggaaactatgtcgaaaactcggcagatcgacaaaattcagtgcgccaaaacattgatactctcactgcagcagttgttcaatgagatgattcaggaaaatggatacaactttgacaggagctcttctaccttctccggtattaaagagcttgcaagacgctttgcccttacatttgggttagatcagctgaagactcgggaggcaattgcaatgctccataaagacggaattgaatttgccttcaaagaaccaaatcctcagggagagtcccaccctcccctgaacctggcgttcctcgatatactatctgagttcagctccaaattgttacggcaggataaacgaaccgtgtatgtttacctcgagaaattcatgaccttccaaatgtctctccgccgggaagatgtgtggttaccgctgatgtcctaccggaatagtctcctggcagggggggacgacgacaccatgagcgtgatctcaggtatctcgtcaaggggctcaacagtaagaagcaagaaatccaaaccatccacggggaagaggaaggtagtggaaggtatgcagttatcacttactgaagagagttcatctagcgactcaatgtggctctctcgggagcaaacgttgcatacacccgtgatgatgcagacaccacaactcactagcacaattatgcgggagccaaagagactgcgcccagaggattccttcatgtcagtgtaccccatgcagaccgagcaccaccagaccccactggactataaccgacgggggacatctctgatggaggatgacgaggagcctatcgtggaagatgtcatgatgagtagcgagggacgcatcgaagatctgaacgaaggcatggatttcgatacgatggacatcgacctgccaccatccaagaaccggcgggagagaaccgagctcaaacctgatttttttgatcctgcctcgatcatggatgagagcgtgcttggtgtgtccatgttttag

SEQ ID NO: 207251 - DNA, 3696 bp, Artificial Sequence
  Description of Artificial Sequence: Synthetic coding sequence
atgatcgccgcccccgagatccccaccgacttcaacctgctgcaggaatccgagacacactttagctctgacactgactttgaagatatagaaggcaaaaaccagaagcaagggaagggcaagacctgtaaaaagggaaaaaagggcccagcggaaaaagggaaaggaggtaatggcggggggaaacctcctagcggcccaaatagaatgaacggccaccaccagcaaaacggcgtcgaaaacatgatgctgttcgaagtcgttaagatgggtaaatctgccatgcagagtgttgtcgatgactggattgagtcttacaagcatgaccgcgacatagcattgctggacctcatcaactttttcattcagtgctccggctgtaagggtgtggtcacagccgagatgtttagacacatgcagaacagtgaaatcattaggaagatgaccgaggagttcgatgaagactctggagattatcccctcacgatggctggaccacaatggaagaaattcaaaagtagtttttgtgaatttatcggcgtgctggtccgtcagtgccaatattccatcatttacgacgagtacatgatggacactgtcatttctctgttgactgggttgtccgactctcaggtgagggcattccgacacaccagcactctcgctgctatgaaactgatgaccgccctcgtaaatgtcgccctgaatcttagcatcaacatggataatacccaacgccagtacgaggctgaaagaaataagatgattggcaaaagggcaaacgagcgtctggaattactgctacaaaagaggaaggagctgcaggagaatcaggatgaaattgagaatatgatgaacgctatctttaaaggagtatttgtccatcgatatcgtgatgctatcgccgagattagagccatctgtatcgaagagattggaatctggatgaaaatgtacagcgatgcattcctcaatgactcttacctgaagtatgtcggttggacaatgcacgacaaacagggggaggtcagacttaagtgccttaccgccttgcagggcctgtattacaacaaagagctgaattccaaattggagctgttcacatcgcggttcaaggataggatcgtgtcaatgacgcttgataaagagtacgacgtggctgtgcaagctattaaactgctcactcttgtcctgcagtcttcggaggaggtcctcaccgccgaggactgcgaaaatgtttatcacttagtttattctgcacaccgtcccgttgccgtcgcagcaggagagttcctctacaaaaaattgttctccagacgggaccccgaagaagatggaatgatgaagcgcaggggtcgccaaggcccgaacgccaacctggtcaaaacacttgtatttttctttctggagtctgaactgcatgagcacgcagcctatttagtagatagtatgtgggactgcgccacagagcttcttaaagattgggagtgtatgaactctcttctgctagaagagcctttgtccggagaggaggctctgacagaccgccaggaatctgcactgatagaaatcatgttgtgtacaattaggcaggcggccgaatgccaccctccagtggggcgagggacaggaaagcgcgtacttaccgccaaagagaagaaaacccagctagatgatcgtaccaagatcactgagctctttgccgtggccctaccccagttacttgcaaagtattctgtggacgctgagaaagtgactaatcttctccagttgccacagtacttcgacctggaaatatacactaccggcagattggaaaaacacctagatgccctgcttcgacaaatccggaatatagtggagaagcatactgacacagacgttcttgaggcctgtagcaagacctaccacgctctttgcaacgaggagttcacgatcttcaaccgggtggatatcagccgctctcagctgatcgacgaactcgccgacaaatttaatcgcctccttgaggacttcttacaagagggcgaagagccagacgaggacgacgcttaccaggtcctctcgacgctgaaaagaatcacagctttccataatgctcacgacttgtcaaaatgggatctgtttgcctgtaactacaaattacttaagacaggcattgaaaacggcgacatgccagagcagatagttatccacgccctgcagtgtacacactacgtgatcctgtggcagctggctaagataactgaaagctcctcaactaaggaggacctgttgagactcaaaaagcagatgagagtgttttgccagatctgtcaacattacctcaccaacgtgaacactacggtcaaagagcaggcattcacgatcctatgcgacatcctgatgattttttctcaccaaataatgagcggtggacgcgacatgctcgagcccttagtctacacgcctgacagttctttgcagagcgaactgttgtcattcatcctggaccacgtatttatcgagcaggatgatgacaataactcagctgatgggcagcaagaggatgaggctagcaaaatagaggccttgcataagaggaggaatctactggcagccttctgcaagctgatcgtgtacacggttgtggagatgaacacggctgccgatattttcaagcagtatatgaaatactataacgactacggggacattattaaggaaacaatgtcgaagacgagacaaattgataagattcagtgcgctaagactctaattctgtctttacagcagctgtttaatgaaatgattcaggagaacgggtacaatttcgaccgcagtagctccacttttagtggaatcaaagaacttgcccgccgattcgccctgacctttggacttgatcagttaaaaacacgtgaggcaattgctatgctccacaaagatggtatagagtttgcttttaaggagcctaaccctcagggcgagtcccacccacctctcaatctggcattcctggacattctctctgaattctcttctaaacttctgcgccaggataagagaacagtgtatgtgtatctcgaaaagtttatgaccttccagatgtccctgcgaagggaggacgtttggttgccactgatgtcttaccgcaattccctgctggccggtggcgatgatgacactatgtccgtgatcagcggtataagcagcagaggttctactgtgcggagcaagaaaagtaagccaagcaccggcaaacgtaaggtcgtggagggcatgcagctgagcctcacagaggaatctagttccagcgactctatgtggctgtcacgggagcagaccctgcatacccccgtgatgatgcagacaccgcaactcacatccaccattatgagggagcccaaacgtctgcgacctgaagattcttttatgtcagtgtaccccatgcaaacagagcatcatcaaacccccttggattataaccgcagaggaacgtccctaatggaggacgacgaggagcccatcgtggaggacgtgatgatgtcgtccgaaggacgaatagaggacttgaatgaggggatggattttgataccatggacatagatctgccgcctagcaaaaacagacgtgagagaactgaattgaagcctgacttttttgatcccgctagcatcatggacgaatcagtactcggagtctccatgttttag

SEQ ID NO: 207252 - DNA, 3807 bp, Artificial Sequence
  Description of Artificial Sequence: Synthetic coding sequence
atgatcgccgcccccgagatccccaccgacttcaacctgctgcaggaatcggagacacatttctcatccgatacagacttcgaggatatcgaaggtaaaaaccaaaagcagggtaagggcaagacctgcaaaaagggcaaaaaaggccccgcagaaaagggtaagggagggaacggtggggggaagcctccgtcaggacctaaccggatgaacgggcaccatcagcagaacggtgtcgagaacatgatgctattcgaggtggtgaaaatgggcaagagtgccatgcagagcgtggttgatgactggatcgagtcttacaaacatgaccgagatattgcactgttagacctcataaactttttcatccagtgcagtggatgtaaaggggtggtgaccgccgagatgttccgccacatgcagaatagtgaaatcatccggaagatgacagaggagtttgacgaggatagcggcgattacccgctgaccatggccggaccccagtggaaaaagttcaaatccagcttctgtgagtttatcggggtgctggtgcgtcagtgccagtattccattatctacgatgaatatatgatggacaccgtcatcagcctgctgacgggtctgtcagattctcaggtgcgggcgtttagacatacgagcacactggcggccatgaaactgatgaccgctctggtaaatgtagcactcaacctgtctattaacatggataacacacagcggcagtatgaggccgagcgtaacaaaatgatcggaaagcgggcgaatgagcgcttggagctgcttctgcaaaagagaaaggagctccaggagaatcaggatgaaattgagaatatgatgaatgccatcttcaagggtgttttcgtccacaggtatagggatgctatagctgagatccgcgcaatctgtattgaagaaattggcatctggatgaaaatgtactcagatgccttcctgaacgattcctacttgaagtacgtgggctggacaatgcacgacaagcagggcgaggtgagactgaagtgtctgaccgctctgcaaggcttgtattataacaaggagttaaatagcaaactcgagctcttcacttcgaggttcaaagacagaatcgtcagtatgaccctggataaagaatatgacgtcgccgtgcaggcgatcaagctgctgacattagttctgcaatcatcagaggaggtattaaccgctgaggactgcgaaaacgtgtaccacctggtgtattcggctcataggccagtcgctgtggcagccggcgagtttttatataaaaagctgttctcccggagggaccctgaggaagacggaatgatgaaaaggagagggcgacagggccctaatgctaacctggtaaaaactctcgtcttcttcttcctggaatccgagctgcacgagcacgccgcttatttggtcgactctatgtgggactgcgcaacagagctcctgaaggattgggagtgtatgaactctcttctgctcgaggaaccattgagcggcgaagaggcattgaccgacaggcaggagtccgcattgatagagatcatgctatgtacaattaggcaggctgccgagtgccatcctcccgtcggaaggggtactggcaagcgagtactcacagccaaagaaaagaagacccagctggacgacagaacaaagatcacggaactgttcgctgttgctctacctcagctgttagccaagtacagcgtcgacgcagagaaagtgaccaacctcctgcaactgcctcaatactttgatcttgaaatctacacaacaggacggttggagaaacatttagacgcacttcttagacaaatccgcaacattgtggagaagcacactgatactgacgtgcttgaggcctgctctaagacctaccacgccctgtgcaatgaggagttcactattttcaaccgcgtggacatctcgagatcacagctgattgacgaactggcagacaaatttaaccgcctcttggaggattttctgcaggaaggggaggagcccgatgaggacgacgcctatcaagtactttctacactcaagcggataactgcattccacaatgcgcatgatttgtctaaatgggacttgtttgcttgtaactacaaactactgaaaaccggtatcgaaaatggggatatgcccgagcaaatcgtaatccatgctctccagtgcacacattacgtgattctgtggcaacttgccaaaattacagaatctagttccactaaggaggacctcctccgactgaagaagcagatgagagtgttctgtcagatttgtcagcactacttgacaaatgtaaacacaaccgttaaggagcaagctttcacaattctgtgtgacatcctcatgatcttttcacaccagatcatgtccggtgggcgggatatgcttgagcctctggtttacacccctgacagctctctccagagcgaactcctatccttcattttggaccacgtttttattgagcaagacgatgacaataactcagcagatggacagcaagaagacgaggcgtctaaaatcgaagccctgcataagcgacgtaatctgttggccgccttttgcaagcttattgtgtacaccgtggtcgaaatgaacaccgcagccgacatattcaaacagtacatgaaatattataacgattatggggatataataaaggagaccatgagcaaaactcgccagatcgacaagatccagtgcgctaagacactgatcctgagtctgcagcaactgtttaacgagatgatccaggagaacggctacaattttgaccgcagcagtagtaccttttctgggatcaaggagctggccagacgttttgcccttacctttggcctggatcagctcaaaaccagagaggcaattgctatgctccataaggatggaatcgaattcgccttcaaggaacctaatcctcagggcgagtctcaccctcccctgaatttagcctttctggatattctaagcgagttcagtagtaaactgttgaggcaggataaaagaacggtgtatgtgtacctggagaaattcatgaccttccagatgtccctgcggcgggaagacgtgtggcttcccctgatgtcttatcggaatagcctcctcgccggaggagacgatgacactatgagcgtcatcagcgggatttcctcacgcggaagtaccgtgagatcaaagaagagtaaaccatccacaggaaaacgcaaagtggtggagggaatgcaactgtctctcacagaggaaagctcctcaagcgattctatgtggcttagccgtgagcagacactgcacacacccgtgatgatgcagactccacagttgacatctaccatcatgagagagcctaaacgactgcgtcctgaggactctttcatgtccgtgtaccccatgcagacagaacatcatcaaacgcctctggactataatacccaggtaacatggatgttggcacagcgtcagcaagaggaggccagacaacagcaggaacgtgcagcaatgagctatgtaaagttgcggaccaacctccaacacgctatcagaagaggaacctccttaatggaggatgacgaggaacctatagtagaagacgtgatgatgtcctcagagggtcgaatcgaagatttgaatgaggggatggacttcgacacaatggatatcgacttaccacctagcaaaaacaggagggaacggaccgagctgaaacctgatttttttgaccctgccagtattatggatgagtccgtgctgggggtctcaatgttttag

SEQ ID NO: 207253 - DNA, 3696 bp, Artificial Sequence
  Description of Artificial Sequence: Synthetic coding sequence
atgatcgccgcccccgagatccccaccgacttcaacctgctgcaggagtcagaaacccactttagttcggatacagactttgaggacattgaagggaaaaaccaaaagcaggggaagggcaagacatgcaaaaagggcaagaaggggcctgctgagaaagggaagggtggcaatggagggggaaagcctccctccggcccaaaccggatgaatggtcaccatcagcagaatggggtcgaaaacatgatgttatttgaagtggtcaaaatgggcaaaagcgccatgcagagcgttgtggatgactggatcgaatcctacaagcatgatagagatatcgcattacttgatcttatcaatttcttcatccaatgtagcggctgtaagggagtggtaacggcggaaatgttccggcatatgcagaactctgagattattcgcaagatgacagaagaattcgatgaggatagtggggactatccacttaccatggcaggcccacaatggaagaagtttaagagctccttctgcgagtttattggagtgctggtacgacagtgccagtatagtattatttatgatgagtatatgatggataccgttatcagtctgctcactggactctctgattcccaggtgcgtgcgttccgccatactagcactctcgccgccatgaaacttatgaccgctttagtcaatgtggctttgaatttatccatcaatatggataacacccagcggcagtacgaagcagagagaaataagatgattggcaaacgcgcaaatgaacgcctggaattactgctgcaaaagagaaaggagcttcaggagaaccaagatgaaatcgaaaatatgatgaacgctatctttaagggtgtattcgtccaccggtaccgtgatgcgattgcagaaatacgtgctatctgcatcgaggagatcggcatctggatgaagatgtattctgacgcatttcttaatgacagttacttgaaatacgttggctggaccatgcacgataagcagggcgaagtgaggttaaagtgcctgaccgcattgcaaggcttgtattacaacaaggaattgaactctaaactggagctcttcacctcgaggtttaaagatcggattgtatcaatgaccttggataaggagtatgacgtggccgtacaggcgatcaagctccttaccctagtgctgcagagcagcgaagaggtcctgaccgctgaggattgcgaaaatgtctaccatttggtttattcagcacataggcccgtcgctgtcgcagccggggagttcctgtataagaagcttttctcaaggcgcgacccagaggaggatggtatgatgaaacgccgggggcgacagggtccgaacgccaacctggtgaagaccctggtgtttttttttctcgagtctgaacttcatgaacacgctgcctaccttgtggatagcatgtgggactgtgctaccgaactgcttaaggactgggaatgcatgaattcgttgttactggaagaaccactgtcaggcgaagaggccctgactgaccgccaggagtcggcactgatcgagattatgctttgtacaattagacaagccgccgaatgtcatcctcctgttggcaggggtactggaaagcgcgtgttaacagccaaagaaaaaaagactcaactcgacgatcggaccaaaattacagagctatttgcggtggccctgccacagttgcttgccaaatactctgtagatgccgaaaaggtcacaaatctgttgcagctacctcagtattttgaccttgaaatttatacaacaggccgcctggagaaacatctcgacgcattgctcaggcagattaggaatatagtggagaagcatactgatactgacgtgctggaggcctgctccaaaacataccacgctctgtgcaatgaagagttcactatctttaaccgtgtggatatttcaaggtcgcaactgatcgacgagctcgctgacaagtttaatcgcctgcttgaagattttttgcaggaaggcgaagagcccgatgaggatgacgcctaccaggtgttgagcacattgaaacggatcactgcatttcataacgcccacgacctgagcaagtgggacctctttgcctgtaattataaattactaaagacaggaattgaaaatggagatatgcccgaacagattgtgatccacgccctgcagtgcacccattacgtgatcttgtggcaactcgccaaaatcactgagtcttcctctacaaaggaggacctgttgcggctaaagaagcagatgcgcgtattctgtcagatctgccaacactatttaaccaatgtcaacactacggtcaaggaacaggcattcactattctctgtgacatcctcatgatattttctcaccagattatgtcaggtggaagggatatgctcgaaccactggtgtatacacccgattcatcactccaatctgaactactctcttttatactggaccacgtgttcatagagcaggatgatgacaacaatagtgccgatggtcagcaggaagatgaggcatccaagattgaggcactgcataagaggaggaacctgctggcagcattctgtaagctgatcgtgtatactgtggtggaaatgaatacagcagccgacatttttaagcagtatatgaaatactacaacgattatggtgatattattaaggagaccatgtcaaaaaccagacagattgacaagatccagtgcgctaaaacactgatattgtctctgcaacagctgttcaatgagatgatccaggagaatggatacaatttcgaccggagctcctctactttctctggaatcaaggagctggctcggaggttcgctttaaccttcggcctggaccagcttaaaacacgagaagctatcgcaatgctgcataaagatggcattgagtttgctttcaaggaacctaatccccagggggagtcgcatccgccccttaacctggccttcctagacatcctgtctgagttctcgagcaagctcctgagacaggataaaaggactgtgtacgtgtacctggaaaaattcatgactttccaaatgagtctacgccgggaagacgtctggttgcccctgatgtcataccgtaacagtctcctggccgggggcgatgacgacaccatgtccgtgatatctggcattagtagcagaggttcgactgtgcgatccaaaaagtctaaaccttctactggaaagcgcaaggtagtggagggcatgcagctgtcgctaactgaggaatcttccagcagcgattcaatgtggctgtcccgtgaacagacactacacacaccagtcatgatgcagacccctcagcttacgagtactattatgcgagaacctaaacgcctgcgcccagaggactcttttatgagcgtttatccaatgcaaaccgagcaccatcagacccccctggactataatcgccgtggtacctccttaatggaggacgacgaggagcctattgttgaagatgtgatgatgtcttctgaagggagaatcgaggacctgaacgaaggtatggattttgacactatggacatagacctgccacctagcaaaaatcgcagggaacgtaccgagctcaaacccgatttcttcgaccccgcaagtattatggacgaatctgtgttgggcgtttcaatgttttag

SEQ ID NO: 207254 - DNA, 3696 bp, Artificial Sequence
  Description of Artificial Sequence: Synthetic coding sequence
atgatcgccgcccccgagatccccaccgacttcaacctgctgcaggagagcgaaactcatttcagttctgacactgatttcgaggatatcgaaggcaaaaatcagaaacagggcaaggggaagacatgcaagaaggggaaaaaaggccccgcagaaaagggcaaaggagggaatggagggggcaagccgccttccgggccgaatagaatgaatggccaccaccagcagaatggggtcgaaaacatgatgttattcgaggtggtgaagatgggaaagagcgccatgcaaagtgttgtggatgactggatcgagtcctataagcatgatcgggatatcgccttactggacctgataaacttcttcatccagtgttccgggtgcaaaggggtagtgaccgccgaaatgttcaggcatatgcagaattcggagatcatccgtaaaatgaccgaggagttcgacgaggatagtggagattaccctctgaccatggccgggccacagtggaaaaaatttaaatcaagcttctgcgagttcatcggagtcctagttcggcagtgccagtatagtatcatttacgatgagtacatgatggacacagtgatttctttactgacaggactttctgacagtcaggtcagggcctttagacatacatcaacgttagccgcgatgaaactgatgactgcactcgtgaatgtcgccttgaacctgtccattaacatggacaacacacagagacagtatgaggcagaaaggaataagatgattggcaaaagggctaacgagaggctagagctcttgctgcagaagcgaaaagagttgcaggaaaaccaagacgagatcgaaaatatgatgaacgcgatctttaagggggtgttcgtgcaccgctacagagatgccatagcggaaatcagagcaatctgtatcgaagagatcggtatttggatgaaaatgtacagcgacgcgttcctcaacgattcctatctaaaatacgtcggatggacaatgcatgataaacagggggaggttcgtctgaaatgtcttactgccttgcagggcctgtactacaacaaggagctaaatagcaagcttgaactattcacgtcccggtttaaagatcgcatagtgtccatgacactcgataaagagtatgatgtggccgtgcaggcaatcaaactgcttacgctggttctacagtcttcggaggaagtccttacagcggaggattgtgaaaatgtgtatcatctagtatacagcgcccaccgacccgtagccgtagcagcaggggaattcctgtacaagaagctgtttagtcggagggaccctgaggaggatggtatgatgaaaagacgaggtcggcagggccccaacgccaacctggttaaaaccctggtctttttttttctcgaatcagaactgcatgagcatgcagcatacctcgtggactctatgtgggattgtgcgaccgagcttctgaaagattgggagtgtatgaactcactcctgctggaggaacccctgagtggtgaagaagctcttaccgatcggcaggaaagcgcattgattgagatcatgctgtgcacaattcggcaggcagcagagtgtcatccacccgttggccgggggaccggtaaaagagtgctgactgctaaagagaagaagacccaattggacgacaggacaaagataactgaattatttgccgttgcgctgccccagctactggctaagtattctgtcgatgctgaaaaagttacaaatcttctgcaattgccccagtacttcgatctggagatctataccaccggaagattagaaaaacaccttgacgcattgctccgccagatccggaacattgttgaaaagcataccgatactgatgtgctggaagcctgttccaagacgtatcatgccctttgcaatgaagagtttaccatttttaatcgggtggacattagtagaagccagctgatcgatgaactggcggacaaattcaaccggctgctggaagatttcctgcaggaaggagaggagcctgatgaagatgacgcctaccaagttctcagtacactgaagcgcattactgcttttcataacgcccacgacctctcaaagtgggatctctttgcgtgtaattataagcttttaaagacagggattgagaacggtgatatgcctgagcagattgtcattcacgcgctacagtgtactcactacgtcatcttgtggcagctcgctaagataaccgaatcttcctccacaaaagaagacctgctgcggctaaagaagcagatgcgagtattttgccaaatttgccagcattatctcaccaatgtgaacaccacagtcaaggagcaggctttcactattctctgcgatatactcatgattttctctcaccagatcatgagcggggggcgggatatgctggaacctctggtttacacgcccgatagctctttgcagagcgagctgctgtcctttatcttggaccacgtattcattgagcaggatgacgacaataactccgcagatggacaacaagaagacgaagcttccaagatagaagctctgcacaagcggaggaacctactggccgcattctgcaagttgatcgtgtatactgttgtggaaatgaacactgccgctgatatctttaagcagtacatgaagtattacaacgattacggagatatcatcaaagagacgatgagcaagacccgccagatcgacaaaatccagtgcgcgaaaacccttatattgtcacttcaacagctgttcaacgagatgatccaagaaaacggatacaatttcgacagaagtagttcgacatttagtggaattaaagaactggcacgacgcttcgccttaacattcgggctggaccagctaaaaacaagagaggcaatcgctatgttgcacaaggatggcatcgagtttgcatttaaggaaccaaacccgcagggagaatcacaccccccattaaatctggcttttctcgacattctcagcgaattctcatctaagcttctgagacaggacaagaggacagtttacgtgtatctagagaaattcatgacatttcagatgagtctgcgccgagaggatgtgtggctccccctgatgagctaccgaaacagtctgctagccgggggggatgatgataccatgagcgttatcagcgggatttccagccgggggagtacagtgcgatcaaagaaatccaaaccctcaaccggaaaacgtaaggtagtcgagggtatgcagctgtcactaacggaggagagctcaagtagtgatagcatgtggctcagcagggagcagacgctacacacccccgtgatgatgcagacccctcagctaacatctactatcatgagagagccaaaacgcctcaggccagaggatagtttcatgagcgtgtacccgatgcagacagagcatcatcagacccccctggattacaaccgtcgagggactagcttaatggaggacgacgaggaaccaatcgtagaggacgtgatgatgtcatccgaggggaggatcgaagacttgaatgaaggcatggacttcgacactatggatatcgatctgcctcctagcaaaaaccggcgcgaacgaacagagttgaagcccgattttttcgaccctgccagtatcatggacgaatcagttctgggcgttagcatgttctag

SEQ ID NO: 207255 - DNA, 213 bp, Artificial Sequence
  Description of Artificial Sequence: Synthetic coding sequence
atgatcgccgcccccgagatccccaccgacttcaacctgctgcaggagtctgagactcactttagctctgacaccgactttgaggatatcgaggggaagaatcagaagcagggaaaagggaaaacttgtaaaaaaggtaagaaagggcccgcggagaaagggaaaggagggaacggcggaggtaagccccctagcgggccgaatagaatgtag

SEQ ID NO: 207256 - DNA, 348 bp, Artificial Sequence
  Description of Artificial Sequence: Synthetic coding sequence
atgatcgccgcccccgagatccccaccgacttcaacctgctgcaggaatctgaaacccacttttcatcagatactgatttcgaagatatagaggggaaaaatcagaaacaggggaaaggcaaaacatgcaaaaaagggaagaaaggccccgccgagaagggtaagggcgggaacggcggcggcaaacctccctctgggccaaataggatgaacgggcatcaccagcaaaatggggtggagaatatgatgcttttcgaggtggtgaagatgggcaagagcgctatgcagtccgtagttgatgattggatcgaatcatataagcatgatcgtgatattgccctcctgtag

SEQ ID NO: 207257 - DNA, 510 bp, Artificial Sequence
  Description of Artificial Sequence: Synthetic coding sequence
atgatcgccgcccccgagatccccaccgacttcaacctgctgcaggagagcgagactcattttagctccgacactgattttgaggatatcgaagggaaaaatcagaagcagggcaagggaaagacatgcaaaaaaggcaaaaagggccctgccgaaaaaggcaagggtggcaatggaggcgggaagcccccgtctggccctaacaggatgaacggccaccaccaacaaaatggagttgaaaatatgatgctattcgaggttgttaaaatgggcaaatcagctatgcaatccgtcgttgacgactggatcgagtcgtacaagcatgatcgtgacattgcgctcctcgaccttatcaacttcttcattcagtgctccggttgtaaaggcgtcgttactgctgaaatgttcagacacatgcagaactcagaaatcatcagaaagatgacagaggagtttgatgaggactccggggactaccctctgaccatggccggacctcagtggaaatag

SEQ ID NO: 207258 - DNA, 465 bp, Artificial Sequence
  Description of Artificial Sequence: Synthetic coding sequence
atgatcgccgcccccgagatccccaccgacttcaacctgctgcaggaatccgagacacatttctcctccgataccgactttgaggacattgaagggaagaatcagaaacaagggaagggaaaaacgtgcaagaaaggtaagaagggacctgcagagaaggggaagggagggaatggtgggggcaaacccccttccggcccgaaccggatgaatggccatcatcagcagaacggcgtcgaaaacatgatgctgttcgaggtcgtgaagatgggaaagtccgctatgcagtctgtagtagacgactggattgagagttacaagcacgacagagacattgcactccttgacctgatcaacttttttattcaatgcagtgggtgtaaaggcgtcgtcaccgccgaaatgttcagacacatgcagaactctgagatcattagaaaaatgacagaggagtttgatgaatag

SEQ ID NO: 207259 - DNA, 627 bp, Artificial Sequence
  Description of Artificial Sequence: Synthetic coding sequence
atgatcgccgcccccgagatccccaccgacttcaacctgctgcaggaatctgagacgcacttttctagcgacaccgatttcgaagatattgagggcaaaaaccagaaacagggaaagggaaagacctgtaagaaaggtaagaagggacccgctgagaaaggcaaggggggcaacggaggaggtaagcctccgagcgggcccaaccgcatgaatggacatcaccagcaaaatggggttgaaaatatgatgctcttcgaagtggtgaaaatgggtaaatccgccatgcagtctgtcgtggatgattggatcgaaagttacaagcacgatagagatattgctttgctggatctgattaatttcttcatccaatgctccgggtgcaagggggttgtgactgcagagatgtttcgccacatgcagaactcagaaatcattcgtaaaatgacagaggaattcgacgaggattcgggagactatcctctcactatggccgggcctcagtggaagaagttcaaatctagcttctgcgagttcataggtgtactggtcaggcagtgtcagtactcaattatctatgatgagtatatgatggatactgttatcagtcttctgaccgggctgtcatag

SEQ ID NO: 207260 - DNA, 1647 bp, Artificial Sequence
  Description of Artificial Sequence: Synthetic coding sequence
atgatcgccgcccccgagatccccaccgacttcaacctgctgcaggagagcgagactcatttcagttctgacacagacttcgaggacatcgagggcaaaaatcagaagcagggcaagggcaaaacatgtaagaagggaaagaaaggtccagctgagaagggaaagggcgggaacggcggcggaaaacctccatcgggtcctaataggatgaacggacatcaccaacaaaacggtgtggagaatatgatgctgtttgaagtcgtgaaaatgggcaagtccgcgatgcagagcgtcgtggatgactggatcgagtcttacaagcatgaccgcgacatcgcccttcttgatctcataaatttttttatccagtgcagtgggtgtaagggggtagtcactgctgagatgttcaggcatatgcagaattctgagatcatccggaagatgacagaggagtttgatgaggattctggcgactatcccttgacaatggccggcccccagtggaagaaatttaagagctcgttttgcgagtttattggagtgcttgttcgacaatgtcagtactccattatttatgatgaatatatgatggacactgttatatccctactgacgggactgtccgatagtcaggttagagctttcagacacacctccacactggctgcaatgaagttaatgaccgctttggtgaacgttgccttgaacttgtcaattaatatggataatacacagcgacagtatgaggcggaacgaaataagatgatcgggaaacgcgctaacgaacgcttagagctcttacttcaaaaacgaaaggaattgcaggagaaccaagacgaaattgagaatatgatgaacgccattttcaaaggcgtgtttgtgcacagataccgcgacgctatcgcagagataagagctatctgcatcgaagaaattggtatttggatgaaaatgtatagtgacgcttttttgaacgacagctacctgaagtacgtggggtggacaatgcatgacaagcagggagaagtgagactgaaatgtctcacggcgctgcaaggcctttactacaataaggaactcaactctaaacttgaactcttcacttccaggttcaaagaccgtatagttagcatgaccttggataaggaatatgatgtggcggtgcaagccattaagttactgacccttgtccttcagagctctgaagaagtgctaactgccgaggactgcgaaaacgtctaccacctagtctatagcgctcaccggcctgtggccgtcgccgcaggggaattcctgtataagaagctcttctcacgtcgggaccctgaagaagacgggatgatgaagcgccgcgggcgacagggacctaatgccaatcttgtgaaaaccttagtcttctttttcctggaaagcgaactgcacgaacatgcagcttatcttgtggactccatgtgggactgtgcaacagaacttctgaaggattgggaatgcatgaattctctgctgttggaggaaccactatccggagaagaagcacttacggaccgccaggagtcagcactcatcgaaattatgctatgcactatcagacaggcagccgagtgccaccctccagtgggacgcggcacaggtaaacgggtgctgtag

SEQ ID NO: 207261 - DNA, 123 bp, Artificial Sequence
  Description of Artificial Sequence: Synthetic coding sequence
atgatcgccgcccccgagatccccaccgacttcaacctgctgcaggaatccgaaacccacttctcctccgatactgactttgaggacatagaaggtaaaaatcagaagcagggtaaaggctag

SEQ ID NO: 207262 - DNA, 3678 bp, Artificial Sequence
  Description of Artificial Sequence: Synthetic coding sequence
atgagcagccccctgcagcgggccgtgggcgacaccaagcgggccctatcagctagctccagctcgtctgcatccctgccctttgacgaccgggactccaatcatacttccgagggaaatggtgactctctgcttgcggatgaagacacggacttcgaggactctttgaaccgcaatgtaaagaagcgcgctgcaaaacggccccccaagaccacgccagttgccaagcaccctaaaaagggcagccgggtggttcataggcatagccgaaagcaatctgagcctcctgcaaatgaccttttcaacgctgttaaggctgctaagtctgatatgcagagcttggtcgacgagtggctagattcgtacaaacaggaccaagatgccggcttcctcgaattggtcaattttttcatccaatcatgcggttgtaaaggcattgttacaccagagatgttcaaaaagatgagtaactctgagattatccagcacctgaccgagcagttcaatgaagactctggagattaccccctgatcgcccccggaccatcgtggaaaaagttccagggatctttttgcgagttcgttcggactctggtgtgccagtgtcagtattcattgctgtacgacggttttcccatggacgatttgatctcgctgctcacgggtctcagtgatagccaagtcagggcctttcgacatactagcacactcgccgcaatgaagctcatgacttcactggtaaaggtcgcgttgcaactctcagtgcatcaggataacaatcagcgtcagtacgaggcggagcgtaacaagggcccaggacagagggcccctgagagacttgagagcttgctggagaagaggaaggagttacaagagcaccaggaagagattgagggaatgatgaatgccctttttcggggggtgtttgttcataggtaccgagacgtgcttccggagatcagagcaatttgcattgaagagattggctgctggatgcagtcatattctacttctttcctgaccgactcctatctgaaatacatcgggtggacactgcacgataagcacagagaagttagattgaaatgtgtgaaggcactgaaaggcctatatggtaaccgggacttaacaaccagacttgaactatttacatcaagatttaaggaccgtatggttagcatggttatggatcgcgaatatgacgtggccgtggaggcggtgcggttgttgatcctgatcctcaaaaatatggagggcgtactcacagacgccgactgcgagtccgtgtacccggtggtgtatgcttcccacagaggattggcttccgcggccggtgaattcctgtactggaagctgttttatccggagtgtgagattagaatgatgggaggacgtgagcagcggcagtctcctggggctcaaagaacattctttcagctgctcctgagtttcttcgtagagagcgagctgcatgaccacgccgcttatctcgtcgacagcctgtgggattgtgctggagcgaggttgaaggattgggagggattgacttctctcttactggagaaggaccaaaatttgggagacgtgcaggaaagcacgttgatcgaaatccttgtttccagtgcccgtcaagctagcgagggccacccccccgtcggtagagtgacaggtaggaagggactgacctccaaagaaaggaagacccaggccgacgacagagtgaaactgaccgagcacctgatcccgcttctaccccaactgcttgctaaattctccgccgacgccgagaaggtgactccactgctgcagttgctgtcttgttttgatctgcatatttattgtacaggacgcctggagaaacacctcgagctgtttttacagcagctgcaagaggtggttgtgaagcatgccgagcccgcagtgctggaggctggagctcatgccctttatctgttgtgtaatccggagttcaccttcttcagccgcgctgacttcgcccgaagtcagctagtggacctcctgaccgatcggtttcaacaggagttggaggagttgttgcaaagtagcttcctggacgaagatgaggtttacaacctggctgctacactcaagcggctcagcgcgttctacaacacccatgacctcactagatgggaactgtacgagccatgctgtcagctgttacagaaagccgtggatactggggaagtgccgcaccaagtcattctgcccgcactaacgctcgtatacttcagcattctgtggaccttgacccacatctcaaagtccgatgcatcccagaagcagttgtcatcactgcgagacaggatggtcgccttctgtgaattgtgtcagtcctgtctctctgatgtggataccgagatccaggagcaggcctttgtgctgctgagcgatctgctcctcatcttctccccgcaaatgatcgtggggggaagagattttctgaggccattagtctttttccccgaagccacattgcagtcagaactggcatccttcctgatggaccacgttttcatccagcctggcgacctcggctccggagacagccaggaggatcacctacaaatagagaggttacaccagaggagaaggcttctggcaggattctgtaaacttttactctacggcgtcctcgagatggacgcagccagcgatgtgttcaaacattacaacaaattctataatgactacggagatattataaaagagaccctcacacgagcacggcagattgaccggtcccattgttcaaggatactgctgcttagcctgaaacagctgtacactgaactgctgcaggagcacggcccgcaagggctgaatgaactgcctgctttcatcgaaatgagagatcttgcccggcgctttgcactgagtttcggtcctcagcagctgcagaaccgggatctggtggttatgctgcacaaggagggcattcaattctcgctgtccgagctaccacccgctggctctagtaaccagccacctaatctcgcattcctggaacttttatctgagttttctccccgcctatttcaccaagataaacaacttctgctgagttatctagaaaagtgcctgcaacacgtgtctcaggccccggggcatccctggggcccggttaccacttactgtcacagtctgtcacccgttgagaacacagccgaaacctctccccaggtcctcccttcatctaagcgccgaagagtagaagggccggcgaagcctaatagggaggacgtgagctcctcccaggaggagtccctacagctgaacagcataccacctacgccaacgttaacatctactgccgtcaagtcgagacagccgctgtggggactgaaggaaatggaagaggaggatgggtctgagctcgacttcgcccaaggccaacctgtggcagggacagaacgttcgcgcttcctgggccctcagtattttcagaccccacacaatccctccggacctgggttggggaatcagctgatgcggttaagcttgatggaagaggatgaggaggaggaattggaaatacaggacgaatccaatgaagagagacaagatactgatatgcaggcttcctcttactcatcaacctccgaacgtggcctcgacctcctggatagcaccgaactcgacatcgaggacttttag

SEQ ID NO: 207263 - DNA, 2667 bp, Artificial Sequence
  Description of Artificial Sequence: Synthetic coding sequence
atgagcagccccctgcagcgggccgtgggcgacaccaagcgggcccttagtgctagcagttctagttctgcctcgcttcccttcgacgatcgagactccaaccatacatctgagggtaacggagattccttgctggctgacgaggatactgacttcgaagattcattaaaccggaacgtgaagaaaagggccgcaaagcggccacccaaaaccactcccgtggcaaagcacccgaagaaaggctccagagtcgtccatcggcacagtcgtaaacagtccgagccgcctgccaacgacctgttcaatgcagtgaaggctgctaaatcagacatgcagagcctcgtggacgaatggctggattcttataagcaggatcaggacgccggctttctggagctggtgaacttttttatacagtcatgcggatgcaaaggtatcgtgacgccagaaatgtttaaaaaaatgagcaatagtgagatcatccagcacctgaccgagcagtttaatgaaatggacgacctcattagtcttttgactggactttcagacagccaggttcgcgcttttagacacacgagcacattggccgcaatgaagctgatgacctcactggtgaaggtcgccctccagttgtcggtacatcaggataacaatcagcggcagtatgaagctgagcggaacaagggacccgggcagcgggcacctgaacggctagagtcgctattagagaagagaaaagaactccaagagcatcaggaggagatagaggggatgatgaatgccctgttcagaggggttttcgtgcaccgttaccgagacgttctgcctgaaatcagagctatctgtatcgaagaaatcggttgctggatgcagtcatactcaactagctttttaaccgactcttatttgaagtacattggctggacactgcacgacaagcatcgtgaagtcaggctgaagtgcgtgaaggccctcaaagggctgtatggaaatcgggatctgaccaccaggctggagctgtttacgagtaggttcaaagaccgtatggttagcatggtgatggatagagaatacgatgtagctgtcgaagccgtgaggctgttgatcctgatacttaaaaacatggaaggggttctgactgatgccgattgtgagtccgtgtaccccgttgtgtacgcttcgcacagagggctggcgagcgccgcaggcgagtttttatattggaagctgttctaccctgagtgtgagatcagaatgatgggaggccgggaacagcgccagagccccggggctcagagaaccttttttcagttgttattaagcttttttgtggaatccgagctgcacgaccatgccgcataccttgtagactcactgtgggactgtgccggtgctcgcctgaaggactgggagggtttgacaagtttactgttggaaaaagatcagaatctgggcgatgtccaggaatctacattaatcgagattctcgtctctagcgctagacaggccagcgaagggcacccgcccgtgggaagagttacaggaagaaagggccttacatccaaagaacggaagactcaggccgacgaccgagtcaaattgactgagcacctaatccccctgctcccgcaactgctggccaagttctctgcagatgccgagaaagtcactccattattgcagctgctctcgtgctttgatcttcatatatattgtaccggccgtcttgagaagcatctggagctttttttgcagcagttgcaggaggtcgtagtgaagcacgctgaaccggcagtgttggaggctggcgctcatgcgctgtacctactgtgcaaccctgagtttacatttttttccagagccgacttcgcaagaagtcagctggttgacctgctgacagaccgattccaacaagaactggaagagctattacaaagtagctttttggatgaagacgaggtttataacctggccgccactctgaagaggctttctgcattctataatacacacgaccttacacgttgggagctctacgaaccttgctgtcagttgctccaaaaagctgtcgataccggggaagtgcctcatcaagtgattctgcccgctctgacgctggtttacttctccatcctttggactctcactcactcattgtcccccgtggaaaacactgcagaaaccagcccccaggtgcttccatccagcaaacgacgtcgcgtcgagggacctgctaagccaaatcgggaagacgttagctcttcacaagaagaatcgctccagctcaatagcatccctcctactccaacacttacctctacggcagtgaagagtaggcagccactgtggggattaaaagaaatggaagaggaggacggtagtgagctggattttgctcaggggcagcctgtggcgggaacggagcgctcaaggttcttggggccacagtatttccagacaccgcataacccaagcggcccggggctaggtaatcagctgatgcggctgtcacttatggaggaagatgaggaagaggaattggaaattcaagacgaatccaacgaggaacggcaagataccgatatgcaagcctcttcttacagctctacctcagagcggggacttgacctcctggacagcaccgaacttgacattgaggacttttag

SEQ ID NO: 207264 - DNA, 789 bp, Artificial Sequence
  Description of Artificial Sequence: Synthetic coding sequence
atgctgcacaaggagggcatccagttcagcctgagcgagctgccccctgccggcagttccaatcaacctccaaacctggccttcttggaactgttatccgagttctcaccacgcctttttcaccaggataaacaattgttattgtcctacctggagaagtgtctccaacatgtgagccaggctcccgggcatccctggggacccgtgacaacctactgtcacagtctttctcctgttgagaacacagctgagacatcacctcaagtgctaccatccagtaaacggagaagggtggaaggacctgcaaaaccaaatcgtgaagacgtttcgtccagtcaggaagaatctttacagttaaattcgatcccaccaacgcctactctcacgtccacagccgtaaaaagcagacagcccctgtgggggctgaaagagatggaagaggaggatggtagcgaactggactttgcccagggctcccagccagtggcgggaactgagaggtcgaggtttctgggaccccagtattttcagaccccgcacaacccgtccggacccggactgggcaatcagctaatgagactttcacttatggaagaggacgaagaagaagaactggagattcaagacgagagcaacgaagagcggcaagatacagacatgcaggcaagcagctactccagtaccagcgagcggggactggacctgttggattctacagaactagacattgagattactgagagtctccctctgctggggaagtccccccacccctacaacagccgttag

SEQ ID NO: 207265 - DNA, 438 bp, Artificial Sequence
  Description of Artificial Sequence: Synthetic coding sequence
atgagcagccccctgcagcgggccgtgggcgacaccaagcgggccctgtcagcctcttcgagtagttcggcctcccttccattcgatgatagagattccaatcacacatcggaaggtaatggcgactctctgctcgccgacgaagatacagatttcgaagactccctcaatagaaacgtgaagaaaagagccgccaagcgcccacccaaaactacccctgtggccaaacaccctaagaaagggtccagggtggtgcatcgccacagtcgcaagcaaagcgaaccccctgctaacgatttattcaacgcagtaaaagccgccaaaagtgatatgcagtccctcgtggatgaatggctggattcttataaacaggaccaggatgctggctttctggagttagtgaatttctttatccagtcatgcggttgcaaaggttag

SEQ ID NO: 207266 - DNA, 339 bp, Artificial Sequence
  Description of Artificial Sequence: Synthetic coding sequence
atgagcagccccctgcagcgggccgtgggcgacaccaagcgggccctaagcgcctcatctagttcgtcggcttctctgcctttcgatgatcgcgactctaatcatacgtcagagggaaacggggattcgcttcttgccgatgaggacactgactttgaagacagcctcaataggaatgtcaagaagcgagccgccaagaggccgccgaagaccacacctgtggccaagcaccccaagaaaggctcgagagtggttcacagacatagtcggaagcaaagcgagccccccgctaacgatcttttcaatgcggtgaaagctgctaagagcgatatgcaatag

SEQ ID NO: 207267 - DNA, 3678 bp, Artificial Sequence
  Description of Artificial Sequence: Synthetic coding sequence
atgagcagccccctgcagcgggccgtgggcgacaccaagcgggccctgagcgcaagttccagcagttccgccagtctgccttttgacgatagagattctaaccacacctctgaaggtaacggcgattccctgctcgctgatgaggataccgacttcgaggacagcttgaataggaacgtcaagaaacgcgctgccaagcggcccccaaagactactccagtggccaaacatcctaagaaggggtctcgagtcgtccacagacatagtaggaaacagagcgaaccccccgcaaacgatctgtttaatgcagtgaaagccgccaagagcgatatgcagtcattagtcgatgaatggctggactcctataaacaggaccaggacgctgggttcttggagttggtcaattttttcattcaatcttgcggttgtaagggaatagtgacacccgagatgtttaaaaagatgagcaattcggaaatcattcaacacctgactgagcagtttaatgaggatagcggggattacccactgatagctcccggccccagctggaagaaattccagggatccttctgtgagtttgtgcggaccctggtgtgtcagtgtcagtacagtctcctgtacgatgggttcccaatggacgacctgataagcctgctcactgggttatctgactcacaagtccgagcctttcgccatacatccactctggctgccatgaagctgatgacatcgctggtgaaggtggccttacaactttcggttcaccaggataacaaccagcgacagtacgaggcagaaagaaataagggaccgggacagcgggctcctgaaagattggagagtttgctagaaaagcgcaaggaacttcaggaacaccaggaagagatcgagggcatgatgaatgccttattccggggcgtcttcgtccaccggtacagagacgtgttacccgagataagagccatctgtattgaagaaataggatgttggatgcagtcctacagtaccagttttttaacagactcctacttgaagtatattggctggacacttcacgacaagcatcgggaagttagactgaaatgcgtgaaggccctcaaagggctgtacggaaacagggacctgaccacccggctcgaactgtttacatctcggtttaaggaccgcatggtatcaatggtcatggatcgagaatatgacgttgccgtcgaagcggtcagattgttgatccttatactgaaaaatatggaaggcgtgctaaccgacgctgactgcgagtctgtctaccccgtagtatacgcctctcaccgcgggttggctagcgcagcgggtgagttcctttactggaaactgttctatcccgaatgtgagattcggatgatgggcggccgcgaacaaaggcagagccctggagctcagagaactttctttcagctgctgttgagctttttcgtcgagtccgagttacatgatcacgctgcataccttgtggactcactctgggattgcgcaggcgcccgcctcaaagattgggaaggtttgacctctttactgctggaaaaagaccagaacttgggagatgtccaagagtctactctgattgaaattttggtctctagtgcacgtcaggcctctgagggtcatccccccgtgggtcgggtgacaggaaggaaggggctcactagcaaagagaggaaaacacaggcagatgatcgggtcaagctgaccgaacatcttatcccactcctgccccagctactggctaagttctcggcggatgcggagaaagtaactcctttattgcaactgctgagttgttttgacctgcacatttactgtaccgggcggctggagaaacacctggaactgtttctacaacaactgcaggaggtggtggtgaagcatgctgagcctgcagtcctggaggcaggggcccatgctctgtacctgctctgtaaccccgagtttacttttttctctcgagccgactttgcccgctcgcagctggtggatttgctaacagaccgattccagcaggagcttgaagagctgctgcagtcttcttttctagacgaagacgaggtgtataacctcgccgcaacccttaaacgtctgagtgcgttttataacacccacgatctgacgagatgggaactatatgaaccgtgctgccagctcctgcagaaagccgtcgatacgggcgaggtacctcaccaggtgatcttgcccgctctcaccttagtctatttcagcattctgtggacactcacacacatttctaagtctgacgcctcccaaaaacagctgagctctctgcgggatcggatggttgctttttgtgagctgtgccagtcctgcctaagcgacgtggacactgagattcaggagcaggcatttgtgcttctgtctgacttgctgttgattttctcaccgcaaatgatcgtcgggggcagagatttcttaagaccattggtatttttccctgaagccaccttacagagtgagctggccagctttctgatggaccacgtgttcattcagccaggggacttagggagcggggacagccaagaagatcatctgcagatcgagaggcttcaccaaagacgcagactgctggccggcttctgtaaactgctactgtacggcgtattggagatggacgctgcgtcagacgttttcaaacactataataaattctataatgattacggagacatcatcaaagaaactctgacccgggcccgtcagattgaccggtcacattgtagccgaatattgctgctttcacttaagcagttgtataccgagctgcttcaagaacacggacctcaagggctgaatgagctcccggcattcatagagatgagagatctggccaggcgcttcgccctctcctttggaccccaacagctgcaaaatagggatcttgtagtgatgctgcataaagagggaatacagttctccctgtctgagttgcctccagcagggagctcgaaccagccacctaatctagccttcctcgagctgctgagcgaattttctcccaggctcttccaccaggacaagcagttactcctgtcttatcttgagaagtgcctccagcacgtaagtcaggctccgggccacccatgggggcccgtgacaacgtactgccattccttgtctccagtggagaatacagccgaaacctcacctcaggtcctgcctagctctaaaagaaggagagtcgagggccccgcgaagccaaacagggaggacgtgagttcgtcgcaagaagagagcttgcaacttaactcgattccccctacccccacccttactagtacggccgtgaaatctcgtcaacccttgtggggcctgaaagaaatggaggaggaggatggctcggaattggattttgctcagggtcagcccgttgctgggacggaacgcagtagatttcttggcccacagtattttcaaaccccacacaacccttctggaccggggctaggaaaccagctgatgaggctgtcattgatggaggaagacgaggaagaggagctggagatccaggatgagagcaacgaggagagacaggatacggacatgcaggcctcaagttactcaagcaccagcgagcgaggactcgacctgctggactctactgaactggacattgaagacttttag

SEQ ID NO: 207268 - DNA, 567 bp, Artificial Sequence
  Description of Artificial Sequence: Synthetic coding sequence
atgagcagccccctgcagcgggccgtgggcgacaccaagcgggccctgagcgcttcttccagctcgagcgcgtccctcccgttcgacgatagagatagcaaccacacttcagaggggaacggagattcactgctcgcggatgaggacacagactttgaagatagcctgaataggaatgtgaagaagcgggcagcaaagcggccacccaaaaccacccccgtggccaagcatcccaagaagggcagccgggtggtgcaccgtcactcaagaaagcagagtgagccacctgccaatgacctgtttaacgcagtgaaggccgctaaatcagacatgcaggattctggagattatccattgattgcccctggcccctcttggaagaaattccagggatcattctgtgaattcgtccgtacactggtgtgccagtgccagtattccctgctatatgacggttttcccatggacgaccttatttctctgctgacaggcctcagtgacagccaggtgagagcttttaggcatacgagcacactggcggcaatgaagctcatgacctctctatag

SEQ ID NO: 207269 - DNA, 1047 bp, Artificial Sequence
  Description of Artificial Sequence: Synthetic coding sequence
atggtgtggccctgggtggccatggccagccggtggggccccctgatcggactggcgccttgctgcctgtggctcctgggggcagtgctgctcatggatgccagtgcgaggcccgccaatcattctagcacacgagaacgcgtcgccaaccgcgaggagaacgagattttacctccagaccacctgaatggtgtgaagttagagatggatggccatttaaacagaggatttcaccaggaagtatttttggggaaggatctggggggattcgatgaggacgctgagccgcgtcgttctcggcgcaagctgatggtgatctttagcaaggttgacgttaacaccgacaggaaaatttctgcgaaggaaatgcagaggtggatcatggagaagaccgcagagcactttcaagaggctatggaagaatccaaaacccattttagggccgtcgaccctgacggcgacgggcatgtttcttgggacgagtataaggtcaaattcttggcctccaagggtcactctgagaaagaagtggccgacgcaattaggctgaatgaagagttgaaggtcgacgaggaaacccaggaggttctggaaaatttgaaagacagatggtaccaagccgattccccccccgcagacttgctgctcaccgaggaggaatttctatcctttctgcatcctgaacacagccgggggatgttgcgctttatggtgaaagaaatagtgcgggatcttgatcaggacggcgacaagcagctgtcagtcccagagtttatttccttgccagttggtactgtggagaaccagcagggacaagacatcgacgataactgggttaaggaccgtaaaaaggagtttgaggaattgatagattccaaccacgatggaatagttacggctgaagagttggaaaatgtgccgaccctcccattgcagccgataggaacccttaattctcacttcgtgaggcttgcagccgagcttggcgggggcaaggccaccctgacgtgtgcacccttagctagaagggcgacctggactccctag

SEQ ID NO: 207270 - DNA, 1089 bp, Artificial Sequence
  Description of Artificial Sequence: Synthetic coding sequence
atggtgtggccctgggtggccatggccagccggtggggccccctgatcggactggccccctgttgcctgtggctgctcggcgctgtgcttctgatggatgctagtgcgcgacctgcgaatcacagctccacccgtgaaagggtggcaaatcgtgaagagaacgagatcctgccaccggatcacctgaacggtgtgaaactggagatggacggacacctgaatcggggattccaccaagaggtgtttttaggaaaagacctcggtggcttcgatgaggatgctgagcccagacgaagcagaaggaagctgatggtgatcttttccaaagtagacgtgaacactgacaggaagatctctgctaaagagatgcagcgatggatcatggagaagaccgctgaacactttcaggaagccatggaagaatctaagacgcacttcagagccgtggatcctgacggagacggccatgtgtcctgggacgaatataaggttaagttcctcgcaagtaagggtcatagtgagaaggaggtcgccgatgcaatcaggctgaacgaggaactgaaggtcgacgaagagacacaggaagtgcttgagaacctgaaggaccgatggtaccaagccgactcaccccccgctgatctcctgttgaccgaagaggaatttctttccttcctccacccagagcatagcagggggatgctgcggttcatggtgaaagagatcgtacgcgatttggaccaggacggcgataagcagctgagtgtgcccgagtttatctctcttccagttggtacagtagagaatcagcagggccaggacatcgatgacaattgggtcaaagaccgcaagaaagaatttgaagaactgatagacagcaatcacgatggaatcgtcacagccgaagagttggagagttacatggaccccatgaacgagtataatgccctgaacgaggctaaacagatgatcgccgtggccgatgagaatcagaatcatcatctggaaccggaggaggttcttaagtactccgagttttttactggcagtaaattagtagactatgctaggtcagtgcacgaagaattttag

SEQ ID NO: 207271 - DNA, 732 bp, Artificial Sequence
  Description of Artificial Sequence: Synthetic coding sequence
tgactggagatggacggccacctgaaccggggcttccaccaggaggtctttcttggaaaggatctcggagggttcgatgaagatgcggagccccgccgaagtagacggaaacttatggttatttttagcaaagtagacgtaaatacggaccgcaagatttctgcaaaggagatgcaaaggtggatcatggaaaagaccgccgaacattttcaggaagccatggaggaaagcaaaacccattttcgagccgtcgatcccgacggcgatggacatgtgagctgggacgagtacaaggtgaagttcttggctagcaaggggcacagtgagaaggaggtggcagacgctattagactgaacgaggagttaaaagtggacgaagagtccagcacgagccggaactttctagacctacgcgccggcgtttgtcgcccgaggtatccccaggctgctcccctcagcgcccaggaggtgctggagaacctgaaggacaggtggtaccaggccgatagccccccggcggacttgctgttaactgaggaagaatttttgagcttcctgcacccggagcattcacgcggtatgctacggttcatggtgaaagaaatagtccgcgaccttgaccaggacggcgacaagcagctaagcgtgcccgagttcatatccctacccgtgggtaccgtagaaaatcaacagggacaggacatcgatgacaactgggttaaagacagatag

SEQ ID NO: 207272 - DNA, 609 bp, Artificial Sequence
  Description of Artificial Sequence: Synthetic coding sequence
atggtgtggccctgggtggccatggccagccggtggggccccctgatcgggctcgcaccgtgttgcctttggctgctgggcgccgtgttgttaatggatgccagtgcgaggccggctaaccatagctccacgcgggaacgagtcgccaatagggaagaaaatgaaatcctgccaccagatcacctgaacggcgtgaaacttgaaatggacggccatctgaataggggcttccatcaggaggtgttcttgggcaaagacctcggggggttcgatgaggacgcggagccccggcgctcccgaagaaagctgatggtcattttcagcaaggtcgacgtgaacaccgaccgaaaaatcagtgccaaggagatgcaaagatggattatggaaaaaaccgccgaacacttccaggaggcaatggaagagtctaagacacactttagagcagtggaccctgatggcgatggccacgtgtcctgggatgagtacaaagttaagtttttagctagtaagggacatagtgaaaaagaagtggccgacgctatccgcttgaatgaagaactgaaagttgacgaggagagacatgggccaccgggacctcgggcactgtag

SEQ ID NO: 207273 - DNA, 636 bp, Artificial Sequence
  Description of Artificial Sequence: Synthetic coding sequence
atggccgtggtgcccctgctgctgctgggcggcctgtggagcgccgtgggtgcttctagtttgggcgtcgtgacttgtgggtccgtagtgaaacttttgaacactcgtcataacgtgcggctgcactcccatgacgtcagatatggaagcgggtcaggacagcagtccgtgaccggcgttacgtcagttgatgacagcaattcttattggaggatcaggggcaagagcgctaccgtgtgcgagcgtggaactccaattaagtgcggtcagcccattaggctgacccatgtaaatacaggccgcaacctgcactctcatcactttaccagtccgcttagcgggaaccaggaggtgtctgcgttcggggaagaaggggaaggagattatctggacgactggacagtattatgcaacggaccatattgggttcgagatggcgaggtgagattcaaacattcctctactgaggtccttctgtcagtaaccggggaacaatacgggcgaccaatcagcgggcagaaagaagttcacgggatggcccaaccttcacagaacaattattggaaggcaatggagggaatatttatgaagccgtcagaattactaaaagccgaagcccaccacgctgaactgtag

SEQ ID NO: 207274 - DNA, 666 bp, Artificial Sequence
  Description of Artificial Sequence: Synthetic coding sequence
atgtggagcgccggccggggcggcgccgcctggcccgtgctgctgggcctactcctcgcccttctggttccagggggcggagctgcaaagaccggtgccgaactcgttacttgtgggagcgtgctgaaactgttaaatacgcaccatcgagttcgtcttcatagccacgacatcaagtacgggtccggaagtggccagcagtccgtaactggtgtagaagcttcagatgatgccaattcttactggcgcatccgggggggatcagagggaggctgtcccaggggtagccctgttaggtgtggccaggctgtgcggctaacccacgtacttacaggcaagaacttgcatacacaccactttcctagccctcttagtaataatcaggaggtctccgcattcggggaggatggcgagggcgacgatctggacctgtggaccgtacggtgcagcggtcagcattgggagcgcgaggccgccgtcagatttcagcatgtaggcacaagcgtcttcctgagcgttacaggcgagcagtacggctcccccattcgcggtcagcacgaagtccatggaatgccttcagcgaatacccacaatacctggaaggcaatggagggtatctttataaaaccaagcgttgagcccagcgcgggacacgatgagctttag

SEQ ID NO: 207275 - DNA, 2058 bp, Artificial Sequence
  Description of Artificial Sequence: Synthetic coding sequence
atggacgtgtgcgtgcggctggccctgtggctgctgtggggcctgttgctgcaccaaggccagtccctttcacattctcactcggagaaggcgaccggtacttcctccggtgcgaattccgaagagtccaccgcagctgaattctgccgcatcgacaagccactgtgccactctgaggatgaaaagctgtcttttgaggccgtacgaaatattcacaagctcatggatgatgacgccaacggcgatgttgatgtggaagagagcgatgaatttctccgtgaagacttaaattaccacgaccctaccgtgaagcactcaacctttcatggagaagataaattgatctccgtcgaggatttgtggaaggcctggaaatcaagcgaggtatacaactggaccgtggacgaagttgtgcagtggctgattacctacgttgaactgccccagtacgaggaaactttccggaagttgcaactatccggtcacgctatgccacggctggccgttaccaataccacaatgaccgggaccgtgttgaagatgaccgaccgctcacataggcagaagttacagctgaaggctcttgacacagtcctttttggcccccccctcctgacccggcacaatcatctgaaggatttcatgctcgtagtgtcaatagtgatcggggtggggggatgttggttcgcctacatccagaaccgctattcaaaagaacatatgaaaaagatgatgaaagacctggaaggactgcatagggccgagcagtcactccacgatttacaggagagactgcataaggctcaggaagagcacagaacagtcgaggtagagaaggtgcatctggagaagaagttgcgggatgagattaacctggccaaacaggaggctcagagactgaaggagctccgagaaggtacagaaaacgagagatccagacagaagtacgctgaggaggagctcgagcaagtccgagaggcattgaggaaggccgagaaggaattagaatcccacagtagctggtatgcccccgaagcgcttcagaagtggttgcaacttacccacgaagtggaggtacagtattacaatatcaaaaagcagaatgctgaaaagcagctgctggtcgccaaagagggcgccgagaagatcaagaaaaaacgtaacaccctgtttggcaccttccacgtagcccattcatcatctctcgacgacgtcgatcataaaatacttactgctaaacaggccctgagcgaagtgactgctgcactgagggagcgactgcatcgctggcagcagatcgaaattctctgcggattccaaattgtgaataaccctgggattcatagcttggtcgctgccttgaacatcgacccctcatggatgggctctacccggcctaatcccgcccacttcataatgacggacgatgtggacgacatggacgaggaaatagtatcccctctcagtatgcagtccccaagtctgcagagttccgtgcgccaacgattaaccgagcctcagcacgggcttggatcccaacgagacttgacccattctgactctgagtcatctttgcacatgtctgacaggcagcgggtcgcccctaaaccgccccagatgtctagggccgcagacgaggcacttaacgcgatgacttccaatgggagccatcgcctgattgaaggagtgcaccctggcagtttggtagaaaaactgcccgatagcccagccctcgcaaaaaaggcgctgcttgccctgaaccacggattggataaggcccattcactgatggagctctctcctagcgcgcccccaggaggctctccacacctggatagttcccggtcccactcacctagcagtcctgaccctgacacacctagccctgtgggagattctcgagccttgcaggccagcaggaacacccggattccccacttggccggcaagaaggccgttgcggaagaggataacgggagtattggagaagaaaccgactcaagccctgggcgtaagaagttcccgctcaaaatttttaaaaagccgttaaaaaaatag

SEQ ID NO: 207276 - DNA, 2502 bp, Artificial Sequence
  Description of Artificial Sequence: Synthetic coding sequence
atgaacgccgccggcatccgggcccccgaggccgccggcgccgacggcaccaggctggcccccggcggcagcccatgtctacggaggcgggggcggccagaggagagccccgctgcggtggttgccccacggggcgctggagagttacaggccgcgggcgcccccttgagattccaccctgcatctccgcggagattgcacccagcatcgacacctggccccgcctggggttggctcctgcgccggcgacgatgggccgccttgctcgtgctgggactccttgttgccggcgccgctgatggatgcgaattggtcccccgccacctcagggggcgacgtgccacaggatccgccgctaccgctgcatcttcccctgctgcagctgctggggacagcccagcccttatgacagatccctgcatgagcctgtcccccccatgcttcactgaggaagatcgcttttcactggaagccctgcagacaattcacaagcagatggacgacgataaagatggcggtatcgaagtcgaagagtccgacgagtttatcagggaagacatgaaatacaaagacgccaccaataaacattcgcacctgcacagggaggataagcacattacaatcgaagatctttggaagcgatggaagacgtctgaagtgcataattggacccttgaggacacactccagtggctgatcgagtttgtcgagctgccacagtacgaaaaaaatttccgcgacaataatgtgaaaggcactactctccccaggatagccgtgcacgaacccagttttatgattagccagttgaagatatcagatagatcccatagacagaagctccagctcaaggcccttgacgttgtactctttggacctctgactcggccaccccataattggatgaaagactttattctgaccgtatccatcgtcattggagtcggaggatgttggtttgcttacactcaaaataaaacctcaaaagagcatgtggctaagatgatgaaagacctggaaagtctgcagaccgccgagcaaagtttgatggatctgcaggaacggcttgagaaagcccaggaggagaataggaacgtagccgttgagaaacagaaccttgaacggaagatgatggatgagattaactacgccaaggaggaggcttgtagactgcgcgagctacgcgagggagctgaatgtgaactcagccgccgtcagtatgccgaacaagaactggagcaagtacgaatggcccttaaaaaggcagaaaaagagtttgagctgagatcaagctggagcgtgcctgacgctctccagaagtggttacagctgacgcatgaggttgaggtacagtattacaacatcaaacggcagaatgcggaaatgcagttagcgattgcaaaagatgaagcggagaaaataaagaaaaaacggtctaccgtgttcggtaccctgcacgttgcgcactcatcctcactcgatgaagtggaccacaagattctggaggctaaaaaagccctctccgaacttacaacctgcttgcgggaacggttatttcgctggcagcaaatcgaaaaaatttgcggatttcagatagcgcacaattcgggccttcctagcctgacttcttcgctctactctgatcattcctgggtggttatgccacgagtctctatcccgccgtatccaatcgccggtggggttgacgacttggatgaggatacaccccctattgtgtcacaatttcctggtaccatggctaaacctccgggctccctggcaaggagttcttcactctgccgctccaggagatccattgtcccctcgagtcctcagcctcagagagcccagctcgctcctcacgccccacatcctagtcatccgcggcacccccatcatccacagcataccccccactctctgccaagccccgacccggacatcttgtcggtcagctcctgcccggccctttacaggaatgaggaggaagaggaggctatctatttttctgccgaaaagcagtgggaggtgccagatactgcaagtgaatgcgactcattgaacagcagcatcggaaggaaacagagtccgcccctgtccctcgagatatatcagacactgagtccacggaaaatcagcagagacgaagtctccctcgaggacagcagccggggagactctcccgtgacggtggatgtgtcttggggcagtccagattgcgtgggactgacagaaacgaaaagtatgatcttctccccagccagtaaggtctacaacggtatcctggaaaaaagctgcagtatgaatcaactcagttcagggattcctgtacccaaacctcgccacacatcctgttcaagtgccgggaatgattccaaacctgtgcaggaggcgcctagcgtcgcgagaataagttcaatccctcacgacttgtgccacaacggcgagaagtccaagaaaccgagtaaaattaaaagcctcttcaagaagaagtcaaagtag

SEQ ID NO: 207277 - DNA, 2526 bp, Artificial Sequence
  Description of Artificial Sequence: Synthetic coding sequence
atgaacgccgccggcatccgggcccccgaggccgccggcgccgacggaactaggctggctcccggcggctccccctgccttaggaggaggggcaggcccgaagagtccccggctgcagtggtcgctcctcggggagccggcgaactgcaggcagccggggctcccctgagattccatcctgcaagtccaaggcgcctgcatcctgcgtccacccctgggccagcatggggctggctactgcggagacggcggtgggctgctctgctggttttgggccttttggtcgctggcgctgccgacggttgcgagcttgtcccccgccacctgcgcgggaggcgtgccacagggagcgccgccacagccgcgtcctcccccgcggctgccgctggcgatagcccggcgctgatgacagacccctgtatgagcctgtctccaccttgtttcactgaggaagaccgcttctccctggaagctctacaaactatccataagcaaatggacgacgacaaggatggcggaatcgaggtggaggaatctgatgagttcatcagggaggacatgaagtacaaagatgctacaaataagcatagccatctgcatcgcgaagacaagcacatcaccatagaggatctttggaaaaggtggaaaaccagcgaggtgcataattggactctcgaagacacccttcagtggctcatcgagtttgtggaactcccccagtacgagaagaattttagagacaacaacgtgaagggaactaccctgcccaggattgctgtccatgagccctccttcatgatttcccagcttaagatcagcgaccggagtcatcgccagaagctgcaattgaaggctctcgatgtcgtcctgtttgggccactgacccgacccccgcataactggatgaaggactttattctcaccgtatccattgtgatcggagtgggaggctgttggttcgcctatacacagaacaagacatccaaggagcacgtggctaaaatgatgaaggaccttgagagcctgcagaccgccgaacagtctctcatggacctacaggagcgattggaaaaggcacaggaagagaatagaaatgttgccgtggaaaagcagaacctcgaacgcaagatgatggacgagattaactacgccaaggaagaagcttgcaggttgcgtgaactgagagaaggcgctgaatgcgagctgtcccgcaggcaatacgcagagcaggaactcgagcaggtgcggatggctcttaaaaaggccgagaaagagttcgagttgaggtccagttggtcagtccctgacgccctacagaagtggttgcagctcacccatgaggtggaggtccaatactacaacatcaaaagacagaacgcagaaatgcaactcgccatcgctaaggacgaagttgcagcctcctaccttattcaagctgaaaaaatcaaaaagaagcgcagtacagtgtttggcactcttcacgttgctcattcttcaagtctagatgaggtggatcataagatcctcgaggcaaagaaggccttgtccgagttaaccacttgtttgagagagcggctcttcagatggcagcagattgagaagatctgcggtttccaaatcgcacataattcaggtctaccctccttgacgagctccctgtactccgatcacagctgggttgttatgccccgggtgagcatccctccatacccaatcgccgggggcgtggacgacctcgatgaggacacacctcccatcgtaagtcagtttccaggaactatggccaagccccccggatccctagctaggtctagtagcctgtgcagaagccggcgtagtattgtcccatcaagcccacaaccacagagggcacagctggctcctcatgccccacaccccagtcatccaaggcatccacaccatcctcagcacactcctcatagtcttcctagtcctgatccagatatcctttccgtctcatcgtgtcctgctctgtatcgtaatgaggaagaagaagaggccatatattttagtgccgagaaacagtgggaggtccccgacacagccagcgagtgtgactctctgaatagctctatcgggagaaagcaaagccccccactcagtctagagatttaccagactctatctccgcgcaagatctcacgggacgaagtgagtttggaagacagctcccgcggggactctccagtgacggtagacgtgtcttgggggagccctgattgcgtaggattaacggagaccaagagcatgattttcagtcctgcttcaaaggtatacaatggaatcctggagaaatcgtgctcaatgaaccagttgtcaagcggaatccccgttccgaagccccgccatacatcgtgctctagcgccggcaatgacagtaagccagtccaggaggctccatcagtcgccagaatctcaagtatcccccatgatctgtgccacaatggcgaaaagtccaaaaagcccagcaagatcaaatcactgttcaagaaaaagtccaaatag

SEQ ID NO: 207278 - DNA, 2061 bp, Artificial Sequence
  Description of Artificial Sequence: Synthetic coding sequence
atgaacgccgccggcatccgggcccccgaggccgccggcgccgacggcacacgcctggcccctggaggctctccctgcctgcggagacggggccggccagaggaatctcctgcagctgtggtggccccaaggggagccggcgagcttcaagcagctggggctcccctgcgttttcatccagccagtcccaggagattacaccctgcctctacccccggccccgcctggggatggcttttgcggcggagaagatgggccgcactgctcgtccttgggctgctcgtagcaggcgcagcagacgggtgcgaactggttcccagacacctacgtggaagaagggctaccggctctgctgccaccgccgcttctagcccagcagccgctgccggcgacagcccagccctgatgacagacccgtgtatgtccttatctcctccctgtttcacagaagaagatcgctttagcttggaagccctccagaccatccacaagcaaatggacgacgacaaggacggtggcatcgaggtggaggaatcagacgagtttatcagggaggatatgaagtacaaagacgccactaataagcatagccatctgcatcgggaagataagcatattacgatcgaggatttgtggaagcggtggaaaacctcagaggtacacaactggacgctggaggacactttacagtggctgatcgaattcgttgagctgccccagtacgaaaagaattttcgcgataataatgtgaaaggtacaacactcccgcggatcgccgtacatgaacctagttttatgatctctcaactgaaaatcagcgatcggagtcataggcagaaacttcagttaaaggcgctggacgtggtgttgtttggccctctcactaggccaccacacaactggatgaaagactttatcctgaccgtgtcaatagtcatcggcgtaggagggtgttggttcgcttatactcagaacaaaacttcaaaggagcacgtggcgaagatgatgaaagatctggagagcctgcagactgccgagcagtcactgatggatcttcaggagaggttggagaaggcccaagaggagaaccggaatgtcgctgtagagaaacagaacctcgagcgaaagatgatggatgagatcaactacgccaaggaggaggcctgcaggcttcgcgagctgcgggaaggggctgaatgcgaactgagtcggcgccagtacgcagagcaggaacttgagcaggtgagaatggccctcaagaaggcagagaaggagttcgagctgcgctcatcttggtccgtgcctgacgcactgcagaagtggctacaacttacccacgaggtggaggtacaatattataatattaagagacagaacgccgagatgcaactcgccattgctaaggacgaggccgagaagattaaaaaaaagaggtctacagtatttggcactctgcacgttgcccactcaagcagcctggatgaggttgatcacaaaatccttgaggctaaaaaagctcttagcgagctgaccacatgtctgcgcgagcgcctatttcgctggcagcagattgagaaaatttgtggtttccagatcgcacacaacagcggactccctagcttgacatcatcgctgtactccgatcatagttgggtagtcatgcctcgggtcagcatcccaccttatcccatagctggcggcgtagacgatctggacgaagacacaccccccatcgtttcacaatttcccgggaccatggcaaagccacctggcagcctggcccgctcctcctcgctctgccgcagccgaaggtctatcgttccctcctcgccacagccccaaagagctcagctcgctcctcatgctccacatccgtctcacccgaggcatccacatcacccccaacacaccccacactctctgcctagccccgaccccgacatcctctcagtttcctcatgccctgctctgtatcgaaacgaagaggaggaagaggcaatatacttctccgccgagaaacagtgtatacacctaggactaggcgcctgcaaatcagagtag

SEQ ID NO: 207279 - DNA, 2241 bp, Artificial Sequence
  Description of Artificial Sequence: Synthetic coding sequence
ctgctggtgctgggcctgctggtggccggcgccgccgacggctgcgaacttgttcctcgccacttgagagggcgacgggctaccggaagtgccgctaccgccgcgagctcacctgctgcagcggccggagatagcccagccttgatgaccgacccatgcatgtctctctccccaccatgcttcactgaagaagataggttctccctggaggctctgcaaactatacataagcagatggacgatgacaaggatggcgggattgaggttgaggagagcgatgaattcattcgtgaagatatgaaatataaggatgccacaaataagcactcacatcttcacagggaggacaagcacataacaattgaggacctgtggaagaggtggaagaccagtgaagtccataactggaccctcgaagacacgctgcaatggttgatcgaattcgtggaactgccgcagtatgaaaagaacttccgagacaacaatgtcaaaggaacaacgctcccaagaatagcggtccacgagccatcttttatgatcagccagctcaagatcagtgataggagccaccggcagaagttgcagctgaaggctctggatgtcgttcttttcggcccactgacaaggcctccacacaactggatgaaagacttcatcttgaccgttagtatagtgataggtgttgggggttgctggttcgcatacacccagaacaaaacctcaaaggagcacgtggcaaaaatgatgaaagacttggagagcctgcagaccgctgagcaatccctgatggacctgcaagaaaggctggagaaggcccaggaagagaatcggaatgtggctgtggaaaagcaaaacctagaacgcaaaatgatggatgagatcaactatgcaaaggaagaagcgtgcagattgcgggaacttcgagaaggggctgagtgcgagctgtcccggaggcagtacgcagagcaggaactggagcaggtacggatggcactgaaaaaagcagagaaggagtttgaacttaggtcttcttggtccgttccagacgcactccaaaagtggctgcagctcactcatgaagtggaagttcaatattacaacatcaaacgccagaatgctgaaatgcagttagctatcgctaaggatgaggccgagaaaattaagaagaagagatctacagtctttggtaccctgcacgtcgcccattcttcgtctctggacgaagtagaccataaaatccttgaagccaagaaggccttgtccgaacttaccacctgcctcagagagcggttattccgttggcagcagatagaaaaaatttgcgggttccagatcgcccataattccggtctgccaagcctgacatcctccctttacagcgaccattcatgggtggtgatgccccgcgtaagcatcccaccatacccaattgccggtggcgtggatgacttggacgaagacaccccaccaatcgtgagtcagtttcctggtaccatggcaaaaccaccgggtagtcttgctaggtcttcctcgttgtgccgctcgcgccggagtatagtcccttcgtccccccagccacagagggctcagttagccccacacgctcctcacccttcccacccgcgccatccccaccacccccaacacactccacattccttaccctcacccgatccggatatcctcagcgtgtcgagctgtcctgcgctgtaccggaacgaggaggaggaggaggctatttatttttcagctgagaagcagtgggaggtgcccgacaccgcatccgaatgcgactctctaaactcaagcattggaaggaagcagtcccctcctttaagcctcgaaatttaccagacactttccccacggaaaatctctcgcgacgaggtatctcttgaagatagttcccgtggcgacagccccgtcactgttgatgtcagttggggcagcccggattgcgtcggcctaacagagaccaaaagcatgatcttctcccctgccagcaaagtctacaatggcatcctggagaagtcctgttcaatgaaccagctctcgtcggggatacccgtccctaaacctaggcacacctcttgtagctccgccggtaacgactctaaaccagttcaggaagcgccgtccgtggcccgaatttcttctattcctcacgacctgtgccataacggcgaaaaaagcaagaagccaagtaagatcaaaagtcttttcaaaaagaaaagtaagtag

SEQ ID NO: 207280 - DNA, 2265 bp, Artificial Sequence
  Description of Artificial Sequence: Synthetic coding sequence
ctgctggtgctgggcctgctggtggccggcgccgccgacggctgcgaattggttccaaggcacttaagaggccggcgggcaacgggctcagctgctaccgctgcctcgagccctgcagcggccgccggtgactccccggcccttatgaccgatccttgcatgtcactgtcccccccgtgcttcaccgaggaggaccgtttttctctcgaagcgttgcaaacaatacacaagcagatggacgatgacaaggatggcggaatcgaggtcgaggaaagtgatgagttcataagggaagacatgaaatacaaggacgctacaaataaacacagccacctgcacagagaggataaacatatcaccattgaggatctatggaagcggtggaaaacatctgaggtccacaactggaccctggaggacactctgcagtggctcattgagtttgttgaacttccccagtatgaaaagaacttccgtgataataatgtgaaaggaacaacacttccacgtattgcggtacatgagcctagcttcatgattagccaactgaagatttcggatcgttcccatcgccagaagttgcagctgaaagcattggatgtggtgttattcgggcccttgactcggcctccacacaattggatgaaggattttattctgacggtgtctatcgtcatcggcgttggtggatgctggtttgcttatacccagaacaagacgagcaaggagcatgtagccaaaatgatgaaagacctagagagtctgcaaactgctgagcagtctctgatggatctgcaggaacggttggagaaggctcaagaggaaaacagaaacgtagccgtagagaagcaaaaccttgagagaaagatgatggacgaaatcaattatgcaaaagaggaggcatgcagactgagggagctgcgtgagggagccgagtgcgagttaagtagacgacagtacgccgaacaggagcttgaacaggtgaggatggcgctgaagaaggcagagaaggagttcgaactgaggagttcgtggtctgtgcctgatgcactgcagaagtggttgcagctgactcacgaggtggaagttcagtactataacatcaagcgccagaatgctgaaatgcagctggccattgctaaggatgaggtcgctgcttcttacctcattcaggcggagaaaataaagaagaagcgatcaacagtgtttggcactctccatgtcgcccacagctcctccctggatgaggttgatcacaaaattctcgaggcaaagaaggccttgagcgagctgacaacctgcctacgtgagaggctgttccggtggcaacagattgagaaaatctgcggtttccagatagctcacaactccggactgccctcccttacgagcagcctgtatagcgatcactcttgggtggtcatgcctagggtctccatcccaccctaccccatagccggcggcgtggacgatttagacgaagataccccacccattgtgagtcagttccccggtactatggcaaagccccctggctcgcttgcccgcagttcaagcttatgcagatccagacggagcattgtaccaagctcaccacaaccccagcgcgcccagcttgcacctcacgccccacacccgtcccatcctcggcacccccaccacccgcagcacacacctcactctctcccgagtcccgatcccgatatcctcagcgtgtcatcttgcccagccctgtaccgcaatgaggaggaggaggaagccatctacttcagtgctgagaagcagtgggaagttcctgacacagcctctgagtgcgactctcttaacagcagtatcggtagaaaacagtcaccacctctaagtctcgaaatctaccagactctttcgcctagaaaaattagtcgggatgaagttagcttggaggattcatcccgcggcgacagtccagtgaccgtcgacgtgagttgggggtctccagactgcgtaggattaactgagacgaagagcatgatcttctcaccggctagcaaggtgtataacggtatcttagaaaagtcatgttctatgaaccagctgtcttcaggcatcccagtcccaaaacctcggcacaccagctgttcctccgctggaaatgactccaagccagttcaggaggcacctagtgtggccaggatttcatcgattccccatgacctgtgccacaatggcgaaaagagtaaaaagccatcaaagataaaaagtttgttcaaaaagaagtccaaatag

SEQ ID NO: 207281 - DNA, 1800 bp, Artificial Sequence
  Description of Artificial Sequence: Synthetic coding sequence
ctgctggtgctgggcctgctggtggccggcgccgccgacggctgcgaactggttcccagacacctgaggggtcgccgggctaccggcagtgcggcaactgccgcaagttccccggcggctgccgcgggtgatagccctgccttgatgactgatccgtgcatgtctctgtcccccccctgcttcacagaggaagacaggttttctcttgaagctttgcagaccattcacaagcagatggatgatgataaggatggcggcattgaggtggaagagagcgacgaattcatcagggaagacatgaaatacaaggatgcgacaaacaagcatagtcatctccatcgcgaggacaagcatataaccattgaggacttatggaagagatggaagacatctgaggtgcacaactggactctggaggacacactccagtggctgatagaattcgtggagctcccacagtacgagaagaattttcgggataataacgtaaaaggaaccactctcccaagaatcgctgtgcatgagccctccttcatgatatcccagcttaaaatctccgataggtctcatcgccagaagctccaactgaaggcactcgacgttgtgctgtttggtccactgacacggcccccacacaattggatgaaagacttcattttaactgtgagcattgtgattggcgtaggggggtgctggttcgcatatacccagaataagacttcgaaagaacatgttgcgaagatgatgaaagacctggagtcacttcagacagcggagcaatccttgatggacctccaggaaaggctcgagaaagcacaggaggagaacaggaatgtagcagtagaaaagcagaacctggagcggaagatgatggacgaaatcaactatgcaaaggaagaagcatgcaggcttcgcgagcttagggaaggcgccgagtgtgagttgtctcgcaggcaatacgcggagcaggagttggagcaggttaggatggcccttaaaaaagcggagaaagagttcgaactcaggagtagctggtcagtgccagatgctctgcagaagtggctgcagctgacacatgaggtggaggtgcaatattacaacattaagcgacaaaatgcggaaatgcagctggccatagctaaagatgaagcggaaaagattaaaaagaagaggtctacagtgtttggaacacttcatgtggcgcactcatctagtctggacgaggtagatcacaaaatcctcgaagccaagaaggccctctccgaactgacaacatgtttgagggagcgcttatttcgctggcagcagattgagaagatttgcggcttccagatcgcccacaattcagggcttccctcactgacttccagtctgtattcggaccactcatgggttgtgatgccaagggtctccatcccaccttacccaattgccgggggtgtcgatgatctggatgaagacactccccccatagtgtcgcagttcccggggactatggccaaacctccaggaagtctcgcgcgatcttcaagcctgtgtcggtccaggaggagcattgtaccatcgtctcctcagccgcagagggctcagttggctcctcatgctcctcatccgtctcatcctcgacacccccatcaccctcagcatactcctcactctctgcctagcccagatcccgacattctgtctgtgagtagttgccctgccttgtacagaaatgaagaggaggaggaggcaatttacttcagcgcggagaaacaatgcatacaccttggcttgggagcttgcaaatctgagtag

SEQ ID NO: 207282 - DNA, 3654 bp, Artificial Sequence
  Description of Artificial Sequence: Synthetic coding sequence
atgtacatcaagcaggtgatcatccagggcttccggagctaccgggaccaaacgatcgtggacccattttcttcaaagcataatgttattgtgggacgcaacggcagcggtaagtccaacttcttttatgcaatccaatttgtcctctccgacgaatttagtcaccttagacccgaacaacgcctggcgctgctccatgaaggcactgggccacgggtcatatcggcttttgttgagatcattttcgataatagcgataatcgcctgcctatcgataaagaagaagtcagcctcaggcgggttatcggagccaaaaaggaccagtatttcctggataagaaaatggttacaaaaaacgatgtcatgaatttgctcgagagcgcaggattttctcggtcgaatccgtattatattgtgaaacaggggaagataaaccagatggccacagctcctgatagtcaaagactgaaactcctgagggaagtggctggaacacgagtgtacgatgaaaggaaagaggagagtatctctctcatgaaggagacagaaggcaaaagggaaaagatcaacgagctgctgaaatatatagaggaaagattacacactctggaggaggaaaaggaagagcttgctcagtatcagaagtgggataaaatgcgtcgtgctcttgaatataccatctacaatcaagagctcaatgaaacacgggcgaaactcgacgagctgtctgctaaacgagaaacaagtggcgaaaagtctcgacaactgcgcgatgcccagcaagatgctcgggataagatggaagatattgaaaggcaagtccgagagctaaagacaaaaatctccgcaatgaaggaagagaaggagcagttaagtgcagaacgacaagagcaaattaagcagcgtacaaaattggagttgaaagcgaaagacttacaagacgagcttgccggaaattccgagcagaggaagagactgctgaaggagaggcagaaattgcttgagaaaattgaggagaaacagaaggagctggccgagaccgaaccaaaattcaattctgtcaaggaaaaagaagagaggggaatcgcacgacttgctcaggctacccaggagaggactgatctatacgcaaaacaaggacggggttcacaattcaccagcaaggaagaaagagacaaatggatcaaaaaagagctcaagtcactggatcaggccattaacgataagaaacgtcaaatcgccgccatacataaagatctggaggataccgaggccaacaaggagaaaaatcttgagcaatataataagctcgatcaggacctgaatgaggtgaaagcccgcgtcgaagagttggaccgaaagtactacgaggtcaagaacaaaaaggatgagctgcagtctgaaaggaactatctctggagagaggaaaacgccgaacagcaggctttagccgccaagcgcgaagatcttgaaaagaagcagcagttgctgcgggctgcaacaggcaaggctattctgaacgggatcgacagtataaataaggtgctggaccacttccggcggaagggaatcaaccagcatgtgcagaacggatatcacggaatcgtgatgaacaatttcgaatgtgaaccagcattttacacctgcgtcgaagtcacagcaggcaaccgattattctatcacatcgtggacagtgacgaagtatcaacaaagattctcatggagtttaataagatgaatttgccgggcgaggtcaccttccttcctcttaacaagctcgacgtgcgggacactgcatatcccgaaacaaatgacgccatccctatgatcagcaagctacgatataacccccgattcgataaggcttttaaacacgtattcggtaagacgctcatatgtaggtccatggaagtcagtacgcagctagcccgggcctttacaatggactgcatcactttggaaggcgatcaggtgtcccataggggagctttaactggtggatattacgacactaggaagtcacgtttggaactgcaaaaggatgttcgcaaagccgaggaggaactcggggagctggaggccaaattaaacgaaaatctgaggaggaatatagaacgaataaataatgagatcgaccaactcatgaatcaaatgcagcagatagaaacacagcagagaaaatttaaagcatctagggattctattctatccgagatgaaaatgctaaaagaaaagcggcaacagagcgagaagaccttcatgcccaagcagcggtccctccagtcgcttgaagccagcctgcacgcaatggagtcaacaagggagagtctaaaagcggaacttgggacggatctcttgtcacaactgtctctggaggaccagaagagggtggatgctcttaatgatgagattcgtcagcttcagcaggagaaccgacagcttcttaacgagaggatcaagcttgaggggatcatcacaagagtggaaacctacctcaacgagaacttgaggaaaagattagatcaggtcgagcaggaactcaacgagctgcgcgaaacagagggggggactgttctcacagccaccaccagtgaattagaagcaatcaacaaacgcgtaaaggatactatggcaaggagcgaggatttggacaactctatagataagaccgaggctggcattaaagagcttcaaaaaagcatggaaagatggaagaacatggaaaaggaacacatggacgcgatcaatcatgacactaaagaactggaaaagatgaccaacagacaaggcatgctgttaaagaagaaggaggagtgtatgaagaagatcagagagcttggctccctgccccaggaggccttcgaaaaataccagacactgtcccttaaacagcttttccgcaaactggaacagtgtaataccgaactcaagaagtacagccatgtaaataagaaggcactggaccagttcgtcaatttctcagaacaaaaggaaaaactcattaagagacaagaggagctggatcgaggttacaaaagcatcatggagttaatgaatgtgctcgagctgagaaagtacgaagccatccagttgactttcaaacaagtgtccaagaactttagtgaagtcttccagaagcttgtccctggagggaaagccaccctcgttatgaaaaagggcgacgtcgaaggcagtcaatcgcaagatgaaggcgaagggagtggggagtcagagagagggagcggctcacagagttcagtgcccagtgttgaccagttcaccggggtggggattcgcgtgtccttcacagggaaacaaggcgagatgagggaaatgcagcagctcagtggtggccaaaagagtcttgtcgcactcgctctgattttcgctattcagaaatgtgatccagccccattctatttgttcgacgaaattgatcaggctctggatgcccagcacaggaaagccgtgtctgacatgattatggaacttgctgttcatgcacagttcatcaccacgacctttcgccctgaactgctcgagtctgccgataagttttacggtgtgaaattcaggaacaaagtaagccacatcgacgtgattacagcagagatggccaaggacttcgtggaagacgacaccactcacggctag

SEQ ID NO: 207283 - DNA, 3306 bp, Artificial Sequence
  Description of Artificial Sequence: Synthetic coding sequence
atggccacccccagcaagaagaccagcacccccagcccccagcccagcaaacgggccctccctagggacccaagtagtgaagtgccctctaaacgaaaaaactccgccccccagcttccacttctgcagtcttccggccctttcgtcgagggcagcatcgtgaggatctctatggagaactttctaacttacgacatttgtgaggtctcccctggccctcacctgaatatgattgtgggcgctaatggtactggcaaatcctctatcgtctgtgcaatttgtttggggttagccgggaaaccagccttcatgggcagggccgacaaagtcggattctttgtgaagaggggatgttcccgggggatggtggagattgaactctttcgcgcatctggtaatttggtcatcacccgcgaaatcgatgtcgcaaaaaatcagtcgttttggtttattaacaagaaaagcactactcaaaaaatcgtggaggaaaaagtagccgccctgaacatacaggtgggcaatctttgtcagttcctgcctcaggacaaggtgggcgaatttgcaaagttatccaagatcgaactgctggaagccacggaaaagtctatcggacccccagaaatgcacaagtaccactgtgagctgaagaacctgcgggagaaggagaaacagctggaaacttcttgtaaagaaaagactgagtaccttcaaaagatggtgcaacgtaatgaaaggtacaaacaggacgtagagcggttttacgagaggaaacgccatctcgacctaattgagatgcttgaggcaaagagaccttgggtggagtatgagaatgtgcgtcaggaatacgaggaggtgaaactggtccgggacagagtgaaggaagaggtgcgcaagttgaaagaagggcagattcccgtcacctgcagaatagaagagatggagaacgaaaggcataatctcgaggcacgaattaaggagaaagccactgatatcaaagaagccagccagaagtgcaaacagaaacaagatgtaatcgagagaaaggacaagcacattgaggagttacagcaagctctgatagtgaagcaaaatgaggagctggatcgccagagaagaatcgggaacacaaggaaaatgattgaagatttgcagaatgagcttaagactactgagaactgcgaaaatctccagccccaaatcgatgcaattacaaatgacttacgccgaattcaggacgaaaaggcactgtgtgagggcgaaatcatcgacaaacggcgagagcgagagacgcttgagaaggagaagaagagcgtcgacgaccatatcgtgcggttcgacaacttaatgaaccagaaagaggataaactgaggcagaggtttagagatacttacgatgccgtgctctggcttcgcaacaaccgcgacaagttcaagcagagagtctgtgagccaatcatgctcactattaacatgaaagacaataaaaatgcgaagtatattgagaaccacataccctctaacgatctgcgcgcctttgtcttcgaaagtcaggaagacatggaggtatttctgaaagaagtccgagacaataagaagctaagagttaatgcagttatcgccccaaagagttcatatgcggacaaagctccatcaaggtctctgaacgaactcaaacagtacggcttctttagctatctgcgggagctgtttgacgctccagatcctgtgatgagttatctgtgttgccaatatcacatccacgaagtgccagtgggaacggaaaagacaagagagaggatcgagcgcgtcatacaggagacaagactcaagcagatatataccgccgaggaaaaatacgtggtcaagacatcattctattctaataaggtgatctcttccaatacctccctgaaagttgcccaatttctgacagttaccgttgacttggaacagcggcgccacctcgaggaacagctgaaggaaatacacaggaagttacaggcagtagattctggactgatcgcactgagggagacatctaagcacctcgagcacaaggataacgaactcagacagaagaagaaggaacttctagagaggaagaccaaaaaacggcaacttgagcaaaagatcagctcgaagctgggcagcttaaaactgatggaacaagatacttgcaacctggaagaggaggagcgcaaggcgagcacaaagatcaaagaaatcaacgtgcagaaagctaagttggttaccgagctcacaaacctgatcaagatctgcacatcactgcacatccagaaggtggacctgatccttcagaatactactgttatcagcgaaaaaaataaattggagtccgattatatggccgcatccagccagttacggctaactgaacaacacttcatcgaacttgatgagaatcgccagcgacttctgcagaagtgtaaagaactcatgaaacgggctcggcaggtttgcaatttgggcgcggagcagacacttccccaggagtaccaaacccaggtgccaaccattcccaatggccataattcctcactccccatggtcttccaggatctgcccaatactctcgacgagattgatgctctactcacagaggagaggagtagagcctcctgtttcaccggcctcaaccctaccatcgttcaagagtatactaagcgggaagaagaaatcgagcagctaacggaggagctgaaaggtaagaaagtagagctggaccagtaccgggaaaacatcagccaggtcaaagaacgatggctcaaccccttaaaggagctcgtcgagaagatcaatgaaaagttttcgaacttctttagctccatgcagtgtgcgggggaggtagatctccataccgaaaacgaggaggattacgataagtacggtatccggatcagggtgaaattccgtagtagcacacagctccatgagctgactccccaccaccaaagtggaggcgaacggagcgtaagcaccatgttgtatctcatggcccttcaggaactgaacagatgcccctttcgtgtagttgacgaaatcaaccagggaatggacccaattaacgagagacgggtgttcgaaatggtggtgaataccgcctgcaaagaaaatacttcacagtatttctttatcactcctaaattgcttcagaatctcccttactctgaaaagatgacggtgctttttgtgtacaatggtccgcacatgttagagccaaatacctggaatctcaaagcctttcagcgccgcaggcgccgcatcacgttcacccaaccttcctag

SEQ ID NO: 207284 - DNA, 3276 bp, Artificial Sequence
  Description of Artificial Sequence: Synthetic coding sequence
atggccaagcggaaggaggagaacttcagcagccccaagaacgccaagcgaccgcgccaagaggagctcgaggactttgataaagacggggatgaggacgagtgtaaggggaccaccttgactgccgctgaggtggggatcattgagtctatccatctgaagaattttatgtgccacagcatgctcgggccgtttaagttcggctcgaacgtcaacttcgttgtaggcaacaacgggagtgggaagtctgcagtgttaaccgcactgatcgtcgggttgggcgggcgcgcggtcgcaacaaatcggggaagcagtctgaaagggttcgtaaaggacgggcagaactctgccgatatctcgataaccctgagaaataggggggatgacgcattcaaagcatccgtgtatggtaacagtatcttaatccagcagcacatatccatcgacggcagcaggagttacaaactgaagtctgccaccggatcggtcgtgagcacacgcaaagaagaactaatcgcaatactggatcactttaatatacaagttgacaatcctgtttccgtcctcacccaggagatgtcaaagcagttcctgcagtctaaaaacgaaggggacaaatacaaattctttatgaaggccactcagctggagcagatgaaggaggattatagctacatcatggaaacaaaggaacgtacgaaggagcagattcaccagggagaggaaaggttgactgaactgaaaaggcaatgcgtagagaaagaagagagattccagtctatcgcgggcttgtccacaatgaaaaccaatctcgagtccttgaagcacgaaatggcttgggcagtggtgaatgagattgagaaacaattgaatgccatcagagacaacattaaaatcggtgaagaccgggctgctagattggaccgcaaaatggaggagcagcaagtccgtctgaatgaagccgagcagaaatacaaggacatccaagataagttagaaaaaatcagtgaggagacaaatgctcgtgctccagagtgtatggccctgaaagcggatgtggtcgccaaaaagcgcgcctataacgaggccgaggtgttgtacaaccgctccctgaatgagtataaggctcttaagaaggacgatgaacagctgtgcaagcggattgaagagttgaagaagtcaactgatcagagcctcgagccagagaggttagagcgacagaagaaaatctcttggttgaaggagcgcgtgaaagctttccaaaaccaggagaactctgtgaaccaggagatcgaacagttccagcaggctatcgagaaagataaggaggagcacgggaagattaaacgggaggaactcgacgtgaagcatgccctgtcctacaatcagagacagttaaaggagctcaaggactcaaagactgatagactaaaacggttcggtccaaacgtacctgcactactggaagcgattgacgacgcctacagacagggacatttcacttataagccggttggcccacttggcgcatgtattcaccttagggatccggagctagcccttgcaattgagtcttgcctcaaggggctgctccaagcttactgctgccacaatcacgcagacgaaagagtcctgcaggcattgatgaaacgcttttacctgccggggacttcacgcccccccatcattgttagtgaattccgcaatgagatctacgacgttcgacacagggctgcctaccacccagattttccgacagtcttgaccgcccttgagatcgacaatgccgtggtggctaatagtctgatcgatatgagaggaatcgagaccgtacttctgattaagaataattcagtagctcgggctgttatgcagagccagaagcctcctaagaattgtcgcgaggcattcaccgctgatggagaccaggtctttgcagggcgatactattcatccgagaatacccggcctaagtttctgagccgcgatgtggacagcgaaatatcggacctggagaatgaagtggagaacaagaccgctcaaatcctgaacctccagcagcacctgagcgctctagaaaaagacattaaacataacgaagagctgctcaagcgctgccaactgcactataaagagctcaagatgaagatccgaaaaaacatcagcgaaataagggaactagagaacattgaagaacatcagtccgtggatattgccactctggaagacgaggcccaagagaataagagtaaaatgaaaatggttgaagagcacatggaacaacagaaagagaacatggagcatttaaagtccctgaagatagaggcggagaacaagtacgatgctatcaagttcaaaatcaaccaactgagcgagctggcagatcccctcaaggatgagctgaacctcgctgactccgaggtcgacaaccagaagaggggaaagcggcactatgaagagaaacagaaagagcacttagatactttaaataaaaaaaaacgagagctggacatgaaggagaaggagctggaagagaagatgtctcaagctagacagatctgccccgagcgcatcgaggtggagaaatccgccagtatcctggacaaagagatcaaccggcttcgtcaaaaaatccaggccgagcacgcaagccacggtgacagggaggaaatcatgagacagtaccaggaagcacgcgaaacatatctagaccttgactcaaaagtccgcactttaaaaaagtttataaagctgctgggcgaaatcatggagcatcggtttaaaacctatcagcagttcaggcgttgcctgacactgaggtgtaagctgtactttgacaatctcctctcccagcgagcttattgcggcaagatgaactttgaccacaagaatgaaacactatccatctcagtgcagccaggtgagggcaacaaggccgcgttcaatgatatgagagccctttccggaggagagaggagcttttctacagtgtgtttcatcctctccctctggagcattgctgagtcaccgtttcggtgcctggacgagttcgatgtgtatatggacatggtaaacagaaggatcgctatggacctgatactgaagatggccgactctcagcggtttcgacagttcattctgctgacacctcagtctatgtcatccctcccatcctctaagttaatccgcattttacggatgtcggaccccgagagagggcagaccaccctacccttcagaccagtcacccaggaagaggacgatgaccagagatag

SEQ ID NO: 207285 - DNA, 3354 bp, Artificial Sequence
  Description of Artificial Sequence: Synthetic coding sequence
atggccaagcggaaggaggagaacttcagcagccccaagaacgccaagcgccctcgtcaggaagaacttgaagattttgacaaggacggagatgaggatgagtgtaagggtacaaccctgactgcagccgaggtcggcatcatcgaaagcatccacctcaagaatttcatgtgtcattctatgctcggaccatttaaatttggatcgaatgtcaatttcgttgtgggcaataacggttcctggtctgccgttgtgagaagcagactgaacgccactagcgcttcgcaggtccaggctatccttctgttccagccatgcggaaagagcgccgtgctcacggcgctaatcgtgggccttggtggccgggccgtggccaccaaccggggttctagccttaagggctttgtcaaggacggtcagaactcggcagatatcagcatcacattgcgcaatcggggagacgacgcctttaaggcgtctgtgtacggcaacagtatattaatccagcaacatatatccatcgatgggtcaagatcatataaactcaaatctgcaacaggatccgtggtttccacgaggaaggaagagttgatcgccatcttggaccactttaacattcaggttgataaccctgttagcgtcctgacgcaagagatgtcaaagcagttcctgcagagcaaaaatgagggagacaagtacaaatttttcatgaaggccacccagctggagcagatgaaagaagactattcatatattatggaaactaaagagaggaccaaagagcagatccaccagggagaagaaaggcttaccgaattgaagcgacagtgcgtcgagaaagaggaacgatttcagagcatagcaggtttaagcacaatgaagacaaatctcgagagcctgaagcatgaaatggcgtgggccgtggtaaacgaaattgagaaacagctgaatgcaataagggacaacattaaaatcggtgaggacagggcagcgagactggaccggaaaatggaggaacagcaggtgagattgaatgaagcggagcaaaagtataaagatatccaggacaaattagagaagattagtgaggaaaccaatgccagagcccctgaatgtatggcgctgaaggcggacgtggtggccaagaaaagagcctataacgaggcggaggtgttgtacaatcgcagtttaaatgagtataaggccctcaaaaaggacgacgagcagctgtgtaagcgcatcgaagagcttaagaagtcaacagaccagagtctggaaccagagagactggagaggcagaagaagatttcttggttgaaagaaagggttaaagcctttcagaatcaggagaacagcgttaaccaggaaattgagcagtttcagcaggccatagagaaggataaggaggagcacgggaaaattaaaagagaggagctagatgtgaagcacgcgctctcatacaaccaacgccagttgaaagaacttaaggacagcaagacagacagactcaagcggttcggccccaacgtcccagccctcctagaagctatcgacgatgcttatcgccaaggacatttcacttacaaaccagtcggtccgctgggagcctgcattcatctcagagaccctgagctggctctagcaatcgagagttgtctgaaaggactattacaagcttactgttgtcacaatcacgccgatgaaagagtgctgcaggcactaatgaagcggttctacctacccggcacgagcaggcctccgatcatcgtcagtgagtttagaaacgagatctatgatgtgagacatcgggcagcctatcacccagatttccccactgtcctgactgcacttgagatcgataacgccgtggtggccaactccttgatagacatgcggggcatagaaacagtattactcattaagaacaatagcgtggcaagggcggtgatgcagtcacagaagcctccaaaaaactgccgagaggctttcactgcggacggcgatcaagtgttcgccggtcgatactattcatcagaaaatacacggcctaaattcctgtcccgtgatgtggatagcgagatctcagacttagaaaatgaagttgagaacaaaaccgcccaaattctaaatctccaacaacacctctcagctctggagaaagacataaaacacaacgaggagctgctaaaacggtgtcagctgcactacaaggagctgaaaatgaagatcaggaaaaatatttccgaaataagagagctagagaacattgaagagcaccagagcgtagatattgccacactggaagacgaagcccaagagaataaatccaaaatgaagatggttgaggagcatatggaacagcaaaaagaaaacatggagcatctgaagagtcttaaaattgaagccgagaacaagtatgatgcaattaaattcaagataaaccaattaagtgaactcgccgatccacttaaagacgaacttaacctggccgatagcgaggtggataatcagaagcgggggaaaagacattacgaggaaaagcagaaagagcatctggatactttgaataaaaaaaagagagaactggatatgaaagagaaagagttggaagagaagatgtctcaggctaggcaaatctgtcccgagcgtatcgaagttgagaagtccgcatccatactggacaaagaaattaaccgacttcgtcagaagattcaggctgaacacgcatcccacggcgaccgcgaggagattatgcggcaataccaggaggctagagaaacgtacctggacctggactcaaaggtaagaactctgaaaaagttcatcaagttgctgggagaaattatggaacatcggtttaaaacctaccagcagtttcgacggtgtttaacactgcgctgcaaactttatttcgataacttattgtcacaaagagcctattgcggaaagatgaacttcgaccataagaacgaaactttaagcatcagcgtgcaacccggtgagggcaataaagccgcctttaatgacatgcgcgcgttgtctggaggagagagaagcttcagcaccgtatgttttattctgagcctctggtccatcgctgaatcccccttcagatgccttgatgagtttgatgtgtatatggacatggtgaatagaagaattgctatggacctcatcttgaagatggcggactcacagcgattccgccagtttatattattgacaccacaatctatgtcctctttaccatctagcaaactaatccgaatcctaagaatgagcgaccccgaaagaggtcagactacactgccattccgccctgtgacccaggaagaggacgatgatcagcgatag

SEQ ID NO: 207286 - DNA, 3276 bp, Artificial Sequence
  Description of Artificial Sequence: Synthetic coding sequence
atggccaagcggaaggaggagaacttcagcagccccaagaacgccaagaggcctcggcaagaggagttagaggacttcgataaggatggggacgaagatgagtgcaagggtactaccctgacagctgccgaggtgggtattatcgaaagcattcatctgaaaaattttatgtgtcacagtatgctcggaccatttaagttcgggagcaacgtgaattttgtcgtgggcaacaatggctctggcaagtccgcagtcctgaccgcacttatcgtggggctgggagggagagccgtggctaccaatcgcggctctagtttaaaggggttcgttaaagatggacagaattctgccgatatctccatcaccctgagaaatagaggcgatgacgctttcaaggcaagtgtttatggtaatagcattctgattcagcagcacatatccattgacggctctaggagctataagctgaagtctgctacagggtccgtggtatctacaaggaaggaggagctcatagcaatactggatcacttcaacattcaggtggataatccggtgagcgtgctgacccaggagatgagtaaacaattcctacagagcaagaatgaaggcgacaagtataagttcttcatgaaagccacccagctcgagcagatgaaagaagattatagttacatcatggagaccaaagaacgcactaaggaacagatccatcagggagaagagcggctaactgaactcaagaggcagtgcgtcgagaaagaagaacgatttcagtccatagctggactatccaccatgaaaactaatcttgaatcactaaaacacgagatggcctgggccgtggtaaacgaaatcgagaagcaattaaatgcaatccgtgataatattaagattggggaagatcgagccgccagacttgacaggaagatggaagaacaacaggtaaggctgaatgaggctgagcagaagtataaggacattcaggacaagttggagaagattagtgaagaaaccaatgcaagggcaccggagtgcatggctttgaaggcggacgttgtggctaagaagagagcgtacaatgaagctgaagtactgtacaaccgtagtctaaacgaatataaagccctgaaaaaagacgacgaacagttgtgtaagcgcattgaagagttaaagaagagcactgaccagtccttagagcctgagaggctcgaacgtcaaaagaagatctcttggctaaaagagcgtgtgaaggctttccaaaaccaagagaatagtgtcaatcaggaaatcgagcagttccagcaggccattgagaaggataaggaagaacacgggaagatcaaacgagaggaactcgatgttaagcacgccctgagttacaatcagcgacagttaaaagagttaaaggatagcaagaccgacaggctaaagcggttcgggcccaacgtccccgccttgctggaagccatcgacgatgcctaccggcaaggtcactttacctacaagcctgttggacccctgggggcctgcatccatttacgggaccccgagctagctttagcgatagagagctgcctcaaaggcctgctgcaggcctattgttgtcacaaccatgctgacgagagggtgctccaggctctaatgaaaaggttctaccttcccggtacctcccggccccccatcatcgtatcagagttccgcaatgagatctatgacgtgcgccacagggctgcctaccaccccgatttcccaaccgtgctgacagcactggagattgacaatgcagtggtggctaattccctgatagatatgcggggaatcgaaacagtgcttctcatcaaaaacaatagcgtcgccagggccgtgatgcaatctcagaaacctcccaagaactgccgggaagcattcacagcagatggcgatcaagtgttcgccggcaggtactacagctcggagaatacgagaccaaagttcctgtctagggatgttgattctgaaataagtgatctagagaacgaagtcgaaaacaaaactgcacagattctcaacctacagcaacatctgtcagcgcttgagaaagatattaaacataatgaagagctactcaaacgctgccagctgcattataaggaattgaagatgaagatcaggaagaacatatcagagattcgggaactggagaatattgaagagcaccagagcgtggatattgctactctggaggacgaggcacaggaaaacaaaagcaaaatgaaaatggtggaggaacatatggagcaacagaaagaaaacatggaacacttgaagtccctcaaaattgaggccgaaaataagtatgacgctattaaattcaagatcaatcagcttagtgagctggccgacccactgaaagacgagctgaacctcgcagattcagaggtcgacaatcagaaaagaggcaaaagacactacgaagaaaagcaaaaggaacatttggataccctaaataagaaaaaaagggaactggacatgaaggagaaagaactggaggagaagatgtctcaagctcgacagatctgtccagagcgcatcgaggttgaaaagagcgcctctattctggataaggagattaatcgtctgcgacaaaagatacaggccgaacatgccagtcatggggaccgggaagagatcatgagacagtaccaggaagcccgagagacctatctggatctcgattccaaagtgcgcaccctgaagaagttcattaagctgctgggtgagattatggaacaccgatttaaaacgtaccagcaattccggcgttgtctgactttgcgttgtaagttgtactttgataacctgttaagccaacgcgcatactgcgggaagatgaattttgatcataaaaatgaaacactgtctatcagtgtacaaccaggggaaggaaacaaggctgcatttaatgacatgagagctctctccggaggtgagaggtcctttagtacagtgtgtttcatccttagcctctggtccatagcagagagtccgtttaggtgtctggacgaattcgacgtttacatggatatggtgaaccgcaggatcgcgatggatcttatcctgaaaatggcggatagtcagcgctttaggcagtttatactgcttacacctcagtccatgtcgagtctcccttccagtaaactcattagaatcctgcggatgtccgaccccgaacgcggccagaccacactgcccttccggccagtcacacaggaagaggatgacgaccaacgctag

SEQ ID NO: 207287 - DNA, 174 bp, Artificial Sequence
  Description of Artificial Sequence: Synthetic coding sequence
atggccaagcggaaggaggagaacttcagcagccccaagaacgccaaaaggccacgtcaagaggagctggaagattttgataaggacggggatgaagacgaatgtaaaggcaccacactcactgccgccgaggttggaattatcgaatccatccatttaaaaaactttatgtag

SEQ ID NO: 207288 - DNA, 3276 bp, Artificial Sequence
  Description of Artificial Sequence: Synthetic coding sequence
atggccaagcggaaggaggagaacttcagcagccccaagaacgccaaacgaccaaggcaggaagagctcgaggacttcgacaaagacggagacgaagatgagtgtaagggcaccactttaacagcggccgaggtgggaatcatcgagtctatccatctgaaaaatttcatgtgccatagcatgttaggtcctttcaagttcggcagcaacgtgaacttcgtcgtgggaaataatggttctggcaaaagtgccgtgcttaccgccctcattgtaggtcttggcggcagggccgttgcaacaaacagagggtcctcactcaaaggcttcgtgaaggacggtcaaaattccgccgatatctcaatcactcttcgcaaccggggggatgatgcctttaaagcatctgtgtacggtaattctatcctgatccagcagcatatctcaatagatggttcacggtcttacaagctaaagtctgccacaggcagcgttgtttccaccaggaaggaggaattgatagccatcttagaccacttcaatatacaggtggacaaccctgtctcagttctcacacaggagatgagcaaacagtttctccagtcaaagaatgagggagataaatataagttcttcatgaaagccactcagctcgagcagatgaaagaggattactcctatattatggaaaccaaggaacggactaaagagcaaattcatcagggggaagagagattgactgagctcaagaggcagtgcgtggaaaaagaggagagattccagtctatcgctggtttgtcaactatgaagaccaacctggaatccttaaagcacgagatggcgtgggccgtggtcaacgagattgagaagcagttgaatgccatccgcgacaacattaagatcggcgaagaccgggcagccagactcgatcggaagatggaggagcaacaggtccgcctgaacgaggccgagcagaagtataaggatatccaggataaactcgaaaaaatatccgaggaaacaaacgcccgggcacccgagtgcatggcccttaaggctgatgtggttgcaaaaaagcgcgcatacaatgaagcggaggtgctgtacaaccggagtttaaatgagtacaaagcgctgaaaaaggatgacgaacaactatgtaaacggatcgaagagctgaagaagtccactgaccagagcctggagcctgagaggctggaacgccagaagaagataagctggttgaaagagcgggtgaaagcgtttcagaatcaggagaattctgtaaatcaggagattgagcaatttcaacaggccattgaaaaggataaagaggaacacgggaaaattaagcgagaagaactagacgtcaaacacgcactgtcttataaccagaggcaactgaaggaactgaaggattccaagaccgatcggctcaaacggttcggtcccaacgtgccagctctgctcgaagcaatcgatgatgcctatcgccaaggccactttacttataagcccgtgggtcccctgggcgcctgcatccatctccgggatccggagcttgcgttggccatagagagttgtttgaaagggctgctccaggcttattgttgccacaaccacgctgacgaacgggtgctgcaagccttgatgaagcgcttctacttacccggcacgagtcggcccccaattatcgtgtccgagttccggaatgaaatctatgatgtgcggcacagagccgcctaccaccccgactttcccacggtgttaacggcactggaaattgacaacgctgtggtagctaactctctcatcgatatgcggggtattgagactgtgctgctgattaagaacaactctgtcgcccgggctgtaatgcagagccagaagccacctaagaattgccgtgaagcattcactgcagatggcgaccaagtgtttgctgggcgctattacagttcggagaacacacgccctaagtttctttcccgcgacgtggacagcgagattagcgatctggagaacgaagtcgagaacaagaccgcccaaatcctgaatctgcagcagcacctctctgcattggaaaaggatatcaagcataatgaggagctcttgaaacgctgccagttgcactataaagaacttaaaatgaagattcgtaaaaatatcagcgaaatacgggaactcgaaaatattgaagaacaccagtcagtggatatcgcaactctggaggatgaggcccaggaaaataagtccaagatgaaaatggtggaagaacacatggagcaacaaaaagaaaatatggaacatttgaaaagcctgaaaattgaagctgagaacaagtatgacgcaatcaagttcaaaattaaccagctgtcagagttagccgatcctcttaaagatgaactcaatctggctgattccgaggtagataatcagaagagagggaagcgacattatgaggaaaaacagaaggaacacctggacactctgaacaaaaagaaacgagaattggatatgaaagagaaggaactcgaagaaaaaatgagccaggctagacagatctgcccagagaggatagaagtggaaaaatccgcctcaattctggacaaagaaattaatcggcttagacaaaagatccaggctgaacatgcgtcccatggcgaccgggaagagatcatgaggcagtaccaggaagctagggagacttatctcgacctggattcgaaggtcagaacgttaaagaagttcattaagcttctgggtgagattatggaacatcggttcaagacataccagcagttccgccggtgcctgacactgaggtgtaaactctatttcgataatctgctttcacagcgggcttactgtgggaaaatgaacttcgaccataagaatgagactctcagcatcagcgtgcagcctggtgaaggaaacaaagccgcttttaatgatatgagagcactgtccgggggagaacggtccttcagcacagtgtgcttcatcctctctctgtggtcaattgctgaatccccatttagatgtctggacgagtttgacgtctacatggatatggtgaacaggagaattgcaatggacctgatcctgaagatggcagactctcagcggtttaggcaattcatactgctgacgccccagagtatgtcttcacttccaagctctaaactcattagaatattacgcatgagcgatccggaacgcggccaaacaacccttccattccggccagtgacccaggaagaagacgatgatcagcgatag

SEQ ID NO: 207289 - DNA, 2130 bp, Artificial Sequence
  Description of Artificial Sequence: Synthetic coding sequence
atggccgagaccctggagttcaacgacgtgtaccaggaggtgaaggggtctatgaacgacgggcgccttcggctttcacggcagggcatcatcttcaaaaacagcaagaccggtaaagtggacaacatccaggcaggagaactgacggaaggtatctggagaagggtggcgttgggacatggactgaaacttttgaccaaaaacggccacgtgtacaaatacgatggcttcagggagagtgaatttgagaaacttagcgatttctttaaaacccactaccgattggaactgatggagaaagatctgtgcgtcaagggctggaactggggcaccgtgaaattcggaggacaactgctctcttttgacataggagatcagcccgtcttcgaaatacccctgagtaatgtttcccagtgcacaacgggcaaaaatgaggtgacccttgaatttcatcaaaacgacgacgccgaagtgagcttaatggaggttcgcttttacgtgccacccacccaggaagacggcgttgatccagtcgaagcgttcgcccagaatgtcttgtccaaagccgacgtcatccaagccacaggggatgctatctgtatatttagagagttacagtgtctgaccccacggggtcggtacgacatcaggatttaccctacattcctacacttgcatggaaagacatttgattacaagataccctatactaccgtgttacggctgttcctcttaccccacaaggaccagcgccagatgttctttgtgatcagtttggacccccccataaagcagggacaaacaagatatcactttcttattctgctgttctctaaggatgaggatattagccttacacttaatatgaatgaggaggaggttgagaagcggtttgagggccggctgaccaagaacatgagcgggagcctatacgagatggtgtcaagggttatgaaagccctggttaacagaaagatcactgtgcctgggaattttcagggacacagcggggctcaatgtatcacttgtagctataaagcatcgtcagggctcttatacccacttgaaagagggttcatctacgttcacaagcctcctgtccatattcgcttcgacgagatttcttttgtaaacttcgcgaggggaacaactaccacacgatcttttgattttgagattgagaccaaacaggggacgcagtatacgttttcctctatcgagagagaagagtatggcaaactcttcgactttgtgaacgccaagaagctgaatattaaaaacaggggcctaaaggaaggaatgaatcccagctatgacgaatatgctgattcagatgaggatcagcacgatgcctaccttgaacggatgaaagaagaagggaaaatccgagaggagaacgcgaacgacagctctgatgattccggcgaagagaccgatgaaagctttaacccgggtgaggaggaagaagacgttgctgaggaattcgactccaacgctagtgcctcctctagttcaaatgagggggactctgatcgtgatgagaagaagcgcaagcagcttaaaaaggccaagatggctaaagaccggaagtcccggaagaaaccagtcgaggtgaagaaaggcaaggaccccaacgcccctaagcgcccgatgtcagcatacatgttatggcttaacgccagcagggaaaaaattaaatccgatcaccccgggataagcatcacagatttatccaagaaggccggagagatctggaaaggtatgtctaaagaaaagaaagaagaatgggaccgaaaagccgaggatgctaggcgcgactatgaaaaggcaatgaaggagtatgaaggaggacgaggcgaatccagtaagagagacaaatccaaaaagaagaagaaggtgaaagtcaaaatggaaaagaagagtacaccttcacgcggctccagcagcaaaagcagcagcaggcagttatcagagtcttttaaatcaaaggaattcgtctcgtccgacgaaagcagctcgggggagaataagtccaaaaagaaaagacggcgctccgaggacagcgaggaggaggagttggctagcactcccccctcaagcgaggattccgcttcaggaagtgacgagtag

SEQ ID NO: 207290 - DNA, 240 bp, Artificial Sequence
  Description of Artificial Sequence: Synthetic coding sequence
atgaagagcctgacctggatcctgggcctgtgggccctggccgcctgctttacccccggagagtcccagcgcggtcccagagggccatacccacctggacctctggcccctcctcagcctttcggccccggctttgtccctcccccaccgccacctccctatggaccaggccgcattcctccaccacccccggcaccctatggacccgggatattcccacctcctccacctcagccttag

SEQ ID NO: 207291 - DNA, 324 bp, Artificial Sequence
  Description of Artificial Sequence: Synthetic coding sequence
atgaagagcctgacctggatcctgggcctgtgggccctggccgcctgcttcactccaggcgagtcacagcgcggcccacggggcccatacccaccagggcccctggccccaccccagccgttcggccctggatttgtgccccccccccctccccccccatatggtcccggacgcattccacctccaccatactcatgcacacccaacatgaacaactgcagtcggtgccatcaccatcacaaaaggcaccactacccctgtaactattgcttttattatccaaaatacgagttccagcactgttttcaagagacattcacttag

SEQ ID NO: 207292 - DNA, 240 bp, Artificial Sequence
  Description of Artificial Sequence: Synthetic coding sequence
atgaagagcctgacctggatcctgggcctgtgggccctggccgcctgctttactcccggggagagccagcgggggccaagagggccctatcccccaggccccctggctcccccacagcccttcggtccaggttttgtgccccctcctcctccacccccctacggtccaggcaggattcctccaccccctcctgccccgtacggtcctggaatcttcccgccacctccaccacaaccgtag

SEQ ID NO: 207293 - DNA, 348 bp, Artificial Sequence
  Description of Artificial Sequence: Synthetic coding sequence
atgagccggcacagccggctgcagcggcaggtgctgagcctgtacagagacttgctcagagctggacgtgggaagccaggggccgaagctagggtgagggccgagtttagacagcatgcagggctaccccgatccgatgttctgcgtatcgaatatctttatcggcgcggacgcagacagctacagctgctaagatccggtcatgcaactgcaatgggcgctttcgtgcgcccacgggccccgactggtgagcccggcggggtggggtgtcagcctgatgacggggattctcccagaaacccacacgattccacgggggcacccgaaactcggcctgacggccgatag

SEQ ID NO: 207294 - DNA, 501 bp, Artificial Sequence
  Description of Artificial Sequence: Synthetic coding sequence
atggccgtgagcaccgtgttcagcaccagcagcctgatgctggccctgtcacgccactcattattgtcaccattactctccgttacgtcattccggcggttctacaggggtgatagtcccacagatagtcaaaaggacatgattgagattccactgcctccatggcaggagagaaccgatgaaagcatagagactaagcgggccaggttgctgtacgagagtagaaagcgcggaatgctggagaactgcatccttttatctcttttcgccaaggagcatttgcagcatatgaccgagaagcagttgaacctgtatgatcgactgataaacgaaccaagtaacgattgggatatttattactgggccaccgaagccaagcccgctccagagatttttgagaatgaggtgatggcactcctgcgagactttgctaagaacaagaacaaggaacaacgccttcgcgccccggacctggaatacctcttcgaaaaaccccggtag

SEQ ID NO: 207295 - DNA, 843 bp, Artificial Sequence
  Description of Artificial Sequence: Synthetic coding sequence
atggccgccgtggtggccctgagcctgcggcggcggctgcccgccactaccttgggaggcgcatgtctccaagcctccaggggcgctcaaaccgcagccgcaaccgcaccaagaatcaagaagttcgccatttaccgctgggacccggataaggccggtgataagccacatatgcagacttacgaggtcgaccttaataaatgcggaccaatggtgctggacgcactgattaagattaagaatgaagtggactctacactcacatttaggagaagctgcagggaggggatctgcggcagctgtgcgatgaacattaatggcggtaatacattagcctgcaccaggcggattgacacaaacctgaataaggtgtcaaagatatacccactgccacatatgtacgtcattaaggacctcgtccctgatctgagtaatttttacgctcaatataaaagcatcgaaccctacttaaagaagaaagatgagtctcaggaagggaaacagcaatacttgcaaagcattgaggaacgggagaaactggatggattgtacgagtgcatactgtgcgcctgctgctccacatcatgcccatcctactggtggaacggggataagtatctgggccccgctgtccttatgcaggcgtatcggtggatgattgatagcagagacgactttaccgaggagagactcgccaagctgcaggatcctttttctttgtatcgctgtcacaccattatgaactgtacccgaacatgccccaaaggcctgaacccaggcaaggccatagccgaaattaaaaagatgatggctacgtacaaagaaaaaaaagcttcagtctag

SEQ ID NO: 207296 - DNA, 453 bp, Artificial Sequence
  Description of Artificial Sequence: Synthetic coding sequence
atggccgccctgctgctgcggcacgtgggccggcactgcctgcgggctcacttcagcccccagctgtgtatcagaaatgctgtccctttaggaacgacagcaaaagaggagatggagaggttttggaacaaaaacataggctcgaaccgcccccttagtccacacataactatctattcctggagcctccccatggctatgagcatctgtcacaggggaacagggatcgctttgagcgcagacgtgggtccacggaagagaccagaggatagtcctgcaattccagtgtggtccgggtgccccggatcgtactgcgtagtactgtatggggccggttctcacgtgaaaaaaggcgggtcccaacaccacctgcccactcattactacattcatcctagtttttgcttgtccttcctgagtccagcttgggagaagttttcgctcttcgtttag

SEQ ID NO: 207297 - DNA, 510 bp, Artificial Sequence
  Description of Artificial Sequence: Synthetic coding sequence
atggccgccctgctgctgcggcacgtgggccggcactgcctgcgggctcacttctcacctcagttgtgcatccgaaatgctgttcccctgggtactactgctaaggaagaaatggagaggttctggaacaaaaacatcggctccaaccggcccctctctccacacatcacaatctactcgtggtcattacccatggcgatgtcaatatgtcatagagggacaggcatcgccttgagcgcaggtgtctcgctgtttggcatgagtgccctgctgttgcccggaaacttcgaatcttacctggaactcgtgaaatccctttgcctggggccggccttgatccacacagccaagttcgcccttgtatttcccctcatgtatcacacatggaatggtattcgccatctgatgtgggatcttggtaagggactgaagattccacagctgtaccagagcggagttgtcgtgctcgtgctcacggttctgtcttcgatgggcctggctgccatgtag

SEQ ID NO: 207298 - DNA, 351 bp, Artificial Sequence
  Description of Artificial Sequence: Synthetic coding sequence
atggccgccctgctgctgagctggagcctgcccatggccatgagcatttgtcatcggggaaccgggatagcactgagtgctggtgtgtccctgtttgggatgtctgcgctattactccctggaaacttcgagtcctacctggagttggtaaaaagtctatgcctgggcccagccctgatacataccgcgaaattcgccctggtttttcctctcatgtaccatacttggaatgggatccggcacttaatgtgggatctgggaaaggggctgaaaatccctcagttatatcaaagtggagttgtggtccttgtcctgaccgtgctgtcgtcaatggggctcgctgctatgtag

SEQ ID NO: 207299 - DNA, 408 bp, Artificial Sequence
  Description of Artificial Sequence: Synthetic coding sequence
atggccgccctgctgctgcggcacgtgggccggcactgcctgcgggcccacttctcaccccagttatgcatcaggaactggtccctccctatggccatgagtatttgccatagaggaactggtatcgcactgagcgcaggtgtttcactatttggcatgagtgcgttgctgttgcccggcaatttcgagtcctatctcgagctggtcaagtctctctgccttggccctgcccttatccatactgcgaagttcgcactggtattcccattgatgtaccacacctggaacggcatccgccacctaatgtgggatctgggcaagggattgaagattccccagctttaccagtccggcgtcgtggtgctcgtgctgaccgtgttaagctcgatgggattggccgctatgtag

SEQ ID NO: 207300 - DNA, 480 bp, Artificial Sequence
  Description of Artificial Sequence: Synthetic coding sequence
atggccgtgctgtggcggctgagcgccgtgtgcggcgccctgggcggcagagctctgctgctgcgcacacctgtagtgcgtcccgctcatatttcggcattcctccaggatcggcccatcccagagtggtgcggtgtacagcacatccacctgtctccctcacaccattctggctctaaggctgccagtttgcactggacgtctgagcgggtagtctctgtactgctgctgggtctgctccccgctgcatacttgaatccatgttctgcaatggactactccctggccgccgctctaacactgcacggacactgggggctcggacaggtagtgacagactacgtgcatggtgacgccttacagaaggctgctaaggctggcttgctggcactctctgctctgaccttcgccgggctctgttacttcaattaccacgatgtgggcatatgcaaggccgtcgccatgctttggaagctatag

SEQ ID NO: 207301 - DNA, 465 bp, Artificial Sequence
  Description of Artificial Sequence: Synthetic coding sequence
atggccgccagcatgttctacggccggctggtggccgtggccacccttcggaatcaccgcccaagaacagcccaacgtgctgctgctcaggggccagtgctgatcgggtctagtcacggcggggtgaacatcgaggatgtggctgcagagtctcccgaagcaatcatcaaagaacccattgacatagaagaagggataaaaaaagagcaggccctgcagctggcccaaaagatggggtttcccccaaacattgtagagtctgctgcggaaaacatggtgaagctatacagcctgttcctgaagtacgacgctacaatgatagagattaatccaatggtagaggattcagacggagcagtgctgtgcatggacgcaaaaatcaacttcgattccaatagcgcttacaggcagaagaaaatctttgacttgcaggactggacccaggaagacgagcgggacaaatag

SEQ ID NO: 207302 - DNA, 897 bp, Artificial Sequence
  Description of Artificial Sequence: Synthetic coding sequence
agcggccggggccaccccagcgagccccccgccagcgacggccccgccgggtgctgttccgggtctaaggatgtggttataaaagcgcaggtacttgcaggaggaagggggaaggggacctttgagtctggccttaaaggaggcgtgaaaatagtgttcagtcctgaggaggccaaagctgtctcttcacagatgatcggcaagaagctgttcactaagcagaccggagagaaaggtaggatttgtaaccaagtcttggtgtgcgagcggaagtaccctcgacgcgagtactactttgcaatcacgatggagcgcagttttcaaggacctgtgctcatcggaagcagtcacggtggtgtgaacatcgaagacgtggccgcagaatcgcccgaggcaattatcaaggagccaattgacatcgaggagggtatcaagaaggagcaagcactgcaactggcccagaaaatggggttccctcccaatattgtggagtcagccgccgagaacatggttaaactttattccctcttccttaagtatgatgccacaatgattgagattaacccgatggttgaagactctgatggtgcagtgctatgcatggacgctaagatcaactttgatagtaatagcgcttaccgtcagaaaaagatttttgatctgcaggattggacccaggaggatgagcgggataaggacgctgccaaagctaacctcaattacatcggactggacggcaatatcggatgccttgtgaacggagccggtttagccatggctaccatggacattattaagctacacggagggactccggcaaactttctcgacgtgggcggaggagccaccgttcaccaggtcactgaggcgtttaagcttatcaccagtgataagtag

SEQ ID NO: 207303 - DNA, 1326 bp, Artificial Sequence
  Description of Artificial Sequence: Synthetic coding sequence
atggccgccagcatgttctacggccggctggtggccgtggccacccttcgcaatcaccggccgcggacagcccagcagcaacaacggaatttgtctttacacgagtatatgagcatggagctcctgcaagaggccggcgtctctgtgcccaaaggatacgtggcaaaatcgcctgatgaagcatacgccattgctaaaaaactggggagcaaggatgtggtcattaaggctcaagttcttgccggtgggaggggcaaaggcacgttcgagagtggcctgaaggggggagttaaaatcgtgttctcacctgaggaggccaaagctgtgtcctctcagatgatcgggaagaagctgttcactaagcagactggtgagaaaggcagaatctgcaatcaagtactcgtctgcgagcgtaaatatcccaggagagaatattacttcgccatcacaatggaacgctcgtttcagggcccagtgcttatcggcagctcccatggtggggttaacatagaagatgtggccgccgaatcccccgaggctatcatcaaagagccaattgacatcgaagaagggatcaaaaaagagcaggctctccaactggcccagaaaatgggcttccccccgaacatcgttgaatccgcagcagagaatatggtgaagctctacagtcttttcctgaaatacgacgcaacaatgatcgagatcaacccaatggtcgaggattcggatggcgcagttctatgcatggacgccaaaatcaactttgatagtaacagcgcctaccggcagaaaaaaatcttcgatctccaagattggacacaggaggatgaacgggacaaggatgcagctaaagcaaacctgaattacattggccttgatggcaacatcggctgtctggtgaacggcgctgggctcgccatggctacgatggacataatcaagctccatggaggaacaccggccaattttctcgacgtgggaggaggagctaccgtccaccaggttacagaggcatttaaattaatcactagcgataaaaaagtgctcgcaatactggtgaatatattcgggggcatcatgaggtgtgatgtcattgcacaaggtatagtgatggccgttaaggatctggaaattaagatcccagttgtcgtgagactgcagggcacccgggttgacgatgctaaagcgttaatcgctgactcaggcctgaaaatcttggcatgtgatgatttggatgaggccgcgcgcatggtggtcaagctcagcgagatagtgacgctagctaagcaggcacatgtcgacgtgaaatttcaactgccaatatag

SEQ ID NO: 207304 - DNA, 1392 bp, Artificial Sequence
  Description of Artificial Sequence: Synthetic coding sequence
atggccgccagcatgttctacggccggctggtggccgtggccaccctgagaaaccatagacctcgaacagcgcagagagcggcagcgcaggttctgggttctagtgggctgttcaataaccacggccttcaggtgcagcagcagcagcagcggaatctgagtttgcatgagtatatgtctatggagttgctgcaggaagctggcgtctcggtaccgaagggctatgttgcgaagtcccccgacgaggcctacgcaatcgcaaagaagctgggaagcaaggacgtcgtgataaaagcccaagtgcttgccggaggtaggggcaaggggacctttgaatctggcctcaagggaggggtcaaaatagtgttcagtccagaagaagctaaggccgtgtctagtcaaatgataggcaagaaattgtttactaagcagacaggggagaagggacgcatctgtaaccaggtgctggtgtgtgagagaaagtaccccagacgggaatattattttgctatcaccatggaacgaagctttcagggcccagtgttgatcgggtcctcacatggtggcgttaacatagaggacgtggcagccgagtcacccgaagccataatcaaggaacctatcgatattgaggagggaatcaagaaagaacaggcccttcaactggcccagaaaatgggtttccctccaaatatcgtggaaagtgcagcggaaaacatggtcaagctttatagcctcttcctgaaatacgacgcgacaatgatcgagataaatcccatggtggaggactcggacggggcagtactttgcatggatgccaagatcaacttcgacagtaacagtgcctacagacagaaaaagattttcgacctgcaagactggacgcaggaggatgaacgagataaggatgccgctaaggccaacctcaactatataggactggacggaaacatcgggtgccttgtaaatggcgccggtctggctatggccacgatggacatcatcaaactgcacgggggaaccccagcaaactttttagacgtgggaggtggcgctaccgtgcaccaggtaacagaagccttcaagcttatcacttccgacaagaaggttttggccatattagtcaacatctttggtggtataatgaggtgcgacgtgatcgcgcagggcatcgtcatggctgtcaaagacctggagatcaagattccagtggtggttcgtttgcagggcactagggtcgatgacgctaaggctctcatcgccgacagcggcctcaagatcctggcgtgtgacgacctggacgaagcagctagaatggtcgtcaaacttagtgaaatcgtcaccctggcaaaacaagcccatgtcgacgtcaaattccaacttccaatatag

SEQ ID NO: 207305 - DNA, 1218 bp, Artificial Sequence
  Description of Artificial Sequence: Synthetic coding sequence
atgagcatggagctgctgcaggaggccggcgtgagcgtgcccaagggctacgttgcaaagtctcccgatgaggcctatgcaatcgcgaaaaagctcgggtcgaaggatgtggtaatcaaagcccaggtcctggcgggcggccgcgggaagggcaccttcgagtcgggcttgaagggcggcgtgaagattgtgttctctccagaggaagcgaaggccgtctcaagtcagatgatcgggaaaaaactgtttaccaagcagactggggaaaagggaaggatctgtaatcaggttctggtatgtgaacgtaaataccctaggcgcgaatactactttgcaatcacaatggagaggagtttccagggacctgtcttaatcggctcatcccacgggggggtgaacattgaggacgtggcagcagaaagccccgaagctatcatcaaggaacctattgacatcgaagagggtatcaaaaaagagcaggctctgcaactcgctcagaagatgggttttcctccaaacattgtggagagcgcagccgaaaacatggtgaaactctattccctatttctaaagtatgacgcaacgatgatcgagattaatccaatggtggaggacagcgacggcgccgtactgtgtatggacgccaagataaactttgactcaaactccgcctaccgacagaaaaaaattttcgatctccaagactggacgcaggaggatgagagggacaaagacgccgcaaaagccaacttgaattatatcggactggacggaaacataggatgtttggtgaacggcgctggactggcaatggcgactatggacattatcaagctgcatggcggaacgccagctaacttcctcgacgtcgggggtggtgcaacggtgcatcaggtgacagaggcctttaagctgattacctcagataaaaaggtgctggctattctggtaaacatcttcggaggcattatgaggtgcgacgtgatcgcacagggcatagtgatggccgtaaaagatctggagattaaaatccctgtggttgtaaggctgcagggaactcgagtggatgatgccaaagccctgattgccgatagtgggctcaaaatactggcctgcgacgatttggatgaagcagccagaatggtcgtgaaactatccgaaattgtcaccctggccaagcaggcacacgtggacgtgaagtttcaactgccaatttag

SEQ ID NO: 207306 - DNA, 876 bp, Artificial Sequence
  Description of Artificial Sequence: Synthetic coding sequence
atggagcggagcttccagggccccgtgctgatcggcagcagccacggcggagtcaacatagaagatgtcgcagccgaaagccctgaagcaattatcaaggagcctatcgatattgaggaaggcataaagaaagaacaggcactacagctggcgcaaaagatgggatttccccccaacatcgttgagtccgcagccgagaatatggtgaagttgtacagtctgttcctgaagtatgatgccactatgatagaaattaacccgatggtcgaggattctgatggtgccgtactgtgcatggatgcaaagattaacttcgattctaatagcgcctatcgacagaaaaagatcttcgacctccaggattggacccaggaggacgagagagataaagatgcagccaaagccaatctcaactatattggtcttgacggcaacattggctgccttgtcaatggcgccgggctggccatggctactatggatattatcaagctgcacggaggcacgccagcaaattttctggacgtcggcggaggcgccacagtgcaccaggttaccgaagcgtttaaattgatcacttctgataagaaggtgctggccatactggtaaacatattcgggggcattatgcggtgcgacgtgatcgcccaaggtatcgtaatggcggtaaaagacctcgagatcaagatccccgtggtggttcggttacaggggactcgagtggacgatgccaaggcgctcatagctgactcgggtctcaagatcttggcatgtgatgatctcgacgaggccgctcggatggtggtaaaactgtccgaaattgtgactctggctaaacaggcccacgtggatgttaagtttcaactgcccatatag

SEQ ID NO: 207307 - DNA, 1218 bp, Artificial Sequence
  Description of Artificial Sequence: Synthetic coding sequence
atgagcatggagctgctgcaggaggccggcgtgagcgtgcccaaggggtatgtggcgaagtccccagacgaggcttatgctatcgccaaaaagctggggtctaaggatgtggtcattaaggcccaggttctggctggcggaagaggcaaaggaactttcgaatccggcttaaagggcggggtgaagatcgtcttttctccagaggaagctaaggccgtgagcagccagatgatcgggaagaaattgttcaccaagcagactggtgagaagggcagaatttgcaaccaggttcttgtgtgcgagcgcaagtatcctaggcgagaatattactttgctatcaccatggagcgctctttccaagggccagtccttataggctcttcccatgggggggtgaacatcgaagacgtggccgcagaaagcccagaggccattattaaggaacctattgacatcgaagaggggatcaagaaagagcaggccttgcagcttgcacaaaaaatgggattccctcccaatatcgtggaatctgcggctgagaatatggtgaagctctactccctatttctgaaatatgacgcaactatgattgagatcaacccaatggtggaggattcagatggagctgttctgtgcatggatgcaaagatcaacttcgatagcaactccgcttatcggcagaagaaaatattcgacctgcaggactggacacaagaggacgagcgggacaaggacgcggccaaggccaatctcaactacataggactggacggcaacattggatgccttgtgaacggggcaggtttggccatggcaacgatggatataattaagcttcatgggggcacgcctgccaacttcttggacgtcgggggcggcgcaaccgtgcaccaagtgaccgaggcatttaagctgattactagcgacaagaaagtgttagccattctggtgaacatcttcggggggatcatgcggtgcgatgtgattgctcaggggattgtgatggccgtgaaggacctggagattaagatcccagttgtcgttaggctgcagggtacaagagtggacgatgccaaggctcttatcgctgactccgggctgaagatccttgcgtgtgatgacttagatgaggcagcccggatggtcgtgaaactgtctgaaatcgtgaccctagcgaagcaagcacacgtcgatgtaaaatttcagttgcccatctag

SEQ ID NO: 207308 - DNA, 990 bp, Artificial Sequence
  Description of Artificial Sequence: Synthetic coding sequence
atgatcggcaagaagctgttcaccaagcagaccggcgagaagggccgtatctgtaaccaggtcctggtctgtgaaaggaaatatccgagacgggagtattacttcgctattactatggaaagaagcttccagggacccgttcttatagggtcttctcacggaggagtgaacatcgaggacgtagcagccgagtccccagaggcaattataaaggagcctattgatatagaggagggaatcaaaaaagagcaggccctgcagttagcccagaaaatggggttccctcccaacatcgtggaatcagccgcagaaaatatggtgaagctgtactcactatttctgaagtatgacgccacaatgattgagattaatcccatggtagaggatagcgacggcgccgtcctatgtatggatgctaaaataaatttcgactctaactctgcatataggcaaaagaaaatttttgacttgcaggattggacccaggaagacgaacgagacaaggatgccgctaaagccaacctgaactacataggccttgatgggaacataggctgtctcgtaaacggggccggccttgccatggctacaatggatatcattaaacttcacggtggcacacccgccaattttctcgatgtggggggtggtgcgactgtccaccaggtcaccgaggctttcaaactcatcaccagcgataagaaagtgctcgcgatcttggtcaatattttcgggggaatcatgcggtgcgacgtaatcgcccagggcattgttatggctgttaaagatctcgaaatcaagatccccgtcgttgttagactccaaggtactcgagtcgacgatgccaaagctctgatcgccgacagcggtctgaagatattggcctgtgacgatcttgatgaggccgcacgcatggtagttaagttatccgagattgtgactcttgccaagcaagcccatgttgatgtgaaattccagcttcccatctag

SEQ ID NO: 207309 - DNA, 1041 bp, Artificial Sequence
  Description of Artificial Sequence: Synthetic coding sequence
atgaccgccaccctggccgccgccgccgacatcgccaccatggtgtccggctcgtctggtctggctgccgctaggctgctgtcgagatcatttctcctgccccaaaatggaatcagacactgctcttatacagcatcccgacagcatttgtacgtggataagaataccaagatcatctgtcagggctttaccggtaagcagggcacattccacagccagcaagctcttgagtatgggaccaaacttgttggggggaccactccaggtaaaggggggcagacacacctcggactgcctgtattcaatacagtcaaggaggccaaggagcaaactggagcaacggcttccgtgatatatgtgccacctccatttgcagccgcagccattaatgaagcaattgaggctgaaattccactggtggtgtgtattacggaaggtatcccacagcaggacatggtcagagtgaaacacaaactgctgaggcaggaaaagacgaggctgatcgggcctaactgccccggggtaatcaacccgggcgaatgtaaaattggaataatgcctgggcacattcacaaaaagggcagaatcggcattgtgtcacgcagtggcaccctgacctatgaagcagtgcatcagacgacacaggtgggccttggacagtccctttgtgtcggtatcggaggcgaccccttcaatggaaccgacttcattgactgtctagaaatcttcctgaacgatagtgcaacagagggaatcatcttgatcggagagatcgggggtaatgctgaggagaacgcagctgagttccttaagcaacataattctgggccaaacagtaagccagtagtctctttcattgcaggtctgaccgcacctcccggtagaagaatgggccatgctggggccatcatagccggaggcaagggcggagcgaaggagaaaattagtgccctgcaatctgcgggcgtcgtggttagcatgagtccagcccagctgggaaccactatctacaaggagttcgagaaacggaaaatgttgtag

SEQ ID NO: 207310 - DNA, 5484 bp, Artificial Sequence
  Description of Artificial Sequence: Synthetic coding sequence
atggcccggaagaagttcagcggcctggagatcagcctgatcgtgctctttgtgattgtgactatcatcgctattgccctcatcgtggttttagctactaaaaccccagccgtcgatgaaatcagcgacagtactagcactccagcgacgaccagggttactacgaaccccagcgatagtgggaaatgcccaaatgtgctgaacgaccctgtgaatgtgagaataaactgtattccagaacagttccccacagagggaatttgcgcccaaagagggtgctgctggaggccttggaatgactccttgataccttggtgttttttcgtggacaaccacgggtacaatgtacaggacatgaccaccacttccattggggtggaagccaagctcaacagaatcccgtcgccaacgctctttggaaacgatatcaacagcgttctcttcactacgcagaatcagactcccaatagattccggttcaagattactgatcctaataaccgtcggtacgaagttcctcaccagtatgtgaaggaatttacaggccctaccgtctcagataccctatatgatgtaaaggtggcgcagaacccgttcagcattcaagtgatcagaaaatccaatgggaagactctttttgacactagtataggccctcttgtctatagcgatcagtacctgcagatttccactaggttacccagtgactacatttatggtatcggggagcaggtccacaaacgtttcaggcatgacctgagttggaagacctggcctatatttacaagggaccaactgccgggcgataacaacaacaacctctatggtcatcagacattctttatgtgcatagaggataccagcggaaagagtttcggcgtattcctgatgaactcaaacgcaatggagatttttatccaacctaccccgattgtaacctatagggtgaccggcggtattctagatttttatattctgttaggagacacacccgaacaggtggtacaacagtatcagcagttggtcgggctgccagccatgcctgcatactggaacctgggatttcaactgtcaagatggaattacaaaagcctggacgtcgtgaaagaagtggtccggaggaatagagaggccggtatccccttcgatactcaggtaacagacatcgactatatggaagataagaaagacttcacctacgaccaggttgcatttaacgggttaccacagtttgttcaagacctgcatgaccacggccaaaaatacgtcataatactggacccagctatcagtataggccgacgcgccaacggaacaacctacgctacgtacgaacgcgggaatacccagcacgtctggattaatgaatctgacggatccacacccatcatcggtgaggtttggcctgggctcacagtgtatcccgattttacgaacccgaactgcattgattggtgggctaacgaatgttctatcttccaccaggaggtgcagtatgatggcctgtggattgacatgaacgaagttagcagcttcatccagggtagtacgaagggctgtaatgtgaacaaattgaactatccccctttcacccctgacatactggacaagctgatgtattctaaaaccatatgcatggacgccgtgcagaactgggggaagcagtacgacgttcattcactgtacgggtacagcatggcaatagcaaccgaacaggcagtccagaaagtgtttcccaataaaaggagcttcattctgactaggtctacgttcgcgggatcgggacgccacgccgcgcactggcttggtgataataccgctagttgggaacagatggaatggtctatcactggtatgctggagttttccctttttgggataccgctcgtgggcgccgacatttgtggctttgtggcagagacaactgaagaactctgccgtaggtggatgcagctgggcgcattctacccgttctccaggaatcacaactcagacggctacgagcaccaagacccagctttcttcgggcaaaactctctcctggtcaagtcttctaggcagtacttgaccatcagatacactctcctcccctttttatataccctgttctataaagcccacgtgttcggggagaccgtcgcccgaccggtgctgcatgagttctatgaggatacaaactcctggatcgaagatactgagtttctttggggacctgcacttctgattacaccagtgctgaagcagggggcggataccgtgagcgcttatattccggatgcaatctggtatgattatgagtccggggccaagaggccctggagaaaacagcgggtggatatgtatctgccagcagacaagatcggtttacatcttcgtggaggctacatcattccaatccaggagcccgatgtgactaccacagcctccaggaagaatccattgggtctgatcgtggcgctcggtgagaacaacaccgctaaaggggattttttctgggacgatggtgaaaccaaggacactatccagaatggtaattacatattgtatactttcagcgtttctaataataccttggatatcgtgtgcacacatagtagctatcaagaaggcactactctagcctttcagactgtgaagatcctaggactcacagacagcgtgaccgaagtcagggtagccgaaaacaaccagcctatgaatgcccacagtaacttcacgtacgacgctagcaatcaggtcctccttatcgctgatctcaagctgaacctcggaagaaatttctctgtgcaatggaaccagattttttccgagaatgaaaggtttaactgctaccctgatgctgatcttgcaactgagcaaaaatgtacccagcgcggatgtgtctggcgaactggcagctctcttagcaaggcaccagagtgttactttcccagacaggacaactcttactctgtgaactccgctaggtactccagtatggggattacagctgatttacaacttaacaccgccaacgcccgcattaaactaccatcagatcccatctcaaccctgcgggtagaagttaagtaccacaaaaatgacatgctgcaattcaagatatatgacccgcagaagaagcgttatgaagtgcctgtcccattgaacattcctacaacccccatatcgacctatgaggatcgattgtatgacgtggagatcaaggagaatccattcggcatccaaatccggcgacggagctctggccgcgtcatctgggacagttggctgcctggctttgccttcaatgatcagttcatccagatcagtaccaggctccctagcgagtatatttatgggttcggagaggtcgaacacacagccttcaagagagatttgaactggaacacatgggggatgtttacacgcgatcagcccccgggttataagctgaacagctatggcttccacccgtactacatggcccttgaagaagaaggcaacgcccacggtgtttttctgcttaactctaacgctatggacgtgacctttcaaccaactcccgcactgacctaccgaaccgtcggcgggattctggacttctatatgtttctcggccctacacctgaggtggccactaaacagtatcatgaggtgatcggtcacccggtgatgccagcttactgggcacttgggttccagctttgtcgctacggctacgccaacactagcgaggttcgagagctgtatgatgccatggtggcagccaacataccctacgacgtgcaatacacagacattgactacatggaaaggcagctggattttaccattggtgaggccttccaggacctgccccaatttgtcgacaagatcagaggtgagggcatgagatatattatcatcctcgaccctgctatctccggcaacgagaccaagacgtatcctgccttcgagcgtggccagcagaatgacgtgttcgtaaagtggcctaacacaaacgatatctgctgggccaaagtgtggcctgatttgcccaacattaccatcgacaaaactctgaccgaagacgaggccgttaacgcttcccgggcccacgtggccttcccagacttctttcggacctccactgcagaatggtgggcccgagaaattgtggatttttacaacgaaaaaatgaagtttgacggactgtggatcgatatgaacgagccaagcagcttcgtgaacgggacaaccacaaaccagtgcagaaatgatgagctgaattacccgccatattttcctgaacttacgaaacgtactgacggcttgcacttcaggaccatttgcatggaagcagaacaaatactctccgatggaacttctgtgctgcactacgatgtgcacaacctctacggatggtctcagatgaagccaacccacgatgccctgcaaaagactaccgggaagcggggaattgtaatttccagaagtacctacccaactagtggacgctgggggggccactggctgggcgacaactacgccaggtgggacaacatggacaaaagcatcatcgggatgatggagtttagcctgttcgggatgtcatacacgggagctgacatctgtggcttctttaacaattcagagtaccatttgtgtacgagatggatgcagctaggggcgttttatccatacagtcggaaccataacattgccaatacacggcgacaggaccccgcatcctggaacgaaaccttcgccgagatgtcccgcaacatcctaaatattcggtatacattgctaccctatttctatacccagatgcacgagatccatgctaacggaggcacagtgatcagacccctccttcacgaattcttcgatgagaagcccacttgggacatcttcaaacagttcctatggggacccgcctttatggtgacccccgttttggagccctatgtccagacggtcaatgcctacgtgcccaacgcacggtggtttgactaccacacaggcaaggacatcggagtccggggccagtttcaaacctttaacgcatcatatgatacgattaatctccatgtcaggggagggcacattctgccttgtcaggagcctgcgcagaacaccttttattcacggcagaagcatatgaagttaattgtggcagccgatgacaatcagatggcccaggggagcctgttttgggacgatggcgagtccatagacacctacgagcgcgatttatatctcagcgttcagttcaatctgaaccagacaactctgacttcaaccatactcaagcgcggctatattaacaagtcagaaacccggctgggctctctccatgtatggggaaagggtactacccctgtgaacgccgtaactctgacctataatgggaataagaacagtcttcctttcaacgaggacaccacgaacatgatcctccggattgatctcaccacccacaatgtgacactggaggagccaattgaaataaactggagctag

SEQ ID NO: 207311 - DNA, 2616 bp, Artificial Sequence
  Description of Artificial Sequence: Synthetic coding sequence
atgaagtacagctgctgcgccctggtgctggccgtgctgggcaccgaattgctgggaagcctgtgctcaactgtgcgaagtcctagatttaggggtcggattcagcaagagaggaagaatattagacccaacattatactcgtactaaccgacgaccaggatgttgaactggggtcattgcaggtgatgaacaaaacccgcaaaatcatggaacacggcggagcaaccttcatcaatgcattcgttacaaccccaatgtgttgcccatctcgctctagcatgctgaccggcaaatacgtccataatcataacgtctataccaacaatgagaattgtagttctccctcttggcaggccatgcatgagccgagaaccttcgccgtatacttgaataacacaggttaccgcacggctttttttggcaaatatttgaatgagtataacggcagctatataccccctggatggcgggagtggctgggtctcatcaagaattctcgcttttacaattacacagtgtgcaggaacggcatcaaggaaaagcacggattcgactacgctaaagattattttactgacctgatcaccaatgagagcatcaattattttaaaatgagcaaacgaatgtatccccacaggccagtgatgatggtaatcagccacgccgcaccccacggccccgaggatagcgcaccccagtttagtaagttgtatcccaatgctagtcagcatatcacacccagctataactacgcaccaaatatggataaacactggatcatgcaatacacaggaccgatgcttcccatccacatggagttcactaacattctgcagcggaagcgcctacagaccctgatgtccgtagatgattccgtggagcgcttatataatatgcttgtggagaccggggaactcgagaacacttacatcatctacactgcagatcacgggtaccatattggacagttcggcctggtgaagggtaagtcaatgccttacgattttgatatccgcgtgcccttcttcatccgagggccgagtgtcgagccaggttcaatcgtgcctcaaattgtattgaacattgacctggctcccaccattcttgatatcgcaggactggacacccctccagatgtagacggaaagtcggttctaaagctgctcgatccagagaagcccggtaatcgatttaggaccaacaagaaagcaaagatatggcgggacaccttcctcgtagagcgtgggaagttcttgagaaagaaggaagagagcagtaagaatattcagcagtccaatcacctgccaaagtacgagagggtgaaggagttgtgccagcaggccaggtatcaaaccgcgtgtgaacaacccggccagaagtggcagtgtattgaggatacatcgggtaagctgaggattcacaagtgcaagggcccaagcgacctgctgaccgttagacagtccacacgcaatctgtacgctcgtggattccacgacaaagacaaggaatgtagctgtcgggagtccggttacagagcgtctagaagccagagaaaaagccagaggcagttcttaagaaaccagggaactcctaagtataagcctcgttttgtgcatacgcgacagacacgatccctatcggtcgaatttgaaggggaaatttacgacatcaacctggaggaagaagaggagctccaggtactgcagcctaggaatatcgcgaagcgacacgatgagggacacaagggacctcgagacctacaagctagcagtggtggcaaccgaggacgcatgttggcagacagtagcaacgccgtggggcctccaactacagtaagagtgacgcacaaatgttttatcctgcctaatgacagcatccactgcgagcgggaattgtatcagagcgcgcgggcatggaaggatcacaaggcgtatattgataaagagattgaggctctgcaagataagattaaaaatttgagagaggtgagggggcatttgaaaagacgcaagccggaggaatgttcctgctcaaaacagtcctattacaataaggaaaagggggtaaaaaagcaggagaaattaaagtcgcacctgcatcccttcaaggaagccgcacaggaggtggacagtaagctgcagctcttcaaagaaaataaccgccggcggaagaaggaacgcaaagagaagaggagacagcgcaaaggcgaggaatgtagccttcccgggctgacatgttttacccacgataacaatcactggcaaaccgctcctttctggaacctcggctctttctgcgcttgtacctccagcaacaataatacctactggtgcctcaggactgtcaatgaaactcacaactttttgttctgcgagtttgccacaggcttcttggagtattttgatatgaatacggatccctaccaactgactaatactgttcacaccgtcgagaggggcatcctgaaccaactgcatgtgcaattgatggagttacggagttgccagggctacaaacagtgcaatccaaggccaaaaaacctggacgtgggcaacaaggatggcggttcctatgacctccatcgcggtcaactatgggacgggtgggagggctag

SEQ ID NO: 207312 - DNA, 2616 bp, Artificial Sequence
  Description of Artificial Sequence: Synthetic coding sequence
atgaagtacagctgctgcgccctggtgctggccgtgctgggcaccgaattgctcggttcactgtgtagcacagtgcggtctcccagatttcgggggagaatccagcaggaaaggaagaatatccggcccaatatcatcctggttttgacagatgaccaagacgttgagctgggtagtctacaagtgatgaataagacacgcaagattatggagcacggcggggctacgttcatcaacgcctttgtgaccacacccatgtgctgccccagccgctcttcgatgctgactggtaaatacgtgcataaccataacgtgtacacaaataacgaaaattgctctagcccttcatggcaagccatgcacgaaccacgaacctttgccgtgtacctcaataataccgggtacaggaccgccttcttcgggaagtatttaaatgagtacaacgggagctatatcccgcccgggtggagggagtggctgggcttgatcaagaatagccggttttacaactatacagtctgtagaaacggaattaaagaaaaacacgggtttgactatgcaaaagattatttcactgacctgattacaaacgagtcgatcaactattttaagatgtctaagagaatgtacccccataggccagtcatgatggttatttcacacgccgctcctcatgggcctgaggatagcgctccacagttctcaaagttatacccgaatgccagccagcacattaccccaagctataattatgcacctaacatggacaaacattggattatgcagtacacagggcccatgctgcctatccacatggaattcaccaacatcttgcagcgcaaaagactgcaaacactaatgtccgtcgacgacagcgtcgagcgcttgtacaatatgctagttgaaactggtgagctcgaaaacacctatatcatttataccgccgatcatggctaccacatcggccaattcgggctggtaaaaggtaaatccatgccatacgatttcgacattagagtgccatttttcatccggggaccatccgttgagccaggttcaattgtgccccaaattgtgttaaacatagacctcgctcccacaatcctcgatattgcagggctcgacaccccgcctgatgtggatggcaagagcgttctcaagctgctcgaccctgagaagccgggaaaccggtttcgtacaaacaaaaaagccaagatatggcgggacaccttcctagtggaacgcggcaagttcctgcggaaaaaggaggagagctcaaagaacatccagcagagcaaccatctacctaagtacgagagggtaaaggaactgtgccagcaggcccgctaccagaccgcctgcgagcagccaggtcagaaatggcagtgtatcgaggacacttctggaaagctgcggatacataagtgcaagggcccctcagacctgctgaccgtcaggcagtctactcggaatctttatgctaggggatttcacgacaaggataaggaatgcagctgtcgcgaaagcggataccgcgctagtcgaagccagcgcaagtcacagagacagtttctgcggaaccagggcaccccaaaatacaagccaaggttcgtgcatactcgccagacaagatccctgtcggtggagttcgagggcgagatttacgatattaacctggaggaggaagaagaactgcaggtgcttcagccccgcaatattgcaaagcgccacgatgagggccataaaggtcctcgggacttgcaggcttcatccggtgggaatagaggacgcatgctggccgactcgtccaatgctgtgggcccacctacaacagtgagggtgacacataaatgctttatcctgcctaacgactccattcattgcgagagagagctgtaccagtccgctcgcgcctggaaggatcataaagcatatatagacaaagagatcgaagccttgcaggataaaattaagaacctcagggaggtgcgcggacacctcaagaggagaaaacccgaggagtgtagctgctccaaacagtcctactacaacaaggaaaaaggggtgaaaaaacaggaaaaactgaagtcccacttgcaccccttcaaagaagccgcgcaggaggtagacagtaaactgcagctgttcaaggagaacaacagaaggaggaagaaagaaaggaaagaaaaacggcggcaaagaaagggggaggagtgttctttgcctgggctgacctgcttcacacacgataacaatcattggcagaccgcaccgttttggaacttaggcagcttctgcgcctgtacatctagtaataataacacgtactggtgcctgaggacggtcaatgagacacataacttcctgttctgtgagttcgccaccggcttcttagagtatttcgatatgaatacagacccatatcagctgacaaataccgtccacactgtggagcgggggattctgaaccagctacacgtgcagctgatggagctaaggtcctgccaagggtacaagcaatgcaatcctagaccgaaaaatctggatgtcggtaataaggatggtgggtcctacgacctacaccggggacaattgtgggacgggtgggagggctag

SEQ ID NO: 207313 - DNA, 2616 bp, Artificial Sequence
  Description of Artificial Sequence: Synthetic coding sequence
atgaagtacagctgctgcgccctggtgctggccgtgctgggcaccgagcttctcggttcactctgttccaccgtgagaagccctagatttaggggtaggattcagcaggaacgtaaaaacatccggcctaatattatcctggtgctgacggatgaccaggacgtcgaacttggctctctgcaggtgatgaataaaactagaaaaatcatggagcatggcggcgcgaccttcatcaatgcctttgtgacaacaccaatgtgttgcccttccaggtcgagcatgctgaccggcaaatatgtacacaaccacaacgtgtacacgaacaacgaaaattgttctagtccctcctggcaggcaatgcacgagccccgcacgttcgccgtgtacttgaataacaccgggtatcgcaccgcattctttggaaaatacctgaacgaatataatggcagctacatcccacctggttggcgggaatggctggggctgattaagaattccagattttacaactacacggtgtgcagaaatggtattaaagaaaagcatgggtttgattatgcaaaggattattttactgacctgatcacgaatgagtctataaactattttaaaatgagcaagaggatgtacccacacagaccggtcatgatggtgataagccatgcagccccgcacggccccgaggacagcgcccctcaattctccaagctttaccccaacgcatctcaacacatcactcccagctacaactacgctccaaacatggacaagcattggattatgcagtacacagggcctatgctgccaattcacatggaatttacgaatattcttcagaggaaaaggctccaaacacttatgagtgtcgatgactcagtggagcgtctttacaacatgctggttgaaacgggtgagctggaaaatacatacattatttacacagccgaccacggatatcacatcggccagttcggactggtgaaagggaaatcgatgccatatgacttcgatattagggtgccatttttcatcagggggccttccgtcgagccaggaagcatcgtccctcagattgtgctcaacattgacctggccccaacaatcctcgacattgccggcttagacaccccccctgacgtggatggtaaatccgtacttaagctgctcgaccccgaaaaacccggcaatcgctttagaacaaataaaaaggcgaagatttggcgcgacacatttttagtagagcgtggcaaatttcttcgcaaaaaggaggagtccagtaagaacatccagcagagcaaccacctcccgaagtacgaaagggtaaaagagctttgccagcaggcgcgctaccagacagcatgcgagcagcccggtcaaaagtggcagtgcattgaggatacatcaggcaaattgcgtatccacaagtgcaagggcccgtctgacttgctgaccgtgagacagagcaccaggaatctctatgctcggggttttcatgacaaggataaagagtgcagttgtcgagaaagcggatatcgagcttctagatcacaaagaaagtcacagagacagttcctcaggaatcaagggacccctaagtacaaaccaaggttcgtgcacactagacaaacaagatccctgagcgttgagttcgagggggagatctatgacattaaccttgaggaagaggaggagttacaggtcctgcagcctaggaatatcgcgaaacggcacgatgagggacacaagggaccaagagacctgcaggcctctagcgggggtaaccgcggaagaatgctggccgactccagtaatgccgttggtcctcccaccactgtgcgagttacacacaagtgcttcattctgcccaatgattctattcactgcgagagagaactctaccagtccgccagagcttggaaggatcataaggcctacatagacaaagagatcgaggcgctccaggataaaataaaaaatctacgggaggtgagaggtcacctaaaaaggcgcaaaccggaagaatgcagttgctctaagcaatcatattataataaagaaaagggggtgaagaagcaggaaaagttgaaaagccacctacatccattcaaagaggcggcacaggaggttgactccaagctgcaactgtttaaagagaacaaccggagacggaaaaaggaaagaaaagagaagcgcaggcagaggaaaggtgaggaatgctccctacctggccttacctgcttcacacacgataacaaccattggcagaccgcaccattctggaacctgggcagcttctgcgcctgtactagctctaacaataacacctactggtgtttgcgcactgtgaacgaaactcacaatttcctgttttgtgagttcgctacaggattcttggagtattttgacatgaatacagacccctatcagctaacaaataccgtacacacagtggagcgcggcatattgaatcaactccatgttcagctgatggagctgcgaagttgccaggggtacaaacagtgcaacccccggccaaagaatttggacgtcgggaacaaggacggtggatcctacgacctgcaccgaggccagctatgggacggttgggaagggtag

SEQ ID NO: 207314 - DNA, 2616 bp, Artificial Sequence
  Description of Artificial Sequence: Synthetic coding sequence
atgaagtacagctgctgcgccctggtgctggccgtgctgggcaccgagctgctgggcagcctatgcagcacggtgcgcagcccccgttttcgagggcgtattcagcaggagcgcaagaatatacgccctaacatcatcttggttctcacggatgaccaggatgtcgaactgggttcgctgcaagtgatgaacaaaacccgcaaaatcatggagcacggcggggctacgtttattaatgcattcgtcacgacacccatgtgttgcccatcgcgatccagcatgctgaccggaaaatacgtgcacaatcacaacgtgtacactaataacgagaactgcagtagcccaagctggcaggcaatgcacgagcccaggacattcgcagtttacttgaacaatacaggttacagaaccgcgttctttggtaagtaccttaatgagtacaacggcagttatattccacccggatggagagagtggctcggcctgatcaaaaacagtcgattctacaattatacagtttgccgtaatggtattaaggaaaaacacggcttcgattacgctaaggattacttcacggacctcatcaccaacgagagcataaactatttcaaaatgagcaaaagaatgtatccccaccgacctgtgatgatggtgatctcacatgctgccccccatggccccgaagacagtgcgcctcagttcagcaaactgtatccgaacgcttctcaacatatcacaccatcatacaattacgccccaaatatggataagcactggattatgcagtacacaggtcccatgctaccaatccatatggaattcaccaatatattgcagcggaagcggctgcagaccttgatgtccgtggatgactctgtagaacgtctatacaacatgcttgtggagacgggcgagctagagaatacttacatcatctatacagctgaccacggttaccacattgggcagtttggacttgtaaagggaaagtctatgccctacgacttcgacattcgagtgcccttcttcataagaggaccctcagtcgagccaggaagcatcgtccctcagattgtactcaacattgatctggcccccacaatcctcgatatcgctggtctagacacgccacctgacgtcgatggcaagtcagtcctaaaacttttggaccccgagaaaccagggaataggttccggacaaacaaaaaggccaagatctggcgcgatacatttcttgtggaacgcggcaagtttctgcggaagaaagaagagtcaagcaaaaatatccagcaaagcaaccatttgccaaagtatgagcgcgtgaaggagctttgccaacaggctcggtaccaaactgcttgtgagcaacctggccagaagtggcagtgtatcgaagacacgtccggcaagctgagaatccacaagtgcaagggacccagcgacctgctgacagtgcgccagtccaccaggaacctctatgcacgaggcttccatgataaggacaaagagtgctcttgtcgtgaatcaggctacagggccagccggagccagagaaaatctcagcgccagtttcttcggaaccaaggcacccctaagtataagccacgctttgtgcatacacgacagacccgcagcctttctgtggagtttgaaggcgaaatttacgatatcaatctggaggaggaggaggaactgcaggtccttcagccaagaaatattgccaaaaggcacgatgagggccacaaggggcctcgggacctgcaggcatcaagtgggggcaaccgtggacgcatgttggccgacagcagcaacgcagtggggccacccaccacagtgcgcgtgacccataagtgttttatccttcctaatgattcaattcactgcgagagagagctctatcagtctgcccgagcctggaaggaccataaagcttacatcgacaaagaaatcgaggcactgcaggataaaattaagaatctacgcgaggtgcgagggcacctcaaacggcggaagcctgaggagtgtagctgttccaaacagagctattataacaaggagaaaggagtgaaaaaacaggaaaagctgaagagtcacctgcaccccttcaaggaagcggctcaggaggtggactccaagctgcaactgttcaaagagaataacagaaggcgcaaaaaggaaaggaaggagaaaagaaggcagcggaaaggcgaggaatgtagtctgcccggcctcacttgctttacacatgacaacaatcactggcagaccgcccctttctggaatttgggctcattttgcgcttgcacttcctccaataacaacacttattggtgcctcagaacagtgaatgaaacacacaacttcctattctgcgagttcgccactgggtttctcgaatatttcgacatgaacaccgatccctaccagctgacaaacaccgttcacacagtagaacggggaatcctgaaccagctacatgtccagctgatggaactcagatcatgccagggttacaaacagtgtaacccccgtccaaaaaatctggacgtgggcaataaagatggcggctcatatgatctccatagaggacagctgtgggacggctgggagggatag

SEQ ID NO: 207315 - DNA, 90 bp, Artificial Sequence
  Description of Artificial Sequence: Synthetic coding sequence
atgaagtacagctgctgcgccctggtgctggccgtgctgggcaccgaactgctgggatccctgtgctctacagtgaggagtccccgatag

SEQ ID NO: 207316 - DNA, 519 bp, Artificial Sequence
  Description of Artificial Sequence: Synthetic coding sequence
atgaagtacagctgctgcgccctggtgctggccgtgctgggcaccgagctgcttggaagcctttgctcaacagtccgcagccctcggttccgcggcaggatacagcaggaaaggaaaaacattcgaccaaacattatcctagtcttaaccgacgaccaggacgttgaactggggtcccttcaagtgatgaacaaaacccgtaagattatggagcatggaggagccacttttatcaacgcgttcgtaactactccaatgtgctgccccagccgatcttccatgttgacgggaaagtacgtgcacaatcataacgtttacacaaataacgaaaactgcagcagcccttcttggcaggccatgcacgagcctcgcacattcgcggtctacctgaacaatacagggtatcggaccgcgttcttcggtaaatacttgaacgagtataacggaagttacatcccccctggttggcgggaatggctcggcctgattaaaaactctagattttacaattacacctag

SEQ ID NO: 207317 - DNA, 231 bp, Artificial Sequence
  Description of Artificial Sequence: Synthetic coding sequence
atgaagtacagctgctgcgccctggtgctggccgtgctgggcaccgaactcttgggttccctgtgtagcactgttcggagccctcgttttagaggcagaattcaacaggaacgaaagaatatcagacccaatattatcctggtacttacagatgaccaggatgtcgagctcggatctctgcaggtaatgaataaaacacgcaagattatggagcatggcggggctacatag

SEQ ID NO: 207318 - DNA, 258 bp, Artificial Sequence
  Description of Artificial Sequence: Synthetic coding sequence
atgaagtacagctgctgcgccctggtgctggccgtgctgggcaccgaactgcttggttccctctgctcgaccgtacgctctcccaggtttcgaggtcgcatacagcaagagaggaagaacatcagacccaatataattttggtcctgactgatgaccaggatgtcgaactgggttctctgcaggtgatgaataaaaccagaaagatcatggagcatgggggcgcaaccttcatcaatgcctttgtcaccacaccttag

SEQ ID NO: 207319 - DNA, 171 bp, Artificial Sequence
  Description of Artificial Sequence: Synthetic coding sequence
atgaagtacagctgctgcgccctggtgctggccgtgctgggcaccgagctacttggttctctttgcagtacagtgcggtcacctagatttcgaggcagaatccagcaggagcgcaagaacattaggcccaacattatcctggtcctgaccgatgatcaggacgtggaatag

SEQ ID NO: 207320 - DNA, 2613 bp, Artificial Sequence
  Description of Artificial Sequence: Synthetic coding sequence
atgggcccccccagcctggtgctgtgcctgctgagcgccaccgtgttctctctgctggggggctcctccgcattcttgagtcaccaccggcttaagggacggtttcagcgagaccgtcggaatattaggcctaatatcattctggtcttaacagacgaccaggatgtggagttgggatcgatgcaggtcatgaataaaacacggagaatcatggagcaggggggagcccatttcattaatgcattcgttactacgccaatgtgctgtccgagcagaagctccattctgactggaaagtacgtgcacaaccacaacacttatacgaacaacgaaaactgcagttccccttcgtggcaggctcaacatgagtccaggacattcgccgtttacctcaatagcacggggtatcgtaccgcattttttggtaagtacctaaacgaatataatgggagctacgtgcctcccggctggaaagagtgggtgggtctgctcaaaaactcccgcttctataattacacattatgcaggaatggcgtaaaagagaagcatggatctgactactctaaggactacttgacggatctgatcaccaatgattctgtcagcttcttccgcacatcgaaaaagatgtacccacaccgccccgttctgatggtgatttctcacgccgccccccatggtcccgaggactccgccccccagtactccaggctgttcccaaacgctagtcagcatatcactcccagctacaactacgccccaaacccagataaacattggattatgcgatatacaggtccaatgaaaccgattcatatggaatttactaacatgcttcagcggaagcggcttcagactctgatgtccgtagacgattctatggaaactatctataacatgcttgtcgagactggtgagttagacaatacatacatagtatataccgctgaccatggctatcacataggacagtttggccttgtcaaaggaaagtcgatgccctatgagtttgatatccgcgtcccattctacgtgagggggccaaacgtcgaggcgggttgcttgaaccctcacattgtgctcaacatcgacctagcacccactatacttgatatcgcaggcctggatatcccagctgacatggacggaaagtccattctgaagttgctggacacagagagacctgtgaatcgttttcatttgaagaagaagatgcgggtctggcgtgattctttcctggtcgaaagaggcaagctcctgcataagcgggataacgataaagtcgatgcccaggaagaaaacttccttccgaagtatcagagggtgaaggatctctgtcagcgagctgagtaccagactgcatgtgagcagctcggccagaaatggcagtgtgtagaagacgctaccggtaagcttaagctacacaagtgcaaggggccgatgagattgggaggatcccgggctctttctaatctagtgcccaagtactatggccaaggcagcgaagcatgcacctgcgactcgggagactacaaactgagtctggcaggaagaagaaagaagttatttaagaaaaaatataaggcgagttatgtccgaagtcggtccattagaagcgttgctattgaggtggatggtcgtgtgtaccacgtgggtttgggcgacgctgcccagccaagaaatcttacaaagaggcattggcctggcgcccctgaggatcaggatgacaaggacggtggcgatttttcagggacaggcggacttcctgactacagcgctgcaaatcccatcaaggttacccaccgctgctacatcctggaaaacgataccgtgcagtgtgatcttgacctgtataagagcctccaggcgtggaaagaccataaacttcacatcgaccatgaaatagaaacgctgcagaataaaataaaaaatctcagagaggtgcggggccacctgaagaaaaagagacctgaagaatgtgattgtcacaagatctcctaccacacacagcacaagggaagattgaagcatcgcgggagttcgttacacccatttaggaagggtctacaggaaaaagataaggtgtggctcctgcgcgaacagaagcgcaaaaagaagctgagaaagctgttaaagcggctccagaataacgacacctgtagcatgcctggattgacatgtttcacccatgacaaccagcactggcagactgctcctttttggacactcgggcccttctgtgcgtgtacgtccgcaaataataacacctactggtgcatgagaacaatcaacgaaacacacaatttcctgttttgtgagtttgccactggctttcttgagtatttcgatcttaatactgacccttatcagctgatgaatgctgtgaacacgctcgaccgcgacgtattaaatcagcttcatgttcagctgatggagttgaggtcgtgcaaagggtacaagcaatgtaatccccgcacccgcaacatggacctggggctcaaagatggtggaagctacgagcagtatcgccaatttcagcgtaggaagtggcctgagatgaaaaggccctcgagcaagagtttaggccagctctgggagggttgggaaggctag

SEQ ID NO: 207321 - DNA, 2559 bp, Artificial Sequence
  Description of Artificial Sequence: Synthetic coding sequence
atgggcccccccagcctggtgctgtgcctgctgagcgccaccgtgttcagcttacttggaggaagcagtgccttcctgtctcaccatcggcttaaaggccgcttccaacgagacaggcgcaatatccgcccaaacattatcttagttctcacagatgatcaagacgtggaactggggtcaatgcaggtcatgaacaagactaggaggatcatggagcagggcggcgcacatttcatcaacgccttcgtgacaacacccatgtgctgtccatcgcgctcttcgatcctgaccggcaaatatgttcacaaccacaacacctataccaataacgaaaattgttccagcccttcttggcaggctcaacacgaatccagaacttttgcagtatacctcaacagcactgggtacaggacagcattttttggaaagtacctgaacgagtacaatgggagttacgtccctcccggatggaaagagtgggtaggtctgttaaaaaactctaggttctacaattacaccctgtgtaggaacggagtgaaggagaagcatggcagcgattactcgaaagactatttaactgatctcatcacaaacgacagcgtttcctttttccgcacctctaagaagatgtacccccacaggccagtgttgatggtgatttcacacgccgcaccacacggtcctgaggactccgccccccagtattcccgcctcttcccaaatgcaagccagcacattactccctcttacaactatgcacctaatcccgacaaacattggatcatgcgctacaccggacccatgaagccgattcatatggagttcaccaacatgctgcagcgcaagcgcctgcaaacactcatgtcagtggacgatagtatggaaaccatctacaacatgctggttgagacaggagagctggataacacgtacatagtgtacacagctgaccacgggtaccatatagggcagttcggtctggtcaagggtaagagcatgccctacgagtttgatatccgcgtccccttttatgtgaggggtccgaacgtggaagccggctgtctcaatccacatatagtgctgaatatcgacctcgctcctacaatcttggacattgccggcctggatattcctgctgatatggatggcaagtcgatcctaaagctcctggacacggaacggcccgtcaaccgttttcacctgaaaaaaaaaatgcgcgtctggcgtgatagttttcttgtcgagagaggtaagcttctgcataagcgggacaacgacaaggtggatgcccaggaagaaaatttcttaccaaaatatcaacgggtcaaggacttgtgtcagagggcggaataccaaaccgcttgcgagcagttggggcaaaagtggcaatgcgtcgaagacgctaccggtaagctgaaacttcataagtgtaaaggccccatgcgtctgggagggtcaagggccttgtccaatttggtgccaaaatattatgggcagggatctgaggcatgtacatgtgattccggcgattacaagttgagtctggccgggaggcgcaagaaattgtttaagaagaaatacaaggccagttacgtacgctctagatcaattaggagtgttgccatagaggtggacggcagagtgtaccacgtggggctcggtgacgctgcacagccgagaaacctcacaaaaagacattggcccggggctccagaggatcaagatgataaagatggaggtgacttctcaggaaccgggggattacccgactattccgccgctaatcctatcaaagtgacacacaggtgctatattttagagaatgacaccgtccagtgcgatctggatctctacaaaagtcttcaggcgtggaaggaccacaagctgcacatcgaccacgagattgagacgcttcaaaacaaaatcaaaaaccttagagaggtccgcggacacttgaaaaaaaagaggccggaggaatgtgactgtcacaagatcagctaccacactcagcacaaagggcgcctgaaacaccggggttcttcgcttcatccttttaggaagggcctccaggagaaggacaaagtgtggctcttgcgggagcagaaaagaaaaaaaaagctgcggaagctcctgaagcgtctccaaaataacgatacttgcagcatgcccgggctgacatgttttactcatgataaccaacactggcagacagcaccattttggacactgggaccgttctgcgcatgtacttccgcaaataacaatacttactggtgcatgaggaccatcaatgaaacccacaacttcctgttctgcgaattcgccacgggatttcttgagtacttcgacctcaataccgacccctatcaactcatgaatgcggtaaatacgctggatcgggatgtgttaaaccagctgcacgtgcagcttatggaactccgttcttgcaagggctacaagcaatgtaacccccgcacaagaaacatggatcttggacttaaggatggtggaagctatgagcagtatcgggggcagctatgggagggatgggaagggtag

SEQ ID NO: 207322 - DNA, 870 bp, Artificial Sequence
  Description of Artificial Sequence: Synthetic coding sequence
ttcagcggcaccggcggcctgcccgactacagcgccgccaaccccatcaaggtgactcaccggtgctacattctagagaacgatacagttcagtgtgatctggacctgtataagagccttcaggcctggaaggaccataaactgcacattgaccatgaaatagaaaccctgcagaataagatcaaaaacctcagggaagtgagaggccatctgaaaaagaagcgcccagaggaatgcgattgccacaagattagctaccatacgcagcacaaaggccgcctcaagcatagagggtccagtctgcatccatttcgtaagggcctgcaggaaaaagacaaggtgtggcttctgagagaacagaagaggaagaaaaagctgcgcaaactgctgaaacgactccagaacaacgatacatgttccatgcccgggctgacttgtttcacacacgacaaccaacactggcagacagccccattttggacacttgggcctttttgtgcatgcacctctgccaacaacaacacctattggtgcatgcgaacaattaatgagacccacaatttcttgttttgcgaattcgccacggggtttctggagtactttgacctgaataccgacccataccagctgatgaacgccgtcaatactcttgaccgtgatgttctaaaccagcttcatgtgcaattgatggaactgcgcagttgcaaaggctataaacagtgcaatccgcgcacccgcaatatggacctagggctgaaggacggcgggagttatgagcagtaccgacagtttcagcggagaaaatggcccgagatgaagaggccttcatccaagtctttaggacaactgtgggagggttgggagggttag

SEQ ID NO: 207323 - DNA, 2604 bp, Artificial Sequence
  Description of Artificial Sequence: Synthetic coding sequence
atgggcccccccagcctggtgctgtgcctgctgagcgccaccgtgttctctctgctgggaggctcttctgccttcctgtcccaccacagacttaaaggaagatttcagagagatcgacggaacattagaccaaacattatcctggttttgacagatgatcaggacgtcgagctggggtccatgcaggtcatgaacaagacccggcgcatcatggagcagggaggagctcattttataaatgcattcgtcactacccctatgtgctgcccttctcgaagctctatcctgacagggaagtatgtgcacaaccacaacacatatacaaataatgaaaattgctctagcccgagttggcaggctcagcacgagtcacggactttcgccgtgtacctgaattctacagggtatcgcactgcattttttggcaaatatctgaacgaatataatggtagctacgttcctccaggttggaaggaatgggtgggtctgttgaagaattctagattttacaattatactctgtgccgcaatggcgtcaaggaaaagcacgggagtgattacagcaaagactatctcaccgacttgatcaccaatgactcggtttcattctttagaacatccaagaagatgtacccacacaggcctgtgctcatggtaatctcccatgctgcgcctcacggcccagaagattccgccccccagtatagccgcttgttccctaatgctagccagcatataaccccatcctacaactatgcccccaaccccgataagcactggataatgaggtacaccggacccatgaaacccatacacatggaattcaccaacatgctacagcgcaagcggcttcagacactgatgtcagttgacgactcaatggaaaccatttacaatatgctagtggagacaggggagctggacaatacttatatcgtgtataccgcggatcatggctatcacataggacagtttggcctcgtgaagggcaaatccatgccatacgagtttgatatcagggtcccattctatgttcggggaccaaatgttgaagcaggctgcctgaaccctcacatcgttctgaatatcgacctggctcccaccatcttggatatagccggcctcgacatccccgccgacatggacggcaaaagcatcctcaagctgctggacacggagcggcctgtcaacagatttcacctcaaaaagaagatgagagtgtggcgcgatagtttcctggtggagcgcgggaaattgttgcataagcgtgacaatgacaaagtcgatgcccaggaggagaatttcctgccgaaatatcagagagtgaaagacttgtgccagcgggcagagtaccagacagcttgtgaacaactgggacagaagtggcagtgcgtggaagacgccactggcaagcttaagctgcataaatgcaaaggtcctatgcgccttggaggcagccgagctctatcgaacttggttcctaagtactacggccagggctctgaggcttgcacttgcgatagtggcgattataagctgagcctggccggtaggagaaagaagctatttaagaagaaatacaaagcctcttatgtgaggagcagatccatcagaagcgtggccatcgaagtcgatggccgcgtttaccatgtgggcctgggggacgccgcgcagccacgtaacctcacaaagcgccactggcccggcgcgcctgaagaccaggatgacaaggacggcggggacttttctgggaccggaggactgcctgattattcagctgccaaccccatcaaagtgacccatagatgctacatcctagaaaacgacacagtccagtgcgatttggatttatacaaatctctgcaggcatggaaggaccataaactgcatatcgaccacgagattgagacgctccaaaataagattaaaaatctgcgggaggttcggggccacctcaagaagaagcgccccgaagaatgcgattgtcataaaatcagttatcatactcagcacaagggccgactgaagcaccggggtagttccctccatccgtttaggaagggcctgcaggagaaagacaaggtgtggttgctgagagagcagaagaggaagaagaaactcaggaaactcctcaaacggctgcaaaataacgatacatgcagtatgccaggattgacctgcttcacccacgacaatcagcactggcagactgcccctttctggacgcttggcccgttttgcgcctgtacatccgctaacaacaacacttactggtgtatgcgcaccattaatgagactcataattttctgttttgcgagtttgcgactggattccttgaatacttcgacctgaacacggacccctatcagcttatgaacgcggtcaacaccctcgatcgcgatgtactgaatcaacttcacgtgcagctcatggagctccgatcttgtaagggttacaaacagtgcaaccccaggacccgaaacatggatctagacggggggagttatgaacagtaccggcagttccagaggcgcaagtggcccgagatgaagcgaccttcaagcaagagtctgggccagctgtgggagggatgggagggatag

SEQ ID NO: 207324 - DNA, 2613 bp, Artificial Sequence
  Description of Artificial Sequence: Synthetic coding sequence
atgggcccccccagcctggtgctgtgcctgctgagcgccaccgtgtttagcctgcttggggggtcttccgcatttctcagccatcatcgcctcaagggtagattccagcgggatcggcgcaatatccgacccaatattattttggtcctaaccgacgatcaggacgttgaactggggagtatgcaggtgatgaacaagacgcggagaataatggagcaagggggagcccatttcattaatgcattcgtaaccacccctatgtgctgtccatcaaggtcatctatccttactggtaagtacgtgcataatcacaacacatacaccaacaacgagaactgttcctcacccagctggcaggcccagcacgagtctagaactttcgccgtgtacctgaatagcacaggatatcggacagccttctttggcaaataccttaatgagtataacggaagctacgtcccccccggatggaaggaatgggtgggtctgctcaagaactctaggttttacaactataccctgtgtaggaacggcgttaaggagaaacatggcagtgactactcaaaggactaccttacggatctgattaccaacgattccgtgagtttcttcagaacatccaagaagatgtacccccaccgcccagtattgatggttattagccatgccgctccccacggccccgaggattcagctccccagtactccaggctcttcccaaacgcaagccagcatattaccccgtcttacaattatgctccaaatcctgacaaacattggatcatgaggtacacagggcctatgaaaccaatccatatggaatttacgaatatgttacagcgcaagcgcctccaaaccctaatgtcggtggatgacagcatggagaccatctacaacatgcttgttgagacaggtgagcttgataacacctatattgtgtataccgcggaccatggataccatataggccaattcgggctggtcaaggggaaaagcatgccttatgagttcgatattcgcgtgcctttttacgttcgaggacctaacgttgaggcaggctgtcttaatcctcatatagtgctgaacattgacctggccccgaccatccttgacatcgcaggacttgacatccctgccgatatggacggcaaaagtattctgaaattacttgatactgaacgccctgtcaacaggtttcatctgaaaaagaagatgcgggtctggagggactcatttctggtggaaagaggcaagctgctccacaagcgggataacgacaaagtggacgcacaggaggaaaactttttgcctaagtatcagcgggtcaaagacttatgccaacgggccgaatatcaaacagcatgtgagcagctggggcagaagtggcaatgtgtcgaggatgcaacagggaaactcaaactccacaagtgcaaaggccccatgcgattaggagggagccgagcgctttccaacctggtgccgaagtactatggtcagggcagcgaagcatgcacttgtgactctggcgactacaagctgtcgcttgcaggccgcagaaagaagctcttcaagaaaaagtataaggcttcatatgtaaggtctcggtcaattcggtctgtcgctatcgaggtggatggccgagtgtatcatgtcggcctgggcgatgcggcacagccccgcaacctgacaaagcgacactggccaggtgcaccagaagaccaggatgataaggacggtggtgatttctccggaactggaggccttcctgactactccgcggctaacccaataaaggtgacgcatagatgctacatcctggagaacgacacagtccagtgcgacctggatctgtataagagcttgcaggcttggaaagaccacaaactgcatatcgatcacgaaattgaaaccctacagaataagatcaaaaatctaagagaggtgaggggtcacctgaagaagaaaagacctgaggagtgtgattgtcacaagatctcatatcatacacagcacaaagggagactgaaacacagaggcagcagtctccacccattcaggaagggactgcaagagaaggataaggtgtggctcctgagggaacaaaagcgcaagaagaagttgcgtaagctgctgaaacgtcttcagaacaacgacacgtgtagtatgcctggcctgacatgctttacccatgataatcaacactggcagacggcgccgttctggaccttgggacccttctgtgcctgtacatctgcgaacaataatacctactggtgcatgaggacaataaatgagactcataacttcctcttctgcgaatttgccaccgggtttttggagtactttgatctgaacactgatccctatcagctgatgaacgctgttaacactctggatcgtgacgtgctcaatcagctgcacgtgcagttgatggaattaaggagttgtaagggctataaacaatgcaatccgcgcactcggaatatggacctgggtcttaaagacggaggatcttatgaacagtaccgccaattccagaggagaaaatggcctgagatgaagaggccaagtagcaaaagtctcgggcagctatgggagggatgggagggatag

SEQ ID NO: 207325 - DNA, 1125 bp, Artificial Sequence
  Description of Artificial Sequence: Synthetic coding sequence
atggccgcccccgccctgggcctggtgtgcggccggtgccccgagttggggctggttctgcttctgctgttgctctctcttctgtgcggcgcagcaggcagccaagaggccggcacgggtgctggagctgggtcgttggctggaagttgtgggtgtggcactccacagagacctggtgcccatgggtcatctgctgccgctcaccggtactctagagaagccaacgctcccggtcctgtaccgggagagcgtcagctggctcacagcaaaatggttccaatcccggctggagttttcacgatgggaacagacgacccccaaatcaagcaggacggcgaggcccccgcacgtcgcgtcactatcgacgctttttatatggatgcttacgaagtgtcaaataccgaatttgagaagtttgtaaattcaacaggctatctgacggaagccgaaaagtttggtgactcctttgtttttgaaggtatgctttccgaacaggtaaagaccaacatccagcaggcagtagctgctgccccttggtggctgcccgttaagggggcaaattggagacacccagaaggacctgactccacaattttgcaccgcccagaccacccggtgttgcatgtgtcctggaacgatgccgtggcctattgcacttgggcaggcaagcggctccccacagaagccgaatgggagtacagctgccggggcgggcttcataacaggctgttcccctggggaaacaaattgcagcccaagggtcagcattatgctaacatttggcagggcgagttccctgtgactaataccggtgaggacggcttccagggcactgcaccagtagatgcttttcctccaaatgggtatgggctgtataacatcgtgggaaacgcctgggagtggaccagcgactggtggactgtgcaccatagtgtggaagagacgcttaaccccaagggacctccgtccgggaaggatagggttaagaaagggggaagttatatgtgccaccgatcctattgctataggtatcgctgtgcggcccgatcacagaatacaccggattcctcggcttcaaatctggggtttaggtgcgcagctgacaggttgcctaccatggactag

SEQ ID NO: 207326 - DNA, 1281 bp, Artificial Sequence
  Description of Artificial Sequence: Synthetic coding sequence
atggccgcccccgccctgggcctggtgtgcggccggtgccccgagctcggtttggtgctgcttctactcctgctgagcttgctgtgtggagccgcaggctcccaggaggcgggcaccggcgccggtgcagggtcattagctggaagttgtggatgcggcacaccccagagacctggtgcacacggctctagtgcagccgcacaccggtatagtcgtgaggctaatgccccaggtccagtaccaggagaaaggcagctggcacactcaaaaatggttcctatcccagctggcgtgtttaccatgggcaccgacgacccgcagataaagcaagatggcgaagccccagccagacgggtcaccatcgatgccttctacatggacgcatatgaagtgtctaataccgaatttgagaagtttgtgaatagtaccgggtatctcaccgaggcagaaaaattcggcgattcttttgtctttgaaggcatgttaagtgagcaggtgaaaaccaacattcagcaggctgtagccgccgcgccttggtggcttccggtgaaaggggcaaactggcggcatcccgagggcccagatagcactattcttcacaggccagaccaccctgtgctacacgtgtcttggaacgatgccgttgcttactgtacttgggccggcaagaggctgcccacagaggccgagtgggagtacagttgtcgcggcggtctccacaacaggctcttcccgtggggtaacaagttacagccaaagggccaacactacgctaatatttggcagggagagtttcccgtgacaaatacaggcgaggacggtttccagggaaccgcgcctgtggatgcctttccgccaaacggatacgggctctataacattgtagggaatgcttgggaatggacgtccgattggtggaccgtgcaccacagtgttgaagagaccttgaaccctaaaggccctccttcaggtaaagacagggtgaaaaagggtggcagctacatgtgtcataggtctcaagaatattatgatccctacttccaggacgtggcttctgagatgctgcgaagacatacagcttctcgatggaaagcatttagcagcctggagccatgctgcagcattcggcgccaccagcaatacgcagccattgaaaggcttacctgtggaaagttcgagctgcgctgcgctagcttgcgtaagattgactgcctgaacaccaacatagcttgcagctactcaatgcgacaagacggtccccgcttgcattgtgtcgactag

SEQ ID NO: 207327 - DNA, 1287 bp, Artificial Sequence
  Description of Artificial Sequence: Synthetic coding sequence
atggccgcccccgccctgggcctggtgtgcggccggtgccccgagctcgggttagtgctgctgcttctcctgttgtcgttgctgtgcggcgctgctggcagccaggaagctgggactggcgctggggctggttctctggcaggatcgtgtggatgtggaacgccacagcgaccaggagcacacggtagttccgcggccgcccatcgctactcaagggaggccaatgctcctggccccgtaccaggggagcgtcagctggcacacagcaagatggtgcccattcccgctggcgtctttaccatgggtaccgacgacccgcagatcaagcaggatggggaggccccagctagaagggtcaccatcgatgctttctacatggatgcatacgaagttagtaacacagagttcgagaagttcgtgaactcaaccggataccttaccgaggcggagaaatttggcgacagtttcgtcttcgaagggatgctctctgaacaggtcaagacaaatatccagcaagctgttgctgcagccccatggtggcttcctgtcaagggcgcaaattggagacaccctgagggccccgactccaccatcctgcaccggccggaccacccagttctccatgtgtcctggaacgatgcagtcgcttactgcacgtgggctggtaaacggctcccaacagaggctgagtgggagtactcctgtcgtggagggctacataaccgactctttccctggggcaacaagttgcagcccaaaggccagcactacgcaaacatctggcaaggcgagtttcccgtgacaaatacaggggaagacggctttcagggtacggctcctgtggacgcgttcccacccaacggctacggcttatataacatcgtgggtaacgcctgggagtggacttcagactggtggaccgttcaccactctgtggaagaaacactgaacccaaaggggccaccatctggcaaagatagagtcaagaaggggggcctgagtaaagcccaccagagaattagccaggagtactatgacccttattttcaggacgtggccagcgagatgttaaggcgtcatacggcctcccgctggaaagcattctctagcttagaaccatgctgctcgataagaagacatcagcagtatgcggcaatcgagcggctcacatgtggcaagtttgaattgagatgtgcatccctccggaaaatcgactgcctgaataccaatatcgcgtgttcgtactcgatgcgacaggacggcccaagactgcattgcgtggattag

SEQ ID NO: 207328 - DNA, 1050 bp, Artificial Sequence
  Description of Artificial Sequence: Synthetic coding sequence
atggccgcccccgccctgggcctggtgtgcggccggtgccccgagctggggctcgtgcttctgcttctactcctgtcactgctatgtggtgcagctggaagccaagaggccgggaccggggctggggctgggagcctggccggtagttgcggatgtggaactccccagcgccccggcgcacacgggagcagtgccgctgcccatagatactcccgtgaagccaatgcgccaggacctgtgcccggcgaaagacagctggcccattccaagatggtacctatacctgccggagtttttaccatgggaaccgatgacccacaaatcaagcaggatggcgaggcccctgcacgtcgcgtaacgattgatgcattttatatggatgcctacgaggtgtccaacacggaattcgagaagtttgtaaacagtactggatatctgaccgaagtggccgcggcgccctggtggctcccagttaagggggctaactggagacaccctgagggccctgactccactattctccatcggcccgatcatccagttctacacgtctcttggaacgacgcggtggcatattgtacctgggctgggaagaggctccccaccgaagccgagtgggaatattcatgcagagggggcctgcataataggctcttcccctgggggaacaagctgcagcccaagggtcagcactacgccaatatttggcagggcgagttcccagttacaaacaccggagaagacggattccagggtaccgcacctgtggatgcgtttccgccaaacgggtatgggctctataatattgtaggaaacgcatgggagtggactagtgattggtggaccgtccatcacagtgttgaagagacacttaatcccaagggaccgccctccggaaaagatcgggtgaagaaagggggttcatacatgtgccatcggtcttattgctaccgttaccgctgcgccgcccgatcccagaacactccagattcctccgccagtaacctaggatttcgatgtgccgctgacagactgccaactatggattag

SEQ ID NO: 207329 - DNA, 1065 bp, Artificial Sequence
  Description of Artificial Sequence: Synthetic coding sequence
atggccgcccccgccctgggcctggtgtgcggccggtgccccgagcttggcctcgtgctgctgttattattgctcagtctgctctgcggagctgcggggtcccaggaggccggcacaggcgcgggcgctggttccctggccggctcatgcggctgcggaacaccccaaagaccaggcgcccatgggagttcagctgccgcccaccgatatagcagagaggctaacgccccagggccagttccaggagaaaggcagctcgctcattctaagatggtcccgatccctgcaggtgtgttcactatgggcactgatgacccacagatcaagcaggatggggaggctcccgctcggcgcgtcaccatcgacgcattttacatggatgcctatgaggtctccaatacagagtttgaaaagtttgtcaactctaccgggtacctgaccgaggctgagaaattcggcgactcatttgtattcgaaggtatgctttccgagcaagtgaaaactaacattcaacaggctgtggcagcggctccgtggtggttgcctgtgaaaggggctaattggcgacatcccgagggacccgacagcactattctgcatagaccggaccaccctgtgctgcatgtgtcctggaacgatgctgtcgcctactgtacctgggctggcaaaaggttgccaaccgaggctgagtgggaatacagttgcaggggggggttgcacaacagactgtttccgtgggggaataagctccagcccaagggacagcattatgctaacatatggcagggggaatttcctgtgacaaatactggcgaagatggctttcagggaactgcaccagtggacgcatttccacctaatggttacggactgtataacatcgttggcaatgcgtgggaatggacgagtgactggtggactgtgcaccactcagtggaagagaccctgaacccgtcctactgctatcgataccgatgcgctgctagaagtcaaaacaccccggacagctctgcttctaatctcggtttccgctgcgctgctgatcgtcttcccacaatggattag

SEQ ID NO: 207330 - DNA, 1638 bp, Artificial Sequence
  Description of Artificial Sequence: Synthetic coding sequence
atgctgctgctgcaccgggccgtggtgctgcggctgcagcaggcctgccgactgaaatccatcccctccaggatctgcatccaagcttgcagcacgaacgatagctttcagccccagagacccagcctaacattttcgggcgacaatagctccacacaagggtggcgtgttatgggcacgttgttgggtctgggggcggtcctggcctatcaggatcaccgatgtagggccgcacaggagagtacgcatatctatactaaggaagaagtctccagccacacctcgcctgaaactggcatttgggtgacactgggaagtgaggtatttgacgttaccgagtttgtggaccttcaccccggaggaccgagtaagctgatgttggccgcagggggaccattagagcccttttgggcgttgtacgccgtgcacaatcaaagccacgtgagagagctgctggcccagtataagatcggcgagctcaacccggaagacaaggtcgccccaacagtggaaacatctgacccctacgctgacgatccagtacgacatccagccctgaaggtgaactctcaacggccctttaatgccgagccaccccctgaactgctcactgaaaattacataacaccaaatcctatcttttttacacggaatcacttgccagtgcccaacttggatccggacacatacaggctccacgtcgttggcgcgccgggtggccagagcctcagtttgtcccttgacgatctacacaatttcccccggtatgaaattaccgttactctgcagtgtgccggcaacagacgaagcgagatgacccaagtgaaggaggtgaaggggctggagtggaggacaggggccatcagcactgccaggtgggctggagcgagactgtgcgatgttctggcacaggccggacaccagttatgcgaaacggaggcccatgtctgctttgagggactcgactctgatcccacaggcaccgcatatggggcctccattcccttggcacgggctatggacccagaggctgaggtactgctggcctacgagatgaatggtcagccgctgccccgggatcacgggtttcccgtaagagtcgtggtaccgggtgtagtcggagcacgacatgttaaatggttgggcagggtgtctgtgcaacccgaggagtcctacagccactggcagaggcgagactacaagggattcagtccgtcggtggattgggagactgtcgacttcgactctgcaccttctattcaggagttgccggttcagagcgccattactgaacctcgcgacggtgaaaccgtggagtctggtgaagtaactatcaaaggatatgcctggtcaggcggggggcgtgctgtgataagagtggacgtaagtttggacggcggtttaacttggcaggtggctaaactcgacggggaagagcagagaccgcggaaagcttgggcatggagactgtggcagttgaaagctccggttcccgcgggccaaaaagagctcaacatagtctgcaaggccgtcgacgatggctacaatgtccaacctgacacagtagccccaatttggaatttgcggggggtgctttcaaatgcttggcacagagtccacgtatacgtgtccccctag

SEQ ID NO: 207331 - DNA, 1638 bp, Artificial Sequence
  Description of Artificial Sequence: Synthetic coding sequence
atgctgctgctgcaccgggccgtggtgctgcggctgcagcaggcctgtcgactgaaaagcattcctagtagaatctgtattcaggcatgttcaaccaacgacagttttcagccacagagaccatcactgacgttctcgggcgataactcctctacccagggttggcgggttatgggcacactactggggctcggtgcagtcctcgcctaccaggatcacaggtgcagagccgcccaagagagtacccacatatacacgaaggaagaggtctcttctcataccagtcctgaaactggtatctgggtgaccctcgggtccgaggtgtttgatgtcacagagttcgtagaccttcaccctggtggcccatctaagctaatgttagccgcaggggggcccctggaaccgttttgggccctgtacgcagtccacaaccagtcacatgtgcgtgagttgctcgcccagtataaaattggggaactcaatccagaggacaaagtggcaccaacggttgaaaccagcgacccatatgctgatgacccagtgcgtcatccagcccttaaagtgaattcccagcgcccgttcaatgccgagcctccgccggagctgctgaccgaaaactatattactcctaaccccatcttttttacgcgaaatcatctccccgtccctaatctggatccagatacttatagattgcacgtggtcggagcgcccggtggccaatctctgtctctctcattagacgatctgcacaattttcccagatacgagattaccgttacgcttcaatgcgcaggaaatcgccgcagcgaaatgactcaggtcaaggaggtgaagggactagagtggaggacaggagctattagtacagccagatgggcgggggcccggctgtgtgacgtgttggctcaggctggccatcagctttgtgaaaccgaggctcatgtgtgttttgagggtctggattccgatccaacaggcacggcctatggcgcatccatccctctggccagagccatggatcctgaagctgaggtgctgctggcctacgagatgaatggtcagccactgccccgggatcatggatttccagtgcgagtcgtcgtgcccggcgtggtcggcgcacggcacgtaaagtggcttggcagagttagcgtccagccagaagaaagctactcccactggcagcggcgcgactacaaagggttttcccctagcgtggattgggaaactgttgacttcgactcggcaccttccatccaggagctccctgttcaatcagccatcaccgagccccgcgacggcgaaactgtagagagcggcgaggtgaccatcaaggggtatgcctggagcggtggcgggcgagctgttattcgagtcgacgtctctctggacggggggctgacttggcaggtagcaaaacttgatggggaggaacaaaggccccgtaaagcttgggcatggcggctgtggcagctgaaggccccagtgcccgcgggtcagaaagagctgaatatcgtatgcaaggccgtcgatgacggatataatgtgcaaccagacaccgtggctccgatctggaacctgcgcggggtcttgtcgaatgcctggcacagagtgcatgtttatgtgtcaccctag

SEQ ID NO: 207332 - DNA, 1638 bp, Artificial Sequence
  Description of Artificial Sequence: Synthetic coding sequence
atgctgctgctgcaccgggccgtggtgctgcggctgcagcaggcctgcaggctgaaatcaatccctagccgcatctgcatccaggcttgctcaacaaacgatagcttccaacctcagcgacctagcctaacattctcaggcgataacagcagcacacaaggctggagggtgatgggtacccttctcgggctgggagccgtcctcgcctatcaagaccacaggtgcagagctgcccaggagagtacgcatatctatacaaaagaggaggtatcctcacacacgtcaccggaaaccggcatctgggttactctgggtagcgaagtgttcgatgtgaccgagtttgttgacctccacccgggtggaccatccaaattgatgctcgctgccggaggccccctggagcccttctgggcgctatacgctgtgcacaatcagtcacatgttcgagaattgctcgcacagtataagatcggcgagctgaaccctgaggacaaagtggcccctacagtggaaacctcagatccttatgctgacgaccctgtgagacacccagccttaaaagtcaattcccaaagacctttcaacgccgaacctccgccggaactactgaccgaaaactatattaccccaaatcctatcttctttacccgcaatcatctcccagtcccgaatctcgatccggacacctatcggcttcacgtcgtgggcgctccaggggggcagtccctgtctctgagcctggacgaccttcacaactttcctaggtacgagataactgtgacgttgcagtgcgccgggaatcgcagatccgagatgacgcaggtgaaggaggtcaagggacttgagtggaggacaggtgcaatctccaccgcgcggtgggctggcgcaaggctgtgtgacgtgttagcccaggcaggccatcaactatgcgaaacggaggcacacgtttgctttgaagggcttgactccgatcctaccggaactgcgtacggggcttccattcctctggcacgcgccatggatccagaagcggaggtactgctggcctatgaaatgaacgggcagcctttgccgcgggaccatggttttcccgtcagggtggtggtcccaggcgtagtcggagccaggcatgtgaagtggcttggacgcgtgagtgttcagccagaagaatcatacagccattggcaacgcagggactacaagggatttagcccaagtgtggactgggaaaccgttgattttgattcagcacctagtattcaagaactccctgtgcagtcagctattacagagcctagggatggagagaccgtggagagcggggaggttacaataaaagggtacgcctggtctggcgggggtcgggctgtcatccgggtcgacgtgagtctggatggtggattaacgtggcaggtggccaaactggacggggaggaacagaggccaaggaaagcatgggcctggagactctggcaacttaaggctcccgtgcctgctgggcaaaaggagcttaatatagtatgcaaggccgtcgatgatgggtataatgtgcagcccgacacagtggcccctatctggaacctgagaggggtgttgagcaatgcatggcatagggtccacgtctacgtgagtccctag

SEQ ID NO: 207333 - DNA, 1638 bp, Artificial Sequence
  Description of Artificial Sequence: Synthetic coding sequence
atgctgctgctgcaccgggccgtggtgctgcggctgcagcaggcctgccgactgaaatccatcccatctcgcatctgcattcaagcctgctctacgaatgattcctttcagccccagagacctagcctgaccttctccggggacaattcctcaactcaaggatggagggtaatggggaccctcttgggtttaggcgctgtcttggcctaccaggaccacaggtgtcgcgccgcccaggagagcacgcacatctatacaaaggaagaggtgagtagccatacaagtccagagaccggcatttgggtgacactaggtagtgaagtctttgacgtcacagagtttgtggacttacaccccggcgggccatctaaactgatgttggccgccggcgggcccttggaacctttctgggctctgtatgctgtacacaaccagtctcacgttcgagagctactggcacagtataagataggagagctcaatcccgaagataaggtggcaccaacagttgagaccagcgatccttacgcggatgaccctgtccgccatcctgctcttaaagtgaacagccaaaggccatttaacgccgagcctccccctgaacttctgaccgagaactacattaccccaaacccaatcttctttacgcgcaaccatttgcctgtgcctaatctcgacccagacacttatcggctgcacgttgtgggggcgccaggaggacaaagcttgtcactctcacttgacgatcttcacaatttcccgaggtacgagataacggtgacattgcaatgcgcagggaatcggaggtctgaaatgactcaggtcaaggaggtcaagggtctggagtggcgcacaggggctatcagtacagcccgatgggcaggagccaggctgtgcgacgttttagcccaggcaggccaccagctttgcgaaacagaggcccatgtctgcttcgaagggctggatagcgatcccacggggacagcctatggggcaagtatccccctagctcgcgcgatggaccctgaggctgaagtcttgctggcttatgagatgaacggccagcctctgcctcgtgaccatggcttcccagttcgagtggtggtgcctggagtcgttggtgctaggcacgtcaagtggcttggacgggtcagtgtgcagcctgaggagagctactcccactggcagcgtagggactacaagggtttcagtccgtcagtcgactgggaaacagttgattttgattccgctccatccattcaggaactgccagtgcagtccgctataacagagccgagagatggcgaaacagtggagagcggcgaggtcacaatcaaaggctacgcctggagtggtgggggtagggccgtaattagggtcgacgtctctcttgatgggggtctgacttggcaagtggccaagctggatggtgaggagcagaggcccagaaaagcctgggcatggagactttggcagttaaaggcccctgtgcctgccggccagaaggaacttaacattgtgtgcaaggccgttgacgatggctacaacgtacaacccgacactgtggcccctatatggaatctgaggggggtcttgagtaacgcatggcatcgtgtgcatgtctacgtcagcccctag

SEQ ID NO: 207334 - DNA, 489 bp, Artificial Sequence
  Description of Artificial Sequence: Synthetic coding sequence
atgctgctgctgcaccgggccgtggtgctgcggctgcagcaggcctgcagacttaagtccattccctcccggatttgtatccaagcatgctctactaacgattcatttcagccacagagaccgagcctgactttctctggtgacaatagtagcacccaaggctggcgtgtgatggggaccttactgggcttaggagccgtcttagcctaccaagatcaccggtgtcgtgctgcacaagagtctacacacatttacaccaaggaggaggtgagctctcacacttcccccgagaccggcatatgggttaccctcggcagtgaagtctttgatgtaactgagtttgtcgatctgcacccaggaggcccctctaaacttatgctggctgcaggtggaccattagagccattctgggcactctacgcggttcataaccagagccacgtgagagagctgctggcccagtacaagattggagaactgaatccgtag

SEQ ID NO: 207335 - DNA, 132 bp, Artificial Sequence
  Description of Artificial Sequence: Synthetic coding sequence
atgctgctgctgcaccgggccgtggtgctgcggctgcagcaggcctgtcgactgaagtcaatcccctcccgaatttgtatccaggcttgcagcactaacgatagtttccagccgcaaagacctagtctttag

SEQ ID NO: 207336 - DNA, 1638 bp, Artificial Sequence
  Description of Artificial Sequence: Synthetic coding sequence
atgctgctgctgcaccgggccgtggtgctgcggctgcagcaggcctgtcgtctgaagagcatcccttctagaatttgcatacaggcttgtagcacaaacgacagtttccagccccaacggcctagtctgaccttttccggggacaacagttctacccaagggtggcgggttatgggtaccctgcttggcctcggcgctgtactggcttaccaggaccacaggtgccgtgcggcccaagaaagcacacatatctacaccaaggaagaagtttcgtcccatactagtcctgagactggcatatgggttaccctgggctccgaggttttcgatgttactgaattcgtggacctgcatcctggcggtccctccaagctgatgctggccgctgggggtccactggagcctttctgggcactctatgccgttcacaatcagtctcacgtgagggagttactggctcagtacaaaattggggaactgaaccccgaagataaggtagcccccaccgtggaaacatcagacccatatgccgatgatcctgtgcgccaccctgctctgaaggtgaacagtcagaggcctttcaatgccgaaccgccacccgagctgctcacggagaattatataacaccaaatccgatcttctttactaggaaccatttgcccgttcctaatctggaccctgatacctatcgcctgcatgtagtgggcgcacccggaggccagtccctgagtctatctcttgatgacctccacaacttcccaaggtatgaaattaccgtaaccttacagtgcgccggcaatcgaaggtccgaaatgacccaggttaaagaggtgaaggggctcgaatggcggaccggagctatttccactgccaggtgggcaggcgcaagactctgcgacgtcctggctcaagccggacaccagctctgcgagaccgaagcccacgtctgctttgagggcctggactccgatcctaccggaaccgcctacggcgctagcatccccctggctagagcaatggatcccgaggcagaggttttactggcctatgaaatgaacgggcagcccctgcctagggaccatggatttccggtaagggttgtggtccctggcgttgtgggggctaggcacgtgaaatggctcggcagagtatccgtgcaaccggaggagagctatagccattggcagaggagggactacaaaggcttctccccctcagtggattgggagactgttgacttcgatagtgcccctagtatacaggaactgcctgttcagtctgcgatcaccgaaccgcgcgacggtgagaccgtggagagtggagaggtgacaatcaaaggctacgcatggtccggcgggggtcgggccgtgattcgggtagacgtctctctcgatggcggcttgacgtggcaggttgcaaagcttgacggagaggagcagagacctagaaaagcatgggcttggcgcctatggcagttgaaagcccctgttccggcgggccaaaaagagctgaatatcgtctgcaaagctgtggatgatggctacaacgtgcaacccgatactgtggcaccaatctggaatctgagaggcgttctttctaacgcctggcaccgcgtacatgtctatgtctccccctag

SEQ ID NO: 207337 - DNA, 1638 bp, Artificial Sequence
  Description of Artificial Sequence: Synthetic coding sequence
atgctgctgctgcaccgggccgtggtgctgcggctgcagcaggcctgccggctgaaaagcattccctcccggatctgtatacaggcttgttccaccaacgactctttccaaccccaacgaccctcactgactttctccggcgacaattcgtcaacacagggctggagagtgatgggtactcttctcggacttggtgccgtgctggcttatcaagaccaccgttgtagggctgcacaagagagcacccatatttacacgaaggaggaggttagtagccacacatcacccgagaccggaatatgggtcaccctgggatctgaagtgtttgacgtcaccgagttcgtagatctgcaccctggtggcccatctaagctcatgctggcagcaggggggccactggaacctttctgggcactgtatgccgtccataatcagtctcacgtgcgagagttgctggcccaatataaaataggagagctcaatccagaggacaaggttgctccaacagtggagacaagcgatccatacgcagatgacccagtgaggcatcccgccctgaaggtcaactcgcagcgtccattcaacgcagaaccacctcctgaattactaaccgaaaattatatcactcccaatcctatcttctttactcgcaaccacctgccggtacctaacctcgatcctgacacctataggctccacgtggtgggcgcccctggcggccagtctctcagcttatcactcgatgatctccataactttcctcgctatgaaattaccgttacgctgcagtgtgccggcaatcgcaggagcgaaatgactcaggtgaaggaagtaaagggtctcgaatggcggactggggcaatttcaacagcccgttgggccggggctcggctgtgtgacgtcctagcacaagcaggccaccaattgtgcgagactgaagcacacgtctgttttgaggggctcgatagcgatccaactggcactgcatatggcgcatctatccccctggcacgggccatggatccggaagccgaggtgctcctagcatacgagatgaacggacagcccctcccccgggaccacgggttccccgtcagagtggtggtccccggagtggtgggcgcgcggcacgtgaagtggttaggaagggtgagcgtccagccagaggaaagttacagtcactggcagagaagggactataagggatttagcccctctgttgactgggagaccgttgacttcgattctgcccctagcatccaggagctccctgtgcagagcgccataaccgagcctagagatggggaaacagtcgagagcggtgaggttaccattaaagggtatgcttggagtggggggggcagagctgtcattagggttgatgtgtcactcgacggcggtcttacttggcaagtcgcgaaactcgacggagaggagcagcggccccggaaggcttgggcatggcgactctggcaactcaaagcccctgtgccagctggacagaaggagctgaatattgtgtgtaaggccgtagatgatgggtacaacgtacagccagacacggtcgcgcccatttggaacctgcggggcgtgctctccaatgcatggcatcgagttcacgtgtatgtctcaccatag

SEQ ID NO: 207338 - DNA, 366 bp, Artificial Sequence
  Description of Artificial Sequence: Synthetic coding sequence
atgctgctgctgcaccgggccgtggtgctgcggctgcagcaggcctgccggctgaaatctatcccctccagaatatgtattcaggcctgcagcaccaacgactcctttcagccacagagaccgtctctgactttttctggtgacaactcatcaacacaaggctggcgtgtcatgggcacgctgctggggctgggagcagtgcttgcctatcaagatcaccgatgtagagctgcacaggaaagtacgcatatctataccaaggaggaagttagttctcatacatcaccagagactggaatctgggtgactctgggctctgaggtgttcgacgtgactgaattcgtggacctacacccaggaggatag

SEQ ID NO: 207339 - DNA, 783 bp, Artificial Sequence
  Description of Artificial Sequence: Synthetic coding sequence
atggccgagagcgaggccgagacccccagcacccccggcgagttcgaatctaagtatttcgagttccatggggtccggctcccgccattttgtcggggaaagatggaggagattgcgaactttcctgtgcggccgtccgacgtgtggatcgtgacttacccgaaatccggcaccagtctgctgcaggaagttgtgtacctggtctctcagggagccgaccccgatgagatagggttgatgaacattgatgagcaactgccggtgctggaatacccccagcccggccttgatattataaaggagctaacaagcccacgccttattaagagtcatctcccctatcgcttccttccttccgacctacataacggcgactcaaaagtcatttacatggctcggaatccaaaggatctagttgtcagttactaccagttccatcggtcactgcggactatgagctaccgggggacatttcaggaattttgtaggcgattcatgaacgacaaactggggtatggctcgtggttcgagcacgtccaggaattctgggagcacaggatggattctaatgtcctgttcttaaagtatgaggacatgcacagggatctggttactatggtggagcagctcgcaaggtttctgggtgtttcttgtgataaggcccagcttgaagcgctcacagagcattgtcatcaattggtagatcaatgctgcaacgccgaggcactgcccgttggacgtgcccattgtgtctttgctcgcaaaatctttctctcttggtag

SEQ ID NO: 207340 - DNA, 855 bp, Artificial Sequence
  Description of Artificial Sequence: Synthetic coding sequence
atggccgagagcgaggccgagacccccagcacccccggcgagttcgaatccaagtatttcgaattccacggcgtacggttgccccctttttgcaggggcaaaatggaggaaatagcaaatttccccgtccggccctcggatgtctggatagtcacctatcctaaatccggcacttctctactacaggaagtagtgtacttggtgtcacagggcgcagatccggacgaaattggcttaatgaatatcgatgaacagttaccagtcctcgagtacccgcagccaggattagatattattaaggaattaacctcccctcgtctcatcaaatctcacctgccatatcggttcctcccctccgacttgcataacggggactctaaggtgatatatatggctcgcaaccctaaagatttggtcgtgagttattatcagttccaccgctccttacgtaccatgtcgtatcgcgggacattccaggagttctgcagacgattcatgaacgataaactcgggtacggctcatggtttgagcatgtgcaagagttctgggagcatcgtatggatagcaacgtcctcttcctgaaatatgaggatatgcaccgagacttagtcacgatggttgagcaactagcacgttttcttggcgtgagctgcgacaaagctcagctagaggccctgaccgagcattgtcaccagttggtggaccaatgctgcaatgccgaggcgttgcccgtaggaagggggagagtagggctgtggaaggatatttttacagtctctatgaatgagaaatttgacttggtgtataagcagaaaatgggaaagtgcgatctgacctttgacttctacttgtag

SEQ ID NO: 207341 - DNA, 516 bp, Artificial Sequence
  Description of Artificial Sequence: Synthetic coding sequence
atggccgagagcgaggccgagacccccagcacccccggcgagttcgaatccaaatactttgagtttcatggagtgaggctgcctccattctgtcgggggaagatggaagagattgctaatttcccagtgagacctagtgatgtgtggattgtgacgtatcccaaatctgtcgggtacgggtcttggttcgagcatgtccaggaattttgggagcaccggatggacagcaacgtgttgttcttgaagtacgaggatatgcatagggacctggtcacaatggtcgaacagttggcccgcttcctgggtgtctcctgtgacaaagcccagttggaagcccttaccgagcactgtcaccaactggtggatcagtgttgcaatgctgaggctttgcccgtgggccggggccgagtgggactgtggaaggacatatttaccgtttccatgaatgaaaaattcgacctggtatataaacaaaagatgggaaaatgcgatctaacattcgacttctacttgtag

SEQ ID NO: 207342 - DNA, 171 bp, Artificial Sequence
  Description of Artificial Sequence: Synthetic coding sequence
atgctggccaagctgctgtgcgaccaggtggtgggcgcccccatcgctgtgtctgcattctacgctgggatgtctattctgcagggaaaggatgatatcttcctggacctgaaacagaaattctggaatacttatatgcaaacccagtcctggctctggcggagcctatag

SEQ ID NO: 207343 - DNA, 888 bp, Artificial Sequence
  Description of Artificial Sequence: Synthetic coding sequence
atggagctgatccaggacaccagccggccccccctggagtacgtgaagggagtcccactgataaaatacttcgctgaggccctgggtccactccagtctttccaggctcggcctgatgatctcttgattagcacatatccaaagtcaggaaccacttgggtatcacaaatcctcgatatgatttaccaggggggggatctcgagaagtgccatagagctccaatctttatgagagtgccattccttgagtttaaggctcccggtatccccagtggaatggaaacactgaaagacactcccgcaccaagattgctcaagacccacctacccctcgctttgttaccgcagactctgcttgaccagaaagtgaaagtggtgtacgtggccagaaacgctaaggatgttgccgtgtcttattatcacttctatcacatggcaaaagtccatcctgagcctggcacttgggacagttttctggaaaagttcatggtgggagaggtgtcctatggtagttggtatcaacacgtgcaagagtggtgggagttgtcacgtactcacccagtgttgtacctgttctacgaagacatgaaagaaaatccaaagcgagagatccagaagatcctcgaatttgtgggaaggtcactgcccgaggagactgtggatttcgtggtccagcacacatctttcaaggagatgaaaaaaaatcccatgaccaactacaccaccgtgccacaagaattcatggaccatagtatcagcccatttatgagaaaaggcatggccggagactggaaaacaaccttcacagtcgctcaaaacgaaaggttcgacgcagattacgctgagaagatggccggctgcagcctgagcttccggtccgagctgtag

SEQ ID NO: 207344 - DNA, 888 bp, Artificial Sequence
  Description of Artificial Sequence: Synthetic coding sequence
atggagctgatccaggacaccagccggccccccctggagtacgtgaaaggggtgcccttaatcaaatatttcgcggaagccctaggccccctacagagctttcaggcgagacctgatgacctgctcattagtacatacccaaagtcaggaaccacttgggtctcccagatcctggatatgatctaccagggtggggatctcgagaaatgtcatcgggcccctatcttcatgagggtgccttttctcgaattcaaagccccagggattccatccggaatggagaccctgaaggataccccagcacctcgcttattgaagacccatttacctttggcccttttgcctcagaccctgcttgatcaaaaggttaaagtagtgtatgtggcccggaatgcaaaggatgtggctgttagttattatcacttctaccacatggctaaggtgcacccggaacctggcacgtgggactctttcctcgaaaaattcatggtgggtgaagttagctatggatcttggtatcagcatgtgcaagaatggtgggagctgtctaggactcatccagtgttatacctgttctatgaggacatgaaagagaaccctaaaagagagatccagaagatcttggagttcgtaggacgtagtctacctgaggaaaccgtggatttcgtcgtgcaacatacttccttcaaagaaatgaaaaaaaaccctatgactaattatacgacagtgccccaggagtttatggatcactctattagtccgtttatgaggaaggggatggctggcgactggaaaactactttcacagtcgcccagaatgaaagattcgacgccgactatgcggagaagatggcaggctgcagcttgtccttcagatctgagctctag

SEQ ID NO: 207345 - DNA, 654 bp, Artificial Sequence
  Description of Artificial Sequence: Synthetic coding sequence
atgctggccaagctgctgtgcgaccaggtggtgggcgcccccatcgccgtctccgcattttacgccggcatgtcaatcttacaagggaaagacgacatcttcttagacctcaaacagaaattctggaacacctatatggtagtctacgtagcccggaatgccaaggatgtcgctgtgagctattaccatttctatcatatggcgaaggtgcatcccgaaccgggcacttgggatagtttccttgagaaattcatggtgggcgaggtatcatatggtagctggtaccagcacgtccaggaatggtgggagctctctagaacgcacccagtgctgtatttgttctatgaggacatgaaggagaacccaaaacgcgaaatacagaaaatcttagagttcgtgggccgctccctcccagaggagacagtggacttcgtcgtgcagcacacctcatttaaggaaatgaagaagaatcccatgactaattacaccacagtaccacaggagttcatggaccattctatcagcccattcatgcggaagggcatggctggcgactggaagacaaccttcacagtggctcagaatgaacggttcgatgctgactatgctgaaaagatggccgggtgctcactttcgttccggtcggagttgtag

SEQ ID NO: 207346 - DNA, 888 bp, Artificial Sequence
  Description of Artificial Sequence: Synthetic coding sequence
atggagctgatccaggacaccagccggccccccctggagtacgtgaagggcgttccactaatcaagtatttcgccgaggctctgggcccccttcagtcttttcaggcacgccctgacgatctgctaatctctacctacccgaagtcaggcacgacatgggtgtctcagatcctggacatgatctaccagggaggagatctggagaaatgccatcgtgctccaattttcatgagagtaccctttctggagttcaaagctcccggcattccctctgggatggagaccctgaaggatacccctgcccctcggctgctaaagacacaccttcccctcgccctcttgccccagactctgctcgaccagaaagtaaaggtggtttacgttgctagaaacgcgaaggacgtcgcggtgtcttactaccacttctaccacatggccaaagtgcacccggagccgggcacttgggacagtttcctggagaagtttatggtcggtgaagtatcatacgggagttggtatcagcatgtgcaagaatggtgggaattgagccgcacccacccagtgctctatttattttatgaggacatgaaggaaaatccaaaacgtgaaatccagaagatacttgagtttgtgggtagatccctccccgaggaaactgtagattttgttgtccagcatacctccttcaaggagatgaagaaaaacccaatgacaaattatacgacagtcccacaagagttcatggaccacagcatttctccttttatgagaaagggcatggcaggcgattggaagacgaccttcacggtcgcgcagaatgaacggtttgatgccgattatgcggagaagatggcagggtgttcactgagctttagatctgagctgtag

SEQ ID NO: 207347 - DNA, 888 bp, Artificial Sequence
  Description of Artificial Sequence: Synthetic coding sequence
atggagctgatccaggacaccagccggccccccctggagtacgtgaagggagttcccctgatcaagtacttcgcagaagctctgggccctctccagtcatttcaggcccgccccgatgacttgctaatttctacttaccctaagtctggcactacatgggtttcccaaatccttgatatgatctaccaagggggcgatctcgagaaatgccaccgggcccctatatttatgagagttcctttcttggagttcaaagcaccagggatcccctctgggatggaaacacttaaggatacccccgctccccgtctacttaaaacccaccttccgttggcccttctccctcaaaccctgcttgaccaaaaggtcaaagtggtttacgtggctcgcaatgccaaggatgtggcagtgtcttactatcatttttatcatatggccaaagtgcaccctgaacccggcacctgggatagctttctggagaagtttatggtaggcgaagtgagctacggaagttggtatcagcatgttcaggagtggtgggagctgtcaaggacccacccggtattatacttattctatgaagatatgaaagagaacccgaagcgagagatacaaaagatccttgaattcgtgggcagatccctgcctgaggagaccgttgactttgtcgtacagcacacttcctttaaagagatgaagaagaacccgatgaccaactacaccactgttccgcaggaattcatggaccattccatcagtcccttcatgaggaagggtatggctggcgattggaagacgacgttcacagtggcccagaatgaacgattcgacgctgattatgcagagaaaatggccggttgctcattaagtttcaggtctgaactatag

SEQ ID NO: 207348 - DNA, 888 bp, Artificial Sequence
  Description of Artificial Sequence: Synthetic coding sequence
atggagctgatccaggacatcagccggccccccctggagtacgtgaaaggcgtgccgttgattaagtacttcgcagaggctcttgggcctctgcaaagcttccaggccaggcctgacgatttgttgatctctacatacccaaaatcgggcacgacctgggtgtctcagatcctggacatgatttaccaaggcggtgacctggagaagtgtcatcgggcgccaatttttatgcgggtgccttttctggagttcaaggtgcccggcatcccctcaggtatggagaccctcaaaaacacgcctgcccctaggctgctgaaaacacacctccctctggcccttctcccccagacactgcttgatcagaaagtaaaagtggtgtatgtggctagaaacgcgaaagacgtcgcggtgtcttactaccatttctaccacatggccaaggtctaccctcatccggggacctgggagtctttcctggagaagttcatggctggtgaggtgtcttatggtagttggtatcagcacgtccaggaatggtgggaacttagtagaacacatcccgtgttgtacctattttacgaggatatgaaggagaatccaaaaagggaaattcaaaagatcctcgaattcgtcggaaggagcctgcctgaggagactgtcgacttaatggtcgaacacacgtcatttaaagaaatgaagaagaatcctatgaccaattataccacggtgcggcgggagttcatggatcactccatttccccatttatgcgcaaaggtatggctggcgactggaagacgacctttacagtcgcccagaacgagaggtttgatgctgactacgctaagaagatggccggatgctcattaagttttagatcagagttatag

SEQ ID NO: 207349 - DNA, 888 bp, Artificial Sequence
  Description of Artificial Sequence: Synthetic coding sequence
atggagctgatccaggacatcagccggccccccctggagtacgtgaagggcgtgccactgatcaagtacttcgcagaagccctagggcctttacagagtttccaggcccgccctgacgaccttctgatctcgacttaccctaagagcggcacaacttgggtctcccagatactcgatatgatatatcagggaggagacctggagaaatgtcaccgcgcccccatctttatgcgggtgcccttcttggaatttaaagttcctggcattcctagcggcatggaaactctgaagaatacgccagcccccagactcctaaagacccaccttccccttgccctacttccacagaccctcttggatcagaaggtgaaggtcgtgtatgtggccaggaacgccaaggacgttgcagttagctactaccatttttaccatatggcaaaggtgtacccccaccccggcacctgggaatctttccttgaaaagtttatggcgggcgaggtgagttacggcagttggtatcaacacgttcaggagtggtgggagctatccagaactcatcctgttttatacttattttatgaagacatgaaggaaaaccccaagcgagagatacagaagatcctagagttcgttgggagatccttgcccgaggaaactgtggacttgatggtggaacatactagcttcaaagaaatgaagaaaaacccaatgaccaactacacaacagtgcgacgcgagtttatggaccattccatctccccttttatgcgcaaaggaatggctggcgactggaagactacctttaccgtcgcccagaatgagaggttcgacgcagactacgctaaaaagatggctggctgctctctgtccttcaggagcgagctgtag

SEQ ID NO: 207350 - DNA, 579 bp, Artificial Sequence
  Description of Artificial Sequence: Synthetic coding sequence
atggagctgatccaggacatcagccggccccccctggagtacgtgaaaggagtaccactcatcaagtattttgcagaggcgctcgggccgctgcagagctttcaggctcgacccgacgatcttctgatctccacatatccaaagagtggaaccacctgggtgtctcagatcctggatatgatttatcagggcggggacctagagaaatgtcaccgcgcccccatttttatgagagtacccttcctcgagtttaaagtgccaggcattccaagtggcatggagaccttgaaaaatactccagctccacggcttctaaagacgcatcttcccttagccctgctcccacaaacgctcttggaccagaaggtgaaggtcgtttatgtggcacgcaacgcgaaagatgtcgccgtatcatactaccacttttaccacatggctaaagtctatccacatcccgggacatgggaatcctttctggagaaatttatggcaggcgaagtgtcgtacggatcctggtatcagcacgtgcaggagtggtgggaattgagtagaactcatccagtcttgtatctgttctag

SEQ ID NO: 207351 - DNA, 891 bp, Artificial Sequence
  Description of Artificial Sequence: Synthetic coding sequence
atggccctgaccagcgacctgggcaagcagatcaagctgaaggaggttgaggggacactgctgcagccagccacagtagacaattggagtcagattcagagtttcgaggctaaaccagacgacttactcatatgcacctatccgaaggcaggcaccacctggatccaggaaattgttgacatgatcgagcaaaacggggacgtcgagaagtgccagcgcgccattatacagcatcgccatccattcatcgagtgggccaggcccccacagccctcgggtgtggaaaaggcaaaggctatgccctccccacgcatcctgaaaacacatctgagtacgcaactgttaccccccagtttctgggagaacaattgcaaattcctctacgtggctcgcaacgccaaagactgcatggtaagttattaccatttccaaagaatgaaccacatgctgcccgatccgggtacctgggaagagtacttcgagaccttcatcaacggaaaggtagtctggggtagctggtttgaccatgtaaaggggtggtgggagatgaaagaccgacaccagatactgtttctgttctacgaagacattaaacgagacccaaaacatgaaatccgtaaggtgatgcagttcatgggaaagaaggtcgacgagaccgtgttggataagattgtgcaggaaacttcctttgaaaagatgaaggagaatcctatgacgaatcgctccaccgtttctaaatccatactagatcagagcattagttctttcatgcggaagggcacagtgggggattggaagaaccacttcaccgtggcccagaatgagcgattcgatgaaatataccggcgcaagatggaaggcacatcgattaatttctgcatggaactgtag

SEQ ID NO: 207352 - DNA, 924 bp, Artificial Sequence
  Description of Artificial Sequence: Synthetic coding sequence
atggccctgaccagcgacctgggcaagcagatcaagctgaaggaggttgaaggcacgctgctgcagcccgcaaccgttgacaattggtcccaaatccagagttttgaagccaagccagacgatcttctaatctgcacttaccccaaggcaggtaccacctggattcaggagattgttgatatgatagaacagaatggcgatgtggagaagtgccagcgcgccatcatacagcatcgccaccccttcatcgagtgggcgaggccaccacagcctagcgaaacaggctttcaccatgtggctcaagccgggctcaagttgctgtcatccagtaacccccctgcttctacctcccaatccgccaaaattacagacttgctgcccccttctttctgggaaaacaactgtaaatttttgtacgtcgctcgaaacgcgaaagattgcatggtctcttactaccacttccaacggatgaatcatatgctgcctgatccaggtacctgggaagagtatttcgagacgttcatcaacggcaaagtcgtgtggggatcttggttcgatcatgtaaagggctggtgggaaatgaaggatcgccatcagatactattcctattctacgaggatataaaacgggatccaaagcacgagatcaggaaggttatgcagttcatgggcaagaaagtcgacgagaccgtactggacaagatcgtgcaggaaacaagtttcgagaaaatgaaagaaaatcctatgaccaaccgaagcactgtcagcaagtctatcttggatcaatcgataagtagtttcatgagaaaggggacagttggggactggaagaatcattttacagtggcacagaatgagcggtttgatgaaatctacaggcgaaagatggaaggcactagcatcaatttctgtatggaactgtag

SEQ ID NO: 207353 - DNA, 933 bp, Artificial Sequence
  Description of Artificial Sequence: Synthetic coding sequence
atggccctgaccagcgacctgggcaagcagatcaagctgaaggaggtggagggtacactactgcaacctgcaactgtggataactggtctcagatccagagtttcgaggctaaaccggatgatctgctgatatgtacatatcccaaggctggcaccacatggatacaggagatagtcgacatgattgagcagaacggcgatgtggagaaatgtcaacgtgccattatccaacaccgacatccattcattgagtgggccagaccgccacaaccctccgtgttagttctgagaaggtgtttcctcctgagctatttcaagggggtggaaaaagctaaggcaatgccttcgcctagaatcctcaagacccacctgtctacccagttgctcccgccgagcttctgggaaaacaactgtaagttcctgtacgtcgcaagaaacgctaaggattgcatggtgtcatattatcacttccaacgtatgaatcacatgctgcctgaccctggcacttgggaggagtatttcgagacatttatcaacggaaaggttgtctggggaagttggtttgatcatgtgaaaggctggtgggagatgaaggaccgccatcaaattttgttcctgttctacgaggatatcaaacgcgacccaaagcatgaaatccgcaaggtgatgcagtttatggggaagaaggttgacgaaactgtgctcgacaaaatcgtgcaggaaaccagtttcgaaaagatgaaggagaacccgatgacaaataggtcaaccgtgtctaagtctatcctggatcagtccatcagttccttcatgcgaaagggaaccgtgggagactggaagaaccacttcacagtagcccagaacgagagatttgacgaaatttacagaaggaagatggagggaacaagtattaatttctgtatggaactgtag

SEQ ID NO: 207354 - DNA, 639 bp, Artificial Sequence
  Description of Artificial Sequence: Synthetic coding sequence
atgggcccccccagcgccagcccccaccgggagtgcatcccctggcaggggttgttgttgacagctagtttacttaatttctggaacccaccgactaccgccaagttaacaatcgaatcgatgcctctatcagttgctgaaggtaaggaagtgctgttgctggtacacaatcttccacaacatctgtttggatactcatggtacaaaggcgaacgcgtagatggcaacagtttaattgtgggatacgtgattggaacccaacaagcaacccccggtgccgcatacagcggccgcgagaccatctacacgaacgccagcctcttgatacagaacgtgacgcagaacgatattggattttacaccttgcaagtgataaaatcagacctggttaatgaggaggcaacgggtcagttccacgtgtaccaagaaaatgcccctggcctgcctgtgggagcggtggccggaattgtgactggtgtgcttgtgggagtggccctggttgctgctctggtgtgctttctgttactcgctaaaacagggcggccctggtctctgccacagctttgtctcctcgacgtccccagcctccactgccccggtccgcccacccagccacaggactcatctttccacctgtag

SEQ ID NO: 207355 - DNA, 1098 bp, Artificial Sequence
  Description of Artificial Sequence: Synthetic coding sequence
atggacggccccgccgagccccagatccccggcctgtgggacacctacgaggatgatattagtgaaatctctcagaaattgcccggggagtacttccggtataagggcgtgccatttcctgtggggctttattcgctcgagagtatctccttggccgagaacacccaggacgtgcgagacgatgatatttttattatcacatatccgaaatccgggactacatggatgattgaaataatctgtctgattttgaaagaaggagacccctcttggatcagatcggttcctatatgggagcgtgcgccgtggtgtgagacaatcgttggtgcattcagccttcctgatcagtacagtcccaggctgatgtcatctcatctgcctatccagatttttaccaaggcatttttttcttctaaggccaaggtgatatacatggggagaaatccacgcgacgttgtcgtgagtctatatcattacagcaaaattgcaggccagctgaaggatcctggcacccctgaccagtttctgcgcgactttcttaaaggcgaggtccagttcggatcctggttcgaccacataaagggatggttgcgaatgaagggcaaagataatttcctcttcataacatacgaggagctacaacaggatctgcagggcagtgttgagcgcatatgtggctttctgggccggcccttaggcaaggaggctctcggatccgtggtggcacattctactttcagcgccatgaaagctaataccatgagcaattatactttgctacctccgtcattgctggatcatagacgtggtgcattcctgcgcaaaggagtctgtggggactggaagaaccattttactgtggcgcagagcgaggcttttgaccgggcatacagaaaacagatgaggggcatgcctacctttccctgggacgaagatcccgaggaagacggtagccccgatcccgaacctagccccgaacccgagcccaaacccagcttagagcctaatacctcattggaaagggaaccccgcccaaactcctctccgagtccatccccaggtcaggcttcagaaacccctcatcccagaccctcatag

SEQ ID NO: 207356 - DNA, 1053 bp, Artificial Sequence
  Description of Artificial Sequence: Synthetic coding sequence
atggccagccccccccccttccacagccagaagctgcccggcgagtacttcagatataaaggagtcccattccctgtcgggctgtatagcctggagtccatatctcttgcagaaaatacacaagatgtacgggatgacgatatcttcatcattacatatccaaagtcaggcaccacctggatgatcgaaatcatttgcctgattcttaaggagggcgatcctagctggattaggagcgtgccaatttgggaacgagctccctggtgcgagaccatagtaggggccttttcactgccagatcaatatagtccccggctcatgagctcccacttgccaattcagatctttacaaaggccttcttctcttccaaggcgaaggtaatctacatgggacgcaatccgcgagacgtcgtggtcagcctctaccactactcgaaaatcgccgggcaactcaaggatcccggaacccctgaccagtttcttcgggattttctgaagggagaggtgcagttcggctcttggtttgaccacataaaaggttggctgcgcatgaaggggaaggacaactttctgttcatcacttatgaagaattgcaacaagatctgcagggctctgtggaacggatctgcggttttttgggacggcccttaggcaaggaggccttgggatccgtcgtggcacactccaccttttccgccatgaaggccaatacaatgtccaactatacactgttgcccccttcactgttagatcatcggcgcggagcattcctgagaaaaggtgtttgcggggactggaagaaccatttcactgtggcccaaagcgaggcctttgatagggcttacagaaaacagatgcgtggcatgcccactttcccctgggacgaggatccggaggaagacggctctcccgaccctgaacctagcccggaaccagaacccaaacccagtctggaaccaaatacatcactagagcgagaacctcgcccaaactcaagcccctcgccatctcctggccaggcgtctgagactccccatccaagaccatcctag

SEQ ID NO: 207357 - DNA, 1041 bp, Artificial Sequence
  Description of Artificial Sequence: Synthetic coding sequence
atggtggagaaggaggaggccggcggcggcatcagcgaggaggaggccgctcagtatgaccgacagatccgcttgtggggactggaagctcagaaacgactgcgagcctcaagagtgctgctcgtgggcctcaaaggcctgggagcggaaattgctaagaacctgatcctggctggcgttaagggccttaccatgctggaccacgaacaagtcaccccggaagacccaggcgcccagtttttgatccggactggcagcgtgggtcggaatcgggctgaagcctctcttgagcgggcacagaacctcaaccccatggttgacgtcaaggtggatactgaggatatcgaaaagaaacccgagtccttcttcacccagttcgacgccgtgtgcctgacctgttgcagtagggatgtgatagttaaggtcgaccagatttgccacaagaatagtatcaaattcttcacaggtgatgtgttcggataccacggctacacttttgccaacttgggcgaacacgagtttgtggaggaaaagacaaaggtggcaaaagtctcccagggcgtggaagacgggcctgacactaagcgcgccaaactcgattcctccgagaccacaatggtgaagaagaaggtcgtcttctgccccgttaaggaagcccttgaggtggactggtcttcagagaaggccaaggcagctctaaagcgaaccactagcgattatttcctcctacaggtgctgctcaaattcagaactgacaagggcagagatccaagctcggatacttatgaggaggatagcgagttgctcttacagatccgcaatgatgtactggattcgttaggaattagcccagacctcttaccagaggattttgtacgctattgttttagcgagatggcccctgtgtgcgctgttgtgggcggaatccttgcccaggagatagtaaaagcattgtctcagcgcgacccaccgcataataatttcttttttttcgatgggatgaagggcaatggtatcgtcgagtgtcttgggccaaagtag

SEQ ID NO: 207358 - DNA, 801 bp, Artificial Sequence
  Description of Artificial Sequence: Synthetic coding sequence
atggtggagaaggaggaggccggcggcggcatcagcgaggaggaggctgcccagtatgacaggcagattcgcctttgggggctggaggcacagaaacggctgcgcgcttcccgagtcctgctcgtgggactcaagggtctgggagcggagatagctaagaatttgatcctcgctggcgtgaaagggctgactatgctggatcacgaacaagtaacacctgaggaccctggagctcagttcctgatacgaacaggctcagttgggcgcaatcgtgcggaggctagtctagaaagagctcagaatctgaaccccatggtcgacgtgaaggtggatacggaggacatcgaaaagaagccagagagcttttttacgcaattcgatgccgtctgtctgacatgttgctccagagacgtgatcgtgaaggtggatcaaatctgccacaagaacagtatcaagtttttcacaggcgatgtgtttggctaccacgggtacacatttgccaacctcggcgaacatgagtttgtcgaagagaagacgaaggttgccaaagtgtcccagggtgttgaagacggtccggacacaaagagagctaagctggactcatccgaaacgacgatggtcaaaaagaaggtggtcttctgtcccgtgaaggaggcactggaagtcgattggtcaagcgagaaggccaaggctgccctgaagcgcacaaccagcgactactttctgttgcaaggcactgcatcccctaggtggccccagtgtgtgcgatggctggaaggcttttggcatcggaaactttag

SEQ ID NO: 207359 - DNA, 900 bp, Artificial Sequence
  Description of Artificial Sequence: Synthetic coding sequence
atggtggagaaggaggaggccggcggcggcatcagcgaggaggaggcagcccagtacgacagacagatccggctgtggggcctggaagcccagaagaggcttagagcctcgcgtgtcttgctggtcgggctcaaaggactcggagccgagatagcgaagaacttgattctggctggtgtcaagggattaaccatgttggatcatgagcaggtgactccagaggacccaggggcccaattccttatcaggacaggctccgttggcagaaacagagcagaggcctctcttgagagagcacagaatctgaacccaatggtcgatgtgaaggtggatactgaagatatcgagaagaagccagaaagcttcttcactcagtttgacgccgtgtgcctgacctgctgcagtcgggatgtgatagttaaagttgaccagatatgtcataaaaactcaatcaaattttttaccggagatgtcttcggctaccatggatatacgttcgctaacctgggggaacatgaattcgtggaggagaagactaaagtcgcaaaagtgtcccagggcgtagaagatgggccagacaccaaaagggccaaactggacagcagcgagactaccatggtgaagaagaaggtcgtcttttgccccgtaaaggaggctctggaggtcgactggtcctcagaaaaagcgaaagccgctctcaagagaacaaccagcgattacttcctgcttcagggtccggttagtgctggcccgtcttcccaacaactcttgctgctccgttggcacgagggtgagtgggactgtggtgtgccgtggccccaggttaactctagattcggatccccaagggacgcaaactgctcaatgcccacctgtattccttgccccttacccagctag

SEQ ID NO: 207360 - DNA, 900 bp, Artificial Sequence
  Description of Artificial Sequence: Synthetic coding sequence
atggtggagaaggaggaggccggcggcggcatcagcgaggaggaggcagcccagtacgataggcaaattaggctctggggcttggaggcccaaaaacggcttcgcgccagtagggtactgctcgttggtttgaaggggctaggggccgaaattgcaaagaacctgatactcgcgggagtaaaaggattgactatgttggaccatgaacaggtgacaccagaagaccccggggcccagtttctgatacggaccggttctgtcgggcgcaaccgggcagaggcttcactagagcgagctcagaatcttaaccccatggtggatgtgaaggtggacaccgaggacatagagaagaagccagaatccttctttactcagttcgacgccgtatgcttaacttgttgctccagggacgtgattgtaaaagtggaccagatatgtcataagaactcaataaaattcttcaccggggacgtgttcggataccacgggtacacattcgctaacttaggcgagcacgagttcgtggaagaaaagaccaaagttgccaaggtcagccagggggtggaggatggcccggacaccaagcgggctaagctagactcctctgaaaccactatggtgaaaaagaaggtagtcttctgcccggtcaaggaagccttggaggtcgactggtcctccgagaaggccaaggccgccctcaaaaggaccacgagtgactattttctcctgcaggagctctttccccggattgtcgagagagtgtacgcccagcggcatcctcggagcacagaacgtacacacgcgaaaatgctaatcccattcctaactaaggaaaagcctgggttcctgggcgaaatggccgtgtcacggagcggcgtcggcaaactgcagtgctcatag

SEQ ID NO: 207361 - DNA, 519 bp, Artificial Sequence
  Description of Artificial Sequence: Synthetic coding sequence
atgctggagaagaccaaggtggccaaggtgagccagggcgtggaggatggtccggatacaaagcgcgctaaactggacagcagcgagacaactatggtgaaaaagaaagtggtcttctgtccagttaaggaagcattggaagttgactggtcgtctgagaaggccaaagccgcactaaaacgcactaccagtgattatttcctactccaggtgctcctgaagttcaggaccgacaagggaagagacccttcctccgacacttatgaggaggattccgagctcctcttgcagatccgtaatgacgtgctcgattcactaggcatttcacctgacctgctgcccgaggatttcgtgaggtactgcttctctgagatggctccagtctgcgcggttgtgggaggcatccttgcccaggagatagttaaggcactcagccagagggatccaccccacaataatttctttttcttcgatggaatgaagggcaatggtatcgtggaatgcctgggacctaaatag

SEQ ID NO: 207362 - DNA, 1935 bp, Artificial Sequence
  Description of Artificial Sequence: Synthetic coding sequence
atggacgacatcgccgaccggatgcggatggacgccggcgaggtgacactggtgaatcacaacagtgtgtttaagacccacttactgcctcagacagggttcccggaggaccagctatccctcagcgaccagcagatcctgtcctccagacaagggcatttggatcgttccttcacatgttccacccgatccgccgcctacaaccccagttactactctgacaacccatcttctgatagctttctgggttcaggcgatctgaggacttttgggcagtctgctaatgggcagtggcgcaacagcacaccttctagttcatcatctctgcagaaatctcgtaacagtcgaagcctttacctagaaacaagaaagacgtctagtggcctgtcaaattccttcgccggaaaatccaaccaccattgccacgtgtctgcctacgagaagtctttcccgattaagcccgtgccttctccttcttggtcaggctcatgccgacggagcctgctcagtcccaagaaaactcagcgccggcacgtatccactgccgaagagaccgtacaggaggaagaaagagagatatatcggcagctcctgcaaatggttaccggcaagcagttcacgattgccaagcctaccacccattttcccttgcacctgtcacgttgtctgagctctagcaaaaacacactgaaggactctctgttcaagaatgggaattcgtgcgcaagccagattattgggtctgacacgtcaagtagcggctctgcctccattctgactaaccaagagcagctgagccactccgtctacagcctcagctcttacacacctgatgtcgcatttggaagtaaggactctgggacactgcatcacccccaccaccaccattcagttccccatcagccagacaacttagctgcaagcaatactcaatccgagggttctgatagcgtcatcctcctgaaggtgaaggattctcagaccccaacgcccagctctaccttttttcaagccgaactctggatcaaggaactcacatctgtctacgatagtcgcgcaagggaacgcctcaggcagatcgaagagcaaaaggccctggccctccagctacaaaatcagagactacaggaaagagaacactccgtccacgatagcgtggaactgcatttacgggttccattggagaaggaaattcctgtgacagtggtgcaggaaacgcagaaaaagggacacaaactcaccgactccgaggatgaattcccagaaatcacggaggaaatggagaaagaaatcaaaaacgtgtttcggaatggcaatcaagatgaggtgctctcggaggcctttaggcttaccattactcgaaaagacatccagacactgaatcatctgaattggctgaacgacgaaattatcaacttttacatgaacatgctcatggagcggagtaaggaaaaggggctccccagcgttcacgctttcaatacttttttctttaccaagctcaaaacggcgggttatcaggccgttaagcgctggacaaagaaagttgatgtgttttcagtggatattctcctggtacctatccatctcggcgtgcattggtgccttgctgttgtggatttccgcaaaaaaaacatcacatattatgattcaatgggcggcatcaataatgaggcatgtcgaatcctcctgcagtacctgaaacaggaaagtattgataagaagagaaaggaattcgacaccaatgggtggcagctctttagtaagaagtctcaggagatcccccaacagatgaatggctccgattgcgggatgttcgcctgtaagtatgctgactgtattactaaggacaggcccatcaatttcacacaacaacatatgccatacttcagaaagaggatggtgtgggaaatcttacatcgtaagctcctctag

SEQ ID NO: 207363 - DNA, 489 bp, Artificial Sequence
  Description of Artificial Sequence: Synthetic coding sequence
atgaagatccccctgaccgccaccatctgcctgcccggcagcagccctcctggcctctgtatttttgccaaagtctccgatgttaaacgtctggagatggacgatatagccgatcggatgagaatggacgcaggggaggttacactggtgaaccataatagtgtgtttaagacgcacctgctgccgcagaccggatttcctgaggaccagctttctctttcagatcagcagattttgagcagccgccaagggcacctggacaggagctttacgtgttcaacaaggtctgccgcgtataacccatcctattactcgggtcctgggctgggcgtgctggctcgatatagctgggggaaaatgttgacctttggaggccatcacggcgtgaccctcatgcagatccgacatatggcagtagcaggcttctcgtcgtttatcaacttccaaataatactgccccagacagtcttcttggcccaggccatctag

SEQ ID NO: 207364 - DNA, 1932 bp, Artificial Sequence
  Description of Artificial Sequence: Synthetic coding sequence
atggacgacatcgccgaccggatgcggatggacgccggcgaggtgacactcgtgaaccacaattcagtgtttaagacacatctgttaccccaaacaggctttcctgaagaccagttgtccctgtccgatcagcagattctgtcctcgagacaaggacatcttgaccgatccttcacttgtagcacccggagtgcggcatacaaccctagttactacagtgataacccctcttcagatagcttcctaggcagtggtgaccttagaaccttcgggcagagcgctaacggccagtggcgaaattccacaccctccagctcttcttcactgcagaagtctcgtaactccagaagtctctacctagaaacccggaagacttcctctggcctctccaacagtttcgcaggtaaatcaaaccaccattgccacgtgtcagcctatgagaaatctttcccgattaagccggtaccctcgccgtcttggtcgggttcatgcagaaggtcccttctgtctcctaagaaaacacagcgccggcatgtctccaccgccgaggaaacagtgcaggaggaggagcgcgagatctaccgccaactgctgcagatggtgacaggcaagcaatttaccattgccaaacccaccactcacttccctctgcacctgtcccgctgcctatccagtagtaaaaacaccttaaaagattccctattcaagaacggaaactcttgtgcctcccagatcattgggagtgacacctccagcagcggcagcgcttctatcctgacaaatcaggaacaactcagtcattctgtctatagcttatcctcttacacgccagacgtagccttcgggtccaaggactcaggtacattacaccatccacatcatcatcacagcgttccgcaccagcctgataacttagcagcatccaatacacagagcgagggatctgacagcgtgatcctcttgaaggtgaaggacagtcagacccccaccccaagtagcacattctttcaggctgaactgtggatcaaggagttaacaagtgtgtacgactctagagcccgtgaacggctacggcagatagaggaacagaaagcgctggccttgcaactccagaaccagagactccaggaacgggagcatagtgtgcacgactcagtcgagctgcatctgcgagtgcccctggagaaggagattccagtgacagtggtgcaggaaactcaaaaaaaaggccataagctgacggatagcgaggacgagttccccgaaataacagaggagatggaaaaggagattaagaatgtgtttagaaacggcaaccaggacgaagtgctcagcgaagcattcaggctgaccattacccgaaaggacattcagacactgaaccatttgaactggctgaacgacgagattataaatttttacatgaacatgctcatggagcgctctaaagagaagggcctgccctccgtccatgcttttaatacttttttctttaccaagctgaaaacagccggttatcaggcagtcaaaaggtggacaaagaaagtagacgttttttctgttgacattctcctcgtacctatccacctcggtgtccactggtgcttagccgtcgtggattttcggaagaagaatataacctattacgacagtatggggggaattaacaatgaggcgtgtcgtatactgctccagtacctgaaacaggagtcaatcgataaaaagagaaaggagtttgatacgaacggctggcagcttttttcaaaaaagtcacagattccacaacagatgaatggctccgattgcgggatgtttgcctgtaaatacgctgactgtattacgaaggaccggccaattaactttactcaacagcatatgccttatttccgcaaacgaatggtgtgggagattctgcatagaaaattactttag

SEQ ID NO: 207365 - DNA, 1935 bp, Artificial Sequence
  Description of Artificial Sequence: Synthetic coding sequence
atggacgacatcgccgaccggatgcggatggacgccggcgaggtgacactggtgaaccataatagcgtattcaagactcatttattgcctcagacaggctttcctgaagatcagctgtccttatccgaccagcagatcctctcaagccgccaggggcatctggaccgatccttcacatgtagtacgaggagcgcggcctacaatccatcctattacagcgacaacccctcctcagatagtttcttagggagcggcgatctacgaacattcgggcaaagcgctaatggccagtggcggaacagcactcccagctcatcaagctcactgcagaaatcccgtaattcccgttccctgtatctggagacacgcaaaacctccagtggcctgtctaactcgttcgccgggaagtccaaccatcactgtcatgtgtcagcttacgagaagagcttcccgatcaaaccagtaccttcacccagttggtccgggtcatgcagacgctcacttctttcccctaagaagacacaacgtcggcatgtcagcacagccgaggagactgtgcaggaagaggagagagaaatttaccggcagctgctgcagatggtgacaggtaagcagttcaccatagctaagccaaccactcactttccactgcatctctcacggtgtctctcctcctccaagaacactctgaaggactccttattcaagaatggaaactcctgtgcttcacagattatcggcagcgacacaagcagtagcgggtcagcctccattctaaccaatcaggaacaactgtcccattctgtgtattctctgtcaagctacacgccagatgtcgcctttgggagtaaggatagcggaaccttacaccacccgcaccaccatcactcggttccccaccagccagacaatctggccgcttcaaatacacagtctgagggtagtgactctgtgatcctgctaaaagttaaggacagccagacaccaaccccgtccagtactttctttcaagccgagctttggatcaaagaactgacttccgtgtacgactccagagcccgggagcggttgagacaaatcgaggaacagaaagccctggcgttgcaactgcagaaccagcggttgcaggaacgcgagcattcagtgcatgactccgttgaactccacctgagggtccccctggagaaggaaatccccgtcacagtggtgcaggaaacgcaaaaaaagggccacaagcttactgattctgaggacgagttccctgagatcactgaggagatggagaaagagattaagaacgtgttccggaatggaaatcaggacgaggtgttaagtgaagccttcagactcacaatcacacgcaaggacattcagacgttgaaccaccttaattggttaaacgacgagatcatcaatttttatatgaatatgctcatggaacggtcgaaagagaaaggactgccctcagtccacgcatttaatacctttttcttcacaaaacttaaaaccgctgggtatcaggccgttaagagatggaccaaaaaagtcgacgtcttcagcgtggacatactcttggttcccatacatttaggtgtgcactggtgtctggcggtagtggacttccgcaagaagaatatcacatactacgactctatgggcggaatcaacaacgaggcttgtcggatcctactccaatatctcaaacaggaatccatcgataagaaacggaaggagttcgataccaacggctggcaactgttcagcaagaagagccaagaaattccgcaacagatgaacggaagtgactgcggcatgttcgcgtgtaagtacgcagactgtatcaccaaagacagacctatcaatttcactcagcagcacatgccatactttcgaaagcggatggtgtgggagatactccatcgaaagttattgtag

SEQ ID NO: 207366 - DNA, 1932 bp, Artificial Sequence
  Description of Artificial Sequence: Synthetic coding sequence
atggacgacatcgccgaccggatgcggatggacgccggcgaggtgaccttggtgaaccataacagcgttttcaaaacacatttgctcccacagaccggttttcctgaggaccagctgtcactgtccgaccagcagattcttagctcccggcagggtcacctcgaccggagttttacttgttccactaggagcgccgcctacaatcctagttactatagtgacaaccctagctctgactctttcttggggagtggagatctgagaacatttggacaaagtgcaaatggtcagtggcgcaatagtactccatcatcttcttcctccctccagaagagcaggaactcccggtcgttatacctggaaacgcgcaaaacaagctctggacttagtaactcttttgccggtaagagcaatcatcactgtcacgtaagcgcttacgaaaagtcttttcccatcaagcccgttccctctccctcctggtcgggcagttgtaggcgttcacttctctctcctaaaaaaacgcagcgccgacacgtctcaaccgcggaagaaacagttcaggaagaggaacgggagatctatagacaattacttcagatggtcaccgggaagcagtttactattgccaaaccaactactcacttcccactccacctgagccgctgcctatccagttctaagaataccctgaaagattcactgtttaagaacggtaattcatgtgctagccagattatcggctctgacaccagctcctctgggtcagcttctatcctgacaaatcaggaacagctctcccactctgtgtattcccttagtagttatactcccgacgtcgcttttggatccaaagactcaggaactctgcaccacccacaccaccatcacagcgtgccccaccagccagacaacctggccgcctctaacacccagtctgagggcagcgattccgtaattctccttaaggtaaaggatagtcaaacacctacaccctcctcgacatttttccaggccgaactgtggattaaggagctgacttctgtgtatgatagtcgcgcgagggagcggctcagacaaatcgaagaacaaaaggccctggctctgcagctgcagaatcagcggttgcaggaacgagagcattctgtgcatgacagcgtcgagttacacctgcgcgtcccattggaaaaagaaattccagtgactgtggttcaagagacacaaaagaagggccacaagctgacagactccgaggacgagtttcctgaaatcaccgaggagatggagaaagaaattaagaacgtgtttcgcaatggaaatcaagatgaggttctctcggaagccttccggctgacaatcacccgaaaggacatccagacactgaatcatctgaattggctgaatgatgagatcatcaacttttacatgaacatgctaatggagagatccaaggagaaggggcttccgtctgtccatgcattcaatacctttttcttcactaagctaaagacagcagggtaccaggcagttaagagatggactaagaaagtggacgtgttcagcgtcgatattctgctggttcccatccacctcggagtccactggtgcctcgcagtggtggacttccgaaaaaagaatattacttattatgattcgatgggcggcattaataacgaggcatgcaggatcctcctccagtacctgaagcaggaatccatagataagaagcgaaaggaatttgatactaatgggtggcagcttttctccaagaagagccaaattccgcagcagatgaatgggagcgattgtggaatgtttgcctgtaagtatgcagattgtattacgaaggatagacccataaactttacacaacagcacatgccatactttcgaaaacgaatggtttgggaaatactccatcggaaattattgtag

SEQ ID NO: 207367 - DNA, 1935 bp, Artificial Sequence
  Description of Artificial Sequence: Synthetic coding sequence
atggacgacatcgccgaccggatgcggatggacgccggcgaggtgaccctggtgaatcacaatagtgtctttaagacccacttgctcccacagaccggatttccagaggaccagctctcattatcagaccaacagatactgagtagtcgccagggacacttggacaggagttttacttgctcgacaaggagcgccgcctacaacccatcctattattcagacaatccctcaagtgactcgttcctagggtccggggatttacgaaccttcggacagtctgccaatggacaatggcgcaattctaccccatccagctccagttctctgcagaaaagccggaactcccgaagcctgtatcttgaaacccgcaaaacttcttctggtctgtccaactctttcgcaggtaagagcaaccatcattgccatgtctcggcctacgaaaaaagctttccaatcaagcctgtcccatctccatcctggtccggctcctgtaggaggagtctcctgtcccccaagaaaacccagcgcagacacgtctccaccgctgaagaaactgtccaggaagaagaacgtgagatctacaggcagcttctgcaaatggtaactggaaagcagttcacaattgcaaagccaaccactcacttcccgctgcacttatcaaggtgtctgagctcttccaaaaacactctgaaagattcccttttcaaaaacggaaactcttgcgcctcccagattataggtagcgataccagctcctctggaagcgcctcgatccttacaaatcaggagcagttatcccacagcgtgtatagcctttcaagttatacaccagatgtggctttcggatccaaggatagtggaacactgcatcatccacatcaccatcatagtgtcccacatcaacccgataacttggccgctagcaatacccagtcggagggcagcgactccgtcatcctactgaaagtgaaggactcccagacaccgacaccaagctccacatttttccaagccgagttatggatcaaagagctgacctctgtatacgacagccgcgctcgagaacgcctgcggcagattgaggagcaaaaagctctcgcgctccaactgcaaaaccagcgcctgcaggagcgggaacactccgtgcatgacagcgtcgagctgcatctccgtgtgccactcgagaaggagatcccagtaacggttgtccaagaaacccaaaaaaaaggacacaagctgactgatagcgaagatgaatttcctgagattacagaggagatggaaaaagaaatcaaaaacgtgttccgaaatggaaaccaggatgaagttctctccgaggcgttccggttaaccatcacacggaaggatattcagacgctgaaccatttaaattggcttaatgatgaaataattaacttttacatgaacatgctcatggagagatctaaggaaaaaggcctcccttctgtgcacgctttcaatacatttttttttacaaagctgaaaaccgcaggctatcaggcggtcaagcgctggacgaagaaggtggacgtgttttctgtggatattctgctagtgccgatacacctcggagttcactggtgtcttgctgtggtggattttcgtaagaaaaacatcacctactacgacagcatgggggggataaacaacgaggcctgcagaattctactccagtatttgaagcaagaaagcatcgataagaaacggaaagagtttgacaccaatggatggcagttgttcagcaaaaagtctcaggagattccacaacagatgaacgggtcagactgcggaatgtttgcctgcaagtatgcggactgtattacaaaggatcggccaatcaacttcactcaacagcacatgccctatttcagaaaacgcatggtgtgggagattctacacagaaagttgctatag

SEQ ID NO: 207368 - DNA, 2268 bp, Artificial Sequence
  Description of Artificial Sequence: Synthetic coding sequence
atgaagaagcagcggaagatcctgtggcggaagggcatccacctggcattctctgaaaagtggaacacaggcttcgggggatttaaaaaattttactttcaccagcacctttgtatcttgaaggcaaaattaggccgaccagtcacctggaacaggcagttgaggcacttccagggcagaaagaaagcattgcaaattcaaaaaacatggatcaaggatgagcctttgtgtgctaagaccaaattcaatgtggcgacacaaaatgtcagcactctatctagcaaggtgaagaggaaggatgcaaagcatttcataagttcatcaaaaacattactgaggttgcaggccgaaaagctcctgagcagcgcgaaaaattccgatcatgagtactgtcgagagaagaacctcttaaaggcagtaactgactttccctcaaattctgccttggggcaggctaatggccaccgacctcgcactgaccctcagccctctgatttccccatgaagtttaacggggaatcccaaagtcccggagagagtggcaccatcgtggtgactcttaataaccacaaacgcaaggggttttgttatggctgttgccaggggcctgagcaccacagaaatggtgggcccttgattcccaagaagttccagctgaatcagcaccgccgaataaaactctccccacttatgatgtatgagaaattgtccatgatccggttccgttataggatcctgcggtcacaacactttcggacgaagagcaaagtttgtaagttgagaaaggcacaacggtcttgggtccagaaggtcactggggaccaccaagaaacccggcgcgaaaacggcgagggggggtcttgtagtccattcccctcccccgaaccaaaagatccatcctgtcgtcaccagccatacttcccggatatggactctagcgccgtggtgaagggcacgaatagtcacgtgcctgattgccacacaaaaggctctagttttcttggcaaggaactcagcctcgatgaggcgtttcctgatcagcaaaacggcagtgccactaatgcttgggaccagagtagctgcagctcacccaaatgggagtgcaccgagctcattcacgatatccctttaccggaacacagatctaataccatgttcataagtgagacagaaagggagattatgacacttggccaggagaatcaaacctcctctgtctcagatgatcgagtgaagctgtccgtgagtggcgcagacacctccgtatcctctgttgacggccctgtaagtcagaaagccgtccaaaatgagaattcttatcagatggaagaagatggtagccttaaacagtcaattctgagctccgaactgctggatcacccttactgcaaatcaccactggaggctccccttgtctgctccggactaaaattggagaaccaagtgggtggtgggaaaaacagccagaaagcttcacccgtggatgatgagcagttatctgtgtgtttaagcggctttctggacgaggtgatgaagaagtatggatccctggtgcccctctccgagaaagaggtgctggggcgcctgaaggacgttttcaatgaggatttttcaaacaggaaaccattcattaacagagaaatcaccaactacagggccaggcaccagaagtgtaattttcggatcttctacaacaagcacatgctggacatggacgatctggcgactctggacggacaaaattggctgaatgaccaggtgatcaatatgtacggcgaactgataatggacgctgtgccagacaaagtccacttttttaatagctttttccataggcagcttgtgactaaaggctataatggtgtcaagcgctggacaaaaaaagttgacttatttaagaagtccttgttgctcataccaatccaccttgaagtgcactggagcctcataactgtgaccctgagcaatagaatcatttccttttacgattcacagggcatacacttcaaattctgcgtggagaatattcgcaaatatcttctgacagaggcccgggagaaaaatcgccccgagtttcttcaaggatggcagacagctgtgacaaagtgtattccacaacagaagaacgattccgattgcggtgtgtttgttctacagtactgtaagtgtctcgccctggaacaaccctttcagttctcccaggaagacatgccaagagtccgtaaaagaatctataaggaactttgcgaatgccgcttgatggactag

SEQ ID NO: 207369 - DNA, 3318 bp, Artificial Sequence
  Description of Artificial Sequence: Synthetic coding sequence
atggccgccggcaagagcggcggcagcgccggcgagatcaccttcctggaggccctggctcggtccgagagcaagcgagacggcggcttcaagaataattggagttttgatcatgaggaagaatcagagggcgacactgacaaggacgggactaacctgttgagcgtggatgaagacgaagattctgaaacctccaaaggtaagaagttgaacaggcgttccgaaatagttgcgaatagcagtggtgagttcatccttaagacctacgtgaggagaaataagtccgaatctttcaagacgttaaagggaaaccctataggccttaatatgctttctaacaataagaaattgagcgagaatacacagaatacatctctgtgctcagggaccgtagtgcatggcaggagatttcaccacgcccatgcccagatcccggtggtgaagacggccgcacaacgcaaggagtatccgccacatgtccagaaggtcgagattaacccagtgcggctgtcacgtctacagggggtggaacgcattatgaagaaaacggaggaatcagagagtcaggtggagccggagatcaaaagaaaagttcagcagaaaagacactgcagcacataccagcccacacctcccctcagcccagcgagtaagaagtgccttacacatctggaggacttgcagagaaactgcaggcaggctattacattgaatgagagtacaggtccgctgctgcgaacaagtattcatcagaactctggagggcagaagtcccaaaacactggactgacgacgaagaaattctatgggaataacgtggaaaaggtccccatcgacattatagtcaactgcgacgatagcaagcatacatacctacagactaacgggaaagtgatcttaccgggagccaagatccccaaaattaccaatttaaaagaacgaaaaaccagcctctccgacctaaacgatccaattatcctttcctccgacgacgatgatgacaacgacaggactaatagacgggaatccataagccctcaacctgccgattctgcgtgcagctcccctgcaccaagcacaggcaaagttgaggctgccctgaacgaaaacacctgcagggccgagcgagaactccgcagcatccccgaagatagtgaacttaacaccgtcaccctccctaggaaggcccgcatgaaagaccagtttggaaattcaatcatcaacacccctttgaagcgcaggaaggtcttctcccaggagccacccgacgccttggctttgtcctgccagagctcttttgattctgttattctcaattgcaggtctattagagttggcaccctctttcggcttttgatcgaacccgtgatcttctgtctcgactttatcaaaattcagctggacgaacccgaccacgatccggtcgaaattatcctcaacacatctgacttgacaaaatgcgagtggtgcaacgtccggaagctgcctgtagttttcctgcaggcaatccccgccgtttaccaaaagctgtccatccaattacagatgaataaagaggataaggtgtggaatgactgcaaaggggtgaataaattaacgaaccttgaagaacaatacataattctgattttccagaacgggcttgatccaccagccaacatggtgttcgagtccatcatcaatgagattgggataaagaacaatataagcaatttctttgccaaaataccatttgaagaggccaatggtcgcttggttgcatgtacccgtacatacgaagaatcaataaaaggctcttgtggccagaaggagaacaaaatcaagaccgtgtcgtttgagagtaagattcagctcaggagcaagcaggagttccagttcttcgacgaagaagaggagactggcgaaaaccatacaatctttattggtccagttgaaaagctgatcgtctacccgccgccacccgcgaagggcggaatctcagtaactaacgaggacctccactgtctgaatgagggtgaatttctgaatgatgtgattatcgacttctacttgaaatacttagtcctcgaaaaactcaagaaggaagatgcggaccgcatccatatcttttcaagcttcttctacaaacggctgaaccaacgggaacgtcggaatcacgaaaccaccaatctttctatccagcagaaaagacatggccgggtgaaaacgtggaccaggcatgttgacatctttgagaaggacttcatattcgtgcccctgaatgaggctgcacactggttcctggccgttgtatgctttccgggtttggaaaaaccgaaatatgagcctaatccacactaccacgagaacgctgtgatacagaagtgcagcactgtcgaagactcctgtattagcagtagcgcaagtgagatggaaagttgtagccagaacagctccgcaaaaccagtgatcaaaaagatgttgaataagaaacactgcattgcggtgattgattctaatccaggacaggaggagtccgatccccggtacaagaggaacatatgctcagtgaagtatagtgtgaagaagattaaccacaccgcaagcgagaacgaggaattcaacaaaggggagagtacctcgcagaaggtcgccgatcgtactaagagtgaaaacgggctgcagaacgaatctctgtcttccacgcaccataccgacgggctgtccaagattcgcctcaactacagcgacgagtcccctgaagcagggaagatgttggaggatgaattggtagactttagcgaagaccaggacaatcaggacgacagtagtgatgacggattcctggcagacgacaactgcagtagcgagattggacagtggcaccttaagccgaccatctgtaagcagccatgtattcttcttatggactcacttcggggacccagtaggtctaatgtggtgaagatcctcagagagtatttggaggtcgagtgggaagtcaagaagggttctaagcgctccttttcaaaggacgtgatgaagggaagcaaccctaaagtacctcagcagaataacttctctgattgcggcgtttacgtgcttcagtatgtcgagagcttttttgagaaccctatcctgtcttttgaactcccaatgaacctggcaaactggttcccccccccgcgcatgagaaccaagcgggaggaaattcggaatatcatccttaagctacaggaggatcagagtaaagaaaagcgcaagcacaaggatacatacagtacagaagcccctctgggcgaggggaccgagcagtatgttaactccatctccgactag

SEQ ID NO: 207370 - DNA, 3339 bp, Artificial Sequence
  Description of Artificial Sequence: Synthetic coding sequence
atggccgccggcaagagcggcggcagcgccggcgagatcaccttcttagaggctctggcaaggagcgagagcaaaagagatggcggtttcaagaacaattggtcttttgatcacgaagaagaatcagaaggagacacagacaaggacggcacgaatctcctgtcagtcgacgaggacgaagactccgaaacatctaaagggaaaaaactcaaccgcaggagcgagatcgttgcgaatagtagtggcgagtttatattgaaaacatatgtgagacggaacaagagcgagtcttttaaaaccctaaagggcaatcctatcgggcttaatatgctttcaaacaacaaaaaactgtctgaaaacacccagaatactagcctgtgctcaggaacggtggtgcacggcaggcggttccatcacgcacatgcacagatacccgtcgtcaaaacggcggcccaacgccttctgagcaatcagatccttaaagaatacccaccacatgtgcagaaagtcgaaatcaatcctgtgaggctctcacgactccagggggttgagcgaattatgaagaaaactgaggaaagtgagagtcaggtggagcctgaaatcaaacgcaaggtgcaacagaagaggcattgttccacataccagcccactcccccactgtcacctgctagtaagaagtgtctaacccatctagaggacttgcagcgcaattgccggcaagccattactctgaacgaatctaccggcccactccttagaacttccatccaccagaattccggtggacagaaatcccaaaacacagggctgactaccaaaaaattctacggaaataacgtcgaaaaggtccctatcgacataatagtgaactgtgacgacagcaaacacacgtatttgcaaactaatggaaaggtgatactgcccggtgcaaaaatccctaagattacgaatctcaaggaacgcaagacctccctatcagatctgaatgacccaattatccttagttctgacgatgatgacgacaatgatagaaccaataggagggagtcaatctctccacagcccgccgattcagcctgttccagtccggctcccagtaccggtaaagtcgaagctgcactgaacgagaatacttgtagggcagagagagagcttcgatccataccggaagatagcgagctgaacacagtcaccctgccacgcaaggcccgtatgaaggaccagtttggtaacagtatcattaacacccccttgaaacgcaggaaggtgttctcacaagaaccgccagacgctcttgctctgtcctgccaatcctcattcgactctgtgatccttaactgtaggagtattcgagtcggtacactctttaggctgcttattgagcctgtcattttctgtttagactttattaaaattcaactcgacgagccagatcatgaccccgtggaaataatccttaacacttcagatcttaccaaatgtgaatggtgcaacgtgcgaaagctaccagttgtatttttgcaggctattccggcggtctatcagaagctctctattcagctgcaaatgaataaggaggacaaagtgtggaatgactgcaaaggagtgaacaaactcactaacctggaagagcagtacatcatcctgatttttcaaaatggcctggatcccccagctaatatggtgttcgagagtataattaacgagattggaattaagaataacatctccaacttctttgcaaagatccctttcgaggaagcaaacggaaggctggttgcctgtaccagaacttacgaggagtctatcaaggggtcatgcggacagaaggagaacaagattaaaacagttagtttcgagtcaaaaatacagctgaggtctaaacaggagttccaattctttgacgaagaggaagagactggggaaaatcacactatcttcatcggccccgtagaaaaactcatcgtgtatcctccccccccggctaaagggggaatttctgtgacgaatgaagatttgcattgtctgaacgaaggcgagttcctcaacgatgtaataattgacttctacctgaagtatctggttttggaaaaactgaagaaggaagatgcagaccggatccacatttttagctcttttttttacaagagactgaaccaaagggaaagacgcaatcacgaaacaactaatttaagtatccaacagaagcgccacgggcgtgtcaaaacctggactcgtcatgtagatattttcgagaaagacttcatctttgtgccgctgaatgaggccgcccactggtttctagcagtggtatgtttccccggcctcgagaagcccaagtatgagcctaaccctcattatcatgagaatgccgtcattcaaaagtgtagcaccgtggaggacagctgtatatcaagctctgccagtgaaatggaatcatgttcgcagaactcaagcgccaagcccgtcatcaaaaaaatgttaaacaaaaagcattgtattgccgtaatcgattctaacccgggccaggaggagtctgacccaaggtataaaagaaatatctgctccgtgaagtacagcgtgaagaaaattaatcatacagcctccgaaaacgaggagttcaacaagggtgaatctacttctcagaaggtagcggacagaacaaagtcggaaaacggcttgcaaaacgagtcactctcttcaacccatcacactgatggcctgagcaaaattaggctcaactactctgatgaaagcccagaggcggggaagatgcttgaggacgaacttgtcgatttctcagaggaccaggacaatcaggacgattcttccgatgatggttttctggccgatgacaactgcagctctgagatcggccagtggcacctaaagccaactatatgtaagcagccttgtatactgttaatggattccctgaggggtccatcacggtctaatgttgtgaagatcctgcgggagtatctggaggtggaatgggaggtgaaaaaggggtcaaaacggtcattttcgaaggacgtgatgaagggctccaaccccaaggtgccacagcaaaacaatttttctgattgcggagtgtacgtgctgcaatatgtggagtcgtttttcgaaaatcctatactgtcttttgaactgcctatgaatctggccaattggttccccccacccaggatgcggaccaaacgtgaagaaatacgaaatattattcttaaactgcaggaggatcagtccaaagagaagcgaaagcataaggacacttactccaccgaagccccattgggtgagggcaccgaacaatacgttaattcaattagtgattag

SEQ ID NO: 207371 - DNA, 3339 bp, Artificial Sequence
  Description of Artificial Sequence: Synthetic coding sequence
atggccgccggcaagagcggcggcagcgccggcgagatcaccttcctagaggcacttgcacgctccgagagtaagagagacggtggctttaagaataattggtcctttgatcacgaagaggaatccgaaggagataccgataaggacgggacgaacctgttatccgtggatgaggacgaagactctgagacctccaagggtaaaaagctgaaccgccgttccgaaattgtcgccaacagcagtggagaatttattctcaagacatacgtgcggcgcaataagagtgagtccttcaagacccttaaaggcaaccctatcggcctgaacatgctgagtaacaacaaaaaattgagcgagaacacgcagaacacttccctctgtagcgggaccgtggtccatggcagacggttccatcacgcgcacgcccagatacctgtggttaagaccgccgcccagtccagcttggatagaaaggaaaggaaagagtatccaccccacgtgcagaaagtggagatcaaccccgtgagattatctagactgcagggagtcgagcgtatcatgaaaaagaccgaggaatcagagtctcaagtagaacctgagataaaacggaaggtccaacaaaaacggcactgtagcacctaccaacccactccccccctgagtcctgcaagtaaaaagtgcctgacccatctggaggacctgcagcgcaactgccgacaggccattaccttaaacgagtccaccggccccctattgcgaacaagcatccatcagaattccggcggccaaaaatctcagaatacaggcctgaccacaaaaaagttctatggcaacaatgtggaaaaagtgcctatcgatataattgttaactgcgacgactctaagcacacatatctgcaaacaaatggcaaggtgattctgcccggtgcaaaaattccgaaaatcaccaacctgaaggaaaggaaaactagtctgtctgacttgaacgaccctataatcctctcatcagatgacgacgacgacaatgatcgaaccaaccgccgtgaatcaatctcccctcaacctgccgacagcgcgtgtagcagcccggcgccgtcaaccggaaaggtggaggccgcactcaacgagaatacgtgccgggccgagcgcgagctgagatcaatcccggaggactccgaacttaatactgtcacgctgcctcggaaagcccggatgaaggaccagtttggcaactcgatcatcaataccccactgaagcgccggaaagtgttctctcaggagccacccgatgcacttgcgctcagttgccagagctcctttgattccgtgatcctgaattgcagatcaatccgcgtggggacattgttccggctgcttattgaacctgttattttttgcctcgacttcattaagatccaattggacgagcctgatcatgacccagtggagatcatcctgaacacatcagatctcaccaagtgtgaatggtgtaatgttaggaagctcccggttgtcttcctgcaggccattcctgctgtgtatcagaaactcagcatccagctgcagatgaacaaggaagataaagtctggaatgactgtaagggtgtcaacaagctcacaaacctggaagagcagtacataatcttgatcttccagaacggcttggaccctcctgccaacatggttttcgaatccatcattaacgaaattgggattaaaaataatattagcaacttctttgctaaaatccccttcgaggaggctaacggccgcctcgtggcatgtactcgcacatacgaggaaagcataaaagggtcatgtgggcaaaaagagaataagatcaaaaccgtctccttcgagtctaaaatacagcttagaagcaaacaggaattccagttcttcgacgaggaggaagagacaggcgaaaatcataccatattcattggtcccgtagaaaagctgatcgtttatcctccacccccggcaaaagggggtatcagtgtaacaaacgaggacctacactgcctgaacgagggcgagtttctgaatgacgtgattattgatttctacctaaagtatctggtcctcgagaagctaaaaaaagaagacgccgaccggattcacatctttagctcctttttctacaagagactgaatcagagggagcggcgaaatcacgaaactacgaacctaagtattcagcagaaacgacatgggagagttaaaacctggacccggcacgtggacatcttcgagaaagacttcatctttgtgcccctgaacgaggcagcacactggttcttggccgtggtgtgtttcccaggcctagagaaaccaaagtacgaacccaaccctcactatcatgagaacgcagtaattcagaagtgcagcacagtggaggacagctgtataagcagtagcgcatctgaaatggagtcatgttcccaaaacagctccgctaagcctgtgatcaagaagatgttaaacaaaaagcattgcatcgcggtgattgactcgaacccaggccaggaggagtctgaccctaggtataagagaaacatctgttccgtcaaatattcagtgaagaagatcaaccataccgcgtccgaaaatgaagagttcaacaagggagaaagcacctcccagaaggtggctgatagaaccaaatctgaaaacggactccagaacgagtccctctcctctacacatcacacagacgggttgagcaaaattcggctgaattacagtgacgagtctcctgaagccggtaagatgctggaagatgagctggtcgatttctccgaagaccaagataatcaagatgactcgagtgatgacggttttctagcagatgacaattgctctagtgaaattggacaatggcacctcaagcccactatctgtaaacagccatgcattctcctgatggacagcctgcgaggcccatctcgatccaatgtggttaagattcttagagagtatctcgaagtggaatgggaagtgaaaaagggcagcaagcgatccttcagcaaagatgtgatgaaaggttcaaatccaaaagtgcctcagcaaaataacttttccgattgcggggtgtatgtgctgcaatatgttgaaagcttcttcgagaaccccatcctgtccttcgagctgcccatgaacctggccaattggtttccacctccaaggatgcgcaccaaacgcgaggagatccgtaatattattttaaagctccaggaagatcagtctaaagagaagcgtaagcataaagatacttactccacagaagcccccctgggggaggggacagaacagtacgtaaacagtatctctgattag

SEQ ID NO: 207372 - DNA, 1074 bp, Artificial Sequence
  Description of Artificial Sequence: Synthetic coding sequence
atggccgccggcaagagcggcggcagcgccggcgagatcaccttcctggaggccctcgcaagatcagaatctaagcgagacgggggctttaagaataactggtcgttcgaccatgaggaggaaagtgaaggagacacagacaaggatggaacaaatctcttgtcggtggacgaggacgaagattctgaaacatccaaaggcaaaaagctcaaccgcagatctgagatcgttgctaattcctctggggaattcatcttgaagacttacgtgagacggaacaaatccgaatctttcaaaactctgaagggcaacccaatcggcctgaatatgctaagtaacaataaaaaactgtctgagaacactcagaacacctccctgtgtagtggcaccgtcgtccatgggcgacgcttccaccacgcacacgcccaaatccctgtcgtgaagactgctgcccaatctaatcagattttaaaggagtaccctcctcacgttcaaaaggttgaaataaatccagttcgcttgtctcgactgcagggagtggttatactgtcttctgacgacgacgacgacaacgaccgcaccaaccgccgcgagtcaatttcaccacagccagctgatagcgcttgctcttctccagccccgagcacgggcaaagtggaggccgccctgaatgaaaacacatgccgcgccgaacgagagctgcgaagtatccccgaagattctgagctaaacactgtgaccttgcctaggaaggccagaatgaaagaccagttcggtaatagcataatcaacacaccactaaagaggcgcaaggttttttcccaggagccccccgacgccctggcgctctcctgccagagcagttttgatagcgtgattttaaactgtagaagtatccgagttggcaccctttttaggctgttgatcgaaccggtgatcgtgattattaagattttctttattacccacaaaaagccagaccacgaccccgtcgaaattattctgaatactagcgaccttactaaatgcgagtggtgcaacgtaaggaaactaccagtcgtgttcctgcagtag

SEQ ID NO: 207373 - DNA, 1107 bp, Artificial Sequence
  Description of Artificial Sequence: Synthetic coding sequence
atgaaggaccagttcggcaacagcatcatcaacacccccctgaagcggcgcaaggtctttagccaagagccaccagacgctctggcactgtcctgtcagagttcatttgactcggtgatactgaattgtcgtagtatacgcgtgggcacgctattccggctcttgatcgaaccagttatcttctgcctggactttatcaaaatccagctggacgaaccagatcatgatcccgtcgaaataattcttaacaccagcgatctgaccaagtgcgagtggtgcaatgttcggaagctgccagtggtttttcttcaggccatccctgcagtgtatcaaaagctttcgattcaactgcagatgaataaagaagacaaagtgtggaatgactgcaagggcgtaaacaaacttaccaatctggaagagcagtacattatattaatattccaaaatgggcttgatcctcctgcaaacatggtgtttgagtccatcattaacgagatcgggattaagaacaacatttccaacttctttgctaagattccattcgaggaagccaatggcagactcgttgcttgtacacggacctacgaagagtctatcaaaggctcatgtggccaaaaagagaataaaatcaagaccgtgtctttcgagtctaagattcagctgcggagcaagcaggagttccagttcttcgatgaagaggaagagaccggagagaatcacacaatcttcattgggcccgtggagaaactgatcgtttaccccccaccccccgccaagggcgggatcagtgtgacaaatgaggatctgcactgcctcaacgagggagagttccttaacgacgtcatcattgacttctacctgaaatatctggtgctcgagaagctgaagaaagaagatgcagaccgtattcacatattctcatcgttcttttacaaacggcttaaccagagagagcgcagaaaccacgagactacaaacctttccattcagcagaaaagacacggacgggtgaaaacatggacacgacacgtcgacatttttgagaaggattttatcttcgtgcccctgaacgaagcatggctcaaacagaatcagaccaagctttag

SEQ ID NO: 207374 - DNA, 2955 bp, Artificial Sequence
  Description of Artificial Sequence: Synthetic coding sequence
atggacaagcggaagctgggccggcggcccagcagcagcgagatcattacagaaggtaaacggaagaaatcatctagtgaccttagcgagatccggaagatgctgaacgccaaacccgaggatgtgcatgttcaatcccctctgtccaaattccgcagttctgagaggtggacgctgccacttcagtgggagaggagtctcaggaataaagtcatctccctagaccataaaaacaaaaagcacataagaggatgcccggtcacttcaaaatcaagccctgagcgaattccaagggttatcctcacaaatgtgctgggaacagaactgggccggaaatatatccgaacaccgccagtgaccgagggaagcctgtctgacactgacaacttacaaagcgagcagctctcttcttcttcagatggatcccttgaatcctatcaaaatctgaatcctcacaagtcctgttatctgtccgaacgcggaagtcagaggagcaagaccgtggatgataacagtgcaaagcaaaccgcacacaataaggagaagaggcgtaaagacgacgggattagcctgctcatatcggatactcaacccgaggatctgaactccggcagtaggggctgcgaccacttagagcaggaatcaaggaataaagatgtaaaatactccgatagcaaagttgagctgaccttgatttcccggaagacaaagcgccgactcagaaataatctgcccgatagccagtattgcacttcacttgataagagcaccgaacaaactaagaagcaagaggatgatagcacaatttccaccgagttcgaaaaaccatcagaaaactatcatcaggatcctaaactccctgaggaaattacgacgaaaccaactaaatccgacttcactaaactcagttcactgaactcacaagaattaactttgtcaaatgctacaaagagtgcatcagcagggtctacaacggagaccgtagaaaactctaattctatcgatatagtgggcatcagctctctagtggagaaggacgaaaatgagctgaacaccatagaaaaaccaatcctaaggggacataacgagggtaaccagtccctgattagcgctgaaccaatcgtggtcagctccgatgaggaaggaccggtggagcataagtccagtgagattctaaaactccagagtaagcaagaccgcgaaaccactaatgagaacgaaagtactagcgaaagcgctctactggagcttccgcttattacatgtgagtccgtgcaaatgagctccgagctctgcccctacaacccagtgatggagaacatctcctctattatgccctctaatgagatggatttacaacttgatttcatttttacttctgtgtacatagggaaaataaaaggggctagcaagggctgcgttacaatcacgaaaaagtacataaagattcctttccaggttagcttaaatgagatcagtttactggtagacacaacacatcttaaaagattcggcttgtggaagtccaaagacgacaatcacagtaagcggagtcatgcaattctgtttttttgggtctcctccgattacctgcaggagatccagacgcagctagagcactcggtgctgtcccagcagagcaagagtagtgagtttattttccttgagctccacaaccccgtgtcacagagggaggagctcaaactgaaagacataatgacagagatctccatcatctccggtgagctggaattatcatacccactgagttgggtgcaggcattcccgctgttccagaatctttccagtaaggaatcttcttttattcactactattgtgtctctacctgtagtttccctgccggagttgccgtcgccgaggagatgaagctgaagtccgtgagtcagccctctaatacagacgccgccaaaccgacttacacattcctgcaaaagcagagctcaggttgttacagtcttagcattactagtaacccagatgaggaatggagagaagtaaggcacaccggcctggttcaaaagttgatcgtttacccacctccccctaccaagggaggtctgggcgtgacaaacgaagaccttgagtgcctagaggagggcgaatttcttaatgatgtgatcatagatttttacctcaagtaccttatcctggagaaagcctccgacgagctggtggaacgaagtcatatcttttcaagctttttctataaatgtctcacacgcaaagaaaataacctgaccgaggataaccctaatctctctatggcccagcggagacacaaacgcgtgcgcacctggactcgacatataaatatattcaacaaagactatattttcgtgccagttaatgagtctagtcactggtacttggctgtaatatgttttccgtggttagaagaagcggtatacgaggactttcctcagaccgtgagccagcagagccaggcccagcagtctcagaatgacaacaagaccattgacaatgacctgaggaccacatccactttgtccttatctgcggaggatagccagtccacagagtctaacatgtctgtccccaagaaaatgtgtaaacgcccctgtatcctgatcctggactcactcaaagctgcatctgttcagaatacggtgcagaatctgcgagagtatttggaagttgagtgggaggtgaaactgaaaacacacagacagttcagtaagacaaacatggtggatttgtgcccaaaggtgccaaaacaggataacagtagcgactgtggcgtttacctgctccagtacgtggagtcatttttcaaagaccctatcgtgaattttgagcttccaatccacctggaaaagtggtttccccggcacgtcataaaaaccaaacgggaggacataagggaactgatccttaagcttcaccttcaacagcaaaaaggttccagcagctag

SEQ ID NO: 207375 - DNA, 3054 bp, Artificial Sequence
  Description of Artificial Sequence: Synthetic coding sequence
atgctgaacgccaagcccgaggacgtgcacgtgcagagccccctgtctaaattccgatcatctgaaagatggactctcccgctgcaatgggagaggtctctgagaaacaaagtgatatctttggatcataaaaacaagaaacatattaggggctgccccgttacaagtaaatcctcaccggagcgccaactgaaggtgatgctgactaatgtgctctggacagatctgggccgcaagttcagaaagaccctccctagaaatgacgctaacctctgcgacgccaataaggtgcagtcagattctctgccaagtacaagcgtggattccctcgaaacgtgtcaaaaattggagcccctgaggcagtcgctcaacctcagcgagcggatccctagggtgatccttactaacgtgctgggcaccgagctggggaggaaatacattcggaccccacctgtcacagagggcagcctcagcgacaccgataacttacaaagcgagcagctcagtagttcgtcagatggtagcctggaaagttatcagaacctgaaccctcacaagtcctgttatcttagcgagcggggctcacagagatccaagactgtggatgacaactccgccaaacagaccgctcataacaaagagaagcggcgcaaggacgacgggatctccctgctcatcagtgacactcagccagaagacctgaactccgggtcccgaggctgcgatcacctggagcaagaatctcgcaacaaggacgtcaagtattccgactccaaggtcgaattgaccctgattagcaggaaaaccaagcgacgactgaggaacaacctcccggactctcaatattgcacatcattggataagtctaccgaacagactaaaaagcaggaagatgatagcacaataagcaccgagtttgagaaaccatctgagaactaccatcaggacccgaagctgccagaggagattacgacaaagccaacaaaaagcgattttaccaagttgtcctctcttaacagccaggaactcaccttgtccaacgcaactaagtcagcctctgccgggtctacgaccgagaccgtcgagaactcgaacagcatcgacattgttggaatcagctcactggtcgagaaagacgaaaacgaactgaataccattgagaaacccattctgcgaggccacaacgaagggaatcagtctcttatcagtgccgagcctattgtagtatcttcagacgaagaaggaccagtggaacacaagtcatccgaaatcttgaaactgcagtccaagcaagatagggagacaaccaatgaaaacgaaagcacgtctgagtctgcactgctcgagttacctctcataacttgtgaaagcgtgcagatgtcaagcgaactttgtccatataaccctgttatggagaacatcagctccatcatgccctcaaatgaaatggatctgcagcttgatttcatctttactagcgtttacatcggcaaaatcaagggggcgtctaaaggctgtgtgacaattaccaagaagtacattaaaattcccttccaggtgtcactgaacgaaatttccctgctcgtcgatacaacacatctgaagcgtttcggtctctggaagtctaaagatgataatcattctaaaagatcccacgcaattctattcttttgggtgtctagcgattacctgcaggagattcagacacagcttgaacacagtgtgctgtctcaacagtctaagagtagcgagtttatcttcctggaactgcataaccctgtgtctcaacgcgaggagctgaagctgaaggatattatgacagagattagcattatatccggggagctggagctttcctatccactgtcttgggtgcaggcattcccactgttccagaatctctccagtaaggaatcttcattcatccactactattgcgtgtcaacctgttccttccccgcaggagtggcagtagccgaggagatgaaattgaagtccgtgagccaacctagcaatactgacgccgccaaaccaacatataccttcctgcaaaagcaatcttctggatgctacagcctttctatcaccagcaatcccgatgaggagtggcgcgaggtgcgacacacgggcttggtgcaaaaactgatcgtatacccgccaccgcctacaaagggtgggttgggcgtgaccaatgaggatttggaatgcctcgaagaaggagagttccttaatgatgtgataattgatttttacctaaagtacctgatactcgagaaagcctccgatgagcttgtggagagatctcacattttcagcagcttcttctacaagtgcctgacccgcaaagagaacaatctgaccgaagataacccaaatctctccatggcccagcgtaggcacaaaagagttcgtacatggacccggcatatcaacatattcaataaggactatatctttgtaccggtcaatgaaagctcgcattggtacctcgctgtgatttgcttcccatggctcgaggaggccgtgtacgaagactttccccagaccgtaagccagcagtcccaagcccaacagagtcagaatgataataaaaccatcgacaatgacttgaggaccactagtaccctgagcttgtctgccgaagatagccagagtaccgaatcaaacatgtctgtgcctaaaaagatgtgtaagaggccatgcatccttattcttgactccctaaaggctgcgagcgttcaaaatacagttcaaaacttgcgggaatacctggaggtggaatgggaagtaaagctgaagacccaccggcagttttcaaaaacaaacatggtggatctgtgcccgaaggtcccgaaacaggacaactcgtctgactgcggagtttatctccttcagtacgtggaatcattcttcaaagatccaatcgttaatttcgagttgccaattcatttggagaagtggtttcccagacatgttatcaaaacaaaacgggaggatattcgagaactgatcctgaaacttcaccttcagcaacagaaggggtcatccagttag

SEQ ID NO: 207376 - DNA, 2661 bp, Artificial Sequence
  Description of Artificial Sequence: Synthetic coding sequence
atgctgaacgccaagcccgaggacgtgcacgtgcagagccccctgtctaagtttagaagcagcgaaagatggaccctccccctgcagtgggaaagaagcctgagaaataaggtcatctctctggatcacaaaaacaaaaaacatatacgagggtgccccgtgactagcaagagctcccctgagagggggtcacagagatcaaagaccgtagacgacaattcggcaaaacagaccgcccataataaggagaagcggcggaaggatgatggcatctctctactgatcagcgatactcaaccggaggaccttaactcgggcagcagaggttgtgaccatcttgagcaggaatcccggaacaaagacgtgaagtacagcgattctaaggtcgaacttacacttatcagtcgaaagactaaacgacgccttagaaataacttgcctgactctcagtactgtacttctctggacaaatctactgaacagaccaagaagcaagaggacgactctactatcagcaccgagttcgagaagccctccgagaattaccaccaggaccccaaactccctgaggagattacaacaaagccaacgaaaagtgatttcactaagcttagtagcctgaactcacaggagctgacactctctaacgcaacaaagagtgctagcgccgggtcaaccaccgaaacggtcgaaaattccaactctattgatatcgtcggcatcagctcactcgtcgaaaaggatgagaatgaattaaacacaatcgagaagcccatcctgaggggccacaatgaaggaaaccagagtctgatcagcgcagaaccaattgtggtatcatccgatgaggagggtccagtggaacacaagagtagtgagattctgaaactccagtcaaagcaggacagagagacgactaatgaaaacgagtccacttctgagtcggccttgttagaacttcccctgattacctgtgagtcagttcaaatgagctccgagctgtgtccttacaacccagttatggagaacatatcgagtataatgcctagcaacgaaatggatctgcagctggatttcatctttacctcagtttacattggcaaaattaagggagctagtaaggggtgcgttaccatcaccaaaaaatacattaagataccctttcaagtgtctctaaatgagatatctctgcttgtggataccactcacttgaaacggtttgggttatggaagtctaaagacgacaaccacagcaaacgcagccatgccattctgtttttttgggtgagcagcgactatcttcaggagattcaaacacagctggaacactctgtgctgtctcaacagagtaagagcagcgagttcatcttcctggagcttcataaccccgtttctcagcgtgaggagctcaagctgaaggatataatgacggagattagtatcatctctggtgaactggagctctcctacccactttcatgggttcaggcatttccactgtttcagaacctcagttcaaaagagtcttccttcatccactactattgtgtgtccacttgcagtttccccgcaggcgtcgccgtcgccgaggagatgaagctgaaatctgtaagtcagccaagcaacacagatgccgccaaaccgacttacactttcttgcagaaacaatccagtggctgttatagcctgagtatcacatcaaaccccgatgaagaatggcgcgaagtgcggcacacaggactagtgcagaagctcatagtttaccccccgccaccaactaagggcgggctgggagtgactaacgaggatctcgagtgtctggaggagggcgagttcctgaacgacgtcattatcgacttttaccttaagtatcttattcttgaaaaagcctccgatgaacttgttgagcggagccatatcttttcctcattcttttacaagtgtctgactcgaaaggagaataatttgaccgaagataaccctaacctgtctatggcacaacgacgacataagagagtgagaacctggactagacatattaatatcttcaataaggactacatctttgtgcctgtgaatgaatcttcccattggtacttagccgtgatttgtttcccatggttggaagaggccgtgtatgaggattttccccagaccgtaagtcagcagtcacaagctcagcaatctcagaacgataacaaaacaatcgacaacgatctgcgcaccacgtccactctctctctatcggcagaagatagtcaatccactgagagcaacatgtctgtacctaagaagatgtgtaagagaccctgtatcctaattctggacagtctgaaagcagcttcggtgcagaatacagtgcagaatctaagggagtacctcgaggtggagtgggaagtcaagctcaagacccataggcagttcagtaagactaatatggtggacctgtgtccaaaggtgcctaagcaggataatagctcggattgcggggtctacctcttacagtatgtggaatccttctttaaagatcctatcgtaaatttcgaactgcccattcatctggagaagtggttcccccgacatgtgattaagaccaaaagagaggacatcagagaattaatcctcaaactccatctccagcagcagaagggctctagcagctag

SEQ ID NO: 207377 - DNA, 717 bp, Artificial Sequence
  Description of Artificial Sequence: Synthetic coding sequence
atgaagaagttcctgtacatcaagagcgtgttccacaccctgcggatggcccaacgaagacataaaagagtcagaacctggacgcgccacataaacatcttcaacaaagactacatctttgtgcccgtcaacgagtcctcacactggtacctggcggttatctgttttccctggctcgaagaagccgtctacgaagactttccgcaaactgtcagccaacagagccaggcccagcagtctcagaacgacaacaaaaccatagataatgatctgagaacaaccagtaccctgtctctgagcgcagaggattctcagagtacagaaagtaacatgagtgtccccaagaagatgtgtaaacgcccgtgcatactcatactggactccttgaaggccgcatctgtgcagaatacagtgcaaaatttgcgtgagtacttggaagtcgagtgggaggtcaaactgaagacgcacaggcagtttagtaagactaatatggtggacctttgtcctaaggttcctaagcaggataatagttccgattgtggcgtgtacttactgcagtacgttgagagcttcttcaaagacccaatcgtgaactttgaactaccgatccatctagaaaagtggtttccccgccatgtaataaagacaaagcgcgaagacatacgcgagctgatcctgaaattgcacctgcagcaacagaaaggctcttcctcttag

SEQ ID NO: 207378 - DNA, 2958 bp, Artificial Sequence
  Description of Artificial Sequence: Synthetic coding sequence
atggacaagcggaagctgggccggcggcccagcagcagcgagatcatcaccgaaggaaagaggaaaaaatcttcgtcagatctgtccgaaatccgaaaaatgctgaacgcaaaacccgaggacgtacatgtgcagagccccctgtccaaattcagatcttcagagcgctggacgttgcctctgcagtgggaacggtcattgaggaataaagttatctctctggaccacaagaacaaaaaacatatcaggggatgtcctgtgacaagcaagtctagccctgagaggcaactgaaggtgatgctgacgaacgttctgtggacagaccttggccgcaagtttcggaagaccttacctcgcaacgacgccaacctgtgtgacgcaaacaaagtccagagtgactcactccctagcacatccgtggacagcctggagacctgccagaagctagagcctctgagacagagcttgaacctgtccgagcggggctcacagagatccaagactgtcgacgataactcggctaagcagactgctcataacaaggagaagcgcaggaaggacgacggcatctccctcctgatttctgacacgcagccggaggatctgaatagtggaagtagaggttgtgatcatctggaacaggagtcacggaacaaggacgtgaagtatagcgattccaaagttgagctaaccctgataagtcgtaaaactaagcgacgcctccgtaacaacctgcctgatagtcagtattgcaccagtctcgataagtccaccgaacaaaccaagaaacaggaagacgactccacaatatccactgaattcgaaaagccgtcagagaactaccatcaggacccaaaactgccagaagaaatcactacaaaaccaaccaagtccgacttcacaaagctgagctccttaaactcccaggaactgactctcagcaatgcaactaagtctgccagcgcaggatctacaacggagacggtggaaaactctaatagcattgacatcgttggaatcagttcgttagtcgaaaaggacgaaaacgagctgaacaccatcgaaaagccaatcctgagaggccacaatgaagggaaccagagccttatttccgctgagcctatagtcgttagttctgatgaggaaggcccagtggagcacaagtcttctgagattctgaaactgcagtctaagcaagatcgggagactactaacgagaacgagagtacgtccgaatccgctttgcttgaactccccctcattacttgcgagagcgtgcaaatgtcatcggagctgtgtccttacaaccccgttatggagaacatctcaagcataatgccgagtaatgagatggacctacaactcgactttattttcacttcagtttatataggaaaaatcaagggtgcctcaaaaggctgtgtgactatcactaaaaaatacattaagattccgttccaagtgtcgctgaacgaaatttcgctattggtagataccacacacctgaagagatttgggctctggaaaagtaaggatgacaatcactcaaaaaggtcacacgcgattcttttcttctgggtctcaagtgattacctgcaggagatccagacacagttggaacacagcgtgctgtcccaacagtccaaaagctccgaattcattttcctagaactccacaaccctgtgtctcagcgggaggaactcaaacttaaggacatcatgactgaaattagtatcattagcggcgagttggagctatcttacccactctcctgggtccaggcttttcctttattccagaatcttagctcgaaggaatcttccttcatccactattattgtgtgtcaacttgttcatttcctgccggcgtcgcggtggccgaggagatgaagctaaaatcagtttcccagccttctaataccgacgctgctaaaccaacgtataccttcctccaaaagcagtcatccggctgctattctctaagtattacctctaaccctgatgaagaatggcgggaagtgagacacacaggcctagtccaaaagttaattgtgtaccctccaccaccgaccaaggggggattgggcgtgactaacgaagacctggagtgccttgaggaaggcgagtttcttaatgacgtgatcattgatttttatctgaagtacctcattttggagaaggcatccgatgagctcgtcgaaaggtcacatatattttcctccttcttctacaagtgtctgactagaaaggaaaataatctgaccgaggataacccaaacctttcaatggctcagcggcggcataaaagagtgcgaacctggaccaggcacattaacatttttaataaggattatattttcgtcccagtgaacgagtcctctcattggtatctggcagttatatgttttccctggctcgaggaagccgtgtacgaggatttccctcagacagtctcgcagcagagtcaagcccaacagagtcagaatgataacaaaaccattgataatgatcttaggactactagcacacttagcctgagtgccgaggactcacagagcactgaatctaacatgtccgttcccaaaaagatgtgcaagagaccatgcattcttatactagactctctaaaggctgcatcggtacagaatactgtgcagaacctgcgcgagtacctggaagtcgagtgggaggtcaaactgaaaacccaccggcagttctctaagactaatatggtggatctgtgtcccaaggtgccaaaacaggacaacagctctgactgcggggtgtacctgctccagtacgttgaatcatttttcaaggatcctatcgttaactttgagcttccaatccacttagagaaatggttccctagacatgtcatcaagactaagcgggaggatatacgcgagctgattctcaagctgcacctgcagcaacaaaagggcagttcctcttag

SEQ ID NO: 207379 - DNA, 3153 bp, Artificial Sequence
  Description of Artificial Sequence: Synthetic coding sequence
atggacaagcggaagctgggccggcggcccagcagcagcgagatcataacagagggcaagcgcaaaaagtcatccagtgatctctccgaaatccgcaaaatgctgaacgcaaagcctgaggacgttcatgtccagtctccactgagcaagttccgatcctctgaacgatggaccctaccactgcagtgggagaggagtttgaggaacaaagtgatctccctggaccataagaataaaaaacatatcagaggctgtccagttacttcaaagtcctcaccagagaggcagctgaaagttatgctgactaacgttctatggacagatttgggacggaagttccgtaaaacgctccctcgtaatgacgctaacttgtgcgacgcaaataaggtccagtctgattccttgccaagcactagtgtagatagtctcgagacttgtcagaaacttgagcctctgagacagtcattaaatctcagcgaacgaattccccgggtaattctcactaatgtgctcggaaccgagttgggccgaaaatacattcgaactccaccggttacagaaggcagcctgtcagacaccgacaatctccagagcgagcagctcagctcatcctccgatgggagcctcgagagctaccagaacttgaacccacacaaaagctgttatttatccgagcgcggatcacagaggtccaaaaccgttgatgataatagcgccaagcagacggcccataacaaagagaagagaagaaaggacgacggcatatctctgctgataagcgatacccagcctgaggatctgaatagtggctcacgtggatgcgaccacttggaacaggaatctaggaacaaggatgttaagtatagcgactccaaagttgagcttaccctcatcagtcgcaagaccaagagacggctccgcaataacctgccggatagtcagtactgtacatccctggacaagagcactgagcagaccaaaaagcaggaagacgatagcacaatctccacggagtttgagaagccctccgagaattatcatcaggacccaaagctgcctgaagagatcaccaccaagcccacaaagagcgacttcactaagctctcgtctctcaacagtcaggaactcacactgtccaacgcgaccaaatccgcgtcagccggctccacgaccgagaccgtggagaattcgaacagcatagacattgtaggaatctcctcattagtggagaaggatgagaacgagctcaatacgatcgagaagcccatcctgcgggggcacaatgaaggaaaccagtcgctcatcagcgcggaacctattgtggtgtcatcagacgaggagggtcctgtcgagcacaaatctagcgagatcctcaaacttcaaagtaagcaggacagagagaccacgaatgagaacgaatcaacatccgaatccgccctgctggaactgccactcataacatgcgaatctgtgcagatgtcatctgagctctgtccatacaacccagtgatggagaatatttcgagcattatgccatctaatgagatggacctgcagttggacttcatctttacctccgtctacataggaaaaataaagggtgcaagtaaaggatgtgttaccattaccaagaagtatattaagattcctttccaagtttccctcaatgaaatctcactactggtcgatactacgcatctgaagaggttcggcctctggaaatccaaggacgacaaccacagtaagaggtcccacgctatactgttcttctgggtgtccagtgactatcttcaggaaatccagactcagctggagcacagtgtgctaagccagcaatccaagtcctcggagtttatatttttggaattacataaccctgtatcccagagagaggaattaaagctgaaggacatcatgacagaaatcagcattataagcggcgaacttgaactgtcctaccccctcagctgggtgcaagccttccccttattccagaacttgagctcaaaagaatcttcttttatacactactactgtgtgtctacctgtagcttccccgccggcgtggctgttgctgaggagatgaagctgaagtccgtttcgcagccaagtaacactgacgctgctaaacccacgtatacctttctgcagaaacagtctagtggctgttactcactttctatcacttctaatcccgatgaggagtggcgggaggttcgtcacactggtttggtgcaaaagctgattgtgtacccacctccgcctacaaaagggggcctcggagtgacaaatgaagatctggagtgcctcgaagaaggcgagttcctgaacgacgttataatcgatttctacctgaagtatttgatcctggaaaaagcttcggacgaactcgtggagcgctcccacatcttttcctcattcttctacaagtgtctcactagaaaggagaacaacctgacagaagacaatcccaatctgtctatggctcaacggagacacaagagagtccggacatggacccgacacataaatatatttaacaaggactatattttcgtaccggtcaatgagtcatcacactggtatttagctgtcatctgcttcccttggctggaagaagcagtatatgaggacttcccccagacggtatcccagcaatcccaggctcagcaaagtcagaacgataataagactatcgataatgatctccgcacaacaagcacgctttccttaagtgcagaagactcccagtccactgagtccaacatgagcgtgccaaagaaaatgtgcaagagaccctgcatactgatcctggacagtctaaaagccgcaagcgtgcagaataccgtccagaacctgcgtgagtacctggaagtggagtgggaggttaagctgaaaacccacagacagttcagcaagacaaacatggtcgatttgtgccccaaggtgcctaagcaagacaattcctccgactgtggggtctacttgctgcaatatgttgaatccttcttcaaggatcccatagtcaattttgagctgcctatccacctcgagaaatggttccctcgacacgtcattaaaactaaacgtgaggacatccgagagttgatcctgaaactccacctgcagcaacagaaggggtcaagctcctag

SEQ ID NO: 207380 - DNA, 1770 bp, Artificial Sequence
  Description of Artificial Sequence: Synthetic coding sequence
atgtaccggtggctggtgcggatcctgggcaccatcttccggttctgtgaccgttctgtgccaccggcacgtgcattgctgaagcgccgaaggagcgatagcaccctcttctccaccgtggacactgacgagatccctgcaaaaaggcctaggttggattgtttcatacaccaggtaaagaactctctgtataacgctgccagtctgtttggttttccatttcaattgaccaccaagcccatggttacgagcgcctgcaatggcacccgaaatgttgccccaagcggagaggtattttccaactcaagctcttgtgagctgactggctcaggctcctggaataacatgctgaagctgggtaataaatctcctaatggcatctccgactaccccaaaataagagtgaccgttacccgggatcaacctcggagggtgctgcctagcttcggcttcactcttaactccgagggttgcaacagaaggccaggtggccgtcgccactccaaaggcaaccctgagagctcattgatgtggaagccacaagagcaggcggtgactgagatgatatctgaggaaagcggaaaagggctgaggcgaccccactgtaccgtcgaggagggtgtccaaaaggaagagcgcgaaaagtaccgcaaactcctcgaacgactgaaggagtctggacacggtaatagtgtttgcccagtgacctcgaactaccattccagccaaagaagccagatggacacactcaagacgaagggctggggtgaggaacaaaaccacggcgtgaaaaccacacagttcgtgcccaaacagtacagacttgtcgaaacaagaggtcccttgtgctccttgagatcagaaaagcgctgctcaaaaggaaagatcaccgacaccgagacaatggtagggatccgattcgagaatgagtctagacgaggttatcagctagaaccagacttatcagaggaagtctccgcccgccttcggctgggaagtgggtctaatggactgctgcggcgcaaagtttcaatcatagagactaaagaaaagaactgttcaggaaaggaacgggatcgtcggacagacgacctgcttgaattaactgaagatatggaaaaggaaatcagtaatgccttaggccacggaccacaagacgagattctctcgagtgcattcaagctgagaattactaggggagacattcaaacactgaagaactaccactggctcaatgacgaggtgatcaacttctacatgaacttgttagtcgagcggaataaaaagcagggctaccccgccctgcacgtgtttagtacttttttttacccaaagctcaagagtggaggctaccaggctgtgaagagatggaccaagggcgtaaacctcttcgagcaggagattattctggtacccattcaccgtaaggttcactggagtcttgttgttatcgatctccgaaagaaatgccttaagtacctggatagtatggggcagaaaggacacaggatttgcgaaatcctactacaatacctgcaggacgagagcaaaaccaagcggaactccgacctgaaccttctggagtggactcatcattcgatgaaaccccacgaaatcccacaacagctgaacggtagtgattgtggaatgttcacttgcaagtacgctgactatatctctcgtgacaagccaattactttcactcaacatcaaatgccacttttccgcaagaaaatggtatgggaaattctccaccagcagcttctttag

SEQ ID NO: 207381 - DNA, 1242 bp, Artificial Sequence
  Description of Artificial Sequence: Synthetic coding sequence
atgtggaagccccaggagcaggccgtgaccgagatgatcagcgaggagagcggcaaggggcttcgacggccccactgcacagtcgaggaaggagtccagaaagaagagagggaaaagtaccgtaagttgcttgagaggcttaaagaatcaggacatgggaattcagtgtgcccagttactagcaactatcactcatcacagagaagccagatggatactctcaagacgaagggctggggcgaggagcaaaaccatggcgtcaaaaccacacagtttgtgccgaagcagtataggctagttgagacccgtggacccctgtgttctttgaggtccgaaaagaggtgctcaaaaggcaaaattactgacacagagactatggtgggtattcgattcgaaaacgagtctaggagaggctatcagctcgagcccgatctctccgaggaagtatccgcccgtctccgcctgggctcagggagtaatggactgcttcgacgaaaagtcagcattattgagactaaagaaaagaattgcagcggcaaagagagggaccgacgaactgatgacctgctggaactcaccgaagacatggagaaggaaattagtaatgccctgggccacggcccacaggatgagatactgagctccgcattcaaattgcgaattacaaggggcgacatacagactctgaaaaactatcattggctcaacgacgaggtaattaacttctatatgaatctgctcgtggagcgtaacaaaaaacagggctacccagctctgcacgtcttcagcacatttttctaccctaagcttaagtccgggggctatcaagccgtgaagcggtggacaaaaggagttaacctgtttgaacaagagattattctcgttcccattcacagaaaggtacattggagcctggtggtcattgatctgcgtaaaaagtgcttgaagtacctggacagcatggggcaaaaggggcataggatttgtgaaattttactccagtatctgcaggatgaaagcaagactaagaggaacagtgaccttaacctgttggagtggacacaccactccatgaagccccacgagataccccagcagttgaatggcagcgactgcgggatgtttacctgtaagtacgctgactacatttcccgcgacaagcctataacattcacccaacaccagatgcccctattccgaaagaagatggtttgggaaatccttcaccaacaattactgtag

SEQ ID NO: 207382 - DNA, 1383 bp, Artificial Sequence
  Description of Artificial Sequence: Synthetic coding sequence
atgtaccggtggctggtgcggatcctgggcaccatcttccggttctgtgaccgaagtgtccccccagcgcgcgcgctgctgaaaagaagacgtagcgactccactctcttcagtacagtggacactgatgagattcccgccaagcggccacggctcgattgcttcatccatcaggtgaaaaactcactctacaacgcagccagcctattcggctttccgttccagctaacaactaagcccatggtgacgtcagcatgcaatggcacgaggaatgtggctccatcaggagaggtcaacggaaactccgtctgccctgtaacatctaactatcactccagtcagagaagccagatggacacattgaagaccaagggttggggtgaagaacagaatcatggggttaagacgactcaatttgtgcccaagcaatacaggctcgtggagacgcggggcccactctgcagtctgcgatcggaaaaaagatgctctaagggtaaaatcactgacaccgagactatggttgggatacgttttgaaaacgaatctcggcggggatatcagctggaacccgatttgtccgaggaggtaagcgctcgcctgcggctgggatccggatctaatggactcctgagacggaaagtatcaattatcgaaacaaaagagaagaattgttccggaaaggagcgggacaggcgcaccgatgaccttttggagctcacagaggatatggagaaggaaattagcaacgctctggggcacgggccccaggacgagatcctgtcctccgcattcaaactgaggatcacacgaggggacatccagaccctgaagaactaccactggctgaatgatgaggtgatcaatttctatatgaatctgcttgttgagagaaacaagaagcaagggtatcccgccttgcacgtcttttcaacgttcttttatcctaagctcaagtcagggggttatcaggcagtgaagcgctggacaaagggggtgaacctgtttgagcaggaaatcattctggtccctatccatagaaaggtgcattggagcctggtggtcatagacctgagaaaaaaatgtttaaagtaccttgattccatgggccaaaaagggcatcgcatttgcgagatcctgttacagtacctccaggatgaatctaagacgaaacgtaacagtgacctgaacctgcttgaatggactcaccatagcatgaaaccacatgagatcccgcaacagctcaacggtagcgattgtggcatgttcacttgcaagtacgcggactatatctcccgtgacaagcctatcacctttactcaacaccagatgcctctcttccgaaagaagatggtgtgggaaatcctgcaccaacagctgttgtag

SEQ ID NO: 207383 - DNA, 1740 bp, Artificial Sequence
  Description of Artificial Sequence: Synthetic coding sequence
atggacagccacccctgcctgtactgcggcccccaggacagcgagggaacaaattggcaaacttccccttctaccttgttttctactgtggatacagatgagattcccgcgaagcggccccggctggactgctttatccaccaggtgaaaaactcactgtacaacgccgcaagcctttttggcttcccctttcaactgaccactaagccaatggtgacttccgcttgtaacggcacccgcaacgtggccccatcaggagaagtcttcagcaattcaagttcatgtgagctcaccggctcagggtcttggaataatatgttgaaattgggcaacaagtctcccaatggcatttctgactaccctaaaattcgggtgaccgtgacacgggatcagccacgacgcgtcctccctagtttcgggttcaccctgaatagtgaaggctgtaacaggcgccccgggggaagacgccactcaaagggaaatcctgagtcttctctcatgtggaaacctcaagaacaggcagtgactgagatgatatccgaagaaagtgggaagggcctccgtaggccacactgtaccgtcgaggagggcgtgcaaaaggaagaaagggaaaaatacaggaagcttctcgagcgcctcaaggagtcaggccatgggaattctgtctgcccagttacaagtaactaccactcctcccagcgatcacagatggatacgctgaaaacaaaaggctggggggaagaacagaaccacggcgttaagactacgcagttcgtacccaagcagtacaggctggtggagactcgcgggcccctgtgctcattaaggtccgagaaaagatgcagcaaagggaaaattactgatacagagaccatggtggggataaggtttgagaacgagtcaagacggggatatcagctggaaccggatctgtcagaggaggtatccgcaaggctgagactggggtctgggtctaacggcttgctgcgaagaaaggtttccattatcgaaacaaaagaaaagaattgttctggcaaggaacgcgacagacggacggatgacctgctcgagctgaccgaggatatggaaaaggaaatctccaatgctctcgggcacggaccgcaagacgagatactgtctagcgcttttaaacttaggataacgcggggagacatccagaccctcaaaaattaccactggctgaacgacgaagtgatcaatttctatatgaacctattggtagaacggaacaagaagcagggatatcccgcactgcacgtgttttcaaccttcttttaccctaaactaaaaagcggagggtaccaggcagttaaacgatggaccaagggagtcaacttgttcgaacaggagattattctggtgcctattcaccggaaagtacattggtcgctggtggtcatcgatctgcggaagaaatgtctgaagtacctagattcaatgggccagaaaggacatcgtatatgtgagatcctcttgcaatacctacaagatgagagcaaaacaaagcgtaattctgacctgaatctgttagagtggacgcatcactccatgaagcctcacgagataccacagcagctcaacgggagtgactgcgggatgtttacatgcaagtatgccgactacatttcccgcgataagcctataacctttacacaacaccaaatgccgctgttccgcaagaaaatggtctgggagatcctccaccaacaactgctgtag

SEQ ID NO: 207384 - DNA, 1722 bp, Artificial Sequence
  Description of Artificial Sequence: Synthetic coding sequence
atgaaggagaccatccagggcaccggcagctggggccccgagccccccggaccagggatccccccggcctattcctcaccccgtcgagaacgccttcggtggcctcctcccccaaagccaagactgaaaagcggtggcgggttcggaccggatcctggatccggcaccactgtgccagcccggaggttgcccgttcccagaccgtcgttcgatgccagtgcttctgaagaggaagaggaagaagaagaagaagaggacgaagacgaagaagaggaggtggccgcttggaggttaccacctaggtggtcccagcttgggacgtcacagagaccaaggccctcgagaccaacacaccggaaaacatgtagccagaggaggcgaagagctatgcgggcattccgtatgctgctgtattccaaaagtaccagtttgacattccactggaaactgtgggggagacaccgcggtcggaggagggggctagcccaccctaagaaccacctgagcccccagcagggcggtgcaacgcctcaggtgccgtccccatgctgccggtttgatagtccacggggtcctccccccccgcgcctgggcttgctgggcgcacttatggcagaggacggtgtgcgcggaagccccccagtgccgagcggaccaccaatggaagaagatggcttaaggtggacccctaaatcacctctggatcctgattccggtttactctcgtgcaccttgccaaatggatttggcgggcagtctggtcccgagggggagagaagcctagctcctccagacgccagtattctaatttccaacgtctgctctattggagaccacgttgcacaagagttgtttcagggatctgatctcgggatggcggaagaagccgagcgacccggggagaaggccggccagcacagccccctccgcgaagagcacgtcacctgcgttcagagcattcttgatgaattcctgcaaacctacgggagtctgatccccctttccacagatgaggtagtggagaagctcgaagatatctttcagcaggaattctcaacacctagtaggaaggggctggtactgcagctgattcagtcctatcaaagaatgcccgggaatgccatggtgaggggatttagggtggcttataagaggcacgttctgaccatggacgatctggggacattgtatgggcagaactggctcaatgatcaggtgatgaatatgtatggagacctggttatggataccgttcctgagaaagtgcacttcttcaatagtttcttttatgacaaattacggaccggctacgatggcgtgaaaagatggactaaaaatgtggatatatttaataaggaactgctgctaattcccattcacttggaggtccactggtccctgatcagtgtagatgttaggcgcagaactatcacgtactttgacagccaacggaccctgaaccggaggtgcccaaagcatatcgccaagtacctccaagctgaggccgtgaaaaaggatcgcttggactttcaccagggatggaagggatactttaaaatgaatgtggccaggcaaaacaacgactcagattgcggcgccttcgtgcttcaatactgcaaacacctagcactgagtcagccatttagtttcacacagcaggacatgccaaagctgcgccgacagatatacaaagagttgtgtcactgcaaattgacagtttag

SEQ ID NO: 207385 - DNA, 1725 bp, Artificial Sequence
  Description of Artificial Sequence: Synthetic coding sequence
atgaaggagaccatccagggcaccggcagctggggccccgagccccctggcccaggtattccgcccgcttattcaagccccaggcgcgaacgactgaggtggccaccacccccaaagcccaggttaaagtccgggggtgggttcggcccagatccaggctccggaaccaccgtgccagctaggcgcttgcccgtaccaaggccttccttcgatgcatccgcatctgaagaggaggaggaagaagaagaggaagaagatgaagatgaggaggaagaagtggcagcttggaggttaccaccacggtggagccagttgggcactagccaaaggcccagacccagtcgccctacacatcgcaaaacgtgcagccagaggcgccggagggcaatgagggcattcagaatgctcctgtattccaagtctactagcttaacattccattggaagctatggggcaggcaccgagggagacgaagagggctcgcccaccccaaaaaccatctgagtcctcagcaggggggagctacgccacaggtaccaagcccttgctgcagatttgactccccacggggcccaccacctccgcgactagggctgctcggtgctcttatggccgaagatggcgttcgcgggtctccccccgtcccgagcggtcctcctatggaggaggacggactgcggtggacccctaagagcccactcgacccggacagtggccttttatcttgtacccttcctaacggcttcggtggccagtccggccccgagggagaaagatcgctagcacccccagatgcgtctattcttattagcaacgtgtgctccatcggggatcatgtcgcccaggaattattccaggggtcagacctggggatggcagaagaggccgaacggcctggcgaaaaggccgggcagcattctcccctgcgcgaagagcatgtcacctgtgtgcagtcaatcttggacgagtttttacagacatatggctccctcatccccctatccacagacgaggtggtcgagaaactcgaggatattttccagcaggagttcagcaccccaagcagaaaaggtttggtcttacagctgattcagagctatcagcgcatgccgggtaatgccatggtacggggattccgggtcgcttataagcgccatgtgctcacaatggatgatctggggacgctgtatggccagaactggttgaacgaccaggtaatgaatatgtatggcgacctggtcatggacacagtccctgagaaggtacacttcttcaactctttcttttatgataaattacgtactaagggatatgacggtgtaaagaggtggacgaaaaatgtcgatatcttcaacaaagaactgctgctgatacctattcacctggaggtgcattggagcctgatatccgtcgacgtgcgccgcaggactatcacctacttcgattcccagaggactctaaatagaaggtgccctaagcacatagccaagtacctgcaagccgaggccgttaagaaagataggctggattttcaccagggttggaagggatatttcaagatgaatgtggccaggcagaataacgattccgattgtggagcctttgtcctgcaatattgtaaacacctggcactttcgcagcctttttcgtttacacagcaggacatgcccaagcttcgtaggcagatttataaggagttatgtcactgcaagcttaccgtatag

SEQ ID NO: 207386 - DNA, 3741 bp, Artificial Sequence
  Description of Artificial Sequence: Synthetic coding sequence
atgatggagaccgagcggctggtgctgcccccccccgaccccctggatctgccattgcgggccgtggagttaggttgcactggacactgggaactactgaatctaccaggtgctccagaatctagccttcctcatggcctgcctccttgcgctcccgatctgcagcaggaggctgaacagctctttctgtcaagcccggcttggctgccactgcatggtgtggagcactcagccaggaaatggcagaggaagaccgatccgtggtctctgttggcggtgctgggcgccccggtgcctagtgatttgcaggcccagcggcacccaactacagggcagatcctcggctacaaggaggtgcttctcgagaacactaacctttccgctactacaagtctttcactgcggcggcctcctggtcccgccagccagagtttgtgggggaatcctacgcagtaccctttttggcccggcggcatggacgaaccaaccattaccgatctcaatactagagaagaggctgaggaggaaatcgatttcgaaaaagacctcctgaccattccaccaggctttaagaaaggcatggacttcgcgccaaaagactgcccgaccccggcccctggtctgcttagcctgagttgtatgctcgaacctctggatctggggggcggagacgaagatgagaacgaggctgtagggcagccaggcggaccgcgcggtgacactgtgtccgcatccccttgtagtgctccacttgcccgcgcctcttctctggaagatctggtgctgaaagaggcatcaactgctgtgtccacccccgaggcacctgaaccacccagccaggaacagtgggctatccctgtcgatgccacatccccggtgggtgatttctaccggctgatcccgcagcccgccttccaatgggcatttgagcccgacgtcttccagaaacaggccatactccacttagagaggcatgatagtgtctttgtggccgcccacaccagcgccggaaaaaccgtcgtggcagagtacgcaatcgctctggcacaaaaacacatgactcggacaatctacaccagccccatcaaggctttgagcaatcagaaattccgcgacttcaggaacaccttcggggatgtgggactgcttacaggggacgtccagttacaccctgaagcctcttgtttgataatgaccactgagatcctgagatcaatgctgtattccgggtccgatgtgatacgtgatctagaatgggtcatattcgacgaggtgcattacatcaacgacgtcgaacgcggcgtggtgtgggaagaagtactgatcatgctgccggaccacgtgtcaatcatccttctttccgcaaccgtgcctaacgccctggaattcgcagattggatcggccgcttgaaaagacggcagatttacgtgataagtacagtcacacggcccgtccccctagagcattatctgtttaccgggaattcctctaagacccagggagagctgttcctgttgctggactcacgaggagcttttcacaccaagggctattacgctgccgtagaagctaagaaggagcgtatgtctaaacatgcacagactttcggagcgaaacagcccacccatcagggaggaccagctcaggacaggggagtctacctgtcgctcctggcctcactccgcaccagagcacaattacctgtggtcgtcttcacattttctcgcggcagatgcgacgaacaggcctcagggctaaccagtcttgatttgaccaccagttctgaaaagtccgaaatccacctctttttgcaacgttgccttgctaggctccgagggagcgatcgacaactgccccaagtgctccacatgtccgagttgctcaatcggggcctgggcgtgcaccacagtggtatcttgcctatcttaaaagaaattgtggagatgctcttctcaagaggtcttgtgaaagtcctgtttgcaaccgagactttcgccatgggagtgaacatgcccgcaagaactgtggtgtttgacagcatgcgcaagcacgatggttcaaccttccgcgatctgcttcccggcgagtacgttcagatggcgggccgtgcgggacggcgcggattggaccctacaggtactgtgatcctgctctgtaaagggcgggttcccgagatggccgatctgcataggatgatgatgggaaagccaagtcagctccagtctcagtttagactcacttatacaatgatcctgaatctgttgagggtggatgcactgagggtggaggacatgatgaaacggagcttctcagagttcccaagtaggaaggatagcaaggcccacgaacaggctctcgcagaactcaccaaacggctgggtgcattggaggagcctgacatgactggtcagctggtggatctccctgagtactattcatggggagaagaactcaccgaaacacagcacatgatacagagaaggatcatggaatcagtgaatggcttaaaatccctgagtgccggcagagtggtggtagtaaaaaatcaggaacatcacaacgccctgggcgtcatccttcaggtgagcagcaattccacaagccgtgtgtttacaaccctggtgctgtgcgataagcccctgagtcaggacccacaggaccggggacccgccacagccgaggtgccatatccggacgatctagtgggcttcaagctctttttgccggaaggaccttgcgaccacactgtcgtgaaactgcagcctggcgacatggcagctatcaccactaaggtcctgcgggtgaatggcgagaaaattcttgaggacttttccaaacgtcagcagccgaagtttaaaaaggatcctcccctggcagctgtcacgacagctgttcaagagctactccgattagcacaggctcatccggcaggaccccccaccctggatcccgtcaacgacctgcagctgaaggatatgagcgttgtggagggcggcttgcgagcacgaaaacttgaggaactgatccaaggcgcgcagtgcgtgcactccccccgcttccccgctcagtacttaaaactgagagaacgcatgcaaatccagaaggaaatggagaggctaagatttctgctctccgaccagagtctattgttgctgcccgagtatcatcaacgcgtagaggtactgaggacgctgggctacgttgacgaagccggtaccgtaaaactggctgggcgcgtggcctgtgccatgtcatcccacgaactgctgctgacggaactcatgttcgacaacgcactgtcaacactccgtcccgaggagatcgccgctctgctgagcggtttagtgtgccagtcacccggagacgcgggtgatcagcttccaaataccttgaagcaggggatagaacgcgtccgtgctgtggctaagaggattggtgaagtgcaagtggcctgcgggctgaaccagaccgtcgaggaattcgtgggagagcttaacttcggcctagtggaagtagtgtacgagtgggcaagagggatgcccttcagcgagctggctggcttgagcggaacacctgaaggcttggtcgtgaggtgtattcaaaggctggctgagatgtgtaggagccttagaggcgctgcccgactggtcggtgagcctgtgctgggagctaagatggagacagctgcgaccctgctgcgaagagatatagtgttcgcggcatccctgtatacacagtag

SEQ ID NO: 207387 - DNA, 3741 bp, Artificial Sequence
  Description of Artificial Sequence: Synthetic coding sequence
atgatggagaccgagcggctggtgctgcccccccccgaccccctggacctccctctgcgagctgtagagctgggctgcaccggccactgggagctactgaacctgcctggcgcccccgagagtagcttgccccacggcttgccaccatgtgcccccgatcttcagcaggaagcagagcagttgttcctctcatcgcccgcatggcttcccctccatggagttgagcacagcgctcggaagtggcagcgaaagaccgatccctggtctttgctggccgtgttgggggcacctgtgcctagcgatctccaggcacagaggcacccgacaaccgggcagatcctcgggtataaagaggtgctcttagaaaatacaaacttgtcagcaactaccagcctgagcttacgccggcctcccggcccagccagccagtccctatggggtaatcctacacaatatccattctggccgggcgggatggatgaaccaacaatcacggatctgaacacaagggaggaggcagaggaggagatcgactttgagaaggatttgctaaccattcctccagggtttaagaaaggtatggacttcgctcctaaggactgccccacccctgccccaggattgctgagcctttcttgtctactggaaccactcgacctaggtggtggcgacgaagacgagaacgaagccgtcggacagccggggggcccacgcggagacaccgtgtccgcctcgccttgcagcgccccactggccagggcatccagccttgaagatctggtgctcaaagaagcctcaactgcggtatctactcccgaggcccccgaacctccctcccaggagcaatgggctattccagtcgatgccacgagtccagtaggtgacttttacaggctgattccgcaacctgcctttcagtgggccttcgaacctgacgtttttcagaagcaggctatactgcacctggagcgacacgattcggtgtttgtggcagcccacacttccgccggaaaaacagtcgtcgccgagtatgcaatcgcgcttgcacagaaacacatgacccgaactatatatacaagtccaattaaagcactctctaatcagaagtttagagattttaggaatactttcggggatgtgggacttcttactggcgacgttcaactgcaccccgaagcgagttgcctcattatgaccaccgagatcctcaggtccatgttgtacagcgggtccgacgtgattagagacttagagtgggttattttcgacgaggtacattatattaatgatgtggagcgaggcgttgtgtgggaagaggtgcttataatgctgcccgaccacgtcagtattatcttgttaagtgctactgtcccaaatgcactggagttcgctgattggatcggcagactcaaaaggagacagatatacgtaatttccactgtgactcggcctgtccccttggaacactacttatttaccggtaacagctctaaaactcaaggagaactgttcctactcttagactcgagaggggcttttcatactaagggctactatgccgctgttgaagccaagaaggaacgtatgagcaagcacgcccagacttttggcgccaagcagccgacccaccaaggcggacccgcccaagatcgcggggtgtatctctcgcttctcgccagtcttagaacaagagcgcaactgccagttgtcgtttttactttctcacggggtcgctgcgacgaacaagcatcaggcctgacatcgcttgacctcactacttcctccgagaagtctgagattcacctgtttttacagcggtgcctggctcgcttgcggggctcagacagacaattgccccaggtccttcacatgtccgagctcctcaaccgcggtctgggagtgcaccactcaggaatcctacccatcttgaaagagatcgtcgaaatgttgtttagccgcggtctggtgaaagtcctattcgcaaccgagacctttgctatgggtgtgaatatgccagctcgaacagttgtgtttgatagtatgaggaagcatgacgggtccacttttcgcgatctgctccctggcgagtacgtgcagatggccgggagagcgggccgcaggggccttgatccaacaggcacagtgattctgctgtgtaaaggtcgtgtgcccgaaatggccgacctgcacaggatgatgatgggaaaaccaagccaactgcagtcgcaatttcggttgacatacactatgatccttaatttgctgcgagttgatgcattacgtgttgaggatatgatgaaaagatcattttctgagttccctagccgtaaagactctaaggcacacgagcaggcactggccgagctaacgaagcgcctcggggccttagaagagccggatatgaccggacagctggtcgacctgcccgagtattatagttggggagaagaactgacagaaacccaacatatgatccaaaggagaatcatggagagcgtcaatggtttaaagtctctgagtgctggaagggtggtcgtggtaaagaatcaagaacaccacaatgccctgggcgtcatactgcaggtgagttcgaacagcacctcacgggtttttaccactcttgtgctctgtgataagccactgtcacaggatccccaggatagggggcctgccacggccgaggtcccatacccagatgacctggttgggttcaaattgtttctgcctgagggcccttgtgaccacacagtggtgaagcttcagccgggcgatatggccgctatcactaccaaggtgctgagagttaacggagagaaaattcttgaggacttcagcaaaagacagcagccaaaatttaagaaggacccgcccctcgcggctgtcacaacagccgtccaagaactcctccgccttgcccaggcccacccagctggaccaccaactctggacccagtaaatgacctgcagctgaaagatatgtccgtggtggagggcggccttcgagcgaggaaactggaagagctaatccagggagctcaatgcgttcacagccctcggtttcctgcgcaatatttgaagttgagggaaaggatgcagatccagaaagaaatggaacgtttgcgattcctgctgtcagaccagtcgctactactccttccagaatatcatcagcgagtcgaggttcttcgaactcttggctatgtggacgaagcaggcactgtaaagctagctggccgggtggcctgcgccatgtctagccatgagttgttgctcaccgagctgatgttcgataatgcactaagtacattacgaccggaagaaatcgctgcgttgctgagtgggcttgtctgccagagccccggagatgccggagaccagctgcctaataccctgaagcagggaattgagcgcgttcgtgctgtagcaaagaggatcggcgaggtacaggtggcatgtgggctcaaccagaccgtagaagagttcgtcggcgagctcaattttggcttggtggaagtcgtgtacgagtgggctcggggtatgccattcagcgagctagccggcctaagcggtacacctgaaggtctggtggtgcgctgcatacagcgtttggcagagatgtgcagaagcctccgcggcgccgctcgtctcgtcggggagccagtcctgggagccaagatggagaccgccgctacactgttgcggagagatattgtctttgctgcgtcactgtacacccagtag

SEQ ID NO: 207388 - DNA, 3741 bp, Artificial Sequence
  Description of Artificial Sequence: Synthetic coding sequence
atgatggagaccgagcggctggtgctgcccccccccgaccccctggacttgcctctgcgtgcggtggagttgggctgtaccggccactgggagctgctgaacttacctggagcacccgaatcatccttaccgcatgggctccctccctgcgccccagacctccagcaggaagctgaacagttgtttctgtccagccctgcctggctgccactgcacggggttgagcacagtgctcgtaagtggcagagaaagaccgacccctggtctctgctagcggtgctgggggcacccgtcccttccgacctgcaggctcaaagacacccgaccacaggacaaattctcggctacaaagaggtactgctggaaaataccaacctctctgccacaacatctctctctctccgcaggccccccggacctgcctcccagagtctgtggggaaatccaactcagtaccccttttggcctggcggaatggacgagcctactataactgatttaaacaccagggaagaagctgaagaggagatcgactttgagaaggacctgctcacaattcccccaggctttaagaagggaatggattttgccccaaaagactgtcccacaccggcccccggtttgttgagcctctcgtgtctgttggagccattggacctagggggcggcgacgaagacgaaaacgaggctgtgggacagcctggggggccccggggcgatactgtgtcagcctccccgtgttcagccccccttgccagggccagctctttggaggatctggtgcttaaggaagcttctactgccgtctccacacccgaagcccctgagccaccttcacaggaacaatgggcaatccccgtcgatgcaacctccccagtgggggacttctatagattgatcccccagccagctttccagtgggcattcgagccagatgtctttcagaaacaggccattctccacctggaacgtcatgacagcgtgtttgtcgccgcccacactagcgcgggaaaaaccgttgttgcagagtacgccatcgctctggctcagaagcacatgacaagaacaatctacacctctccaatcaaagcactgtctaatcagaagtttagggacttcaggaacaccttcggcgatgtgggactgctgacaggggacgtccagttgcacccggaggcttcatgcttgatcatgaccactgagattctgcgctccatgttgtatagcggcagcgacgtcatccgagacttggagtgggttatctttgacgaagtgcactacatcaatgatgttgagcggggtgtggtctgggaggaagtattaattatgttgccagaccacgtgtccatcatccttctaagtgctactgtacccaatgccctagagttcgctgactggatcggaagactgaagagacggcaaatatacgtcatatccactgttacaaggcccgtcccactggagcactatctgtttaccggaaacagctcgaaaacacagggtgagctgttcttgcttctcgatagcagaggcgcctttcacaccaagggctattacgccgccgtagaagctaagaaagaacggatgagtaagcacgctcagacatttggcgccaagcagcctacccatcagggtggtcccgcacaggacaggggcgtgtacctgagcctcctggcatcgttgagaacccgcgctcaacttcccgtcgtggttttcacctttagtagagggagatgcgacgaacaagccagcggcctgacttccctagatttaactacgtcctctgagaagagcgaaatccatttatttctacaacgctgtctggcccgccttagagggtctgaccgccagctacctcaggtcctccatatgtcggagctgctgaaccgaggtctaggcgtgcaccattctggcatacttcccatcctaaaagagatcgtggagatgctgtttagccgcggtttagtaaaagtcctattcgcaacagagaccttcgccatgggagtgaacatgccagcccgcacagtggtctttgactccatgagaaagcacgatggctctacctttcgcgatctactacccggcgaatacgtccaaatggctggcagggcaggacgcaggggcctggatccaaccggtaccgtgatcctgttatgtaagggaagggttcccgagatggcggacttacaccgaatgatgatgggaaaaccaagccaattgcaaagccagtttagactcacttatactatgattcttaacctgctgagagtggacgcgctgagggtggaagacatgatgaaacgatccttctccgaattccccagtcgtaaggattccaaagcacatgagcaggccttagccgagcttacaaaacggctgggggccctcgaggaacctgatatgaccggccaactcgtagatctgccagaatattattcctggggagaagagcttaccgaaactcagcacatgatccagaggcgcatcatggagtccgttaacggactgaaaagcctatccgccgggagagtagtagtagtaaagaaccaggagcaccacaacgccttgggcgtgatccttcaggtttcgtctaactcaactagccgagtgttcacaacccttgtcctatgtgacaaacctttgagccaggatccacaagataggggacctgccacagctgaggtcccttatccagacgacctcgtgggctttaagctatttctacctgagggaccctgcgaccatacagtggtcaagctgcagcctggggacatggcagccataactacaaaagtgctgagggtgaacggggaaaagattctggaggacttctccaaacggcagcagcctaagtttaaaaaagacccccccctggctgccgttactactgctgtccaagaattattacgactggcccaggcacacccggccggccccccaaccctcgatccggtgaacgacctccagcttaaggacatgtctgttgtggagggaggactgagagcgaggaaacttgaagaactgatccaaggggcccagtgtgtgcattcacctcgatttcctgcccaatatttgaagttgagggagagaatgcaaattcagaaggaaatggagcggttgagatttttgctgtcggatcagagcctcctcctcctgcccgagtaccaccaaagagtggaagtgctgcgaaccctggggtatgttgacgaggcaggaaccgtgaaactggctggcagggtggcttgtgccatgagctctcacgagctgcttcttaccgagctgatgttcgataacgcactgtcaacactacgccccgaggagattgccgcactgctgtcagggttggtctgtcaaagcccaggggacgcaggagaccagctgccaaacacactgaagcagggcattgagagagtaagagcagtcgcaaagaggattggggaagtccaggtcgcctgtggcctgaaccagactgtcgaggaatttgttggcgaacttaatttcgggttggtggaggttgtctacgagtgggcccggggcatgccctttagtgagcttgctggtctctccggcacacccgagggactcgtcgtgcggtgcatccagagactagctgagatgtgccgaagcttgcggggtgccgcccgcctcgtcggcgagcctgtcctcggggcgaagatggaaacggcagccactctgctccggcgggatatcgtgtttgcagcctctctttacactcagtag

SEQ ID NO: 207389 - DNA, 3741 bp, Artificial Sequence
  Description of Artificial Sequence: Synthetic coding sequence
atgatggagaccgagcggctggtgctgcccccccccgaccccctggatctgcctctacgtgcagtcgaattggggtgcaccggacattgggagctgttgaacctgccgggcgcccctgagagcagtctgccacacggtttaccgccatgtgcacccgaccttcagcaggaggcagaacaattgttcctctcctcgcctgcgtggctgcctctgcatggggtggaacatagcgctcggaagtggcagcggaagaccgatccatggtctctcctcgcggtccttggggcccccgtcccatctgacttgcaggcccagcgccaccccaccacaggccagatcctcggctataaggaggtgctgctggaaaacacgaatctctccgcgacgacttcactgtcccttaggaggcccccaggcccggcatcccagtcactgtggggaaatcccacacagtatcctttttggcccgggggaatggatgagcctaccattacggatcttaacacacgggaggaggctgaagaggaaatagacttcgaaaaggacctgctgacaatcccccccggctttaaaaagggtatggatttcgctcccaaagattgcccgacgcctgcacccggcctgctgagtctcagctgtctgttagagcccttggacctgggcggcggcgacgaggacgaaaatgaagctgtcggccagcccggaggacccaggggcgacaccgtgtccgcttcaccctgtagtgctcctttggcaagagcgagcagcctggaggaccttgtattaaaagaggcaagtaccgccgttagcacacccgaggctccagagcctccatcccaagagcagtgggcaattcccgtcgatgcaacgtcacctgttggagacttttatcggctcattccccagcccgcattccagtgggccttcgaaccagacgtcttccaaaagcaggccattcttcaccttgaacggcacgactctgtatttgtggcagctcacacatccgccggcaaaactgtggtggctgaatacgcgattgcactggcccagaagcacatgactcggaccatttacaccagtcctatcaaagccttgtccaatcagaaattcagagatttccgcaatacttttggggatgtgggcctgctgactggggacgtgcagctgcaccccgaggcatcctgcctgattatgaccacagagatcctacgaagcatgctgtattcagggagtgacgttatccgagacttggagtgggtgattttcgatgaagtgcactatatcaacgacgtggaaagaggggtggtctgggaagaggttctcattatgctgccggatcatgtgagtattattctgctctcagcaaccgtgcccaacgcattggaatttgcggactggatcggcagactgaaacggcgacagatttacgtgatatctacagtgaccagaccggtacccctggagcattacctgttcactggtaattccagcaagacacaaggagagctgttcttgctgctcgactctaggggagctttccacactaagggctactatgcagccgtggaagcgaaaaaggagcggatgtccaagcacgcccagacctttggagctaagcaaccaacacaccaaggaggacctgcccaggatcggggagtgtacctttcccttctagccagccttcgcacaagggcccagttgcctgttgtggtgttcacctttagccgaggacgctgtgatgagcaggcctccgggctgacgtccttggacctcaccacaagctcagagaagtcagaaattcatctgttccttcagaggtgcttagcccggctccgcggaagtgacagacagctgcctcaggtgcttcacatgagcgaattacttaacaggggacttggcgttcatcatagtggaattcttcccatcctgaaagagattgtagaaatgctcttcagccgcgggctcgtgaaggtcttgttcgctactgaaacctttgccatgggtgtaaacatgcccgctagaaccgttgtttttgacagcatgcgcaagcacgatggctcaactttccgcgatctcctgcctggggaatatgtgcagatggccggtagggccggccggaggggcctggaccctacgggcactgttatcttgctgtgcaagggaagagtgcccgaaatggcggatctacaccgtatgatgatggggaagcccagtcagttgcaatcccaatttcggcttacctataccatgattctgaatctcctccgtgttgacgcactccgtgttgaggacatgatgaagcgctcattttccgagttccccagcaggaaggactcaaaagctcacgaacaggccctcgcggagctcaccaaaagactgggtgcgctggaggaacccgacatgaccggccagctggtggacctcccggagtattactcctggggagaagagctgacggaaacccagcatatgatccaacgcagaatcatggagagcgtcaacggcctgaagtctctcagcgctggccgagtggtcgtggtcaaaaaccaggaacaccacaatgccttgggggtgatactgcaggtgagcagcaattccacaagtagggtgtttactaccctagtgttgtgcgacaagccactgagccaggatccacaggacaggggccccgccacagccgaggtgccttacccagatgatctcgtgggctttaaattgttcctgcccgaggggccttgtgatcatactgtcgtgaagttacagcccggcgatatggctgctatcactacaaaagtgctgagggttaatggggaaaagatcctggaggattttagtaagcggcaacagcccaagtttaagaaagaccctccgctggccgcagtaaccacagccgtgcaagaactactgaggctcgcacaggcccaccccgctggaccacccacgttagatccagtgaacgatttgcaactcaaagacatgagtgtggtcgaggggggattgagggctcgtaagctggaggagttgatccagggtgcccagtgcgtgcattcgccaaggtttcccgcacaataccttaagctgcgggagcggatgcagattcagaaggagatggaaagactccggttcctgttatccgaccagagcctcctgctgctgccggagtaccaccaacgcgtggaagtcctccggaccctgggttacgtggacgaggcggggaccgtcaagctagcagggcgagtcgcgtgcgctatgtcctctcacgagctgctcctaaccgagctcatgtttgacaacgccctgtcgacgctgaggccagaagagatcgccgcccttctgtccggattggtgtgccaatctcctggcgacgccggcgaccagctccccaacaccttaaagcaaggtattgaaagagtccgggctgtcgccaagcggattggcgaggtccaggttgcttgtggcctgaatcagaccgtggaagagttcgtcggagaactcaattttggactggtggaggtggtctatgaatgggctaggggaatgcccttttcagagcttgctggattatctgggacgccagaaggtctggtagtgcgatgcatacaacgcctagctgaaatgtgtcgctccctgcgaggcgcggcccggctcgtcggggaaccggtcctgggggcaaagatggagactgcggctaccttactcagaagggatatagtgttcgctgcctcgctttatacccagtag

SEQ ID NO: 207390 - DNA, 3741 bp, Artificial Sequence
  Description of Artificial Sequence: Synthetic coding sequence
atgatggagaccgagcggctggtgctgcccccccccgaccccctggatctccccctgagggcagtggagctcggttgtacgggtcattgggagctactcaacctcccaggggccccggaaagcagcctgccccatgggcttccaccttgcgctccagacctgcaacaggaggccgagcaattattccttagttcccctgcttggctgccccttcacggagtggagcatagcgcccgcaagtggcagcggaagaccgatccatggtccctcctagcagttttgggagctccggtaccctctgatctgcaggcccagcgccatcccacgacaggacagatcctgggatataaggaggtattgctggaaaatactaacttgtccgctaccacgtctctgagcctgcgaaggccacccgggcctgccagccagtctttgtggggtaatcccacccagtatcccttttggcccggcggaatggacgagcctaccatcacagacctcaacacgcgggaagaagctgaggaggaaatcgactttgagaaagacttgctgacaattcctccaggctttaagaagggtatggatttcgctccaaaagattgcccgacaccagcccctggcctattgagcttgtcttgcctcctggagcccctggacctgggggggggggacgaagacgagaatgaagcagtcgggcagccgggaggccctcgcggtgatacagtcagcgcctcaccctgcagcgccccactcgcccgtgcatcctctctggaggatctggtcttgaaagaggcaagtactgccgtgtctacacccgaggccccagagcctcccagccaggagcaatgggcaatacctgtagacgccacaagccccgtgggtgatttctataggctgattccacaacctgctttccaatgggcatttgagcctgacgtgtttcaaaagcaggccatcctacacctcgaacgtcatgactccgtcttcgtggcggcccacaccagcgctgggaaaacagtggtcgctgagtacgcaatcgcgctggctcagaagcacatgacgcgcacgatctacactagcccgatcaaggccctatccaaccagaaattcagagactttcgtaacactttcggcgacgtgggactgcttactggtgatgtacaattacacccagaggcctcctgcctcattatgacaacggaaatactcagatccatgctatatagcggatctgatgtgatccgggacttggagtgggtgattttcgacgaggtacattacataaatgacgtggagagaggcgtcgtctgggaggaagtcctcattatgctccccgatcatgtatctattatacttctgtccgccactgttcctaacgcactagagtttgcagattggattgggcggctaaagagaaggcaaatatacgtcatcagtaccgtcactcggcccgtgcctctggagcattacttgtttactggaaattcatccaaaactcagggtgagctgttccttctgctagattcccggggcgccttccacacaaagggctattacgccgctgtggaagccaagaaagaacgaatgtccaagcatgctcaaacctttggcgccaaacagcccacacatcagggaggcccagctcaggaccgcggggtatacctttcattgctggcttcactgagaacgagggctcagctgccagtcgtggtgtttacttttagcagaggcagatgtgatgaacaagcgagcggactgacatccctcgaccttactacgtcttctgaaaaatccgaaatccatcttttcctgcagagatgtctagccaggttgaggggctcagacaggcaactgcctcaggtgctgcatatgagcgagttacttaaccgaggtctgggtgtgcatcattccggaatcctccctatcctgaaggagatcgtcgaaatgctcttttctaggggtctggtaaaggtgcttttcgccacggagaccttcgccatgggcgttaacatgcccgctaggacagttgtcttcgactccatgaggaaacacgatggctcaacattccgcgacctgctgccgggtgaatatgtgcagatggccggccgcgctggtaggcgaggcttagaccccactgggacagttatcttactttgtaagggaagggtgccggagatggcagatctccatcgcatgatgatgggcaaaccgagccagcttcagagccagtttagactgacatatacaatgattcttaatttgctgcgggtggatgcgctgagggtggaggatatgatgaagagatcattcagcgagtttccttccaggaaggattctaaggcccacgaacaggccctggctgagctgacgaagcggctgggggcactggaggagccagacatgacaggacagttagtcgatctacccgaatattattcttggggcgaggaactgactgaaactcaacacatgatccagcgaaggatcatggagagtgttaatggcttgaagagcctgtcggccggacgtgtggtggtggtgaagaaccaggaacaccacaatgccctgggtgtgatcctccaagtctcaagtaattccacttctcgagtgtttactacacttgtgctgtgcgataagcccctgagtcaggatccacaggaccgtggacctgcaacagccgaggtcccatatcccgatgatctggtggggttcaagttgttcctgcccgagggcccgtgcgaccacacagtggtgaaactgcagccgggtgacatggctgcaatcaccaccaaagtgctgagggtgaacggcgagaaaatccttgaggatttttcaaagcgtcagcagcctaagtttaagaaagaccccccactcgccgccgtcacgaccgcagtgcaggagctactacggttggctcaggcacaccctgcgggcccgccaaccttggatcctgtgaacgatctgcagttgaaggatatgtccgtggttgagggcggtcttagagcacgtaagctggaggaactcatccaaggcgcccagtgcgtgcacagcccgagatttccggctcaatatttgaaactccgagagcgcatgcagattcagaaggaaatggaacggctgcgatttttgttgtcagaccagtccctgctcctgcttcccgaatatcaccaaagagtggaggtgcttagaaccctcgggtacgtggacgaggcaggcactgtaaagctcgctggcagagtggcatgcgccatgagcagccacgaacttctcctgactgaactcatgtttgataacgctttgtctaccctgcgaccagaggagattgccgctctgttgagcgggctcgtgtgtcaatcccctggtgacgccggagatcagctgccaaatactttaaaacaggggattgagcgtgtgcgcgccgtcgccaaaaggattggcgaggtgcaggtagcgtgcgggctgaaccagaccgttgaagaattcgttggcgagctgaactttggcttggttgaagtggtatacgagtgggcgcgcggcatgccattctcagagctggctggcctgagtggcacacctgaaggattagtggtgagatgcatacaaagactggctgagatgtgcaggtccctacgaggagctgccagactcgtgggtgagcctgtgctcggcgctaagatggaaactgccgcaaccctcttgcggcgagacatagtgttcgctgcatcactttatactcagtag

SEQ ID NO: 207391 - DNA, 3267 bp, Artificial Sequence
  Description of Artificial Sequence: Synthetic coding sequence
atggacgagcccaccatcaccgacctgaacacccgggaggaggccgaggaagagatagactttgagaaggacctccttaccataccccctgggtttaagaaggggatggactttgcgcccaaggactgccctacccccgcaccaggacttctatccctctcctgcatgctggagccgctagacctgggaggaggcgatgaggacgagaacgaggctgtgggtcagccaggcgggcctagaggagatacggtatccgcttccccctgctccgcccccctggcaagagcttcttccctcgaggatctggtcctgaaagaagcctctaccgcagtgtccaccccggaggcccctgaaccccctagccaggagcagtgggcgatccctgttgacgccaccagccctgtgggcgatttttacagactcattccccaaccagcctttcagtgggcattcgagcccgatgtctttcagaagcaagcaatcctgcacctggaacgccacgattcagtgttcgtggccgcccatactagtgctggcaaaaccgttgtcgctgaatacgcaattgccctggctcagaaacacatgactcggacaatttacacctctcctattaaggctctgagcaaccaaaagttcagagactttcggaatacttttggggatgtggggctgttgaccggcgacgtccagttacaccctgaagcgagctgcctcataatgaccacagagatcttaagatccatgctgtactctggatccgatgtgatcagggacctggaatgggtcatcttcgatgaagtccactacatcaacgatgtggagagaggcgtcgtctgggaggaagtcttgatcatgctccccgatcatgttagtataatcttgctaagcgccaccgtccccaacgctctggaattcgcagactggatcggtcgactcaagcggcgccagatttacgtgattagcacagtcacaagacccgtaccattggagcactatctgtttacaggcaactcttctaaaacacagggcgaactctttttactgctggacagtaggggggcctttcatactaaggggtactatgctgcggtggaagctaagaaggaacgcatgtctaagcacgctcagacctttggcgcgaaacagccaacccatcagggtggccctgctcaggatcggggagtatatctcagtctgttggcaagtctgcgtacaagagcccagctgccagtggtggttttcaccttctcgaggggccggtgcgacgagcaggccagtggcctgacttccctggaccttacaaccagtagtgagaagagcgagatccacctttttctgcagagatgcctcgcgcggctgcgagggagtgaccggcaattgccccaggtattgcatatgagtgagttgctgaataggggactgggagtccaccactccggtattctgcctattctgaaagaaatcgtagaaatgttgttctctagaggactagtgaaggtgcttttcgccaccgaaaccttcgcaatgggagtgaatatgcctgcacggacagtcgtgtttgattctatgaggaagcatgatgggtcaaccttccgggacctactgcccggcgaatacgtgcagatggctggaagagctggccggagagggctggacccaaccgggacagtgatcctgctgtgcaaaggacgagtgccagaaatggccgatctgcaccgcatgatgatgggaaagcctagccagctgcaaagccaattccgcctgacatacacaatgattctgaatttgctgagagtggatgccttaagggttgaagatatgatgaaaaggtctttctccgaatttccaagtcgaaaagattcaaaggcccatgaacaggcactagctgagctgaccaagcgcctgggagccctcgaagagcctgatatgaccggacagctagtggaccttcctgagtactacagctggggcgaggagttgaccgagacccaacacatgatccagcgccgtatcatggagtccgtcaatgggctaaaaagcctgtccgctggtcgagttgtggtggttaaaaaccaagaacaccacaatgccctcggtgtgattttgcaggtaagttctaactccactagtcgggtctttacaacattggtcctctgtgacaagcccctaagccaggatccccaggatcgtggcccggccactgccgaagttccatatccggacgatctagtgggctttaagctattcctaccagagggaccatgtgaccacaccgtggtgaagctacagcctggagatatggcagctattaccacgaaggtcctgcgagtcaacggcgaaaaaatccttgaggacttcagcaaaaggcagcagcccaaattcaaaaaagaccctccactggccgctgtgaccacagccgtacaggagttactgagactggcacaggcgcatcccgccggaccacctaccctggaccctgtcaatgacctgcagctcaaggatatgtcagtggtggaaggggggctgagggctaggaaactggaggaacttatccagggcgcccagtgcgttcacagtccacgtttcccggcccagtacctcaagcttcgagagcggatgcagatccagaaagagatggagaggcttcggtttttactcagtgaccaatcactcctgctgctccctgaatatcatcagcgcgttgaggttctgcggacgctgggttatgtggacgaggcggggacagtgaaactggccggacgcgtggcgtgcgcaatgtcttcccacgaacttctcctgacggagctgatgttcgacaacgccttgagcacactgagacctgaggaaatcgcagcactgctgtctggcctcgtgtgccaatcacctggcgacgctggtgatcagctgcccaacaccctgaagcaggggatcgagcgcgttcgcgcagtagctaaacgaatcggcgaagtacaggtggcatgtgggctgaaccagacagtagaggaatttgtcggagagctgaacttcggtctcgtggaagttgtctatgagtgggctaggggcatgccttttagtgagctggccgggctgtccggcactcctgaaggcctggtggttagatgtattcagcgcttggccgagatgtgccgctcactgcgaggagcagctaggctcgttggagagcccgtgctcggggccaagatggagactgctgctactcttctgcgcagagacatcgtgtttgctgctagtctgtacacacaatag

SEQ ID NO: 207392 - DNA, 3741 bp, Artificial Sequence
  Description of Artificial Sequence: Synthetic coding sequence
atgatggagaccgagcggctggtgctgcccccccccgaccccctggacttaccattacgtgcagtagaactgggctgtaccggacattgggaacttcttaacctgccgggagcccccgaatccagtctaccccatggcctgcccccatgcgccccagatctccagcaggaggccgagcagctgttcctcagttctcccgcctggctgccactacatggcgtagagcatagtgccaggaagtggcagcgcaagaccgacccttggtctctgctggccgttttgggtgcccctgtgcctagcgatctccaggcgcagaggcaccctactactgggcagattctggggtataaagaagtgttgctggaaaataccaatctgagcgcaaccacctccctgagcctgcgacgccctccggggcctgcctcacaaagtttgtggggcaatccgacacagtatcccttctggcctggagggatggatgagcctacaatcacagatctgaacacgagggaggaagctgaggaagagatcgacttcgagaaagacttgctcactatccccccaggcttcaaaaaaggcatggattttgcaccaaaagactgccccaccccagcgcccggtctattatcattaagttgtatgttggaacctctagatttgggtggaggggacgaggatgaaaacgaagccgtcggtcagcccggtgggcccagaggagataccgtgagcgcttctccctgttccgcacctttagcacgggccagctcactagaagacctggtgctgaaagaagccagcacggccgtgagcacccccgaggcccctgagccacccagtcaggagcaatgggccatccccgtggatgctacatctccagtcggcgacttctataggttgattccgcaacccgcttttcagtgggccttcgaacccgacgtgtttcaaaaacaggcgattttgcacctggagcgccacgactcagtgtttgtggcggcccatacgtcagcaggcaagactgtcgtggctgagtacgctattgcgctggctcagaaacatatgacacgaactatctatacctcaccgatcaaggccctcagtaaccagaagtttcgcgatttccggaataccttcggcgatgtgggcctcttgaccggagacgtgcaattgcaccccgaggctagctgcctcatcatgacaacagagatcctgaggagcatgctctattctggctcagacgtgatccgtgatctcgaatgggtgatcttcgatgaggtgcactatatcaatgacgtggagagaggcgttgtctgggaagaagttctcatcatgttacccgatcacgtgtctatcatcctccttagtgctacagtcccaaatgcactggaatttgcggactggatcggtagattgaaaaggcgccaaatatacgtgattagtacagttacaaggcccgttcccctcgagcactaccttttcacgggtaactcaagtaagacacagggcgagttgttcctgcttctcgatagcagaggggcgttccatacaaaaggctactacgcggccgtggaagcaaagaaagagagaatgtccaagcacgcacagaccttcggcgctaaacagccgacacatcagggtggccctgctcaggatcgaggggtgtacttgagtctccttgcctctttgcgcacaagggcacaattacccgtggtcgtgttcaccttttccagaggacggtgtgatgagcaggcttctggactcacgtctcttgacctgaccaccagcagtgagaagagcgagatccatctctttctccagcgttgcctggctcgcctccggggctccgaccggcagctgccccaagtgttgcatatgagtgagctactgaacagagggctgggggttcaccattcagggattctgccaattctgaaagagatagtcgaaatgttattctcccgaggactcgtgaaagtccttttcgccaccgagacctttgcaatgggcgtcaacatgccagccagaacagtggtcttcgactccatgaggaagcatgatggctcaacgtttagagacctcctgcctggggagtacgtgcagatggcagggagagcgggccgaaggggcttagatcccactgggacggtcatattgctctgtaagggccgggttcccgagatggcagacctacataggatgatgatgggcaagccttcccaacttcagagtcagtttcgtcttacatacacgatgatccttaaccttctccgtgtcgacgccttaagagtcgaggatatgatgaagaggtctttctcagaattcccctcgcgtaaagattcgaaggcccatgagcaggcactggccgaactcacaaaacgcctgggagccctggaagagccggacatgactggacagctggttgacttacctgaatactattcatggggcgaagagttgactgagactcagcacatgatccaacgcagaatcatggaaagtgtgaacggcttaaagtcactgtctgccggcagggtggtagttgtaaagaatcaggaacaccataatgctcttggagtgatcttgcaagtgtcctcaaattcgaccagcagagtatttaccaccttagtgctgtgtgataagcctctgagccaggatccccaagatcggggaccagctacagccgaagtcccataccccgacgatcttgttggcttcaaactattcctcccagaagggccatgtgatcataccgtggtcaaactgcagccaggtgacatggctgctatcaccactaaggtcctgagagttaatggggagaaaattctggaggacttttccaaacggcaacagcctaaattcaaaaaggatcctcccctggcagcggtaacaactgctgtacaagagctgctacgcctggcccaggcccacccagcaggccccccaacactggatcctgtcaatgatttacagcttaaggacatgtcggtggtggagggggggctgagagcacgtaagctggaggagttgattcagggggcccagtgtgtgcattctcctaggttcccggctcagtaccttaaactccgggaacgtatgcagattcaaaaagagatggagaggctgcgcttcctcctctcggatcagagtttgctgttgttacccgagtatcaccagcgcgtagaggtgctccgaacgttggggtacgtggatgaagccgggactgtcaaattagccggacgcgtggcatgtgcgatgtcatcgcacgagctgcttctgacagagctcatgtttgataatgccctgtccaccctgaggcctgaagagattgctgccctcctaagcgggctggtgtgccagtctccaggtgatgccggggatcagctgccgaatactctgaaacagggaattgaaagggtgcgggctgttgcaaagcgaatcggtgaggttcaggttgcctgtgggttgaaccaaacagtggaagagtttgtcggcgagcttaactttggcctagttgaagtcgtatatgagtgggcacgggggatgccattttccgagctggccggcttgagcggtacacctgagggccttgtcgtaagatgcatccagagactggcggaaatgtgccggagtctcaggggcgctgccaggcttgtcggtgagcccgtacttggcgcaaagatggagacggcagcaacgttgctgcgcagggacatcgtcttcgcggcgtccctgtacacccaatag

SEQ ID NO: 207393 - DNA, 3162 bp, Artificial Sequence
  Description of Artificial Sequence: Synthetic coding sequence
atggacttcgcccccaaggactgccccacccccgcccccggcctgttgagcctcagttgtatgctcgagccattggacttgggcgggggggatgaggacgagaatgaggcggtagggcagcccggaggaccccgtggcgatacagtgtccgcatctccatgcagcgcacccctagcccgtgccagctctctcgaagacctggtcttaaaagaagcttcaaccgcagtcagtacacctgaggccccagagccacctagtcaggagcagtgggctattcccgtagacgcaacaagtcccgttggcgacttctatcgtcttattccccaaccagcatttcaatgggccttcgaaccagatgtgtttcaaaaacaagcaattctccatttggaaaggcacgatagcgtttttgtggccgcgcatacttcagccggaaagaccgttgtcgccgagtatgcgatcgccctggctcaaaagcatatgacgaggaccatatatacaagtcccataaaggcactctctaatcagaaattcagggacttccgtaacacgtttggcgacgtgggactcttaacgggtgatgtgcaattgcatcctgaggcttcctgcttaatcatgacaactgagatcctgcggagcatgttgtattctggatccgatgtgataagagatctggaatgggtgatctttgacgaagtccactatatcaacgatgtcgaaagaggagtggtgtgggaagaagtccttatcatgctcccagaccacgtgtctatcatcttactgtctgctaccgtgcctaatgcacttgagtttgctgattggatcgggcggctgaaacgacgccagatttatgttatctcaaccgtaacacggcctgttccattggagcattacctcttcacagggaattcaagtaaaacacagggcgagctgtttctgctgctggacagccggggcgcgttccatactaagggatactacgccgctgtcgaggctaagaaggagagaatgtcaaagcacgctcagaccttcggcgcaaagcaacccacacaccagggcggaccggctcaggatcggggcgtttatttaagcctcttggcttcccttagaacgcgagcccagctccccgtcgtggtgttcactttctccaggggcagatgtgacgaacaagcatccggactcacaagtctcgatttgacaacctcgtccgagaaaagcgagattcacctattccttcagaggtgtctggcgagactgcgcggaagcgatagacagcttccccaggtgctccatatgagcgagcttttgaataggggattgggcgtgcaccattctgggatcctccccattctgaaagaaatcgttgagatgcttttttcacgcggtctcgtgaaggttttgttcgctaccgaaacctttgccatgggagtcaacatgccagccaggacagttgttttcgactcgatgcgcaagcatgacggcagtacctttcgtgatctgcttccgggcgaatacgtacagatggccggcagagcaggccgcagagggctggatccgaccggcaccgtgatcttactgtgtaagggaagagttcctgagatggccgatctgcatagaatgatgatgggtaaacccagccagctccaaagccaatttcgcttgacttacaccatgattctcaatctgctccgagtcgatgctttacgggttgaggatatgatgaaaagatccttttccgagttcccgtctcgtaaggatagcaaagcgcatgagcaggctctcgccgaacttactaaacgtttaggagccctcgaggaaccagatatgactggacagcttgtggacctgcccgaatactatagctggggtgaagagttaaccgaaacccagcacatgattcagcgacgcatcatggagtcggtgaatggcctaaaaagcctctccgcggggagggttgtggtagttaagaaccaggagcaccataatgccctgggggtaatccttcaggtctccagtaactctacaagccgagtcttcactaccctggttctatgcgacaaacccctgtcgcaggatccccaagacagagggcctgctaccgcagaggtgccataccctgatgatctggtgggctttaaattatttttaccagagggcccttgcgaccatacagttgtgaagttacaacccggggacatggcggccattaccacgaaggtacttcgagttaacggggagaaaattttggaggattttagtaaacgccagcaaccaaagttcaaaaaggatcccccgctagctgccgtgaccactgcagttcaggaactccttaggctggcccaggcacatcccgccgggccaccaactctggacccagtcaatgatctgcagcttaaggatatgagcgtcgtcgaaggtggactgagagctagaaagctggaggagctaatccaaggagcccaatgtgtccattctccacggtttccagctcagtacctcaagctccgggaacggatgcagatccagaaggagatggagcgcctgcgcttcctgctgtctgatcaaagccttctcttgttgccggaataccatcagcgggttgaagtcctacggacactggggtacgtggacgaggccggcaccgtcaagttggcaggccgggtcgcctgcgccatgagttcacacgaactgctcctgaccgaactgatgttcgacaacgccctttcaactcttcggccagaagagattgccgccctgctttcaggtctggtgtgtcagtcccccggcgacgctggcgatcagttgcccaacactctcaagcagggaatagagcgcgttagagcagttgccaagcgcatcggcgaggtgcaggtagcgtgtgggctgaaccagactgtcgaagaattcgtgggcgagttgaacttcggcctcgttgaggttgtttacgagtgggcccgcgggatgccattttccgaactggctgggctgagcggcacacccgagggattagttgtgaggtgtattcagcggctggctgaaatgtgtagaagcctccgtggggcagcacgcctggtaggtgaacctgttcttggtgcaaagatggaaaccgcagccacccttctgcgccgggatattgtgttcgcggccagcctctacacccagtag

SEQ ID NO: 207394 - DNA, 3162 bp, Artificial Sequence
  Description of Artificial Sequence: Synthetic coding sequence
atggacttcgcccccaaggactgccccacccccgcccccggcctgttatctctttcctgtatgctcgagcccctcgacctgggtggaggggacgaggacgagaacgaagccgtgggtcagcccggtgggccacggggagacacggtgtcagcttcaccctgttcagccccattggcaagggcatccagcttagaggatctagtgctgaaggaagccagtactgcagtatcaactcctgaagctcccgaacctcctagtcaagaacagtgggctatacctgtggatgcaacgagtcctgttggagacttctatcggctcatcccacagcctgccttccagtgggcatttgagcctgacgtgtttcagaaacaagcaatacttcacctggagaggcacgactcagtattcgtggctgcccatacatccgccgggaaaaccgtggtagccgaatatgcgattgcgttggcccagaagcatatgacccgcacaatctacacatctccaataaaggccctgtccaatcagaaattccgagactttcggaacacatttggggatgtaggtctgctaactggggacgtacagctgcatcctgaagcatcgtgcctgattatgactaccgagattctccgcagtatgctatattctggcagcgacgtgatccgcgacctggagtgggtgattttcgacgaagtgcactatatcaatgacgttgagaggggcgtcgtttgggaggaagtcttgatcatgttgccggatcatgtctctatcatcctgcttagtgcaaccgtgcctaacgctcttgaattcgccgactggatcggacggttgaaaaggaggcagatttatgtcatctcaactgtcaccaggcctgtcccactagagcactacctgtttactgggaacagtagtaaaacgcaaggcgaactgttcctcctattggacagtcgtggggcatttcacactaaggggtattatgcagcagtggaagctaaaaaggagcgtatgtctaagcatgcgcagacttttggcgccaaacagcccacccatcaaggcggtccagctcaggataggggtgtgtatttaagccttctggcatctcttcgtacaagggcgcaactccccgtggtggtctttacattctctcggggaagatgtgatgaacaggccagtggcctgaccagcctcgaccttactacttcatctgaaaaatcagaaattcacctgttcctacaacgctgccttgcccggttgagagggtccgatcgccagcttccccaggtgcttcatatgtcggaactgctgaatagaggcctcggggtgcaccattctgggattcttcctattctgaaggagattgtggaaatgctcttttctcgcggactcgtgaaggttctatttgcaactgagacctttgcaatgggggtcaacatgcccgcgcggacagtggtcttcgattccatgaggaaacacgatggttctacattccgcgaccttctccccggagagtatgttcaaatggcaggccgggccggccggcgcggactggatccgaccggtaccgtcatcctactgtgtaaaggaagggtccccgagatggccgacctgcacagaatgatgatgggtaaaccatcccagttgcaatcccaatttagactcacatacacgatgatcctgaacctgctcagggtcgatgcactccgggtcgaggatatgatgaagcgctcgtttagcgagtttccttcccggaaggacagcaaagcacacgagcaggctctggctgaattgaccaagcgcctcggtgccttagaagagccagacatgaccgggcaactagtggacctgccagagtattactcttggggcgaggaactcacagaaacccagcatatgatccaaagacggattatggagtctgtgaatgggcttaagtctctctctgctgggcgggtggtagttgtcaaaaatcaggagcatcataatgctttgggcgtgatcctacaggtgtcttccaactcaacgtcgcgtgtctttaccactctggtgctgtgtgacaagcccctgtctcaggatccccaggatcggggcccagccacggctgaggtcccttaccccgacgacctggtgggcttcaagttgttcttgccagaaggaccctgcgaccatacagttgtcaaacttcagccgggggatatggcagccattaccactaaggtgctcagagtgaacggagagaaaatcttggaagacttttccaaacgccagcaaccaaagtttaagaaagacccacccctggcagcagtgactacagccgttcaggaacttctgagactggctcaggcccacccggcaggcccccccactctcgacccagtgaacgacctccagctgaaggacatgtcagtagtcgagggcggtctcagagccaggaagttggaggagctgatccagggcgcacagtgcgtacacagccctcgctttcccgcacagtatctcaagctgagagagcgaatgcaaatccagaaagagatggagcgtctgagattcctactcagcgaccaaagcttgctcctgctgcctgaatatcatcagagggtcgaggtgcttcggacccttggctacgtggatgaggcaggaaccgtgaagctggccgggagggtggcctgcgcgatgagttcccacgaactcctcctcaccgagctgatgtttgataacgcattgtctacgttgcggccagaagagatcgcagccctcctaagtggactggtttgccagtccccaggagacgcaggggatcagctgccaaacaccctgaaacagggtattgagcgagttcgggcggtcgctaaaagaattggggaggtgcaggttgcgtgtggtctgaatcagactgtggaggaatttgtcggcgaattgaatttcggacttgtggaagtcgtttacgaatgggcacgggggatgccgttttctgagctggccggattatcagggacccccgagggcctcgtggtgcggtgcattcagcggttggcagaaatgtgtcgcagccttagaggggccgccaggcttgtaggcgaacctgtactgggcgctaaaatggaaaccgctgccactttgctaagaagggacatcgtctttgccgcttctctgtacactcagtag

SEQ ID NO: 207395 - DNA, 693 bp, Artificial Sequence
  Description of Artificial Sequence: Synthetic coding sequence
atgatggagaccgagcggctggtgctgcccccccccgaccccctggatttaccactacgggccgtggagctggggtgtaccgggcactgggagctgctgaacctacccggagcccccgaatcatcattgcctcacggtctgcccccatgcgcaccagacctccagcaggaagctgaacaactgtttctcagctcacctgcttggctacctctccacggtgtcgaacactcagcccgtaaatggcagcgaaagaccgatccctggtctctgctcgccgttttgggagcgccagtgcccagcgacctacaggcccagaggcatccgacaactggccaaattctaggatacaaagaggtcctgctcgaaaataccaacctaagtgcaactaccagtctgtccctccgaagacctccaggtcctgcatcccaatctttgtgggggaacccaactcaataccctttctggccagggggcatggacgagcccactattacagatcttaacactagggaagaggcggaggaggagattgatttcgaaaaagacttacttaccatacctcctggattcaagaaaggcatggacttcgcacctaaaggcagcgtgcactcctgcatacaccccagaggcccaagggcatccatctccggggcagtgggacacccctgtggccggcacctgccgtgctggtag

SEQ ID NO: 207396 - DNA, 3267 bp, Artificial Sequence
  Description of Artificial Sequence: Synthetic coding sequence
atggacgagcccaccatcaccgacctgaacacccgggaggaggccgaagaggaaatcgactttgaaaaggacttgctgactattccccccggcttcaagaaggggatggatttcgctccaaaagactgtccgacacccgccccaggattgctgagcttgagctgtctgctcgagccccttgatttgggcggaggggatgaagacgaaaacgaggcagtcggacagcctgggggcccaagaggcgacactgtatcagccagtccctgcagtgcaccgctggcacgcgcatcctctctcgaggaccttgttctcaaagaggctagcactgccgtcagcactcccgaggcccccgagcccccttcgcaagagcagtgggcaataccagtggacgccacttctccagttggtgatttctatcggttgatcccccaaccagcctttcagtgggcgttcgagcccgacgtttttcagaaacaggctatcctgcatctggagcgccacgacagtgtgttcgttgccgcacacactagtgctgggaagactgtggttgcagagtacgcaatcgcactggcccagaagcatatgacaagaacaatctacacatcgcctatcaaagctttgagtaatcaaaaatttcgggactttaggaacactttcggagatgtgggactactaaccggcgacgtacagctgcatcccgaagctagttgtctcatcatgacgacagaaatcctgagaagcatgctgtacagtggctctgacgtaattagagatttggagtgggtcatatttgatgaggtacattatattaatgacgttgagcggggtgtggtttgggaggaagtgctcattatgctgcctgatcatgtgagcatcatattgttaagcgccacagtgccgaatgccctcgagttcgccgactggatcggacgactgaaacgccgccagatttacgtcatctcaaccgttacgagacctgtgcctctcgagcactacttgtttactggaaattctagtaagacccaaggtgaacttttcctgctcctcgatagccgaggagcttttcacactaaagggtattacgctgccgtcgaggcaaagaaagagagaatgtcaaaacacgcgcagacattcggcgcaaagcaacccacacaccagggtggtcccgcccaggacaggggcgtgtatctgagcctgctggcttccctgaggacacgcgctcagctcccagttgtagtgtttacgttttctagaggaaggtgtgatgagcaagcgtccggacttacgtcactggatctaacaaccagcagcgagaagagtgaaatccacctgtttctccaaagatgcctagctagactgagggggtcagatcggcagctgccacaggtgctacacatgtctgaactgctgaacaggggacttggggtccaccatagcggtattctgcctattctgaaagagatcgtggagatgttattctcacggggactggtgaaggtcctgtttgccactgagacctttgccatgggtgttaacatgcccgctcgcactgtcgtgtttgacagtatgagaaaacacgacggttccacttttagggatctgctccctggggagtatgtacagatggccggtcgcgctggtcgaaggggactggatccaactggaacagtgatcctgctttgtaaggggagagttccagaaatggctgatttgcacagaatgatgatgggtaagccaagtcaactccagagccagttcagacttacatacaccatgatcttaaatttgctgcgcgtggacgcactgcgggttgaagatatgatgaagcgatccttcagtgaatttccctccagaaaggacagtaaggctcatgaacaggctcttgctgagttaactaaacgcctcggcgctttggaggaaccagacatgaccggtcagctggtggatcttcctgagtattatagttggggagaggagctcactgagacccaacatatgatccagcgacggataatggagtctgtcaacgggctgaagtctttgagtgccggtcgcgttgttgtggttaaaaaccaggaacatcacaatgcccttggggttattctgcaggtgagctcgaactcaaccagtagagtttttaccaccctggtgctatgcgataaaccactaagccaagaccctcaggatcgggggcccgccacagcagaagtcccttaccccgacgacctcgtggggttcaaattgtttttaccagagggaccctgcgaccacactgtggtgaaactgcagcctggagatatggccgccatcaccaccaaggttcttagagtcaacggagagaaaatcctcgaagacttctcaaagcgccagcagccaaaatttaagaaagaccctcctctcgccgctgtgactactgccgtccaggagttgctgcgtctcgcgcaggctcacccggccggtccaccaactctggaccccgttaacgatctgcagctgaaggacatgagtgttgttgaaggcgggctgcgggcccggaaacttgaagagcttatccagggagctcaatgtgtccactcgcctcgatttcctgcacagtacctaaaactgcgcgaaagaatgcagattcagaaggagatggagagactccgttttctactttctgaccagtctctgttgctgctgcccgaatatcaccaaagagtcgaagttctccgtacactcgggtatgtcgacgaggctgggaccgtgaagttggctgggcgcgtggcatgtgccatgtcttcccacgaacttctactcacagaacttatgtttgacaatgctttaagcactcttcgcccggaggaaatagctgcactattaagcggtctggtgtgtcagtccccaggcgatgcaggagaccaacttccaaataccctgaagcaagggatcgagagggtgcgagctgtggccaaacggatcggcgaggtgcaggtggcctgcggattgaaccagacagttgaagaattcgtcggcgagctgaactttgggctagtggaggtggtgtacgagtgggccaggggaatgccgttttctgaactcgccgggttgtccgggacccccgaagggctggtagtgcggtgtattcaacggttggcagaaatgtgcagaagccttagaggcgccgcaagactcgtcggcgagccggttctgggagctaaaatggaaacggccgctaccctgcttaggagagacatcgtgtttgccgcttctctctacacgcaatag

SEQ ID NO: 207397 - DNA, 3162 bp, Artificial Sequence
  Description of Artificial Sequence: Synthetic coding sequence
atggacttcgcccccaaggactgccccacccccgcccccggcctgctctccctcagttgtctactagagccactcgacttaggaggaggagatgaggatgaaaatgaagctgttggccagccaggcggccccaggggggacacagtgtctgctagcccttgctccgctcctcttgctcgggcttcttcccttgaggatctcgtgctgaaagaggcaagtacagccgtgtctacacccgaagccccagaacccccaagtcaggagcaatgggccattccagtggacgcaacatctccggtcggggatttttaccggctgattccccaaccagctttccagtgggcattcgaacctgatgtattccagaaacaggccatattgcacctagagagacatgattccgtgttcgtcgccgcgcatacaagcgcaggaaagactgtggtagcagagtacgcaatcgccctggcacagaagcacatgactcggacaatatatacctcccctattaaggccctgtccaatcagaaattccgggactttcgaaacacctttggagatgtgggacttctgacaggtgatgtgcagcttcatcctgaggcgtcctgtctgattatgaccaccgagatcctaaggagtatgctgtactctgggtctgatgtgattcgggatcttgagtgggtaatttttgacgaggtacactatataaatgacgtagagagaggcgtcgtgtgggaagaagttttgattatgctgccggatcacgtgtcgatcatccttctctctgccaccgtgcccaacgctctggaattcgctgattggatcgggcgccttaagcggagacaaatctatgtaatcagcaccgtgacaaggcccgtgcccctggagcattacctctttaccgggaactcgtctaagacacagggtgaactgtttttgctactcgacagtaggggggccttccataccaagggatattatgcagctgtcgaggcaaaaaaggaacggatgtcaaaacatgcccaaacatttggcgccaagcagccgactcaccaaggtgggccagcacaggatcgcggcgtttacttgtccctgctggcaagcctgaggacaagggcgcaactgcccgtggtggtattcacattttctcggggaagatgcgacgaacaggctagcggcttgacctccctcgatttgactactagctcagagaaatctgaaatccacctgtttctgcagcgttgtctggccagactgaggggcagcgacaggcagctgccacaggtgttacatatgtccgagttacttaatcgcgggctcggagttcaccattccggcattctacctatcttgaaagagatcgtggaaatgctattttcccgtgggctcgtgaaggtcttgttcgccactgagacctttgctatgggcgtaaatatgcccgcccggactgttgtgtttgactcgatgcggaagcatgacggatcaacttttagggacctactcccaggcgagtatgtgcagatggctggcagggccggtcgcagggggctggatccaactggaaccgtgattctcctatgtaagggtagggtgcctgagatggcagatttacacagaatgatgatgggcaagcccagccagctccaaagccagttcagactcacctataccatgattctcaatctgttgagagtagacgccttgcgcgtcgaagatatgatgaagaggagcttctctgagttccccagcagaaaggatagtaaggcacacgaacaggctctggctgagctcacaaagcgacttggagccctggaggaacccgatatgactggacagctggtcgatttaccagagtactactcttggggtgaggagttaaccgagacacagcatatgatacaaagaaggattatggaaagtgtcaatggtctgaaaagcttgtccgcaggtcgagtagtggttgtgaagaatcaagagcaccacaatgcccttggggtgattctgcaggtctcttcaaacagtactagtagggtgtttacaacattggtgctgtgcgataaacctctatcccaggatccacaggaccgaggtcctgccactgcggaagtcccataccctgatgatctggtgggcttcaaattgttcctgcccgagggcccttgcgaccacactgtggtcaagcttcagccaggggatatggccgccatcacaacaaaggtgttgagggtcaacggggaaaagattctcgaggactttagtaaacggcaacaacccaagtttaagaaggatccgcctctggccgcagtaactaccgccgtgcaggagctgttgagattggcgcaggcccacccggcagggccgcccaccctcgaccccgtgaatgatcttcagttaaaggatatgtctgtggtcgaaggcggcctgagagcacgtaaacttgaggagcttattcagggcgcacagtgcgtgcactcccccagatttcctgctcagtacctgaagttaagggagcgcatgcaaatccagaaagaaatggaaagactccgcttcttactgtctgaccagagtctgctgctccttcccgaataccatcagagggtggaggtcctgcggactctaggctacgttgacgaggccgggaccgtgaagctggctggccgagtcgcttgcgccatgagctcccatgagctcttgctcaccgagctgatgtttgacaacgccctttccaccctgaggccagaagagatcgcagccctcctcagcggtttggtctgccaatcacctggtgatgcaggcgatcaactccccaatactcttaagcagggcattgaacgtgtccgagctgtggctaagcgcattggcgaagtccaagttgcatgcggtctgaaccaaacagtggaagagtttgtgggggaactaaacttcgggttagtggaggtagtttatgaatgggcaagaggaatgccattttcagaattggcaggtctctctggaacccctgagggtctcgtcgtgcgctgtatacaaagacttgcggaaatgtgccgcagcctcagaggggcagcgcgcttggtcggggagcccgtcttaggagctaagatggaaaccgccgctactctgttaagacgggatatcgtgttcgctgcgtccctatacacccagtag

SEQ ID NO: 207398 - DNA, 2643 bp, Artificial Sequence
  Description of Artificial Sequence: Synthetic coding sequence
atgatggagaccgagcggctggtgctgcccccccccgaccccctggaccttccattgagggccgtcgagctgggttgcactggacattgggagctgcttaatctgcctggtgctccggaatcttcgctaccacatgggcttcccccctgcgcacctgaccttcagcaggaagcagaacagctcttcctttcctccccagcctggcttcctctccacggcgtggagcactctgcacgcaaatggcagaggaaaaccgatccctggtctctactggctgttctgggggcgcccgtaccgtctgaccttcaagctcagaggcacccaacaaccggacagattcttggatacaaagaggtgttattagaacactatcttttcacaggcaatagcagcaagacccagggggagctgtttctcctcctcgactccaggggcgcatttcacactaaaggatactacgccgctgtggaagccaaaaaagaacggatgtcaaagcatgcccagacattcggcgccaagcagccgacacatcaaggcgggcccgcgcaggatagaggcgtgtatctgtcactactcgcctctctgcgcactagagcccagttgcccgtagttgtgttcactttttcgaggggtcggtgcgacgaacaagcctcaggccttacgtcgctagacctcaccacctctagcgagaaatccgagatccatcttttccttcaacggtgtctggcccggttgcgtggatccgatcgccagctgccccaggtgctacacatgtctgaactcttgaatcgcggtctgggcgtacatcattcgggcatcctcccaatcctgaaagaaatagttgagatgttgtttagtagagggttggtgaaggtattgttcgcaactgaaaccttcgccatgggagtgaacatgcccgcccgcactgtggtctttgattcaatgcgaaagcacgatggctctaccttccgtgacctgctcccgggggagtatgtccagatggccgggcgagccggaagaagaggtcttgatcccacgggcactgtcatcctgctgtgcaaaggacgagtgccagaaatggctgacttacacagaatgatgatgggaaagccttctcagctccagtcacagttcagactaacttacacaatgatcctaaatctccttcgggtcgacgccttgcgcgtcgaagatatgatgaaaaggtccttttcagaatttccatcacggaaggatagcaaagcacacgaacaggctcttgccgagctcacgaaacggctgggcgctctggaagaaccggatatgaccggccagctggtagatttgcctgagtactattcatggggcgaagaactgactgagacccagcacatgattcagagaagaatcatggagagtgtgaatggccttaagagcctttctgcaggtcgcgtggttgtagtgaagaatcaggagcaccataatgcactgggagtgattctgcaggtctcttccaattcaacttctagagtcttcacgacactcgtcctatgcgataaaccactgtcacaggatccacaggaccggggaccagctacagcagaggtcccttatcccgacgatctcgtcggcttcaagctgttcttgccagaaggcccttgcgaccataccgtggtgaaattacagcccggggatatggccgccatcaccaccaaagtactaagggttaatggcgagaagatcttggaggactttagcaagcgtcaacagcccaagtttaagaaggaccctccgctggccgccgtgaccaccgccgtgcaggaattgcttcgtttagcgcaggctcaccctgctggccccccaacccttgatccggttaatgaccttcagctgaaagatatgtcagttgtcgaaggggggctgagagctagaaagttggaagaactcatccagggcgcgcagtgtgtgcacagcccccggttcccggctcagtacttgaagctccgcgaaagaatgcagatccagaaggagatggaacggctgcggttcctgctgagtgaccagtctctccttcttttgccagagtatcaccaacgggtagaggtgctgcggactctgggttatgttgacgaagcaggaacagttaaactcgccggtagagtcgcgtgcgcaatgtcctcccacgagctgttgctcacagagctgatgtttgacaatgccctgtctaccctgagacctgaagaaattgccgctctgctgagtgggctggtgtgtcaaagccctggggatgctggagatcagctccccaataccttgaagcagggtatcgaacgagtgagagcagttgccaaacggataggcgaagtgcaggtggcttgtggcctgaaccagacagtcgaagagttcgtaggagagcttaattttggcctggtggaagtagtctacgagtgggctagggggatgcctttctcagaacttgctggtcttagcggcaccccagaggggttggttgtgcgatgtatccagagactggctgagatgtgccggtccctcaggggagccgcccgccttgtgggcgaaccagtcctgggagcaaagatggagaccgctgctacactgttacgacgggatatcgtctttgctgcttccctctatacacagtag

SEQ ID NO: 207399 - DNA, 3267 bp, Artificial Sequence
  Description of Artificial Sequence: Synthetic coding sequence
atggacgagcccaccatcaccgacctgaacacccgggaggaggccgaagaggagattgactttgaaaaggatctacttacaatcccaccaggattcaaaaagggcatggactttgcgcccaaggactgtccgacccccgctccgggcctgttatctttatcctgtctgctggaacccttggatctgggcgggggcgacgaggacgaaaacgaggccgttggacagcccgggggccctaggggcgatacggtcagtgcttccccttgttctgccccgctcgcacgagcttctagccttgaggatttagtgctcaaggaagcgtctacggctgtcagtacaccagaggcacctgagcctccgtctcaggaacagtgggcaatcccagtggacgcaaccagccccgtaggcgatttttatcgactgattccccagccagctttccagtgggcctttgaacccgacgtttttcagaagcaggctatattgcacctggagcggcatgactccgtgtttgttgctgctcatacctccgctggtaaaaccgtggtcgccgaatacgccattgctctggcacagaagcacatgactcggaccatttatacaagccccattaaagcactgtctaatcaaaagtttcgcgattttcgtaatacctttggagatgtgggtcttcttaccggcgatgtacagctgcatcctgaagcatcttgcctcatcatgactaccgagatcctgaggtctatgctttactctgggagcgatgttattcgcgacctggaatgggttattttcgacgaagtgcattacattaatgatgtggagaggggggtagtgtgggaggaggtgctcataatgctaccagatcacgtatccataattctgctctctgcaacagtccccaacgccctcgagttcgccgactggattggcaggctcaaaagacgacagatatacgtgatatcaacggtgacacgtcccgtgccactggagcattacttatttaccggcaacagttctaagactcagggtgaattatttttgttacttgattctcgtggggcgtttcacactaagggctactatgcagcagtggaggccaagaaagaacggatgtccaaacacgctcaaacttttggagcaaagcagcctacacaccagggcggcccagctcaggatcgaggagtttacctgagcctattggctagtctaaggacaagggcacaactccctgtggtggtgttcaccttttctcgcgggaggtgcgatgagcaggccagtggtctgactagcctggacttaaccacttcatctgagaaatctgagattcaccttttcctgcagcggtgtctagcgagactccggggatctgaccggcagctaccccaagtgctgcacatgagcgagcttctcaaccgcggtttgggggtgcatcacagcggcatcttgcctattcttaaggagattgtggaaatgctgttctcccgggggctggtgaaagttctgtttgccaccgaaaccttcgcaatgggggtaaatatgcctgcccggaccgtcgtgtttgatagtatgaggaagcacgatgggtccaccttccgcgacctgctccccggggagtacgtccagatggcagggcgcgctggccgccgaggcctcgatcctacaggcactgtgatcctactctgtaaggggcgtgttccggagatggcagatttgcacaggatgatgatgggcaagccatcgcaactgcaatctcaattccgcctcacctacacaatgatcctgaacctcttgagggtcgatgcattgcgtgttgaagatatgatgaagcgcagttttagtgaatttcccagccggaaagactccaaggctcatgaacaggcgttagccgagcttactaaacgcctgggggccctggaagaacccgatatgaccggccagctggtcgacttaccggagtactatagctggggcgaagagctgacagagactcagcatatgatccagcggcgaatcatggagagcgtgaatggactgaaaagcctcagtgccggtcgagtcgttgtagtcaagaatcaagagcaccacaatgctcttggtgtcattttacaggtcagttctaattccacctctcgagtgtttacgaccctggtgctgtgcgacaaaccacttagccaggatcctcaggaccggggccccgctacagcggaagtcccatatccagacgacctggttgggtttaaactgtttctccctgagggtccatgcgaccacacggtcgtgaaattacagccaggcgatatggcagccatcaccacaaaggtgctgagagttaacggcgagaaaatcctggaggacttttctaagcgacagcagccgaagtttaagaaggatcccccgttggcagcagtgaccaccgcagttcaagagctgctccggttggctcaggctcatcccgcaggccctccgaccctggatccagtcaatgacctccagctcaaggatatgtccgttgtggagggtggcctgcgggccagaaagctggaagaactgattcaaggcgcacagtgcgtccattccccccggttcccagcacagtacctgaagcttcgggagcgaatgcagatccagaaggaaatggagcgcctgcgctttttgctttctgaccagtcattgcttctgcttcctgaataccatcaacgcgtcgaagtgttgcgcaccttgggctacgtggatgaagcaggaacagtgaagctcgcagggagggtagcctgtgccatgtctagccacgagcttttgctaactgagctgatgtttgacaatgccctcagcacattgcgtccggaagaaatcgctgccctgctttccgggctcgtttgtcagtcccccggggacgccggtgaccagctcccgaacacactgaagcagggcatcgagagggtcagggccgttgccaaacgcatcggtgaagtccaggtagcatgcggcttgaatcagaccgtagaagagttcgtgggagagctgaactttggcttggtcgaggtggtgtacgagtgggcccgggggatgccatttagtgaactggccggcctgtcaggtacccccgagggacttgtggtgagatgtatccagcgcttggctgagatgtgtaggagcttacggggtgccgctaggctggtaggcgaacctgtgttgggcgcaaagatggagacagctgcgaccctactccgccgcgatatcgtctttgccgccagcctctatactcaatag

SEQ ID NO: 207400 - DNA, 2643 bp, Artificial Sequence
  Description of Artificial Sequence: Synthetic coding sequence
atgatggagaccgagcggctggtgctgcccccccccgaccccctggacctgcctttacgggcagtggaactgggttgcacaggccactgggagctcctgaacctccctggggcccctgaatcaagtttgccccatggcctaccaccctgcgctcccgatttacagcaagaagccgagcagctgttcctttcttctcctgcttggctgcctcttcacggagttgagcactccgcacggaaatggcagaggaaaaccgacccctggagtctgctggcagtgctgggcgctcccgtccccagtgacctccaggcgcagaggcatcctacaaccggacagatcctgggctacaaggaagtcctcttagaacactacctttttaccggaaacagttccaaaactcaaggcgagctgttcctgctcttagatagccggggtgcatttcacaccaaagggtactatgctgcggttgaagcaaagaaagaaaggatgtccaaacatgcccagaccttcggggccaagcaacccacacaccagggtggtcccgcacaggacagaggggtgtatctctcacttctggcctctctgcggacccgggcccagttgcccgtggtggtgttcacatttagcagaggtaggtgtgatgaacaagcatcgggcctcacaagccttgacctcactaccagctcagagaagtccgaaatccatcttttcctgcagcggtgtctggcacgtctgagaggtagcgatcggcaacttccgcaggttctgcatatgtctgagctgcttaacagagggctgggagtgcaccatagcggcatcttacccattctgaaggaaatcgttgagatgcttttctcaaggggactcgtgaaggtcttatttgccaccgaaacttttgccatgggcgttaacatgcctgctcgcactgtggttttcgactctatgcgtaagcacgacggatccacattccgcgaccttttacctggggagtacgtacaaatggccggtcgggcaggtaggagggggctcgacccaaccggcaccgttattctcttatgcaagggcagagtgcctgaaatggctgaccttcaccgcatgatgatgggcaagccaagtcagcttcaatcccagttccggctcacctacactatgatcctcaatctattgagagtggatgcactgcgcgtagaagacatgatgaagcgcagtttctcagaatttccttccaggaaagactctaaagcacatgaacaggctctggcagaattaactaaaaggttgggggccctggaagagcctgacatgacgggccaattagtcgacctgccggagtattactcttggggcgaggagctgactgaaacccagcacatgatccagcgtagaattatggagtctgtgaacgggctgaaatcactgagcgccggccgcgttgtcgtagtcaaaaaccaggaacaccataatgcattaggcgttatcctgcaggtctcgtcaaattccacctctcgggtatttacgacactcgttttatgtgacaaaccactctctcaggacccgcaggatcggggtccagccacagccgaagtgccttacccggacgacctcgtaggctttaagctatttctacctgagggaccatgcgatcatacggtggttaaattgcagccaggggacatggccgctatcacaactaaggtcctaagggttaacggggaaaaaatcctggaagactttagcaagcgacagcagcccaagtttaaaaaggatccgcccctggctgctgttacaacagccgtgcaggagttgctgcggctggcacaggcacaccctgcagggcctcctaccttagatcccgtgaatgacttacagcttaaggacatgtctgtggtggagggtggcttaagggcccgcaaactggaggaactcatacagggggcccaatgcgtgcactcccctcggttccctgcccaatacctgaagcttagggagaggatgcagattcagaaggagatggagaggttacgcttcctgttgagcgatcaaagcctgcttctcttaccggaataccaccaacgcgtggaagtgctgcgcactcttgggtatgttgatgaggctggaacagtgaagttagcgggccgagttgcctgtgcgatgagtagccatgagctgttattgactgagctgatgtttgataatgccctgagcaccctgagacctgaggagatcgccgcactcctatccggactcgtttgtcagagccctggggacgcaggcgaccagcttcccaatacattgaaacaggggatcgagcgtgtgcgagctgttgccaaacggattggcgaggtgcaggtggcttgcggactgaaccagacagtggaagaattcgtgggcgaactgaactttggcctcgtagaagtcgtctacgagtgggctaggggcatgccttttagtgagttagcaggtttgtccggaacacccgaaggtctcgtggttcgctgcatccaacgcctggcagagatgtgccgttccctgcggggcgctgcccggcttgtcggagagcctgtgctgggcgccaaaatggagactgcggccacattgctccgccgcgacatcgtgttcgcagccagcttgtatacccagtag

SEQ ID NO: 207401 - DNA, 2643 bp, Artificial Sequence
  Description of Artificial Sequence: Synthetic coding sequence
atgatggagaccgagcggctggtgctgcccccccccgaccccctggaccttccactgagggccgtggaactcgggtgtacaggccattgggaacttctgaatctgcccggagcccccgagtcatctcttccccacggcctgcctccctgtgcccctgatctgcaacaggaggccgagcaactgttcctgtcctctcccgcctggctgcctttacatggcgtggaacattccgccaggaaatggcagcgcaaaaccgatccatggagcctgctggccgtgctgggcgctcccgttcccagtgatctgcaggcacagagacatcctactacaggtcagatcctgggctacaaggaggtgctgctggagcactacctcttcaccgggaactcatccaagacccaaggagaattatttcttctgcttgatagccgcggcgcgttccacactaaaggctattacgctgcagtcgaggcaaaaaaagagcgaatgagcaagcacgcacagactttcggagccaagcagcctacccaccagggcggcccggctcaagacagaggggtatacctctcacttttagcatcattgagaacccgcgcccagctgcctgtcgtcgtttttacgttctcccgcggaagatgtgacgagcaggcttctggcctgactagtttagacctgactacaagctcagagaagtctgaaatccacctgttcctccagcgctgtctagcgcggctgcggggaagtgacagacaactaccgcaggtgctccatatgagcgagctgctcaatagaggtttgggcgttcatcacagcggcatcctgcccattctgaaagagattgttgagatgctatttagtcggggactggtcaaggtgctctttgccacagagaccttcgcgatgggggtgaatatgccagcgcgcacagtcgtcttcgactctatgagaaaacacgatggctctacttttcgtgacctgctgcccggcgaatatgtgcaaatggctggtcgagccgggcgtcggggtctcgaccctaccgggacagtgattctcctgtgcaaggggcgcgtgcccgagatggcagacctgcacaggatgatgatgggcaaacccagccagctgcagagccagttccgtctgacttacaccatgatattgaacttactgagagtcgacgccctcagagtggaagacatgatgaagcgttcttttagcgagtttccttcccggaaggactcaaaggctcacgagcaggctctggcggaactgaccaagcggctaggagccctcgaggagccagacatgaccgggcagctggtggacctgccagaatattattcctggggagaggagctgaccgaaacccagcacatgatccagcggcgaatcatggagtccgtgaacgggctgaagagtctctccgccggcagagtggtagtcgtcaaaaaccaagagcatcataatgccttgggtgtcatcctgcaggtctcaagcaatagtacaagccgcgtgttcacgaccctggtcctgtgcgacaagccactgagtcaggacccgcaggaccgtggtcccgctacagctgaggtgccgtaccctgacgacctggtaggctttaagctcttcctccccgaaggaccatgcgatcataccgtcgtcaagctgcagcctggggacatggccgctataactaccaaggtgctgagggtgaatggagaaaaaatcctggaagatttctcaaaacgccagcaacctaaattcaaaaaggatccgcctcttgccgccgtcacaacggccgtgcaggaactgctgagattggcccaggctcaccccgccgggcctccaacactggatccagttaacgatctgcagctcaaggacatgtccgtagtggaaggaggcttgagagcgaggaagttagaggagctgattcagggcgcgcaatgtgtacacagtccaagatttcccgcccagtacctcaaactgagagaaagaatgcagatacagaaagagatggagcggttgcggttcctccttagcgaccagagtctgctgctcctaccagagtaccaccagcgcgtggaggtcttgcgaactctgggttacgtggatgaagccggcactgtgaaattggccgggcgggtggcctgcgctatgtccagccacgaattgctgttgaccgaactgatgttcgacaacgccctgtcaaccctaagacctgaagagatagctgccttattgtcaggactggtctgtcagtctcccggcgacgcaggggatcagctcccaaacacacttaagcagggaatcgagcgcgtccgagcagtagccaagcgcatcggtgaggtccaggtggcttgtggcctcaatcaaacggtcgaagaatttgtaggcgagttaaactttggtttggtcgaggtcgtgtatgagtgggcccgcgggatgccgttctcggagctggcaggactgtcaggcacacctgaaggtctggtggtaaggtgcattcagcgtttggctgagatgtgccgctcattgcgtggggccgcacggctggtgggggagccagtgctaggggccaagatggaaaccgccgcaaccctgctaagacgggacatcgtgttcgcggctagcctctacacccaatag

SEQ ID NO: 207402 - DNA, 693 bp, Artificial Sequence
  Description of Artificial Sequence: Synthetic coding sequence
atgatggagaccgagcggctggtgctgcccccccccgaccccctggacctgcctttacgcgcggtggagctgggctgcacgggtcactgggagctgttgaacctgcctggcgctccagagtcgtcactgcctcacggactgcctccctgcgcccccgatttgcaacaggaagcagagcaactgtttctgagttcacccgcatggctgccattgcatggcgtggagcactctgcgcgaaagtggcagcgaaagacagacccatggagtctgctagctgtgctcggcgcgcccgtaccctccgatcttcaggcacagagacatcctacgacaggccagatcctggggtataaggaggtgctgctggagaacacaaacctaagtgcgacaacctcactttcgctccggcggccaccgggtcccgcatctcagagcttgtggggaaacccaacacagtatcctttctggcccgggggcatggatgagcccactattactgacctgaatacccgggaggaggcagaagaggagatagatttcgaaaaggatttactgacaatccctccgggcttcaagaaaggcatggacttcgcccctaaagggtcagtgcacagttgtattcacccgcggggacccagagcttccatcagcggggccgtgggacatccctgcggccgccacctgccctgttggtag

SEQ ID NO: 207403 - DNA, 2643 bp, Artificial Sequence
  Description of Artificial Sequence: Synthetic coding sequence
atgatggagaccgagcggctggtgctgcccccccccgaccccctggaccttccactgcgggccgtcgaacttgggtgtactggtcactgggagttactcaatctgcccggagcaccagagagtagcctgcctcatggattgccaccttgtgctcccgacctgcagcaggaggcagagcaactgtttttaagctccccagcttggctgcctctgcacggcgtggaacactccgccagaaaatggcagcgcaagactgatccctggtcactgctcgctgtcctgggtgcccccgtcccaagtgacttgcaagcgcagcgacaccccactaccggacagattctcggatataaagaggtgctcctagaacattatctatttacaggcaactcctcaaaaacacagggcgaactattcctgctgctagattcccggggggcgtttcacacaaaaggctactacgcagctgtggaagccaaaaaagagcggatgagtaagcatgctcagacattcggagctaagcagcctacacaccagggaggaccagctcaggaccgcggcgtttatttgtctcttttggcttccctgcgaactcgggctcagctcccagttgttgtgtttacttttagccgcggccggtgtgacgaacaagcgtccggactgacctcactcgacttaaccacaagctccgagaagtccgagatccacctgtttctgcagcgatgcctcgcgcggctgagaggctcagatcgccagctgccacaagttctccacatgtcagagctgctaaatcgcgggctcggggtgcatcattctggaatccttccgattctcaaggagattgtggagatgctgtttagtagagggctggtgaaggtcttgtttgcgacggagacgttcgcaatgggcgttaacatgccagcacgcactgttgtgttcgacagtatgcggaagcatgatggatctaccttccgcgatctgttgcctggagagtatgtgcaaatggctggccgagcaggaaggcggggcctcgatccgaccggtacagtaatccttttatgcaaaggtcgagtgcccgagatggctgatctgcatcgtatgatgatggggaagccaagccagctacagagtcagtttaggcttacatacacaatgattctgaacctgctgcgggtcgatgccctacgtgttgaggacatgatgaagcggtcctttagcgagtttccctctaggaaagactctaaggcccatgagcaggcgctggctgagttgaccaaaaggctgggagctttagaggaaccagatatgaccggacagctcgttgatcttcccgagtactatagctggggcgaggaactaactgaaactcagcatatgattcagaggcgaatcatggagagcgtcaacggccttaaaagtctgtcagctggacgggtggtagtcgttaagaaccaggagcaccacaatgctctgggtgtgattctgcaggttagttcaaattctacatcacgggtgttcactactcttgttctatgcgataagccattgtcacaggaccctcaggataggggtcctgctaccgccgaagtaccgtacccagatgaccttgtggggtttaaactcttcctcccggaggggccctgcgaccacacagttgtcaagctgcagccaggcgatatggcagctattaccactaaagttctgcgcgttaatggtgagaagatactagaagatttctctaagcgacaacaacctaaattcaaaaaagacccaccgttagctgctgtgactaccgctgttcaagaactgctccgacttgcccaggcccatcctgccggaccgccaaccctcgaccccgtgaacgacctccaactgaaagatatgagtgtggtggaaggcggcctcagagccagaaagttggaggaacttatccaaggcgcgcaatgcgtacattcaccccgcttccctgctcagtacttgaagcttagagagcgaatgcagatccagaaagagatggagcgactgcgattcctactgtccgaccagagcctgctgcttctccccgagtaccaccagcgggtggaagtgctgaggacacttggatatgtagatgaggcaggaactgtgaagttggccggaagagtggcctgcgcgatgtccagtcatgagcttttactcactgagctgatgtttgacaacgcactcagcaccttgagaccagaggaaatcgctgcccttctgtccgggctggtctgtcaatctccgggcgacgccggggatcagctgcccaacacgctgaagcaggggattgagagagtgcgtgcagttgctaaaaggatcggtgaggtgcaggtagcctgcggcctgaatcagaccgtcgaagagtttgtgggtgagcttaattttggcctggttgaagtggtctacgagtgggcccgaggcatgcccttctccgagctggcagggctcagcgggacccccgaagggctggttgtgcgatgcattcagagactggccgaaatgtgccgctccctcaggggcgccgccaggctggttggggagcctgtcctgggagctaagatggaaacggcggcaaccttgctccggagagacattgtgtttgcggcaagcctttacacccagtag

SEQ ID NO: 207404 - DNA, 3267 bp, Artificial Sequence
  Description of Artificial Sequence: Synthetic coding sequence
atggacgagcccaccatcaccgacctgaacacccgggaggaggccgaggaggagattgatttcgagaaggacctcctgactattccccctggctttaaaaaagggatggatttcgccccaaaggactgtccaacacccgcacccggcctgctctctctaagctgtctcctggaacccctggatttgggcgggggcgatgaagatgagaatgaggctgtaggccaaccagggggaccaaggggcgatacagtgtccgcaagtccctgctcagcaccgttggcaagagcctcttcattagaagatctggtcctcaaggaggcatcaaccgcagtaagcacgccagaagctccagagccaccctcccaggagcagtgggccatccctgttgacgctacaagcccggtaggagacttctaccgcctgattccccaacctgcctttcagtgggctttcgagcctgacgttttccagaaacaggccatcctgcatctggaacggcatgatagtgtctttgtggcggcacatacaagcgctgggaagaccgtcgtcgctgagtatgctatcgctctagcccagaaacatatgactaggacaatctacaccagccctattaaagccctgtccaaccagaagtttagagattttcggaatactttcggcgacgttggactcctcactggggacgtccagctccacccagaagcctcatgtctaataatgacaaccgaaattctaagaagcatgctgtactccggcagtgatgttattcgggacctagaatgggtgatatttgatgaggtgcactacatcaatgacgtagagcgcggggtcgtctgggaagaagtgttgatcatgttacctgatcacgtgtccattattctactatccgcaactgtcccaaatgctttggagtttgccgactggattggtcgtctgaaacgaaggcaaatttatgttatcagcacagttactcgcccagtgcctctcgagcactacctgttcacgggtaacagctctaagactcagggagagctgttcttgcttctggacagccgaggggccttccatactaaaggctattatgcggccgtggaagcaaaaaaggaaaggatgagtaagcatgcgcagacctttggagcaaagcagccgacccaccagggaggaccggcacaagatagaggggtgtatctgagccttcttgcctcactccgtacccgcgctcagttgcccgtcgtggtgttcaccttttccaggggcaggtgcgacgaacaagcaagcgggctgacctcactggaccttacaacaagcagcgagaagagtgagatccacctcttcctgcagaggtgtttggcacggttaagaggatcagataggcagctgccgcaggtcctgcatatgagcgaactgcttaacagagggctgggagtccaccatagcgggatcctgccaatcctgaaggagatcgtggaaatgctgttctcccgggggctggttaaagtgctttttgccaccgagaccttcgctatgggcgtgaacatgccggcgcggactgtcgttttcgacagcatgcggaaacacgacgggtctacatttcgggatctgctgcctggtgagtatgtgcagatggcgggccgcgccggccggagggggttggaccctacagggaccgtcatcctcctatgtaagggtcgagttccggaaatggcggatttacaccggatgatgatgggaaaacctagccagttgcagtcccagtttcggctgacttacaccatgattctcaatctgctgagggtggacgccctccgcgtggaagacatgatgaagaggtccttctctgaattcccttcgcgaaaggatagtaaagctcacgaacaggcactggctgaacttacaaaacgtctcggcgctctggaagaacctgatatgaccgggcagttggtcgacttacccgagtattactcttggggggaggagctaaccgaaactcagcacatgatccagcgccgcataatggaaagcgtgaacggattgaagagcttgtcagccggtagggtcgtcgtggttaaaaaccaagaacatcataatgctctaggggtcatccttcaggtgtcctccaacagtacttcgagagtttttaccacacttgtcctgtgtgacaagcccctcagccaggacccccaggacagaggcccagccactgctgaggtgccctatccagatgacctagttgggttcaagctgtttctgcccgaaggcccctgtgatcacactgtggtaaagctgcaaccaggcgacatggccgccatcaccacgaaggtactgcgcgtgaatggcgagaaaatcttggaggatttttctaagcggcaacagccaaagttcaagaaggatcccccactggccgcagttactacagcggtgcaggagctcctacggctggcgcaagcccatccggccgggccgccaaccttggatcccgtgaatgacctccagctgaaggacatgagcgtggtagagggaggcctgcgcgctagaaaactggaagaactgatccagggagcccagtgtgtgcactcaccaagattccctgcgcaatacttaaagttacgggagcgcatgcagatacagaaggagatggagagattacgttttttattgagcgaccagtccctactgctgctgcccgaataccatcagcgagtggaagtgctgcgtaccctgggctacgtggatgaggcaggcactgtgaagcttgctgggcgggtggcatgtgccatgagctctcacgagcttctgttaactgaactgatgtttgataacgccctcagcactcttaggcccgaagagattgcggccttgctgtctggattggtatgccaatcccccggcgacgccggggaccagctccccaatacccttaagcaaggcatcgagcgggtccgtgccgtggctaaaaggatcggcgaggtccaggtagcctgcgggttgaatcaaaccgtggaagagtttgtcggcgaactcaacttcggtctggtcgaggtggtttacgagtgggccagaggaatgcccttctctgaattagcaggattgagcggtaccccagagggactggtggtgaggtgtatacagcggttggctgagatgtgccgctcactgaggggggccgctaggctcgtgggtgaacccgtgctgggagccaaaatggagacggcagctactttattgagacgggacattgtgtttgcagcctctttatatacccaatag

SEQ ID NO: 207405 - DNA, 3267 bp, Artificial Sequence
  Description of Artificial Sequence: Synthetic coding sequence
atggacgagcccaccatcaccgacctgaacacccgggaggaggccgaggaggagattgatttcgaaaaagacctgttaacaataccccctggcttcaagaagggcatggactttgcgccgaaagattgccctacaccagctcccggcttgttaagtctgagttgtctgctggagcccctagacctgggtgggggagatgaagacgaaaacgaggcggtaggacaaccaggcggacctcggggtgacacagtgagtgcgagcccttgtagcgcaccgctagcccgggcctcatcactagaagacctggttctgaaggaggcgagcactgccgtgtctacacctgaagcccccgagccgccctcccaggaacagtgggcgatccccgttgatgcgacttcgcccgtgggcgacttctatagactaatacctcagccagcattccagtgggctttcgagcccgacgttttccagaagcaggccatacttcatctggagcgccatgacagcgtgtttgtggcagcccacacgagtgcgggaaagacggtggttgctgaatacgcaatcgcactcgcccagaagcacatgacccgcacaatttataccagcccgatcaaagccttaagcaaccagaaattcagagactttaggaacacgtttggtgatgtggggttactgacaggcgatgtccagctccaccctgaagctagctgcctcattatgacaactgagatcctccggagtatgctctactctggctctgacgtgatccgagaccttgaatgggtcatttttgatgaggtccattatatcaatgatgttgagagaggcgtagtgtgggaagaagtgctgatcatgcttccagaccatgtgagtataatcttactgtccgctacagtacccaacgcgctagagtttgccgactggatcggacggctcaaacggaggcagatttatgtgatcagcacagtcactaggcccgttccactcgagcactatctgtttacgggaaacagctccaaaacccaaggcgaattattcttgttgctcgacagtagaggcgcttttcacacaaagggttactatgcggcggttgaagccaagaaggagaggatgagcaagcacgctcaaacattcggagccaaacagccaacacaccaaggagggccggctcaggaccgcggggtgtacctttccctcctggccagtttgagaacccgggcccagctccccgtcgtggtattcactttttcccggggtaggtgtgacgagcaggcttccggcttaactagtttggatctgaccacaagttcagaaaaatctgaaattcatctgtttctccagagatgcctcgcgcggcttcgaggctccgacaggcagctgccccaggtgctccatatgagcgaactcctcaaccgaggcctcggggtccaccactcaggtattttgcctatattgaaggagatcgtggaaatgctgttcagccgaggcctggtcaaagtcctgtttgcaactgagacctttgcaatgggggtgaacatgcctgctaggacggtcgtgttcgattccatgagaaagcatgacgggtccacatttcgagacctacttcctggagaatacgttcagatggcagggcgcgccgggaggcgggggcttgatcctaccgggactgtaattctactttgtaagggacgtgtccccgagatggctgatctgcaccgtatgatgatgggcaaaccgtctcagctccagtcacaattccggctgacatacacgatgattttgaacctcctgcgagtcgacgcactcagagttgaggacatgatgaagcggagttttagcgagttcccatcacggaaggactctaaagcccacgagcaggctctcgccgagctgacaaaaaggctgggggccctggaggaacccgacatgacgggccaactggtggatctcccagagtattactcatggggtgaagagctgactgaaacccagcatatgattcagcgtcgtattatggagtctgtaaacggactcaagtccctgagtgctgggcgcgttgtagtggtgaagaaccaggagcaccacaacgcgctcggcgtgatcctgcaggtgtcatcaaactccacaagtagggtgtttacgactttggtcttatgcgacaagcccttatcccaggacccccaggacagaggacctgctaccgctgaagtgccctaccctgacgatttagtcggcttcaagctgtttctccctgaagggccctgcgaccatacggtggtcaagcttcaacctggagacatggccgccatcaccaccaaagttctcagagttaacggcgaaaaaattctcgaggacttttcaaagcgccagcaaccaaagttcaagaaagatcctcccctggctgccgtcacaacagcggttcaagagttgttacgcctggcacaggcacatcctgctggaccgcctacactcgaccctgtgaacgatctgcaactgaaagatatgtccgtggttgagggaggtctacgagcccgtaagctggaggaactcattcaaggagctcaatgtgttcattctcccagatttccagcccagtatctgaagttgcgcgaaagaatgcagatccagaaggaaatggaacgcttgcgattcctgctgtccgaccagagccttctgctcctgcctgaatatcatcagagagtggaagtcctaagaaccttgggatacgttgatgaggctggcacggtgaaactcgccggacgggtcgcttgcgcgatgagctcgcatgagctgttgcttaccgagcttatgttcgataacgcactttcaactcttcgaccggaagagatcgcagcgctgctctcagggctggtctgccagagtccaggggatgcaggtgaccaactcccaaacaccctgaaacagggaatcgagcgggtgcgagccgtagctaaacggatcggggaagttcaggtcgcatgtggactcaatcaaaccgttgaggagtttgtgggggaactaaactttgggttagtggaggtggtgtacgaatgggctcgcggaatgcccttttctgaattggctggattaagtgggacaccagaggggctggtggtgaggtgtattcaaaggctggcagaaatgtgccgatctctgcgcggcgccgctcgcttagttggcgaaccggtactgggcgccaaaatggagacagcggcaaccctgctgcggagagatatcgtcttcgccgcatctctttacacacagtag

SEQ ID NO: 207406 - DNA, 693 bp, Artificial Sequence
  Description of Artificial Sequence: Synthetic coding sequence
atgatggagaccgagcggctggtgctgcccccccccgaccccctggacctgccattgcgcgcagtggaacttggctgtacaggacactgggaactacttaacttaccaggcgcacccgagagctccctaccccacgggcttcctccatgtgccccagatctgcagcaggaggccgagcagctgtttctttcaagtcctgcttggctgccactccacggcgttgaacactcagcccgcaagtggcaaaggaagacagacccttggagtttgctcgccgtcctaggtgcccccgtgccatcggatctgcaggcccagcggcacccaacaaccggccagatactcgggtataaagaagttctactggagaacacaaacctttcagccacaacttcactatccctgaggcgcccccccggcccagcaagccagagcttgtgggggaatcctacacagtatcctttttggcccggcgggatggatgagcctactatcacagacctcaacacccgagaggaggctgaggaggagatcgattttgaaaaagatctgctcacgattccaccaggctttaagaaagggatggatttcgcccccaagggttccgttcacagttgtatccaccccaggggaccacgggctagcattagcggggccgttggccacccctgcggacgccacctgccctgctggtag

SEQ ID NO: 207407 - DNA, 3267 bp, Artificial Sequence
  Description of Artificial Sequence: Synthetic coding sequence
atggacgagcccaccatcaccgacctgaacacccgggaggaggccgaggaagaaatcgactttgagaaagacttgctgacaattccccctggattcaaaaaagggatggatttcgcccccaaggactgccctacaccggccccaggtctactgagcctttcttgtatgctagagcccctagatctgggcggaggggacgaagacgagaatgaggccgtgggtcagccaggcggccccagaggcgatacagtgtcagcgagcccatgctcggccccattggcccgggcgtcatccctcgaggatctggtgctcaaagaggcatccactgccgtttccacaccggaggctccagagccaccttcccaggagcagtgggccattcctgtggatgcaaccagccctgtaggggacttctacaggctgatcccccaacccgccttccagtgggctttcgaacccgacgtcttccagaaacaggcgatcttacatttggaacgacatgatagcgtgtttgtggccgcccataccagcgcgggtaagacagttgtcgcagagtacgcaatcgctctggctcagaagcatatgacacgcacgatatacacatcgcccattaaagcactgtctaaccagaaattccgagactttcgaaacactttcggtgatgtcggcttgttgacaggagatgtgcagctccatcctgaagcctcttgcctgatcatgacaactgagatcctgcgctctatgttgtatagcgggagcgatgtaattcgagatttggaatgggtaatattcgacgaggtacactacatcaatgacgttgaaagaggtgtcgtgtgggaggaagtgctcataatgctacctgatcacgtcagtattattctgctatccgcgaccgtgcccaacgcgttggagttcgccgactggataggcagactcaagcggagacaaatctatgtaattagtacagtgactagacccgtgccccttgagcattatctgtttacggggaactcatcaaaaactcagggggagctcttcctgttacttgactcccgcggggcatttcatactaagggctattacgctgccgtggaggctaagaaggaacgaatgagtaaacatgcccaaaccttcggcgcaaagcagcccacccaccagggcggccctgcacaggaccggggcgtgtacctatctttactggcctctctaaggacgagagctcaacttccagtggttgtctttacattctcccgcggcaggtgcgatgaacaggcctcaggcttaacatccctcgacctcactacctcctcagagaagagtgaaatccatctcttcctacagagatgtcttgctaggctcagaggaagtgataggcagcttccccaagtccttcacatgtctgaactactcaaccgcggactgggtgttcaccatagcgggattctgccgatcctcaaggaaatagtagagatgttattttctagaggcctggtcaaggttttgttcgctacagagaccttcgccatgggagtgaacatgccagcccgaacagtagttttcgacagcatgcgtaagcatgacggctctaccttccgggatttgctgcccggcgaatacgtacagatggctggaagggccgggagacgaggtctggaccccaccggcaccgtcatcctgctgtgcaaaggaagggtcccagaaatggctgacctgcaccgcatgatgatgggcaagccgtcacagctccagtctcagtttcggctcacatatacaatgatactgaatcttttgagggtcgacgcgctccgagtggaggatatgatgaaaagaagcttcagcgagttcccctctcgaaaagattctaaagcccacgagcaagcgctcgcggagctgacaaagcgcctcggggccctcgaggagcctgacatgactgggcagctggtcgacctgcccgaatattactcttggggggaagagcttaccgagacccaacacatgatccagagacgcattatggaatcagtgaatggcctgaaatcccttagcgcggggagggttgtggtcgtgaagaaccaggagcaccacaacgctctcggggttattctgcaggtgagtagcaattcaacatctcgtgtgttcacaactctggtcttgtgtgataagccgcttagccaggacccacaggataggggtccagccactgcggaagtaccctatccagatgatctagttggattcaaactgttcctgcctgagggcccttgcgatcacacggtggtcaaactgcagccaggggacatggcagctatcaccaccaaagtcttacgggtcaacggggaaaaaatcctagaagatttctctaagaggcagcagcctaaatttaagaaggaccctcccctggccgccgtgaccactgcagttcaagaattgctgaggctcgcacaggcgcacccagccggcccccctactcttgaccccgttaacgacctccagctcaaagacatgtccgtggtagagggcggactgcgtgcaagaaagctggaagagttgatccagggggcccagtgtgtgcatagtcctcgatttccagcacaatatctgaaactgcgagaacggatgcagattcagaaggagatggagaggctgaggtttctattgagtgatcaatctttactcctgcttcccgagtaccaccagcgcgtcgaagttcttcgaactctgggctatgtcgacgaagccggaaccgttaagctggcaggccgcgtagcttgcgcaatgtctagtcacgaattgctactcactgagttaatgtttgacaacgccctgtccacactgcggcctgaagagattgccgcgttgttaagtgggttggtgtgtcagagtccgggggacgctggcgatcagttgcctaataccctcaaacagggcattgagcgggtgagggctgtggcaaagcggattggtgaggtccaggtcgcgtgtggcctgaatcagactgtggaggagttcgtgggggagcttaacttcggccttgtggaggtggtatacgaatgggcacgagggatgccctttagcgagctcgctggattaagtgggacacccgaaggtctcgtggtgcgatgcattcagcgcttagccgaaatgtgccgctctttgaggggggccgccagactggtcggggagccagtcctcggagctaaaatggagactgcagccaccctgctgcgccgtgatatcgtctttgcagcctctttgtatacccaatag

SEQ ID NO: 207408 - DNA, 693 bp, Artificial Sequence
  Description of Artificial Sequence: Synthetic coding sequence
atgatggagaccgagcggctggtgctgcccccccccgaccccctggaccttccactgcgggctgtggagctgggatgcaccggccactgggaactgcttaatctccccggagccccagagtcctctctccctcatggcctacccccatgcgctcctgacctccaacaggaggccgaacagttgttcttgtcttcccccgcatggttgcccttgcatggcgttgaacacagcgcaagaaagtggcaacggaagacggacccatggtccttgctcgcagtgctcggtgcccccgtcccaagcgatctgcaggcccaacggcacccaactacaggccaaattctcggatacaaagaggttcttttagaaaataccaacttgtcagcaacgacaagcttaagcttgagaaggccacccggacccgcgagtcagtctctatggggtaatcctacacagtatccattctggcctggcggaatggacgagcccacaatcactgacctgaatactagagaggaggccgaagaagagatcgacttcgagaaggacctcctgacaattccacctggtttcaagaaagggatggactttgcgccgaaaggatctgtacattcatgcattcacccaaggggacctcgtgcatctattagcggagccgttgggcacccatgcggtcgacacctgccatgttggtag

SEQ ID NO: 207409 - DNA, 2643 bp, Artificial Sequence
  Description of Artificial Sequence: Synthetic coding sequence
atgatggagaccgagcggctggtgctgcccccccccgaccccctggatctgcccctcagggcagtcgagctggggtgcactggacattgggagctcctgaacttacctggggcgccagagtcttcactgcctcacggactccccccatgcgccccagaccttcagcaggaagccgagcagctgtttctctcctctcccgcatggctgccacttcatggagtggagcactccgcccggaagtggcaaaggaagacagacccatggagccttctggctgtcttgggcgcccctgttccttcagatctccaggctcagcggcacccaacgacgggccagattttgggctacaaggaggttctgctagaacactatcttttcaccggaaatagtagtaaaacccagggggaactgtttctgctgctggatagtcggggcgcttttcacacaaaaggttactatgctgccgtcgaagcaaaaaaggaacggatgtcaaaacacgctcaaacctttggcgccaaacagccaacccaccagggcgggcccgcccaggatcgcggcgtgtatctttccctactggcctccctccgcaccagagcacaactgcctgtggttgtatttaccttttcacggggtaggtgtgatgagcaggcgtcaggcctaaccagcttggaccttaccaccagctcggagaagtctgagatccatctgtttctgcagcggtgcctcgcaaggctcaggggttctgacaggcagctaccccaggtgctgcacatgtctgaactcctaaaccggggtctgggtgtacaccactccggtatcctgcctatattgaaggagatcgtagaaatgctgttctcacgcggattagtaaaggtgctgtttgcaaccgaaacctttgccatgggcgtcaacatgccagcacggaccgttgtcttcgacagcatgagaaagcacgacggcagcaccttccgggatcttcttcccggggagtatgtgcagatggctggcagggcaggaagacgggggctcgacccgactgggactgtaatcttgctgtgcaagggtagagtgcccgagatggcggacttacaccgcatgatgatgggaaaacccagtcaactacagagtcagtttaggttaacctacaccatgattctcaacctgttgcgggtggacgcactccgggttgaggacatgatgaagcggtctttcagcgagttccctagtcggaaagactcgaaagctcatgaacaggcactggccgaattaacgaaaagactaggcgctttagaggagcctgacatgaccggacagctggttgatctacccgaatactattcttggggcgaagaacttacggaaacccagcatatgatccagagaagaatcatggagtccgttaacggccttaagtccttgtccgctgggcgggttgtggttgtgaagaatcaggaacaccacaacgccctgggcgtgatactacaagttagttctaacagcacttcacgagttttcacaaccctggtcttatgtgacaaacccctgtcacaagatccacaggacagaggacctgctaccgcggaagtaccctacccagatgacttagtcggttttaaactgtttctgccagaaggtccctgtgaccacacagtcgtcaaactacagccaggggatatggctgctattaccacgaaagtactgagagtgaacggcgagaagatcttagaggatttttccaaacgccaacagccaaagtttaaaaaggacccccctctcgccgccgtgaccacggccgtgcaagagctgctgcggctcgctcaagcccatcctgccggaccgcctaccctcgatccagtgaatgacctacagctgaaggatatgagcgtggtggagggaggacttcgcgcccgcaaactcgaggaattgattcaaggcgcgcagtgtgtgcacagcccccgctttcccgcccaatacctgaagttacgtgaaaggatgcagattcagaaggaaatggaacggctgcgttttttgctttccgaccagtccttgctgctgttacccgagtatcaccagcgggtcgaggtcctccgaaccctaggctatgttgatgaggcaggcaccgtcaaactcgcaggcagggtggcctgcgcgatgagttcacacgagctgctgctgacggagcttatgtttgacaatgctctcagcactttgcggccagaggaaattgccgctctgctttccggcttagtgtgtcagtccccaggggatgctggggatcaactgcctaataccctgaagcagggaatcgaacgggtaagagcggttgctaaaaggatcggagaagttcaagtcgcctgtggcctgaaccagaccgttgaagagttcgtcggagagctgaacttcgggctggttgaggtggtctatgagtgggctcgcggaatgccatttagcgaacttgcaggtctgtcagggacgcctgaagggctcgtcgttaggtgtatacaacggttagcagagatgtgcagatcactgcgtggtgcagcacgactcgtgggtgagcctgtgctcggggccaagatggaaaccgccgcgacactcctgcgtagggacatagtttttgccgcatcactgtacacccaatag

SEQ ID NO: 207410 - DNA, 693 bp, Artificial Sequence
  Description of Artificial Sequence: Synthetic coding sequence
atgatggagaccgagcggctggtgctgcccccccccgaccccctggacctccccttgcgggctgtcgaactcggctgcactggccattgggagctccttaatttaccaggcgcccctgaatctagtcttccccacggattgcctccatgcgcccccgatttacaacaagaggccgagcagctgttcctcagttcccccgcttggttgcctttacacggggtagagcactcagcccgtaagtggcagcggaagacagatccctggagcttgctcgctgtgctcggcgccccggtgccctctgatctccaggcccagaggcacccaactacaggacaaattctcggctataaggaagtgttgctggaaaacacgaatctaagtgctaccacttcgctttccttgcgtcgacctcctggaccagcatctcagtccttgtggggtaatcccactcaataccctttttggcctggtggtatggacgagccaacaataacagacctgaatacccgagaggaggccgaggaggaaatcgattttgagaaggacctcctgacaatccctcctgggtttaaaaaaggcatggactttgcgcctaagggcagcgtgcattcctgtatccacccaagaggaccgcgtgctagtataagtggagcagtggggcatccttgcggcaggcatctgccatgctggtag

SEQ ID NO: 207411 - DNA, 3162 bp, Artificial Sequence
  Description of Artificial Sequence: Synthetic coding sequence
atggacttcgcccccaaggactgccccacccccgcccccggcctgctgtccctgtcgtgcctgctggagcccctcgatcttggaggtggggatgaagacgagaacgaagctgtggggcagccaggcggaccgcggggagatactgtgtctgcatcgccctgcagcgccccattagcacgggccagttcgctagaagatttggtgctgaaggaagcttctaccgccgtctcaactcctgaggcacccgaaccaccctcccaggagcagtgggccattccagttgatgctacctctcctgtcggcgatttttataggcttatccctcagcccgcatttcaatgggctttcgagcctgatgttttccagaaacaggccattctgcacctggagaggcacgattcagtctttgttgctgcccacacatcagccggcaagaccgtggtcgctgagtacgcaatcgcccttgcgcagaagcacatgacccggacgatctatacatctcccatcaaagcgctgagcaaccagaagtttcgagattttaggaacacctttggtgacgtcgggctgctgacaggagatgtgcagctccatcctgaagccagctgtttgatcatgacaaccgaaattctgcggtccatgctgtactctggctcggatgtgatccgcgacttagaatgggtgattttcgatgaagtgcactatatcaatgatgtggaacgtggggtggtgtgggaggaggtactgattatgctgccagaccatgtatcgatcatcctgttgtctgcaacagtgcctaacgccctggaatttgccgattggattggacgcctgaagcgtagacaaatttacgtgatcagcactgtgactcggccagtcccgctagagcattatttgtttaccggaaattctagcaaaacccaaggagaactcttcctgctgctcgacagccgaggagcattccacaccaagggatactacgccgcagtcgaggccaagaaggagcgaatgagcaaacacgctcagacatttggtgctaagcagcccacgcaccagggtgggccagctcaggacaggggcgtttacctgtctctgttagcctctctgcgcactcgggcccaactgccggtggttgttttcacgtttagccggggtcggtgcgacgagcaggcctccggactgacatctctagatctgactacttccagcgagaagagcgagattcacctgtttctccagagatgcctcgcccgtttgcgggggtcagatcggcagcttccacaggtgctgcacatgagcgagttgttaaatcgcggactcggtgtgcatcactcagggatactgcccatcttgaaagagatcgtcgaaatgctattttctcgggggctagtcaaggtcctcttcgctacagagacattcgcaatgggcgttaatatgcctgcgagaacagtggtgtttgattccatgcggaaacacgacggctcaacgtttagggatctcctaccaggtgagtacgttcagatggccggacgcgcgggaagaaggggattggacccaaccgggactgttatcctgctttgtaaggggcgggtgccagagatggccgatctacaccggatgatgatgggcaagccgtcccagctgcagagccagttccgcttgacatataccatgatcctgaaccttttgagagttgacgctcttagagtggaagatatgatgaaacggagcttcagcgaatttccttcaagaaaggactcaaaggcccatgagcaggccctggctgagctgaccaagcgactgggagctctggaggaacccgatatgacagggcagttagtggacctgcccgaatactactcctggggtgaggaacttacggagactcaacacatgattcaacgacggatcatggagtccgtgaacggcctcaaatctctctccgcaggccgggtggtggttgtcaaaaaccaagaacatcacaacgcccttggggttatacttcaggtcagttctaatagcacgtctcgcgtgtttacgacactcgtcctgtgcgacaaacccctgtcccaggatccacaggacagaggaccggccactgctgaagtgccctacccggatgatttggtcggatttaagctgttcctgcctgagggaccttgtgaccacactgtcgtgaaactgcagccgggagatatggctgccatcaccacaaaggtgctgcgggttaatggcgagaagattctggaagatttctcgaagaggcagcaacctaagtttaagaaggatcctccacttgccgctgtgaccaccgctgtccaagaactgttgagattggcccaagcccacccagcagggcctcctacgttggaccctgtgaacgatctgcaactgaaagatatgtccgtggtggaaggaggccttagggcgcgcaagctcgaggagctgatccaaggggcacagtgtgttcactctccccgatttccagcacagtacctgaaattacgcgaacgaatgcagatacagaaggagatggagagacttcggttccttctgtcagatcagtctctgctgctgctgcccgagtaccatcagcgtgtggaggtgcttcgcacgttagggtatgtggacgaggctggcactgttaagttagcaggccgagtagcctgcgccatgagctcacatgaactgctgttaactgaactcatgttcgacaacgccttgtccactctgaggcccgaagagatagcagccttgttgagcgggctggtctgccagagtccaggggacgccggggaccagctgccaaacaccctcaaacaaggcatcgaaagggtgcgtgcggtcgccaagcggattggtgaagtccaggtggcatgcggactgaatcagaccgtggaggagttcgtgggagaactgaactttggacttgttgaggtcgtgtatgaatgggcccgtggcatgccgttcagtgagctggctgggctgagcggtacccctgagggcctggtcgtccggtgcattcagaggcttgcagaaatgtgcagaagtcttagaggcgccgcgcggttggtgggcgagccagttctgggcgctaaaatggagactgctgcaacattactgaggcgtgacatcgtttttgctgcatctctctatacgcaatag

SEQ ID NO: 207412 - DNA, 3162 bp, Artificial Sequence
  Description of Artificial Sequence: Synthetic coding sequence
atggacttcgcccccaaggactgccccacccccgcccccggcctgttgtctctgagttgtcttttagaaccgctggatctcggaggaggcgatgaagatgagaatgaggctgtgggccagcctggaggccctcggggagacacagtgagcgccagcccttgttccgcccccctagcccgagcctcaagtctcgaagacctcgttctcaaagaggcgtctactgccgtatcaacgccagaagcacccgaaccgcccagtcaagagcagtgggccattcctgtggacgcgactagtcccgtgggcgacttttatcggctgattccacagcccgcctttcagtgggccttcgaacccgatgtatttcagaagcaggccatcctccatttggagcgccacgattccgttttcgttgcagcccacactagcgcaggaaaaaccgtcgtggccgagtacgctatcgccttagcccaaaaacacatgacaagaacgatctacacttcaccgattaaggcactcagcaaccaaaagttccgagactttaggaatacctttggggatgtggggctcctcaccggcgatgtgcagctgcacccggaagcctcctgtctcattatgaccactgagatcctccgctccatgctttatagtggctctgatgtcatccgggatctggaatgggttatattcgacgaggttcactatatcaacgacgtcgagaggggcgtcgtctgggaggaggtgctgattatgctccccgaccacgtgtccattatcctgttaagcgcaactgtgcccaatgccttagagtttgccgactggatcggcagattaaaacggcgccagatctatgtaatctccaccgtgacaaggccagttcctttggaacactacttgtttaccgggaatagctcaaaaacccaaggggaactgttcctcctgctcgactcccgaggggcgttccataccaaaggatactatgccgcggtggaggccaagaaagaacggatgagcaagcatgcgcagaccttcggcgccaaacagccaacccaccagggcgggcccgcccaggatagaggggtctacctcagtctcctggctagcttgcgaacccgagcgcagcttcctgtcgtcgttttcaccttctctcggggcaggtgcgacgaacaggccagcggcctgaccagcctcgacctgacgacaagcagcgagaagtccgaaatacacctgttcctgcagcggtgcctcgccaggctgcgaggcagcgatagacagctgccacaggtgttgcacatgagtgagctactcaaccgaggtctgggcgtccaccatagtgggattttaccgatactcaaggagatcgtcgagatgctattctcacgtgggctggtgaaggtcctattcgccacagagaccttcgctatgggcgtaaatatgccggccaggacagtcgtgtttgattctatgagaaagcacgacggttcaacgttccgggacctcctccctggtgaatatgtccagatggcaggcagagccggacgacggggcttggaccccactgggactgtgattcttctctgtaagggacgagtgcccgagatggcggacttgcataggatgatgatgggtaaaccgagtcagctacaatcccagtttcggttgacttacactatgatcctgaatctcctcagagtagacgctctgagggtcgaagatatgatgaaacggtcttttagcgagttcccatccagaaaggattccaaagcacatgagcaggcactggccgaattaactaaaaggcttggcgcactggaagaacctgatatgacgggtcagctggtcgatctaccagagtactatagctggggggaagaactgaccgagactcaacatatgatccagcgtaggataatggaatctgtgaatggcctcaagagtctctcagcaggccgcgtggtggtcgtgaagaatcaagagcatcacaacgcgctgggagtgattctccaggtatcttctaattctacttcacgagtgttcaccacattggttctttgtgataaacctctctcacaggacccacaggatagaggccccgctacggccgaagtcccgtaccctgatgacctggtgggcttcaagttgttcctcccagagggcccttgtgatcacacggtggtgaagttacagccgggggacatggcggccattacgacaaaagttctgcgggtgaacggagagaaaattctcgaggacttctcgaaacgtcagcagccgaagtttaagaaagaccctcccttggcagccgtgacgacggccgtacaagaactgctaagactggcacaggcccatcccgctggaccgcctaccctggaccctgtgaatgatctgcaactgaaggatatgtccgtggtggagggcggcctccgagcaagaaagttagaggagttgattcagggagcccagtgtgtgcacagcccccggttcccagcccagtatctgaaactgagagagcgtatgcaaatacagaaggaaatggagcgtttacgctttctcctgtctgatcagagtcttttgctcctgcccgaataccaccagagagtggaagtgctgcgaacactcggatacgtggacgaggccggcactgtcaagttagccggacgagtggcttgtgccatgagttcccatgagctgctgctgacagagttgatgttcgacaacgccctctccacactcaggcctgaggaaatcgcagctcttttatcaggactggtgtgccaatctcccggagacgccggagatcagctgcctaacacgcttaaacaggggatcgaacgggtgcgggcagtggcgaagcgcataggcgaggtgcaagttgcatgcgggctgaatcaaaccgttgaagaattcgtgggcgaactgaacttcgggctagtggaagttgtctatgaatgggcccgaggaatgcccttttcagagttggctggtctgtcaggaacccctgaaggattggtggtccgatgcatccagaggctggctgagatgtgccggtccctacgaggcgccgcacgattggtgggcgaaccggtgctcggtgcaaaaatggaaactgctgccaccctcctgaggagggacatcgtgttcgctgcctccctatatacacagtag

SEQ ID NO: 207413 - DNA, 3162 bp, Artificial Sequence
  Description of Artificial Sequence: Synthetic coding sequence
atggacttcgcccccaaggactgccccacccccgcccccggcctgctgtctctatcttgcctactcgagcctctggatctggggggcggcgacgaggacgagaacgaggcggtgggtcagcctggaggaccacgtggcgatactgtgtccgcatcaccatgctctgctccgctggcgagggccagtagtttggaggaccttgtcttaaaagaagcaagcactgccgtgagtaccccagaggcgcccgaaccaccatcacaggaacagtgggcgatacccgtcgacgctacttcacctgttggcgatttttacagacttatcccccagccagctttccagtgggcttttgaacccgatgtgtttcagaagcaggccattctgcacctagaacgacacgatagcgtgtttgtagctgcccatacgagtgccgggaaaaccgtggtggccgagtacgccatcgccctggctcagaaacatatgacacggactatatacacatcaccaatcaaagcgctgagtaatcagaagttccgggactttaggaataccttcggtgacgttggactgttaactggtgacgtccagctgcaccccgaggccagctgtctgattatgaccactgagatattaagaagcatgctctactctggctccgatgtgatcagggatctcgaatgggtcatattcgatgaagtgcactatatcaatgatgtagaaagaggcgtggtgtgggaagaggtacttattatgctgcccgaccacgtgagcatcatcctactgagtgccaccgtccctaatgccctggagttcgcagattggattggccgtcttaagaggcggcagatttacgttatttccacggttacacgacctgtacccctggaacactatctcttcacaggcaattcatccaaaacacaaggggagctctttctgcttttggactctcgcggtgcttttcatacaaagggatactacgctgccgtcgaagccaagaaagaacgcatgtctaaacacgcacaaacttttggggccaagcagccgacccatcaaggcggaccggcccaggatcgcggggtttacctctccctcctggcatcattacggaccagagcccaacttcccgttgtggtattcacttttagccgggggagatgtgatgagcaggctagcggactaacaagcttagacctgacgacctcaagtgagaagagtgaaattcacctgtttctgcaaaggtgcctggcccgcctgcgaggtagcgaccgacaactgccgcaagtgctgcatatgagtgagctgctcaatcgcggcctaggcgtgcaccactcagggatcctgccgatactgaaagagattgttgagatgctgttttctcgtggactggtgaaagtgctctttgctaccgagacgtttgctatgggagttaacatgcctgcccggactgtcgtgttcgactccatgaggaaacacgacggctctacgtttcgagacctgcttcctggggagtacgtgcaaatggcgggtcgagccgggcggcggggcctcgatcctacgggcacggtgatcctcctctgcaaaggccgcgtgccagagatggctgatctgcacagaatgatgatgggcaagccgtcacagctgcagtcacagtttagattgacatataccatgatcctgaatctgcttagagtagacgcattgcgggtggaggacatgatgaagcgcagtttttccgagttcccgtcacgcaaggatagcaaggcccatgaacaagccctggccgaacttacaaagcgattgggtgcgctagaggagccggacatgactgggcagcttgtggatctgcccgagtattactcatggggggaagaactcaccgaaacgcagcacatgattcagagacgcattatggaatcagtcaacggtctgaaatccttaagcgctggaagggtggtggtggtgaaaaaccaagagcatcacaacgcactgggtgtaatactgcaggtaagcagcaactccacaagccgagtgttcaccactctggttctgtgtgacaagcccctgtcacaagaccctcaagatcgtggccctgctactgcggaagtgccctacccagacgatctggtgggattcaagctatttctgcctgagggcccatgcgaccacacagtagtcaaacttcagcccggtgatatggctgctataacgacaaaggtcttaagagtgaatggggaaaagatcctggaggatttttccaagcggcagcaacctaagtttaagaaagatcctcccctggcggctgtcacaactgccgttcaggaactgctccgactggcccaagctcacccagccgggccgcctacactggacccggtgaacgacctccagctgaaggatatgtccgtggtggagggcgggctacgcgctcgaaaactggaagaacttattcaaggcgcccagtgcgtccactccccgcggtttccagcacaatatctcaagttgcgagagcgaatgcagattcaaaaggagatggagcggctgagattcctgctttctgatcaatcattgctattattaccagagtaccaccagcgcgttgaagtgctgcgcactctcggttatgtggacgaagccggaacagtgaagcttgcaggacgtgtagcatgcgctatgtcaagtcatgagctgcttttaaccgaactaatgttcgacaatgccctatcgactcttaggcctgaggaaatagccgccctgctgagcggattggtctgccagtccccaggtgatgccggcgatcagcttccgaacaccctcaagcaaggaatcgaacgggtgagagcagtggccaagagaatcggtgaagtccaggttgcttgtggactgaatcagacagtcgaggaattcgtgggcgagctgaattttggattggtcgaagttgtgtatgagtgggctagaggtatgcctttttccgaacttgccggactgagtggaacccctgagggattggtcgttcgttgtatacagagactggcagaaatgtgcagaagcctgcggggtgccgcccggctggtcggggagcccgtcctgggagccaagatggagaccgccgctacactccttaggagggacattgttttcgctgcctcgctgtacacacagtag

SEQ ID NO: 207414 - DNA, 465 bp, Artificial Sequence
  Description of Artificial Sequence: Synthetic coding sequence
atggccaccaaggccgtgtgcgtgctgaagggcgacggccccgtgcaaggcatcattaattttgagcagaaggaaagtaatgggcctgtgaaagtctggggatccatcaagggactcactgaggggttgcacggtttccacgtccacgagtttggagacaataccgcaggctgtacctcggctggaccacactttaatcctctcagtcgtaaacacggaggacccaaagatgaagagcggcacgttggcgatctgggcaatgtgacagcagacaaggatggcgtcgctgatgtctcaatcgaggacagtgtgatctctctgtctggggatcactgcatcatcgggagaactctggtcgtgcacgaaaaagcagacgaccttggcaaaggtggcaacgaagagagcaccaaaaccgggaacgccggctcccggcttgcctgtggcgtgattggcatcgcccagtag

SEQ ID NO: 207415 - DNA, 108 bp, Artificial Sequence
  Description of Artificial Sequence: Synthetic coding sequence
atggccaccaaggccgtgtgcgtgctgaagggcgacggccccgtgcaggggattattaatttcgagcagaaagaaagtaacggtccagagggcgtaggtaagcactag

SEQ ID NO: 207416 - DNA, 1074 bp, Artificial Sequence
  Description of Artificial Sequence: Synthetic coding sequence
atggacagcgtggagaagaccaccaaccggagcgagcagaagagcaggaaatttctgaagtccctgattcgcaaacaacctcaggaattattgctggtcattggaaccggggtgtccgctgctgtcgcccctggaatccccgccctgtgctcatggcgcagttgtatcgaggctgtgattgaggccgccgagcaattggaggtcctgcatccgggtgacgttgctgaattccgtcgcaaggtaaccaaagacagggatctgcttgtggtggcccacgatctaatccgtaaaatgtcaccgagaaccggcgatgctaagccaagcttcttccaagattgtctcatggaagtgtttgacgatctggaacaacacattcggtcccccgtcgtgctgcagagcatcctgtccctgatggaccgtggagctatggtcttaacaactaattacgacaatctgctggaagccttcggtcgtcggcagaataaaccaatggaatccttggatctcaaagataaaaccaaagttctggagtgggcaagaggccacatgaaatacggcgtcctccatatccacgggctctacacagacccctgcggggttgtattggacccttccggatataaagatgtcacccaggacgcagaggtaatggaggtgcttcagaatttgtaccgaactaaatccttcttgtttgtgggatgtggtgagacactccgggaccagatcttccaggcgctgttcttgtactccgttcccaacaaggtcgatctggagcactacatgcttgtgctgaaagaaaacgaggaccacttcttcaagcatcaagccgacatgctcctgcacggcatcaaggtggtcagttatggcgactgttttgatcacttccctggctacgtgcaggatctggcaacccagatctgcaaacaacaatcccctgatgccgaccgcgtagattccaccacactgctagggaacgcctgtcaggactgcgccaaacgcaagctggaagagaacggaattgaagtatcaaaaaagcgaacccaatccgacaccgacgacgccggggggtcctag

SEQ ID NO: 207417 - DNA, 636 bp, Artificial Sequence
  Description of Artificial Sequence: Synthetic coding sequence
atggacccccggaaggtgaacgagctgcgggccttcgtgaagatgtgcaaacaggacccctccgtcctccacaccgaggaaatgagatttctgagggaatgggtagagtctatggggggaaaagtcccccccgcgacccagaaggccaagagcgaggagaacacaaaggaagaaaaaccagactcaaagaaggtggaggaggatctcaaggccgacgagccttcctcagaagagtccgatcttgagatcgacaaagagggtgtaatcgaaccggacacagacgcccctcaggaaatgggggacgaaaacgctgaaataaccgaggagatgatggaccaggcgaatgataagaaggtggccgccattgaggctctgaatgacggggagctccagaaggccattgacttatttacagacgcaattaagctcaacccccgcctggccatcctttatgcaaagagagcatcagtatttgtgaagttacaaaagccaaacgcagcaatcagggactgcgaccgtgccatcgagattaacccggactccgcacagccctacaagtggaggggtaaagcccatagacttctggggcactgggaggaagccgcccatgaccttgccttggcttggacccagtag

SEQ ID NO: 207418 - DNA, 489 bp, Artificial Sequence
  Description of Artificial Sequence: Synthetic coding sequence
atgggcggcaaggtgccccccgccacccagaaggccaagagcgaggagaatacgaaagaagagaaacctgacagcaagaaagttgaggaggacttgaaggcagatgagccctcgtcggaggagtctgatctggagatagataaagagggtgtaatcgaacccgacaccgacgccccgcaagaaatgggcgacgaaaatgccgagataactgaggagatgatggaccaggctaacgacaagaaggtcgcggccatcgaagctctaaatgacggggaactgcagaaagccattgacctgttcacggatgccattaaactcaacccgcggctcgccattttgtatgctaagcgagcttctgtttttgtaaaactgcagaagcccaacgccgctattcgggactgcgatcgggctatcgaaataaatcctgatagcgcccagccatataaatggcgcggcaaagcgcaccggctgcttggccattgggagtag

SEQ ID NO: 207419 - DNA, 366 bp, Artificial Sequence
  Description of Artificial Sequence: Synthetic coding sequence
atggacccccggaaggtgaacgagctgcgggccttcgtgaagatgtgcaagcaggaccctagcgttctccatacagaggaaatgaggtttctgcgtgaatgggtagagagcatgggcggaaaagtcccccctgccacccaaaaagctaagtccgaagagaacacgaaggaggagaaacctgactccaaaaaagtggaggaagatctgaaggcggatgagccctcatctgaagagtctgacctggagatcgacaaagaaggagtgatcgagccggacacagacgccccccaggagatgggcgatgagaatgcagaaattacagaagaaatgatggaccaggccaacgataaaagcggttgttactag

SEQ ID NO: 207420 - DNA, 2568 bp, Artificial Sequence
  Description of Artificial Sequence: Synthetic coding sequence
atgggcagcgaccgggcccggaagggcggcggcggccccaaggacttcggcgcagggctgaagtacaattcccgccatgagaaagtcaatggactggaggaaggagtcgagtttttgcccgtgaacaacgtgaaaaaagttgagaagcacgggccgggacgctgggttgtattggcagccgtgctgataggcctattattggtgttattgggaatagggttcctcgtatggcacctgcaatatcgggacgtccgcgtgcagaaggtgtttaatggatacatgagaatcaccaatgagaactttgtggatgcctatgaaaattctaatagtactgagttcgtcagccttgccagcaaggtgaaggacgcccttaaactgctgtattccggcgtgcccttcctgggcccttaccacaaagagtctgccgtaaccgccttctctgaaggcagtgttattgcatattattggagcgagttcagcattcctcagcacctggtcgaggaagctgagcgagtgatggccgaagaaagggtggtcatgctgcccccacgtgcccggtctctgaaatcctttgttgtgacctctgttgtcgccttccctacagattccaaaaccgttcagagaacgcaagataactcatgttcatttggcctgcatgccaggggcgtggagctgatgcgttttactacccctggctttcctgacagcccttatcccgcccatgccaggtgtcaatgggcacttcggggtgatgccgatagtgtgctcagcctgacattcaggtcgttcgatctggcatcttgtgatgaaagaggctctgatcttgtgacagtatacaatacgctgtcaccgatggaaccccacgcactggttcagctctgcgggacttaccctccgagctacaacctcacctttcatagttctcagaatgtgctcctgattaccttgatcactaatacagaacgccgacacccaggatttgaagctacatttttccaactgcctcggatgtccagctgcggaggccgtctgcggaaggcccagggaacctttaactcgccttactatccaggacattatcctccaaatatagattgtacttggaacatcgaagtccccaacaaccagcacgtaaaggtgaggttcaaatttttctatctgttggagcctggagtgccagccggtacctgtccgaaagattacgttgaaataaacggcgaaaaatactgtggggagaggtctcagttcgtcgtcacatctaactctaacaaaatcacagtcaggttccattcagaccagtcttacaccgacactgggttcttggctgagtatctgtcctacgattccagcgacccctgccccggtcagttcacatgtcggacaggaagatgtattcggaaagagctgcggtgcgatgggtgggccgactgtacagaccatagtgatgagctgaactgctcttgcgatgccggtcatcaatttacatgtaagaacaaattctgtaaacctctgttttgggtatgcgactctgtgaacgactgcggagacaacagtgacgagcagggctgtagttgtcctgcgcagacattccgctgcagcaacggaaagtgcctgtctaagagtcagcagtgcaacgggaaggacgactgcggagatggttccgatgaagcctcctgcccaaaggtgaatgtggtcacctgcacgaagcacacctacagatgcctgaacggcctgtgtctgagcaaaggaaacccggagtgtgatggaaaagaagactgctccgatgggtctgacgaaaaagattgcgactgtggcctcaggtcattcaccagacaggccagggtggttggaggcacggatgctgatgaaggcgagtggccgtggcaggttagtctgcatgcgctggggcagggacacatctgtggggcaagcctcatatcccctaattggctggtcagcgcagcgcattgttacattgatgatcggggattcagatactctgatcccacccagtggacagcttttttgggccttcatgatcagagtcagagatcagccccaggggtacaggagaggaggcttaagcggatcattagccacccatttttcaacgattttaccttcgactatgacattgcactacttgagctggagaagcctgcagaatactcctctatggtccgccccatatgcctgcccgatgcctcccatgtgtttccagcaggcaaggcaatctgggtcaccggctggggccatactcagtacggagggaccggagcactcatcctgcagaagggagagataagagtgattaaccagacaacttgcgagaacctgttacctcagcagatcactccacgcatgatgtgcgtcgggttcctatcaggtggggttgatagctgtcagggagattccggcgggcccctttcaagcgtagaggcagacggcaggatcttccaggccggtgtagtctcctggggagacggatgtgctcagaggaataaacctggtgtctacacaaggcttcctctgttcagggattggataaaggaaaacacaggcgtgtag

SEQ ID NO: 207421 - DNA, 3414 bp, Artificial Sequence
  Description of Artificial Sequence: Synthetic coding sequence
atgaccatgaccgccaacaagaacagcagcatcacccacggcgccgggggcacaaaagcccctagagggacattgagtagatctcagagcgtgtctccgccccccgtactatctccaccccgctcccctatataccctctcagcgatagcgagacttccgcctgcaggtatcctagccattccagtagtcgagtcctcttgaaggatcgtcacccaccagcaccttcccctcagaaccctcaggatccatcccccgacacatccccccctacttgcccatttaagactgccagctttggttacttagacagatcgccgtcagcctgcaagcgtgacgctcaaaaggagtccgtgcagggtgctgcccaggatgtggctggtgtggctgcctgtttgccactggctcagtcaaccccgtttcccggcccagcagcagggccacggggcgtcctgctgactaggacagggacacgtgcacactcactggggatacgcgaaaaaatctccgcttgggaaggaagacgggaggcttccccacggatgtctatgtgtggcgagaagcgggaagggtcaggctcggagtgggccgcatctgagggatgtccttctttggggtgtcccagcgtggtcccgagcccctgtagtagtgagaaaacctttgacttcaagggtctgcgcagaatgtcaagaaccttctccgagtgtagctaccctgagaccgaagaagaaggcgaggcgcttcccgtaagagattcattttaccgccttgaaaagagattgggaagaagtgaaccgtcagctttcctgcgtggacatggttccagaaaagaatcttctgctgtgcttagccggatccagaagatcgagcaggtgctgaaagaacagccaggccgtggcctccctcagttgccctcaagctgttattcagtcgaccgaggcaaacgaaaaacaggtacacttggatcattggaggagcccgcgggtggagctagcgtgtccgcggggtcccgagctgtaggcgtcgccggagtggcgggtgaagccgggccacctccagagagagaaggcagtggctccaccaagccaggcacgccaggaaactcacctagcagtcagaggctgccctctaagtcttctctggatccggctgtcaaccctgtgcccaaacctaaaaggacatttgagtatgaggcggacaaaaatcccaagtccaagccctccaatggcttaccgccatcaccgacaccagcagcccctccaccactgccatcaacacccgctccacctgtaaccaggagaccgaagaaagatatgcgcggccatcggaaatctcagtccaggaaaagtttcgaatttgaggacgcctcctctctgcaaagcctgtacccttccagccctactgaaaatgggaccgagaaccaaccaaagttcggatccaaatcaaccctggaagagaacgcttacgaagatatagtaggcgacttaccaaaggagaacccgtacgaggatgtggaccttaaaagccgtagagcaggccggaagagtcagcagctcagcgaaaactccctcgatagtttacatcgcatgtggtcaccccaggaccgcaagtacaacagccctcctactcagctgagcctgaagccaaatagccaaagcctcagatccggcaactggtcggagcgaaaatctcatcgcttaccccgtctgccgaagaggcactcacacgacgatatgttgttgcttgcacaactatcgcttccaagtagcccctcatccctgaatgaagacagcctttcaacaacatccgaacttctttcatccagacgagcccggcgcatccccaagctggttcagcgaatcaactcgatttacaatgccaaaaggggtaagaaacgcttgaaaaaactgtccatgagctcaattgaaactgcctcccttcgcgatgagaacagtgagtccgaatctgatagcgacgatcgctttaaagcccatacccaaaggctggtgcacattcagagcatgctgaaaagggccccctcatataggactctggagctggagctgctcgagtggcaggagcgcgagctgttcgagtacttcgttgtggtgagccttaagaagaagccctcccggaacacctacctgccagaagtgagttatcaattcccaaaacttgaccgacccaccaaacagatgagggaagctgaggagagactgaaggcaattcctcagttctgtttccccgatgccaaggactggcttcctgtgagcgagtactccagtgagaccttttctttcatgttaaccggggaagacggatcacgccggttcggctactgtcgccgtctgctcccatctggcaaaggccctcggttacccgaagtgtactgcgtgatttcgagactgggttgcttcggcctgttcagtaaggtgctcgatgaagtggagaggcggagaggtataagcgccgcccttgtgtaccccttcatgaggtccttgatggaaagccctttcccagcccccggcaaaaccattaaggtgaaaaccttcctaccaggggcaggaaatgaggttctcgagctgcgccggccgatggactccaggctcgagcacgtcgattttgaatgtctgttcacttgcctgtccgtgcggcaactgatcaggatcttcgccagcctgctacttgagcgaagagtgatattcgtcgccgacaagctgtccactctgagcagctgctctcatgcagtcgtggctctcttatatcctttcagttggcagcacacttttatacccgttctgccagcaagtatgatcgacatcgtgtgttgtcccaccccatttttggtcggcctattgagcagctccctccctaaacttaaagagctgccagtggaggaagcactgatggtaaacctcgggtctgataggtttatccgccaaatggacgacgaggatacccttctgccacggaagctccaggccgccctggaacaggccctagagcgcaaaaacgagctcatctctcaagactcagacagcgattcggatgacgaatgcaacaccttgaacggactagtgtcagaggtcttcatcagattcttcgtggagacggtcgggcattatagtttatttttgacacagtccgagaaaggtgagcgtgccttccagcgggaagcctttagaaaaagcgtggcgtccaaatctattcgaaggttcctggaggtgtttatggaatcccagatgttcgccggattcatccaggatagggagctgcgcaagtgcagagccaaggggctgtttgaacaaagggttgagcagtatctagaagaactgccggataccgagcagagcggcatgaacaagttcttgcgggggttgggcaacaaaatgaagtttcttcacaagaaaaactag

SEQ ID NO: 207422 - DNA, 3414 bp, Artificial Sequence
  Description of Artificial Sequence: Synthetic coding sequence
atgaccatgaccgccaacaagaacagcagcatcacccacggcgccggtggaactaaagctccccgcgggacgctgtcgcggagtcagtctgtatccccaccccctgtgcttagtccgccgaggtcccccatttatcccctgtccgattcagagacttctgcttgcagatacccctcacacagtagttcccgtgtcctcctgaaggatcggcacccccctgcgcccagcccccagaaccctcaggacccttcccctgacaccagcccaccaacgtgtccttttaagaccgcatcattcggctacttagacagatccccatctgcatgtaaacgagatgcgcaaaaagagtccgtacagggcgctgcccaggacgtggctggggtggctgcctgcctccctctggctcagagtacaccattcccaggccccgccgccggccctagaggggttttgctgacccggacgggcacccgagcacatagtctgggcattcgcgaaaagataagcgcatgggaggggcgaagggaagcgtctcccaggatgagcatgtgtggggagaaacgggagggctcgggatcagaatgggcagccagtgaggggtgtccatccctcggttgcccttccgttgtacccagcccgtgtagtagtgagaagactttcgattttaaggggctgaggcgtatgtctcgcacattcagcgaatgctcttaccccgagaccgaggaagagggcgaagctctgcctgtccgagatagcttctaccgattggaaaaaaggctcggaaggtccgagccatccgcctttcttaggggccacggatctcgtaaggagagttccgctgtgctgtctagaattcagaaaattgaacaggtgctgaaagagcagcctgggcgcggcctgccgcaactgccttcctcttgctactccgtggatagaggaaagagaaagacaggcacactgggatcactcgaagagcctgctgggggtgcttccgtgagtgctggaagtagagctgtcggggtggctggagtcgcgggcgaggccggcccacctcccgaaagggaaggcagcggcagcactaagcccggtactcctgggaattctccgtccagtcaaaggctaccatctaaaagctcgctggatccggccgtgaaccctgtgcctaaacccaagcgtacattcgagtacgaagcagataaaaaccccaagtccaagcccagtaacggactacctccgtcacctacaccggctgctccaccgccactcccttcaacacccgccccgcccgtgacgcgccgacctaagaaagatatgaggggccacagaaagtcccagtcaagaaaatcttttgaattcgaggacgcatccagtctgcagagcctgtatcctagctcccccacagaaaacggtaccgaaaaccagccaaagttcggaagcaaaagtacattggaggagaatgcttacgaagatatagtgggcgatctgccaaaggagaatccttatgaggatgtcgacttgaagagccgccgggcaggtagaaaaagtcaacagctctccgagaactctttagactctcttcataggatgtggtcccctcaagaccgaaaatacaacagccccccaacacagttgtcattgaaaccaaacagtcagtcccttcggtctggaaactggtcggaaagaaagtcccaccgactgccccgtctgccgaagagacactcacacgacgacatgctgctcttggcacaactgtccctgccttcaagccccagttcactgaacgaagacagtctttcaactactagtgaactactgtcgtcacggagggccaggcgtatccctaaacttgtacagcggattaatagcatctataacgcgaagcggggaaagaaaaggttgaaaaagctatctatgagttccatcgagaccgccagcctgcgagatgagaatagtgagagcgaaagtgactctgatgatcgctttaaggcccacacacagaggttggtgcacatccaaagcatgcttaagagagctcccagctaccgcacgctggaactggaattactggagtggcaagagcgggagctgttcgaatactttgtcgtggtgtccttaaagaaaaaaccatctcgcaacacctacctcccagaggtatcttatcagtttccgaaactagataggccaaccaagcaaatgagggaagctgaagaaagactaaaggccatcccccagttttgcttccctgatgcaaaggactggctgcctgtgtcagaatattcgtctgagacattttcattcatgctgaccggtgaggacggctcccgccgattcggctattgccgtcgacttttgcctagtggcaagggaccaagactgcccgaagtgtactgcgtaatatccagacttggatgtttcggcctcttctccaaggtcctcgatgaggttgaacggagaagggggatttcagctgcccttgtgtatccgtttatgcgttccttaatggagtctccctttcccgccccaggtaaaaccataaaggtcaagacctttctaccaggcgcaggcaatgaggtgctggagctacgcaggcctatggattctagattggagcacgtggacttcgaatgtctgttcacatgcctgagcgttagacagctgatccgtatttttgccagcctgctgttagagcgaagagttatattcgtggccgacaagctgagcaccctctcttcttgcagccacgcggtcgtggccttattgtatcccttctcatggcagcacaccttcatccctgttttacctgctagtatgatagacattgtgtgttgcccgaccccctttctggtcggattgctctccagttcccttcctaagctgaaagagttacccgtcgaagaagcattgatggtcaatctgggaagtgacagatttatcagacagatggatgatgaggatacccttctgccgcgaaaattgcaggcggctttggaacaggccctggaaaggaagaatgagctgatctcccaggactctgactccgactccgacgatgagtgcaacacgctcaatggactggtctcagaggtttttatacgattttttgtggaaaccgtcggccactactcgctgttcttgacccagagtgaaaagggtgaacgcgccttccagcgtgaagcctttcgaaagtctgtcgcttccaagtcaatcaggcgattccttgaggtcttcatggagtcccagatgttcgccgggttcattcaagacagggagctcaggaagtgccgggccaaaggtctgtttgagcaaagagtggaacagtatctggaggagctcccagatacggagcagtcaggaatgaacaaatttttgaggggactggggaataaaatgaagtttctgcacaagaaaaattag

SEQ ID NO: 207423 - DNA, 1263 bp, Artificial Sequence
  Description of Artificial Sequence: Synthetic coding sequence
atgaccagccggaagaacggcggcggcgcccacagctggcaggagacaccctgggagcaaagacgcgctctcggtttgcaacgggctgagatgactatgacagcgaacaagaattcaagcatcacccatggcgctggtggaaccaaagcacccagagggactctgtcaagaaaaagcttcgagttcgaggacgcctcctccctgcagtctctgtacccgtcctcccccaccgaaaatggtaccgaaaatcagcctaaattcggctcgaaatcaaccctggaagaaaatgcctacgaggatattgtgggcgacctccccaaggagaatccctacgaggacgtggatctgaagtctcgtcgggctggccgaaagtctcaacagctcagtgagaactcactggactcactgcaccggatgtggtctccccaagacaggaaatacaactcccctcccacccagttatcgctcaaaccaaacagccagagcctccgatcagggaactggtctgagagaaagagccacaggcttcccagactgcctaaacgccactctcacgacgatatgctgttgctcgcccaactcagtctgcccagtagcccaagctcactgaatgaggattcgctgagcacaacctccgaactgttaagttcacggcgagcccgtagaataccaaaactggttcaacggattaactccatctataatgcaaaacgcggtaagaaacgactgaaaaaactgtccatgtctagcatcgagaccgcatccctccgggatgagaacagcgaaagcgaaagcgacagcgacgatagattcaaagcccacacacagaggcttgtccacatccagtcaatgctgaaaagggcgcctagctataggaccctggaactcgaactgttggaatggcaagaacgcgaattgttgagcaccctttggtggtgtccctctagacgcagccaccgggagacccccacttcgcccaagtctccaacctcctttccaaggaacgttctgtcccccgccctacacgtcgcagccggctcgttttcgttcctgcgactgtgctcttcaaggacctcttttcgccgcagtgttcagacgcctgcctggtcaccgtctcccgcccagttggcacttctggacaggcccacaaagcaaatgcgagaggccgaggaacgactgaaggctatccctcaattttgtttcccagatgctaaggattggctacccgtgtctgaatacatgcgcccgtttctgagttgttag

SEQ ID NO: 207424 - DNA, 174 bp, Artificial Sequence
  Description of Artificial Sequence: Synthetic coding sequence
atgaccatgaccgccaacaagaacagcagcatcacccacggcgccggtggcaccaaagcacctaggggcactctgtcgaggagccagagcgtgtccccacccccagtgcttagcccccctagatcgccgatttatccgcttagtgatagcgagaccagtgcctgtcgttactag

SEQ ID NO: 207425 - DNA, 123 bp, Artificial Sequence
  Description of Artificial Sequence: Synthetic coding sequence
atgaccatgaccgccaacaagaacagcagcatcacccacggcgccggaggcacgaaagcgccaaggggaacactcagccggtcccagtccgtgtctcctccacccgttttgtcaccaccttag

SEQ ID NO: 207426 - DNA, 144 bp, Artificial Sequence
  Description of Artificial Sequence: Synthetic coding sequence
atgtggagcccccaggaccggaagtacaacagcccccccacccagttgtcactgaagccaaactcacaatcactcaggagtggcaactggagcgagagaaaatcacaccgactgccacgcctgcccaagagacattcccattag

SEQ ID NO: 207427 - DNA, 219 bp, Artificial Sequence
  Description of Artificial Sequence: Synthetic coding sequence
atgaccatgaccgccaacaagaacagcagcatcacccacggcgccggcggaaccaaggctccgagaggcacattaagcaggaagtctttcgagtttgaggacgccagcagtttgcagtcactctatccttcatctcccacagaaaatgggactgagaatcagccgaaattcggcagcaagtctactttggaggaaaacgcatatgaggatatagtgtag

SEQ ID NO: 207428 - DNA, 375 bp, Artificial Sequence
  Description of Artificial Sequence: Synthetic coding sequence
atgaccatgaccgccaacaagaacagcagcatcacccacggcgccgggggcaccaaggccccgaggggtacccttagcaggtcccagtctgtcagccctccacccgtgcttagccctcctcgctcaccaatttacccgttgtctgatagcgagacatccgcttgccggtatccttctcacagttcctctagggtgcttctcaaggacaggcatccacctgctccaagtccacaaaatccacaagacccttctccagataccagtccccccacatgcccgtttaaaacagcctcattcggctatcttgatagaagtccctctgcctgcaaacgggacgcccagaaagaatctgtgcagggagccgcccaagattag

SEQ ID NO: 207429 - DNA, 429 bp, Artificial Sequence
  Description of Artificial Sequence: Synthetic coding sequence
atgaccatgaccgccaacaagaacagcagcatcacccacggcgccggcgggacaaaggccccccgggggaccctctcaagatcacagtcagtgtccccgccacctgtattgtcacctccccgttccccaatctaccctctgtctgactccgagactagtgcgtgtagatacccttcacactccagcagccgtgtgctgttgaaggatcggcacccgcctgcaccctcgccccagaatccacaggatccttcgccggacactagccctccaacatgtccatttaagaccgcctcattcggttacctcgataggtctccctcagcgtgcaaacgcgatgctcagaaagagagtgtgcagggggctgcacaggacgttgccggagttgccgcctgtctgccactggctcagtcaaccccattcccaggctag

SEQ ID NO: 207430 - DNA, 2154 bp, Artificial Sequence
  Description of Artificial Sequence: Synthetic coding sequence
atgaccatgaccgccaacaagaacagcagcatcacccacggcgccgggggcaccaaggccccacgcggtacattaagtcgaaaatccttcgaattcgaggatgcctcctccctgcagtcactgtatccttcaagcccaactgagaatggcacagagaaccagccaaaatttggaagtaagagtactcttgaagagaatgcctacgaagatatcgtgggtgaccttcctaaagaaaatccctacgaagacgttgacctgaagtccaggcgcgcaggtagaaaatctcaacaactctccgaaaacagcttagatagcttacaccgtatgtggagccctcaagaccgaaaatataacagtccacccacacagctgagccttaagccaaattcccagtcccttagatccggaaactggtccgagagaaagtcacacagattgccgagactgcctaaacgccattcacacgatgacatgcttctgctagcacaactgtccctgccctcaagcccatcctccttaaatgaggactcactctccaccacctccgagctgctctcctctagacgggccaggcgtatcccaaaacttgtccagagaatcaatagcatttataacgccaagagggggaaaaagcggctgaaaaagttgagtatgtctagtattgaaacggctagtctgagagacgagaattcagagtccgaaagtgactcagacgaccggtttaaggctcatactcagcgcctggtacacatacagtcaatgcttaagagggctccctcctatcggaccctggaactcgagctgttggagtggcaggaacgggaactgtttgaatattttgtggttgtttctctgaaaaaaaagcccagtcgcaacacctacctccccgaagtgagctatcagttccccaagctggacaggcccacaaagcagatgagggaggctgaggagagactaaaagccataccgcagttctgttttcctgacgccaaggactggctgccagtgtcagagtacagtagcgagacattctccttcatgctaactggcgaggatggctctcggcgatttggctactgtaggcgactcctgccgtcaggcaaggggcccaggctgccagaagtctactgcgtaatcagtcggctgggctgtttcgggctgttctctaaagtcctcgatgaagtcgagcggcgcagaggcatttctgcagccctggtttatccattcatgcggagcttgatggagagcccttttccggcacccgggaaaacaataaaggtcaaaacattcctacccggcgctggcaacgaagtcctggagttgaggcggcccatggactctcggctcgagcatgtagatttcgagtgtttgtttacctgcctgagtgtaaggcagttgattcgcatcttcgccagcctactcctggaaagaagagtcatttttgttgcagataagctgtcgacgttaagttcatgctcccatgcggtagtggccctcctgtaccctttttcttggcaacacacattcattccggttctaccggccagtatgatcgacattgtctgctgcccaaccccattcctggtagggctgctttccagcagccttccgaaactgaaggagttaccagtggaggaggccctgatggtgaacctgggatccgacagattcatcaggcaaatggatgatgaggatacgctcctgcctcgcaaactccaggccgctctggaacaggctctggagaggaagaatgaactcatatcccaagactccgactctgacagcgatgatgaatgtaacaccctgaacggacttgttagcgaagtgtttatcaggttcttcgtggaaaccgtaggccactattccttgtttcttacccaatccgaaaagggtgagagagccttccagagggaggcatttcgcaagtcagtggcttccaaatccatccggagatttctcgaagtatttatggagtcgcaaatgttcgccggcttcattcaagatcgggaactgaggaagtgtagagctaagggattatttgagcagcgggtcgaacaatatttggaggagctgcccgacactgaacagagtgggatgaacaaattcttgcgaggacttgggaacaagatgaaattcttacacaagaaaaattag

SEQ ID NO: 207431 - DNA, 159 bp, Artificial Sequence
  Description of Artificial Sequence: Synthetic coding sequence
atgaccatgaccgccaacaagaacagcagcatcacccacggcgccggcgggaccaaggcaccacgagggacacttagccggagccagagtgtatctccaccccctgtgctttcgccaccacgctctcctatataccccctgagtgacagcgagacttag

SEQ ID NO: 207432 - DNA, 336 bp, Artificial Sequence
  Description of Artificial Sequence: Synthetic coding sequence
atgaccatgaccgccaacaagaacagcagcatcacccacggcgccggtgggacaaaagcaccacgggggacattgtcccgaagccagtctgtgagtcctccaccagtcctgtcccctccgcgaagccctatctatcctctgagtgactcagagacctcagcttgccgatacccctcgcactcctcttcgagagtactcctgaaggatagacatcccccagctccatcacctcagaacccacaggacccttctcctgacacatccccaccgacttgcccctttaagaccgctagtttcggatacttggacagatccccatccgcctgtaaacgctag

SEQ ID NO: 207433 - DNA, 162 bp, Artificial Sequence
  Description of Artificial Sequence: Synthetic coding sequence
atgaccatgaccgccaacaagaacagcagcatcacccacggcgccggcggaactaaggcccccagaggcacactgtcgcgttcacaaagtgtttcacccccaccagtgctttcccccccaagatccccaatctaccctctgagcgactccgagacttcctag

SEQ ID NO: 207434 - DNA, 252 bp, Artificial Sequence
  Description of Artificial Sequence: Synthetic coding sequence
atgaccatgaccgccaacaagaacagcagcatcacccacggcgccgggggcactaaggccccccgaggcacactcagtaggagtcagagcgtctctccacccccggttttatctccgcctagaagtcctatctacccgctatccgacagcgagacttcagcgtgcagatatccatcacattcatccagtagggtcctcctgaaggacaggcacccccctgcccctagcccccagaatccacaggatccatag

SEQ ID NO: 207435 - DNA, 288 bp, Artificial Sequence
  Description of Artificial Sequence: Synthetic coding sequence
atgaccatgaccgccaacaagaacagcagcatcacccacggcgccgggggcacaaaagcccccaggggtacactctcccggagtcagagcgtttcgccgccccccgttctaagtccccctagaagccccatatatcccctgtcagatagtgagacttccgcgtgccggtacccatcccattcctccagtcgcgtgctgcttaaggaccgacatccgcctgcaccctccccccaaaaccctcaggatccttccccagacacttctcccccaacgtgtccttttaaatag

SEQ ID NO: 207436 - DNA, 465 bp, Artificial Sequence
  Description of Artificial Sequence: Synthetic coding sequence
atgaccatgaccgccaacaagaacagcagcatcacccacggcgccggaggtaccaaagccccacgaggcactctgtcccgatcacagagcgtgtcgccccctccagttctgagtccaccaagatcccccatctatcccctctctgactcggaaactagcgcttgcaggtatcctagccatagcagtagccgcgtgctgctgaaagacaggcatccacctgcccccagcccccaaaatccacaggatccttctccagacacatcaccacccacttgcccctttaaaactgcatccttcggatatctggaccggagtccatcagcatgtaaacgtgatgcacagaaggagagtgtacagggtgccgcccaggatgtggccggagtggctgcctgcttgcctctagcacaatccacaccatttcccggtccagcagcaggacctcgtggtgtcctgctcacaaggtag

SEQ ID NO: 207437 - DNA, 540 bp, Artificial Sequence
  Description of Artificial Sequence: Synthetic coding sequence
atgtggagcccccaggaccggaagtacaacagcccccccacccagctgtctctaaaaccaaatagccagtccctacgctctgggaactggagtgagagaaaatctcacagactgcccaggctccccaagagacacagtcacgatgacatgttgcttcttgcccagttgtccctaccctctagcccttcctccctgaacgaggattcgttgagtacaacctctgagcttctgagttcaaggagagcccgaagaattcccaagcttgtgcaacgcatcaactccatctataatgcaaaacgcggtaagaagcgactgaaaaaactctccatgtcttccatcgagactgcaagtctgcgagacgagaatagcgagtctgagagcgactctgacgaccgtttcaaggcccacacacaacgtctggtacatatccaatcaatgctcaaacgcgcccccagttatcgcactctggaactcgagctactggaatggcaggagagggagctgtttgagtacttcgttgtggtgagtctgaagaagtag

SEQ ID NO: 207438 - DNA, 2154 bp, Artificial Sequence
  Description of Artificial Sequence: Synthetic coding sequence
atgaccatgaccgccaacaagaacagcagcatcacccacggcgccggtggcacaaaagcccccaggggaacactctctcggaagagctttgaatttgaggacgctagctccctgcagtccctgtatccatcttccccaaccgagaatggcacggagaatcagccgaagttcgggtctaagtcgacactggaagagaacgcctatgaggacatcgtcggagacctgcccaaggagaatccttatgaagatgtggatcttaagagccggcgtgccggtcggaaaagccagcaactatccgagaactcactcgacagccttcataggatgtggagcccccaagatagaaaatacaactcaccacctacacagctgagtctgaagccaaactcacaatctttgcgctcaggtaactggtccgagagaaagagtcatagactgccccgcctgcccaaacggcactcccacgacgatatgctgttgctggcccagctttccttacccagtagtccctcctcactgaatgaggatagcttgtccactacatctgaacttctctcaagcaggcgcgctagaaggataccgaagcttgttcagcgtattaatagcatctacaatgcaaagagaggaaagaaacgcctcaaaaaactgtcaatgtcgtccatagaaacagcatcactgcgggacgagaattccgaatccgagagtgattcagatgacaggtttaaggcccacactcagagactggtccacattcagtccatgctcaagcgggcaccctcctacagaacgttagagttagagctgctagagtggcaggaacgggagctctttgagtacttcgtggttgtatctctgaaaaagaagccatcccgtaacacttacctgccggaggtgtcttatcagttccccaagctggacagaccgactaagcaaatgagagaagcagaggagagattaaaggcgataccccagttctgctttccggatgctaaggactggctcccagtgagtgagtattcttcggagacctttagcttcatgctgaccggagaggacgggtctagaaggttcggatactgcagacgcttacttccaagcgggaaagggcctcgtctgcctgaagtatattgcgtaataagtcgactggggtgctttggccttttttccaaggtgctggacgaagtggaaagaaggcgaggtatttctgccgcactggtgtaccccttcatgaggtctctgatggagtcgccattccctgcaccaggaaagacgattaaagtgaaaacatttctgcccggcgccggcaatgaggtactggagctacggcgtcccatggacagccggctggaacacgttgattttgagtgtcttttcacctgtctgagcgtgcgccaattaatccggatttttgcgtctttgcttctcgagaggcgcgtgatcttcgtggccgacaaactcagcactctttcttcttgctctcacgcggtggttgccctcctgtaccctttctcctggcagcacacatttataccggtgctcccggcttcgatgatagatatcgtctgctgtcccacccccttcctagtaggactgctgtcttcatccttgcccaagctgaaagaactccccgtggaggaagctcttatggttaacctgggcagcgatagattcatccgccagatggatgatgaggacacactgctgccgcgaaaacttcaggcagcgttggaacaggccctggagcggaagaatgagctgatcagccaggatagcgattccgatagcgatgatgagtgcaacactctcaacggactcgttagcgaagtattcataaggttctttgtagaaacagtgggtcattattctttgttccttacacagtcggaaaagggggagagagcattccagcgagaagcctttcggaaaagcgttgcctccaaaagtattcggagattcctcgaggtgttcatggaatctcaaatgttcgccggcttcatacaggaccgtgagttgcggaaatgtcgtgccaaaggcctgtttgagcagcgggtggagcaatatctcgaagaactgcctgataccgagcaaagcggaatgaacaagttcctccgggggcttggtaataaaatgaagttcttacacaagaagaactag

SEQ ID NO: 207439 - DNA, 411 bp, Artificial Sequence
  Description of Artificial Sequence: Synthetic coding sequence
atgaccatgaccgccaacaagaacagcagcatcacccacggcgccggcggaaccaaggctcctcgggggaccctgagccgaaaatcctttgaatttgaagatgcctctagccttcagtccctgtatccaagctctccaacggagaatggcaccgaaaaccagccgaaattcggaagtaaaagcacactggaggaaaatgcctatgaggatatcgttggcgacctaccaaaggaaaatccgtatgaggatgtcgacctcaagagccggagagctggaaggaagtctcagcagctgtccgagaatagcttggacagtttgcataggatgtggagcccccaggatagaaagtataatagtccacccacacaactctctctgaaaccaaacagccagagtcttcgatctggttag

SEQ ID NO: 207440 - DNA, 225 bp, Artificial Sequence
  Description of Artificial Sequence: Synthetic coding sequence
atgaccatgaccgccaacaagaacagcagcatcacccacggcgccgggggaacaaaagcccctcggggcacattgtctaggtctcagtcagtctctccgccccccgtactcagtccacccaggtctccaatctatcctctatccgattcggagacttccgcctgtagatatccttctcacagctcttcacgagttctgctgaaagaccgccatccgcccgcctag

SEQ ID NO: 207441 - DNA, 420 bp, Artificial Sequence
  Description of Artificial Sequence: Synthetic coding sequence
atgaccatgaccgccaacaagaacagcagcatcacccacggcgccggtggaacgaaggccccacggggaactctctctcggtcccagtcggtgtccccgcccccagttctaagccctcctagaagcccaatatacccactctccgactctgagacgagcgcttgccggtatccgtctcattcttcctcccgtgttttgctgaaggacaggcaccctcccgctcctagcccacagaatcctcaggatccttcaccagacacctctccacccacatgtccatttaaaaccgcaagctttggttacttagatcggtctccgtcagcatgtaaaagggacgcgcagaaagagtcggtgcagggggccgctcaggacgtcgccggtgttgcagcttgcctgcctttagcccaatccactccatag

SEQ ID NO: 207442 - DNA, 1830 bp, Artificial Sequence
  Description of Artificial Sequence: Synthetic coding sequence
atgtggagcccccaggaccggaagtacaacagcccccccacccagttgagcctgaaaccaaattctcagtccctgcgaagcggtaattggtccgagcgcaagtcccacagactgccaagactgcctaaaagacactctcatgatgacatgctgcttctggcacagcttagcctgccctcttcaccttcttccttaaacgaagattctctgtcgacaacatctgagctgttgtctagccgtcgtgccagaagaatcccaaagttggtgcagcggataaacagcatttacaacgccaaacgcggaaagaaaagactcaaaaagctgtcaatgagcagcatcgagacagcttctctccgagatgaaaacagtgaatccgaaagcgattcggatgatcgcttcaaggcccacactcagaggctggtccacatacagtctatgctcaagcgggcaccttcatacaggactctcgagcttgagctgttagaatggcaggaaagggagctgtttgagtatttcgttgttgtgagcctgaaaaagaagccctcccgcaatacctacctgcctgaagtctcttatcagttccctaagttggataggcccaccaaacagatgagagaagccgaggaaagactgaaagctattcctcagttttgtttccccgacgcgaaagattggttgcctgtttctgagtactctagtgaaaccttctcatttatgctgacaggggaggatggaagcagaagattcggttactgcagacgattgcttccctccgggaaaggcccccggctgccagaggtttattgcgtgatctcaagactgggttgcttcggtttgttcagtaaggtcctggacgaggtggagcgtcgtaggggcatttccgcggctcttgtttatcctttcatgcgcagccttatggagtctcccttccctgcgcccggaaagacaatcaaggtgaagaccttcctgccaggagcaggcaacgaagtgctggagctacgtcgtcccatggattcccgccttgaacacgttgactttgaatgtctgttcacctgtctgtcagtccgtcaactgatccgcatttttgcttctctcctcctggagcgcagggttatcttcgtagcagataagctgtcgactctctcctcctgcagtcatgccgtggttgcactgctgtatccattctcttggcagcatactttcatccctgtgctgcccgcttccatgatcgacattgtttgctgccctacaccatttttggtgggtctgctttcgtcctcactgccaaagctgaaggagctgcccgtcgaagaggccttgatggtgaatctcggctctgaccgattcatacgacaaatggatgatgaggacacactcctccccagaaagctacaggccgcactagagcaggctctggagaggaagaatgaattaatctcccaagatagcgattcagactccgacgacgaatgcaacacattaaatggccttgtgtccgaggtttttataagattctttgtcgagacagtaggacattactctctcttcctcacacagagcgaaaagggagagagagccttccagcgagaggcattccgaaagagtgtcgcctctaaaagcatcaggcgcttcttggaagtgtttatggagagtcaaatgtttgccgggtttattcaggacagagaattgcgtaagtgccgcgccaagggactcttcgaacagagggtggaacagtaccttgaagaactcccagacacggagcagtccgggatgaacaaattcctgagagggctgggcaacaaaatgaaattcctccacaaaaagaattag

SEQ ID NO: 207443 - DNA, 234 bp, Artificial Sequence
  Description of Artificial Sequence: Synthetic coding sequence
atgaccatgaccgccaacaagaacagcagcatcacccacggcgccggaggaacaaaggcccccagaggtacactgagccgaaagtccttcgagtttgaggacgcctccagtcttcagtcattgtacccctcttcgcccacagagaacggcacagagaatcagcccaagttcggctccaaaagtacgctggaggaaaatgcctatgaggacatcgtaggagacctgccaaagtag

SEQ ID NO: 207444 - DNA, 81 bp, Artificial Sequence
  Description of Artificial Sequence: Synthetic coding sequence
atgaccatgaccgccaacaagaacagcagcatcacccacggcgccggtggaacaaaggcccctcgcggaactctgtcttag

SEQ ID NO: 207445 - DNA, 1035 bp, Artificial Sequence
  Description of Artificial Sequence: Synthetic coding sequence
atgtggagcccccaggaccggaagtacaacagcccccccacccagttatcgcttaagcccaatagccagagcctgcgttcagggaattggtcagagagaaagagccaccggttacctagactgcctaagcgacacagccacgacgatatgctcctcctcgcccagcttagtcttccctcatcaccaagctccctgaatgaagactcccttagcaccacaagcgagctgctcagctcgcggcgagcccggaggatccccaagttagttcagaggattaattcaatttacaacgctaagcgtggcaagaaaagactaaaaaaattatctatgtcttccattgaaacggcgagtttacgggatgaaaattccgaaagcgagagcgactcagatgaccgcttcaaggcccacacacagcgcctcgttcacattcagtcaatgttgaagcgcgctccttcatataggactttagaactcgagctgttagagtggcaggagagagagctgtttgagtacttcgtagtcgtgtcgctaaagaagaagccttctaggaatacatacctgcccgaggtgagctaccagttcccgaagctggatcgtcccactaaacagatgcgcgaggccgaggaacggcttaaagcgatccctcagttctgtttcccagatgcgaaagactggctgccagtgtcagagtacagcagtgagactttttcttttatgctgacgggtgaggatggtagcagaaggtttggatactgtcggcgcttactgccctcgggcaagggcccacggctccccgaagtgtactgtgtcatcagcaggcttgggtgttttggactgttcagcaaagtgctggacgaggtcgagcggaggcgaggcatctcagctgccctggtgtatccattcatgcgtagcctcatggagtcaccattccccgcccccggcaaaactataaaggtgaagacattcctccccggggctggaaacgaggtgctggaattgagacgaccaatggattccaggctggagcacgtgtag

SEQ ID NO: 207446 - DNA, 231 bp, Artificial Sequence
  Description of Artificial Sequence: Synthetic coding sequence
atgaccatgaccgccaacaagaacagcagcatcacccacggcgccgggggcacaaaagcacctcggggcacccttagccggaaatcgttcgagtttgaagacgcttccagccttcaaagcctttatccctcaagtcccacggagaacgggacggaaaaccagccaaagtttggctccaagagcaccctggaggagaacgcctacgaggacattgtcggggatctgccctag

SEQ ID NO: 207447 - DNA, 225 bp, Artificial Sequence
  Description of Artificial Sequence: Synthetic coding sequence
atgaccatgaccgccaacaagaacagcagcatcacccacggcgccggcggcacaaaggctcctagaggaaccctgagtcgttcacaatcagtgtctcccccacccgtgctttcaccccctagatcaccgatttaccctctcagcgactcggagacatcggcctgcaggtaccccagccactcctcaagccgtgtattgcttaaagacagacacccacccgcctag

SEQ ID NO: 207448 - DNA, 435 bp, Artificial Sequence
  Description of Artificial Sequence: Synthetic coding sequence
atgaccatgaccgccaacaagaacagcagcatcacccacggcgccggcggcaccaaggcccccagagggacactttcaaggagtcagagtgtaagtccccctcccgttctgtcacccccacgctcacctatttatcctctgagcgactcagaaacttccgcttgcagatatccttcccactcttcctcacgggtactcctgaaagataggcatcctcctgcaccctcacctcagaacccccaggatccgtccccagacactagtccgccaacatgcccatttaaaacagcgtctttcggctacctagaccggagtccatctgcatgcaagcgagatgctcagaaagaatctgtgcagggagccgcgcaggatgtggccggagtcgccgcctgtctgcccttggcccaatccactccttttccaggacctgcatag

SEQ ID NO: 207449 - DNA, 3414 bp, Artificial Sequence
  Description of Artificial Sequence: Synthetic coding sequence
atgaccatgaccgccaacaagaacagcagcatcacccacggcgccggcggaacaaaagctccccggggaactctttcccggagccaatcagtttcccccccacccgtattgtcgccccctcgctcgccaatctaccctctaagtgattctgaaaccagcgcctgcagatatccgagccacagcagctctcgggtgttgctcaaagaccgacacccccccgcgcccagcccccagaaccctcaagatcccagtccggatacctcaccccccacgtgcccatttaagaccgccagctttgggtacctcgatcgcagcccttcagcgtgtaagagggacgcccagaaggagagtgtgcagggggctgcgcaggatgtcgctggtgtggccgcatgtttacccttagcccagtcaactccattccctggaccagcagccggtccccgcggagtcctcttgaccaggacaggaaccagagcccattccctgggcattcgtgaaaaaatctccgcttgggaggggcgacgggaggcttcacccagaatgtcgatgtgcggtgagaaacgggaagggtctggcagcgagtgggccgcctccgaaggctgccctagtttaggctgcccttcggtggtccccagcccttgcagctccgagaaaacctttgactttaagggccttcgcagaatgtctaggacattctccgagtgcagctaccctgagaccgaagaggagggggaggccttacctgtgcgagactctttttacagactggagaaacgcttgggtcgaagtgaacctagcgcgtttctgcgtgggcacggttcccgcaaagagagcagcgcagtgttgagtaggatccaaaaaatcgagcaggtgcttaaagagcagccggggcggggcttgccgcaactgcccagcagttgctatagcgtcgacagaggtaagcgtaagacaggtaccttagggagtcttgaggaacctgccggtggcgcctccgtgtcagccggcagccgggcagtcggcgtggcaggtgtggcaggcgaagcggggccacctcccgaaagggagggttccggcagtaccaagcccgggactcccggaaatagtccaagctctcaaagactgccgtcaaaaagcagtcttgaccccgctgttaatcccgtcccaaagccgaaacgcacctttgaatatgaagctgacaaaaatcctaaaagcaagcctagcaacggtctgccccctagtccaactcctgcagccccacccccactccccagtactcctgccccacctgtgacccgcagacccaagaaagatatgcgcggacaccgtaagtcccaatccagaaaatctttcgagttcgaggacgcctcttccctgcagagcctgtacccatcttcccccactgagaatggaacagagaatcaacccaaatttggatctaagtccactctggaagaaaatgcgtacgaggatattgttggcgacctgcctaaggaaaacccatatgaagacgtcgacctaaagagccgacgtgctgggagaaaaagtcaacagctcagcgaaaattctctagattcgttgcataggatgtggtcacctcaggacaggaagtataattccccacctactcagttgtctttaaagccaaacagccaatctctgcgatccgggaactggagtgagagaaagtcacaccgcttgccgagattaccaaagaggcatagccacgatgacatgctcctgctcgcccagctgtcccttcctagcagcccctcctcactgaacgaagactcattatctaccacctcagagctcctgtcatctcgccgggccagacgtatccccaaactcgtacagcgaattaactccatatataacgcaaagcggggcaagaaacgtctgaagaaactttcaatgtccagtatcgagaccgccagcctccgcgacgaaaattcggagagtgagtctgacagtgatgacaggtttaaggcgcatactcagagactggttcatatacagagcatgctcaaaagagccccaagctatcggacactggaacttgaactacttgaatggcaggaacgagagctgtttgagtattttgtcgtggtgtctctgaaaaaaaaaccttctcgcaatacctacctgcctgaagtgtcataccagtttccgaagctggacaggccgaccaagcaaatgcgcgaagcagaagagcggctgaaagccattccccagttctgtttccccgacgctaaagattggttaccagtttccgaatattcgtctgagacctttagttttatgcttacaggtgaggacggaagccgccggtttggatactgtagaagactgctgccttcgggtaaagggcctaggctgccagaggtttattgtgttatctccagactaggttgtttcggcctgttcagcaaagtgctagatgaggtggaaaggcgacggggaatcagcgcagcactcgtgtatccatttatgagatcgctcatggaaagccccttccctgctcccggaaagacaatcaaagtaaagacgtttctcccaggcgcggggaatgaggtcctagaactccggcggcctatggattccaggcttgaacacgtggatttcgagtgtttatttacttgcctgagcgtccggcagttgatccggatatttgccagcttactgctcgagaggagggtaattttcgtggctgacaaactgagcaccctttcatcttgctcacatgcagtggttgcgctgctgtacccgtttagctggcaacacacgtttattcctgttctgccagcatccatgatcgatatagtgtgctgccccaccccttttctagtaggcctgctgtccagtagcttaccaaaactgaaggagttacctgtcgaggaagcccttatggtaaacttagggagtgatcgatttattcggcagatggacgatgaggacacgctactcccacggaaactgcaggcagccttggagcaggctctggagcgtaagaatgaactgatctctcaggactccgattccgattcagacgacgaatgtaatacccttaacggcctggtgtctgaagtgtttatacgcttctttgtcgaaactgtgggccactattcgctctttctgacccagtctgagaagggtgagcgggcattccagcgggaggcctttaggaagtccgtcgcatcgaagtccattcgacgtttccttgaagtgtttatggaatcccagatgttcgcaggattcattcaagacagagagctgcgtaagtgcagagctaagggactgtttgagcagcgggttgaacagtacttagaggaactcccagacacagagcaaagtggaatgaacaaattcttgagagggctggggaataagatgaaatttctgcataagaagaattag

SEQ ID NO: 207450 - DNA, 369 bp, Artificial Sequence
  Description of Artificial Sequence: Synthetic coding sequence
atgaccatgaccgccaacaagaacagcagcatcacccacggcgccggcggtacaaaggctccacgggggacactgtcccggtcccagagcgtgagcccgcctccagtgctaagccctccccgctcccctatatatcccctgagcgactccgagacctcagcctgtcgttacccctcccactctagttctcgggtactcttaaaggaccggcatccaccagccccctcacctcagaacccacaagatccgtcaccggatacctcaccccccacttgcccttttaagacggcgtcctttgggtaccttgacagaagcccaagcgcatgtaagagagacgcgcagaaggagtcagtacagggggccgcctag

SEQ ID NO: 207451 - DNA, 93 bp, Artificial Sequence
  Description of Artificial Sequence: Synthetic coding sequence
atgaccatgaccgccaacaagaacagcagcatcacccacggcgccggcggtactaaagccccccggggcaccttgtcccggagccaaagctag

SEQ ID NO: 207452 - DNA, 1758 bp, Artificial Sequence
  Description of Artificial Sequence: Synthetic coding sequence
atggccgaggccgccaccggcttcctggagcagctgaagagctgcatcgtctggtcttggacatatctgtggaccgtgtggtttttcattgtgctctttctggtatatattcttcgggtccctctgaagataaacgacaatttgagcactgttagcatgttcttgaatacactgactccaaagttctacgttgccttgactggaacctcttcactcattagcggactgatcttaattttcgagtggtggtactttagaaagtacggcacctcctttattgaacaagtatccgtctcccatctgcggcccctgctgggcggcgtcgataacaattctagcaataactcaaattcatcaaacggagactccgacagcaaccgacagtctgtttctgagtgtaaggtgtggcgaaatcctctcaatctgtttcgcggcgctgagtataatagatatacctgggtgacgggaagagagccactcacctactacgacatgaatctcagcgcacaggaccatcaaaccttctttacctgcgattcagaccacctgaggcccgcggatgcaatcatgcaaaaagcttggcgggagcgtaacccacaggctcggatatccgccgctcatgaggctctcgaaatcaatgagatccgtagccgcgtcgaagttcccctgatcgccagcagcacgatttgggagattaagcttttgcccaaatgcgctacagcctatattctgctagccgaagaagaggcaactactatagcagaagctgaaaaactttttaagcaagcactgaaagcaggagacggttgttatagaagaagccaacaactccagcatcatggctcccagtacgaagctcaacatcggcgagatacgaatgtactcgtgtatattaagcggcgcctggctatgtgcgctaggaggctaggaagaacaagagaggctgtgaagatgatgagagacttgatgaaggaatttcctctcctctctatgttcaacatacacgaaaatttacttgaggctcttctcgagttacaggcctatgcggacgttcaagctgttctggccaagtacgatgatatctcactaccgaagtccgcgactatttgttacacagctgccctgctcaaggcacgcgcggtgtccgataaattttcccccgaggctgcaagtcgcagaggtctgtccacagcggaaatgaatgccgtcgaagcaattcatcgcgccgtggaattcaacccccacgtgccaaaatacctgctcgaaatgaaaagtttgatcctgcctccggagcatattctgaaacggggagacagcgaggccatcgcctacgcgtttttccatctggcacactggaagagagtggagggggcgctgaacttgctccattgtacctgggagggcactttcagaatgatcccctaccctctggaaaagggccacctcttttatccctaccctatctgtactgaaacagcagacagagagctgctgccatcctttcatgaggttagtgtataccccaaaaaggaactgcccttcttcattctgttcaccgcaggcctgtgttccttcaccgctatgctagccctccttacccatcagttccctgagctgatgggagtattcgcaaaggcgatgatcgatatcttctgttctgctgaattccgcgactggaattgcaagtcgatttttatgagagttgaggacgagcttgagattccaccagctccgcagtcacagcatttccagaattag

SEQ ID NO: 207453 - DNA, 1500 bp, Artificial Sequence
  Description of Artificial Sequence: Synthetic coding sequence
atgagcatgttcctgaacaccctgacccccaagttctacgtggccctcactgggacctcatctctgatctccggcctcatccttatctttgaatggtggtattttcgcaaatacggcactagctttattgagcaggtgtctgtctcacacctaagacctctactgggtggtgttgacaacaactcatccaacaatagcaacagctctaatggtgatagtgattctaacaggcaaagtgtgtctgaatgcaaggtgtggcgaaatcccctgaacttatttcgaggcgccgaatataaccgatacacgtgggttacaggccgggagcctctgacgtactacgacatgaatctcagcgcacaagatcatcaaaccttctttacatgcgactctgatcatctccgccctgcagatgcaattatgcagaaggcttggcgtgaacggaacccccaggctcggatctcagcggcccacgaagccctggagataaatgagtgtgcgactgcttacattcttctggccgaggaggaggcaacaaccatagcagaggcagaaaagctctttaaacaggccctcaaggctggagacgggtgctacaggcgctcccagcagcttcagcaccatggctcccaatacgaggcacagcatcgccgtgacacgaacgtactcgtgtacataaaaagacggctggccatgtgcgccagacgcttgggccgcactagggaggccgtgaagatgatgagagacctcatgaaagaattcccactcttgtccatgtttaacatccacgaaaacctgctagaggcactgctagaactccaggcctatgccgatgttcaagccgtgctggccaagtacgacgatatcagtctccctaagagcgccaccatctgttacacagcagccctgctcaaggcgagggctgtctcagataaatttagtcccgaagccgcctctcgacgcggcctcagcaccgccgaaatgaacgccgttgaggctatccatagagcggtggaattcaatccgcacgtgccaaaatacctgctggaaatgaaaagtctgatcctaccacctgaacatatacttaaacgcggggactctgaagctatcgcgtacgcgttttttcaccttgcccactggaaaagggtggagggcgccctgaacctgctccactctttcaggatgatcccgtacccccttgaaaagggacaccttttctacccctaccccatttgcaccgaaacggctgacagagagctgttaccttctttccacgaagtgagcgtttatcccaaaaaagaactgcctttctttattctgttcaccgcgggactgtgctcctttactgccatgctggctcttctgacacatcagtttccagaactcatgggggtctttgcaaaagcatttctaagtacgctgttcgcccctctgaacttcgtcatggaaaaggttgagtctattctaccgagctctctttggcatcagctgaccaggatctag

SEQ ID NO: 207454 - DNA, 1536 bp, Artificial Sequence
  Description of Artificial Sequence: Synthetic coding sequence
atgttcggcaccgagagcagcctgagcatgttcctgaacaccctgacaccaaagttctatgtggctctgaccgggacttcctccctgatcagcgggctcatcctaatctttgagtggtggtatttccgaaagtatggaacgtcgtttattgaacaagtctccgtctcccaccttaggccgctgctaggtggggtggacaataacagcagcaataattcgaatagcagcaacggcgactctgatagcaaccggcaatctgtctcagagtgtaaggtctggcggaatccgttgaatctctttagaggggctgagtataaccgctacacctgggtgaccggtcgcgagccccttacctattatgacatgaaccttagcgctcaggaccaccaaacattcttcacctgcgactcagaccacctccgccccgcggatgcaattatgcaaaaggcttggcgcgagcggaacccacaggcccggatctcagctgcccacgaggccctggagatcaatgaatgtgcaaccgcttatattctcttagcagaggaggaggctaccaccattgccgaggctgagaaactatttaaacaggcactcaaggctggggatggttgctatagacgcagtcagcagctccagcaccatggaagccagtatgaagcccaacacagacgggacacgaatgtactcgtatacatcaaacgccgtctggccatgtgtgctcggcggttgggtagaacacgcgaggcggtcaagatgatgagagacctcatgaaggaatttcctctcctgtcaatgtttaacattcatgagaacctgttggaggccttgctggagttgcaagcttacgccgacgtccaggcggtgctggctaaatatgacgatataagcctaccgaagtccgccacaatttgttacactgctgccctgctcaaggcccgtgccgtgagcgataagtttagtcccgaggctgcgtctaggagagggttgtcaacagcagaaatgaacgccgtagaagcaatccatcgcgctgtggaattcaatccccacgttcctaagtatcttctagaaatgaaatcactgattctccctccagagcacatcctgaagcgcggcgacagtgaggcgatcgcctacgcatttttccaccttgcacactggaagagggtggagggtgctctcaacctactgcattgcacttgggaaggtacctttaggatgattccttatcctctagagaaaggccacctgttctacccatatccaatttgcaccgaaaccgccgaccgggaacttctgccctcgttccacgaagtgagtgtgtatcctaagaaagaactgcctttttttatactgttcactgcagggctgtgcagttttaccgccatgctcgcgttactcactcatcaatttccagaattgatgggagtgtttgccaaggctttcctgtccactctgttcgcccccttaaactttgtgatggagaaggtagagtccatacttcccagcagtctgtggcaccagttgacgagaatttag

SEQ ID NO: 207455 - DNA, 1605 bp, Artificial Sequence
  Description of Artificial Sequence: Synthetic coding sequence
atgttcggcaccgagagcagcctgagcatgttcctgaacaccctgactcccaaattctacgttgccttgacaggcacctcttccttaatctccggtcttattcttatcttcgaatggtggtatttccgcaagtacggcacatctttcattgagcaggtgtcagtgtcacatttacgccctttgctggggggagtcgacaataactcctccaacaactcaaacagcagtaatggagattctgatagcaataggcagtctgtttcagagtgcaaggtctggagaaatccacttaacttgtttcggggcgccgaatataacaggtatacctgggtcaccggcagggaaccgttaacctactacgacatgaacctctctgcccaggaccatcagacatttttcacatgcgactcggaccacctgagaccagcagatgcaatcatgcagaaggcgtggagagagcgtaacccgcaggcccgcatatcagcggcccacgaggccttggaaattaacgagatccgcagccgagtggaggtacccctcatcgccagcagcacaatttgggagattaagcttctgcctaagtgcgcaaccgcctacatcttgttagccgaagaggaggcgactaccatagctgaagcagagaagctgtttaagcaagctctcaaagctggtgatggatgctacaggcgctcacagcaactgcaacatcacggctcccagtacgaggctcagcatagaagagacacgaacgtgctggtgtatatcaaacgccgcctagctatgtgtgcccggagactgggccgaactagggaagcagtgaagatgatgcgggatctcatgaaagagtttcctctgctgtctatgttcaacatccacgagaatctacttgaagccctgctagaacttcaggcttacgctgatgtgcaggcggtcctggctaaatacgacgacatatccctgccaaagagcgccacaatctgctacacggccgccctgctgaaagctcgcgcagtttccgacaagttctcacctgaagcggcctctcggagaggcctctctactgccgagatgaatgccgtggaggccattcaccgcgccgttgagtttaacccccacgttccgaaatacttgctggagatgaaatccctgatcctgcctccagagcatattctcaagagaggcgactccgaggcgatcgcatacgcattcttccacttagctcattggaagcgagttgaaggcgcccttaacttgctccactgtacctgggaagggacgtttaggatgatcccctaccccctggagaaagggcatttgttttacccgtatccaatctgcacagaaacagccgatagggaactattaccctcattccatgaagtctcagtatatcccaagaaagaactacctttcttcattttattcaccgccgggctgtgcagtttcacggcaatgctcgccctgttaacacatcagttccctgaactgatgggcgtgttcgctaaggcattcctgtcaaccctgttcgcaccactgaatttcgtgatggagaaagtagagagcatcctgccatccagtctgtggcaccagctgacgcgtatttag

SEQ ID NO: 207456 - DNA, 1665 bp, Artificial Sequence
  Description of Artificial Sequence: Synthetic coding sequence
atggccgaggccgccaccggcttcctggagcagctgaagagctgcatcgtctggagctggacttacctctggactgtttggttctttatcgtcttatttctcgtgtatatcctccgcgtgccactcaaaatcaacgacaacctaagcacagtttctatgtttctgaacactctgacacccaagttttacgtggcgctgacaggaaccagctcactcatctctggcctgatacttatctttgaatggtggtacttccggaaatatggcacaagtttcatcgagcaagtctccgtgtcgcatcttcgtcctttgctcggaggggtggacaacaactcttcaaacaactccaattcaagtaacggtgattccgactcaaatagacagtctgtgtcagaatgcaaggtctggcgtaaccccctgaacctttttaggggcgccgaatataatcgctacacatgggtcacaggacgagagccccttacatactacgatatgaacctgtctgcacaagaccaccaaacattctttacgtgtgatagcgatcaccttcggccagccgacgccattatgcaaaaggcctggagagagcggaatccccaggctcgcatctccgctgctcacgaggctctggagattaatgaatgcgctactgcctacatcctacttgccgaggaggaagccactacgatcgccgaggctgagaaactgttcaaacaggcgctgaaagctggcgatgggtgttaccgacgctcgcaacaactacagcatcatggttctcagtacgaggcacagcaccgtcgcgataccaatgtgctcgtttatataaagaggcgcctcgccatgtgtgcaagacgcttaggaagaacacgcgaggccgttaaaatgatgcgtgatctcatgaaagaatttcctcttcttagcatgtttaatatccatgagaatctgctcgaggcattgctagagctacaggcctacgctgatgttcaggcggttctcgccaaatacgacgacattagtttacctaagagcgcaacaatttgctacaccgccgccctgctaaaggcccgtgccgtgtcagataagttctctccagaagccgcatccaggaggggtttaagcaccgccgagatgaatgcagtcgaagcgatccaccgggctgtggagtttaacccacacgtccccaagtaccttctggagatgaagagcctcatcttgccccccgagcacatcttgaagaggggtgactccgaagcaatcgcctacgcttttttccatctagcccactggaagagagtggaaggcgccttgaatcttctgcactgtacctgggagggtactttccggatgatcccctacccgctcgaaaaagggcaccttttctatccctaccccatctgcactgaaacggctgatagagagcttcttccatccttccacgaagtttctgtgtatccaaaaaaggagctgcctttttttatcctttttaccgccggcctgtgttctttcacagccatgctggccttactgacacaccagtttccagagctgatgggggtgttcgctaaggctttcctcagtaccctgttcgcccctctgaattttgtcatggaaaaagttgaatcaatcctaccttctagcctctggcaccagctgacccggatctag

SEQ ID NO: 207457 - DNA, 189 bp, Artificial Sequence
  Description of Artificial Sequence: Synthetic coding sequence
atgagcatgttcctgaacaccctgacccccaagttctacgtggcccttacaggcacttcaagtttaatttccgggcttattcttatctttgagtggtggtactttagaaaatacggtactagttttatcgagcaggtgagcgtatcacacctcaggcccctcctggggggagtggacaataattcttag

SEQ ID NO: 207458 - DNA, 264 bp, Artificial Sequence
  Description of Artificial Sequence: Synthetic coding sequence
atgagcatgttcctgaacaccctgacccccaagttctacgtggccttgacaggtacctcatctctcatcagcggactgattctgatctttgaatggtggtattttcgaaagtatggcacaagttttatcgagcaggtcagtgtgtcccatcttcggcctctactgggaggggtagataataactctagtaataactccaattcatccaatggagattcagattccaaccggcagtccgtgtcggagtgtaaagtgtggcgatag

SEQ ID NO: 207459 - DNA, 1323 bp, Artificial Sequence
  Description of Artificial Sequence: Synthetic coding sequence
atggccgagaacaacgagaacatcagcaagaacgtggacgtgcggcccaaaacttcccggtcgaggtccgctgatcgtaaagacggatacgtatggtcaggtaagaaattgagctggagcaaaaagagcgagagttactccgatgctgaaactgtgaacggaattgagaagacggaagtgagcctcagaaaccaggaaaggaagcacagttgctcctctatcgaactggatttagaccactcttgcggacacagattcttgggaaggagtctgaagcaaaagctccaggatgcagtaggacaatgcttcccaattaagaactgctcgagccgccattcatccggactgccatccaaacgtaaaatccacatcagtgagttgatgctcgacaagtgccctttcccccctcggtcagacctggcctttcgctggcacttcatcaaaaggcacactgcacctattaacagcaaaagcgatgagtgggtcagcacagacctatcacaaacggaactgcgggatggccagctgaagcgaaggaatatggaagagaatataaattgcttcagccacacaaacgttcagccctgtgttataaccacggacaatgctctctgtcgcgagggcccaatgaccggatcggttatgaatctcgtaagtaacaattccatcgaagacagcgacatggactccgatgacgagattctgactctttgcacctctagtcggaagcggaacaaacccaaatgggatctggatgacgagatcctccagctcgagacaccaccgaaatatcatactcagattgactatgtgcattgcctagtgcccgacctcctgcagattaataataacccctgctactggggggtgatggataagtacgctgcagaagcccttttggaaggtaagcccgagggtacattcctgttgagggactctgcgcaagaggattaccttttcagcgtgtcctttcgccgatactcacgatcactgcacgcccgcattgaacagtggaaccacaactttagcttcgacgcccacgacccatgcgtgtttcattcccctgacatcaccggtctcctcgagcattataaagatccatccgcctgcatgttcttcgaaccgctcctgagtacaccactgattcggaccttccccttttccctccaacatatctgtagaacagtaatctgcaattgcactacttacgacggcattgacgcccttcccatcccgtccagcatgaagctatatctgaaggagtaccactataagtctaaggtgcgggtcctgagaattgacgcaccagagcagcagtgttag

SEQ ID NO: 207460 - DNA, 1323 bp, Artificial Sequence
  Description of Artificial Sequence: Synthetic coding sequence
atggccgagaacaacgagaacatcagcaagaacgtggacgtgcggcccaaaaccagtcgaagcagatctgctgaccgaaaggatggttacgtttggagcggtaaaaagctgtcatggtctaagaaatcagaatcgtattctgatgccgagaccgtcaacggcattgagaaaacagaggtctctctgcggaatcaggagagaaagcacagctgtagtagcatagagctagacttggatcattcctgtggtcaccgattccttggtcgaagcctgaagcagaagctgcaggatgcggtgggacaatgttttcccattaaaaattgtagttccaggcactcctccgggctacctagcaaacggaagattcacatctcagaattaatgctggacaaatgtccttttccaccacggtccgacctggccttcagatggcactttattaagcggcataccgcccctatcaactcaaagagcgatgaatgggtatccaccgacctttctcagaccgagttacgcgatggacagctgaaacgcaggaatatggaagagaatattaactgcttctcacacactaatgtccaaccatgtgtgatcactaccgacaacgccctgtgcagggaggggcctatgacggggtctgtcatgaaccttgtgagtaacaacagcatcgaagactcggatatggatagtgatgacgaaatcctgacattgtgcacaagttcaagaaaaagaaataagcctaaatgggatttggacgatgagattctacaattggaaaccccacctaagtatcatactcaaatcgattacgtgcactgtcttgtgcccgatctgctacagataaataacaatccgtgctattggggagtgatggacaagtatgcggccgaggctctcctggagggaaaacctgagggtacatttctcctgcgggacagcgcgcaggaagattacttgttcagcgtttcattccgtcggtactctcgctctctacatgcacggatcgaacagtggaatcataacttctctttcgatgcgcatgacccatgcgtctttcactctccagatattacagggctactagaacattataaggacccctccgcttgtatgtttttcgagcctctcttaagcacacctctcatcagaacctttcccttcagcctgcagcacatatgcaggacggtgatttgtaattgtaccacatacgacgggattgatgccctgcccatccccagtagtatgaaactgtacttgaaggagtaccattataaatcaaaagttagagtcttgcggatagatgcgccagagcagcagtgttag

SEQ ID NO: 207461 - DNA, 1323 bp, Artificial Sequence
  Description of Artificial Sequence: Synthetic coding sequence
atggccgagaacaacgagaacatcagcaagaacgtggacgtgcggcctaagacatccaggagtaggagcgctgacaggaaagatggctacgtatggtcaggcaagaaactgagctggtcgaaaaagtctgaatcctactccgacgccgaaactgtcaacggcattgagaagactgaagtgagtctcaggaatcaagagcgtaaacacagctgctcatccattgagcttgatcttgaccactcttgcggtcatcggtttctaggcagatcactcaaacagaagctgcaagacgccgtgggccaatgcttccccatcaaaaactgctcatctcgacactctagcgggctcccttcaaaaagaaagatacatattagcgagttgatgttggacaaatgcccatttcctccgagaagtgatctcgccttcaggtggcacttcatcaaaaggcacacagccccgattaacagtaaatctgatgagtgggtctctacagacctgtctcagactgagcttagggatggccagctgaaaaggcgcaatatggaagaaaatattaactgctttagccacacaaatgtgcaaccatgcgttatcacaacagacaatgccctgtgtcgcgaggggcctatgactggctctgtcatgaacctcgtctcaaacaacagtattgaagattctgacatggactcagatgatgagattctcaccctgtgcacatcttcacgcaagcggaataagcctaagtgggacttagacgacgaaattttgcaactggaaacccctcccaagtaccacacacagattgattacgtccactgtttagtccctgaccttctgcagattaataacaacccttgctattggggcgtgatggacaagtacgccgccgaagccttgctcgaaggaaagccagagggcacctttctgctgcgcgatagcgcccaggaagactatctctttagcgtttcctttagaaggtacagccgctccctgcatgcaaggatagagcaatggaatcataacttctcatttgatgcccacgatccctgtgtgttccacagcccggatataaccggattgctggaacactacaaagaccccagcgcatgcatgtttttcgaacccctactgagcacacccctgattcgtaccttcccttttagtctgcaacacatctgtcggactgtcatctgcaattgcacgacatatgacggtattgatgcacttcccatcccctcttccatgaagctgtacctgaaggaatatcactataagagtaaagttcgcgtactccgcatcgacgctcccgagcagcagtgttag

SEQ ID NO: 207462 - DNA, 1611 bp, Artificial Sequence
  Description of Artificial Sequence: Synthetic coding sequence
atggacaaggtgggcaagatgtggaacaacttcaagtaccggtgccagaacctgtttggacacgaaggcggctcaagaagtgagaacgtcgatatgaacagcaatagatgcctgtctgtgaaggagaagaatatttccattggagacagtactccacaacagcagagcagtcccctccgggagaatatcgctctgcagctcggtttgtcacctagcaaaaacagctcgagacgaaaccagaattgcgcaaccgagatcccacaaatagtcgaaattagtatcgaaaaggacaacgactcatgcgtcactcctggaactcgcctcgcaaggcgggatagttactcacgtcatgcgccgtggggtggcaagaaaaagcactcctgtagcactaagacacagtccagcctcgacgctgataagaagttcggccggacgagatctgggttgcagagaagggagcggaggtacggggtaagttccgtccacgacatggactcagtcagctcccggacagtaggctcaagaagcctgaggcagagactccaggacaccgtgggactctgcttccctatgcgtacctacagtaagcagtctaagcccctattcagcaataaacgtaaaatccacttatctgagctcatgctagagaagtgtccctttcccgctggtagtgatctggctcagaaatggcatcttattaaacagcacaccgcacctgtgtccccccactctactttttttgacacctttgaccctagtcttgtatcaacagaggatgaggaagacaggttacgggaaaggcggcgcctctcgatcgaagagggtgtcgacccaccccccaacgcgcagatccatacgtttgaagcgactgctcaggtgaatccactgtataagctcggacctaagttggccccgggcatgacagagatctctggggattctagtgccataccgcaggcaaactgtgactccgaggaggatacgacaacgctgtgtcttcagtctcggagacagaaacagaggcagatttccggggactcgcacacgcatgtgtccaggcagggagcatggaaggttcacacacagatcgattatatccactgcctcgtacccgatctcctgcaaattacaggaaatccctgttactggggagtgatggatcggtacgaagctgaggccttgttggaaggaaagccagaagggacatttttgttaagagacagtgcccaggaagactacctgttctccgtgtcctttcggcgctacaaccggtctctgcatgccaggatcgagcagtggaaccataatttctctttcgacgcccacgatccctgcgtattccacagctcaaccgtcaccggtctgttagaacattacaaagacccttcatcctgcatgttttttgaacccttgcttacaatcagcttgaaccgtacattcccattctctctgcagtacatctgcagagccgtcatttgtcgttgcacaacttacgatggaatcgatggactaccactaccatctatgctccaggatttcctaaaagagtatcactataagcagaaagtccgcgtcaggtggctagagcgtgagccggttaaggctaagtag

SEQ ID NO: 207463 - DNA, 1611 bp, Artificial Sequence
  Description of Artificial Sequence: Synthetic coding sequence
atggacaaggtgggcaagatgtggaacaacttcaagtaccggtgccaaaacctgttcggacacgaaggcggctcccggagtgaaaatgtggatatgaactccaaccgttgtctgtccgtcaaggagaagaatatttctataggagacagcactcctcagcagcagtccagccccttgagagagaatattgcattgcaactggggctgagtccttccaagaatagttccagaaggaaccagaactgtgccaccgaaattccacagatcgttgagatttctatcgagaaagacaatgactcgtgcgtgactccggggacaagattagcccgcagggactcttactcacggcacgctccctggggtggcaaaaaaaagcattcatgctctaccaaaactcagagcagcctggacgctgataagaaatttggacggacacggtccggactccagcgtagagagcgtaggtacggcgtcagcagcgtccacgacatggacagtgtttcatccagaaccgtggggtcacggtcccttcgacaaaggctgcaagatacagtgggtctctgcttcccaatgagaacctattccaagcaatccaaacctctgtttagtaataaacgcaaaatccacctatccgagctgatgctggagaagtgcccattcccagccgggtctgacctagcacagaagtggcacctcatcaagcagcacaccgctccagtttccccacattccacctttttcgacaccttcgaccctagtttagtgtctacggaggatgaggaagacaggctcagggaaaggcgcagattatcaatcgaggagggagtggatccaccgccgaacgcacagattcatacatttgaggcaaccgcccaggtgaacccgctctacaagttaggtcccaaactggctccagggatgaccgaaattagtggggactcaagcgctatccctcaagctaactgcgattccgaggaggacaccactacactctgccttcagagcaggaggcagaagcagcggcagattagcggggactcccatactcatgtttcaaggcagggggcttggaaggttcacactcagattgactatattcattgtctggttccagacctgctgcagataaccgggaacccctgctactggggtgtgatggaccgatacgaagcggaagcgcttctggaaggcaaacctgaaggaacctttttactaagggacagtgcccaagaagactacctgtttagtgtatcattcagaaggtataaccgaagtctgcacgcccgtatcgagcagtggaaccacaatttttctttcgacgcccatgatccttgcgtgtttcactcatctacggtaacgggtctgctggaacattataaggaccccagttcgtgcatgttcttcgaacccctacttacgattagcctcaaccgaacttttccatttagtctgcagtatatctgccgcgctgtgatatgcaggtgtaccacctacgacggaattgatggccttccactcccatcgatgctccaagatttcttgaaggagtaccactacaagcagaaggtaagagtccggtggctcgagcgtgagcccgtcaaggcaaagtag

SEQ ID NO: 207464 - DNA, 3264 bp, Artificial Sequence
  Description of Artificial Sequence: Synthetic coding sequence
atgagcgacagcgaggacagcaacttcagcgaggaggaggacagcgaaaggtcctccgatggggaggaggcagaggtggatgaggaaaggaggagcgcagcgggttccgaaaaggaggaagagcctgaagacgaagaagaagaggaggaagaggaagagtacgatgaagaggaggaggaagaagacgatgatcgcccgccaaagaagccccgccatgggggatttattttagacgaggctgacgtcgatgacgagtatgaagacgaggatcagtgggaggacggggccgaagacatcctagagaaggaagagatagaggcctctaacattgataatgtagtgctggacgaggacagaagtggggccaggcgattgcagaacctctggcgggatcaaagagaggaggagctcggcgaatattatatgaagaagtatgccaaaagctctgttggtgagaccgtatacggcggctcagacgaattgtccgatgacataacccagcagcaactactcccgggcgtgaaagatccaaatctgtggactgtcaaatgcaagattggcgaggagcgggccacagccatttccctgatgcgcaaatttatcgcttaccagtttacagatacaccactgcagatcaaatcagtggttgctccagaacacgtgaaggggtacatctatgtcgaagcttacaaacagactcacgtgaaacaggccattgagggcgtgggcaacctccgattaggctactggaaccagcagatggtacccataaaggaaatgacagacgtacttaaagtggtaaaagaagtagccaacctgaaacccaaatcctgggttcggttgaagcgggggatctataaagacgacatcgcccaggtggactacgtcgaaccatcccagaataccatatctctcaaaatgataccaagaatcgactatgaccggatcaaggctaggatgtcactgaaagattggtttgccaaacgaaaaaaattcaagcgaccaccacaacgtctattcgacgcggagaagataagaagcctcggcggcgacgtagcttcggacggggactttctcatcttcgagggaaacagatatagcaggaagggcttcctgtttaagtcattcgcaatgagcgccgtgatcactgaaggggtcaagccaacgctctcagagcttgagaaattcgaagatcagccagaaggaatcgacctcgaagttgtaactgaaagcaccgggaaggagagggagcacaacttccagcccggcgataacgtcgaagtctgcgaaggcgaacttataaaccttcaaggaaagattctgtccgtggatggcaataagattacaataatgccgaagcacgaggacctgaaagatatgctcgaattcccagctcaggaactgcgcaagtactttaagatgggcgaccacgttaaagtaatcgctggaagatttgagggagacaccggcctgattgtccgcgtcgaggaaaacttcgtgatactgttcagcgaccttacaatgcacgagctgaaggtattaccgcgcgaccttcagctgtgttcagagaccgcatcaggcgtcgacgtgggcggtcagcacgagtggggcgagctggtgcagctggatccacagaccgtcggagtcattgtgaggctggagcgcgagacctttcaggtgttaaatatgtatggcaaggtcgtgacagtccgccaccaggccgtgacccgtaaaaaagacaatcggttcgctgtggctctcgattccgaacaaaacaatatacacgtgaaagatatcgttaaggtcatcgatggaccacacagcggacgcgagggggaaatccggcatctttttaggtctttcgctttcctgcactgcaagaagcttgtagaaaatggagggatgttcgtgtgtaagactaggcacttagtcctggcggggggctctaagcctcgggatgtcacaaacttcacagttggtggattcgctcctatgtctccccgcattagcagccctatgcacccatctgcggggggacaaagggggggctttggctcgcccggcggcggctctggcggcatgtcaaggggacgaggtcgccgcgacaacgagttgatcggtcagacagtgcggatctctcagggaccctacaaaggctatatcggggtggtgaaagatgcgacggagagcactgcaagggtcgaattgcactccacgtgtcagacaatctcagtggatcgccagagactgactacggtgggcagccggcgtcctggtgggatgacgtccacatatggccggacccctatgtacggaagccagacaccaatgtacggctccgggtcgagaacaccaatgtacgggagccaaacaccccttcaggacggctcaaggacaccacactacggtagccagaccccactgcacgacggttcgaggacacccgcccagtccggtgcatgggaccccaataatcccaacacaccctctagagcggaggaggagtacgagtacgcgttcgacgatgaacccactccaagccctcaggcttatggcggcacacccaacccccagacacccgggtacccagacccctcctccccacaggtaaatcctcaatataaccctcagactccagggacgccagctatgtacaacacagatcaattcagcccctacgctgctccgtctccacaggggtcgtatcagcccagtcccagcccacaatcatatcaccaagtagccccaagccccgcaggctatcagaacacacattcacccgcctcttatcatccgactccctcccccatggcctatcaggcaagcccatcgccaagccctgtgggctactcccctatgaccccaggggctccttccccaggcggctataaccctcacacaccaggaagcggtatcgagcagaacagttcagattgggttacaactgatattcaggtcaaagtcagagacacctacctggacacccaggtggtcggtcagacaggcgtgattaggtcggtgacaggaggtatgtgcagcgtgtaccttaaagacagtgaaaaggtggttagcattagtagcgaacatctggaacccatcaccccaaccaaaaacaacaaagtgaaggttatccttggagaggatcgggaggctacaggcgtcctcctgagtattgacggtgaggacggcatcgttaggatggacttagacgagcagctgaagatcctgaacctccggtttctaggaaaactgctcgaagcgtag

SEQ ID NO: 207465 - DNA, 3198 bp, Artificial Sequence
  Description of Artificial Sequence: Synthetic coding sequence
atgagcgacagcgaggacagcaacttcagcgaggaggaggacagcgaaagaagcagtgacggagaggaggcagaggtagacgaggagcgtcgcagtgctgccgggagtgaaaaggaagacgatgatagaccccctaagaagcccagacatgggggcttcattctggacgaggctgatgtggacgatgaatacgaagacgaagatcagtgggaggacggggctgaggatatcctagaaaaagaagagatcgaagcttcaaatattgataacgtggtgctggatgaggacagatctggggccagaagactccaaaatctatggagggatcagagggaggaggagctgggagaatattatatgaaaaagtatgcgaaatcatctgtaggggaaacggtttacggcggatccgacgagctgtcagacgacattactcaacagcagctgctaccaggggtgaaggaccctaacttatggactgtgaagtgcaaaataggtgaggaacgggccaccgccattagtctgatgcggaaattcattgcctaccaatttacagacactccccttcagattaaaagtgtggtagctccagagcacgtaaagggctacatctacgttgaggcctataagcagacgcacgtgaaacaggcgatcgagggcgttggcaatctgcgcctgggatactggaatcaacagatggtgcccattaaagagatgaccgatgttcttaaagtcgtgaaggaggtggcaaacctgaagcctaaatcatgggttcggctgaaaaggggcatatataaggatgatatcgctcaggttgattatgtggaaccctctcagaataccattagtctgaaaatgattccgaggatcgactacgacaggatcaaggcgcgcatgagcctgaaggactggttcgccaaacgcaagaagttcaaaaggcccccacagagattgtttgatgctgagaaaatacgatcattgggcggagatgttgcctctgatggcgacttcttgatcttcgaaggcaatcgctactcacgcaaagggttcctcttcaaatctttcgcaatgagtgcggtgattactgaaggagtcaaaccgacactcagcgaactcgagaagtttgaggatcagcccgaaggtatcgacctggaagttgtaaccgaaagcacaggtaaagaaagagagcataacttccagcccggagataatgttgaggtgtgcgagggcgaattgattaacctccaagggaaaatcttgtctgttgacggcaataagatcaccatcatgcctaaacatgaggacctgaaggacatgctggagttccccgcccaagaactccgaaaatattttaaaatgggcgatcacgtgaaggtcatcgcagggaggttcgaaggtgatacgggactgatcgttagggtggaagagaacttcgttattctcttcagcgaccttacaatgcatgaactcaaggtgttgcctagggatctgcaactatgctccgaaacagcgagcggagtcgacgtgggaggccaacatgaatggggggaactcgttcaactggatcctcagaccgtaggtgtaatcgtcaggcttgagagagaaaccttccaggtgctgaacatgtatggaaaggtggtgacggttcgacaccaagccgtgacccgaaaaaaggataacaggttcgcggtggcactcgatagtgagcagaacaacatccacgtaaaagatattgtgaaagtaatcgatggccctcactccggaagagagggcgagattagacacctctttcgatcttttgctttcctgcattgcaagaagttagtggaaaatgggggtatgtttgtctgtaaaaccagacatcttgtgctggccggagggtcaaaaccacgagacgttaccaactttacggttggcggcttcgcccccatgtcccccaggatttcttcacccatgcatcccagtgctggcgggcagcgcggcggttttgggtcccccgggggggggtccggcgggatgtcccgaggccggggtcgacgcgacaatgaattaattggccaaactgtaagaatcagccaggggccttataaggggtatatcggcgtggtgaaggatgcgacggaatccaccgctagagtggagcttcacagcacatgtcaaaccattagtgtggacaggcagcgacttaccaccgttggctcccgtagacccggcgggatgacctctacgtacggccgcaccccgatgtacggcagtcagacacctatgtatggctctggatcccggacacccatgtacgggtcacagacacccctgcaggacgggagccgtacccctcattatgggtctcagacaccactccacgatgggagtagaacccccgctcagagtggagcttgggacccaaataaccctaacaccccctctcgagctgaagaggagtatgagtacgcctttgacgacgagccaacccccagcccccaggcctacggcggcactcccaatccacagacgccgggttacccagacccttcgtccccacaagtgaaccctcaatacaatccccagactcccgggacacctgcaatgtataacacagatcagttcagtccctatgctgccccaagtcctcaggggtcctatcagccaagtcctagccctcaatcgtatcaccaagtcgcacccagcccagccggatatcaaaacacccactcgcctgcttcctatcatccaactccgtctccaatggcttaccaggccagcccgtctcccagtcccgttggctactcccctatgactccgggggccccgagcccagggggttataacccccacaccccagggtcaggaatcgagcagaattcatcagactgggtgactactgacatccaagttaaagtgcgtgacacatatcttgacacccaagtggtcgggcagacaggcgttattcggtctgtcaccgggggcatgtgtagcgtgtacctcaaagacagcgagaaggtggtcagtatcagttctgaacatttggaacctattacacccactaaaaacaacaaagtgaaagtcatcctcggcgaagaccgcgaagcaacgggtgtgctgctgtccatcgatggagaagatggcattgtgcgcatggacctggatgagcaactgaagatcctcaatctgcgctttcttggtaagcttctagaagcctag

SEQ ID NO: 207466 - DNA, 3252 bp, Artificial Sequence
  Description of Artificial Sequence: Synthetic coding sequence
atgagcgacagcgaggacagcaacttcagcgaggaggaggacagcgagagaagtagcgacggcgaagaagccgaagtggatgaggagcgcagaagtgcagcaggatcagagaaagaggaagagccagaggatgaggaggaggaagaagaagaggaggagtacgatgaagaagaggaggaggaggacgacgataggcctcccaagaagcccagacacgggggcttcatcctggacgaagccgatgtggatgatgagtatgaagatgaagaccagtgggaagacggggcggaggatatcctcgagaaagctagcaacatcgataacgtggtcctcgacgaggacagatcaggagcaaggcggcttcagaacctgtggagggatcagcgcgaagaagagctgggtgaatactatatgaaaaaatatgcaaagtcttcagtgggcgaaactgtgtacggcggatcagatgaactcagtgacgacatcacccaacagcaactcctgcccggtgtcaaggacccaaatctgtggaccgtcaagtgcaagataggggaagagcgtgcaacggctatatcattgatgcgaaaatttattgcctaccagtttacagataccccattacagatcaagtccgtggtcgccccagaacatgtcaagggatatatctatgttgaagcttataagcagactcatgttaagcaggcaattgagggtgtcggaaacctgcgcctgggatattggaaccagcagatggtgcctatcaaggagatgacagatgttctgaaggtggtgaaagaggtggccaacttgaaacccaagagttgggtaaggttgaaacgggggatttataaggacgatatcgctcaagttgactatgtagagccctcccagaacacaatctcccttaagatgattccaaggattgactacgacaggatcaaggctcgcatgtcactcaaagattggtttgcgaagcggaagaaatttaagcgaccaccgcagcgactttttgatgcagaaaaaatccgctcactgggcggtgacgtggcaagcgatggggactttctgatattcgaaggcaatcgatattcgcgtaagggatttctgttcaagtcattcgccatgtccgctgtaataaccgaaggcgtgaaacctaccctgtccgagctggaaaagttcgaggaccaacccgaaggaatagatctagaagtggtcaccgagagcacaggcaaggagcgggaacacaatttccaacccggcgataatgtagaagtgtgcgaaggagagttgataaacctgcagggaaagattctgtcggtggatgggaacaagatcacaataatgcctaaacatgaggatcttaaggacatgcttgagttccccgctcaagagctgagaaagtattttaaaatgggcgatcacgtcaaggtgatcgccggcagattcgaaggggacacgggactcattgtgcgcgttgaagagaatttcgtgattctcttcagcgatctgacaatgcatgagctaaaggtgctgcctagggatcttcagctgtgctccgaaactgcctcaggtgtagacgtgggaggtcagcacgaatggggagaactggtgcaattggacccgcagaccgtcggggtgatcgtgcgcctggagcgcgaaacttttcaggtgcttaacatgtacggtaaggtggttaccgtgaggcatcaggcagttacgcgcaagaaagataaccgcttcgctgtggcactggactctgaacagaataatatccacgtgaaagatatcgtgaaggtcattgacggcccacactccggcagagaaggagaaataagacacctttttcgcagtttcgccttcctgcactgtaagaaattggtggaaaacggcggtatgttcgtttgcaaaacacggcatctggtcttagccggtgggtccaaaccacgtgatgttaccaactttacagtgggcggctttgctcccatgagtccccgcataagtagccctatgcaccccagtgccgggggccaacgcggcggcttcgggagccccgggggcggaagcggcggaatgagtcgggggcgcggtaggcgcgacaatgagctgatagggcagacggtacgaattagtcaggggccatacaaagggtacattggagtcgtgaaagatgcgaccgagagtaccgctagggtcgaactgcacagcacctgccaaacaatttccgttgaccgccagcgattaactacagtgggttcacgccggccaggtggcatgacatccacgtatggacggacgcctatgtacggctcacagacacccatgtacggctccggatccagaacacctatgtacggtagccagacacccctgcaggacggctctcggaccccacactacggatcccagactccactccacgacgggtcacgcacccctgctcagagcggcgcctgggaccctaataacccgaatactcctagcagggcggaagaagaatatgaatatgctttcgacgacgaacctacgcctagtccacaagcctacggcgggacacctaatccacaaaccccaggttatccagacccgtcgagccctcaggtgaatccccaatacaacccccagacacctgggactcccgccatgtataatactgaccaattttcgccctatgcagccccttcaccccaaggaagctatcagccctcaccatctccccaatcctaccaccaggtggccccctctcccgccggctaccagaatactcattcacctgcctcttaccaccctactcccagcccaatggcctaccaggccagcccctcccctagccctgtgggctactcaccaatgacacccggagcgccttctcctggagggtataatcctcacacccccggctcaggaatcgaacagaattcaagcgattgggtgacgaccgatatccaggtcaaagttcgggatacttatctcgatacacaggtcgtcggccaaacaggagtgattcggtctgtcacaggtggcatgtgttctgtgtatctcaaagatagtgaaaaggtggtcagcatctcatccgagcacttagaaccaattacgcctaccaaaaacaacaaagtgaaggttattttgggcgaggatagggaggccacaggagttctcctttcaattgatggagaggacggtattgtgcgcatggatctggacgagcagctcaagatcctcaatcttcggttcctgggcaagctcctggaagcgtag

SEQ ID NO: 207467 - DNA, 3264 bp, Artificial Sequence
  Description of Artificial Sequence: Synthetic coding sequence
atgagcgacagcgaggacagcaacttcagcgaggaggaggacagcgagcgatcgtctgatggcgaagaggccgaggtggatgaggagaggaggagcgctgccggatctgaaaaagaagaggagcccgaggatgaagaggaagaagaggaggaggaagaatatgatgaagaagaagaagaggaggacgacgaccggcccccaaagaagccacgacacggggggtttattctggacgaagccgacgtagatgacgagtacgaagatgaggaccagtgggaagatggagctgaagatatcctggagaaggaggaaattgaggcctccaatatcgacaacgtggtgttagatgaagatagaagcggtgcgcgacggctgcagaacctttggcgcgaccagagagaggaggaattaggcgagtactacatgaagaagtatgcaaagagctccgtgggcgagaccgtttatggaggttccgatgagctgagcgatgacatcactcaacagcagctcttaccgggtgtaaaggatccaaacctgtggactgtgaaatgtaagatcggggaggagcgggcgaccgctatcagcctcatgcggaaatttatcgcctatcagttcaccgatactccactccaaattaagtctgtggtcgcccctgagcacgtgaaaggatatatctatgtcgaggcatataaacaaacgcacgtgaagcaggccattgaaggagtgggcaacttgaggttaggttactggaatcaacagatggtgcccattaaagagatgaccgatgtgctgaaagtcgttaaggaggtcgcaaacctgaagcccaagtcatgggtaagactgaagcgcggaatctacaaagacgacattgcacaggtggactacgtcgagcctagccagaacactatcagtctcaagatgatccccagaatcgactacgataggattaaagcccggatgtccttaaaggattggtttgccaagcgaaaaaagtttaaacgacccccccagcggctctttgatgcagagaaaatccgctcgttggggggtgacgtggcttccgacggcgacttccttatatttgagggcaatcgatattcaaggaagggctttttattcaaatcattcgcgatgtccgctgtgattactgagggcgttaaacctacactgagtgaactcgaaaagtttgaggaccagcccgaagggatcgatctggaagtggtgaccgaatccacaggcaaggagagagagcataatttccagcccggcgataacgtagaggtatgcgagggcgagctgattaatctccaagggaagatcctcagtgttgatggcaataaaatcaccattatgcctaagcacgaagacctgaaagatatgctggagttccccgcccaagagctcagaaaatactttaagatgggtgaccacgttaaagtgattgcagggaggttcgagggggacactgggctgatcgtccgtgtggaggagaactttgttattctgttctctgatctgactatgcacgagttaaaggtgttgcctagagaccttcagttgtgcagtgagaccgcatccggcgtcgatgtgggcgggcagcacgagtggggggaactggtccaattagacccccaaacagtgggtgtcattgtgcggctcgaacgagagacgttccaagttctgaacatgtatggcaaagtggtgactgtacggcatcaggccgtgacccgcaagaaagacaatagattcgccgtggctcttgattcagagcagaacaatattcacgtgaaagacatagttaaagtaattgacggaccccatagtggcagagagggagagattaggcacttgttcagatctttcgcgttcttgcattgtaaaaagctggtcgagaacggaggcatgttcgtttgtaagacccgacaccttgtcttagccggaggatccaaaccaagagacgtgacaaactttacagtgggggggttcgctccgatgtctccacgcatcagctctccaatgcatcccagcgccggcggacagcggggaggtttcggatccccaggtggaggcagcggaggaatgtcaaggggaagaggcagacgagataacgagctcattggtcagacagtccggattagccaggggccctacaaaggttacattggggtcgtgaaggacgcgacagaaagtactgcacgagtggagctccattccacgtgtcagacgatcagcgtggatcgacaaaggctgaccacagtgggaagccgcagacctggagggatgactagtacctacggacgaacacctatgtacggttcacagacccctatgtacggcagcggaagtcgaaccccaatgtacggatctcagacacccctccaggacggatcccggaccccccactacggaagccaaactcccctccatgatgggtccagaacacccgcccagtcaggtgcctgggaccccaacaatccaaatactccgtcaagagctgaggaagaatatgagtatgcttttgatgacgagcccactccctcccctcaggcgtacggcggaaccccaaacccacagacccccggttatcccgaccccagttctcctcaggtcaacccgcagtacaatcctcagacaccagggactccggccatgtacaacacagaccagttctcaccctacgccgcaccctcacctcaagggtcatatcagccgagcccaagtccccagagttaccatcaggtggcaccttcccctgctgggtatcagaatacacattcccctgcctcatatcacccaactccttcacctatggcctaccaggcttcaccttccccatctcccgtaggatatagccccatgactcctggcgctccctctcccggggggtataacccccacacccccggatccgggatcgaacaaaactcatcagattgggttactactgatatacaagtgaaagtgagggatacctacctggatacccaggttgtgggtcagacaggtgtcatccggagtgtgaccgggggaatgtgctccgtatacctcaaggacagcgaaaaggtggtaagcatcagcagcgaacacctggagcctattacaccgactaaaaataacaaggtaaaggtcatccttggagaagatcgagaagcgaccggtgtgctgttgtctattgatggtgaagatgggatcgtgcgcatggatctagacgaacagttaaaaattctcaacctgcggttcctggggaagctgctcgaggcgtag

SEQ ID NO: 207468 - DNA, 3264 bp, Artificial Sequence
  Description of Artificial Sequence: Synthetic coding sequence
atgagcgacagcgaggacagcaacttcagcgaggaggaggacagcgagagatcatccgatggggaggaggctgaggtggatgaagagcgccgatctgcagccggctccgaaaaggaggaggaaccagaagacgaagaagaagaggaggaagaggaggaatatgatgaagaagaggaggaagaggacgacgatcgccccccgaaaaagccaaggcatggcggcttcatcttggatgaggccgatgttgatgatgaatatgaggacgaggatcagtgggaagatggtgctgaagatattttggagaaggaagagattgaagccagcaacattgataatgttgttctagatgaggatcgttcaggggcgagacgcctacagaatctctggcgggaccagcgggaggaggagctgggcgagtattatatgaagaagtatgcgaaatcttccgtgggggagacggtctacggcgggagtgatgaactctccgatgacatcacacagcagcagctcttacctggagtgaaagacccaaatctctggacagtcaaatgcaaaatcggtgaggaacgcgcaaccgctatcagtctcatgagaaagttcattgcctatcagtttacagatacgccgcttcagattaagagtgttgtggctcctgagcacgtaaagggatatatctacgtggaggcctataagcaaacacatgtcaaacaagccatagagggggtgggaaacctacgccttgggtattggaaccagcagatggttccaatcaaagagatgacagacgtcctgaaagtcgtcaaggaagttgcaaacttaaagccaaaatcctgggtccggctcaagcggggcatttacaaagatgacatcgcccaggtagattatgttgaacctagtcagaacacaataagtctcaaaatgatccccaggattgactacgataggatcaaggccagaatgtctttgaaggattggttcgctaaacgtaagaagttcaaacggccaccacaacggttgtttgacgccgagaaaatacgcagtctggggggggatgtggcaagcgacggagactttttgatcttcgagggcaatcgctactcacgcaagggatttctcttcaaatccttcgcaatgtccgccgtgatcacagaaggtgttaaaccgacactgagcgagttagagaagttcgaagatcagcccgaaggcattgacctggaggtagtgaccgagtctacggggaaggaaagagaacacaattttcagcccggcgacaatgttgaggtgtgtgagggggagctgattaacctccagggtaagattctttccgtggacggcaataagatcaccatcatgccaaaacatgaggatctgaaggacatgctggagttccccgcccaagaactgaggaagtattttaagatgggagaccatgttaaggtgattgccggccgatttgagggtgacactggtctgatcgtccgggtcgaggaaaacttcgtgatattattttccgatctgaccatgcatgagcttaaagtcctcccgagagatctacagctttgctccgagaccgcgagcggggtcgacgtgggcggccagcatgaatggggggaattggtacagctggatccacagacggtaggggtgatagtgcggctggagagagagacatttcaggttttgaacatgtatgggaaggtggtcacagttaggcatcaggccgtgacccgaaaaaaggataatcgcttcgccgtggccctggattcggagcagaataatattcacgtaaaagatatcgtaaaggtgatcgacggaccgcacagcggacgagagggagaaataaggcacctgtttaggtcttttgcatttctacactgcaaaaagctggttgaaaatgggggtatgtttgtgtgcaaaacacgacacctcgtcctggccgggggatctaagcccagagatgtcacaaacttcactgtaggaggattcgctcccatgtcgccccgcatctcttcaccaatgcacccgtccgcggggggccagagaggcgggtttggtagtccgggagggggctccgggggtatgtcacggggccggggcaggcgggacaacgaactgattgggcagacagtaaggatcagtcagggcccatacaaagggtacattggggtggtgaaagacgctaccgagtctactgctcgggtcgaattacactctacatgccagacaatatcagttgaccggcagcgcctgacaaccgtaggatctcgtcggcccgggggcatgactagtacgtatgggcgcacaccaatgtatgggagccagacacctatgtatggatccgggtccagaacacctatgtacggctctcagaccccactccaagatggtagtcggactcctcactatgggtcacagaccccactccacgacggtagcaggaccccagcgcagagcggcgcttgggacccgaataatcccaacacaccaagcagagcggaggaagagtatgagtatgcgtttgacgatgagcccactcccagcccccaagcatacggtggtacacccaatccgcagacccctggttaccctgatccttcttctcctcaggttaatccacaatacaacccacagacaccaggcaccccggccatgtataataccgaccagttttcaccttacgcagcaccttctccacagggtagctaccagccttcaccttcacctcaatcttaccaccaggttgcacccagccccgcagggtatcagaatacccattcccctgcttcttatcacccgacgccctccccaatggcttatcaggcttcaccctctccttccccggtgggatatagccccatgactccaggcgccccaagtccgggtggatataacccacacacacctggatcagggattgagcagaactcctccgattgggtaacaactgacattcaggtgaaggtaagagacacatacctggatacccaggtcgtgggtcagactggtgttattaggagcgtaacagggggaatgtgttctgtgtacctcaaggattccgagaaggtagtcagcatttctagcgaacatcttgagccaataacgccaacaaagaataacaaagtgaaagttatattaggggaggacagagaggctactggagtgctgttgtccattgacggcgaagatggcatcgttcgaatggatttggatgagcagctgaaaatactgaatttacggttccttggtaaactgttagaagcctag

SEQ ID NO: 207469 - DNA, 3264 bp, Artificial Sequence
  Description of Artificial Sequence: Synthetic coding sequence
atgagcgacagcgaggacagcaacttcagcgaggaggaggacagcgaacgcagttcagatggggaagaggccgaggtcgatgaggagcggagaagcgctgctgggtccgaaaaggaagaggagccagaagatgaggaggaagaggaggaagaagaagaatatgatgaggaagaagaagaggaggacgacgaccgacctcctaaaaagccacgtcatggagggttcatcctggacgaggccgacgtggatgatgaatatgaggacgaagatcagtgggaagacggggctgaggacatacttgaaaaagaggaaattgaggcctcaaatattgacaatgtggtcctcgatgaggaccggtccggtgcacggcgtctgcagaacctctggcgggaccagcgcgaggaagagctgggggaatactatatgaaaaaatacgccaagagtagcgtgggggagaccgtttatgggggatctgatgagctgagtgatgacattacacagcagcaacttcttcccggggttaaggaccccaacctgtggacagtcaaatgtaaaattggcgaggagcgcgccacagcaattagtctgatgcggaagttcatcgcataccagtttaccgacacccccctgcaaattaaatccgtcgtcgcacccgagcatgtcaaaggctacatctacgtggaggcctataagcagactcacgtcaaacaggctatcgaaggagtgggtaatttaaggctcgggtattggaaccaacagatggtgccaattaaggagatgacagatgtactgaaggtggtgaaggaggttgccaaccttaagcccaaaagctgggtaaggttgaagagaggcatctataaggatgacattgcacaggtagattacgtggagccaagccagaacacaatttccctgaagatgatacctcggatcgactacgaccgaataaaagcaagaatgtccctgaaagactggttcgccaagcgcaagaaatttaagaggcctccccagagactcttcgacgccgagaagattcgcagcctgggaggtgacgtggcctctgacggcgattttctaatcttcgaggggaaccgctattcccgtaaggggttcctctttaaaagctttgcaatgagtgctgtcataacggaaggtgtcaaaccaacactgtccgagctcgagaagtttgaggaccagccggaagggattgacctggaagtggtcaccgagtcaactggcaaggagagagagcacaattttcaacctggagacaacgttgaagtgtgcgagggagagttaattaatctgcagggcaaaatactgagcgtggacggaaacaagataaccatcatgccaaaacatgaagacttgaaggacatgctggagttccctgcacaggaacttcgtaagtactttaaaatgggtgatcatgttaaagtgatcgctggtaggttcgagggagacactggtctgattgttcgagtggaggaaaactttgttattctgttttcagacttgaccatgcacgaactcaaagtgcttccacgagacctgcagctgtgttccgaaactgcatcaggggtggacgtgggcggtcagcacgagtggggagaactggtccaactggatccacagaccgtgggcgtcatcgtccggctggaacgggagaccttccaagtgctcaacatgtatggtaaggtggtgaccgtccgccaccaggctgtgactcgaaagaaggataacaggttcgccgtggcattagacagcgagcagaacaatattcacgttaaagatatcgtcaaggtgatcgacggtccacacagtggccgggagggagagatacgacatctgtttaggtcctttgcctttttgcactgtaaaaagctcgtagagaacggaggtatgttcgtatgcaagactagacaccttgtactcgctggaggttccaaacctagagatgtcaccaatttcactgtgggtggcttcgcccccatgtcccctaggataagttctcccatgcatccttcagccggtggccagcgcggagggttcggtagtccagggggcggtagtgggggcatgtccagaggtcgcggacggcgggataacgaactgatcggccagactgtcaggataagccaagggccttataaaggttatattggtgtggtgaaagatgcaaccgagagtactgctcgggtggaactccatagcacttgccagactatctccgtggacagacagagacttacaaccgtgggatccagacggcccggcgggatgacatcaacctatggccgcacaccaatgtatggcagccagacccctatgtatggctctggatctcgcacacctatgtacgggagccagaccccactacaggacggtagtagaactccacattacggctctcagacccctctccacgacggctcccgtacccctgctcagagtggagcctgggacccaaataacccgaacacccccagtcgggcggaggaggagtacgagtacgcttttgacgacgagcctacaccctccccgcaggcctatggagggactccgaacccacagaccccgggctatcccgatcctagctctccacaggtcaatcctcagtacaacccgcagacgccaggcacaccggccatgtataatactgatcaattttctccttatgcagcgccgtcacctcagggaagttaccagccaagtccgagtccacagtcttaccatcaagtggcgccgagcccggccgggtatcaaaacacccacagcccagcaagctaccatccaaccccttcaccgatggcctaccaagccagtcccagcccatctcctgtgggatactctcccatgaccccaggcgcgcctagtcccggcggctacaatccccatacacccgggtctggtattgagcagaacagcagcgactgggtcactacagacatacaggtgaaagtacgggatacctacttggatacccaggtggtggggcaaacgggagttatccgctccgttactggcgggatgtgcagtgtgtatctgaaggattcggagaaggttgttagtatatccagtgaacatttagagcctatcacccctacgaaaaacaacaaagtgaaagtcatcctcggagaagaccgggaagctacaggcgtgctgctatcaatcgatggcgaggacgggatcgttagaatggacttagatgaacagctgaagattttgaacctgcgcttccttggtaaacttctggaggcatag

SEQ ID NO: 207470 - DNA, 5181 bp, Artificial Sequence
  Description of Artificial Sequence: Synthetic coding sequence
atgagcgacttcgtggagagcgaggccgaggagagcgaggaggagtataacgacgagggggaagtcgtgccccgagtcaccaagaagtttgtggaagaggaagacgatgatgaggaggaggaggaggagaatctggacgaccaagatgaacagggtaatttaaaaggattcatcaatgacgacgatgacgaggatgaaggcgaggaagacgaaggctcggactccggtgacagcgaggatgacgttgggcacaaaaagagaaaaagaacttccttcgacgatcgacttgaagacgatgactttgatctgattgaggagaatctgggggtgaaagtaaaaagaggacagaagtatcgcagggtcaaaaaaatgtctgacgacgaggatgacgatgaagaggagtacggtaaggaggagcacgaaaaggaggctattgctgaggaaatcttccaagatggcgaaggagaggagggccaggaggccatggaggcaccaatggcccctccagaggaggaagaggaggacgacgaggagtcagacattgatgactttatcgtcgacgatgacggccaaccgctaaaaaagcccaagtggcgtaagaaactacctggttacacagacgccgctttacaggaagctcaagaaatttttggcgttgatttcgactatgacgagtttgagaaatacaatgaatacgatgaagagctggaagaagagtatgaatacgaagatgatgaagccgaaggagaaatcagggtccgaccaaagaaaactactaagaagcgcgtctcccggcgcagcattttcgagatgtatgaaccctccgagctcgaatctagccacctcaccgatcaagacaacgagatacgcgccactgacctgcccgagagatttcagttacgcagtatccctgttaagggtgccgaagatgacgagctagaggaagaagccgactggatctacaggaatgcctttgctaccccaactatcagcttacaagagtcttgtgattatctcgaccgcggtcaaccagcatcatcctttagcaggaagggcccttctactatccagaagatcaaggaagccctcggcttcatgcggaatcagcacttcgaggttccattcatcgctttctatcggaaggagtacgtagagcccgagttacatataaacgatctgtggagggtctggcagtgggatgaaaaatggacacagctcagaatccgcaaggaaaatttgacgagactgtttgagaagatgcaggcttaccagtacgagcaaatcagcgctgatcctgataaacctctggctgatggtattcgtgcactggatacaacggatatggagcggttgaaggatgtacagagcatggacgagctgaaagacgtctataaccatttcttgctttactacggtagggatatccccaaaatgcagaacgccgccaaggcaagcagaaagaaactgaaacgagtgagggaggaaggggatgaagagggcgaaggcgatgaagcagaggatgaagagcagcgaggtcccgaactgaagcaggcctcccgtcgggatatgtatacaatatgtcaaagcgccggcctcgatggacttgctaagaagttcggcctaacaccggagcagttcggagaaaatctaagagactcttaccagcgtcacgaaaccgaacagttcccagccgagcctctcgagctggcaaaagactacgtctgcagtcagtttccaacacccgaggcagtgctggagggcgcgcggtatatggtcgccctgcagatcgcacgcgagcccctggttcggcaggtcctgagacagacttttcaggagagagccaagctgaatatcaccccaactaaaaaagggagaaaggatgtcgatgaagctcattatgcctattcctttaaatacctgaagaacaaacccgtcaaggaactaagagatgatcagtttcttaagatctgcctcgccgaagatgagggtctgctgactaccgacatcagtatcgacttgaagggagtggaggggtacggcaatgaccagacttatttcgaagagatcaaacagttctactatagggatgagttttcacatcaggtgcaggagtggaatcgccagcgcactatggctattgaaagggcactccaacagttcctctacgtgcagatggctaaggaacttaagaataaactgctggccgaggctaaggagtacgtaatcaaagcctgctcgcgtaaactgtataactggctccgcgtggccccatacagacccgatcagcaggtggaggaagatgacgattttatggatgaaaaccaggggaagggtattcgggtgctgggaatcgctttttcttcagcaagagatcacccggtgttttgcgctctggttaatggagagggtgaggtcacagacttccttcgactgccccactttaccaaaaggcgaaccgcatggcgcgaggaagaaagggagaaaaaggcccaggatatcgaaacactgaagaaatttctcctgaacaagaaaccgcatgtggtgacagttgccggggagaaccgcgacgcccagatgctcatcgaggatgtgaagcgcatcgtgcacgagctggaccaaggacagcagctctcctccattggagttgaactggtcgacaacgaacttgctatcctgtacatgaattccaaaaaatctgaggcagagttccgagattacccaccagttcttagacaagccgtcagcctcgctcgcaggatacaggatcctcttatagagtttgcccaggtctgttcgtccgacgaggatattctatgtctcaagttccatcccttgcaggagcatgtggtgaaagaggaacttctgaacgccttgtattgtgaattcatcaatagagtgaatgaggttggtgtggacgtcaatcgtgcaatcgctcacccatattctcaggctttgattcagtacgtttgtggtctggggccacgtaagggaacccacctgctgaaaatcctaaaacagaataacaccaggctggagagtcggacacagcttgttacaatgtgtcacatgggaccaaaggttttcatgaattgcgccggctttcttaaaatagataccgccagcttaggagacagcacggattcatatattgaggtcctcgacgggagcagagtacaccccgagacctacgagtgggccagaaagatggcggtggatgccctcgagtatgatgaatcagccgaagatgcaaacccggccggggccctcgaagaaatcctcgagaatcccgagagactcaaggatttggatttggacgcatttgccgaggagctagagaggcagggctacggagacaagcacataaccctctacgatattcgggcggagttgtcatgccgctataaggatctgcgcactgcgtatcggagcccgaatactgaggagatttttaatatgttaaccaaggagacccctgaaacgttttacattggcaaacttatcatatgcaacgtcaccgggattgcccacaggaggccgcagggagaatcttatgaccaggctattaggaacgatgaaaccggactctggcagtgtcccttctgtcagcaggacaatttccccgaattgtctgaggtctggaaccatttcgactcagggtcttgcccaggacaggccattggcgtgaaaaccaggctagacaatggggtcaccgggtttatccccactaagtttttgagtgataaggtggtaaaaaggccagaggagcgggtcaaggtggggatgactgtgcactgtagaattatgaaaatcgatattgagaaatttagtgcggatctgacatgccgcacttccgacctgatggaccgcaacaacgagtggaaactccccaaagacacctattatgatttcgacgctgaggcagctgatcacaagcaagaggaggatatgaagcgcaagcaacagcgcaccacctacattaagagagtaattgcccatccgagttttcacaacatcaattttaagcaggccgagaagatgatggaaaccatggatcagggggacgtcattatacgcccttctagtaagggcgaaaaccacctgacagttacatggaaggtgagtgatggaatttaccagcacgttgacgtgcgcgaggaggggaaggaaaacgcattctcactgggcgctacgctctggattaacagcgaggaatttgaagacctggacgaaattgtcgcccggtatgtgcagccaatggcttcctttgcaagagacctgctcaatcacaagtattaccaggattgctctggaggagatcgcaagaaactggaagaactgttaataaagaccaagaaggagaaacctactttcataccgtattttatctgcgcatgcaaagagctgccaggcaagtttcttctaggttaccaaccacggggcaaaccgaggatagagtacgtcacggtgacacctgaaggattccggtaccgtgggcagattttccctactgtgaacggactgttcagatggtttaaagatcattaccaagacccagtgccggggataaccccgagctcttcaagccgtacccggactcccgccagcatcaacgcgacccccgccaatattaacctagctgacctgacaagggctgttaacgctctgccccagaacatgaccagccagatgttttctgccattgctgctgtcacgggccaagggcagaaccctaatgcaaccccagcgcagtgggccagttcccagtacggttatggagggagcggcggcggttctagcgcgtaccacgtctttcctacgccagcgcagcagcctgtggccaccccgctgatgaccccctcctacagttacactacgccttctcagccgattaccacgccacaataccaccagctgcaagcgtccacaacacctcagtccgctcaagcccagccccagccaagttctagttccagacagcgacagcaacagcctaaatccaatagtcatgccgctattgactgggggaaaatggcagagcagtggttgcaggagaaggaggcagagcggcggaagcagaaacagcgcctcacaccacgaccatctccatcaccaatgattgaatctacacccatgagcatagcaggtgacgccactcctctactggatgagatggatcggtag

SEQ ID NO: 207471 - DNA, 2181 bp, Artificial Sequence
  Description of Artificial Sequence: Synthetic coding sequence
atgagcgacttcgtggagagcgaggccgaggagagcgaggaggagtataatgatgaaggagaggtggtaccgcgcgtgactaaaaagttcgttgaagaggaggacgacgacgaagaggaagaggaggaaaatttggatgaccaggacgaacaaggtaatctcaaaggcttcattaatgacgacgacgacgaggatgaaggtgaggaagatgagggctctgactctggggacagcgaagacgatgtcgggcacaaaaagagaaaacggacttcttttgatgatcgacttgaggacgatgattttgacctgattgaggaaaatctgggggtgaaggtgaaaagaggacagaagtatcggcgcgtcaagaaaatgagcgatgacgaggacgatgatgaggaggagtacgggaaggaagaacacgaaaaggaggctatagctgaggagatcttccaagacggagaaggagaggaggggcaggaggccatggaggccccgatggccccccctgaagaggaggaagaagacgacgaagaaagcgacattgatgacttcatcgtggacgacgacggacagccactcaaaaaaccaaagtggcgaaagaaattgcccggctacacagatgcagctttacaagaagcccaggagatcttcggggtcgactttgattacgacgaattcgaaaaatataatgaatacgacgaagagctggaggaggaatatgaatatgaggacgatgaagccgaaggggagattcgggtccggccgaaaaaaaccactaaaaaaagggtgtcccggcgaagcatctttgaaatgtacgaaccttcagaacttgagtcctctcacctcactgatcaggataacgaaattcgggcaacagacctgcccgaacggttccagctcagatcaatccccgtgaaaggcgcagaagacgacgagctggaagaggaggccgactggatttatcgaaatgcctttgccacacccaccattagcttacaagagtcttgtgattatctcgacaggggacaaccagccagcagtttctctagaaagggtcccagcacaattcaaaaaatcaaagaagccttagggttcatgcggaaccaacattttgaagtgccatttattgcattctatcggaaggaatacgtggaacctgagctccacatcaacgacctctggcgggtgtggcaatgggatgagaaatggacccaattacgaattcggaaagagaatctcaccagactcttcgaaaaaatgcaggcctatcaatacgagcagataagcgccgaccccgacaagcccctggccgacggcattcgggccttggatacaactgacatggaaagattgaaggacgtgcagtctatggacgaactaaaagatgtctataatcattttctgctgtactacggtcgtgacatccccaagatgcagaacgctgcaaaagcaagcaggaagaagctcaagcgggtgcgtgaggagggcgacgaggagggagagggtgatgaggcagaggacgaggagcagcgaggccctgagttaaaacaagccagcaggcgcgacatgtacactatctgccagtctgcaggactcgatggcctggctaagaagtttggccttacacccgagcagtttggggagaatctgagagacagctaccagaggcacgagactgagcagttccctgccgagccccttgagctggccaaggactacgtatgcagtcagtttccaacgcctgaggccgtgctggagggggcaagatacatggtcgctctgcagattgcgcgggagcccttggtccgacaagtgctcagacagacattccaggaacgggccaagctgatgacgccatcttatagctacacaaccccctctcagccgattaccacgcctcagtaccaccaactacaggcctcaactaccccccaaagcgctcaggcccagcctcaacctagttcctcatcacgccagcgccagcaacaacccaagtcaaacagccacgccgccatcgattggggaaaaatggcggagcagtggttgcaggaaaaggaggctgagagaaggaagcagaagcagaggctcacacctagaccttcaccttctccaatgatcgagagtaccccaatgagcatcgccggggatgccacacctctgctggacgaaatggaccgctag

SEQ ID NO: 207472 - DNA, 2361 bp, Artificial Sequence
  Description of Artificial Sequence: Synthetic coding sequence
atgagcttcagccgggccctgctgtgggcccggctgcccgccggccggcaagcggggcatcgggctgctatatgttctgccttgcggcctcacttcggcccatttccgggagtgctcgggcaggtgtccgtcctcgccaccgcatcatccagtgcgagtggggggagcaagattcctaatacctcactcttcgtgcctttgactgtgaagccccagggcccgtccgcggacggggacgtcggcgccgaactgacgaggccgcttgataaaaacgaggtaaagaaagtgctggataagttctataagaggaaagagattcagaaactgggtgccgactatggtcttgatgccaggttatttcaccaagcattcatttcctttcgcaattacatcatgcagagccactcccttgacgtggatatccacatcgttctgaatgatatctgttttggtgctgcacatgctgacgatctcttcccattcttcttgagacacgcaaagcagatcttccctgttctggactgtaaggatgacctgcgcaagattagtgacctgcggataccccctaattggtacccagacgcccgtgccatgcaacggaagatcatcttccactccgggccaacaaatagcggtaaaacttatcacgctattcaaaaatacttctccgcgaagagcggtgtgtactgcggacccctcaaactcctcgcacacgaaatcttcgagaagtctaatgccgccggcgtgccgtgtgatctcgtgacaggggaagaaagagtgacagtgcagccaaacggtaaacaggccagtcacgtctcctgcacggtcgaaatgtgcagcgtgaccacgccatacgaggtggcagtcatcgatgaaatccaaatgattagggacccagcacgcggttgggcttggacgagggcactcctgggcctctgcgctgaggaggtgcacctgtgcggggaacctgccgctatagatctggtaatggagttgatgtataccactggggaggaagtggaagtgcgagattacaagagacttacacctatcagcgtgctggaccatgcgcttgagtcactggacaacctgaggcctggagattgcattgtgtgttttagtaagaatgatatatactccgttagtagacagattgaaatccgcggactggagtccgctgttatctatggcagtctgcctccaggaacaaaactggctcaggccaaaaagttcaacgaccctaatgatccctgcaagatcctggtagcaactgacgcgatcggaatggggttgaacctttctattagacggataattttctactcccttatcaagcccagtatcaacgaaaaaggggagagggagctggagcctattacaacctcacaggctctacagattgccggccgagctgggcgattttcaagtcggtttaaggaaggtgaggtaaccacgatgaatcatgaagatttgtctctcctcaaagaaatacttaaacggcccgtggacccaataagagccgctggcctgcaccctactgcagagcagattgaaatgttcgcttatcacttacctgatgcgacactctccaaccttatcgacatattcgtcgatttttcccaggtcgacgggcagtacttcgtttgtaatatggatgattttaagttcagcgccgaactgattcaacacattccactgagcttaagagtgagatatgtgttctgcacagcccctattaataaaaagcaacccttcgtgtgctcttcactcctgcaatttgcacgtcagtacagtaggaatgagccgctcacatttgcctggctgaggcgttacatcaagtggccattgctaccaccaaagaacataaaggaccttatggatcttgaggccgtacatgacgtgctggacctgtatctgtggttgtcttaccgcttcatggatatgttccctgacgcgtctctgatcagggatctgcagaaggaactcgacggtattattcaggatggggtgcacaacatcacaaagctgataaagatgagcgaaacccacaaactcctcaatctcgaaggctttccaagcgggagtcaaagcaggctgagcggcacgttgaagtcacaagcaaggaggacccgcggcactaaggcgctaggatctaaagccacagagccacctagccccgacgccggcgagctgagcttggcttcccgcttggtgcagcagggcctgcttacacccgatatgctgaagcaattggagaaagaatggatgacccagcagacagagcacaacaaagaaaaaacggagtcgggcactcaccctaagggcactaggcgcaagaagaaagagccagacagtgactag

SEQ ID NO: 207473 - DNA, 792 bp, Artificial Sequence
  Description of Artificial Sequence: Synthetic coding sequence
atgagcttcagccgggccctgctgtgggcccggctgcccgccggccgacaggccggccaccgggctgccatctgcagcgctctgcggccccattttggtcctttccccggggtgctcgggcaggtgagcgtccttgcaactgcttccagctcggcgtctggaggcagtaagatccccaatacatctctctttgtccccctcaccgtaaaaccacagggcccatcagctgacggagacgtgggcgccgagttaaccagacctctggacaaaaatgaagtcgcggttatagacgagatccagatgatccgtgatccggcacgcggctgggcctggaccagagctctgctcggactgtgtgctgaggaggttcatttatgtggagaaccagcagccatcgatctcgtgatggaactgatgtataccacaggtgaggaagtggaggtgcgggattacaagcgcctcaccccaattagtgttctggatcacgccctagaaagcctggacaacctccgccctggagattgtatagtgtgtttctcgaaaaatgatatctatagtgtgagtaggcagatcgagattagaggcttagaatcagccgtgatttatgggtctctgccccccggaaccaaacttgcgcaggctaaaaagttcaacgatccgaacgacccttgtaaaatcctggttgccaccgacgctatcgggatgggcctcaacctgagcattaggaggatcattttctactccttgataaagccttctattaatgaaaaaggggaaagagagctggaatag

SEQ ID NO: 207474 - DNA, 1233 bp, Artificial Sequence
  Description of Artificial Sequence: Synthetic coding sequence
atggccgccgtgggcgccgaggcccggggcgcctggtgcgtgccctgtcttgtgtcactggacacgctgcaggaactgtgtcgaaaggaaaagttaacttgcaaatcaattggaatcacaaagaggaatcttaacaattacgaggtggagtacttatgcgactataaggttgtcaaggacatggagtattatctggtgaagtggaaggggtggccggatagtacaaacacttgggaaccactacaaaacctcaagtgcccccttctgctgcagcagttctcgaacgataagcacaattacctgtcacaggtgaagaagggaaaagccatcactcccaaagacaacaataaaaccctcaaaccggctatcgccgagtatatcgttaagaaggcaaagcagcgcattgccttgcagcggtggcaggacgagttgaatcgtcgcaagaaccataaaggtatgatcttcgtcgagaacacggttgatctggagggaccccccagcgacttctactatatcaatgagtataaacctgctcctggtatctccctggtaaatgaggcaaccttcgggtgctcttgcactgactgtttcttccaaaagtgttgtcccgctgaggcaggcgtgttgctcgcatacaataagaatcaacaaattaagatccctcctggaacacccatttacgagtgtaactctaggtgccagtgcggcccggattgccctaatcggatcgtgcaaaagggtacccagtactcattgtgtattttcagaacaagtaacggtaggggctggggcgtgaaaacactcgtgaagattaagagaatgagcttcgtgatggaatacgtgggcgaggtgatcacgagtgaggaggccgaacgtagaggccagttctacgacaataagggaatcacctatctgttcgatctagactacgaaagcgacgaatttactgtcgacgccgcaaggtacggcaacgtatcccatttcgtgaaccactcctgcgaccctaacctgcaggtgttcaacgtttttatagataatctggacacacgactcccaaggatcgcactgtttagcacacggaccatcaatgcaggcgaagagctaactttcgactaccagatgaaaggctccggcgatattagttctgatagcatcgaccatagtcccgcaaaaaaaagagtcaggactgtgtgtaagtgtggggccgttacttgtaggggctatctgaattag

SEQ ID NO: 207475 - DNA, 693 bp, Artificial Sequence
  Description of Artificial Sequence: Synthetic coding sequence
atggccgccgtgggcgccgaggcccggggcgcctggtgcgtgccctgtctggtgagcctggataccctgcaagaactgtgtcgcaaggagaagctgacgtgcaagtctatcggcatcacaaaacgcaacctgaataattacgaggttgaatatttgtgtgactacaaagtcgtgaaagacatggaatattaccttgtcaaatggaaaggatggcccgatagcaccaacacatgggagccacttcagaatttgaaatgcccactgttgctgcaacagttcagtaacgataagcataattatctgagtcaggttatcactagcgaggaggccgagcgcaggggtcagttctacgataacaaggggataacgtatctgttcgacttggactatgagtccgacgaatttacggtagacgccgcccggtatggcaatgtatcccattttgtgaatcatagttgcgaccccaacctgcaggtctttaacgtgtttattgacaatctggacacccgcttgccaagaatcgcactgtttagcacccggaccattaatgccggggaggaactcacttttgactaccagatgaaaggtagcggggatatttcaagtgacagtattgatcactccccggctaaaaaaagagtccgtacggtttgtaaatgtggagcagtcacatgccgggggtatttgaattag

SEQ ID NO: 207476 - DNA, 459 bp, Artificial Sequence
  Description of Artificial Sequence: Synthetic coding sequence
atggagtactacctggtgaagtggaagggctggcccgacagcaccaacacctgggaaccccttcagaacctgaagtgccctctattgctccaacagttttctaatgataagcacaattatctaagccaggttatcacgagcgaggaggccgagcgaaggggtcagttctatgacaacaagggaatcacatacttattcgaccttgactatgaatctgacgaattcacagtggacgcggctcggtatgggaacgtgtcccattttgttaaccacagttgtgatccaaacctgcaggtgttcaacgtgtttatagacaacctggatacccggctcccacgaatcgcgctgttttcaacccggactattaacgccggagaggaactcacgttcgactaccagatgaagggatctggagacatttcatcagactctatcgatcattctcccgcaaagaagtag

SEQ ID NO: 207477 - DNA, 1053 bp, Artificial Sequence
  Description of Artificial Sequence: Synthetic coding sequence
atggagtactacctggtgaagtggaagggctggcccgacagcaccaacacctgggaaccattgcagaaccttaaatgcccgctcctactgcagcagttcagcaatgataagcataattacttatcccaagttaaaaagggaaaggctatcacccccaaagataataacaagactctgaagccagcaatagccgagtatatagtcaaaaaagctaaacagaggatcgcactgcagaggtggcaggacgaacttaatcggagaaagaaccataaaggtatgatttttgtagagaacacagtggatttagaggggcccccttcagacttctactacatcaatgagtacaaacccgcccctggtatatcattggtgaatgaagcaacttttgggtgctcctgcacagattgtttcttccaaaaatgctgcccagcggaggctggcgttctgctcgcctataacaaaaaccaacaaatcaagatcccccctgggaccccaatctatgagtgcaactccagatgccaatgtgggccggactgccctaaccggattgtgcagaagggaacacaatactccctatgcatctttaggacttctaacggacgtggttggggagttaaaacactcgtgaagattaaacgtatgtcattcgtcatggagtacgtaggagaggtgataacgtcggaagaagccgagcggaggggacagttctatgacaacaaaggaatcacatacctgtttgatttggattacgagtccgacgagttcactgtcgatgccgccaggtatggcaacgtcagccacttcgtcaatcattcctgtgacccgaacctgcaagtgttcaacgtctttatagacaacctggatacgagacttccaaggatcgcgctgtttagcactcggactatcaacgcgggggaagaattaaccttcgattaccagatgaagggttcaggagatatctctagtgactccattgaccattcgccagctaagaagagggtgcggacagtgtgcaagtgcggcgccgttacctgcaggggatatctcaactag

SEQ ID NO: 207478 - DNA, 2658 bp, Artificial Sequence
  Description of Artificial Sequence: Synthetic coding sequence
atgaagtggctgggcgagagcaagatcatggtggtgaacggccggagaaatggggggaaactcagcaacgatcaccagcagaatcagagtaagctccagcatactggcaaggatacgctgaaagctggtaaaaacgccgtggagagaagatctaacagatgtaatggaaattccgggttcgaaggacagagtagatatgttccatcgtcaggcatgagcgcgaaagaactgtgcgaaaacgacgatctggccacaagcctggtgctggatccgtacttgggattccaaacacataagatgaacacgtctgcttttccttcaagaagcagccgccatttcagtaagtccgattctttcagtcacaacaaccctgtccgctttcggcccattaaggggcgacaggaagagctcaaggaggtcattgagcggtttaagaaggatgaacatctcgagaaggcctttaaatgccttacatctggtgaatgggcacggcactacttcttgaacaagaacaagatgcaagagaagctcttcaaagagcacgtattcatttatctccgcatgttcgcaaccgacagcgggttcgagatcctcccctgcaataggtacagctccgaacagaacggggcaaaaatagtagcgacaaaagaatggaagcgaaacgacaaaatagagctgttggtgggctgcatcgctgaattatcggagatcgaggaaaacatgctcctgcgacacggtgaaaacgactttagcgtcatgtactccacccggaagaattgtgctcagctttggctcggaccagctgcattcatcaaccacgactgccgcccgaattgtaagttcgtgtccacgggcagagacaccgcatgcgtaaaggcccttagggacattgagcctggagaagagatctcttgttattacggtgacgggttcttcggtgagaacaatgaattctgcgagtgttacacatgtgaaagacgcggcacaggagcctttaaaagtcgcgtcggactcccagccccagcccccgtgatcaactccaaatacggcctgcgcgagacggataagcggcttaatcgtctgaagaaactgggcgactcaagcaaaaatagcgatagccagtccgtctcaagcaacacagacgcagatactacccaagaaaaaaacaacgctactagtaatcggaagtcaagcgttggcgtgaaaaagaatagcaaaagtcgtaccctgacaaggcaaagtatgagtcgcatccccgccagcagtaatagcacatcatctaagctgacacacattaataacagtagggtacctaagaagctgaagaagcccgccaaacccttgttgtctaagattaaactgaggaatcactgtaaaagactcgaacagaaaaatgcaagtaggaaactggaaatggggaacttagtcttaaaagaacccaaagttgtgctttacaaaaacttaccaataaagaaggacaaggagcctgaaggcccagcgcaagccgccgttgcctccgggtgtctcacacggcatgctgccagagagcacagacagaacccagttagaggggcccattcccagggtgaatcctcgccctgtacatatattactaggcggagtgtgcgcaccagaacaaacctcaaagaggcttcggacattaagctggaaccgaacacccttaacgggtacaagagtagcgtgactgaaccctgtcctgattccggggaacaactacagcctgcccccgtcctgcaggaggaggaactggctcacgagactgctcaaaagggtgaggctaagtgccacaagtcagacaccggtatgagcaagaagaaatcaagacagggcaagcttgtgaagcagtttgctaagatagaggaatctacccccgtgcatgattctcctggaaaggatgatgccgttccagacttgatgggtccacactctgaccagggcgagcatagcggaactgtgggggtgcctgttagctacacagactgtgctccgagcccagtgggctgcagcgtggttacatcggatagctttaagaccaaagactccttcagaaccgcgaagagcaaaaagaaacggaggattactcgatatgatgcccaacttatcctcgagaacaactccggcattcccaaattaaccctgcgtaggcgacacgatagtagtagtaagaccaacgaccaggagaatgatggcatgaactcttcaaagatcagcatcaagctcagcaaagaccatgataacgacaataatctgtatgtggcaaagctaaataacggcttcaatagcggtagcggctcatcctccaccaaactcaagatacaattgaaacgagatgaggaaaacagaggctcatatactgaggggcttcacgagaacggggtgtgctgctctgaccccttgtctctgttagaatccaggatggaggtggatgactattctcagtacgaggaggaatctaccgatgactccagctcctcagaaggggacgaagaagaagacgactacgatgatgattttgaggacgattttattcccctgcccccagccaagcgtctccggctgatcgtgggaaaagactccatcgatatcgacattagctcgcggcggcgcgaagaccagagtctgcgcctgaacgcatag

SEQ ID NO: 207479 - DNA, 1182 bp, Artificial Sequence
  Description of Artificial Sequence: Synthetic coding sequence
atgaagtggctgggcgagagcaagatcatggtggtgaacggccggaggaacgggggaaaactgtcaaatgatcatcagcagaaccaatccaaacttcaacacacagggaaagacacattgaaagccggcaagaatgctgtggaaaggaggagtaaccgctgtaacgggaatagcgggtttgaaggccagagtaggtacgttccttcgtctggtatgtcagccaaagaactatgcgagaacgacgacttagcgacctctcttgtgctagacccttatctcggctttcagacacacaaaatgaacacttcagcattcccatctcggagttcacggcacttttctaagtctgactccttttcgcacaataaccctgtccggttccggccaatcaaagggaggcaggaggagctgaaggaagtgatcgaaaggttcaagaaagatgaacacttagaaaaggcctttaaatgcctcacctcaggcgagtgggccaggcactactttctgaataaaaataagatgcaagaaaagctcttcaaggagcatgtgtttatttacctgcggatgtttgctactgactcaggctttgaaattctgccttgtaacaggtacagtagtgagcaaaacggtgcaaagattgtagcgactaaggaatggaagcgcaacgataagattgagctgctcgtggggtgcatcgccgaactgtctgagatcgaagaaaatatgcttctgagacacggggaaaatgacttcagcgtgatgtactctacccgaaaaaattgcgcacaactttggttaggcccggccgcatttataaaccacgattgccggccaaactgtaaattcgtctcaactggcagggacaccgcctgtgtgaaagccctccgcgacatcgagccaggcgaagagattagctgctattacggtgacggcttctttggagaaaacaacgaattttgtgaatgctacacctgtgagagacggggtactggtgccttcaaaagccgggttggattgcccgccccagcccccgtaatcaattcaaagtacggcctccgggaaacagacaaaaggctgaataggctgaagaagcttggcgatagcagcaagaactccgatagtcaatctgtctcatccaacacagacgccgataccacccaggagaagaacaatgcatcaaagtag

SEQ ID NO: 207480 - DNA, 1182 bp, Artificial Sequence
  Description of Artificial Sequence: Synthetic coding sequence
atgaagtggctgggcgagagcaagatcatggtggtgaacggccggcgcaacggggggaaactgtcgaatgaccaccagcagaatcagagcaaactgcaacacacaggcaaagacactctcaaggccggtaagaacgcagtggagcggcgcagcaatcggtgtaatggcaacagcgggttcgaaggccagtcacggtacgtaccttcaagtggcatgtccgcaaaagagctgtgcgagaacgatgatttagcgacctcattggttctggatccttatcttggattccagacccataaaatgaacacctccgcctttccttccagaagtagccgccatttttccaagagcgatagtttctctcacaacaacccagtgcggtttcggccgatcaaagggcgtcaggaagaactcaaagaggtcatcgagcgcttcaagaaagacgaacatctggaaaaagcttttaagtgcctcaccagcggtgagtgggcacggcactactttctgaacaaaaacaagatgcaggaaaaactgttcaaagaacatgttttcatctatctacgcatgttcgcaacagacagcggtttcgaaattctcccctgcaatcgttactcctccgaacaaaacggggcgaagatcgttgctactaaggaatggaagaggaatgataagatcgagctcttagtcggatgtatcgccgagctgtcagaaatcgaagaaaacatgctgcttcgacacggagaaaacgatttcagcgtgatgtactcaacacgcaaaaactgcgcacagctttggctggggccggcggcctttattaatcacgactgtagacctaattgtaagtttgtgtcgacaggaagagacaccgcatgtgtgaaggctctgcgggacatcgagccaggagaagagatcagttgttattatggagacgggttcttcggagagaacaacgagttttgcgagtgctacacctgcgagaggagaggaacaggggcatttaaaagtcgggtcgggttgccagcacccgcccctgttattaactcaaaatatgggctgcgggaaacagacaaaagactaaaccgacttaagaaactgggcgactccagtaagaactctgacagtcagagcgtttcatctaataccgatgccgacacaacccaagaaaagaacaatgcaagtaaatag

SEQ ID NO: 207481 - DNA, 357 bp, Artificial Sequence
  Description of Artificial Sequence: Synthetic coding sequence
atgaagtggctgggcgagagcaagatcatggtggtgaacggccggaggaacggtggaaagctctctaacgaccatcaacaaaaccagtctaaactgcaacatacaggcaaggatacccttaaggcaggtaaaaacgcagttgagagacggtctaatagatgtaacggtaattccggctttgagggccagtccaggtatgtgccatcctcaggaatgtccgctaaggaattgtgtgagaatgatgacctggcaacctctctggtgctggatccatacctggggtttcaaacacataagatgaatacttccgcatttccctcacgctctagtcggcatttttctaaatccgattcatag

SEQ ID NO: 207482 - DNA, 1389 bp, Artificial Sequence
  Description of Artificial Sequence: Synthetic coding sequence
atgggccccgaccgggtgaccgcccgggagctgtgcgagaacgacgaccttgccacaagcctggttctggatccttatctggggttccgcacacacaaaatgaatgtgagcccagtgcccccccttcgccgtcagcaacatctgaggagcgctctggagactttcctgcggcagagagatttggaagccgcttacagagcactcaccctgggagggtggacggctagatattttcagagtagaggccctcgacaggaagccgcgctgaaaacacatgtctacaggtaccttcgcgcctttctgcctgagtctggctttacgattctgccctgtacaagatactcaatggaaacaaacggtgctaaaatcgtatccacgcgggcctggaagaagaatgaaaaactggagctgcttgtcggctgtatagccgaacttcgagaggctgacgagggtttactgcgggctggggaaaatgactttagtatcatgtatagtactaggaaacggagtgctcagctttggctaggccccgctgcgtttattaatcatgactgtaagccaaactgcaagttcgtgccagcagacggtaacgctgcctgcgtaaaggtcctccgcgacatcgagcccggcgacgaggtgacatgtttctatggagagggcttctttggagagaagaatgagcattgcgagtgtcacacatgcgaaaggaaaggtgagggcgcttttcgcacccggccaagggaaccggcgcttcccccacgacctctcgataaatatcagctgcgtgagactaaacggcgtctgcagcagggcttagatagcggatcaaggcagggactgctcggcccgcgcgcctgcgtccacccaagtccacttcggcgtgacccgttctgtgctgcttgtcagccactcaggctcccagcatgctcagcacgccctgatactagcccgctgtggcttcagtggctcccccagccccaaccacgggtccgacctcgaaagcggagaagacctaggccccgacgcgctccagtgttgtctactcatcatgcagcaagggtgtctctccatcgttggggaggctgcggccctcattgccgcttgcgcggtgaagccctggttgccctgggccagcctcctcacgcccgctgggccccgcagcaggactggcattgggcaaggagatatgggctgccatacgtggtccgggtggatctgagacgactggctccagccccacccgcaacacccgcgcccgccggaaccccaggcccaattctgattccgaaacaggcactcgccttcgcccccttttcaccaccgaagcggcttaggctggtcgtgtctcatggaagcatagacctggacgtcggcggcgaggagttgtag

SEQ ID NO: 207483 - DNA, 390 bp, Artificial Sequence
  Description of Artificial Sequence: Synthetic coding sequence
atgccccggcggggccggtggctgagctgcagccccgaggccgagggtatacgacgtgtgggttctcgcgcagctctccgggttcatcctctggagcacaggccccgttgggggactcccggcgggatgactaaggggagtagattcctggcccctgaatctgaactctcctggggaccaggggacgcaactcctggcttgtggttcttcatttcagatggcgtgggagaggacctctggaattcagcaggttggtcatccgtgccagaagggttcgggcagcgcatgcgcgggcccggattaactcctcacaccgacgccgggggcgatggcaataaaaggcgccactcggaaagattgtgccgggcatctgttctccaaccgccctag

SEQ ID NO: 207484 - DNA, 744 bp, Artificial Sequence
  Description of Artificial Sequence: Synthetic coding sequence
atgcacctggcccggctggtgggcagctgcagcctgctgctgctgcttggcgccctaagcgggtgggctgcctcggatgaccccatagagaaggttatcgagggaattaatcggggtttgtccaatgcagagcgggaagtcggcaaggccctcgacggcatcaattcaggaatcacacatgctggacgcgaggtggagaaagtcttcaatgggttatccaacatggggtctcatactgggaaagagctcgataaaggtgtgcaagggttgaaccacggcatggataaggttgcacacgagataaaccacggaatcggccaggctggaaaggaagcagaaaaactagggcatggcgtgaataacgcagcaggtcaggctgggaaagaggctgacaaggcagttcagggatttcacactggagtgcaccaggcaggcaaagaggcggagaaactggggcagggcgtcaaccatgccgcagatcaagcaggcaaagaggtcgaaaaactaggccagggagcacatcacgccgcaggacaagcaggcaaagaattgcagaacgctcataatggagtgaaccaggcatctaaggaagccaatcaactcctgaatggtaatcaccagagtggctcttcttcacaccaagggggcgctaccaccacccccctggccagtggggcctcggttaataccccgtttataaatttacccgctctgtggaggtccgttgcaaacatcatgccatag

SEQ ID NO: 207485 - DNA, 1773 bp, Artificial Sequence
  Description of Artificial Sequence: Synthetic coding sequence
atgcacctggcccggctggtgggcagctgcagcctgctgctgctgctgggtgccctgtccggttgggctgccagtgacgaccccatcgaaaaagtgattgaaggcatcaaccggggcctctccaatgcagaaagggaagtgggcaaagctctggacggcataaacagcggtattacgcacgctgggcgagaggtggaaaaggtctttaacggattgagcaatatgggctctcacaccggaaaggagctcgacaagggcgtccaggggctgaatcatggcatggacaaggtggcacacgaaataaaccatggcataggacaggcagggaaagaagccgagaagctgggacatggtgtgaataacgccgcgggccaggttgggaaggaggcagataagctaattcatcacggggtgcatcacggcgccaaccaggctggatctgaggccggtaagtttggacaaggagtggacaacgctgctggacaggctggaaatgaagctggccgttttggtcagggagtccatcatgccgccgggcaggccggaaacgaggctgggaggttcggacagggagttcatcacgcagctggacaggccgggaacgaagctggacggtttgggcaaggggcacaccatggcctatctgaggggtggaaagagactgaaaagttcggccagggcattcatcacgccgccggtcaggttgggaaggaagccgagaagttcgggcagggcgcccaccacgcggcgggacaggcaggcaacgaagccggtcgttttgggcagggcgtccaccacggcttaagtgaaggctggaaggagactgagaagtttgggcagggtgtccatcacaccgcgggccaggtcggcaaggaagccgaaaaatttgggcagggcgctcatcatgcagctgggcaagctggaaacgaggccggaagattcggacagggggcccatcatgccgctgggcaggcaggaaatgaggccgggcggttcggacagggtgtacaccacggactgagtgaaggatggaaggagaccgaaaaatttgggcagggagtgcatcacgccgcttcacagttcggaaaggaaactgaaaaattgggtcatggggtgcatcatggagtgaacgaagcttggaaggaagctgagaagttcggacagggggtccatcacgccgccagtcaggtgggaaaggaagaggatagagtggtgcaggggctacaccacggagtgagtcaggctgggcgtgaagcaggccagtttgggcacgacattcaccacaccgcaggacaagccggtaaggagggcgatatcgctgttcacggagtccaaccaggtgttcacgaggccggcaaagaggccggccagttcggccagggggtgcaccacacgttagagcaggccggcaaagaggcagataaggccgtccagggcttccacactggcgtccaccaggctggaaaagaggcggaaaaactgggccaaggagtaaatcacgccgctgaccaagcagggaaggaagtcgagaaactgggacagggagctcatcacgccgctgggcaagccggtaaagagcttcaaaacgcccacaacggtgtgaatcaagcgtccaaggaagccaatcaactcctgaatggcaaccatcagtctggctcgagctcccatcagggcggcgccaccaccacccccctggcctccggggcaagcgtgaacactcctttcattaacctcccagctctgtggaggagcgtcgctaacattatgccttag

SEQ ID NO: 207486 - DNA, 288 bp, Artificial Sequence
  Description of Artificial Sequence: Synthetic coding sequence
atgggcagccacaccggcaaggagctggacaagggcgtgcagggccttaatcacggtatggataaggtcgcccatgaaatcaaccacggaatcggccaggccgggaaagaagccgaaaaactgggtcacggcgtaaataatgccgcgggacagggtaaccatcagtcagggtctagtagccaccagggcggagctactacgacaccgttggcttccggagctagcgtgaacacgccttttatcaacttaccagcgttatggaggagcgtcgctaatatcatgccatag

SEQ ID NO: 207487 - DNA, 738 bp, Artificial Sequence
  Description of Artificial Sequence: Synthetic coding sequence
atgtggctgtgccccctggccctgaacctgatcctgatggccgcctccggcgcagtttgcgaggttaaggatgtgtgcgtgggttctccaggaattcctggcacgcccggatcccatggactgccggggcgtgacgggcgtgatggactaaaaggcgatcctggcccacctggtccaatgggacctccgggcgagatgccttgtccccccgggaatgatgggctcccgggggctcccggaattccaggagagtgtggtgagaaaggtgagcccggcgagcgcggccctcccggactgcctgcacaccttgatgaagagctgcaagcgacgctgcacgatttccgtcatcagatcctccagacacggggagcattgtcactacaaggatccatcatgacagtaggcgaaaaggtgttctcttcgaacggacagtccattactttcgacgcaatccaggaagcatgcgccagagcaggcggtcggatagctgtcccaagaaaccctgaggagaacgaggcaatagcttcctttgttaagaaatacaacacctacgcctatgtcgggctgacggaaggcccctcgcctggggattttaggtactccgacggaacgcccgtcaattacaccaactggtaccggggcgagccagccggtagaggcaaagagcaatgcgttgagatgtacacggacggccagtggaacgacaggaactgtctgtatagccgattgaccatctag

SEQ ID NO: 207488 - DNA, 570 bp, Artificial Sequence
  Description of Artificial Sequence: Synthetic coding sequence
atgggcccccccggcgagatgccctgcccccccggcaacgacggcttgcctggcgcacccggaattcccggcgagtgtggggaaaaaggtgagccaggcgagcgtggaccacctggtttaccagcacacctggatgaggagctgcaggccactttgcacgatttccgtcatcagatattgcagacccgcggtgccctttcccttcagggctcaatcatgacggtaggagagaaggtgttcagctccaatggccaatctatcacctttgatgcaattcaggaggcttgcgcccgggcaggaggacgcatagccgtgccacgcaatccggaagagaacgaggcgatcgcaagtttcgtcaagaagtacaatacttacgcctacgtgggtttgactgagggccccagccccggggacttccgatactccgacggcacacctgtgaactatacaaactggtaccggggggaaccggccggcagagggaaagaacaatgcgtggagatgtatacagatgggcagtggaacgacaggaactgcctgtactcaaggctgactatttgtgagttttag

SEQ ID NO: 207489 - DNA, 747 bp, Artificial Sequence
  Description of Artificial Sequence: Synthetic coding sequence
atgtggctgtgccccctggccctgaacctgatcctgatggccgccagcggcgccgtgtgtgaggtgaaagatgtatgtgttggatcacccggtatacccggaacccctgggagccacggtttgcccggaagggacgggcgagacggcctgaaaggagatccaggcccacctggcccgatggggcctcctggcgaaatgccttgtcctcccgggaacgatggactccccggagcccccggaatccctggggagtgcggagagaaaggagagcccggagagcgggggcctccggggctgcctgcgcacctggacgaagaactacaggctacactccacgactttagacaccagatcctgcaaacgcggggggcacttagcctgcagggcagcatcatgactgtaggcgagaaggtgtttagcagtaatgggcagagcataacattcgacgcgattcaagaagcctgtgcacgcgccggtggcagaatcgcagttccacgtaaccccgaggagaacgaggcaatcgcctcttttgtaaaaaaatacaatacctacgcttacgtggggttgacggaggggccttcgccgggggatttccgttacagtgacggaactcctgtcaattatacaaactggtatcgaggcgaacccgctggaagaggaaaagaacagtgtgtagagatgtatactgatggtcaatggaacgatcggaattgtctatattcacgactaaccatctgcgaattctag

SEQ ID NO: 207490 - DNA, 747 bp, Artificial Sequence
  Description of Artificial Sequence: Synthetic coding sequence
atgtggctgtgccccctggccctgaacctgatcctgatggccgccagtggcgccgtgtgtgaggtaaaagatgtgtgtgtaggctcccctggcatccccggcactccggggtcacatggtttaccaggcagagatggccgagacggactcaagggcgatcccgggccgccagggccaatgggccccccaggtgagatgccttgcccaccagggaacgacggcctaccgggcgcaccggggatcccaggagagtgtggggagaagggcgaacccggagagagaggcccacccggtctccctgcccacttggatgaggagctccaagcgacgctgcacgattttcggcaccagatcctccagaccaggggcgccttgtctcttcagggatcgataatgaccgtgggggagaaagttttttccagtaacggacagagtatcactttcgacgccatccaggaggcttgtgcccgcgccggcgggcgcatagcggtgccaagaaacccagaagaaaacgaagctatagccagctttgttaagaagtataatacatatgcttacgtaggcctgaccgaaggaccctcccctggtgatttccggtacagcgacggtacccccgttaattataccaactggtacaggggagaaccagcaggaagaggcaaagaacagtgtgttgagatgtataccgacggacagtggaatgacaggaattgcttatacagcagactgacaatctgcgagttctag

SEQ ID NO: 207491 - DNA, 792 bp, Artificial Sequence
  Description of Artificial Sequence: Synthetic coding sequence
atgcggccctgccaggtgcccggcgccgccaccggcccccgggccatgtggctctgtcccctcgccctgaacttaatcctcatggcggccagcggggctgtatgtgaggtgaaagacgtctgcgtcggatcgccaggaattcctggtacaccaggttctcacggactgccgggcagggacggccgggacgggctcaagggagatccaggccctccaggcccaatggggcccccgggggaaatgccgtgcccgcctggcaacgatggcctgccaggcgccccgggtatccccggtgagtgcggagaaaagggtgagccaggggagcgcggcccccccggccttcccgcacacttggacgaggagctgcaagcaacccttcacgattttagacaccagatcctacaaacacgcggggccctctccttgcaggggagtataatgactgtaggcgaaaaagtgttcagctccaacgggcagagtataaccttcgatgctatccaggaggcctgcgcaagagccgggggtagaatagccgtcccgagaaatccagaagaaaacgaagctatcgccagcttcgttaaaaaatacaatacttacgcttatgtggggctcaccgaaggaccatctcctggggactttcggtactcagatggaactcccgttaattacactaactggtataggggcgaacctgcaggccgtggtaaagaacaatgcgtagagatgtacacagatggacagtggaacgataggaattgcctgtatagcagattaacaatttgcgaattttag

SEQ ID NO: 207492 - DNA, 747 bp, Artificial Sequence
  Description of Artificial Sequence: Synthetic coding sequence
atgtggctgtgccccctggccctgaacctgatcctgatggccgccagcggggcggtgtgcgaggtcaaggacgtttgcgttggatcccccggcattcctggtacgcccggatcccacggactgccaggccgcgatgggagggacggcttgaagggcgacccagggcctccaggaccgatggggccaccgggggagatgccatgcccaccaggcaacgatgggcttcctggcgctcccggcatcccaggcgagtgcggagaaaagggcgagcctggtgaaagaggccccccaggcctccctgctcacctggatgaagaacttcaggcaacgctgcacgacttccgtcatcagattctacagactcgaggcgcactttcactgcaggggagcatcatgacagtgggcgaaaaggtcttctctagtaacgggcagtccatcacttttgacgccatccaggaagcctgcgcacgcgccggaggccgtatcgctgtgccgcgaaatccagaggagaacgaggcgatagcctctttcgtaaagaaatacaacacatacgcctatgtaggcctgactgaagggccttcgccaggcgacttcaggtattccgacggtacgccagtgaactatacaaactggtataggggagagcctgctggcagaggaaaagagcagtgtgtggagatgtacacagacgggcagtggaatgataggaattgcctctatagcagactgaccatctgtgaattttag

SEQ ID NO: 207493 - DNA, 477 bp, Artificial Sequence
  Description of Artificial Sequence: Synthetic coding sequence
atgtggctgtgccccctggccctgaacctgatcctgatggccgcctccggggccgtgtgtgaggtgaaggacgtttgtgtaggaagccccgggatacctggaactccaggctcacacggtctgcccggaagagacggtcgggacggccttaaaggcgatcccggtccgcctggcccgatgggccctcctggggaaatgccttgcccacccggaaatgacggtctccccggtgccccaggcatcccaggggaatgcggggaaaagggcgagcccggcgaacgcggacctccaggcttacctgctcaccttgacgaggagctacaggctacgctgcacgattttaggcaccagatactacagactcgcggcgccctgtcgttgcaggggtctattatgaccgtcggtgaaaaggtgttcagctcaaacggccaaagcataactttcgacgctatccaggaggcatgtgcaagggcctag

SEQ ID NO: 207494 - DNA, 477 bp, Artificial Sequence
  Description of Artificial Sequence: Synthetic coding sequence
atgtggctgtgccccctggccctgaacctgatcctgatggccgcctccggcgccgtgtgtgaggttaaagacgtgtgtgttggctcccccggcataccaggaacccccggttcccacggattgcctgggcgcgacgggcgagatggtctgaaaggcgatccaggaccacctggacctatggggccacccggggaaatgccatgcccaccgggcaacgacgggcttcccggagcccctggtattcctggcgagtgtggagagaaaggagagcccggggagagaggacctccgggactgcccgcccaccttgacgaggagctgcaggctacgcttcacgactttagacaccaaattctccagacaaggggagccctcagcttacagggcagtattatgaccgtgggggaaaaagttttcagttctaatggacaaagcataactttcgacgcgatccaagaggcctgtgctcgagcatag

SEQ ID NO: 207495 - DNA, 747 bp, Artificial Sequence
  Description of Artificial Sequence: Synthetic coding sequence
atgtggctgtgccccctggccctgaccctgatcctgatggccgcctccggggccgcatgtgaggtgaaggatgtgtgcgtgggaagtcccggcataccaggcactcctggatcacatggccttcccgggcgggacgggcgagacggtgtcaagggagaccctggccccccaggtcctatgggcccgcccggagagactccctgcccccctggtaacaacggactaccaggtgctcctggcgtgccgggggagcggggtgaaaagggggaggctggtgagcggggcccccccggcctgccagcccatctcgacgaggagctgcaggctaccttacatgactttcggcaccaaatattgcagacccgtggggccctgtccctgcaaggctctataatgaccgttggcgagaaagtgtttagttctaacggtcagagcatcaccttcgacgctattcaggaggcctgcgcccgcgcaggtggacggatagccgttccaaggaacccagaggaaaatgaagctatcgccagctttgtaaagaagtataacacctatgcctatgtggggttaacagagggcccaagccccggggatttcaggtactcagacggcactcccgtgaattatacaaattggtaccgcggagagccggccggcagaggaaaggagcagtgtgtggaaatgtatacagacggccagtggaatgatagaaactgtctgtacagccggctgaccatctgcgagttttag

SEQ ID NO: 207496 - DNA, 747 bp, Artificial Sequence
  Description of Artificial Sequence: Synthetic coding sequence
atgtggctgtgccccctggccctgaccctgatcctgatggccgcctctggcgctgcttgcgaggttaaggatgtgtgtgtgggcagcccagggatcccaggaacaccaggatctcatggcctgcccggaagagatggacgagatggagtcaaaggggaccctggcccacctggacccatggggcccccaggcgaaactccttgcccacctggcaacaacggcctgccgggggctcccggggtgcccggggaaaggggggagaagggagaggctggcgagcggggtcccccaggactaccagcccatctcgacgaagagctgcaggccactctccacgactttcggcatcagatcctccagacaagaggtgctctgtcactacagggcagcatcatgacagtgggagagaaagtattctcatccaatggccagtccattacattcgacgctattcaagaagcttgtgcgagggccggaggaaggatcgctgtgccccggaaccctgaagagaatgaagcgattgccagttttgtgaagaagtacaacacctatgcttatgttgggctgaccgagggtccctcacccggtgattttcgatatagtgacggcaccccagtcaattacacgaactggtataggggagagccggccgggagaggcaaagaacagtgcgtggagatgtacactgatggccagtggaacgataggaattgtctgtacagccgcctgaccatatgtgagttctag

SEQ ID NO: 207497 - DNA, 477 bp, Artificial Sequence
  Description of Artificial Sequence: Synthetic coding sequence
atgtggctgtgccccctggccctgaccctgatcctgatggccgccagcggcgctgcatgcgaggtgaaggatgtttgtgtgggcagccctgggataccaggcacccctgggtcgcacggactacccggtagagacggtagagatggtgtaaagggcgaccccggaccccctggccccatgggcccaccaggggagaccccttgtccacccggtaataatggactgccaggcgctccaggcgtcccgggagaaagaggcgagaagggagaagccggggaaagggggcccccggggctgccagcccatctggatgaagaactgcaggccacactgcacgactttaggcaccagatccttcagactcgcggcgcactgtctctgcagggaagcatcatgaccgtgggggagaaagtattctccagcaacgggcaatcaattactttcgacgcaattcaagaggcctgcgcccgagcatag

SEQ ID NO: 207498 - DNA, 645 bp, Artificial Sequence
  Description of Artificial Sequence: Synthetic coding sequence
atgcggccctgccaggtgcccggcgccgccaccggcccccgggccatgtggttatgccctctggctctcaccctgatcctcatggccgcttccggcgctgcctgcgaggtgaaagacgtctgcgttggctcacctgggattcccgggaagcggggcgaaaaaggtgaagccggggaacggggccctccgggactccccgcacacctcgacgaggagctccaggcgactctacacgatttccggcaccagatcctgcagacaaggggggcactctcattgcagggatccatcatgaccgtgggcgaaaaggtcttttcctccaatgggcaatccatcaccttcgacgcaatacaggaggcctgtgccagggcaggaggacggattgcggtccccaggaaccctgaggaaaacgaggccatagctagttttgtgaagaaatacaacacctacgcttatgttggtctcacagaggggccaagcccaggagacttcaggtactctgacggaacccctgtgaactatactaactggtaccgtggcgaaccagcaggaaggggaaaggagcagtgcgtggagatgtacacagacgggcaatggaacgaccgaaactgcctgtattctcggctgacaatttgtgaattctag

SEQ ID NO: 207499 - DNA, 1146 bp, Artificial Sequence
  Description of Artificial Sequence: Synthetic coding sequence
atggccgagagccacctgctgcagtggctgctgctgctgctgcccacactctgcggcccaggaacggccgcttggactacgtctagtttggcttgtgcccaagggccggagttctggtgccagtccttggaacaggctctccagtgtcgggccctgggccattgcctgcaggaagtctgggggcacgttggcgcagacgacctgtgtcaggagtgtgaggatatcgtccacattcttaataagatggcgaaggaggccatctttcaagacaccatgcgtaagtttcttgagcaggagtgtaatgtgctgccgctgaaactgctgatgcctcagtgcaatcaggttctggacgattattttccactcgtcattgactactttcagaaccagaccgattccaacggcatatgcatgcatcttggcctctgcaaatccagacaacctgaacccgagcaggaaccagggatgagcgaccccttacctaagcctctgagggaccccctgccagaccctctgctggacaaactggttctgccagtattgcctggcgccctgcaggccagaccaggaccacacacccaggatctctccgagcagcagtttcctattccgctcccatattgctggctgtgtagagctctcatcaaaaggatccaggcaatgataccgaagggcgcattagccgtcgccgtagcacaggtctgcagggtcgtccccctggtcgccggagggatatgccagtgcctcgctgaaagatattcagtaatcctgttggacacccttttaggacggatgctcccacagttagtctgtcggctggtcttacgttgctctatggatgactctgccggaccacgttcaccgactggtgaatggttgccgcgcgactccgagtgtcacctgtgcatgtctgtgactactcaagccggaaactctagtgagcaggccattcctcaggccatgctccaggcttgcgtgggttcgtggctcgatagggaaaagtgcaagcagttcgtcgagcagcatactccacagttactgacactggtgcccagagggtgggacgcccacactacctgtcaggcacttggtgtctgtggtacgatgtctagccctctgcagtgcatccattccccggacctttag

SEQ ID NO: 207500 - DNA, 1128 bp, Artificial Sequence
  Description of Artificial Sequence: Synthetic coding sequence
atgctgctgttcctgctgagcgccctggtgctgctgacccagcccctaggatatctggaggctgaaatgaagacatattcgcacagaaccatgcctagcgcatgcacactcgtaatgtgttcaagcgtcgaatcaggcctccccggcagggacggccgggatggacgggaaggcccccgcggcgagaaaggagaccccgggctgccaggcgctgccggacaagctggcatgccagggcaggcaggaccggtcggccctaagggagataatggcagcgtgggagaaccaggccccaaaggagatacagggcctagcggcccacctggaccccccggcgtacctggtcccgccggcagggagggaccactgggaaagcaaggaaacatcggaccacagggtaagccaggacccaagggcgaagcaggccctaaaggtgaggtgggagctcccgggatgcagggtagcgcaggcgctaggggcctggctgggcctaagggagagcgaggcgtccccggcgaaagaggtgttccggggaacaccggagctgctggatccgcaggtgctatgggaccccaagggtctcctggcgccagggggccccccggtctgaagggcgacaaagggatcccaggggacaagggcgcaaaaggtgaatctggtctgcctgatgttgcttctcttcggcaacaggttgaagccctgcaaggccaggtgcaacacctgcaggcggccttcagccagtacaaaaaagttgagttgttcccaaatggccagtctgtaggcgagaaaatttttaaaaccgcaggctttgtgaagcccttcacggaggctcaactcctgtgcacccaggcagggggacagcttgcttccccccggtcagcagctgagaacgctgcactccagcaattggtggttgccaaaaacgaagctgcctttctaagtatgaccgatagcaaaaccgagggaaaattcacatatcccactggagagagccttgtgtatagtaattgggctcctggggagcccaatgatgatgggggttctgaggattgcgtcgaaattttcacaaacgggaagtggaacgaccgcgcctgcggtgagaagcggctcgtagtgtgcgagttctag

SEQ ID NO: 207501 - DNA, 657 bp, Artificial Sequence
  Description of Artificial Sequence: Synthetic coding sequence
atgttcctgagcaccagcaagcacggccggcaggaggccatgctgctgttcctcttaagtgccttggttctgctcacacaacctttgggttatctagaagccgagatgaaaacttacagccatcgaacaatgccatccgcttgtacactggtaatgtgtagttccgttgagagcggccttcctggccgggacggtcgagacggccgggagggcccccgcggcgaaaagggcgatcccggcctgcctggcgccgccggacaggccgggatgccggggcaagctggtcctgtggggcctaagggggataacggatccgtcggtgaaccgggccccaaaggggacaccggtcccagcggtccaccaggcccaccgggagttcctggtcccgcggggagggaaggaccactgggcaaacagggaaatatcggcccgcaaggcaagccagggccaaagggcgaggcaggccccaagggtgaggtaggggcacccggaatgcaaggctccgcgggggcccgaggtttggctggccccaagggtgaacggggtgtgccaggggaacgaggtgttcctggtaataccggggccgccggaagcgccggggctatgggaccccaggggagtcccggcgcccgggggcccccaggtctgaagggctag

SEQ ID NO: 207502 - DNA, 903 bp, Artificial Sequence
  Description of Artificial Sequence: Synthetic coding sequence
atggccgccgtggccgccctgcagctgggcctgcgggccgccggccttggacgcgctccagcttctgcagcctggcggtccgtgctgcgtgtctccccgagaccaggggtggcctggcgaccttctcgatgtgggagttctgctgctgaagccagcgctaccaaggccgaggacgacagcttccttcagtgggtgcttctactgattcccgtgaccgcatttggtctgggcacctggcaggtccagcgtcgaaaatggaaattgaatctgattgcagaactggagtcaagggtgcttgccgagcccgtacctctgccagcggaccctatggaactcaaaaacttggagtatcggcccgttaaggtccgcggctgtttcgatcacagtaaagaactctatatgatgcccaggactatggtggaccctgtgcgcgaggctagggagggtgggctcattagctcaagtacccaaagcggggcatacgtcgtcacacctttccactgcaccgacctaggggtaaccattctcgtcaaccgcggcttcgtgcctaggaagaaggtgaatcctgaaacaagacaaaaaggccaaattgaaggggaggtggaccttatcggtatggtaaggttaactgagactagacagcctttcgtgcctgaaaataatccagagcgaaaccactggcattaccgcgacctggaggctatggctcggatcacgggcgccgaacccatcttcatcgacgcaaatttccagagcacagtgcccggcggacccatcggcggccaaactagggtcaccttgcgcaatgaacacctccagtacattgtaacctggtatggcctctccgcagctacatcttatctctggtttaagaaattcctgagagggacccctggcgtttag

SEQ ID NO: 207503 - DNA, 813 bp, Artificial Sequence
  Description of Artificial Sequence: Synthetic coding sequence
gcccccgccagcgccgcctggcggagcgtgctgcgggtgagcccccgtcccggtgttgcttggaggccttctaggtgtggctcgtccgcagctgaagcctccgctactaaagccgaagacgactcgtttctccaatgggttctcctcctaatcccagtgaccgcctttggtctggggacatggcaggtgcaacggagaaagtggaagctcaacctcatcgctgagctggagtcccgcgtgctggccgagcctgttcctcttccagccgaccccatggagttgaagaacctggaatatcgtcctgttaaggtaagaggttgttttgatcattcaaaggaattgtatatgatgccaaggacgatggtggatccggtcagggaggcccgcgaaggcgggctcatctccagcagtacccagtctggcgcgtatgtcgtgactccgtttcactgcactgacctggggaagaaggtgaatcccgaaacgagacaaaaaggacaaattgaaggcgaggtcgatctgattgggatggttaggttgacagaaacgcgccagcctttcgtcccggaaaataatcctgaacgaaatcattggcattatcgagatctggaagctatggccagaataactggagccgagccaatttttatcgatgcgaatttccaatcaaccgtgcccggagggccaattggtggccagacacgagttacactgcggaatgaacatttgcagtatattgtcacatggtacggtctctctgctgctacaagttacctgtggtttaagaaattcctccgaggaacccctggggtatag

SEQ ID NO: 207504 - DNA, 771 bp, Artificial Sequence
  Description of Artificial Sequence: Synthetic coding sequence
atgagcgagctgcccggcgacgtgcgggccttcctgcgggagcaccctagcttgcgactgcagaccgatgctaggaaagtgagatgcatcctcactggtcacgagctgccatgtcgcctgcctgagcttcaagtgtacacccgcgggaagaaatatcagagactcgtaagggcaagtcccgctttcgactacgctgagtttgagcctcacatagtgccttctacaaagaacccccaccagttgttctgtaaactgaccctgagacatatcaataagtgtccagaacatgtccttagacacacccaggggagaagataccagagggccttatgcaagtacgaggaatgtcagaagcagggcgtggagtatgtgcccgcttgcctcgtgcaccgccgtagaaggagggaagaccagatggacggagacggcccaaggcctagagaagcgttctgggagccgaccagttcagatgaggggggggcagcctcagacgattccatgacagatctttaccctccagaactcttcacacgcaaggacttgggaagtacagaggacggcgacggcacagatgactttctgacagacaaagaggatgagaaagcaaagcccccccgcgagaaagctactgacgaaagccgccgggaaactacggtgtaccgcggcctggtgcagaagagagggaagaagcaactgggcagcttgaagaagaagtttaagtctcaccatcgtaagccaaagagtttctcaagctgtaagcagcctgggtag

SEQ ID NO: 207505 - DNA, 810 bp, Artificial Sequence
  Description of Artificial Sequence: Synthetic coding sequence
atgggccagaacgacctgatgggcaccgccgaggacttcgccgaccaatttctccgggttacgaagcaatatttaccacacgtagcacgcctgtgcctcatatcaaccttcctagaagatggcatccgcatgtggtttcagtggtccgagcaacgggattatatcgacacgacctggaattgtggataccttttggccagttcattcgtctttctgaatttgctaggccagcttactggatgcgtcctggtgttgagtaggaatttcgtgcagtacgcatgcttcggtctgtttggaataatcgcactgcaaaccatcgcgtactctatcctgtgggacctgaaatttctgatgcggaatctggctctcggtggtggcttgctgttgctgctggctgaaagtcgctctgagggcaagagtatgttcgccggtgtgcccactatgcgcgagtcctcaccaaaacagtatatgcaactcggggggcgcgtcttgttggtactgatgtttatgaccctcttgcacttcgacgcttcattctttagcatcgtgcaaaacatcgtcggcacagccctgatgatcctggtcgccattggcttcaagactaaattggctgcactcacactcgttgtctggctcttcgctatcaacgtttattttaatgccttttggactatcccagtgtataaaccgatgcatgattttctaaagtatgattttttccagaccatgtcagtgatcggaggcctcttactggtcgtggcacttggtcctggcggagtcagcatggacgagaagaagaaggagtggtag

SEQ ID NO: 207506 - DNA, 561 bp, Artificial Sequence
  Description of Artificial Sequence: Synthetic coding sequence
atgggccagaacgacctgatgggcaccgccgaggacttcgccgaccagttcttgagggtgaccaaacaatatttacctcacgtcgccagactgtgccttatatcgaccttcctcgaagatggtattcgaatgtggttccaatggtcagagcaacgagactacatagataccacctggaactgcggatacctgctggcctcgtctttcgtgtttctcaacctgctgggacagctgaccggatgcgtactggtgctgagcaggaactttgtccaatatgcctgtttcggactgtttggcattatcgcgctgcaaaccatcgcctacagtatcctttgggatttgaaatttctgatgagaaatttagctctgggtggggggctgctgctcctgctggccgagagccgcagtgagggcaaatctatgtttgctggcgtacctacaatgagggagagctcccccaagcagtacatgcagcttggcggaagggtgcttctcgtgctgatgtttatgactctgctgcattttgacgctagctttttttctcagcccagccagcagtag

SEQ ID NO: 207507 - DNA, 567 bp, Artificial Sequence
  Description of Artificial Sequence: Synthetic coding sequence
atgggccagaacgacctgatgggcaccgccgaggacttcgccgaccagtttcttcgagtcactaaacagtatctgccacacgtcgccaggctgtgcctcatctccacctttttagaagacggtatccgaatgtggtttcagtggtctgaacagagggattacatagacaccacctggaactgtgggtatctgctggccagctcatttgtcttcttaaacctgctaggccaattgactgggtgcgtgctcgtcctgtcccggaacttcgttcagtatgcgtgttttgggctgttcggaattatagccttacagacaattgcatatagtattctgtgggatctgaaatttctcatgcggaatttggccctgggggggggtttacttttgctactggccgaaagccgatcagaaggtaagtcaatgtttgccggtgtcccaaccatgcgggaaagttcaccaaaacacacatgcctggcgaagacacggggcaggcagggcctggtgcgaggaggcttcaataaaacagcctccttctacgtctctagctccctacctctgccttggtag

SEQ ID NO: 207508 - DNA, 783 bp, Artificial Sequence
  Description of Artificial Sequence: Synthetic coding sequence
atgcggagcctggccaccgagttcctgcgggtgaccaagcagtaccttccccacgtagcgagactttgtcttattagtacattcttggaggatggtatcaggatgtggttccagtggagtgaacagcgggactatatcgatacgacttggaactgcgggtatctcttggcatccagcttcgtgttcctgaatctccttggccaactgacaggatgcgtgttggtgctttcacggaactttgtgcagtacgcctgctttggactgtttggtattatagccctgcagacaatcgcatattccatactgtgggaccttaagttcctgatgcgaaatctggcgctgggcggggggttactcctccttctggctgagtcccggtcagagggcaagtccatgtttgcaggagtgcccaccatgagggaatccagtcctaagcagtatatgcagcttggcggtcgggtcctcttggtcttaatgttcatgacccttcttcatttcgatgcatcattcttctcaattgttcagaacattgtaggcactgctctcatgattctggtggccataggctttaagactaagcttgctgcccttacgctggtggtatggctcttcgccattaacgtctacttcaatgccttttggactatcccagtctacaagcctatgcacgacttcctgaaatatgatttctttcagacgatgagcgttattggaggcttactcctagtggtggctctgggcccaggtggcgtctctatggatgaaaagaagaaagagtggtag

SEQ ID NO: 207509 - DNA, 387 bp, Artificial Sequence
  Description of Artificial Sequence: Synthetic coding sequence
atgggccagaacgacctgatgggcaccgccgaggacttcgccgaccagttccttcgcgtaactaagcagtatctgccccacgtggcaaggttgtgcttgatctctacttttcttgaggatggtattcggatgtggtttcaatggtccgagcagagagattatattgacacaacctggaactgtggatacctcctggcatcctccttcgtgttcctgaacctcctgggccagctgaccggatgcgtactggtactgtccaggaactttgtgcagtatgcatgttttggcctttttggaatcatagcactgcaaactatcgcctatagtattctgtgggacctgaagttcttgatgcggctctcccgcacttcatgggcacagttatag

SEQ ID NO: 207510 - DNA, 1086 bp, Artificial Sequence
  Description of Artificial Sequence: Synthetic coding sequence
atggccagcctgctggccaaggacgcctacctgcagagcctggccaagaaaatctgcagtcactctgccccagaacagcaagctcgtacgagagcaggcaaaactcaagggtcagagacagcaggaccccccaaaaagaagcgaaaaaagacccaaaagaagttccggaagagggaggagaaggcagcagagcataaagcaaaatcactgggcgagaagagtcccgcagcttccggtgcccggcggcctgaggcagctaaagaagaggccgcctgggcgtcatcttccgctggaaaccctgctgatgggctggcaactgagcctgagagcgtgtttgctctggacgtcctccgccaaaggctgcatgagaaaattcaggaggctcgggggcagggtagtgccaaagaactgagtcccgctgctctggaaaagcggcgtaggagaaaacaggaaagagacagaaaaaagagaaagagaaaggagctgagagctaaggagaaagcgcgcaaagcagaagaggccacagaggctcaggaggtagtggaagccacacctgaaggagcttgtaccgagccgcgagagccacccggcctgatcttcaacaaagtggaagtgtcagaggacgagcctgcatccaaggcacagagacggaaagaaaagcgacagcgggtgaagggcaacctgacccccctcactggaaggaactacaggcagctcttggaacggcttcaggctcggcagtcccggctggacgagctgagggggcaagatgaaggcaaagcccaggaactggaggccaagatgaagtggactaatttgctgtataaagccgagggggtgaaaatccgggacgacgaacgcctgctgcaagaggccctcaaaagaaaggaaaaacggcgcgcccagcgtcagcggcgctgggagaaacggactgccggagtagtggaaaagatgcaacagcgtcaggatcggcggagacagaaccttcggagaaagaaagctgcccgggcagagcgccgtctcctccgagctcggaaaaagggccgaatcctcccgcaagatttagagagggcaggactggtctag

SEQ ID NO: 207511 - DNA, 789 bp, Artificial Sequence
  Description of Artificial Sequence: Synthetic coding sequence
atggccatgagcagcggcggcagcggcggcggcgtgcccgagcaggaagatagcgtgctttttcggagaggcacgggccagtccgacgactctgacatttgggacgacaccgccctgatcaaagcatacgataaggccgttgccagtttcaagcatgccctgaaaaatggcgatatctgtgagacctccggcaagccaaagactacccccaagcgtaagccagcgaagaagaacaagtcccagaagaagaacacagccgcatccctgcagcaatggaaagtcggggacaaatgttccgcgatttggagcgaagacgggtgcatatatccagccaccatcgcttcaatcgattttaagagagaaacctgcgtggttgtttataccggttacggtaatcgggaggaacagaatctgtcagacctcctaagtccaatttgcgaggtcgctaataatatcgaacaaaacgcccaggaaaacgagaacgaatcccaagttagcaccgacgaatcagagaactcccgaagccctggcaataagtctgacaatattaagccgaagagtgccccctggaacagcttcctgcctccgcctcctccaatgcctggtccgcgtctgggtcctgggaagatcattccccctcccccacccatttgtcctgattccctggatgacgctgatgcactcggatccatgctcatctcctggtacatgtccggttatcatacggggtattatatgggcttcaggcagaaccagaaggagggcagatgtagtcattccctcaactag

SEQ ID NO: 207512 - DNA, 885 bp, Artificial Sequence
  Description of Artificial Sequence: Synthetic coding sequence
atggccatgagcagcggcggcagcggcggcggcgtgcccgagcaggaagactcggtgctgttccgccgagggacgggccagagcgatgactcagacatatgggatgatacggcactcatcaaagcatacgataaggccgtggcatcctttaaacatgctctgaagaacggcgacatctgtgagacatcaggcaaaccgaagacgaccccaaaacgtaaacctgctaagaaaaataagtcccaaaaaaagaacactgctgcgtccctgcaacagtggaaggttggtgataagtgctctgctatatggtcagaagatggttgtatttaccccgccaccatcgcctccattgacttcaagcgcgagacttgcgtcgtcgtctacaccggatatggaaacagggaggagcagaacttgtccgatctcctgtcaccaatatgtgaggtcgccaacaacatcgagcagaatgctcaagaaaacgaaaatgagtctcaagtctccaccgacgaaagcgaaaactcgaggtcccccggtaataagagcgataacattaaaccgaagagtgcaccctggaattctttcctccccccccctccccctatgcccggtccccgcctggggccgggcaaaccaggattgaaatttaatggtccgccaccccctcctccaccaccacccccccatctgctcagctgttggttacccccattcccaagcggtcctccgataatacctcccccacccccgatctgcccagattctctagacgatgccgatgctctgggcagtatgctgatttcttggtacatgtccggataccacacgggctactatatggggtttaggcagaaccagaaggagggacggtgttctcacagcttgaactag

SEQ ID NO: 207513 - DNA, 789 bp, Artificial Sequence
  Description of Artificial Sequence: Synthetic coding sequence
atggccatgagcagcggcggcagcggcggcggcgtgcccgagcaggaagactccgtgttgtttcggcggggaacgggccaatccgatgattccgatatctgggacgatacagctctgatcaaagcgtatgataaagccgtagcctcctttaaacacgcgctcaagaatggggatatctgcgagaccagcggcaagcccaagaccacgcccaagaggaaacctgccaaaaagaacaagtcacagaagaagaacaccgcggcctcactgcagcagtggaaggtgggcgacaaatgctccgctatttggtctgaggacggatgcatttaccccgctactatagcgagcattgatttcaagcgggaaacctgtgtggtagtgtacacagggtatggaaatagagaagaacagaatctctccgatctcctgtcccctatctgcgaggtcgcaaacaacatcgaacaaaacgctcaggaaaacgaaaacgagagccaggtgtcaaccgacgagtctgaaaattcccgtagtccagggaataagtctgataatataaagccaaaaagcgccccctggaattcatttcttccaccaccgccacccatgccaggaccccggttgggaccgggaaagattattcctccgcctccacccatctgccccgactcactagatgatgccgatgctctggggagcatgctgatttcttggtatatgtccggataccatacgggttactacatgggctttcgccagaaccagaaagagggccgttgtagccacagtctgaactag

SEQ ID NO: 207514 - DNA, 849 bp, Artificial Sequence
  Description of Artificial Sequence: Synthetic coding sequence
atggccatgagcagcggcggcagcggcggcggcgtgcccgagcaggaggactcggttttgttcaggcggggtaccggccaatcagacgactctgacatttgggacgacacagccttaataaaagcgtacgataaagctgtcgcctccttcaaacacgccctgaagaatggggacatatgtgagacaagtgggaagcccaagactacgccaaaaagaaagcctgcaaagaagaacaagtcccagaaaaagaataccgccgcatccctgcagcagtggaaggtgggcgataagtgctctgcaatctggtccgaagatggttgcatttatcctgccactattgcgagcattgactttaagcgcgagacttgcgttgtcgtgtacacggggtatgggaatagagaagagcaaaacctgtcagatctcctcagccccatctgtgaagtcgcgaataatatcgagcagaatgctcaagaaaatgaaaatgagtcacaagtgtccaccgacgagtccgaaaacagtcgctcccccggaaacaagtccgacaacataaaacccaaatccgctccctggaattcatttttgccgccaccaccgccaatgcctgggccccgcctggggcccgggaagcccgggctcaaattcaatgggccacctccgccgccccccccaccgcctccccacttactgtcctgctggcttccacctttcccatccggtccacccatcataccacccccaccacccatttgtccagactctctggacgacgccgacgcgctcggatccatgctgattagctggtatatgtccggctatcatacaggatactatatggagatgttggcctag

SEQ ID NO: 207515 - DNA, 885 bp, Artificial Sequence
  Description of Artificial Sequence: Synthetic coding sequence
atggccatgagcagcggcggcagcggcggcggcgtgcccgagcaggaggactctgtcttgtttagaagaggcacaggccaatccgacgactctgatatctgggatgacactgccctgatcaaggcctacgacaaggccgttgcctcctttaagcatgcacttaaaaacggggatatctgtgaaacatcgggcaagcctaaaacgactcctaaacggaagcctgccaagaaaaacaagtcacaaaagaagaacacggccgcttcactgcagcagtggaaagtcggagacaagtgctccgctatatggtcagaagatgggtgtatttatcctgctacaatcgcatcaatagactttaaaagagagacgtgcgtcgtcgtgtataccgggtacggcaaccgggaagaacaaaacctatccgatctcctctcacccatttgtgaagtagctaataacatcgagcaaaatgctcaggagaatgagaacgaaagccaggttagcacagacgaatctgagaacagccggtcgcccgggaataagtcagataacattaagcccaaatctgccccctggaactcattccttccccccccaccccctatgcccggcccaaggcttggacccggcaagcccgggctgaaattcaacggacctcctccaccgcctccgccaccgcccccacacctcctttcgtgctggctccctccattcccttcagggccacccattataccgcctccgcccccaatctgccctgattcgttagacgatgccgatgcgctgggttctatgctgatctcttggtatatgtcaggctatcataccgggtattacatgacaggtttccactgcgtgagccaagatgggctcaatctgctgaccccttag

SEQ ID NO: 207516 - DNA, 684 bp, Artificial Sequence
  Description of Artificial Sequence: Synthetic coding sequence
atggccatgagcagcggcggcagcggcggcggcgtgcccgagcaggaagactctgtcttatttcgtcgggggactggccagtccgatgattcagacatctgggacgacaccgccctcatcaaggcatacgacaaagcagtcgcctcttttaagcacgctctgaaaaacggagacatatgcgagaccagcggcaaacctaagaccacccccaaacgcaagccagccaaaaagaacaagtcccagaagaaaaataccgccgcatccctgcaacagaatgagaacgagagtcaggtgtcgacagatgaaagcgagaattcccgatcgcccggaaacaagagtgataacataaaacccaagtccgcgccgtggaactcattcctccctccaccacctcccatgccgggtccgcgtttaggcccaggcaaacccggattgaaattcaatgggcctcctcctccccctcctcccccccccccccacctcttgtcctgttggctgccacctttcccctccggccctcctatcatcccccccccccctccaatttgtcccgattctctcgatgacgccgacgctctcgggtcaatgctcatcagttggtacatgtcaggatatcatactggctattacatgggcttccgccagaaccagaaggaaggcagatgcagccacagcctaaactag

SEQ ID NO: 207517 - DNA, 849 bp, Artificial Sequence
  Description of Artificial Sequence: Synthetic coding sequence
atggccatgagcagcggcggcagcggcggcggcgtgcccgagcaggaggatagcgtgctctttaggcgggggactggacagtccgacgactccgatatctgggacgataccgctctgatcaaggcctatgacaaagccgtggcaagttttaagcacgctctgaaaaatggggacatctgcgaaacatcgggaaagccaaagacaactccaaagcgcaaaccagccaaaaagaacaagagccaaaaaaaaaatactgctgccagcttacagcagtggaaagtgggggacaaatgcagtgccatttggtccgaggatggttgtatctatccagcgacgattgcttcaatcgattttaagagggagacttgcgtggtagtgtatacaggttacggtaacagggaagagcagaacctttcggatctgctaagtcctatctgcgaggtcgccaacaacattgagcaaaacgcccaggagaacgaaaatgaaagtcaggtttccaccgatgagtccgagaactccagatcgcccggtaacaaaagcgataatattaagccaaagtcggcgccttggaactcttttctgccgccacctcctcctatgcccggaccaagattgggaccgggcaaacctgggttgaaattcaacgggcccccccctccccctccccctcctccccctcacctgttaagttgttggttgccccctttcccaagtggcccacccatcatccctcctcccccccctatctgtccggattccctcgatgatgccgatgccctaggctccatgctgatctcttggtacatgtcaggctaccacacgggttactacatggaaatgctggcgtag

SEQ ID NO: 207518 - DNA, 789 bp, Artificial Sequence
  Description of Artificial Sequence: Synthetic coding sequence
atggccatgagcagcggcggcagcggcggcggcgtgcccgagcaggaggacagcgtactctttcggaggggtacaggccagtccgatgattccgacatctgggatgacacggcacttattaaagcatacgacaaagctgtagctagcttcaagcatgccctgaagaatggcgacatttgtgaaacatctggtaaacccaagaccacccccaagcgaaagcccgcgaagaaaaacaaatcccaaaagaagaataccgccgcttctttgcaacagtggaaggtcggggacaaatgtagcgccatctggagcgaggatgggtgtatctatcctgctaccattgcaagcatcgattttaagagggaaacttgcgtggtggtgtacactggctatggcaatcgggaggagcaaaatctgtctgacctcctgagccctatctgtgaggtggccaataatatcgaacaaaacgctcaggagaacgaaaatgagtcccaagtctccaccgatgagtcagagaacagccgttctccaggaaacaaatccgacaacatcaagccaaaatcagctccgtggaactcattcctccctcccccacccccaatgccaggccctagactcggccccgggaagatcatcccacctcccccgccaatttgcccggacagcctggacgatgctgacgcactcggaagcatgttaatctcttggtacatgtcaggataccataccggctactatatgggctttagacagaaccaaaaagagggaagatgcagccattcgctgaattag

SEQ ID NO: 207519 - DNA, 885 bp, Artificial Sequence
  Description of Artificial Sequence: Synthetic coding sequence
atggccatgagcagcggcggcagcggcggcggcgtgcccgagcaggaggatagcgtcctgtttcgtcgcggcaccgggcagagcgatgattctgatatctgggacgacactgctctgatcaaagcttacgataaggccgtggcgtcgtttaagcatgctctcaaaaatggggacatttgcgagacatctggaaagcccaaaacaaccccgaagaggaagccagctaagaagaataagagtcaaaagaaaaataccgcagcttcgctgcagcagtggaaagtgggagataagtgttctgccatttggtctgaagatggctgtatctacccagccacaattgctagcatagactttaaaagggagacctgcgtcgtggtttatacaggatatggaaaccgggaggagcagaacctgtcagaccttttatcaccgatctgcgaggttgctaataatatcgagcagaatgcccaggagaacgaaaatgagagccaggtttccaccgatgagtccgaaaattcacgttcaccaggcaacaaatcagacaatataaagcccaaaagcgcaccttggaactctttccttcctcctccgccccctatgccagggccccgcctcggccccggcaagcctggtctgaagttcaatgggccaccccctccccctccacctcctccacctcacctcctcagttgttggctccccccctttccctctggtcctccaattattcctcctcctcctccaatctgtccggatagcctggacgacgctgacgccctgggctccatgctgattagctggtatatgtcgggctatcacacaggctactatatgggattccgccaaaaccagaaagagggcagatgttcgcatagtctgaactag

SEQ ID NO: 207520 - DNA, 885 bp, Artificial Sequence
  Description of Artificial Sequence: Synthetic coding sequence
atggccatgagcagcggcggcagcggcggcggcgtgcccgagcaggaggactctgttctgtttaggcgcggcacaggtcagagcgacgactctgacatctgggacgacacagctctcatcaaggcctacgacaaggctgtggcctccttcaaacatgcactcaaaaatggagacatatgtgaaacgtccggcaagccaaaaacgactcccaaacgtaaacctgccaagaaaaacaagtctcagaaaaagaataccgccgcatcactgcagcaatggaaggtgggcgacaaatgctccgccatatggagtgaagatggttgtatttaccctgctactatcgcatcaatcgactttaagcgcgaaacttgcgttgtagtctacacagggtacgggaatcgcgaggagcagaatctgtccgacctgttatcccctatttgtgaagtcgccaacaatattgaacaaaacgcgcaggagaatgagaacgaaagccaggtaagcacagacgagtcagaaaatagtcggtccccgggcaataagagtgataatataaaacctaagagtgcaccctggaacagttttttaccacccccaccgcccatgcctgggccaagactgggccctggtaaacctggtctgaagttcaacggacccccacccccacccccgccccccccgccccacctgctctcatgctggctgccacccttcccctcggggccacccataatccctcccccaccccctatttgtcccgactccctggatgatgctgacgctctcggatcaatgttaatctcctggtatatgtcgggctatcataccggttattatatgactggatttcattgtgtgtctcaggacggactcaacctcctgaccccttag

SEQ ID NO: 207521 - DNA, 684 bp, Artificial Sequence
  Description of Artificial Sequence: Synthetic coding sequence
atggccatgagcagcggcggcagcggcggcggcgtgcccgagcaggaagacagcgtgttattccggagagggaccgggcagtccgacgatagcgatatttgggatgacactgctctaatcaaagcatacgacaaggcagtggccagcttcaagcatgcgctgaagaatggcgatatctgtgaaacatctggaaagcccaagaccaccccgaagcggaaacctgctaaaaaaaataaatctcaaaaaaagaatacggccgcaagcctccagcagaatgagaacgagagtcaggtgtccacagatgagagtgagaactcccgttctccaggcaacaagagcgacaatataaaaccaaaaagcgcaccttggaactccttccttccaccaccgcctcccatgccgggtccaaggttaggtcccggtaagcccggcctaaagtttaacgggccgcccccacctccgccccctccacccccccacctactgtcctgttggctgccccctttcccctctggtcccccgattatccccccacccccgcccatctgtccggactcactggacgacgcagatgcgctaggttccatgcttatcagttggtacatgtcaggataccatactgggtattacatgggttttcggcagaaccaaaaggaaggtagatgctcccattcccttaattag

SEQ ID NO: 207522 - DNA, 4494 bp, Artificial Sequence
  Description of Artificial Sequence: Synthetic coding sequence
atgccccggtgcatcgcccacttctgcgagaagccccccagcgtgtcatacagcatcttggagtctgtgtcaaaggctaagtttgctgcaggatctgtggtgagttttaagtgtatggagggtttcgtcctgaacacttcagctaagatcgaatgcatgcgggggggccaatggaatccgtcacccatgtcaattcagtgtatacccgtgaggtgcggtgagccccctagcattatgaatgggtatgcttctgggagcaattattcctttggtgcaatggtggcctacagctgcaacaaaggcttttacattaagggtgagaaaaaaagcacctgtgaggctacaggtcagtggagctcaccaattcctacatgtcaccctgtgagctgcggcgagccgcccaaggtggaaaatggctttctcgagcacaccaccggcagaatcttcgagagtgaggttcgataccagtgtaatccagggtataagtccgtcggtagccccgtttttgtgtgtcaagccaatagacactggcattcggaaagccctctcatgtgcgttcctctagactgtggaaaaccaccgccaatccagaatggcttcatgaaaggagagaacttcgaagtggggtcaaaagtgcagttcttctgcaacgaaggctatgaactcgttggagactcttcctggacctgtcagaagtccggcaagtggaataagaagtccaatccaaagtgcatgcctgcgaaatgccccgagcctcctctcctcgagaaccagctcgttctgaaagagctcacaacagaggtgggagttgtgacgttctcatgtaaggagggccacgtcctgcagggaccctctgtgttaaagtgcctccctagtcagcagtggaacgattccttccccgtttgtaagattgttctttgtacgcctcctcctctcatcagctttggggtgccaatcccctcttcagccctacatttcggatccaccgtgaaatactcatgtgtaggaggattctttctcagggggaacagcactaccctgtgtcaaccagacggaacctggtcctcacccctgccagaatgtgttcccgtggaatgtccgcagcccgaggaaattcctaacgggatcattgacgtacagggactcgcctatttaagcaccgcgctgtatacctgtaagccagggttcgaattagtcggtaacaccacgaccttgtgtggagagaacggtcactggctgggcggtaaaccaacttgcaaggctatcgaatgcctgaagccaaaagagatcctcaatgggaagttttcctacacagatttgcattacggacaaacggtgacatattcctgtaaccgcggctttcgcctcgagggaccgtcggccttaacctgtttggaaaccggtgactgggatgttgacgccccttcttgtaatgctatccactgtgattcgccccagccgatcgaaaatggtttcgtggaaggtgccgattactcttatggagctatcataatctactcatgttttcccgggttccaagtcgcgggccatgccatgcagacttgcgaggagtctggctggtctagtagcattccgacttgcatgcctatagactgtggcctgcctccccacatcgacttcggggactgtacgaagctgaaagacgaccaggggtacttcgagcaggaagatgacatgatggaggtgccttatgtaacaccccatcccccgtaccacctgggagctgttgcaaagacttgggagaacacgaaggagagccccgccacacactccagcaactttctttatgggaccatggtgtcttatacatgcaatcccggctacgagcttctaggaaaccccgtccttatctgccaggaggacggaacatggaatggttcagcaccatcttgtattagcatagagtgcgatctgccaacagcccctgaaaatggctttctcagattcactgagacatctatgggatctgctgtgcaatattcatgtaaaccaggacatatccttgctgggagcgatttaaggctctgtctggagaatcggaagtggagcggagcttctccccgctgcgaagcaattagttgcaaaaagcccaaccctgtcatgaacggatccattaagggcagcaactacacttacctctcaactctgtattatgagtgtgatcccgggtatgtgctcaatggtacagagcgacgcacctgccaggatgacaaaaactgggacgaggacgagcccatctgcatacctgtggattgcagctcccctcccgtatcagcaaatgggcaggtgcgtggggacgagtataccttccaaaaagagattgaatatacatgcaacgaaggattcctgcttgaaggagcacggtccagagtgtgcctggctaacggcagttggtccggcgcgactcccgactgcgtccccgtgagatgcgccaccccgcctcagctggccaatggagtgaccgagggcctggattacggcttcatgaaagaagtgacctttcattgtcatgaaggttatattcttcacggagcacccaagttaacctgccagtcagacggaaactgggacgcagaaattcccctttgtaagccggtcaattgcggcccgcctgaggaccttgcccatggatttccaaatggttttagcttcatccatggcggacacatccagtatcagtgtttcccagggtacaagttacatgggaactccagtagaaggtgcttaagcaacggaagctggagcggaagctctccaagctgtcttccatgtaggtgttccacgcctgtgatcgaatatggaactgtgaacggcactgatttcgattgcggtaaagcagctcggattcagtgctttaagggcttcaagttgcttggcctgagcgagatcacctgtgaagccgacggccagtggagtagtgggtttcctcattgcgaacacacaagttgcggcagcctacccatgatccccaacgctttcatttccgagacctcaagctggaaggagaacgttatcacatattcttgtcgctctggatatgttatccagggctcttctgatttgatctgcaccgagaaaggcgtttggtctcagccctacccagtgtgcgagccactgagctgcgggagccccccgagcgtcgcaaacgcggtcgctaccggagaggctcacacctacgagagcgaagtaaagctgcgctgcttggagggctacactatggatacagataccgatacatttacctgtcaaaaagatggcagatggtttcccgagagaataagctgtagccctaaaaagtgtcctctgccagagaatattacacatattttagttcatggcgatgatttttccgtgaacaggcaggtgagcgtgtcctgtgcagagggatatacgtttgagggcgtgaacatcagcgtctgccagttggacggaacctgggaaccacctttttccgatgagagttgcagccccgtgtcttgtggcaaaccggagtctcccgaacatggcttcgtggttgggtccaaatatactttcgaatctaccattatataccagtgtgagccaggttacgaactggagggaaaccgagaacgtgtctgccaggagaaccgccaatggtctggtggcgttgccatttgtaaggagacaaggtgcgaaactccactggagtttcttaatggcaaagctgacatcgagaaccgtactacaggtccaaatgtcgtttacagttgcaataggggctatagcttagaaggaccatcagaggctcattgcactgagaacggcacttggagtcaccctgtgcccctgtgcaagccgaacccctgcccagttccatttgtgattcctgaaaatgccttactgagtgaaaaggagttctacgtcgaccaaaatgtctcaattaagtgtagagaaggtttcctgctgcagggccatggcatcatcacctgcaatccagacgagacttggacacagacatcggctaaatgtgagaaaatctcatgcggacctcctgctcacgtagagaatgccatcgcccgaggtgtgcactatcagtacggcgacatgataacatattcttgctattctggttatatgctggagggcttcttgcgatccgtctgcctggagaatggaacatggactagccccccaatctgcagggcagtgtgtcgcttcccatgtcagaatggaggcatttgccagaggccgaatgcctgctcctgtcctgagggctggatgggcagactttgtgaagaaccgatttgcatcctcccgtgcttaaatgggggacgctgcgttgccccataccagtgcgactgtcctccaggctggacaggaagtcgttgccacacagctgtgtgccagagcccctgcctgaatggtggcaagtgtgttagacctaatagatgtcactgtctgtctagctggacagggcataactgcagtcggaagaggcggacaggtttctag

SEQ ID NO: 207523 - DNA, 4650 bp, Artificial Sequence
  Description of Artificial Sequence: Synthetic coding sequence
atgtggccccggctggccttctgctgctggggcctggccctggtgagcggctgggcaaccttccagcagatgagcccatcgcggaacttctcctttaggttgttcccggagacagccccaggagccccaggctcaatacctgccccccctgctccgggcgacgaggccgccggtagccgtgtcgaaagactgggccaggccttcagacggagagtcagactgctgagagaactctctgaaagactggaattggtattcttagttgacgatagctcaagtgttggtgaagtgaatttcaggtctgagctcatgtttgttaggaaattgttgagcgacttcccagtagtcccgacagccacccgagtggccattgtgacgttttcatcaaagaactacgtcgtgcctcgagtggattatattagcacccgaagagcccgccagcataagtgtgctctgctgctgcaggagattcccgccatctcctacagaggcggcggcacgtatacgaaaggggcattccagcaagccgctcagattctgctgcatgctcgggagaatagcaccaaagtggttttcctgatcaccgacgggtatagtaacgggggtgacccaaggcccattgcagcctcccttagagattctggggtggagattttcacattcggtatatggcagggcaacattcgcgaactgaatgatatggcctctacccctaaggaggagcactgctatctcctacatagctttgaggagtttgaggcgctcgcccgcagggctctacatgaggacttgcctagtggatcctttatccaggacgacatggtccactgttcatatctgtgcgacgaggggaaagattgttgcgatcgcatgggctcttgcaaatgcgggacacataccgggcacttcgagtgtatctgcgagaagggttattatggtaagggcctccagtatgagtgcactgcctgcccgagcggcacctataaacctgagggcagccccggcggtatcagctcttgtatcccctgccccgacgagaatcatacaagccccccgggctccactagtcctgaagactgtgtttgccgagaggggtaccgcgcctccggccagacatgcgagctggtgcactgccccgctttgaagcccccggagaacggctatttcattcagaacacctgtaataaccatttcaacgccgcctgcggagtgcggtgccatcccggatttgatctggttggctcaagtataatactctgcttgcccaacggactgtggtccggcagcgagagctactgtcgcgtgcgaacatgcccacatttgcgccagcccaagcacggtcacattagctgttcaactagggagatgctctataaaacaacttgtctggtcgcttgcgatgaagggtacaggctggaggggagtgacaagctgacctgccagggtaattcacagtgggacggacctgaaccacgttgtgtggagcgtcattgcagcacatttcaaatgcctaaggacgtcataattagtccccacaactgcgggaaacagccagcaaaatttgggacaatctgctacgttagctgccggcagggttttattcttagtggagtaaaagagatgctgcgctgcacaacgtcgggcaagtggaatgtgggagtccaggctgctgtgtgtaaagatgtcgaggcaccccagatcaattgccccaaagacattgaagccaagaccttggaacagcaggatagcgcaaacgtgacctggcaaatcccaaccgctaaggataattcaggcgaaaaggtgagtgtgcacgtccatcctgcctttacgcctccttatctcttccctatcggggacgtcgcaatcgtttatacagcaaccgacttgtctgggaatcaggcgtcttgtatttttcacatcaaagtcattgacgcggaaccccccgtcatcgactggtgtagaagtcctcccccagtacaggtatccgaaaaagttcacgccgcttcctgggatgagccacagttttccgacaactctggtgcagaattagtgattacccgctcgcatacgcagggcgatttatttccacagggggaaaccattgtgcaatataccgccacagatcctagtggaaataacaggacgtgtgacatacatatcgtcataaagggaagcccctgcgaaataccctttacccctgtgaacggagacttcatttgtactcctgacaataccggagtgaattgcactctcacttgtcttgagggctacgacttcaccgagggctccacagacaagtactactgtgcctatgaagatggcgtgtggaagcccacctacaccacggagtggcctgattgtgccaagaagcgcttcgccaaccacggtttcaagtcttttgagatgttttataaagcggctaggtgcgatgatacagacctgatgaagaagttcagtgaagcttttgaaaccaccttgggcaagatggtgccaagcttctgttccgacgctgaggatatcgactgtaggctggaagagaacctgaccaagaagtattgtctggaatataactatgattatgagaacgggttcgctattggcccaggcgggtggggcgccgctaacagactggactactcttacgacgacttcctcgataccgtacaggagaccgcaacttcaattggaaacgctaagtcttcccgcattaagcggagcgctcctctgagtgactacaagattaagctcattttcaatataacagcctcggtaccactgcctgacgagaggaatgacacgcttgagtgggaaaatcagcaaagacttctgcagaccctggaaaccattactaataaactcaagagaacgctgaacaaagatcctatgtactcctttcagcttgcaagtgagattctcatcgcagacagcaatagcctcgaaacaaagaaagcatcaccattttgtcgccccggaagcgtactgcgcggtcggatgtgtgtgaactgtcccctgggcacatactacaatctcgaacatttcacatgcgagtcgtgccgcatcgggtcatatcaagatgaggagggccagctggagtgcaaactttgcccttccgggatgtatacggaatatatacattctcgaaacatctcagattgcaaagcacaatgcaagcagggaacttatagttactcaggcttggagacctgcgagtcatgcccactcgggacctaccagccaaagtttggaagccggtcgtgtctgagttgccctgagaatacctcaacagtcaaacggggggcggtgaacatcagcgcatgtggcgtgccatgtcctgaaggaaagttcagtaggtctggcctcatgccgtgccacccgtgccctcgggattactatcaacctaacgctggcaaggccttctgcctggcttgcccgttttatggcaccaccccatttgccgggtctcgcagcattacggagtgtagctcattctcctcaaccttctctgccgcagaggagtctgtggtcccccctgccagtcttgggcatattaaaaaacgccacgagattagcagccgggtgtttcatgagtgtttctttaacccctgtcataatagcggaacctgccaacagctgggacgaggatatgtgtgcctgtgccctcttggatataccggcttgaaatgcgagacggatatagacgagtgtagtcctctcccgtgcctgaacaacggcgtgtgcaaagatctcgtgggggaattcatatgtgaatgcccgtcagggtataccggccaaaggtgcgaggagaacatcaacgaatgttcctcgtcaccgtgtctgaacaagggtatatgcgtggacggagtagctggctataggtgcacctgcgtaaaaggatttgtgggcctgcactgcgagacggaggtgaacgaatgccagtccaacccctgtctcaacaacgctgtctgtgaggatcaagtggggggcttcctatgcaagtgccccccaggctttctgggtacacgttgcggcaaaaatgttgacgaatgtttaagccagccatgcaaaaatggggctacatgtaaggacggcgccaacagctttcgttgcctgtgtgccgccgggttcacaggctcacactgcgagctgaatattaacgagtgtcagagtaatccctgccgcaaccaggccacgtgtgttgacgaattaaattcctattcctgcaaatgtcagccgggattcagtggcaagagatgcgaaaccgagcagagtactgggttcaatctggacttcgaagttagcggtatttacggatatgtcatgctggacggtatgctgccttcactccacgctctgacttgtactttctggatgaaatcttccgatgacatgaattacggcacaccaattagttacgccgtggacaacggatctgataatacgctgctgctgacggactataatgggtgggtactgtatgttaacgggagggaaaagataaccaactgcccgtccgtgaatgacgggagatggcaccacatagccattacgtggacaagcgccaatggcatttggaaagtgtacatagatggaaagcttagcgatgggggtgccggcctttctgtgggcctaccaattcccgggatgttttag

SEQ ID NO: 207524 - DNA, 2538 bp, Artificial Sequence
  Description of Artificial Sequence: Synthetic coding sequence
atgagccccagccggaacttcagcttccggctgttccccgagaccgccccgggcgctccaggcagcatcccagccccccccgcccctggggacgaggccgcaggctctcgcgtggagcggttgggtcaggccttccgccgtagagttaggctgctccgagagctgagtgagagacttgagctggtgtttttagtagacgactccagctcagtaggggaggtcaactttcggtctgagctgatgtttgtacgcaagctcctctctgattttccggtggtgccgacagcaacccgggtggcaattgtgacgttcagttccaagaattacgttgtgcctagggtggactacatcagtacccgacgagcccgacagcacaagtgcgctctcctgctccaggagatccctgccatcagctatcggggcgggggcacctatacaaagggggcctttcaacaggcggcccagatccttttacatgctagagagaactcaactaaagttgttttcctcatcaccgacggctatagcaatggaggggatcctcgccctattgctgctagcctgcgggactcaggggttgagatctttacgttcggaatctggcagggaaatataagagagcttaacgatatggcctccacacctaaggaagagcactgctatctcctgcactcattcgaggaatttgaagcactcgccaggcgcgctttgcacgaggaccttccctcaggtagctttattcaggacgacatggtccactgcagctatttatgcgacgagggaaaagattgctgtgacagaatggggtcatgcaaatgtggcacccacactggacacttcgagtgcatctgtgagaagggctattatgggaaaggactccagtatgagtgcacagcctgccctagcggaacttacaaacccgaaggctctccgggcggaatctcttcctgcattccgtgtccggacgagaaccacaccagcccacctggctcaacctctcccgaagactgtgtgtgtagggaagggtaccgggcctccggacaaacatgcgaactggtgcattgccctgccctgaaacctccagaaaacggctatttcatccagaatacttgtaataaccacttcaacgctgcatgtggtgtgcggtgtcacccaggattcgatcttgtggggtcgagcatcattctttgtctgccaaatggtctgtggagtggtagtgaatcatattgtagggtgcgcacctgtccccatctgaggcagcccaagcacgggcacatctcctgttccactcgagagatgctgtacaaaactacttgcctggtcgcctgcgacgagggctacaggctggaggggagtgacaaactgacctgccagggcaactctcagtgggatgggcccgagccgagatgtgtggagagacactgctcaacattccagatgcctaaagatgttatcattagtccgcacaattgtgggaaacagccagctaagttcggcacaatttgttatgttagctgccgacagggatttatcctgagcggtgtcaaggagatgttacgatgtactaccagcggcaagtggaatgtgggcgtccaggccgccgtctgtaaagacgtggaggccccacagattaattgcccaaaagatattgaggcaaagaccttggagcagcaggattccgccaatgtgacttggcagatcccgaccgccaaagataactctggagagaaggtgagcgttcacgtgcatccagcctttacgcctccctatctgttccccattggagatgtggcaatcgtatacacggcaacagaccttagcggaaatcaagcttcatgtattttccatataaaggttatcgatgctgagccaccagtcatcgattggtgccggagccctcccccggtccaggtgagcgaaaaagtacatgctgcctcatgggacgagccacagttttcggataactccggagcagaattggtgattacaagaagccacacacaaggagacctctttccccaaggagaaaccatcgtgcagtatactgcaaccgacccaagcggcaataacagaacgtgcgatatccacatagtcatcaagggaagcccatgtgagatacccttcactcccgtaaatggagatttcatatgtacgcctgacaataccggggtgaactgtacattaacttgccttgagggttatgacttcaccgaaggttcaactgataagtattactgtgcctatgaagacggggtctggaaacccacttatacaacggagtggcctgattgcgccaaaaaacgcttcgccaaccacggcttcaagagttttgagatgttttacaaggccgcaaggtgtgatgatacggacctgatgaagaaattctcagaagccttcgagaccaccctgggaaagatggtcccaagcttctgcagtgacgctgaagacatcgactgtcgactggaagaaaatttgaccaaaaaatactgtttggagtataattacgattacgaaaacggctttgctatcgggaactag

SEQ ID NO: 207525 - DNA, 1548 bp, Artificial Sequence
  Description of Artificial Sequence: Synthetic coding sequence
ctggagaaccagctggtgctgaaggagctgaccaccgaggtgggcgtcgtgactttcagctgtaaagagggccacgtgctacagggaccgagtgtcctgaagtgccttccgtctcagcagtggaatgattcttttcctgtttgcaagattgtcctttgcacccctccccccctgatcagcttcggagtgcctattccttcttcagctctgcacttcggaagtaccgtcaagtacagttgcgtgggcgggttttttctaagaggcaacagcacgactctctgccagcccgacggcacttggtctagcccactgccagaatgcgttcccgtggagtgtccgcagcctgaggaaatcccaaacggcataatcgatgtgcagggcctcgcgtatctcagtacagcattgtatacatgcaaacccgggtttgaattggttggcaacacaacaaccttatgcggcgagaatggccactggctgggggggaagcctacatgcaaagcgatcgaatgcttgaagcccaaagagatacttaacggcaagttttcctacactgatcttcactacggtcagacagttacgtacagttgtaacaggggcttcagactggagggtccatcagccttaacctgcctcgaaaccggcgactgggacgttgatgctccctcctgcaacgcgattcactgtgactcgccccagccaattgaaaatggattcgtcgaaggcgccgactactcttatggcgcaatcattatttatagctgttttcccggatttcaggtggctggccacgcaatgcagacttgcgaggagtccgggtggtctagcagtattccaacctgtatgcccatagactgtggattgcctccccacatcgactttggggactgtacaaagctgaaagatgatcagggctactttgagcaagaagacgacatgatggaagttccctacgtgacgccgcatcccccatatcacttgggcgctgtagccaaaacatgggagaacacaaaagaatcgcctgcgacccatagttcaaactttctttatggcaccatggtgtcctacacttgcaatcccggttatgaactgcttggaaatccagtcttaatctgccaagaagacggcacttggaacggatctgctcctagctgtatctccattgaatgcgatctgccgaccgctcctgagaacggctttttgcgcttcactgagacaagtatgggaagcgccgtgcagtatagctgtaaaccaggtcacattttggccggctccgatttgcgactatgcttagaaaatcgtaagtggagcggcgcgagccctagatgtgaggctatctcgtgcaagaagccaaatccagtcatgaatggttcaatcaagggctccaattatacatatctgagcacattatattacgaatgtgaccccgggtacgtgctgaatggcaccgagcggcgaacctgtcaggatgacaaaacagggatgcgcatgtcgccctttgctttcctctggactgcagtccatccccagtcccaacctatggccaggtag

SEQ ID NO: 207526 - DNA, 10647 bp, Artificial Sequence
  Description of Artificial Sequence: Synthetic coding sequence
atgagccccagccggaacttcagcttccggctgttccccgagaccgcccccggcgccccaggctcgatacctgccccgcctgctcccggtgacgaagctgccgggagtcgtgtggaacggctggggcaggcctttcgccgacgcgtgcgactgctgcgggaattgtctgaacgcctagagctagtgttcctggtggatgacagttctagcgtaggagaagtaaattttcgatccgaacttatgttcgtccgcaaactattatccgactttcctgtggtacccacagcaaccagagttgccattgtgacgttctcaagtaagaactatgtcgtgcctcgtgttgactatattagtacacgacgcgctcgtcagcataaatgtgcactgctactgcaggagattcctgccatctcctacagaggaggcgggacatacacgaaaggggcgttccagcaggcggcacagatcctactgcatgcacgggagaactccaccaaggttgttttcctgataaccgatgggtattctaacggaggagaccctcgacctatagcagcctctctcagagactcaggggtggagattttcacctttggtatctggcagggcaatatcagggagttgaatgatatggcgtcaacgcctaaggaggaacactgttacctgctgcatagttttgaagagtttgaagctctggcaagacgggcattgcatgaggatctgcctagtggaagctttatccaggatgacatggtgcactgtagctacctttgcgacgaaggtaaagattgctgcgaccgtatgggctcatgtaagtgtggtacccacacgggtcacttcgaatgcatttgtgaaaagggctattacggcaagggccttcaatatgaatgcaccgcctgccccagtggcacctataaaccggaagggagccccggcggcatatcaagttgcatcccttgtcccgacgagaaccatacctctcctccaggctccacttcgccagaggattgcgtctgccgtgaaggctatcgagcctcaggccaaacctgtgagctggttcactgtcccgcactgaagccaccagagaacggctacttcattcaaaatacttgcaacaaccattttaacgcagcttgcggagtacggtgtcatcccggtttcgatctggttggaagcagtattatcctgtgtctgcctaacggtctatggtcgggcagcgagtcatattgcagagtgcggacctgtcctcacctgcggcagcctaagcatggccatatctcatgctctacccgggaaatgttgtacaagaccacttgtttagttgcatgcgacgaaggatatcgccttgagggttccgataagctgacatgccagggtaatagccagtgggacggccctgagcctagatgtgtggaaaggcactgcagtacgttccagatgccaaaggacgttatcataagcccccacaattgtgggaagcaaccggccaagttcggaactatctgctacgtcagctgccgtcaggggttcatacttagcggtgttaaggaaatgcttcgatgtacgacctccggcaagtggaacgttggcgtacaggccgccgtgtgcaaagacgtagaggccccccaaattaactgcccaaaggatatcgaagctaagacacttgaacaacaagacagtgctaatgtgacctggcagatacccaccgccaaggataatagcggcgagaaagtaagcgtgcatgtgcatcccgcctttacacctccatatctttttcccatcggtgacgtggcgatagtctacacagccactgacctgtccggtaatcaggcatcctgtattttccacatcaaagtgatcgatgccgagcctcccgtaattgactggtgccgcagccctcctcccgtccaggtaagtgagaaggtacacgccgctagctgggacgagccacaattcagcgataacagcggggccgagctggtgattacccggtcacacacacagggtgatctctttccacagggtgaaactattgttcagtatacagccacagacccttccggcaacaacaggacatgcgatatccatatcgtgattaagggctcaccatgtgaaattccctttacccccgtaaatggggacttcatttgcaccccagataacactggagtgaactgcactctaacctgtctggaagggtatgatttcaccgaggggtccaccgataagtattactgcgcctacgaagacggcgtttggaaacctacatatactacagagtggcctgattgtgccaagaagcggttcgcgaatcacggctttaagtcttttgaaatgttttacaaagcagcccgctgtgatgacaccgacctcatgaagaaattctcggaggcttttgagaccactcttggcaaaatggtcccttcattttgcagcgacgctgaggacatcgattgccgcctggaagaaaaccttactaagaaatactgcctggagtataattacgattatgagaacgggtttgcaataggcccaggggggtggggcgcagcaaatcggctggattacagctatgatgacttcctggatacggtccaagaaactgctacatcaattggtaacgctaagagctcgcgcatcaagaggtccgcccctctgagcgactacaagatcaaattaatatttaatattaccgcctccgttcctctgcccgacgaacggaatgacacccttgagtgggaaaaccagcagcggctgttgcagactctcgagaccatcacaaataaactcaaacgcaccttgaataaggacccgatgtacagcttccaactggcctctgagatcctgattgccgatagcaatagcctggagaccaagaaggctagtccattttgtagaccgggaagtgtcctccgaggaaggatgtgcgtgaattgtccactgggtacatattacaacctggagcactttacttgtgaatcttgcagaattggcagctatcaagacgaggaaggacaactcgagtgcaagctgtgcccctccgggatgtatactgaatacatccattctagaaacattagcgattgtaaggcacagtgtaagcagggcacctactcatatagcgggttagagacctgtgagtcatgccctcttggaacctaccagccgaaattcgggagcaggtcttgtctgtcatgtcccgaaaatacctcaactgtcaagcgcggggccgtcaacataagtgcttgcggtgttccttgcccggaaggaaaatttagtagatcaggactcatgccttgtcacccctgtcctagagactactatcagccgaatgccgggaaggcattttgtctggcctgtccattctatggcaccacaccttttgcagggagccgcagcattacagaatgctcgagcttcagcagtacgttttctgccgccgaagagagtgtcgttcctcccgcttctctggggcacattaaaaaacgccatgagattagctcccaagtattccatgagtgcttctttaacccctgtcataacagtggcacttgtcagcagctcgggaggggttacgtgtgtctctgtccgctcggatatacaggcctgaagtgcgagaccgatattgacgagtgcagtccattgccatgcctgaacaacggggtttgtaaggacctcgtaggcgagtttatttgcgaatgcccgtccggctataccgggcagaggtgtgaggaaaatattaatgaatgctcctctagcccatgtctgaacaaaggcatctgtgtcgatggtgtggctggctaccggtgtacctgtgtgaaaggcttcgtaggattacactgcgagacagaggtcaacgagtgccagagtaatccgtgtctgaataacgctgtttgtgaagatcaggtcggaggcttcctgtgcaaatgcccccctggattcctgggtacacggtgcgggaaaaatgtggacgaatgcttgtcgcagccctgcaagaatggagcgacttgcaaagatggtgctaattccttcagatgcctgtgtgccgccggattcaccggaagccattgtgaactgaatattaacgagtgtcaaagcaacccgtgccgcaaccaggccacttgtgttgacgagctgaatagctactcctgcaagtgccagccgggattcagtggaaagcgatgtgaaaccgagcagtcaaccgggtttaatcttgactttgaggtaagcggcatttatggatacgtgatgcttgatgggatgctgcctagcctccacgccctgacttgcacattctggatgaagtccagtgacgacatgaactacggtacacccatctcttacgccgttgataatggttctgataataccttgctgctcacagattacaatggctgggtgctttatgtcaacggacgcgaaaaaatcactaactgccctagtgttaatgatggacgatggcatcatatcgcaattacctggacatccgctaacggcatatggaaggtttatatagatggaaaacttagcgatggaggcgctggactgtccgtgggcctgccaattccaggcggcggcgctctggtgctcggccaagaacaggacaagaaaggagaaggcttttcacctgctgagtcattcgtgggctcaatatcccagctgaatctttgggactacgtgctcagtccccagcaggtgaagtctctggctacatcctgtcccgaagagctctcgaagggtaacgttttggcctggcctgatttcctgagcggtatagtaggaaaggtgaagatcgattctaaaagtattttttgtagtgactgtccgaggctgggtgggagtgtcccacacctaaggactgctagcgaagacctcaagccaggttctaaggtgaatctcttttgcgaccccggattccagctggttgggaaccccgtgcagtactgcctcaatcaaggacagtggacacagcctctgccacactgcgaaagaatcagttgcggcgtgccacctcctcttgagaatggatttcactctgccgacgacttctatgctggatctaccgttacctatcaatgcaataacggttactatctgctgggtgatagccgcatgttttgcaccgataatggctcatggaatggggtgagtccaagttgcctcgatgtcgacgagtgcgctgtgggatctgattgttcggaacacgcatcgtgtctgaacgtcgacgggagctacatctgttcctgcgttcctccgtacaccggtgacggcaagaactgcgccgaaccaattaaatgtaaggcaccaggtaatcctgagaacggtcactccagtggggaaatctatactgtgggggccgaggtgactttctcgtgtcaagagggatatcagctcatgggtgtcaccaagatcacttgtctcgagtccggggaatggaatcatctgatcccttattgcaaggcggtaagctgcggcaagccagccatcccagagaatggctgcatcgaggagctggcattcacattcggctctaaagtaacgtatcggtgcaacaagggttatacactcgcaggtgataaagagtcttcttgcctggccaattcctcctggagtcactcaccccctgtctgtgaacctgttaagtgcagttccccagagaacatcaacaacgggaagtacatcttgagcggtctcacttatctatctactgccagttactcgtgtgatacgggatactcacttcagggacctagcatcatcgaatgcactgctagcgggatctgggatagggcacctcctgcatgccacttggtgttttgtggtgaacctcccgctatcaaggatgcagttattaccgggaataatttcactttcaggaatactgtgacatatacctgtaaagaagggtacactttggcaggtttagacacaattgagtgtttagccgatgggaaatggagcagaagcgaccagcaatgtctggcagtgtcctgcgacgagccacctattgtcgatcatgcatcacccgaaaccgcccatcggctgttcggcgatatagctttctactactgttccgacgggtactccctggccgataattctcaactcttgtgcaacgcccagggcaagtgggtcccccccgaaggccaggacatgccacgctgcatcgctcacttttgcgagaagcctccatctgtgagctactcaatcctggaatcggtgtctaaagcaaagtttgctgccgggagcgttgtgtcctttaagtgcatggaaggcttcgtgctgaacacatcagctaagattgagtgcatgagaggcggacagtggaaccccagtcccatgagtatccagtgcattccagttcggtgcggtgaacctccaagcatcatgaatggttatgcctctggctctaattattcatttggagccatggtggcctattcttgtaataaggggttctatattaagggagagaagaaatccacatgtgaggccactgggcagtggtcctcgccaattcctacatgccaccccgtatcctgcggggagccccctaaggtcgaaaacggcttcctggagcacactactgggcgaatttttgagagtgaggtccgttatcaatgtaaccccggttataaatccgttgggtcgcccgtgttcgtttgccaggcaaacaggcactggcattctgagtcaccgctgatgtgcgttccactggattgtgggaaacccccacctatccaaaacggttttatgaaaggtgagaattttgaggtgggttccaaggtgcagttcttctgtaacgagggttatgagctggtcggagacagttcgtggacctgtcagaaatccggtaaatggaacaagaaatcgaaccctaagtgtatgccagccaagtgtcctgagccacctctgctggaaaaccaactcgttctgaaggagctgacaacagaggtaggagtggtgaccttttcgtgcaaggaggggcacgtgctgcaggggcccagcgtactcaaatgcctcccttctcagcagtggaatgactcattcccagtgtgcaaaatcgtcctgtgcacacctcccccgttgattagttttggcgttcctatcccgtccagcgcactacattttggttccaccgtaaagtactcctgtgtcgggggcttcttcctgcgtggaaactcaacgaccctctgtcaacctgacggtacctggtcctcacctctccccgaatgcgtgccagttgaatgcccccagcccgaggagattcccaatggaattatcgacgtacaggggttagcctacttatcgaccgcattgtacacctgtaaacctggtttcgaactggtgggaaatactacgaccttgtgtggggagaatgggcactggttgggaggtaagcccacttgtaaggcaattgaatgcctgaaaccaaaagaaatcctgaacgggaagttctcctacacggacttgcattacggccagactgtgacttactcgtgtaatcgcgggtttcgccttgaagggccctctgcactgacttgccttgagactggggactgggatgttgacgccccatcctgtaatgccatccactgtgattccccccagcccatcgagaacgggttcgtcgagggcgcagattactcttacggcgccatcatcatctactcttgttttcctggatttcaggtcgctggccacgccatgcagacttgcgaggaatccgggtggtcaagcagcattcccacgtgtatgccgatcgattgtggattaccgccgcacatcgatttcggggactgcactaagcttaaagatgaccagggctactttgaacaggaggatgatatgatggaagttccttacgtgactcctcatccaccataccacttaggcgccgtggctaagacttgggagaatacaaaggagagccctgctacccattcatccaacttcctttatggtacaatggtgtcttacacgtgtaatcccggatatgaattattgggtaatcctgtgctgatttgtcaagaagacggaacttggaatgggtctgctccaagctgcatcagcatcgagtgtgacttgcccaccgctcctgagaacggtttcttgcgatttactgagacttcaatgggttccgcggtacagtatagctgtaaacctggacacatcctggccggaagcgacctccggctctgtctggaaaatcggaagtggagcggagctagtcccagatgtgaggccatctcctgtaagaagccgaaccctgtgatgaacggctcaattaaagggtccaactacacttatcttagcacgttgtactatgaatgcgatccggggtatgtcctaaatggcactgagcggcggacctgtcaggacgacaagaattgggacgaggacgagcctatctgcatcccagttgattgtagctccccacctgtgagcgccaatgggcaagtcaggggcgacgagtatactttccaaaaggaaatagaatacacatgcaatgaggggttcttgcttgaaggagctagaagcagagtctgcctggccaacggtagttggagcggggctacaccggactgcgtacccgttaggtgcgccacgccaccgcagctcgccaatggcgtgacagaaggactggactacggctttatgaaagaagtgactttccattgtcatgagggatacatactgcacggagcgcctaagctgacatgtcagtccgacggaaattgggacgctgaaatccccctttgtaagccagttaattgtggcccccctgaggatctcgcacatggatttcctaacggcttcagttttatccatggtgggcacatccagtatcaatgtttcccagggtataagctccatggtaattcaagtcggagatgcttaagcaacggcagctggagcggcagtagcccctcgtgtttgccctgtaggtgttcgacccctgtaatcgaatacgggactgttaacggaactgatttcgactgtggcaaggccgcgcgtatacagtgcttcaaagggtttaagttactcggcctgtccgagatcacctgcgaggctgatgggcagtggtcatccggattcccgcactgcgagcacactagctgcggttctctgcctatgatcccgaacgcattcatatccgagacatcatcttggaaagaaaatgtcatcacatatagctgtcgctctgggtacgtgattcaaggaagtagcgacctcatctgtaccgaaaaaggagtgtggagccaaccatatcctgtgtgtgagcctttaagttgtggctcacctccaagcgtggccaatgctgttgcgaccggagaagcccacacatatgagtccgaggtaaagctccgatgtctggagggctacaccatggatactgacacagatacctttacctgccagaaggacggccgttggttccctgagagaatctcgtgcagtccaaaaaaatgcccgctcccagagaatatcacccatattttggtgcacggtgacgatttctctgtaaacaggcaggtgtcagtttcttgtgcggaggggtacacatttgagggcgttaacataagcgtctgccagctagatggaacatgggagccacctttttccgacgagtcatgttcccccgtctcttgtggcaaacctgagagtcctgagcacggcttcgtggtgggcagcaaatacaccttcgagtcaacgattatttatcagtgcgaacccgggtatgagttagagggcaaccgcgagcgtgtgtgccaggagaatagacagtggagcgggggggtcgccatatgtaaagaaactcgatgcgagacccccctggagttcttgaacgggaaagctgatatcgagaaccgcacaacgggccctaatgttgtatattcttgcaatagaggatatagtcttgaggggccctccgaagctcattgtactgagaatggcacttggtcccacccagtaccattgtgcaagcccaatccatgccccgttcccttcgttattcctgagaatgctctgctatcagaaaaagaattctacgtggaccagaatgtgagtattaaatgcagggaggggtttcttctccaaggacacggtattatcacatgtaatcccgatgagacgtggacacagacttcagccaagtgtgagaaaattagctgcggccccccagcccacgtggagaacgccattgcacgtggcgttcattaccagtacggtgacatgattacctacagctgttactcggggtatatgctggagggatttctgaggagcgtctgcctggaaaatgggacctggacttcccctcccatatgcagggccgtgtgcaggttcccatgtcaaaatggcgggatctgtcagcggccgaacgcttgtagttgtcctgaaggatggatgggtcgactctgtgaggagcccatttgtattctgccctgcctcaatggtgggaggtgcgttgcaccttatcagtgcgattgcccccctggctggacaggcagccggtgccacacagctgtttgtcagtccccatgtctgaacggcggcaaatgcgtaaggccaaatagatgtcactgcttatcttcgtggaccggccacaattgttcccgtaagcgcagaacaggcttttag

SEQ ID NO: 207527 - DNA, 10716 bp, Artificial Sequence
  Description of Artificial Sequence: Synthetic coding sequence
atgtggccccggctggccttctgctgctggggcctggccctggtgtccggttgggctacttttcagcagatgtctccaagtagaaattttagtttccggcttttccccgaaaccgccccaggggcccccggcagcattcccgcgcccccagctccaggggatgaggccgccggatctagggtagagcggctcggacaggccttcaggcggcgggtgagactcctgcgcgaactcagcgagagactggagcttgtgttcctggttgatgactcttccagcgtgggggaagtgaatttcaggtcagagctcatgtttgtaaggaagctattgagtgattttcctgtggtacctaccgcaaccagggtggccatcgtgacattcagcagcaagaactacgtcgttcccagagtggattacatcagcaccagaagggctcgccaacataaatgtgcgctgctgctgcaggaaatccccgccatttcatacaggggcgggggcacatacaccaagggagcgtttcaacaggccgcccagattctgctccacgctagagaaaatagcaccaaggtagtgttcttaatcacagacggatattcaaacggtggtgacccacgtccaatcgcagcaagcctccgggactcgggagtcgagattttcacttttggcatctggcaaggtaatatcagggagttaaatgacatggcctccacacctaaggaggagcactgttatctcctccactcgttcgaggagttcgaggcattagccaggcgggcactgcatgaggatcttcccagcgggtcattcatacaagatgatatggtgcattgtagctatctgtgcgatgaagggaaggattgctgtgacagaatgggcagctgtaaatgtggcactcacactgggcatttcgagtgtatctgtgaaaaagggtattacggcaagggattgcagtatgaatgcaccgcatgtccgagtgggacatacaagcccgagggatctccagggggtattagcagttgtatcccgtgcccagacgagaaccacactagccctccagggtcaacttccccggaggactgcgtttgcagggagggttatagagcctctgggcagacttgcgagctggtccattgccccgcgctcaaaccccctgaaaacggatactttatccagaatacctgcaataaccacttcaacgccgcctgtggcgtgcgctgccaccctgggtttgatctagtcgggtcatctatcattttatgtctgcccaatggcctatggagtggctctgagagctactgccgagtaagaacatgtcctcacctgcgtcaaccaaagcacggtcacatcagttgctcgacccgcgagatgctgtataaaaccacctgcttagtagcctgtgatgagggctaccgactggagggaagtgataaactaacttgtcagggcaactcacagtgggatggcccagagccccgctgtgtggagcggcactgctccacattccaaatgcctaaagacgtgatcatatcccctcataattgcggaaaacaacccgctaaatttggaacaatctgctacgtttcatgcagacagggatttatcctgagtggtgtcaaagaaatgctgaggtgcaccacttccgggaagtggaatgtgggagtgcaggccgcagtgtgtaaggatgttgaagctcctcagataaactgccccaaagacattgaagccaagacactagagcagcaggatagcgcgaacgtgacctggcagataccaaccgctaaggataactccggagagaaagtatccgtgcacgttcacccagccttcacacctccctatttattccccattggcgatgtggctattgtttacactgccacggacctgagcggaaaccaggcctcatgtatctttcatattaaggtgatcgatgccgagccaccagtaatagattggtgccgttcgccacccccagtgcaggtgagcgaaaaggtacatgccgcctcctgggatgagccgcaattttctgacaatagcggcgccgagctcgtaattacacgttcccacacacagggggatttattcccgcagggcgagaccattgttcagtacactgccactgaccctagcggcaataacagaacatgcgacattcatatcgtgatcaaaggaagcccgtgcgagatccccttcacacccgttaacggcgacttcatctgtacaccagataacaccggagtaaactgtactctgacttgcctggaaggctatgacttcacagaaggctctacggacaagtattattgcgcatacgaggatggcgtgtggaagcccacgtacactacagaatggccagactgtgccaagaaacggttcgccaaccacggctttaaatcttttgagatgttctataaagccgcaaggtgtgacgacactgacctcatgaagaagttctcagaggcgtttgaaacaacactcggcaagatggtgccatcattctgctccgatgccgaagatatcgattgcaggctggaggagaatttgaccaaaaaatactgtttggagtataattatgactatgaaaacgggttcgctattgggccgggtggctggggcgccgccaaccgcctggactatagctatgacgatttcttagacaccgttcaggagactgcaacatcaattggaaatgccaaaagctctcgcattaagaggagtgcaccactttccgactacaagatcaaattgatttttaacatcacggcgtccgtccccctgcctgacgagcggaacgacaccctagagtgggaaaatcagcagagactcctgcagacattggagactatcaccaataagttgaagcgaacactgaataaagacccaatgtactctttccagctggcatcagaaattctcatcgcagatagtaatagtctggaaacgaagaaggcttcaccattttgccggccaggttccgtactgagagggcggatgtgcgtgaattgtccactaggaacttactacaatctcgagcacttcacatgtgaatcctgcaggattgggagctaccaggatgaagagggccagttagagtgtaagctgtgcccttccggcatgtatacagagtacatccactccagaaacatcagtgattgcaaggcgcagtgcaagcagggcacttacagttacagtgggctagaaacttgcgaaagctgtcccctcgggacctatcagcctaagtttggctcgcgttcttgtctgagttgccccgagaacacctcgactgtaaaaagaggagccgttaatatctcagcttgcggtgtgccatgtcccgagggtaagttcagtaggtcaggtctcatgccttgtcacccttgccctcgggattattaccagccaaacgcaggaaaggctttctgcctagcctgccctttttatggcaccaccccattcgctgggtcaagatcaatcacggagtgtagcagcttcagctctactttttctgccgccgaggagtcagtggtgcctccggccagtctcggccacatcaaaaaacgccacgagataagttcccaggtcttccacgaatgcttcttcaatccttgccacaattccggcacatgtcaacagctggggcgcggctatgtctgtttatgcccactggggtacacgggactaaagtgtgaaaccgatatcgacgagtgttcaccactaccctgtcttaataacggcgtatgcaaagatttggtgggtgaattcatttgcgagtgtcctagcgggtacaccggccagcgctgcgaggagaacattaacgagtgttcctcttcaccgtgccttaataaaggtatctgtgttgacggagtggccggataccgctgcacttgcgtaaaaggattcgtgggcctgcactgcgaaaccgaggtgaatgaatgccagtctaatccatgcctgaacaatgccgtgtgcgaggaccaggtgggtggattcctttgtaagtgcccccctgggttcctaggcacacgctgcggtaaaaacgtggatgagtgcctttcacagccctgtaagaatggggccacctgcaaagacggagcaaacagctttaggtgcctctgcgcggctggcttcaccggttcacactgcgagctcaacattaatgaatgccaatcaaatccctgcaggaatcaggccacctgtgtcgatgagttaaatagctattcttgtaaatgtcagcccgggttttccggaaagcggtgcgagacagaacagtccacgggtttcaatctggacttcgaggtgtctggcatctacggatatgtgatgctggatggtatgctgccatctctccacgcgctgacttgcacattctggatgaaaagcagtgacgacatgaactacgggacccctattagctacgccgttgataacgggtctgacaataccctcttgttaaccgattacaacggatgggtcttgtacgtgaacggcagggagaaaatcactaactgccctagtgtgaatgacgggcggtggcaccatatcgcaatcacatggactagcgccaacgggatttggaaggtctatattgacggaaaattgtctgacggtggcgctggcctgtccgtgggcttgcccatcccaggcggcggagctctcgttctgggtcaggaacaggataaaaagggagagggctttagtcctgccgagtccttcgtgggctcaattagtcagttgaacctgtgggattacgtgctgtcccctcagcaggtcaaatcactggccacctcctgtcctgaagaactgtccaaaggcaacgtactggcctggccagatttcctgtcgggcatcgttggaaaggtcaagatcgatagcaagagcatcttttgcagcgactgccctcggctcggcgggtctgtgccccacctgcgaactgcatctgaggatctaaagccaggtagtaaggtaaatctgttttgtgaccccggattccagctggtggggaacccagtccagtactgcctcaatcaagggcaatggacacagccgctgccgcactgcgagcggatctcctgtggcgtgcccccccctcttgaaaatgggttccactccgcggatgatttctacgctggctctacagtgacgtatcagtgcaacaatggatactatctgctcggagatagtaggatgttctgtaccgacaatggttcttggaatggagtctctccttcgtgtctcgacgttgacgagtgtgccgtggggtccgattgtagcgaacatgcatcctgtctgaacgtcgatggcagttacatttgcagttgcgttccgccttataccggagacgggaaaaattgcgccgagccaattaagtgcaaggcacccgggaaccccgagaatgggcactccagtggcgaaatatacaccgtgggagcggaggtgacattctcttgtcaggagggataccaactgatgggcgtgaccaaaattacatgtctcgaatccggagaatggaatcacctgataccttactgcaaggccgtgtcatgcggcaaacccgctattccggaaaacggttgcattgaggaactggcctttacattcgggagcaaagtgacatacaggtgtaacaaagggtatacattggccggcgataaagagagctcctgcctggcaaactcctcctggagtcattcgccacccgtttgtgagcccgtgaaatgctcctctccagaaaatataaataacgggaagtatattttgagtgggctgacgtacctgagtactgcctcttacagctgcgatacgggatattccctgcagggcccgtcaatcatagaatgtacggcttccggcatttgggatagggctccaccggcctgccacctggttttctgtggcgaaccccccgcaattaaggacgcagtgattacaggaaacaatttcacctttagaaataccgtcacctacacctgtaaagaaggttacactctggctgggctggacaccattgagtgtctggccgacggtaagtggagtcgctctgatcagcagtgtctggcggtgtcttgcgacgagccccccatagtggaccacgcatcaccggaaactgcccacaggctgttcggggatattgcattttactattgttcagacggatactccttagccgataattctcaactgctgtgcaatgcacagggcaaatgggtccctcctgagggacaggatatgcctaggtgcatagcccatttctgtgagaagcctccaagcgtgagctacagcattctggagtcagtctcaaaagccaagtttgccgccggctctgttgtgtcttttaaatgtatggaggggtttgtgctgaacacttccgctaagatagagtgcatgcgcgggggacaatggaaccccagccctatgtcaatccaatgcattccagtccgctgcggagagcccccctctataatgaacggatatgcatcaggaagcaactatagctttggcgctatggtcgcatactcatgcaacaagggcttttatataaagggggaaaagaaatccacgtgtgaagccacaggccagtggagttcgccaatccctacctgtcacccagtgtcctgtggggagccacccaaggtagaaaacggcttcttagagcacacaacaggcaggattttcgaatctgaggtgaggtatcagtgtaatcctggttacaagagtgtcgggtcccctgtatttgtgtgccaggctaataggcactggcattccgagtcacccctaatgtgtgtgccgctggactgcgggaaaccgccacccatacagaacggatttatgaagggggagaacttcgaggtgggaagcaaggtgcagttcttctgcaatgaggggtatgagctggtgggcgattcctcctggacctgtcagaagtctggaaaatggaacaaaaaaagcaatccgaagtgtatgcctgccaaatgtccggagccccctttgctggagaaccagttagtccttaaagagttaaccactgaggttggtgtggttacattttcgtgtaaggaagggcacgtgctgcagggaccaagtgtgctgaaatgtttgcctagccagcagtggaatgacagtttccccgtatgcaaaattgtgctgtgcacacctcctcctctgatatcctttggagttcctatcccatcttcagcgctgcactttggcagtaccgtcaagtactcttgcgtgggggggttttttcttcgcggaaattccacaactttgtgtcaacccgacggtacctggagcagtccactccccgagtgcgtgcccgttgagtgcccccagccagaggaaatccctaatggcattattgatgtgcagggactcgcgtacctctccaccgctctctacacctgcaaacccggttttgagctggtggggaataccacaacgctgtgcggggaaaacggtcactggctcgggggtaaaccaacatgcaaggcaatagagtgcctcaagccaaaggaaattttgaatgggaagttctcttataccgacttgcattacggccaaactgtgacttacagttgtaaccggggcttccggctcgaggggccatccgctctgacctgcctggaaaccggggattgggacgtggatgcgccgtcatgcaacgccattcattgtgattccccacagcctatcgaaaatggatttgtcgaaggggcagattactcctacggtgccatcataatctatagctgttttccaggctttcaggttgcgggccatgctatgcagacctgcgaagaatctggctggtcctcatcgatcccgacttgcatgcctatcgattgtggcctgcctcctcacatcgactttggcgactgtacaaagcttaaagatgatcagggatatttcgagcaggaggacgacatgatggaggttccctatgtgacacctcatccaccataccaccttggagcggtggccaaaacgtgggagaataccaaggaatccccggccacccacagctctaattttctctatggaacaatggtcagctacacatgcaacccgggatacgaactcctgggtaaccccgtcctcatatgtcaggaggatggaacctggaatgggtctgcacctagttgcatcagcatcgaatgcgacctgccaacagcccccgagaacgggttcctgcggtttactgagacttcaatgggatcagccgtgcagtactcatgtaaacccggacacatcttggcaggaagcgatcttcgactgtgcctggagaataggaagtggagcggggcttcaccaagatgcgaggccattagctgcaagaagcctaatccagtgatgaatggatccatcaaggggtcgaattacacctaccttagcacgttgtactacgagtgcgacccagggtatgtgttgaacggtacagagcgccggacctgtcaggatgacaaaaactgggatgaggacgagcccatctgtatcccagtggactgttcctccccaccagtgagtgcaaatgggcaggtgaggggggacgaatacactttccagaaggagatagagtacacttgcaatgagggatttctcctggagggagctcggtcccgtgtctgtctagctaatggctcctggtccggggcaactcctgactgtgtcccggtgagatgtgctacgcccccacagctcgctaacggcgtgactgagggtctggattacgggttcatgaaggaggtgactttccattgccacgagggctacatcctgcacggcgcccctaagttaacctgccagtccgatgggaactgggacgctgagattcctttgtgcaagcctgtcaattgcggcccacccgaagatctggcccatgggttccccaatggattctcatttatccatgggggccacattcagtatcagtgtttcccaggttataagcttcacgggaatagttcgcgtcggtgcctgagcaacggctcatggtccggaagtagcccctcctgcctgccttgtcggtgcagtacccccgttattgagtatggtaccgtaaatggaactgactttgactgtgggaaagctgcaagaatccagtgcttcaagggattcaagcttctgggtctatcagaaataacctgcgaagctgacggccagtggtcctctgggtttccgcattgtgaacacacatcatgcggtagtttaccaatgattccaaatgcatttatttctgaaacctcaagctggaaagaaaacgtaatcacgtattcttgccggtcaggctatgtgattcaggggagcagcgatctgatatgcactgagaagggcgtgtggtcgcaaccgtatcctgtttgtgaacccctgtcctgtggcagccctcctagtgtcgccaacgccgtggcaaccggtgaggcccacacctatgaatcagaagtcaaacttcgctgcttagaaggctatactatggacaccgataccgataccttcacctgccagaaagacggccggtggtttcccgaaaggattagctgcagccctaagaagtgtcccctgcctgagaatattacccacattctggtacacggcgacgatttttctgtgaatcggcaggtgagcgtctcatgtgcagaggggtatacgttcgagggagtaaacattagcgtgtgtcaattagacggcacctgggaacctcccttctctgacgagagttgctccccagtaagttgtggcaagcccgagagccccgagcacggattcgttgtgggatctaagtacacatttgagagcactatcatttatcagtgcgaaccaggttatgagctggaaggcaaccgcgagcgggtatgtcaggagaataggcagtggtctgggggggtggcgatttgcaaagaaacgcgatgcgagactccactggaatttctaaacggtaaagctgatatcgagaaccgaacaactggacctaatgtagtgtacagttgcaacagaggatacagcctcgagggtccttccgaggcgcattgcaccgagaatggcacctggtcacacccagtgcccctgtgcaagcccaacccatgccccgttccatttgtgattcccgagaatgcactgttgagcgaaaaggaattctacgtagatcaaaacgttagtattaaatgccgggaggggtttctcctccaaggccacgggataattacctgtaatccagacgagacctggacccagacatcggcaaagtgcgagaaaatttcatgcgggccccccgcccatgtggaaaacgcaatcgcgcgcggcgttcactaccagtatggggacatgatcacctattcttgctattcgggttacatgttggaagggtttctgcggtcagtatgtctcgagaatggaacatggacgtccccacctatttgtcgagccgtgtgtcgcttcccatgccagaatggcggtatttgtcagcgccccaatgcctgctcatgtcctgagggctggatgggtcgcttatgcgaggagccaatctgtatcttgccatgtctgaatggcggcagatgcgtggccccttatcaatgcgattgcccccccggttggactggctcgcgctgtcacacagccgtatgtcagtccccctgtctaaatggaggcaagtgcgtgagacctaaccgctgccactgcctgtcatcatggactgggcataactgcagccgtaagcggagaaccggcttttag

SEQ ID NO: 207528 - DNA, 1356 bp, Artificial Sequence
  Description of Artificial Sequence: Synthetic coding sequence
atggacttcgacgtgggccggaccacccacctgagcagcagcccctgctccgcctcgaatggcggagagtctggacaggtcagcaagcgccgatgtctgattggagagagcggccacgacacaccatggtgttcccctatcaaagtaaagtacggcgatgtttattgcagagccccacaaggcggttactacaagactgccctgggcaccagatgtgacattcgctgccagaagggatatgaattacacggttcttccctgctcatctgccagagcaacaaaaggtggtctgacaaggtgatttgcaagcagaaacgatgtccaactctggcaatgcccgcgaacggggggtttaaatgtgtggacggggcttatttcaactcccgttgcgagtactactgctcccccggatataccctgaaaggcgagcgcactgtgacctgcatggacaacaaggcttggagcggacgtccagcttcttgcgtggatatggaaccacccaggataaagtgcccatccgtgaaagaacgtattgctgaacctaacaagctgaccgtgagggtgagttgggaaaccccagaggggagggacacggccgacggcatcctgacggatgtgattctcaaaggtttaccgccagggtcaaatttccccgagggggatcacaagatccaatataccgtttatgatagagctgagaacaaaggcacgtgtaagttccgcgtaaaggtgagggtaaagcggtgtggcaaactgaacgcccccgagaatggctacatgaagtgctcctccgatggagataattacggggctacctgtgagttctcctgtatcggtggatacgaactccagggatcaccagcccgcgtgtgtcagtccaacctggcctggagtggaacagagccgacctgtgccgccatgaatgtgaatgttggagtaagaaccgcagctgcattgcttgaccagttttatgaaaaacgcaggttactgattgtgtctactccgacggcaagaaatcttttgtatcgtctgcagctggggatgttgcagcaagcacagtgcggcctcgacttgagacatattaccgtcgtagagctggttggtgtcttccctactctcattgggcggataggcgctaaaataatgcctcccgccctagctctccagctgcggttgctgttgagaataccgctgtacagcttctctatggttctcgtagataagcatggcatggataaggaacggtatgtgagtctggtcatgccggtcgctttgttcaacctgatcgatacttttcccctgagaaaagaagaaatggtgttacaggcagaaatgagccagacttgcaatacatag

SEQ ID NO: 207529 - DNA, 1395 bp, Artificial Sequence
  Description of Artificial Sequence: Synthetic coding sequence
atgggcagccccgcccaccggcccgccctgctgctgctgctgcccccactattgctgctgctcctccttagggtacccccatctagatctttcccagggagtggcgactcgccattggaggacgatgaagtgggatactcccacccgagatacaaggatactccttggtgttctcccattaaggttaaatacggagatgtatattgtcgggccccgcaaggtggctattacaagaccgcgttagggacaagatgcgacatcagatgccagaagggttatgaattgcacgggtcatccttactgatctgccagtccaacaaaagatggtcagataaagtaatctgcaaacagaaacggtgcccaactcttgctatgcccgccaacggggggttcaaatgcgtagacggagcctatttcaactcccggtgtgagtattactgtagccccggttataccttaaaaggcgagaggaccgttacgtgtatggacaataaggcttggtccggaaggccggcctcatgtgtggatatggaacctccccgcatcaaatgcccgagcgtcaaggaacgtatagcagagcccaacaagttgaccgtgcgcgtttcgtgggagacacctgaaggaagagatacagcggacggcatcctgacagacgtgatcctcaaaggcttaccgccaggatccaatttccctgaaggagaccataagatccagtacaccgtgtacgatagggccgaaaacaagggtacatgtaagtttcgggtaaaagtgagggtgaaacggtgcggaaaactcaacgccccagaaaatggctacatgaaatgcagtagcgacggggacaattacggtgcaacctgcgagttttcttgcatcgggggctatgaactgcagggctctcctgcgagggtctgccagtccaacctcgcatggtccgggaccgagcccacatgtgctgccatgaatgtgaacgtgggggttagaacagcggcggcactcttagatcagttttacgagaaacgtcgcctcctgatcgtcagcacgcccaccgcccggaacttgctgtaccggctgcagctgggcatgctgcaacaggcccagtgcggactcgacttgcggcatattacagtcgtcgaacttgtgggtgtgtttcccacgctcatcggacgcatcggtgcaaagattatgccaccagcactcgcacttcaattacggctcctgttacggatccctttgtatagcttctccatggtgctcgtggacaaacacggcatggacaaggagcggtatgtgtcactggttatgccagtcgcactgttcaatttgattgatacctttccacttcggaaggaagaaatggtgctccaagccgagatgtctcagacttgtaacacgtag

SEQ ID NO: 207530 - DNA, 1218 bp, Artificial Sequence
  Description of Artificial Sequence: Synthetic coding sequence
atgggcagccccgcccaccggcccgccctgctgctgctgctgccccccctgctcctcctgctgctgctccgtgtgcctccatctaggtcgttccctggctctggagattccccgctcgaagacgatgaggtgggctattcccaccctaggtacaaggatactccatggtgctcaccaattaaggtcaaatacggggatgtatactgcagggccccccaaggaggatactacaaaactgccctcggcacaagatgtgacatccgctgccagaaaggctatgaactgcatggctcctcccttctcatctgccagagtaacaagcgctggagcgacaaagtgatatgtaagcacatggagcctccacgcatcaagtgcccatcagtgaaagagcgcatcgcagaaccgaataagctcacggtccgagttagttgggaaacccccgaggggagagatacagcggatggcatcctaacagacgtcattctgaaaggactgccacccggaagcaacttcccagagggggaccacaagattcaatataccgtctatgatcgcgcagagaataagggtacatgcaagtttcgggtaaaggtcagggtgaaacgatgcgggaaactcaatgctcctgagaacggctacatgaaatgtagcagcgatggcgacaactatggagcgacctgcgaatttagttgtattggagggtatgaactgcagggctctccggcgcgcgtgtgccaaagtaaccttgcttggtctggcactgagcccacctgtgccgccatgaacgttaacgtgggcgtgagaactgcggctgcattactggatcagttttatgaaaaacggcgtctgctcatcgtatcgacccccactgcgagaaacctcctgtacaggctccaactgggcatgctgcagcaggctcagtgtggactagacctcagacatataacagtcgttgaactagttggggtgttccctaccctgattgggagaatcggcgctaaaatcatgcccccggctctagccctgcagttgagattactccttcggattcccctgtactccttctctatggtcctagtcgacaagcacggcatggacaaagaaagatatgtctctctggtcatgccggtggccctgtttaacctgatcgatacattccctctgcggaaagaggaaatggttctccaggccgagatgtcccaaacctgcaacacctag

SEQ ID NO: 207531 - DNA, 1140 bp, Artificial Sequence
  Description of Artificial Sequence: Synthetic coding sequence
atgggcagccccgcccaccggcccgccctgctgctgctgctgccccccctgctccttctgctcctgctacgggtacccccctccaggtccttccctggatccggcgatagccccctggaagacgatgaggtgggctattcacacccccgctataaggacaccccatggtgtagccctatcaaggttaaatacggagatgtgtactgcagggcaccccagggaggctactacaagactgccctgggaacacggtgtgatatcaggtgccagaaagggtatgaactacatgggagtagtcttctcatttgtcagagtaacaaaaggtggagcgacaaggtcatttgtaagcagaagcgatgccccacactggccatgcccgcgaacggtggatttaagtgcgtggatggagcatacttcaattcccgctgtgagtattactgttcgccagggtacactctgaagggtgaaagaacggtcacctgcatggataataaggcttggtctggtaggcccgcctcgtgcgtcgacatggaacctccacgcatcaaatgtccttcagtcaaggagaggattgccgaaccaaacaaactcaccgttagagtctcatgggaaacacccgaagggagagacaccgcagatggtattctgactgatgtgattctgaagggtcttccccccgggtctaacttcccggagggtgatcataagatacaatacaccgtctatgatcgggccgagaataagggcacctgcaaattccgtgttaaagttagagtgaaaagatgtggcaaactgaatgctccagagaacggatacatgaaatgcagtagtgatggggataattatggtgccacctgcgagtttagctgtattggcggttatgaactacaaggcagccctgcccgggtctgtcagagcaacctggcttggtccggcactgagccgacttgtgcagccatgaacgtgaatgttggggtacgaacagctgccgccctgctggaccagttttatgaaaagagacgcttgctgatcgtgagcacacccaccgcaagaaatctgctttaccgtctccagctgggtatgctccaggccgtcgccgctaatccaactttgctcctgcaatacggtgcgagcggctag

SEQ ID NO: 207532 - DNA, 1335 bp, Artificial Sequence
  Description of Artificial Sequence: Synthetic coding sequence
atgggcagccccgcccaccggcccgccctgctgctgctgctgccccccttacttttgctcctcctgctccgtgttcctccttcccgttcctttcccgatacgccctggtgttctccaataaaagtgaaatacggggacgtttactgccgcgccccccagggtgggtattacaaaaccgccttaggaaccagatgtgatataaggtgccaaaaaggctatgagctccatggttcttctttactgatttgccagagcaacaaacgttggtctgacaaagtgatttgcaagcagaaacgatgtcccactctcgctatgccagcgaacggcggctttaagtgtgtcgatggagcctatttcaactcgaggtgtgagtattattgctcccccgggtataccctcaagggagaacgcacagtgacctgtatggacaataaggcttggtctgggcgccctgcgtcttgtgtcgacatggagccacccaggatcaagtgccctagcgtgaaggaacggatcgccgaacccaataagcttacagtccgtgtgtcatgggagacaccggagggccgagacaccgccgatggcattttgaccgatgtcatcttaaaaggactcccaccagggagtaacttcccagagggagatcataaaattcagtataccgtttacgaccgggctgagaataagggcacatgtaagttcagagtgaaggtccgcgtgaaaagatgtggcaaactcaacgcgccggagaacggctatatgaaatgttcgagcgacggggacaattacggagccacctgcgagttctcgtgcataggagggtacgagctgcagggatcgcctgctagagtgtgccagtcaaacctggcttggagcggaaccgagccaacctgcgccgctatgaatgtgaacgtgggggtgcgtacagccgcagcgctgcttgaccagttctacgaaaagcgtcgcctgttgatagtgagtacaccgacagcccggaatctgctgtacagactccaactgggcatgctgcagcaggcccagtgtgggctggacctgcgacacattactgtcgtggagctggttggcgtcttcccaacactcatcggacgcatcggagccaaaattatgccaccagctctggccctgcagctccgcctgctgctgcgtatccccctgtattccttcagcatggtcctggtagacaaacacggcatggacaaggagcggtacgtcagcctggtaatgcccgtggcgctgtttaatctcatcgatacattccctctccgaaaagaggagatggtgcttcaggccgaaatgagccaaacttgcaatacgtag

SEQ ID NO: 207533 - DNA, 1398 bp, Artificial Sequence
  Description of Artificial Sequence: Synthetic coding sequence
atggccagccagctgacccagcggggcgccctgttcctgctgttctttctcacacccgcagtgaccccaacatggtatgccggcagcggctattacccggatgagagctataatgaggtctatgctgaggaggtacctcaagctcctgccctcgactaccgagttccgcggtggtgctacacactgaacatccaagatggagaggcgacatgctactcgcccaagggcggaaactaccatagctcccttggcaccagatgcgaactatcctgcgatcgaggatttaggctcatcggccggagatcagtgcagtgtctgccttctcgccggtggtcgggcacggcatactgtcgccagatgcgatgtcacgccctcccatttatcacctcaggaacatatacttgtactaacggcgtccttttagactccaggtgcgactacagctgcagcagcggctatcacctggaaggggaccggagccgtatctgtatggaggacggaagatggagcggcggggaaccagtgtgtgtggacatcgatccacccaagataaggtgtcctcactctcgggaaaaaatggcagagcccgagaaactgaccgcacgcgtatattgggaccctccacttgtcaaggactccgccgatggcacgatcaccagggttacgctcaggggacctgaaccagggagccatttccctgaaggggagcatgttatccgttacaccgcttacgatcgggcatacaaccgggccagctgcaagtttatcgtgaaggtgcaagtgcgccgatgtccaacgctgaaacctccgcagcatggatacctgacatgtaccagcgcaggtgataattatggcgcgacctgcgaataccactgcgacggagggtacgaccggcagggaacaccttcccgcgtttgtcagtcgagccgacagtggagcggtagtccccccatttgcgcccctatgaagattaacgtgaatgttaactccgccgccggactgctcgaccagttttacgagaagcagagactcctgataatatcagcacccgatcccagcaatcggtactacaagatgcagatatccatgcttcaacagagcacgtgcggacttgatctgcgccatgtgacaatcattgagttagtcgggcaacccccacaggaggtgggcaggatccgcgagcagcaactgagcgccaatattattgaagagttgcgacagttccaacgcctgaccaggagctactttaatatggtgctgatcgataaacaaggcatcgatagagacaggtacatggagcctgtgactcccgaagagatatttactttcatcgatgattacttactgtccaaccaagagctcactcagaggcgcgagcagagggatatatgtgaatag

SEQ ID NO: 207534 - DNA, 1452 bp, Artificial Sequence
  Description of Artificial Sequence: Synthetic coding sequence
tgaaccttcatggtggaggacgccgtggaggccatcggcttcggcaagttccagtggaagctgtccgtgttgaccggtttagcctggatggccgacgccatggagatgatgatactctctatcctggcgccccagctgcactgcgagtggaggctgccttcctggcaggtagccctgttaacttccgtcgtctttgtcggcatgatgtctagttccaccctgtggggaaacatctcggaccagtacggcaggaagaccggcctgaagataagtgtgctatggacgctttattatgggatcctcagcgctttcgctcctgtctacagttggatactggtcctccgcgggctggtcggctttggcattggtggggttccccaaagcgtgaccctgtacgccgaatttcttccgatgaaggcccgcgcaaaatgtatactccttatcgaagtgttctgggcgattggaaccgtgttcgaggttgtactggcagtgttcgtgatgccgagtctagggtggagatggctgcttatactgagtgctgtgcctttactgcttttcgctgtgctgtgtttctggttaccagaatcagcaagatatgacgttctgtctggaaatcaggaaaaagctatagccacccttaaacgcatcgccactgagaacggagcccccatgccccttgggaagctgatcatcagccgccaagaggacaggggaaagatgcgcgatctattcactccccacttcaggtggaccacattactgctgtggttcatttggttcagcaacgccttcagctattacggcctagtgctgctgactacagagcttttccaggccggcgatgtatgcggaatctcctcaaggaagaaggccgtggaggccaagtgctctttggcgtgcgaatatctatccgaggaagattacatggaccttctgtggacgactctgagcgaatttcccggagtgcttgtcactctgtggataatagatcgactgggacggaagaaaaccatggccctttgctttgtcatcttttctttttgcagtctgttgctgtttatctgtgtgggccgcaacgtcctaaccctccttctttttatcgcccgggcctttatctccggaggatttcaagctgcctacgtgtacacacctgaagtgtaccccacagcaacccgggctctaggactgggcacatgctccggcatggcccgggtgggcgcgctgattacaccgttcattgcccaggttatgctcgagagctctgtttatttaactctggccgtgtactctgggtgttgcttgctggccgcattggcaagttgttttctgccaattgaaactaaagggcgtgggttacaggagagttctcaccgcgagtggggacaggaaatggttggaaggggaatgcacggcgctggggtgacaagaagtaactctggtagccaggagtag

SEQ ID NO: 207535 - DNA, 39 bp, Artificial Sequence
  Description of Artificial Sequence: Synthetic coding sequence
atggaggaggacctgttccagctgcggcagctgccctag

SEQ ID NO: 207536 - DNA, 1023 bp, Artificial Sequence
  Description of Artificial Sequence: Synthetic coding sequence
atggccgccggccggctgatcatcaagaccgagttcctgcccaccaagtatagaggctatatgctgccactgtcccaggtgttttggttggctggctctcttttgattattggcctggccagtgtcatcattccaaccattggttggagatggcttatcagagtggcctctattcctggcatcatactgatcgttgcatttaagtttattcccgaaagtgcccgattcaacgtctctacaggaaatacacgcgcggccctcgccacccttgagcgggtagcaaagatgaaccgcagcgtgatgcctgagggcaagctcgtggagccagtgctggagaagagggggcgctttgccgacctcctggacgctaaatacctcaggacaaccttacaaatttgggtaatctggcttggcatttccttcgcctactacggcgttattctggccagtgctgaacttctggagcgggatttagtctgtggtagcaagagtgattcagccgtggttgtgacgggcggggactcaggcgagagtcagagtccttgctattgccatatgtttgctccctccgactatcgtacaatgattatttccacaatcggggagatagctctcaatcccttgaatatcctagggatcaacttcctggggaggcgactgagcctaagcatcacaatgggatgtaccgcgctcttctttctcctgctgaatatctgtactagctccgctggactcatcggctttctgtttatgctgcgggccctggtggccgcaaatttcaataccgtgtatatatacaccgctgaagtgtatccaaccaccatgagggccctgggtatggggaccagcgggtcgttatgccggatcggcgccatggtggcccctttcattagccaagtgcttatgtctgcatccatactcggagctctttgcttattcagcagcgtgtgcgtggtctgtgccatcagcgcgttcacactcccaatcgagacaaaggggcgggccttgcagcagattaaatag

SEQ ID NO: 207537 - DNA, 1479 bp, Artificial Sequence
  Description of Artificial Sequence: Synthetic coding sequence
atggccaccaagcccaccgagcccgtgaccatcctgagcctgcggaaattgtcgttaggtacagccgagccacaggtaaaagagcctaagaccttcacagtggaggatgcggtcgaaacaattggcttcggacgttttcatatagctcttttcttaatcatgggtagtacaggcgttgtcgaggccatggaaattatgctgatcgccgtcgttagccctgttatccggtgtgagtggcagctggaaaattggcaagtcgcactggtgacaacaatggtgttttttggttacatggtgttctccatcctgtttggacttcttgccgacaggtacgggcggtggaaaatccttctaatatccttcctgtggggcgcatatttctcactgctgacgagcttcgccccatcttatatctggtttgtgtttttacgcacgatggtcggatgcggagtgagtgggcactctcagggacttattattaagactgagttcctcccaacgaaatacaggggctatatgctacccttgtctcaggtcttctggcttgctggctcacttctaattattggcctggcctctgtgatcatccctactatcgggtggagatggctcattcgcgtagcctccatacctggcatcattttgattgttgcctttaaatttatcccagagtctgcgcgatttaacgtgagcactgggaacacccgtgccgccctagctactctcgagcgggttgctaagatgaatcggtcagtcatgccagaaggtaagcttgtggagcctgtgttggaaaagcggggtaggtttgctgacctcctggacgcgaagtatctgcggaccactctgcagatatgggtgatttggttgggcattagtttcgcttactacggcgtcatccttgcctccgctgaactgctggaacgggatctcgtttgtgggagcaagagcgactcagccgtcgtggtgaccgggggagactcgggagaatctcagagtccctgttattgtcatatgttcgctccttctgactacaggacgatgatcataagtaccattggcgaaattgccctcaatcctctgaacatcctgggcattaactttcttggtagaagactctccctgtcaattaccatgggctgcacagctcttttctttttacttctgaatatttgtaccagctcagcgggactgatcgggtttctgttcatgctcagagctttagtggccgcaaatttcaacacagtgtacatttacaccgcagaggtatatcccaccaccatgcgcgctctggggatggggacatccggttctttgtgccgcatcggagccatggtcgcacccttcatatctcaagtgcttatgagcgcctctatcctgggcgcactttgcctgttctcatcagtgtgtgtggtttgcgcaatcagtgccttcaccctcccgattgaaacgaagggtcgagctctgcagcagatcaaatag

SEQ ID NO: 207538 - DNA, 1023 bp, Artificial Sequence
  Description of Artificial Sequence: Synthetic coding sequence
atggccgccggccggctgatcatcaagaccgagttcctgcccaccaagtacaggggatatatgcttcccttgtcccaggttttctggctggccgggtccctgttaattatcggtcttgcctctgtgattatccccacaatagggtggagatggcttatacgggtggcctctattcccggcataattctgatagtagcttttaaattcataccagagtccgctcgtttcaatgtcagcactgggaatacaagggccgctctggccaccctcgagcgagtggcaaagatgaatagatcagtgatgcccgagggaaagctggtcgaaccagtgctggaaaagcgaggcaggtttgcagacctgttggatgccaagtacctgagaaccacactgcagatttgggtcatttggctgggtatttcttttgcctactacggtgtcattctcgcctctgcagaactgctggaacgagatctggtgtgcgggagcaagtccgattcagcagttgtggtgacaggcggggactccggtgaaagtcagtcgccctgctactgccacatgttcgctccgtctgattaccgaactatgatcattagtaccatcggcgaaatcgccctgaacccgcttaacatactcggcatcaactttctcggccgcaggctgtctctgagcatcaccatggggtgcaccgcccttttttttctgctcctaaacatttgcacctcttccgccgggcttatcggttttctattcatgctgagagctctggtagccgctaacttcaataccgtttatatttacactgccgaggtctaccccaccacaatgagagctctgggaatgggcacttccggttctctatgccgcataggtgccatggtggcgccctttatcagccaggttctgatgtctgcatcgatcctgggtgcactctgtcttttcagcagtgtctgcgtcgtctgcgccatctccgcattcaccctgcccatcgagacaaaggggcgagccctgcagcagataaaatag

SEQ ID NO: 207539 - DNA, 1758 bp, Artificial Sequence
  Description of Artificial Sequence: Synthetic coding sequence
atgggcagcctgaaggaggagctgctgaaggccatctggcacgcctttaccgcactggaccaggatcattccggaaaggtgtccaagagccagcttaaagtcctgtcacataacctgtgtacagttttgaaggtaccccacgaccctgttgccctggaggaacacttccgagacgatgacgaagggccggtgagcaatcaggggtatatgccctatttgaatcgatttattttggagaaagtgcaggataactttgacaaaattgaattcaataggatgtgctggactttgtgcgttaagaaaaacttaacgaagaacccattactcataaccgaggaggatgcattcaagatttgggtgatttttaactttctgtcagaggacaagtaccctcttatcatcgtgtcggaagagatcgagtacctcctgaagaagctgacagaggcgatgggcggaggctggcagcaggaacagtttgagcattacaaaattaattttgacgatagtaagaatgggctttcagcttgggaacttatagagctgattggtaacgggcagttcagtaagggaatggatcgccaaactgtgtccatggcgattaacgaagtgttcaatgagctgatcttagatgtacttaagcagggctatatgatgaaaaaagggcatcgaagaaagaactggaccgaaaggtggtttgttctaaagcctaacatcatttcctactatgtgagcgaggacctgaaagacaagaagggtgacatactactagatgagaattgctgcgtggaatctttgccagacaaggatggtaagaaatgtctgtttctggtgaagtgctttgacaagacattcgagatttctgcttccgataaaaagaagaaacaggaatggatccaggctatccattcaaccattcatctgctgaagctcggatctcccccaccacacaaggaggcccgacagaggcgcaaagagcttcggaagaaacagctggccgagcaggaggaactggaacggcagatgaaggaactccaggccgcaaacgaatcaaaacagcaggagctggaggccgtgcgaaagaaactcgaggaggccgctagcagggcggccgaagaggaaaagaagcggcttcagactcaggtggaactccaagcaaggttctccacggaattggagcgggagaaacttattcggcagcagatggaggagcaagttgcccagaaatcatccgagttggagcagtatctgcagcgggtccgggaactggaagatatgtacctcaagcttcaggaagcgctggaagatgaacggcaagcacgccaggacgaagagacggtccgcaagctccaggcgcgactgctggaggaagaaagcagcaagcgtgctgagctggagaagtggcatctcgaacaacagcaggccattcagaccacagaggcagaaaagcaggagctggagaatcagcgagtgctgaaagagcaagcgctccaagaagccatggagcaacttgaacagctggaattggagaggaagcaggcccttgagcagtacgaggaggtcaaaaaaaaactcgaaatggctacgaacaagactaagagttggaaagacaaggtggcccaccatgagggtctgatcagactgattgaaccagggtcaaagaaccctcacctgattactaactggggcccagcagcttttacggaagcagagcttgaggagcgcgagaaaaactggaaggaaaaaaagacaacggagtag

SEQ ID NO: 207540 - DNA, 3129 bp, Artificial Sequence
  Description of Artificial Sequence: Synthetic coding sequence
atggagcaggacaccgccgccgtggccgccaccgtggccgccgccgacgctacagccacaattgtggtcatagaagatgagcagccaggaccaagcacttcacaagaagaaggcgcagcagcagccgctaccgaagccaccgccgctacagagaagggtgagaagaaaaaagagaagaacgtgtcaagcttccagctcaagctagccgcaaaggcaccaaagtccgagaaggagatggatcctgagtacgaagagaagatgaaggctgaccgtgctaagcgtttcgaattcctcttgaaacagactgagcttttcgctcacttcattcagccatcagcccagaagagcccaacctcccccctgaacatgaaactgggaagaccacgaatcaaaaaggatgaaaagcagtccctgatttcagccggcgactaccgacacagacgtacggagcaggaggaagacgaagagcttttatctgaatccaggaagacatcgaatgtgtgcatcagatttgaggtgtccccgtcctacgtgaagggcgggcctctacgggactaccaaatccgcggactgaactggctaatttcgttgtatgagaacggagtcaacggaattctcgcagatgagatggggctgggtaaaaccctacagacgattgccttgctgggctatctgaaacactatcgaaacattccaggcccccatatggttctggtgcctaaatccacacttcataactggatgaatgagttcaagaggtgggtaccttcgctccgggtgatatgtttcgttggggacaaagacgctcgcgccgcttttatccgggacgaaatgatgcccggtgagtgggacgtatgcgtgacctcctatgagatggtgatcaaggagaagtccgtgtttaagaagttccattggcgttacctggtgatagacgaggctcatcggataaagaatgaaaaatctaaactctcagaaatagttcgggaatttaaatctactaacaggcttcttctgaccggaacacccttgcagaataatctccatgaattgtgggccctgctgaactttctcctgccagacgtgttcaattccgccgatgacttcgattcatggttcgatactaaaaactgtctgggggatcagaagttggtggagcgcctccatgctgttctgaagccattcctgttgcggcgcattaaaacagacgtcgagaaatcactgcccccaaagaaggaaattaagatctatcttgggctgagcaaaatgcagcgggagtggtatacaaaaatcctgatgaaagatatagatgtgttaaactcctccgggaaaatggacaagatgaggcttctgaacatccttatgcagttgaggaagtgctgcaaccacccctatctgtttgacggtgctgagccagggcccccctatacaaccgatgaacacattgtgtccaattccggcaagatggtggtgctggacaaattactcgctaaactcaaggaacagggcagtcgagtcctgattttctcccaaatgactcgactgctagatatcctggaagactattgtatgtggcgtggatacgaatattgccgtctggacgggcagaccccccacgaggagcgcgaagaggccattgaggctttcaacgcccccaactcttctaaattcatcttcatgctgtccacaagagcaggggggctgggtatcaacctcgcgtcggcagatgtcgttattctatacgattcagattggaaccctcaagtcgacctccaggccatggaccgagcccatcggatcggtcagaaaaaaccagtccgagtcttccgattgattacggacaataccgttgaggaaagaatagtggaaagagccgaaatcaaattacgcctggactccatcgtgatccaacaaggcaggcttattgaccagcagtcaaacaagctcgccaaagaagagatgcttcagatgattaggcatggcgccacacacgtgtttgcctcaaaggaatctgagcttaccgatgaggatatcacaactatcctggagcgcggtgagaagaaaacagcagagatgaacgagcggttacaaaagatgggggaatccagtttacgcaatttccgaatggacattgagcaatccctgtacaagttcgaaggggaagactatcgggagaaacaaaaactcggcatggtcgaatggatcgaacctcccaaacgggagagaaaagctaattacgccgtcgacgcatactttcgtgaagccctgagggtgtcagaaccgaaaatacccaaggcccctcgtccaccaaagcagccaaacgtgcaggactttcagttcttcccacccagactatttgagctcctggaaaaggaaattctctattaccggaaaacaatcggttacaaggtgcctcggaatcctgatattccaaatccggcgctcgcccaacgcgaggaacagaaaaaaatagatggagctgaaccactgacaccagaagagacagaagagaaggaaaagcttctaacccaagggttcaccaactggacaaagcgagatttcaatcaatttattaaagcgaacgaaaagtatggccgggacgacatcgacaacattgcccgggaggtggagggaaaaagcccggaagaggtcatggagtacagcgccgttttctgggagcgctgcaatgagctgcaagatatagagaagataatggcccagattgagagaggtgaagctaggatccagcgacggatttctattaagaaggccttggacgcaaaaatagcacgctacaaggcgcccttccaccagctgaggattcagtatggaaccagcaagggtaagaattatacagaagaagaggataggtttctcatctgtatgctgcacaagatgggatttgaccgagagaatgtatatgaggagttgagacagtgcgtccggaatgctcctcagttccgattcgactggttcattaaatcaagaactgccatggagttccagcgccgatgtaatacattaatctctttgattgagaaagagaatatggagattgaggaacgcgagcgagccgagaagaagaaacgggccacgaagacacccatggtgaagttcagtgccttttcgtag

SEQ ID NO: 207541 - DNA, 3165 bp, Artificial Sequence
  Description of Artificial Sequence: Synthetic coding sequence
atggagcaggacaccgccgccgtggccgccaccgtggccgccgccgacgcaacggctacgatcgtggtgatagaagacgagcagcccggcccttctacatcacaggaggaaggtgccgctgccgccgctacagaggccacagccgctactgaaaagggcgagaagaagaaggaaaaaaatgtgagcagtttccagcttaagctagctgctaaagctccaaagagcgaaaaggagatggaccctgagtacgaagagaaaatgaaagcagacagagccaagagattcgagttcttgctgaagcagaccgagctgttcgctcactttattcagccctccgcccagaagtcaccaacctcacctttgaatatgaaactgggcagacctaggattaaaaaggacgagaagcagtcactgatcagcgccggtgactacaggcaccgccgcacagagcaagaggaagacgaggaactcttgagcgagtccagaaaaactagcaacgtgtgcatccggttcgaggtctccccaagctatgtcaaagggggcccgctgcgggactaccagatccggggcctgaactggcttatcagcctgtatgaaaacggcgtcaatggcatcctggccgacgagatgggcctgggaaagacccttcagacaatagctctgttgggctaccttaagcattatcggaacatccccggccctcacatggtgctcgttccaaagtctaccctgcataattggatgaatgagtttaaacgctgggtgccaagcttacgtgtcatatgcttcgtcggggacaaggatgccagagcagcttttatccgggacgagatgatgcccggggaatgggacgtgtgcgtgaccagttacgaaatggttataaaggaaaagagcgtgttcaagaagtttcactggcggtacttagttattgatgaggcccatcgcatcaaaaacgagaaaagcaagctcagcgaaatcgtccgggagtttaagtcaacaaatcgtttgttgctgaccggtactcccctccagaacaacctccacgagctgtgggccctcctgaactttctgctgccggacgtttttaatagtgctgatgacttcgactcttggtttgacactaagaattgtttaggtgatcagaaattagtcgaacggttacatgcagtcctaaagccattcttgctgaggcgaattaagactgacgttgagaaaagtcttccacccaagaaggagattaaaatttaccttggactcagcaagatgcagcgcgaatggtatacaaagattttaatgaaagacatcgacgtgctgaattccagcggaaagatggacaaaatgcgcttacttaacattctcatgcaactcagaaaatgctgtaaccatccctatctgtttgacggcgctgaacctgggcctccgtatactactgacgaacatatcgtgtccaattctggcaagatggtggtgcttgataagctgttggcaaaactcaaggagcagggctcacgggttttaattttcagtcagatgacgcggctgctcgatatactcgaggactattgtatgtggagggggtacgagtactgcagactggacggacagaccccgcatgaggagcgggaagacaagttcctggaagtggaatttctaggacagagagaagcgattgaggcttttaacgccccaaactcttccaagttcatttttatgctctcaacaagggctggtggactgggcataaacctggcttccgccgacgtggttattctttatgactcagattggaatccgcaagtggacctgcaggctatggaccgggcccaccgtatcggacagaaaaaaccagtgcgggtctttaggttgattactgataacaccgtggaagaacgtatcgtggagagagctgaaatcaagttgcgactcgactccatagtgattcaacagggcagactgatcgatcagcagtctaacaagcttgccaaggaggaaatgctccagatgatccgccacggtgccactcatgtgttcgcatccaaagagtccgagctaaccgacgaggacatcactacaatcttagaaagaggagagaaaaagactgccgagatgaatgagaggcttcagaagatgggggaatcctctcttcgcaacttcaggatggacattgagcaaagcctttataagtttgagggagaggattaccgcgaaaagcagaaactcggcatggttgagtggatcgaacccccaaagcgggagcgcaaggcaaattatgccgtggatgcctactttagagaggccttgcgggtcagtgagccaaagattcctaaggcccctaggcctcccaagcagcccaacgtgcaggatttccagtttttcccaccccgtctcttcgaactattagaaaaagagattttgtattaccgaaaaaccatcggctataaggttcccaggaaccccgatatccccaaccccgcactagcacaaagagaggagcagaagaaaatagacggcgcggaacctctaactcccgaggaaactgaagagaaggagaaactgctgacccagggctttaccaattggacgaaacgcgactttaatcagtttatcaaagcaaatgagaagtacggcagagacgacatagacaacatagctagggaggtcgagggcaagagtcccgaagaagttatggaatatagcgccgtgttctgggagagatgcaacgaacttcaggatatagagaaaattatggcacaaatcgaaaggggagaagcaagaattcagagaaggatcagcatcaaaaaggctctggacgctaagatcgcccgctacaaagccccctttcaccagttgagaatccagtatggcacttctaagggaaagaactacaccgaggaagaggaccggttcttaatctgcatgttgcacaagatgggcttcgacagagaaaacgtgtatgaggagctgagacaatgcgttagaaacgcaccacagtttcggtttgactggttcataaagagccgcacagctatggagtttcagcgccgctgtaatacactgattagcttaatcgaaaaggaaaatatggaaattgaggagagggaaagagccgagaagaagaagcgtgctaccaagacacccatggtgaagttctcggcctttagctag

SEQ ID NO: 207542 - DNA, 3129 bp, Artificial Sequence
  Description of Artificial Sequence: Synthetic coding sequence
atggagcaggacaccgccgccgtggccgccaccgtggccgccgccgatgcaacagccactatagtggttatagaggatgaacagcctggaccatcaacaagtcaggaggaaggtgccgctgccgcggcaaccgaggcgacagccgcaacagagaagggagagaagaaaaaggaaaagaatgtatcctcttttcagctgaaactcgccgcaaaggctcccaagtctgaaaaggagatggaccccgaatatgaggagaaaatgaaggctgatcgagctaagagattcgagttcctgctcaaacaaaccgaattattcgctcatttcatccagccttccgcccaaaaatctcctactagtccactcaacatgaagctcggacgcccccgcataaagaaggatgagaaacaaagcctgatctcagctggtgactaccgacacagacgtacagaacaggaagaggacgaggaactattgagcgagtcccggaaaactagcaacgtgtgcatcaggttcgaggtgtctccgagttatgtgaagggcggaccgctgagggactaccaaattcgcggcctgaactggctaatctcactttatgagaacggggtgaacggaatcctcgcagatgaaatgggtcttgggaagactttgcaaacaatcgccttgctggggtacctaaagcattaccgcaacattccaggaccccacatggttcttgtcccgaagtcaaccctccacaactggatgaatgagtttaagagatgggtgccaagcctgcgcgttatctgcttcgtgggagacaaggacgcccgggccgctttcatccgcgatgagatgatgccaggcgaatgggacgtctgtgtgacctcctacgagatggtgatcaaagaaaagtcagtgttcaagaagtttcactggcgctatttggtgatcgatgaagcccaccggatcaaaaatgaaaaaagtaagctctctgagatagtgcgggagttcaaatccaccaaccgcctgctgttaacaggaacgcccctacaaaacaatctgcacgaattatgggctttgctgaatttcctgctccctgatgtattcaacagcgccgacgatttcgattcctggtttgataccaaaaattgcctgggggaccagaaacttgtggagaggcttcatgctgtgcttaagccttttctgttgaggcggatcaaaacagatgtggagaagtcgctacccccaaagaaagaaattaagatctatctaggtctttctaagatgcagagagagtggtacacaaagatcttaatgaaggacatcgatgtgctgaattcttctggcaagatggataaaatgcgactccttaatattctgatgcagctgaggaagtgttgtaaccacccgtatttgtttgatggggcagaacccggtcccccctacacaacagacgagcatatagtcagcaattctggcaaaatggtcgttctggataagctgctcgcaaaactgaaagaacagggttcacgggtgctcatttttagccagatgacccgcctgctggacattctggaggactactgcatgtggcggggatacgagtactgcaggctggacgggcagacccctcacgaggagcgcgaggaagccattgaagcatttaacgctcctaacagttccaaattcatatttatgctctcaacccgggcaggcggactgggtataaatctcgcctccgcagacgtcgttatcctgtatgacagtgactggaaccctcaggtcgatctgcaggcaatggatcgagcccacagaatcggacagaagaagcctgtgcgggtttttcggttaattaccgataacaccgttgaggagagaatagttgagagagcggagattaagttgaggttagacagcatagtgatccaacaagggcggctgatcgaccagcaatcaaataaacttgctaaggaggagatgttacagatgattaggcatggggcaacacatgttttcgcatcaaaggaatccgaactgacagatgaggatatcaccacgatcctcgaacggggtgaaaagaaaaccgccgagatgaatgaaaggttacagaaaatgggggaaagctcactgagaaattttaggatggacattgaacaaagcctgtacaagttcgagggtgaggattacagggagaagcagaaactgggtatggtggagtggattgagccgcctaagcgcgaacggaaggctaactatgctgtggatgcctactttagggaagcccttcgagttagcgagcccaagataccaaaggctccacgccctcccaagcaacctaacgtgcaggatttccagttttttccgccccgtcttttcgaactgttggagaaggagattttatattataggaagacgatcggatataaggtcccacgaaatcctgatatccccaaccctgcacttgcccaaagagaagagcaaaaaaaaatcgacggcgccgagccacttacccccgaagagactgaagagaaagagaaactactgacccaggggttcaccaattggacaaagagggactttaaccaatttattaaagccaacgagaaatatggccgggatgacatcgataacatcgcgagggaagtggagggcaagagccccgaggaggtgatggagtacagcgcggtcttttgggaaagatgtaacgaactgcaggacatcgagaaaatcatggcacaaattgagcggggtgaggctcgaatccagcgccggatcagcatcaaaaaggctctagatgcaaaaattgctcggtacaaagcacccttccaccagctgcgcattcagtatgggacctctaaaggtaaaaactataccgaagaggaagatagattcctgatttgtatgctgcacaagatgggattcgacagagagaacgtgtacgaggagctgcggcaatgcgtgagaaacgccccacagtttcggttcgactggttcatcaagtcccgaactgcaatggaattccagcgccggtgcaacacacttatcagcctgatagagaaggaaaacatggagatcgaggaacgggagagggccgagaagaagaagagagcaaccaagaccccaatggtgaagtttagcgccttctcatag

SEQ ID NO: 207543 - DNA, 3018 bp, Artificial Sequence
  Description of Artificial Sequence: Synthetic coding sequence
atggagcaggacaccgccgccgtggccgccaccgtggccgccgccgacgccaccgcaacgatcgttgtgatagaagatgagcaacctggtccttccactagccaggaagaaaaaaatgtctcatccttccaactcaagctcgcggcaaaggcccccaaatcagaaaaagagatggatcctgagtatgaagaaaaaatgaaggccgaccgagccaagcggttcgagttcctactgaaacagacagagctgtttgctcacttcattcagccttccgctcagaagagcccgacgtcacccctcaatatgaagctgggacggccgcgaattaaaaaggacgagaagcagagcctcatctcagctggtgactacagacatagacgcactgagcaggaagaggacgaggaacttctgtctgagtcacgaaagaccagtaatgtgtgtatccggtttgaagtatctccatcttacgtgaaggggggccctcttagagactatcagatcaggggcctcaactggcttatttcattgtatgaaaacggggttaatggcatcctcgcagatgaaatgggtttggggaaaacccttcagacaattgctctcttaggctaccttaagcactatcgcaatattccagggccccacatggtgcttgtgcctaagagcacgttacacaactggatgaatgaatttaagagatgggtgccatctcttcgtgtgatctgcttcgttggggataaggatgcaagagccgcctttattcgggatgagatgatgccaggtgagtgggacgtttgcgttacctcatacgagatggttatcaaggagaagtccgtttttaagaagttccactggcggtatctggtgatcgacgaagcccaccgcatcaaaaacgagaaaagtaaactttctgagattgtgcgagaattcaagtctaccaaccgacttctactcacgggcactcccctgcagaataacctgcacgagttgtgggccctgctgaatttcctcctccctgatgtatttaattcagccgatgatttcgactcgtggtttgacactaagaattgtctaggggaccagaaattagttgaacggctgcacgctgtcttgaagcccttcttgctccgccgtatcaagacagacgtggagaagtccttacctcctaagaaagagatcaaaatttatctgggactgtcaaaaatgcagagggagtggtacacaaagattctgatgaaggacatcgatgtactaaatagcagcgggaaaatggacaaaatgcgtctgcttaacattttgatgcagcttcgtaaatgttgcaaccacccctacctctttgacggggccgagcctgggcctccttacacgaccgacgaacatattgtgagcaacagcggcaaaatggtggtgttagacaagctcctggccaagctaaaagaacagggcagtagagtactcattttttctcagatgacacgcctgcttgacatccttgaggattattgcatgtggcgcggctatgagtactgcagattggatggccagaccccgcatgaagaaagggaggataagtttttagaggtggagtttcttggccaacgggaagcgatcgaggccttcaatgcaccgaactcttcaaaattcatattcatgctgtccactcgagccggtggccttggcatcaatctggccagtgccgatgtggtaattctatacgactctgactggaatccccaggtagacttgcaagcaatggaccgcgcacatagaatcgggcagaaaaaacccgtcagggtcttcaggcttatcactgacaacacagtcgaagaacgtattgtggagcgggccgaaattaagctacgtctagactcgattgtgatccagcagggcaggttgatcgatcagcagagcaataaactggcgaaggaggaaatgttgcaaatgataaggcatggtgctacccatgtcttcgccagtaaggagtccgagctgaccgacgaggacattacaacgatcttggagcgtggggagaaaaagaccgcggagatgaacgaacgactgcagaaaatgggtgagagttctctgcgaaactttagaatggatattgaacagagcctctataagttcgagggcgaggactacagagagaaacagaaactggggatggtcgaatggatagagccccccaaaagggagaggaaggcaaattacgccgtggacgcatatttccgagaggcactccgggtgtccgagcccaagatcccaaaagcccctagaccccctaaacagccaaacgtccaggactttcaatttttcccccctcgattatttgaactactcgagaaggaaatcctgtactatcgcaaaaccattggctataaagttccaaggaacccagacatacccaatcccgctttagcgcagagagaggagcagaagaagattgacggcgccgagcctctcacacccgaggaaaccgaggagaaagaaaagctgctcacccaaggattcacaaactggaccaagagagactttaatcagttcatcaaggctaatgaaaaatacggacgggacgatatcgacaatatagcccgggaggtagaggggaagtcacctgaggaagtgatggagtactccgcagtgttctgggaacgctgtaatgaactccaggacatcgaaaaaataatggcccagatcgagcgcggagaagctaggatccagcggagaatatcaatcaaaaaagcactggacgccaaaatcgcccggtacaaagcacccttccatcagttgcgtatacagtatgggacatcgaagggcaaaaactacacagaagaggaagaccgctttctgatctgcatgttgcataaaatgggtttcgatcgggagaacgtgtatgaagagctccgccagtgtgtgaggaatgcaccccagttccgcttcgactggtttatcaaatctcggacagccatggagtttcagcggcgctgtaacacgctgataagccttattgagaaggagtag

SEQ ID NO: 207544 - DNA, 837 bp, Artificial Sequence
  Description of Artificial Sequence: Synthetic coding sequence
atgctgatgaagcggctggccgcccggtgcttcgccggcctgctgatcctgtcccccctgacagtcataagcgacagcagacctgccgatagtggcaaagcaattgaagacggaaatcttgaagagatggaagaggaagtccgccttaagaagcgtaaacgacgccgcaacgtggataaagatcctgccaaggaagacgtcgaaaaagctaaaaaaaggagaggacgcccacccgccgagaagctgtctccgaatcccccaaaactcacgaaacaaatgaatgccattatcgacacagtcatcaactataaggactcatctggaagacagctcagcgaggtttttatccaactgccatctagaaaagagcttccggaatactatgaactcattaggaaaccagtggacttcaaaaagataaaagagaggattagaaatcacaagtacaggtctttaggcgatctagagaaggatgtaatgctgctttgccataatgcgcagacatttaacctggaggggtcccagatctacgaagactctatcgtgctgcagagcgttttcaagtcagcccggcaaaagatcgccaaagaggaggaatccgaagacgaatccaacgaggaggaggaggaggaagatgaggaggaaagcgagtcagaggccaagtccgtgaaagtgaagataaaactgaataagaaagatgacaagggacgcgacaagggcaagggaaagaagcgccctaatcgcggcaaagcaaagcctgttgtttctgacttcgattccgacgaggagcaagatgagcgggagcagtcagagggctccggaacagacgacgagtag

SEQ ID NO: 207545 - DNA, 711 bp, Artificial Sequence
  Description of Artificial Sequence: Synthetic coding sequence
atggaggaggaggtgcggctgaagaagcggaagcggcggcggaacgttgataaagacccggccaaggaagatgttgagaaggcaaagaagcggcgggggcgtcccccagctgagaagttgagcccgaatcccccgaagctaaccaagcaaatgaatgcgatcattgatactgtcataaattacaaggattcaagcggccgacagctctccgaggtgtttatccagcttccatcccggaaggagctcccagagtattatgagctcatccgaaaacctgtggactttaagaaaataaaggagcgtattcgcaatcataagtacagatcacttggagacctcgagaaagatgtgatgcttttgtgccacaacgcccagacctttaatctggaaggctcccagatctacgaagatagcattgtccttcagagcgtgttcaaatcggcccggcaaaagattgcaaaggaagaagagagtgaggacgaatctaatgaggaagaagaggaggaagacgaggaagagtccgaatcagaggcaaaaagcgtgaaagtgaagatcaaacttaacaaaaaagacgacaaggggcgagataaaggcaaagggaagaaaagacctaacagaggtaaagctaagcccgtggtctccgacttcgatagcgacgaggagcaggatgagcgtgagcaatcagaaggtagtggaaccgacgacgaatag

SEQ ID NO: 207546 - DNA, 4773 bp, Artificial Sequence
  Description of Artificial Sequence: Synthetic coding sequence
atgagcacccccaccgaccccggcgccatgccccaccccggcccctctcccggccctggcccgtctcccggacctatccttggaccgagcccaggcccggggccatcccctggcagtgtccatagcatgatgggccccagtcccggacccccgtcggtttcacatcctatgccaactatgggttcaaccgacttcccacaggagggtatgcatcagatgcacaagcccattgatgggattcatgataagggcattgtcgaggatattcactgcgggtccatgaaaggcactggtatgcggcccccccacccagggatggggcctcctcaaagtcctatggaccaacactcccagggctacatgagccctcatccgtcgcctctgggggccccagagcacgtgagcagcccgatgtcaggcgggggtcctaccccgcctcaaatgccacctagtcagcctggggcattgattcccggcgatccccaagctatgtcccagcctaacaggggcccgtctcccttcagtcctgtccagctgcatcagcttcgagctcagatcctcgcctacaaaatgctggctaggggtcagccacttcccgagacactgcagctggcggtacagggaaagcgtaccctcccagggttacagcagcagcagcaacagcaacaacaacagcagcagcagcagcaacagcagcagcagcagcagcaacagcctcagcagcaaccccctcagcctcagacccaacagcaacaacagccagctctggtgaactataatcggcctagcggacctggacctgaactctctgggcctagtacaccccagaaacttccagtgcctgccccaggagggaggcctagtcctgccccaccggccgctgcgcagccccctgccgccgcggtaccgggtccatcagtgccgcagcctgctccagggcaaccgagccccgtgctccaactgcaacagaagcagtctcggataagccccatccagaagccccagggactcgatcctgttgaaatcttacaggagagggagtataggctgcaggcaaggatagcgcacagaatccaggagttagaaaatctccccggtagcctaccaccagacttaaggacaaaagcaacggttgaattaaaagcgctcaggcttctaaatttccaacggcagctgcgacaggaagttgtcgcctgcatgagaagagacactactctggaaacggctctgaattcaaaggcctacaagaggagtaagcggcagaccctcagggaggctcgtatgaccgagaagctcgagaagcagcagaagattgaacaggaacgaaagagaagacagaagcaccaggagtacttgaacagcattctgcagcatgcaaaagattttaaggaataccacaggtctgtcgccggcaaaattcaaaagttaagtaaggccgtggcaacttggcatgctaacactgaaagggaacagaaaaaggagaccgagagaattgagaaggaacggatgaggcgccttatggccgaggatgaagagggctacaggaaactgatagaccaaaagaaagaccgccggctggcttatctcctgcaacagaccgacgagtacgtcgctaatttaaccaatcttgtttgggagcacaaacaggcccaggcagcaaaagaaaaaaagaagcggcgcaggcggaaaaagaaggcagaggaaaacgccgaggggggagaatccgcccttggaccagacggcgagcccattgacgaatcaagccagatgtcagatcttccagtcaaagtgacacataccgaaacaggaaaggtgctttttgggcccgaggcgccaaaggcttctcaattagacgcctggctcgagatgaatcccggatatgaagtcgcgcctcggtccgattctgaggaatcggactctgactatgaggaagaagacgaagaagaggagagctcaaggcaggagacggaagagaaaatcctcttggatcctaacagtgaggaggtatcagaaaaggatgccaaacaaatcatcgaaaccgccaagcaagacgtggatgacgaatactcaatgcagtattccgcccgcggatcacaaagctactacaccgtggcacacgctatttccgaacgggtcgagaaacagagcgctctcctgattaacgggacactgaaacattatcaactccaggggctcgaatggatggtcagcctatacaacaataacctgaacggcatcctcgccgacgaaatggggctcggaaaaactatccagacgatcgctttgatcacgtatctgatggaacataaaagacttaatggaccctacttaatcattgtccctctgagcacactttcaaattggacttacgagttcgacaagtgggctcctagcgtggtgaaaatttcttacaagggcacccccgccatgcgccgatccctggttccacaactcagatccggaaaattcaatgtgctcctgactacttatgagtacattataaaggacaaacacattctggccaagattagatggaagtatatgatagtggacgaagggcacaggatgaagaaccatcactgtaagctcacccaggtgctgaatacacattacgtcgcgccgcgccgtattctgctgacgggaaccccacttcagaataaactccccgagttatgggccttgctcaattttctgcttcctacaatttttaagagctgttcaacttttgagcagtggttcaacgccccattcgcaatgacaggggagcgcgtggacctcaacgaggaagaaacaattctcataattcgccggctgcataaggtgctgagacctttcctgctccgacggcttaaaaaggaagtggagtcccagcttcccgagaaagtggagtacgttattaagtgcgatatgtctgccttgcaaaagattctgtatcggcacatgcaggcaaagggcatactgctaactgacggcagcgaaaaggacaaaaagggaaaagggggcgctaaaacgttgatgaatactatcatgcagctgaggaaaatctgtaaccacccgtacatgttccagcatatcgaggaatccttcgccgagcaccttggatactccaatggagtgatcaatggggcagagctctaccgggcctctggcaaattcgaactgctcgacaggattctgcccaagttgagagcaacaaatcaccgcgtgctgctgttttgtcaaatgaccagcctgatgactatcatggaggactacttcgccttcaggaacttcctgtatctgagactggacggcactaccaagtccgaagatcgtgcggctctgctgaaaaagtttaacgaacctggcagccagtacttcatcttcctgctttctactagggctgggggcctaggactgaatttacaagctgccgacacagtggtaatatttgattccgattggaatccacatcaggacctgcaggcccaggacagggcccatcgaataggtcagcagaacgaggtacgcgttctgcggctgtgtaccgtaaattcagtggaggagaaaatcctagccgccgcgaagtataagctgaacgtcgatcagaaagtgattcaggcgggaatgttcgatcagaagtccagtagtcacgaaagacgagcgttcctgcaggctatcttggaacatgaggaggagaacgaagaagaggacgaggttcctgacgatgaaactttgaatcaaatgatcgcacggcgggaagaagagtttgatctctttatgaggatggatatggatagaaggagagaggacgcccggaacccaaaacgaaagcccaggctgatggaagaagacgagcttccttcatggattattaaagacgatgccgaggtggagcgtctgacatgcgaggaagaggaggagaaaatttttggcagaggatccaggcagagacgcgacgtcgactactctgatgccctcacggagaagcagtggctgcgcgcaatcgaagacggaaaccttgaagagatggaggaagaggtgcgcctcaaaaaacgcaagcgcaggaggaacgtggataaggatcccgcaaaagaggatgttgagaaggctaagaagaggaggggccgcccaccagcggagaagttaagccctaacccccccaagctgactaaacagatgaacgccattattgataccgtcataaactataaggatcggtgtaacgtggaaaaagtaccgtctaatagccagctggagatcgaaggcaacagttcgggaaggcagttgtctgaagtatttattcagctaccaagccgtaaagagttgccagaatactacgaactaatccggaagcctgtggatttcaaaaagattaaagaacgcattcgcaaccacaagtacagaagtttgggggatctcgaaaaagatgtgatgctgctgtgtcacaatgcccagacattcaacttagagggatcgcaaatctatgaggacagcatcgtgctgcaaagtgtatttaagagcgcccggcagaagatcgccaaggaagaggaatccgaagatgaaagcaatgaagaggaggaggaagaggatgaagaggagtccgaatcggaagcaaaatctgtgaaggttaaaatcaaattaaacaaaaaagacgacaagggccgcgataagggcaaaggcaagaaaaggcctaatagagggaaggcaaagccggtcgtaagcgactttgattccgatgaggagcaggacgaaagagagcagagtgagggctcaggaaccgatgacgagtag

SEQ ID NO: 207547 - DNA, 4719 bp, Artificial Sequence
  Description of Artificial Sequence: Synthetic coding sequence
atgagcacccccaccgaccccggcgccatgccccaccccggcccctcgccaggtcctggcccctcccccggcccaattttgggacctagcccgggccccgggccgagccccggctctgtccattctatgatgggaccaagccctggacccccctcagtcagccacccaatgcccacaatgggcagtactgatttcccccaggagggaatgcaccaaatgcacaagcctatcgatggaatccacgataaaggtatcgtcgaagatatccactgcggatctatgaaaggtacaggaatgagacccccgcacccaggcatgggccctccccagtcccccatggaccaacacagtcaaggttatatgtcaccacatccttctccgctaggggcacctgaacatgtttcctcgccaatgagcggcggcggacccaccccaccacagatgcctccctcccaacctggcgccttaattcctggtgacccacaggctatgtcccaacccaaccgcggaccttcgcccttctcgccagtgcaactgcaccagcttcgggctcaaatactggcctacaaaatgctcgccagaggacagcctcttccagagacactccaattggcagttcaggggaaaaggaccctgcccggcctgcaacaacagcagcagcagcaacagcagcagcagcagcagcaacaacagcaacagcagcagcagcaacagcctcaacagcagccaccacaaccacagacacagcagcaacaacaacctgcgttggtcaattacaatcgcccgtcgggacccggtccagaactcagcgggccatcaactccacagaaattacccgtgcctgcacccggtgggcggcccagccccgcccctccggcagcagcacaacctcccgctgccgcagtaccaggtccctccgtgccgcagcctgcccccggtcagccttcccctgtgctgcaattgcagcagaagcaaagcagaatatcacccatccagaagccacagggacttgatcccgttgaaattctccaggagcgcgagtaccgtcttcaagctagaatcgctcatcgaattcaggagctggaaaacctcccagggtcactgcctcccgacctcagaaccaaggccaccgtagaacttaaggccttgaggctcctcaacttccagaggcagttgaggcaggaagtggttgcatgtatgcgaagggatacaactttagagaccgctttgaattcgaaggcttacaaaagatcgaaacgccagaccctgagagaggctagaatgaccgagaagctcgagaaacaacagaaaatcgagcaagaacggaagcggcgacagaaacaccaagaatatctgaatagcattttacagcatgctaaagatttcaaagagtaccacaggtctgttgccggcaagattcaaaaactgagcaaggctgtcgcaacatggcatgcaaacactgaaagggagcagaaaaaggagacagaacgcattgagaaggagcgcatgaggaggctaatggcagaagatgaggagggttataggaaactcatcgaccagaagaaggatcgcaggctcgcatatctgctgcaacagactgacgaatatgtggccaatctgacaaatctggtttgggagcacaagcaagcccaggccgctaaagagaagaagaagcgtagacgcaggaagaaaaaagcggaagagaatgccgagggtggcgaatcagctctgggccccgacggcgaacccattgatgagagctctcagatgagtgatttacctgtcaaagtaacccatactgagacgggaaaggtcctctttggtcccgaggcgcctaaggcttcacaactcgacgcctggctggaaatgaatccgggatacgaggtggctcctcggagcgatagtgaggaatccgactccgactatgaagaagaggatgaagaagaagagtcatcgaggcaggaaaccgaggaaaagatccttttggatccaaacagcgaagaggtcagtgaaaaggacgcaaaacaaatcattgagactgccaaacaggatgtcgatgatgaatattcgatgcaatacagcgcacgggggagccagtcctactacaccgtggcccacgcgataagcgagcgagtcgagaagcagtccgcgttgctgatcaacgggaccctgaaacattatcagctccagggtttggagtggatggtgagcctgtacaacaacaacctgaatgggatcctagcagatgagatgggcctgggaaaaactattcaaaccatcgctctcatcacatacctgatggaacacaaacgcctcaatgggccatatttgatcatcgttcctctctctactctttccaactggacgtacgagtttgacaagtgggccccctctgtggtgaaaatctcatataaagggactcccgcgatgcgccgtagtctcgtgcctcagctgcggtccggaaagtttaatgttctattgactacttatgagtacattattaaagataagcatatcttggcaaaaattcggtggaagtatatgattgtcgacgaaggtcatagaatgaaaaatcaccattgtaagctgacacaggtgttgaatacccactatgtggctccccgacgcattttactgacgggcacgccgcttcagaacaagttacccgagctatgggcacttcttaatttcctactccccacaatcttcaagagctgctccactttcgaacagtggtttaatgctcctttcgctatgacaggggaacgggtggatctgaatgaagaagaaaccatcctgattatacgccggttgcataaggtgctgcgtcctttcctgttgagacggcttaagaaggaggttgaatcgcagctgcccgagaaagttgagtatgtcataaagtgcgatatgagcgccttacagaagattttgtaccgtcacatgcaggccaaagggatcttgctgacagatggctctgagaaggacaagaagggcaagggcggcgcgaagaccctgatgaacactattatgcaactacgcaaaatctgtaatcatccttatatgtttcaacatatagaagagagctttgccgaacacttgggatactctaacggcgtcattaatggtgccgaactgtaccgggcttccggcaagttcgagctgctggatagaatcctgccgaaactgcgggcgaccaaccacagggtgttactgttttgtcagatgacctcactgatgaccataatggaagactacttcgcatttcggaatttcctgtatctcaggttagacggcacgacaaagtccgaggatcgggccgcattgctaaaaaagttcaacgaaccgggcagccaatacttcatctttctactgtcaacgcgcgccggtggtttgggcctgaacctgcaggcagccgacaccgtggtgattttcgacagcgattggaatcctcatcaagacctacaggcccaggatagagcacatcgcattggtcagcagaacgaagtgcgcgttcttagactctgcaccgttaacagtgttgaggaaaagattctcgcggccgcaaagtataagctaaatgtcgatcagaaggtcattcaggccggtatgtttgaccagaaatcttcctcacatgagaggagggctttcctacaggcgattctggagcacgaggaagagaatgaagaagaggacgaagtccccgacgacgagacactcaatcaaatgatcgctaggcgcgaagaggagtttgacctgttcatgcggatggacatggaccgccgtagggaagatgctaggaatcctaaacgcaagcctcgtctgatggaagaggacgagctgccctcttggataattaaggacgacgctgaggtggagcggctcacctgtgaagaggaggaagaaaagatctttggaaggggctcgcgtcagagaagagacgtcgactattccgacgcactgacagaaaaacagtggctgagggcaattgaagatggaaacctagaggagatggaggaagaggtacgtctaaagaaacgaaaacgaaggcgcaatgtagataaggaccccgctaaggaggacgtggagaaagccaagaaacggagagggcgccctccagccgagaaactctcacccaatcctcccaaactcaccaaacagatgaatgcgatcattgatacagttatcaactacaaggactctagcggacggcagctgagtgaagtgttcatccagcttcctagtcggaaggaactgcctgagtactatgagcttatccgaaaacccgtggatttcaagaaaatcaaggaaagaatccggaaccataagtatcggtccctgggggacttggaaaaagatgtgatgttactgtgccacaacgcccagacattcaacctggaaggctctcagatttatgaagattctattgtgttacagagtgttttcaagagtgctcggcaaaaaatcgccaaagaagaggagtctgaggacgagagtaacgaagaggaggaggaagaagacgaagaggagtcagagtcagaggctaagagcgtcaaagtgaaaatcaagctcaacaaaaaagatgacaaggggagggacaaaggcaaggggaagaagagaccaaaccgggggaaggccaagccagtcgtatccgattttgatagcgatgaagagcaggacgagagggagcagtcagagggttccggtacagatgatgagtag

SEQ ID NO: 207548 - DNA, 360 bp, Artificial Sequence
  Description of Artificial Sequence: Synthetic coding sequence
atgctgctgtgccacaacgcccagaccttcaacctggagggcagccagatttatgaggactcaatagtgcttcagagcgtatttaaatcagccagacagaagatcgctaaagaggaggagtctgaggatgaatcaaatgaggaggaagaggaagaggatgaggaggagtcagaaagcgaagccaagagcgtcaaagtgaagataaagcttaataagaaagacgataaggggagagataaagggaaaggaaagaaacgtccaaataggggcaaggctaaacccgttgttagcgactttgactccgacgaagaacaggatgagcgggagcagtccgaagggagtggcactgacgatgaatag

SEQ ID NO: 207549 - DNA, 711 bp, Artificial Sequence
  Description of Artificial Sequence: Synthetic coding sequence
atggaggaggaggtgcggctgaagaagcggaagcggcggcggaacgttgataaggaccccgcgaaagaggatgtcgaaaaggcaaaaaagcggagaggtcgccctcctgctgaaaagctgtctcctaacccacctaaactgacaaagcagatgaacgccatcattgatacagtgattaattacaaggactcctcagggcggcagctctctgaggtttttatccaactgccgtcaagaaaggaactcccagagtattacgaacttatacggaaacccgtggatttcaagaaaatcaaggaaagaattaggaaccataagtacaggtctctgggcgacctggaaaaagatgtgatgcttttatgtcataatgcccaaacatttaacctcgaaggttctcaaatttatgaagactccatcgtcttgcagtcggtgttcaagtccgctcgacagaaaatagccaaagaggaagagtctgaggacgaatccaacgaggaggaggaggaagaagatgaggaggagagtgaaagcgaagccaaaagcgtgaaggttaagatcaaattaaacaagaaggacgataagggcagagacaaaggaaagggcaagaagcgtcctaacagagggaaagccaaaccagtagttagcgactttgacagcgacgaggagcaggacgagcgggaacagagtgaggggtccggaacagacgatgagtag

SEQ ID NO: 207550 - DNA, 711 bp, Artificial Sequence
  Description of Artificial Sequence: Synthetic coding sequence
atggaggaggaggtgcggctgaagaagcggaagcggcggcggaacgtggataaagatcccgctaaagaggacgtggaaaaggctaagaaacgccgcggcaggccgcctgccgagaagctgagccctaatcctcctaaactcaccaagcagatgaacgctattatcgatacggtaatcaattataaggacagtagtgggcggcagctgagtgaggtgttcatccagcttccttctcgaaaggaactgccagagtactacgaattgataagaaaaccggtcgacttcaaaaagatcaaagagaggatccggaaccacaaatacaggtccctgggggaccttgaaaaggatgtaatgttactctgtcacaacgcccaaaccttcaatctcgaaggctcccagatttacgaggattctatcgtgctgcagtctgtgtttaagtccgctaggcagaagatcgccaaggaggaggaaagcgaagacgaatcgaacgaggaggaagaggaagaggacgaagaagagtcggaatccgaggccaaatctgtaaaggtaaaaattaagcttaataaaaaagacgacaaggggagagacaaagggaagggcaagaaaagacccaatcggggcaaagccaagccagtggtcagcgactttgatagcgacgaagaacaagacgagcgggagcagtctgaggggagtgggacggacgatgagtag

SEQ ID NO: 207551 - DNA, 765 bp, Artificial Sequence
  Description of Artificial Sequence: Synthetic coding sequence
atggaggaggaggtgcggctgaagaagcggaagcggcggcggaacgttgataaagatcccgccaaagaagacgtggagaaggccaaaaagcgtagggggagacctcccgcagagaagctgagtcccaatccccccaaattaacaaagcagatgaatgccataattgacaccgtgattaactataaggaccgatgtaatgtggagaaagtgcccagcaacagtcagctcgagatcgaaggcaacagttcaggacgtcagctgagcgaggtgtttatccaactcccgtctagaaaggagctgcctgaatattatgagctcatccgcaaaccagtggactttaaaaaaattaaagagagaatcagaaaccacaagtacaggtctcttggcgatcttgagaaggatgtcatgctgctatgtcacaatgcccagacgtttaatttagaaggctcgcagatttacgaagattccattgtgctgcagagcgtgttcaagtctgctagacagaaaatcgccaaagaggaggagagcgaggacgagtctaatgaggaagaggaggaggaggacgaggaggaatcagaatcagaagccaagtccgtcaaggtgaagatcaaactgaataaaaaggacgataaggggagggataaaggcaaagggaaaaagaggccaaataggggaaaggcaaagcccgtcgtatccgatttcgattcagacgaggaacaggacgagcgtgaacaatcagagggatccggtactgatgatgagtag

SEQ ID NO: 207552 - DNA, 4719 bp, Artificial Sequence
  Description of Artificial Sequence: Synthetic coding sequence
atgagcacccccaccgaccccggcgccatgccccaccccggcccctcacccggccccggtcccagtcccggccctatcctcggaccctcgcccggaccaggaccatctccagggagcgtccacagcatgatggggccctcccctggccccccgagcgtgtcacaccccatgcctactatgggctcaactgattttcctcaggagggtatgcaccaaatgcataaacccatcgacggtattcatgataaggggatagttgaggatatacactgcggaagtatgaagggtacaggaatgcgccctccccaccctggtatgggtccaccccagtcccctatggaccagcattctcagggttacatgagccctcacccatccccactgggggctccagaacatgtgtcgagtcccatgagcggaggcgggccgacccctccgcagatgccaccatctcagcccggtgcattaattcctggagatccccaggccatgtctcagcccaaccggggacccagcccattcagccctgtgcagcttcatcagttgcgggcacaaatccttgcctacaaaatgttagccagaggccagccactgccagagactcttcagctggctgtacagggcaagcgcaccctccccggcctccagcagcaacagcagcagcagcagcagcagcagcagcagcagcagcaacagcagcagcaacagcagcaaccccaacagcagccccctcagccgcagacccagcagcaacaacagcctgccctggttaactataaccgcccatcagggcctggacccgagctatcaggaccttctactcctcaaaaactccccgttcctgccccaggaggtcgcccgtcccctgccccgccggctgctgcccagccaccagccgcggcggtgcccgggccaagcgtgccacaaccagcccctggacagccttcaccagtccttcaactgcagcagaagcagtcacgcattagtcccatccaaaagccacagggactggaccccgttgagattctacaggaaagggagtatagactccaagctaggattgcccaccgaatccaggagctagagaatctccccggaagcctgccccccgatctcagaacaaaagcaactgtggagctcaaggctcttaggctgctgaattttcagcggcagttgaggcaggaagtggtcgcctgtatgcgaagggacacaacgctggagacagcccttaactctaaggcctataagcggagtaaacggcagacccttcgcgaagctcgcatgacagagaagctagaaaaacagcagaaaattgaacaagaacgaaagcgaaggcaaaagcatcaggagtaccttaacagcattctgcaacacgcgaaggacttcaaagagtaccaccgcagtgtggcaggcaagatccagaaactcagtaaagccgtggcaacttggcatgccaataccgagcgggagcagaagaaagaaaccgaaagaatcgagaaagaaaggatgaggcggttgatggccgaggatgaggaaggctaccgcaaattgatagaccagaaaaaagaccggagactagcttacctcctgcagcagacagatgaatacgtggctaatctgacaaatttggtgtgggaacacaagcaggcccaggccgccaaggagaagaagaagcggagacgacgcaagaagaaggccgaagaaaatgccgaaggcggcgagagcgcactaggacctgatggggagccaatagacgaatcttcccaaatgtccgatttgcccgtgaaggtgacccacacggaaacgggtaaagtccttttcggccccgaagcacccaaggcctcccagctggatgcctggctggaaatgaatcctggttacgaagtcgctccgcgctcagatagtgaagagtccgattccgactatgaggaagaagacgaggaggaagagtcctcaaggcaggaaacagaggaaaaaatactcctggacccaaacagcgaggaggtcagcgaaaaggatgctaaacaaataatcgagaccgccaaacaagatgtggacgatgagtatagtatgcagtattccgccagggggagccagtcgtattacacagttgcccacgcaatttctgaacgcgtagaaaagcaatccgcccttcttataaatggaactctgaagcattaccagctacaagggcttgaatggatggtgtcattgtacaacaacaatctgaacggcatcctcgctgacgaaatgggtctgggaaaaaccattcagaccatcgccctgattacttacctaatggagcataaacgactgaacggcccttacctgatcatcgtgcctctttccaccctatctaactggacctacgaatttgacaagtgggctccttccgtcgttaagatatcatacaagggcacaccagccatgagaagatctcttgttccacaattgcggagtgggaaattcaatgtactcctgaccacctacgagtatattatcaaagataagcatattctcgccaagatcaggtggaagtacatgattgtggacgagggacatcgaatgaaaaatcatcactgtaaacttacgcaggtgctgaatacccattacgttgctccaagacgtatcttgctaacaggcacaccactccagaataaactgcctgagctctgggctttgctgaatttcttacttccaacgatcttcaagtcctgtagtacctttgaacagtggtttaatgctccttttgccatgacaggtgagcgtgtcgacttgaatgaggaggaaaccattttgatcatcaggcggctacacaaggtgcttagacccttccttctaaggaggctaaaaaaagaggtggagtcccaactccctgaaaaggtggagtatgtgatcaaatgtgatatgagtgccctgcagaaaatcctctacaggcacatgcaggctaaaggcatcctactcaccgacggcagtgaaaaagataaaaagggaaagggcggcgccaagactcttatgaatacgatcatgcaactcagaaagatctgtaatcatccgtatatgtttcagcacatcgaggaaagcttcgccgaacacctaggttatagcaatggggtaatcaatggtgccgagttgtatcgagcaagtggcaagttcgaactccttgaccgcattttacccaaattgcgggcgaccaaccacagagtcctattgttctgccagatgacaagtctcatgaccattatggaagactattttgctttcagaaatttcttgtacctcaggcttgatgggactactaaaagtgaggacagggctgcgctgctcaagaaatttaatgagcctggtagccagtactttatcttcttattgtctacacgcgccgggggcttagggcttaatctgcaggccgccgatactgtcgtgatctttgacagtgattggaacccgcatcaagatttacaggcacaggatcgggcacatcgaataggacagcagaacgaagtcagggtgctgaggctctgcactgtgaattcagtggaagaaaaaatactcgcggcagccaagtacaaactcaacgtggatcaaaaagtcatccaagcgggaatgttcgaccagaaaagtagttctcacgagcgcagggcttttctgcaggcaatcctcgagcatgaggaagagaacgaggaagaagacgaggtaccggatgacgagactctgaatcagatgatcgcccgacgagaggaggagtttgacttattcatgcgcatggacatggacagacgtcgagaggatgccaggaatccaaaaagaaaaccccggctcatggaagaagacgagcttcccagctggattataaaggacgacgctgaggtcgaaaggctcacctgtgaggaagaagaggagaaaatttttgggcggggaagtagacagagaagggatgtcgactattcagacgccctgaccgagaaacaatggttacgcgcaatcgaggatggtaatcttgaagagatggaggaagaggtgaggcttaaaaaaaggaagaggcgccggaatgtagataaagatcccgcaaaagaagacgtggagaaggccaaaaagaggcgcggccggccaccagctgaaaaactcagccccaaccccccaaaattgaccaagcagatgaacgcaatcattgatacggttatcaattacaaggacagtagtggaagacagctgtcggaagtgttcatccaactgcccagccgcaaggaactgccagagtactatgaacttatccgaaaaccagtagacttcaagaaaattaaggaacgcattcggaatcataagtaccggtcactcggggaccttgaaaaggatgtcatgctcctttgtcacaacgctcaaacgttcaacctggaaggctctcagatttatgaggactctatagtgctgcaaagcgtgttcaagagcgcgcggcagaaaatcgctaaggaagaggagtcagaggatgagtctaacgaagaggaagaagaggaagacgaggaggaaagcgaatcagaagccaaaagtgtgaaggttaagataaagctgaataaaaaagatgataaaggccgggacaaggggaaaggcaaaaagcgcccaaaccggggcaaggctaagcctgtggtgtccgacttcgattcagacgaggagcaggatgagagagagcaatccgagggcagtggcactgatgatgaatag

SEQ ID NO: 207553 - DNA, 4773 bp, Artificial Sequence
  Description of Artificial Sequence: Synthetic coding sequence
atgagcacccccaccgaccccggcgccatgccccaccccggcccctcacctgggccgggccccagtcctggaccaattctgggcccatcgcccgggccaggtccttccccaggctccgtgcactctatgatgggcccctcacctggaccaccctcagtgtcccatcccatgcctacgatgggttccactgattttccacaagaagggatgcaccagatgcataaaccaatcgatggtatacacgataagggaattgtagaagatatacactgcggctcgatgaaagggactggcatgcgccccccacatcctggcatggggcctccgcagtcccctatggatcagcattcccagggctacatgtctccacacccctctcctctgggtgcacctgaacacgtaagttcacctatgagtggcggtggccctacacccccccaaatgccacccagtcagcctggggcattgattcctggagatccccaggcaatgtctcaaccaaacaggggcccctcgcctttctcacccgtacaattgcaccagctgcgggctcagatactcgcctacaagatgctggcccgaggccagccattgccagagacccttcagctggctgtccagggcaaacgcaccctaccaggtttgcagcagcaacagcaacaacaacaacagcaacaacagcagcagcagcagcaacagcagcagcagcagcagccccaacagcagccaccacagcctcaaactcaacaacagcagcagcccgctctggttaactacaacagaccatctggccctggtccggaactttccggaccttcaacaccacagaaactaccagttcccgctccagggggacgccctagccctgccccacccgccgctgctcagccgccggctgcagccgttccagggccctctgtgccacagcccgcgcccgggcaaccctcacccgtcctgcaattacaacagaaacagagtcgcatctcgcccatacagaagccgcaggggcttgaccctgtggagattctccaagaacgagaatatcgccttcaagccaggatcgcacaccggatacaggagcttgagaatctgcccggctccttaccccctgatctgcggaccaaagcgactgttgagctcaaggctcttcggctactgaattttcagagacagctgagacaggaggtagtcgcctgcatgcggcgggacaccaccctggaaaccgcgttgaattcaaaagcttacaagcgctccaaacggcaaactctgcgtgaggcacgtatgacagagaaactggaaaagcaacagaagattgagcaggaacgaaagcgaaggcagaaacaccaagagtacctgaattccatcctacagcacgcaaaggatttcaaggaataccaccgctctgtggccgggaaaattcaaaaactaagcaaggccgtggccacgtggcacgccaataccgaaagggaacagaagaaagagaccgaacgtatcgagaaagaacgaatgcgacggctaatggccgaggatgaagaaggatataggaagctgattgaccaaaagaaggataggcgccttgcctacttgcttcagcaaactgatgaatatgtggcaaaccttaccaatctggtctgggaacacaaacaagctcaggctgctaaggaaaagaagaagcgtaggagacggaagaaaaaggccgaagagaacgcagaaggtggggagagcgcccttgggcctgacggggagccaatcgatgaaagctcccagatgtctgatctgcccgtgaaagtgactcacacagagacgggaaaagttctgtttggacctgaagcccctaaggccagccaattagacgcctggttggaaatgaatccaggctatgaggtagcaccaaggagtgatagtgaagagtcagacagtgattacgaggaagaagacgaggaggaggagagcagtcgtcaagaaaccgaggaaaagattctgctcgatccaaatagtgaggaagtctccgaaaaggatgccaagcagattattgaaactgccaagcaggatgttgatgacgagtatagcatgcagtattctgctcgaggctcccagagttattacactgtggcccacgctatctccgagcgcgtcgagaagcaatccgccctgcttattaacggaaccctaaaacattatcagctgcagggcctggagtggatggtatcattatacaacaacaacttaaatggaatccttgccgacgaaatgggcctggggaagacaatacagacgatcgccttgattacttatcttatggaacacaagaggttaaacggcccttacctgatcatagtgccactgagcaccctaagcaattggacctacgagttcgacaagtgggcaccatctgtggtgaaaattagctataagggcacacccgccatgaggagatccttggtcccccaactgcggtcgggcaagttcaacgtgctattgaccacttacgaatatatcataaaggataagcacattctggccaagatccgatggaagtatatgattgttgacgaggggcatcggatgaaaaatcaccactgcaagctgactcaagttctgaatacacactatgtcgcccccaggcgtatacttctgacgggcactccattacagaacaagctgccagagctctgggctcttctgaattttctactgccaactatatttaagtcctgttccacctttgaacagtggtttaacgcaccctttgccatgacaggtgaacgagtcgatttaaacgaggaagaaacaatcctgatcatacgacgacttcacaaggtcctgcggccttttctgctcagaaggctaaagaaggaggtggaatcacagttgccagaaaaggttgaatacgtcattaaatgcgacatgtccgccctgcagaaaattctgtacagacacatgcaagccaaaggtattctcctgaccgacggttcagagaaagataaaaaagggaagggcggtgcaaagactctcatgaacacaattatgcagctccgtaaaatatgtaatcacccttatatgttccaacacatcgaggagagttttgccgaacatctcggctattcaaacggggtgattaacggggcagagctctatcgagcgtcaggaaaattcgagctgctcgatcgaattctgcctaagttgcgggccaccaaccatcgggtgctactgttttgtcaaatgacatctttaatgactatcatggaagactattttgcgttccggaactttctgtacctgagactggatgggaccacaaaaagcgaggacagagccgcactgcttaagaaatttaatgagcctggctcccagtacttcattttcctattaagcacaagagcagggggactgggcctaaacctgcaggctgccgacacagtggtgatcttcgattccgactggaatccccaccaagatctgcaggcccaggaccgggcgcatagaattggccagcagaacgaggtgagagtgctgagactatgtaccgtgaacagcgttgaagaaaagatcctcgccgcagccaaatacaaactgaatgtggatcaaaaagttatacaagctgggatgtttgatcagaagagcagctcacacgagcgccgcgcctttctccaggctattctggaacacgaggaggaaaacgaggaagaagatgaggtgcccgatgatgagactctgaaccaaatgatcgccaggcgggaggaggaattcgaccttttcatgaggatggacatggaccggcggagagaagatgcccgtaatccgaaacggaaaccaaggctaatggaagaggatgagcttccttcatggataatcaaggatgacgccgaagtggaaagattaacttgtgaagaggaggaagagaaaatatttgggcgtggatctaggcaaagaagagacgtagactactcagacgccctaacagagaagcagtggctgcgcgccatcgaggatggaaacctggaagagatggaagaagaagtgagactcaagaaacgcaagcggagacgtaatgtggacaaagaccctgctaaggaagatgtggagaaagcgaagaaacgtcggggccgccccccagccgagaagctgagcccgaacccccccaaacttaccaagcagatgaacgctatcattgacacggtaattaattataaggaccgctgcaacgtcgaaaaggttccctccaattctcagttagagatagaggggaattccagtgggcgtcagctgagtgaggtgtttatccagctgccctctcggaaggagttgccggagtactatgaattgataaggaagcccgttgacttcaaaaagattaaagaaagaattcgcaaccacaagtatcggagcctgggggacctggaaaaggacgtgatgcttctctgtcataacgcacagacattcaatcttgagggctcccagatttatgaggatagcattgtgcttcagtccgtgtttaagtctgcccgtcagaaaattgctaaggaagaggagagtgaggatgagagcaatgaagaggaggaggaggaagacgaggaagaatccgagtctgaagcgaaatcagtcaaagtaaagattaagttgaacaagaaggacgacaaaggcagggataagggcaagggtaagaaaaggcctaaccgtggaaaagctaaaccggtggtcagcgatttcgacagcgacgaggaacaggacgagagagagcagtctgaagggtctgggactgacgatgaatag

SEQ ID NO: 207554 - DNA, 534 bp, Artificial Sequence
  Description of Artificial Sequence: Synthetic coding sequence
atggaggaggaggtgcggctgaagaagcggaagcggcggcggaacgtcgataaggaccctgctaaggaggacgtggagaaagccaagaagcgccgaggaagacccccagccgagaagctgagccccaacccgcccaaactgaccaaacagatgaacgctatcatagacacagtaattaattacaaggattcctcaggcaggcagctttccgaggtattcatccagcttccctcccggaaagagctacctgaatattatgaactcattaggaaacctgtggacttcaaaaaaatcaaagaaaggattaggaatcataagtaccggagcctgggggatctcgagaaggatgtcatgctgctctgtcataatgcacaaacatttaatctggagggctcacagatatacgaggattcgatcgttctccagagtgtattcaagtccgcaaggcagaagatcgctaaagaggaagagagcgaagatgaatccaacgaggaggaggaggaggaggatgaggaagagagcgagagcgaatag

SEQ ID NO: 207555 - DNA, 816 bp, Artificial Sequence
  Description of Artificial Sequence: Synthetic coding sequence
atgaagcggctggccgcccggtgcttcgccggcctgctgatcctgtcaccactcacagtaatttcagattcccggcctgccgacagcggaaaagccattgaggacggcaatctagaagagatggaggaggaggtgagacttaaaaagaggaagaggcgcaggaatgtggacaaggatccagccaaggaagacgttgaaaaggccaaaaagagacgaggcaggccaccagcagagaagctttcccctaacccacctaaactcaccaagcagatgaatgccatcatcgatacagtgatcaactataaagattccagtggcaggcagctgtcagaggtctttattcagctgccgagccgtaaagaactcccggaatactacgaacttatccgcaagccggtagacttcaagaaaatcaaggagagaattcggaaccataagtaccggtctttgggagacctggaaaaggacgttatgttgctttgtcacaatgcacagaccttcaatctggagggaagtcagatctacgaagactctatcgttctgcagtcggtttttaaaagtgcacgtcagaagatcgcaaaggaggaggaatcggaggacgagagcaatgaggaggaggaagaggaagatgaagaggagagcgagtccgaggcgaagagcgtcaaagtgaaaataaagcttaacaagaaagacgataaaggaagagacaaaggcaagggaaaaaaaagaccaaaccgtggaaaagcaaaacccgtcgtgagtgatttcgacagtgacgaggaacaggacgaacgtgtaagcgtggcggattggtag

SEQ ID NO: 207556 - DNA, 462 bp, Artificial Sequence
  Description of Artificial Sequence: Synthetic coding sequence
atgaagcggctggccgcccggtgcttcgccggcctgctgatcctgtccccgctcactgtaatctcggattcccgaccagctgactccggcaaggcgatagaagatggaaatttggaggaaatggaggaagaagtccgcctgaaaaagcggaagagacggcggaacgttgacaaagatcccgctaaagaagacgtggagaaagctaaaaagcgccgcgggcgcccacccgcagagaagctgtcccctaacccaccgaaactgaccaaacagatgaatgccatcatcgatactgttatcaactacaaggattcctccggccgacagctcagcgaagtgtttatccagctgccctctcggaaggagctgcccgagtattacgaactgatcaggaagccagtcgacttcaagaagattaaggaaagaatccgtaatcacaagtaccgcagtctgggcgatctatag

SEQ ID NO: 207557 - DNA, 468 bp, Artificial Sequence
  Description of Artificial Sequence: Synthetic coding sequence
atgagcacccccaccgaccccggcgccatgccccaccccggccccagtccaggccccggcccctctccaggacccatcttggggccaagccctggacccggcccatccccaggatcggtccatagtatgatgggacccagccctgggccccctagtgtgtcccaccccatgcccaccatgggctcgaccgattttccccaagaaggcatgcatcagatgcacaagccaattgacggtattcacgataagggaattgtggaagatatacactgcggatccatgaaaggtactggtatgcgccccccacaccccggaatgggccctccacagtctccgatggatcaacattcacagggatacatgagcccccacccaagcccccttggtgctccagagcacgtctcctcccccatgtcagggggcggacctaccccaccccagatgcctccttcccaacccggggcctag

SEQ ID NO: 207558 - DNA, 1680 bp, Artificial Sequence
  Description of Artificial Sequence: Synthetic coding sequence
atgagcacccccaccgaccccggcgccatgccccaccccggcccctcacccggacccggcccctctccaggaccaattctcgggccctcccctgggcccgggcccagtcccgggtctgtccactcaatgatgggtccttcaccaggcccacctagtgtatcacaccccatgccaaccatgggtagtacagactttccgcaagagggcatgcatcagatgcacaagcccatcgatgggatccatgacaaggggatcgtggaggatattcactgtgggtccatgaaggggacggggatgcgcccacctcatccggggatgggccccccgcaaagcccaatggaccagcacagtcagggttacatgtccccacatccttcaccactaggggcacctgaacatgtctcttcacctatgagcggaggaggccccactccgccgcagatgcccccatcccagccgggcgcattgattcccggagacccacaggccatgtcgcaaccgaatcgcgggccctctccgttctcacccgtgcagctgcaccaactccgtgctcagattttggcgtataagatgctggccaggggacagcctttaccggaaacactccagctcgctgtccaaggcaagagaacgctgcccgggctccaacagcagcagcaacagcagcaacagcagcagcagcagcagcaacagcagcagcaacagcagcagcagccgcaacagcagccccctcagcctcagacccagcaacagcagcagccagcgttagtgaactacaataggccgtccgggcccgggcccgaattgagcggcccctcgaccccacagaagctgccagtaccggcgcctggcggaagaccctcaccagcaccgcccgctgccgctcagccccccgctgcagctgtcccaggcccatcagtcccacagcctgctccaggacagccgagccctgtcttgcagctacagcagaaacagtcaagaatttctccaatacaaaagccacagggcctcgacccagtggaaatactgcaggagagagagtacaggcttcaggctagaatcgcacatagaattcaggagctagaaaatctgccaggctcccttcccccagacttacggacaaaggccacagtggaattaaaggctcttcgcttgctgaattttcagcgccagctccgtcaggaggttgtcgcctgcatgcggcgtgataccaccctggaaacagccctgaattcaaaagcctacaagcggagcaagcgccagacactgcgcgaggcacgcatgactgagaagctagaaaagcagcagaaaattgaacaggagcgcaagaggaggcagaaacaccaggaatatttaaattccattctgcagcacgccaaggattttaaggagtatcacagaagcgtcgctgggaagatccaaaaattgtctaaagcagtggcaacctggcacgcaaacacagaaagggagcagaaaaaggaaacggagaggatcgagaaggagaggatgaggaggctgatggctgaggatgaagagggttatcgcaagctaatcgatcagaagaaggataggagacttgcttatctgttgcaacagactgacgaatatgtggccaatcttaccaatctcgtgtgggaacacaaacaggcccaagccgcgaaggagaagaagaagcgttag

SEQ ID NO: 207559 - DNA, 516 bp, Artificial Sequence
  Description of Artificial Sequence: Synthetic coding sequence
atggaggaggaggtgcggctgaagaagcggaagcggcggcggaacgtggataaagatcctgctaaggaagatgtggagaaagccaagaagcgccgcggtcgtcccccggccgaaaaactttcacccaacccccctaagctgactaagcagatgaacgccatcattgacactgtgataaattacaaggatcggtgtaacgtcgagaaggttccaagcaacagccagttggaaatcgagggtaattcttccggcaggcagctatctgaggttttcatccagctgcccagccggaaagagcttcccgagtattacgagctcattcgaaaaccagtagactttaagaagattaaggaaagaatccgaaatcacaaatacagatcccttggagaccttgagaaagatgtgatgttgctgtgtcataatgcccagaccttcaatctagaggggtctcagatatatgaggatagtattgtgctacagagtgttttcaagtctgctcgtcagaaaattgcgtag

SEQ ID NO: 207560 - DNA, 201 bp, Artificial Sequence
  Description of Artificial Sequence: Synthetic coding sequence
atgagcacccccaccgaccccggcgccatgccccaccccggcccctcccctggccccggccctagtcccggcccaattcttggccctagccctggtccaggccccagtcctggctcagttcactctatgatggggccttccccaggtcctccttctgtgtctcatcctatgcctactatgggtagcaccgacttcccatag

SEQ ID NO: 207561 - DNA, 4944 bp, Artificial Sequence
  Description of Artificial Sequence: Synthetic coding sequence
atgagcacccccgacccccccctgggcggcaccccccggcccggcccttcgcctggccctggcccctcaccaggtgcgatgttgggcccatctcctggcccatctccaggttcagctcacagtatgatgggccccagcccagggccaccgtctgccggccatcccatacccacacaggggccagggggatatccacaagataacatgcatcagatgcacaaaccaatggaaagtatgcacgagaaagggatgagcgatgatccaaggtacaaccagatgaaggggatgggaatgagatctggcggccacgcaggtatgggccccccaccgagcccgatggatcagcactcccagggctatcctagccccttgggcggaagcgaacatgcatcctctccggtgcctgcctctggacctagttccggaccacagatgtcttctggtcctggcggcgccccgctggacggagccgaccctcaggccttgggccagcagaatcgcggccccactcccttcaaccagaaccagctacatcaactgcgagctcaaatcatggcttacaaaatgctggccagaggacagccactgcccgaccacctgcagatggccgtgcagggaaaacgtccaatgcccggtatgcagcagcagatgcccaccctcccgcctccatcggtctcagcaaccggtcctggaccagggccagggccggggcccggaccgggccctggcccggccccgcccaattattcacgcccacatggtatgggtggccccaacatgcctccgccagggccatccggagtgcccccaggtatgccaggacaaccccccgggggccctccgaagccctggccagagggacccatggccaatgccgctgctcccacatcaacgcctcagaaactgatacctccgcagccaacagggaggcccagccctgcaccccctgcggtacctcctgctgcgagtcctgtgatgcccccccagacacaaagtcctggacagcctgcacagccggcaccaatggtgcctttgcatcagaaacagagccgcatcaccccaattcagaaacccagaggtcttgatccagtggaaatcttgcaggagagagaatacagactccaggccagaatcgcacacagaatacaagagctcgaaaacctgcccggctccctagcaggggacttgcgaactaaggctacaatagaactcaaggctctgaggctcctgaatttccaaaggcaactgcgccaagaagttgtagtgtgtatgcggagagacactgcactggaaactgccttgaacgcgaaagcgtacaaacggagtaaacgccagtccctgagagaagcacggatcactgaaaagctggaaaagcaacagaaaattgaacaagagagaaagaggcgccagaaacatcaagagtacctaaacagtatactccagcatgccaaggacttcaaggagtaccatcgttctgtaaccggcaaaatccaaaaattgactaaggcggtcgctacatatcacgctaataccgagcgggaacagaagaaggagaatgagagaatcgagaaagagcgcatgaggaggctaatggccgaggacgaggaaggttatcgtaagctcattgaccaaaagaaggacaaacgcctggcgtatcttctgcaacagacagacgagtacgtggcaaacttgactgagttggtgcgccagcacaaagctgcccaggtggccaaggaaaaaaagaagaagaaaaaaaagaaaaaagccgaaaatgcagagggccagaccccagccataggacccgatggcgagccgcttgacgagacaagtcagatgagcgacctgcctgtcaaggtaatccacgttgagagtggaaaaattcttactgggacagatgcgcctaaagctgggcagctggaggcatggctagagatgaaccctggttacgaagtagccccaagaagcgatagcgaggaaagcggctcagaagaagaagaggaagaagaggaggaagagcagcctcaggcagcacagccaccgaccctcccagttgaagaaaaaaaaaaaattccagaccctgactccgatgatgtgagtgaagtcgatgccaggcatatcatcgaaaacgctaagcaggatgtcgatgatgaatatggagtttcacaggccctagcaagaggacttcagtcctattacgctgtggcccacgctgtgaccgaacgtgtcgataaacagtccgccctgatggtcaacggtgtcctgaaacagtaccaaatcaaaggactagagtggctagtgagtctatataataataacctgaacgggatccttgccgatgaaatggggctgggaaagaccattcaaaccattgccctgatcacctatttaatggagcataaacgaattaacggtccattccttattatcgtcccactaagcacgctgagtaactgggcgtatgaatttgataaatgggcccccagtgtagtgaaggtttcctataagggttcccccgcggcccgcagggcattcgtgcctcaactgcggtcaggcaaatttaacgtactgctgacgacatacgaatatatcatcaaagacaaacacatcctcgcaaagatccgctggaagtatatgatcgtggacgagggccacaggatgaaaaaccaccactgcaagctcacgcaggtgctgaatactcattatgtggcccctcggcgactgcttctgactggcactccactgcaaaataagcttcccgagctttgggctctgcttaattttctcctacccacaatctttaaatcttgctcaacatttgaacaatggtttaatgcccctttcgccatgaccggggagaaggtcgatttaaatgaggaggagaccattttaattattagaagactacacaaggtgctgcgccctttcctcctgcggaggctcaagaaggaagtggaagctcagttgccagaaaaagtggaatatgtcataaagtgtgacatgtccgccctgcaacgcgtcctctataggcacatgcaagcaaaaggcgtgcttctgaccgatgggtctgagaaggataaaaaaggaaaaggtgggacgaaaaccctcatgaacactatcatgcagctgcggaaaatttgcaatcatccctacatgtttcagcacattgaggagagctttagtgaacacctgggcttcactggaggtatcgtgcaaggcttagacctataccgggcgtctgggaagtttgagcttctggatcggattctccccaagttacgggccactaaccataaggtccttctgttttgccagatgacatctcttatgactatcatggaagactacttcgcttatcgggggttcaaatatcttagactggatggcaccacaaaggccgaggacagggggatgctgcttaagacatttaatgagcctggaagcgagtatttcatttttctcctctctacaagggccggtggactcggcctgaacctgcaatccgcagatacagtgatcatcttcgactccgactggaaccctcaccaggacctgcaggcccaagatagagctcacaggataggccagcagaatgaggtaagagtgctgcgtttgtgcaccgttaactcagtggaagagaagatacttgccgctgcgaaatacaagctgaatgtagaccagaaggtgatccaggccggtatgttcgatcaaaaatcatccagccacgagcgcagagccttcctgcaagcaatccttgaacatgaagaacaagacgagtcacggcactgcagcactgggtccggctccgccagttttgcacacacggccccgccacccgcaggagtgaatccagatctggaagagcctccccttaaagaggaagacgaggtgccggatgatgagacagtgaatcagatgattgcccgccatgaagaagagtttgacctgtttatgcgaatggatctggacaggagacgagaagaggccagaaatcccaaaagaaagcccagattaatggaagaggacgagctcccgtcctggattatcaaagatgatgcagaagtggagcgcctcacatgtgaggaggaagaagagaagatgtttggcaggggatctcggcaccgcaaggaggtcgattactccgacagcctcacagagaagcagtggctgaaggccatcgaggagggtactctcgaggaaattgaagaggaagttcgacagaagaaatctagccgcaagcggaagcgagattccgacgccgggagcagcactcctaccacatccaccagaagccgcgacaaggatgatgaaagcaaaaagcagaagaaaagaggtcgaccaccagctgagaagctttctcccaacccaccgaacttgacaaaaaagatgaaaaagattgtcgacgccgtgatcaagtataaggacagcagtagtggaaggcaattgagcgaggtgtttatccaactaccttccaggaaagagctgcccgagtattatgagctgattcgcaagccagtcgatttcaaaaaaatcaaagagagaattaggaatcacaagtatcggtccttgaatgatctggagaaggacgtgatgctcctgtgtcagaatgctcagacgttcaatctggaaggttctctaatatacgaggacagcatcgtcctgcagtccgtattcaccagcgttagacagaagattgagaaagaagatgattcagaaggcgaagagtcagaggaagaggaagagggcgaagaagaaggcagcgaaagcgagtctcggtctgtcaaggtgaagattaagctggggagaaaggagaaggcacaggatcggctaaagggtgggaggaggagaccctctagaggctccagggctaaacctgtagtgagcgatgacgactccgaagaggagcaagaagaggatcgatcgggatccggcagcgaggaagattag

SEQ ID NO: 207562 - DNA, 5040 bp, Artificial Sequence
  Description of Artificial Sequence: Synthetic coding sequence
atgagcacccccgacccccccctgggcggcaccccccggcccggccccagtcccggcccagggccttcgcccggggctatgctcggcccctctccaggaccaagccccggttccgctcattcaatgatgggaccctctccaggcccccccagcgcgggtcaccctatccccacccaaggacctggaggttacccccaggataacatgcatcaaatgcacaagccaatggagagcatgcacgagaagggaatgtcggacgacccgcggtacaaccagatgaaagggatgggtatgcgcagtggggggcacgccggtatgggcccaccaccctctccgatggatcagcatagccagggctacccaagcccgcttggcgggtcagagcatgctagtagtccagttccagcctctgggccaagctccggaccccagatgtcatcaggccctggcggggcacctttagatggggctgatccgcaggcgttggggcagcaaaataggggcccaacccccttcaatcaaaatcagctgcaccaactgagggctcagattatggcatacaagatgcttgctagagggcagccactgcctgatcatcttcagatggcagtccagggaaagagaccaatgccaggcatgcagcagcagatgccgacgctgcctccgccttctgtctcagccactgggcccggacctggcccaggcccagggcccggccctggaccaggcccagccccccctaattactcccgcccccacggcatgggtggcccaaacatgcctccacccggaccctctggagttcctcctggaatgcctgggcagcctcccggcggtcccccaaaaccgtggcctgagggccccatggctaacgccgccgccccgacaagcacccctcagaaacttatacctccgcaacctacaggcaggcctagtcctgcccccccggctgtgccccctgcagcaagtccagtcatgcctccccagacccaatccccaggccagcccgcacagccagctccaatggttcctctccatcaaaaacagtctagaataactccaatccagaagccaagaggtcttgatccagtggaaatcttgcaagagcgcgagtaccgattgcaggcacgtattgctcatcggattcaggagctggaaaatctaccggggagcctcgctggggacctgagaacgaaggctactattgaattgaaagcactgaggctcctcaattttcagcgacagttgcgacaggaagttgtggtctgtatgcgcagggacaccgcgctggagaccgctctgaatgctaaagcctacaaacgttctaagagacagagtttgcgggaagcacgtattactgagaaactggagaaacaacagaagatcgaacaggagcgcaagcgcagacagaagcaccaggagtatctcaactctattctgcagcatgctaaggacttcaaagaatatcataggagcgtaaccggtaaaattcaaaaacttaccaaagctgtggccacctaccatgccaataccgaacgggaacaaaaaaaggagaatgagcgcatcgaaaaagaacgcatgcggcgcctcatggcagaggacgaggaaggttaccgtaagctcatcgatcagaagaaggataaacgcctggcatatctcctacagcagacagacgagtatgtggccaatctcaccgaactggtcagacagcataaagcagcccaggtcgctaaagagaaaaaaaagaagaagaaaaagaaaaaggctgagaatgccgagggacagacccccgctatcggtcccgacggagagcccctggacgagacatcccagatgtctgacctcccagtcaaggtgatacatgtggagtctgggaagatcttgacaggcactgatgcccctaaagcgggtcagctagaagcttggcttgagatgaatccgggatatgaagtggcaccgaggtcagatagcgaggagtctggctcagaggaagaggaggaagaagaggaagaggaacagccccaggccgcccagccccctactcttccagtcgaagaaaagaaaaaaattcccgacccagactcagatgatgtcagcgaggtggacgccagacacattatcgagaatgccaaacaagatgtggatgacgaatatggagtcagtcaggccctagcccgcggactgcagagctactatgcagtcgctcacgccgttactgaacgggtggacaagcagagtgccctcatggtcaacggagtgctgaagcagtaccagattaaaggcctcgagtggctggttagtctctacaataataacctgaatggtattttagccgatgaaatgggccttggaaagaccattcaaactattgctctaatcacctacctcatggaacataagcgcatcaacggaccttttctgatcattgtccccctctcaactctatcaaattgggcctacgagtttgacaaatgggcccccagtgtggtgaaggtcagctataaaggaagtcctgccgcgcggagagccttcgtgccacagctgagatctggtaaatttaacgtgctcctgaccacttatgaatacattattaaagacaagcacatcctggctaagattcggtggaagtatatgatcgtggatgaggggcatcggatgaagaaccaccactgtaaactgacccaggtgttgaatactcactatgtggcaccccgacggctcctgctcactggaacgccactgcaaaacaagctgccagagttgtgggctctgctgaatttccttttgcctaccattttcaaaagctgttctacattcgagcaatggtttaacgccccattcgctatgacaggtgaaaaggtcgacctgaatgaagaagagacaatactgattattcgtagactgcacaaagtgttaaggccattcctcttgcgcagactgaagaaggaagtagaggcacagctgccggagaaggtagagtacgttattaagtgtgatatgagcgcactgcagcgcgtcctttatagacatatgcaagccaagggcgtgctgttgacggacggctcagaaaaagacaaaaaggggaagggtggcactaaaaccctgatgaataccatcatgcagctgcggaagatctgcaatcatccatatatgttccagcacatcgaggaatccttctctgaacacctgggattcacaggtggaattgttcaggggctggatttgtaccgagcttctgggaaatttgagctcctggaccggattttgccaaagttgcgggcaaccaaccacaaggtcctgctgttttgccaaatgactagtctaatgacaattatggaggactattttgcataccgtgggttcaagtacctgagactggacggcacgacaaaggctgaagataggggcatgcttttgaaaaccttcaatgagccagggtcagaatacttcatatttctactgtctacgagggctgggggcctaggacttaacctacagagtgccgatacagtgattatattcgacagcgactggaacccacaccaagacctgcaggcgcaagatcgtgcccatcgcattggccagcagaacgaagtgcgtgtgctgcgtctgtgtacagtcaattcggtcgaggagaaaatcctggcggctgctaaatacaagctcaacgtagatcagaaagtgatccaagccggaatgtttgaccaaaagtctagcagtcatgagcgccgggcctttttgcaggccatcctggaacacgaagaacaagacgaatcacgccattgttctaccggtagtggctccgcctcttttgcacataccgctccaccacccgcgggagtcaatccagacctggaagagccccctctgaaggaagaagatgaagtccctgatgacgaaaccgtgaatcagatgatcgcgaggcacgaagaagagtttgacctgttcatgcgaatggacttggaccgtcggcgcgaggaggcgcgaaaccccaagcggaaaccgcgccttatggaggaagatgaactgccctcctggatcatcaaggatgatgctgaagtggaaagactgacatgcgaggaggaagaggagaaaatgttcggaaggggatccaggcaccggaaggaggtggactactctgactccctcaccgagaagcagtggcttaagaaaattacaggcaaagacatacacgacaccgcaagttcagtggccagggggctgcagttccagcggggccttcaattttgcacccgtgctagtaaagcaatcgaagagggtactttggaagaaattgaagaagaagtgagacagaagaagagctctcgcaaacgcaagagggactcagatgctggcagttctactccaacaacatccactcgctcacgggacaaagatgacgagtccaaaaaacagaagaaacgtggcagacctccagcggaaaagttgagtcctaaccctcctaatctgactaaaaagatgaagaaaatagtggacgccgtgatcaaatataaagactccagcagcggcaggcagctgtccgaggtctttatacagctgccctcaaggaaggagctgccagagtattatgagttgattaggaagcccgtagattttaagaaaattaaagagcgcattagaaaccataaatatcgctcactcaacgacctcgaaaaagacgtgatgcttctatgtcagaatgcccagacattcaatcttgagggtagcctaatctatgaggattccattgttctgcagtcagtgtttactagcgttagacagaagatagaaaaggaagatgattctgaaggtgaagaatcggaagaggaggaggaaggtgaagaagagggctcagagtctgagtctaggagtgtgaaggtcaagatcaagttgggaaggaaggagaaagcccaggacaggctgaagggtgggagacgaaggccctcacggggttcccgggcaaagcccgttgttagcgatgacgactctgaagaggagcaggaagaagatcgcagtgggagcgggtcggaagaggactag

SEQ ID NO: 207563 - DNA, 4854 bp, Artificial Sequence
  Description of Artificial Sequence: Synthetic coding sequence
atgagcacccccgacccccccctgggcggcaccccccggcccggccctagtcctggcccaggccctagcccaggcgctatgcttggtccttcaccaggccccagccctgggagcgcccattcaatgatggggcccagtccgggcccgccatcagccgggcacccaattcctactcagggacctggaggctatccgcaagataatatgcatcaaatgcataagcccatggaatccatgcatgagaaagggatgagtgacgatccaagatacaatcagatgaagggaatgggtatgcggtcaggaggacacgccgggatggggcctccaccgtcccccatggaccagcactcccaggggtatccatcgccgctcggtggctccgagcatgcgtctagccccgtaccagcctcaggaccatcttcgggtcctcagatgtcatccggtcccggtggggccccccttgatggcgctgacccacaggcccttggccaacaaaatagaggccccacgccatttaatcaaaaccagctgcaccaactaagagcccagatcatggcctacaagatgctggcacgggggcaacccctgcctgaccacctacagatggccgttcagggaaagaggcccatgcctggaatgcagcaacagatgcccactctcccgcctccgtcagtgagtgccactggtcctggccctggcccgggaccgggtcccggaccaggtccagggcccgcgcctcctaattactcaagaccccacggtatgggcgggcccaatatgcctccaccagggccctccggagtcccacccggcatgcctgggcagccaccagggggccctcctaagccttggccagagggcccaatggccaacgcagctgctcctacaagtactccgcagaagctcatcccacctcagcccaccgggcgaccgtctcctgcccctcctgctgtgcccccggcagccagcccagtgatgcccccacagactcaatcccccggccaacccgcccagcctgccccgatggtccctctgcatcagaaacaaagcaggattacgcctatccagaagcctaggggactagaccctgtggagatcctgcaggagagggagtacaggttgcaagcgaggatcgcccatcgaattcaggagcttgaaaacctgccaggttcccttgccggcgatctgaggactaaggctacaattgagctgaaggccctgagactgctcaacttccagagacagctccgtcaggaggtggtggtctgtatgaggcgagatactgctctcgaaaccgcactgaatgctaaagcctacaagagatctaagcggcagtccctgcgtgaagcacggataacggagaagttagagaagcagcaaaagatcgagcaggagaggaaacgtagacagaagcatcaggagtacctgaattccatcctgcagcacgccaaggattttaaagaataccacaggagcgtaacagggaagatacagaaattgactaaagccgttgctacataccacgccaataccgagagagagcaaaaaaaggagaatgagcggattgagaaagaaagaatgcgaagacttatggcggaggatgaagagggatacaggaaactgatcgaccagaaaaaagataagagattggcctatctcctccagcagacagatgagtatgtggccaacttaaccgagctcgtgcgtcagcataaggctgcccaggtggccaaagaaaagaagaaaaagaagaagaagaagaaggcagagaatgcggagggtcagactcccgcaatcggccccgatggtgaaccactggacgagacatctcagatgagtgacctgcctgtgaaggtgatccacgtggaaagtgggaaaatcctcacaggcaccgacgctccaaaagctgggcaacttgaagcctggttagagatgaatcccggctacgaggttgctccacgctcagactccgaagagagtggcagtgaagaagaggaagaggaggaggaggaagagcagccccaggctgcccaacctccgacgcttccagtggaagagaagaagaagattcccgaccctgatagtgatgacgtgtctgaggttgatgcaagacatatcattgagaacgcaaaacaagatgttgacgatgagtatggggtgtcccaagccctggccagaggcctgcaaagctactatgcagttgcgcacgccgtgacggagcgagtagacaagcagagcgcacttatggtcaacggcgtgctgaagcagtaccagattaaagggttggaatggttggtttctttatacaacaataacctaaacggcatcctggccgacgaaatgggattgggaaaaacaattcagacaatcgctctgatcacatacctgatggagcacaaacgaataaatggccccttcctgatcattgtccctttatcaactttgtcaaattgggcctatgagttcgataaatgggcgccttctgtggtcaaagtgtcctataaaggttccccggcagcgcgccgcgcctttgtcccacagctgaggagcgggaagttcaacgtgttacttaccacatacgaatatataatcaaggacaaacacattctggctaaaattcgatggaaatacatgatcgtggacgaaggtcataggatgaaaaaccatcactgcaagctgacccaagtcttaaatacccactatgtggctccacgaagactgctcctgacaggaacaccactgcagaataaattgcctgaactgtgggccctactgaacttcctgcttcctacaatctttaagtcatgttctacatttgagcagtggttcaatgccccattcgcgatgactggagaaaaggtcgacttaaatgaagaggagacaatcttgatcattaggaggctgcacaaggttctccgaccctttctgctgcggaggctgaagaaggaagtggaggctcagctccctgagaaggtcgagtacgtgattaaatgtgatatgagtgctctccagcgagtgctttatagacatatgcaggccaagggagtgttactaaccgacggatcagaaaaggacaaaaagggaaaaggcggcaccaagaccctgatgaataccattatgcagctacgaaagatatgcaaccatccgtatatgttccagcatatagaagagagtttcagcgaacacctaggtttcaccggaggtatcgtgcaaggcctggacttataccgcgcttcgggcaaattcgagctcctggaccgcattctgccaaagctgagggctaccaaccacaaggttttgctgttttgtcagatgacatccctcatgaccataatggaggattactttgcatacagaggatttaagtacctgcggctggacggcactactaaagccgaggaccgagggatgctgctgaaaacattcaacgaacccggctcagagtacttcatcttcctcctttctactcgtgccggcggactgggcttgaacttacaatcagcggatacagtcattatatttgattctgactggaatccccatcaggaccttcaagcacaggatcgggcccaccgtattgggcagcagaatgaagtacgggtcctccgtctttgtaccgtgaacagtgtcgaggagaaaattcttgcagcagcaaagtacaagctgaacgtggatcaaaaggttatccaagccggcatgttcgatcagaagtcttccagtcatgaacgaagggcctttctccaggccattttagaacacgaagagcaggacgaggaagaggatgaggtacccgatgacgaaaccgtgaaccagatgatcgccagacacgaggaggaatttgacttattcatgcgcatggacttagaccggagacgggaggaagcacgtaatccgaagcgaaaaccacgactgatggaggaagacgaattgcccagctggataataaaagacgacgcagaagtggaacgcctcacgtgcgaagaggaagaggagaaaatgttcggcagagggtccagacatagaaaagaggtggactattctgactctctcaccgagaagcaatggctgaagactctcaaggcaattgaggaaggcaccctcgaggaaatcgaagaagaagtgcggcagaagaagtccagtcgaaagagaaaacgcgacagcgacgctgggagcagcacaccaaccaccagcacacgctctcgggataaggatgatgagtccaaaaagcaaaaaaaacgaggaaggccccccgccgagaaattgagcccaaacccgccaaacctgacgaaaaagatgaagaagatagtcgatgctgttatcaaatacaaggactcaagcagtggcagacagctgtcagaggtgttcatacagcttccgtcccggaaagaattgccagaatattatgagctcattaggaagccagtcgatttcaagaagattaaagagaggatcaggaaccacaaatacagaagcctgaacgatctcgaaaaagacgtcatgctgctctgccagaatgctcaaacctttaacctagaagggtcattgatatatgaggactccatagtcttacagagcgtgttcacttcagtccgacagaaaatcgagaaggaagatgactctgaaggagaggaatccgaagaagaagaagagggtgaggaggaaggaagcgaatcagagagcagatctgtgaaagttaagattaaactggggcgcaaggagaaagcacaggacaggctcaaaggaggaaggcgtcggccctctaggggatccagagcgaaacccgttgtcagcgatgacgacagcgaggaagaacaggaagaggaccgcagtgggagcgggtccgaggaagattag

SEQ ID NO: 207564 - DNA, 5046 bp, Artificial Sequence
  Description of Artificial Sequence: Synthetic coding sequence
atgagcacccccgacccccccctgggcggcaccccccggcccggcccatcaccaggccctgggccatctccaggggctatgctggggccatcaccagggccgtccccgggatctgctcactcgatgatgggcccctctcctggtccccccagcgcagggcatcccatcccaactcagggtccaggaggctatccgcaggataacatgcatcaaatgcacaaacccatggaatcaatgcatgaaaagggcatgagtgatgatccccgctataatcagatgaagggtatgggtatgcgctcaggggggcacgccgggatggggcccccccctagtcccatggatcagcactcccagggctacccatccccgcttggtggaagcgagcacgcaagctctccagtccccgctagtggcccttcatcgggaccacagatgtcatccggccccggaggagcacctctagacggtgccgacccccaggctctggggcagcagaatcggggccctacgccatttaaccagaatcagctgcatcagttacgtgctcagattatggcctataagatgcttgctcgaggccagccgttgcctgaccacctccagatggccgtgcagggtaaacgtcccatgccgggtatgcaacagcaaatgcccaccctccctcctccgtctgtgagtgctacagggccagggcctggacctgggccaggacctggcccaggccccggacccgctccccctaattacagccgccctcacgggatggggggcccgaatatgcctccaccaggcccatcaggtgtgccacctggcatgcctggccaacccccaggggggccaccaaaaccgtggcctgagggccctatggcaaacgccgctgcccccacttcgacccctcaaaagctaatcccaccccaacctactggcaggccaagcccagcaccacccgccgttccacccgctgcatcccctgtgatgcctcctcagacgcagagtcctggccagccagcgcaacccgcccccatggtacccttgcatcagaaacagtcacgaatcacacctatacagaaaccccgagggctggatccagtcgaaatcttgcaagaacgtgagtataggctccaggcgaggatcgcccatcgcattcaggagctcgaaaacttgcctggatcactcgccggcgatttgagaactaaggctaccattgaactaaaggccttacgcttactgaacttccaacggcagctaagacaggaggtggtggtgtgcatgcgccgcgatacagctctcgagaccgcactgaacgcgaaagcctacaagcgaagcaaacgacaaagtctcagagaggctcggatcactgagaaactggagaagcaacagaaaatcgaacaggagcgcaagcggaggcagaaacaccaagagtatttgaattccattctgcaacacgcaaaagatttcaaggagtaccataggtctgtaaccggcaaaatccagaagctgactaaagctgtggcaacgtaccatgccaacactgagagggagcaaaagaaggagaacgaaaggattgagaaggaacggatgaggagactaatgggacaacgggaaaaatctaggagaggcttgggctcacagtcctgggctcgcatttttgcagacctgagtgatcatcaaaacgactgcgtgactagcgtaacagagagtttggttggccagattctggcagcatgctccggagaggagggagaggtcgagtggaaagggcgagatagagtaagacgtttacgagcagaagacgaggaaggatatcgcaagctcatcgatcagaagaaagacaagcgtctcgcttatctcctgcagcagaccgacgaatatgtagctaacctgaccgagctggtgagacaacacaaggcagcacaagtcgcgaaggagaaaaagaagaagaaaaaaaaaaaaaaagcagaaaatgctgaagggcagacgcctgccatcggcccagatggagagccactggacgagacatctcagatgagtgatctgcctgtcaaagtgatccacgtggagagcgggaagatcctcactggtacggacgccccaaaggctggccagctcgaggcatggctggagatgaatccaggatatgaagtggccccgcggtcggactcagaggaatccgggtccgaagaggaggaggaggaggaagaagaagaacagccccaagctgctcaaccccctacactgccagtcgaagagaagaaaaagattcctgacccagattctgatgatgtgtctgaggtggatgctcggcatattatcgagaacgcaaagcaggatgtagacgacgaatacggggttagccaggctttggccaggggtttgcagtcgtattatgccgtggcccacgccgtcaccgaaagagtcgacaagcaatctgcccttatggtaaacggtgtactcaaacagtatcagataaagggactcgaatggctggtttccctatacaacaataatctcaatggtatcctcgcagatgaaatgggcctaggcaagacaatccaaacaatcgccttgatcacataccttatggaacacaaaagaataaacggcccatttctgattattgtgcccctgtctacactgtcaaattgggcctatgaatttgataagtgggcaccctctgtcgttaaagtttcctacaaaggtagtcctgccgccaggcgtgcttttgttcctcagctccgctcaggaaaatttaatgttcttctgactacctacgaatacatcataaaagataaacacattctggccaaaattcggtggaaatatatgattgttgacgaagggcatcgcatgaagaaccaccattgcaagctgacacaagtactgaatacccattacgtagcgcctcgtcgcctgctgctgaccgggactcctcttcaaaacaagcttcctgaactgtgggccttactgaacttcttgttacccacaatctttaagagctgctcaaccttcgagcagtggtttaatgctcctttcgcaatgaccggagaaaaggtagatctcaacgaagaggagactatcctgattatcaggcggctgcataaagttctgcgaccattcttgctgagaaggttaaaaaaggaggttgaggcccagctgcccgaaaaagttgagtacgtgattaaatgcgatatgtcagcccttcagcgcgtgctctacagacacatgcaggcaaagggcgtcctgcttactgatgggagcgagaaggacaagaagggcaaggggggcaccaagaccctgatgaacaccatcatgcagctgcgcaagatctgtaatcacccctacatgttccagcacattgaggaatcattctccgaacacctgggctttacaggaggcatcgttcagggcctcgatttatatagggcttctggcaagttcgagcttttagaccggattctgccaaaattgagggctaccaaccacaaggtgcttctgttttgtcagatgacgagtctgatgaccattatggaggattacttcgcctacagaggtttcaagtatctccggttagacggaaccacgaaagcagaagatagaggcatgctgctgaaaacctttaatgagcccggttccgaatatttcatatttctccttagtacaagggctggcggcctcgggctcaaccttcagagcgctgataccgtcattattttcgatagcgactggaatcctcatcaagatcttcaagctcaagaccgcgcccacagaatcggacaacagaacgaagtgcgtgttctgagactgtgtacagtgaactccgtggaagaaaaaatactggccgcggccaagtataagttgaatgtggaccagaaagtcattcaggcagggatgttcgatcagaagagcagctctcacgagcggcgggcgttcctgcaggctatcctggagcacgaggaacaggacgaagaggaggacgaagttccggatgacgaaacggtaaatcaaatgattgctcggcatgaagaagaatttgatttatttatgaggatggatcttgacaggcggcgcgaggaggccaggaatcccaagcgtaaacccagattaatggaggaagacgagttgccgtcctggatcatcaaagatgatgcagaggttgagagattgacctgtgaggaagaggaagagaagatgttcggcaggggcagccgccatcggaaggaggtggactactctgattctttgaccgagaaacaatggcttaaaactttgaaagccattgaggaaggaacgcttgaggagatagaagaagaagtgcgccagaaaaagtcttctagaaaaaggaaaagggattcagatgctggatcatccaccccaaccacatctactcgcagccgtgacaaagacgacgaatccaagaagcagaaaaaacgaggaagaccacccgccgaaaagttaagtcctaaccccccgaatctgaccaagaagatgaaaaagatcgtggacgctgtgattaagtacaaagactccagtagcgggcggcagctttcggaggtctttattcagttaccttcacgaaaagagcttccggagtactatgaactaattaggaagccagtcgattttaagaaaatcaaggagcgaattagaaatcacaaatatcgctcgctgaatgatctcgaaaaggacgtgatgcttctttgccaaaacgcccagacgttcaacctcgaaggaagtctaatctacgaggattcaatcgtactgcagagcgtgtttacttccgtcagacagaagatcgagaaggaagacgattcggagggggaagagtcagaagaggaggaggaaggagaggaggagggatcagaatctgaatctcgttcagtcaaggtcaagattaaattagggcggaaggagaaagcccaggatcgactgaagggtggccgaagaaggccttcacggggcagccgggctaagcctgtggtgtccgatgatgatagtgaggaggaacaagaagaggaccgaagtgggtcgggatcagaagaagactag

SEQ ID NO: 207565 - DNA, 4944 bp, Artificial Sequence
  Description of Artificial Sequence: Synthetic coding sequence
atgagcacccccgacccccccctgggcggcaccccccggcccggcccctccccaggtccgggcccatctcctggcgccatgctcgggccttctccaggcccatcgccaggcagcgcccattccatgatgggtccgtcacctggaccaccaagcgccggacatccaatacctacacagggacctggtggctacccacaagacaacatgcatcagatgcacaaacctatggaatcaatgcacgaaaaaggaatgagcgacgatcccagatacaatcaaatgaaggggatgggaatgcgatctgggggacatgctgggatggggccacctccctctccgatggatcagcactctcagggctacccaagtccactgggcggaagcgagcatgcctcatccccagtgccagcgagcggcccttcctctggaccgcagatgagttccgggcctgggggtgcacctctagacggcgccgacccacaggctctgggacagcagaatagaggacctaccccttttaatcagaaccaattacatcagttgagagcgcagattatggcttacaaaatgctagcccggggacagcctctcccagaccatcttcagatggctgtgcaagggaagcgtccaatgcctgggatgcaacagcagatgcccactctgccccccccaagcgtgtccgctaccggccctgggccgggcccaggtccagggcctggcccgggccccggcccagccccacccaactactctagaccccatggaatgggaggtcccaatatgcccccgcctgggccctcgggcgtgccaccagggatgcccggccagccacccggcgggccccctaaaccatggcccgagggtccaatggccaatgctgctgccccaacaagtacaccacaaaagctgataccaccccaacccacgggtagacccagtcccgccccacctgctgtccctccggccgctagtcctgtaatgcctccccagacccagagcccagggcagcctgctcaacctgcccctatggtccccctgcaccagaaacagtctcgaatcactcccattcagaagcccaggggcctggacccagttgaaattctgcaggagagagaatatagattgcaggccagaattgcccatcggatccaggagctggagaatttgcctgggagtctggccggagacttgcggactaaggccaccattgagttgaaagcgctgagactcttgaacttccaacggcagctcagacaggaagtagtcgtctgcatgcgccgtgacacagccctggagactgcgctgaacgctaaggcctacaagagatccaagcggcagtctctccgggaggccagaataactgagaaattggaaaagcagcagaagattgaacaggaacggaagcgacggcaaaagcatcaagaatatcttaacagcatactgcagcacgccaaagactttaaggaataccacagatccgtgaccggcaagatccagaaacttactaaagccgtcgcaacctaccatgccaatacagagagggagcaaaagaaagaaaacgagcggattgaaaaggagaggatgcgtcgattgatggctgaagacgaggagggatacagaaaactgatcgatcaaaagaaagacaagaggctagcctatcttctgcagcagacggacgagtacgtggccaacttgacagagcttgtcaggcagcacaaagccgcacaggttgccaaggaaaagaagaaaaaaaaaaaaaagaaaaaagcggagaatgccgaggggcagacaccagccatcgggcccgacggggagccgctcgatgagacaagtcagatgagcgatttgcccgtgaaggtaatccacgtagaatccggtaagattcttacaggcaccgacgctccaaaagcgggccagctggaggcctggctcgaaatgaatcctgggtatgaggttgcacctcgctcagattctgaggaatcggggtctgaggaagaggaagaagaggaggaggaggagcaaccccaagccgcccagcctcccacgctgcctgtggaggaaaaaaaaaaaattcccgatcctgatagcgacgacgttagtgaggtggatgcacgccatatcatcgaaaacgccaagcaggacgtagacgatgagtatggagtctcccaggccctggctagggggctacagtcctattacgctgtcgcccatgctgtgacagagagagtcgacaagcagagcgctcttatggtaaatggcgtgctgaaacagtatcagatcaaagggctcgaatggctggtgagcctctataacaacaaccttaacggtatactcgcagacgagatgggactcggtaagaccatccagaccatagctcttattacctatctcatggagcacaaacgtattaatgggccattcttgattatagtcccactttcgaccctgtctaactgggcctacgagtttgacaagtgggcccctagcgtagtgaaagtctcctataagggttcacctgctgccagaagggccttcgtgccgcagctaagatcaggtaaattcaatgtgctactgaccacatatgagtacataattaaagacaaacacattctggccaaaatacgttggaaatatatgattgtcgatgagggtcatcgtatgaaaaaccaccattgcaagctgacgcaagtgttgaatactcattatgttgcgccccgcaggctgctgctgactggaactccactccagaataaactgccagaactctgggcattgctgaacttcttactccccacaatttttaaaagctgctcaacgtttgagcagtggtttaatgccccctttgcaatgactggggaaaaggtggacctgaacgaggaagaaacgatcctgattatcagaagattacacaaggtccttaggccattcctcctgagaaggctcaagaaagaagtcgaggcccaactaccagaaaaagtggaatatgtcatcaaatgcgacatgtctgcccttcagcgcgtgctgtatcggcacatgcaggccaaaggagtgttgctgactgatggttctgagaaggacaagaagggcaaaggtgggaccaaaactttaatgaatacaattatgcagcttcgcaaaatatgcaaccacccatacatgttccaacacattgaggaaagcttctcggagcatctggggttcactggcggcatcgtccagggcctggacctgtaccgcgcgtcaggcaagtttgagctccttgataggatcctgcccaagttgagggcaaccaatcacaaggtgcttctcttctgccagatgacaagtctgatgactataatggaagactacttcgcataccgcggatttaagtatctgcggctcgatggcacaaccaaggcggaggatcgcgggatgctgctgaaaacttttaacgaaccagggtcagaatattttatctttctgctaagtacacgggccggcggactcggactgaacctccagagtgccgacacagtgatcatttttgattcggattggaaccctcatcaagatttgcaagcccaggatagggctcacagaatcggacagcagaacgaggtcagggtcctgcgactttgtactgttaattcggttgaggaaaagatactggccgctgcaaaatacaagctaaacgttgaccaaaaggtgatccaggcggggatgttcgaccagaaatccagttcccatgagcggcgagcttttctccaggccattttagagcatgaagagcaagatgaaagccggcattgttcaacaggatccggatccgcctcatttgcacacaccgctcctccacctgcgggggtgaatcccgacctcgaggaaccccctctgaaagaggaggacgaagtgccggacgacgagacagtgaaccagatgatcgcacgccatgaagaagaattcgacctgttcatgcggatggatcttgaccggcgtagagaggaagctcgtaatcccaagaggaaaccaagactgatggaggaggacgagttgccctcctggatcataaaagacgatgccgaggttgagcggctgacatgcgaagaggaggaagaaaaaatgtttggacgtgggtccaggcatagaaaggaggtcgactacagtgattcattgacagagaagcagtggctcaaggcaatcgaggaaggtacactggaggagatcgaggaggaagtgagacaaaaaaaatctagcaggaaacggaaacgggactccgacgccggaagcagtactccaaccacttcgacaaggtccagggacaaggatgatgaatctaagaagcaaaagaagaggggccggcctcctgctgagaagctatccccaaatcccccaaatctgactaagaagatgaaaaaaatagttgatgccgtcataaaatacaaggattcaagctcaggtaggcagctgagcgaagtctttatacagctgccttcaagaaaagaactccctgagtattatgaactgatacggaaacctgtggatttcaagaaaatcaaggaaagaatcagaaatcacaagtatcgcagcctgaacgatctggaaaaggacgtgatgctgctctgccagaacgcccagacatttaacttggagggatccctgatttatgaggactctattgtgcttcagagcgtgtttacctctgtgcggcagaagatagaaaaggaagacgactccgagggcgaggagagtgaagaggaggaggagggagaagaggagggctcagagtccgaaagtagatctgtcaaagtcaaaattaaacttgggaggaaagagaaggcacaggatcgactcaaaggggggcggcggaggccctcgagaggcagtcgggccaagccagtggttagtgacgacgactctgaagaagagcaagaggaagacagatctgggtcaggatctgaggaggactag

SEQ ID NO: 207566 - DNA, 4842 bp, Artificial Sequence
  Description of Artificial Sequence: Synthetic coding sequence
atgagcacccccgacccccccctgggcggcaccccccggcccggccctagtccaggaccgggacccagcccaggggctatgctcggcccctcccctggcccttccccggggagtgcccatagtatgatgggccctagccctggccctccatccgcaggccatcccatcccgacccagggtccaggtggctatcctcaggacaacatgcatcaaatgcacaaacctatggagagtatgcacgagaaaggtatgtccgacgatccgcgctataatcaaatgaaaggaatgggcatgaggagtggggggcatgctggaatgggaccaccaccctctccaatggaccagcattcccaaggttatccttcgccacttgggggtagcgagcacgcaagtagtcctgtgcctgcctcaggcccgagttccggcccccaaatgtcttcaggtccagggggggcccctttggatggggcagatcctcaggccctgggccagcagaacagaggtccaaccccattcaatcagaatcagctccatcagctacgagctcaaatcatggcttataaaatgctcgcccgtggccaacccctccctgatcatctgcaaatggctgtccagggtaagagaccaatgcctggcatgcagcaacagatgcctacactgcccccaccctccgtctcagcaactggccctggcccaggcccagggccaggacccggacctggtcctggccccgctcctcctaactactcccgacctcacggcatggggggaccgaacatgcccccccccgggccaagtggagtcccccccggcatgccggggcagccccccggcgggccccccaaaccttggcctgaggggcctatggcgaacgctgccgcacctacgtctaccccccagaagctcattccccctcagccaacaggcaggcccagtcccgcacccccagccgtgccacccgcagcctcaccagtgatgcccccacagacccagtcacctggacagcctgcacagcccgcgccgatggtcccgctgcaccagaagcagtctcggatcactcctatacaaaaacctcgcggtcttgatcctgtggaaatcctccaggagcgcgagtataggctgcaggcacggatcgctcacagaattcaagagctggaaaatcttccaggctccctggcaggggatttacgcaccaaagcaaccattgagctgaaagccctccgtctgctcaacttccagagacagctgcgacaggaggttgtcgtatgcatgagacgcgacactgctctggaaaccgctctaaacgcaaaagcatacaagagaagcaagcggcaatccctgagagaggctaggataaccgagaaactggagaagcagcaaaagatcgagcaagagagaaagcgcagacaaaagcaccaagaatatctcaacagtatccttcaacatgccaaagattttaaggagtaccatcggtccgtgacaggcaaaatacagaaacttaccaaagccgtggcgacctatcacgctaacactgaacgggagcagaagaaagagaacgaacgcattgaaaaggaaagaatgaggcgtctgatggcagaggacgaggaaggttatcgaaaactgatcgaccagaaaaaagacaaacgacttgcgtacctgctgcaacagacagacgaatatgtggctaacttgaccgaactggttaggcagcacaaagctgcgcaggtcgccaaagaaaaaaagaagaagaagaaaaagaagaaagcggaaaacgctgaaggacaaacacctgctatcggtcctgacggcgagccccttgatgagaccagccagatgagtgacttgccggtgaaagtgatacacgtggagtccggaaaaattctgacaggcaccgacgccccaaaggctggccagctagaggcgtggctggagatgaaccccggatacgaggtagctcctcgctccgacagcgaggagagtggatccgaagaggaggaagaagaggaagaagaggagcaaccacaggccgcacagcctcccaccctcccagtggaagagaagaaaaagattccagaccccgacagcgacgatgtgagcgaagtggatgccaggcatattatcgaaaacgcaaagcaggacgtcgatgacgaatacggcgtcagccaggccctcgcccgaggactgcagtcttattacgcagttgctcacgcagtaactgaacgagtggataagcagtccgccctgatggttaacggcgttctaaaacagtaccagattaagggtctcgagtggttagttagcctttacaataataatctcaatggcatcctggctgacgagatgggcctgggcaagaccattcagacaatcgctctgattacatatctcatggagcacaagcgcattaatggaccgttccttatcatcgtacccttatctactctatctaactgggcttacgagtttgacaaatgggccccttctgtggtgaaagtgtcctataagggttcacccgccgcacgccgggcctttgtgccccagctgcgttccggcaagtttaatgtcctacttacaacatacgagtacatcataaaggacaagcatatacttgccaaaatccggtggaagtatatgatcgtagacgaaggacaccgaatgaaaaatcaccactgtaagctgactcaggtgctgaacacacattacgtcgctcccagacgtctactgctcaccggaacaccgctccagaacaagctgcctgaactctgggccctccttaactttctgcttcctaccattttcaagtcctgcagcacttttgaacaatggttcaatgcgcccttcgccatgaccggcgagaaagttgatctcaatgaggaagaaaccatacttatcataaggaggttgcacaaggtactgaggcctttccttctgcggcgcctgaaaaaggaagttgaggcacagctccctgaaaaggtcgaatacgtgattaaatgcgacatgtcggcactgcagcgggttttgtaccgtcacatgcaggctaagggagtgctcctcactgacgggtcagaaaaagataagaaaggcaagggcggaaccaagacgctcatgaataccattatgcaactgaggaagatttgcaatcacccttacatgtttcagcatatcgaagaatcctttagcgaacacctagggttcactgggggtatcgtgcaagggctggacctgtatagggcttccggcaaatttgagttacttgacaggatcttgcccaaactgcgcgctacaaaccataaggtgcttctgttttgccaaatgacatcactgatgactatcatggaggactacttcgcctatcgagggtttaagtacctgaggcttgatggcacgacaaaggctgaagacaggggtatgcttttaaagacttttaatgagcctggttccgagtacttcatctttctcttgtctacccgtgctggcggcttggggttgaatctccagagtgccgacacagtgataatctttgactcagactggaatcctcatcaggacctccaggcccaggatcgcgcccaccgcattggacagcagaacgaagtgagggtgctgaggctgtgtaccgtcaactcagttgaagaaaaaattctggccgccgcaaagtacaagctcaatgtggatcagaaagtgatccaggccggcatgttcgaccaaaagtctagttctcacgagaggagggcttttctgcaggctattctcgaacatgaagaacaagacgaagaagaggacgaagtacctgatgacgagaccgtcaatcagatgatcgcgaggcatgaagaggagttcgacctgttcatgcgtatggaccttgatcgtaggcgggaagaggctcggaaccccaagagaaagccccggttaatggaggaagacgaactaccaagctggatcattaaggatgacgccgaggtcgagcgtctgacgtgcgaagaggaggaggaaaaaatgttcggtcgcggtagtagacatcggaaagaggttgactatagcgatagccttactgaaaaacaatggctcaaagccatcgaagaagggactttggaggaaattgaggaggaagtccgacagaagaagtcaagccggaagcgaaagagagattcagatgccggctccagcaccccgactacaagtaccaggtctcgagacaaagacgacgagtctaaaaaacaaaagaaacggggaagacctccagcagagaagctgagtcccaatccaccgaacctgaccaagaagatgaagaaaatcgtggacgctgtgatcaaatacaaggacagctccggtaggcagctgtctgaggtgtttatccaactaccatccaggaaggagttgcctgaatactacgagctgatcaggaagccagtggattttaagaaaattaaagagcggattcggaatcacaaatacagatccctcaatgacctcgagaaggacgtgatgttactctgtcagaatgcacagacattcaatctggaaggttctctcatctacgaagatagtattgtcttacaatccgtcttcacttctgtcaggcaaaaaatcgaaaaggaggacgactctgagggagaggaaagtgaggaagaagaagagggcgaggaagagggcagcgagagcgagtcccgctctgtgaaagtcaaaatcaagttgggccgcaaggaaaaggctcaggatagattaaaaggaggcaggcgtaggcccagtagggggtctagagcaaaacccgtcgtttctgacgacgattccgaggaagagcaggaggaggaccgatctgggtcgggcagcgaagaggattag

SEQ ID NO: 207567 - DNA, 4851 bp, Artificial Sequence
  Description of Artificial Sequence: Synthetic coding sequence
atgagcacccccgacccccccctgggcggcaccccccggcccggccccagcccggggcccggtccttctccaggagccatgttgggaccatcgcccggacctagtccaggctccgcccactcaatgatgggtcctagtcccggaccccctagcgcaggacaccctattcctactcagggtccaggtgggtacccccaagataatatgcaccagatgcacaagcctatggagagcatgcatgagaagggtatgtccgacgatcctagatacaatcagatgaaaggaatggggatgcgaagcggagggcatgccggtatgggccctcccccttcaccgatggaccagcattcccagggatacccgtcacccctgggcggctcagagcacgcttctagccctgtgccggcctccggccccagttcaggaccccagatgtcctcagggcctgggggagcccccctggatggggccgacccccaggctctcggtcagcagaatagaggacctaccccgttcaaccaaaatcaactccaccagctacgcgcacagatcatggcatataagatgctcgcccggggacagccgctgcctgatcatctccaaatggccgttcaagggaagagaccaatgcccgggatgcagcaacaaatgcccacactcccccctccaagtgtgtctgccacaggacctgggcccgggccagggcccggacccggcccaggtcccggcccggccccacctaactactctagacctcacgggatgggcggcccaaatatgccacccccaggacccagcggggttcctcccgggatgcctggacaaccacccggagggccccccaagccctggcctgagggaccgatggccaacgctgccgcccccacaagcacaccccaaaaactcattccaccacagcccactggtagaccgtctcccgcgcccccggccgtgccccccgctgcgagcccagtaatgccaccacaaacacagtcaccaggacaaccagctcagcccgcacctatggtgccattgcaccaaaagcagagccgcatcacacccattcagaagccacgggggctggaccccgtggaaatactacaagagagagagtaccggctgcaggcccggatcgcccaccggatccaggagcttgaaaacctcccaggttcactggcaggcgacttgagaactaaggctacaatagagctcaaagccctcagactgttgaattttcaaaggcaattgaggcaggaggtagttgtttgcatgcgaagagacactgctttggagaccgccctgaacgccaaagcttacaagcggtctaaaaggcagtcccttagagaggcgaggatcactgagaaattggagaaacagcagaagattgaacaggagcgcaagaggcggcagaagcaccaagaatacctgaactccatactgcaacacgcgaaagactttaaagaatatcatcgctctgtcaccgggaagattcagaaactgacaaaggccgtggccacatatcatgctaacaccgaaagggaacagaagaaggagaacgaaagaattgagaaagaaaggatgaggaggctaatggccgaggacgaggaaggctatagaaaattgatcgaccagaagaaggataaacggcttgcatatctcctgcagcaaacggacgagtacgttgctaatctgaccgaacttgtcaggcagcataaagcagcgcaggttgccaaagagaagaaaaaaaagaagaagaagaagaaggcagaaaacgccgagggccaaaccccagcgatcggcccggatggggagccgctggacgagacatcacagatgtccgacctgccagtgaaagtcatccatgtagagtctggcaagattctgactggtacagatgcaccaaaggcagggcagctggaagcgtggctggaaatgaaccccggctacgaggtagcaccaaggagtgactctgaagaaagcggatccgaggaagaggaggaagaggaggaggaggagcaacctcaggccgcccagcccccgaccctaccggtggaggagaaaaaaaagatcccagaccctgactctgatgatgtgtctgaggtcgacgcgaggcacatcatagaaaatgcaaaacaggatgtggacgacgaatacggtgtgtctcaggctctggcccgaggcctccagtcctactacgcagtggcccacgccgtgacagaacgcgtggacaagcagtccgcccttatggtgaacggcgttctgaaacaatatcagattaagggcttggaatggctggtctcattgtataacaacaatctgaacgggatcctggctgatgagatgggtctgggcaagaccatccagacaattgcccttataacgtatctgatggagcacaaaaggattaatgggcctttcctcataattgttcctctaagcacactctcaaattgggcctatgaattcgacaaatgggctccatcagtagtgaaagtgtcctataaaggctcccccgccgcacgcagagcattcgtgccccagctgagaagtggaaagtttaatgttctactgacaacctacgaatatattattaaagataagcatatcctggctaagattaggtggaagtatatgatcgtcgacgaggggcacaggatgaaaaaccatcactgtaagctcacacaggtgctgaatacacattacgttgccccacgacgtctcctgctgacggggacaccactgcaaaacaagctgcctgagttgtgggcattgttaaacttcttactgccgaccatcttcaagagctgctcaacttttgaacagtggttcaacgcaccttttgccatgactggcgagaaagttgatcttaatgaagaggagacaatcctcattatcagaagacttcataaagtcctccggccctttctgctgcgcagactgaagaaagaagttgaagcgcagctgccagagaaggtggagtatgtgatcaaatgtgatatgtcagcactgcagcgcgtgctttacaggcatatgcaggccaaaggtgtgcttctaaccgacggcagtgagaaagataagaagggtaaaggcggaactaagaccctgatgaatacaataatgcagttgcggaaaatttgcaaccacccttatatgtttcagcatatagaggagtcattttctgaacaccttgggttcacagggggcatcgttcaaggattagatttataccgagcgtctgggaagttcgagctgttggatcgcatcttgcccaaactgcgagccacgaatcataaagtgttgctgttttgccagatgaccagcctgatgacaatcatggaagactactttgcctatcgcgggttcaagtatctcagactcgatggaacaacaaaggccgaagacaggggaatgctccttaagacctttaacgagcccggatccgaatactttatttttttactgagcacgagagccggcgggcttgggctcaatcttcagagcgccgataccgtaattatctttgactccgactggaatccgcatcaggatctgcaggcccaggatagagcccacagaatcggtcagcagaatgaggtgagagtccttcggctgtgtacagtgaacagcgttgaagaaaagattctcgccgcagcgaaatacaagctcaacgttgatcagaaagtcatacaggccggcatgttcgatcagaagtccagctcccacgagcgacgcgccttcttacaggctatactggagcatgaggaacaggacgaggaggaggatgaggttcccgatgacgagacagtgaaccaaatgattgctcgccacgaggaagagtttgacctgtttatgcggatggacctggacaggcgtcgcgaggaggcccgcaatcccaagagaaaacctcgtctgatggaagaggatgagcttccttcatggattatcaaggatgacgccgaagtagagcgccttacctgtgaggaggaggaggaaaaaatgttcggccggggatcacgccacaggaaagaggttgactatagcgatagccttacggagaaacagtggttgaagacgttgaaagctatcgaggagggcacgctggaggagattgaggaggaagtccggcagaagaagagctcccgaaaacggaagagggactcagatgccggaagctctacccccacaacatccaccaggtcacgcgataaggatgacgagtctaaaaagcaaaaaaaacgaggaaggcctcctgccgaaaagctgagcccaaaccctcccaacctgaccaagaagatgaagaaaatagtggatgcagtcatcaaatacaaggacagttcaggaaggcagcttagtgaggtttttattcagctgccgagtagaaaagagcttcctgagtactacgaattaatcaggaaacccgttgatttcaaaaaaattaaggagaggatacgaaatcataagtacaggtccctaaacgatctcgaaaaagatgtgatgctgttatgtcaaaatgcacaaacttttaacctggaagggtctctaatttatgaggactctattgtgttacagagcgtgtttacaagtgttcgccagaaaatcgagaaggaagacgattctgaaggagaggaaagtgaagaagaggaggagggcgaggaggagggatcagagagcgaatcgaggagtgtgaaggttaaaataaaactagggaggaaggaaaaagcccaagaccggctaaaggggggtcgcaggagaccaagtcgcggatctcgggccaaaccggtggtcagcgatgatgacagtgaggaggagcaggaagaagaccgctcaggcagcgggtccgaggaggattag

SEQ ID NO: 207568 - DNA, 4845 bp, Artificial Sequence
  Description of Artificial Sequence: Synthetic coding sequence
atgagcacccccgacccccccctgggcggcaccccccggcccggccctagccctggccccggaccttcccctggagccatgctcgggccctccccaggtccaagtccaggttctgcccatagcatgatgggcccctcaccaggacctccgtctgccggccaccccatccctacccagggacctggcgggtatccacaggataatatgcatcagatgcacaagcccatggaatccatgcacgaaaaggggatgagcgacgaccctagatacaatcagatgaagggaatgggcatgaggtctggcgggcacgcaggcatgggaccaccgccttcgccaatggatcagcattcccaaggctatccctctcccctgggcgggtcggagcatgcctcttcccctgtccccgcgtcagggcctagcagtggcccccagatgtcttccggacccggtggcgctccactcgacggcgctgatccccaggcccttggacaacaaaatcgggggcctacgccatttaatcagaatcagctgcatcagctcagagctcagatcatggcgtacaagatgctcgcccgcggccaacctcttcccgatcacctgcagatggctgtccagggaaagcgaccaatgccaggaatgcaacagcagatgccgacacttccccctcctagtgtgtcggcaaccggtcctggacctggcccagggccagggcctggtccaggcccaggtccggcaccacccaactactcaagaccacacggcatggggggccctaatatgccgcctccaggacccagtggggtcccacctggaatgcctggccagccacccgggggccctcctaaaccttggcctgaagggccaatggccaacgcggcggctcccacaagtaccccacaaaagctaatcccaccgcaaccaacgggcagacctagtcctgctcctcccgctgtaccccccgccgcttctccagttatgccaccccagactcaaagtcccggtcaacctgcccaacctgcacccatggtcccactgcaccagaagcagagccgcataactcccatccaaaagcccagggggctcgatccggttgaaatcctccaagaacgggaatacaggttgcaggctcggattgcacacagaatccaagagctggaaaatctcccaggcagcctcgctggagacctgaggaccaaggccacaatcgagctgaaagcactgcgcctgctgaactttcaacgtcaacttagacaggaagtcgtcgtctgcatgcgacgtgataccgcactggagactgcactgaatgccaaggcgtacaagcgaagcaaacggcagagcctacgggaggctcggatcaccgagaaactcgagaaacagcagaagattgaacaggaacgtaagcgtcgccagaagcaccaggagtatctgaactccattctgcagcatgctaaagacttcaaggagtaccaccgctccgtaacgggcaaaatccagaaactgaccaaggctgttgcaacctatcatgctaacactgagagagagcagaagaaggagaacgagagaattgagaaagaaaggatgaggcgattgatggcagaagacgaggagggataccggaaactgattgaccagaagaaagacaaacgcctggcctatctactccagcagaccgatgagtatgttgccaaccttactgagctggtcagacagcacaaagctgcgcaggtggcgaaggagaaaaagaaaaagaaaaaaaagaaaaaagccgaaaatgccgaaggccagacccccgcaatcgggcctgatggtgaacccttggatgaaacaagccagatgtccgacttaccggtgaaagtgattcacgtcgagtcaggcaagattttaaccggcacggatgcaccaaaggcgggacagctggaagcatggcttgaaatgaatcccggctacgaggttgccccacggagcgacagtgaagagagcggtagtgaagaagaagaagaagaggaggaagaagaacagccacaagccgcgcagcctccaacattgccggtggaagagaaaaaaaagatccccgatccagatagtgacgatgtgtctgaggtcgatgcgcgccacatcattgagaatgcaaagcaggacgtcgacgacgaatatggcgttagccaggcattggcacgcggtctacagtcatactatgctgtagcccacgctgtgactgaacgggtcgataaacagtctgcgcttatggtcaacggcgttctcaaacagtatcaaattaagggtctcgaatggttagtgtccctctataacaacaatctcaacggaattcttgctgacgaaatgggcctggggaagaccattcagactatcgctctgataacttatctgatggagcacaagaggatcaatggaccctttttgattatcgttcccctttcaaccctaagcaactgggcttacgagttcgacaaatgggctccctctgtggtgaaggtcagctacaaggggtctccagctgcccgacgcgccttcgtgccccagctgagatccggtaagtttaatgttctgcttactacctacgagtacattattaaagacaagcatatcctagctaagatcaggtggaagtacatgatcgtagacgaagggcatcgtatgaaaaatcaccattgtaagctcacacaagtgctgaatacccactatgtggccccgcgtcgtctactgttgactgggactcctttacagaataaactgccagaactttgggcacttctgaatttcctgttaccaaccatttttaaaagctgttccacctttgaacagtggttcaatgcaccctttgctatgacaggcgagaaggtggacctgaatgaggaagagaccattctgattatccgccgcctgcacaaggtgctcagaccatttcttcttagacgtcttaagaaggaggttgaggcacagttgcctgagaaggttgagtacgtgattaagtgtgatatgtcagcactccagcgcgtgctgtatcgtcatatgcaggctaaaggcgtattgctgacagatgggtcagaaaaggacaaaaaaggcaagggggggactaagacattaatgaataccatcatgcagcttcgaaagatttgtaatcacccttacatgtttcagcatatagaagaatcatttagcgaacacctcgggttcacgggagggattgtacaggggctggacttgtacagagctagtgggaaatttgaactcttggacagaatattgccaaaactccgagcaacgaaccataaagtgttgctcttctgccaaatgacttctctgatgactattatggaagattactttgcttatcggggattcaaatacctgcgcctcgacgggactactaaagctgaggaccgcgggatgctcctgaagacttttaatgagcctggatcagaatatttcatctttctgctgtctaccagggccggaggattgggactcaacctgcaaagtgccgataccgtcatcatttttgatagtgattggaacccacaccaagacctgcaagcccaagacagggcacaccgcatcggacagcagaatgaggtcagggtacttcggctgtgcactgtcaactcggtcgaggaaaagattcttgctgcagccaaatacaaactgaatgtcgaccagaaggtcattcaggccgggatgtttgaccaaaaaagctctagtcatgagcgaagagcctttctacaagccatcctcgagcatgaggaacaagacgaagaggaagacgaagttccagatgatgagaccgtaaaccaaatgatcgccaggcatgaagaggagttcgatttgttcatgaggatggatctggatcgccggagagaggaggcccgcaatcctaaacgtaagcctcggctgatggaggaggacgagttacctagctggatcataaaggacgacgccgaggtcgagcggcttacatgcgaggaggaagaagagaaaatgtttggcaggggctctcgccaccggaaggaggtcgactactccgattcattgacggagaagcagtggctgaaggcgattgaggagggaactctggaagagattgaagaagaagttaggcaaaagaagtcctccagaaaacggaagagagattccgatgccggttcttctacccccacgacttcaacaagatcacgggataaggacgacgaatctaagaagcagaagaagcgtggccggccaccagccgagaaactgagtccaaatcccccaaacttgaccaaaaagatgaaaaaaatcgtcgacgcagtgatcaagtataaagactcctcatccggccggcagctgtcggaggtcttcattcagctgcctagtagaaaggaactcccggagtattacgaactgattaggaaaccggttgacttcaagaaaatcaaagagagaattaggaatcataaatatcgctcactgaacgacctggaaaaggacgtgatgctcctatgccagaatgcacagacttttaacctggaaggatcactcatttacgaggacagcatagtgcttcaatccgtgtttacaagcgttaggcagaaaattgagaaagaagacgattccgagggggaggagtctgaagaggaggaggaaggcgaggaggaaggttcagaatccgaatcccggtctgtgaaggtcaagattaagttgggtcgtaaggagaaagcacaggacagactgaagggaggccgccgtcgccctagccgaggttcaagagcaaaaccagttgtttccgacgatgatagcgaagaggaacaggaggaggaccgatccggctcaggcagtgaagaggattag

SEQ ID NO: 207569 - DNA, 3159 bp, Artificial Sequence
  Description of Artificial Sequence: Synthetic coding sequence
atgagcagcgccgccgagcccccccccccccccccccccgagagcgcaccgtccaagcctgcagcaagcattgccagcggcggctcaaatagttcgaataagggtgggccagaaggagtcgcggcccaggcggtcgcgagcgccgccagcgctggccctgccgacgccgaaatggaagagatcttcgatgatgcctcccctgggaaacaaaaagaaattcaggaaccagaccccacctatgaagaaaaaatgcagacagatcgagccaatcgtttcgagtacctcctgaagcagacggaactgttcgcccacttcatccagcccgctgcccagaagactcctaccagtcccctgaaaatgaaaccgggccgaccaaggattaaaaaggacgaaaagcagaacttgctgagtgtgggcgactaccgtcatcgaaggactgagcaggaagaagacgaggagctcctaacagagtcatccaaagctacaaacgtttgcacgaggttcgaagatagtccctcttacgtcaaatggggcaagttaagggattatcaggtgcggggacttaactggttgatttccttgtatgagaacggaatcaacggtatcttggccgatgagatggggcttggaaaaacactgcagactatttccctgctcggatatatgaagcactataggaacatacctgggccacatatggtcctggtccccaaatcgacacttcataattggatgtcagagtttaagagatgggtacctacactgaggtctgtttgcctgatcggcgataaagagcagcgagcagctttcgtgagggacgtcctgctgcctggggaatgggacgtctgtgttacctcatacgagatgctcataaaggagaaatccgtgtttaagaagtttaattggcgttatctggtaattgacgaggcgcacagaattaagaacgagaagagcaaactgtccgaaattgtacgggaattcaagacgacaaaccgcctgctgctcactggcactccacttcaaaacaatcttcacgagttgtggtctcttctgaattttttgcttccagatgttttcaatagcgctgatgacttcgacagctggttcgacactaacaattgccttggcgaccaaaaattggtagaaaggctccatatggttcttcgcccgttccttttacggcgaatcaaagcggatgtcgagaagagcctgccacccaagaaggaagtgaagatatatgtcggactcagcaaaatgcagagagagtggtacaccagaattctgatgaaggatatcgatattctgaatagcgctggaaaaatggacaagatgcgactcctgaatatcctaatgcaactccggaagtgttgtaatcacccttatctctttgacggtgccgagcccggtccgccatacacaacagatatgcacctggtcacaaactctgggaagatggtcgtgctcgacaagctattgccgaagctcaaggagcagggtagccgcgtgctgatcttttcccagatgactagagtgctcgacatcctggaagattactgcatgtggagaaattacgaatactgccggctggacgggcagacgccacacgatgagcgacaggattctatcaacgcatacaatgagcccaatagcactaagtttgtgtttatgcttagcacacgcgctggcggactgggaattaacctagcaaccgcagacgtggtaattctctacgattccgactggaacccacaggtagacctgcaagccatggaccgagcccaccggatcgggcagacaaagactgtgagggtattccggttcattaccgacaacacagttgaagagcggatcgttgaaagggcagaaatgaagcttcgtctggacagcatcgtgatccaacaaggacgcctggtggaccaaaatttgaataagattggaaaagacgagatgttacagatgattagacacggggctacacacgtgtttgcatccaaggagtcggaaatcacagatgaagacattgatgggattctggaacgcggggctaagaagactgctgagatgaacgagaagctctccaaaatgggtgaatcttctctgcggaattttactatggataccgaatcttccgtttataatttcgagggcgaagactatcgcgagaaacagaagatcgcctttaccgaatggattgagccgcccaagcgggagcgtaaggccaattacgcggttgatgcttattttcgggaggcacttcgcgtgtcggaacctaaggcgccaaaagcgccacgacctcctaaacagccgaatgtgcaggattttcagttcttccccccgcggctttttgaactattggaaaaggagatcctgttttacaggaagacgataggctacaaggtgcctagaaatcccgagctgcccaatgcagcacaggcgcaaaaggaggagcagcttaagatcgacgaggccgagagtcttaacgacgaagagttagaggagaaggaaaaactcctgacccagggcttcaccaattggaataagcgcgatttcaaccaattcataaaagcaaacgaaaagtgggggagagatgacatagagaacatcgcaagagaggtcgaaggaaagaccccagaggaagtgatcgagtatagcgctgtgttttgggaacgctgcaacgagctgcaggacatagaaaagattatggcacagatcgaaaggggcgaggcgagaattcagaggcgcattagcatcaagaaggcgttagacaccaaaataggaagatacaaagcacctttccatcagttgaggatctcatatggcaccaataaaggcaagaattacacggaagaagaagatcgttttttaatctgtatgcttcacaagctcggcttcgataaagagaatgtctacgacgagttaagacagtgcatccgaaattccccacaatttcgctttgactggtttctgaaatcgagaaccgccatggagctccagagacgctgcaatactctgattaccctgatcgagagagaaaacatggagctggaagagaaggagaaagccgaaaagaagaagcggggcccaaaaccatcaactcagaaacgcaaaatggacggtgcgcctgatgggaggggtagaaaaaagaagctgaagctctag

SEQ ID NO: 207570 - DNA, 2988 bp, Artificial Sequence
  Description of Artificial Sequence: Synthetic coding sequence
atggaggagatcttcgacgacgccagccccggcaagcagaaggagatccaggaaccagacccaacgtacgaagagaaaatgcaaaccgaccgcgcgaatcggttcgagtacttgctgaaacagactgaactgtttgcccactttatccagcccgccgcccaaaaaaccccaacaagccccctgaagatgaaaccagggcgcccccgcatcaagaaagatgagaaacagaacttactgagcgtgggtgattaccgacaccgacgcaccgaacaggaagaagacgaggagctgctaaccgagtctagcaaggcaactaatgtgtgcacacggtttgaggactccccttcttacgtcaaatggggcaaactgcgcgattatcaagttaggggcctgaactggcttatctctctttatgaaaacggaataaacggaatcctcgctgacgagatgggcctgggaaaaaccctgcagactataagcctgctaggatacatgaagcattataggaacatacccggcccacatatggtactggtcccaaagtcaaccttgcacaactggatgagcgagtttaagaggtgggtgcctacactgcgatccgtatgcctgattggcgacaaggaacaaagggccgcctttgtgagagacgtactgctgcccggtgaatgggatgtgtgtgtgacgagttacgagatgctcataaaagagaaaagcgtttttaagaagttcaattggcgctacctggtcatcgacgaggctcaccgcataaaaaatgagaaatccaagctcagcgaaatagtcagggaatttaagactactaacaggctgctgctcacaggaacacctctgcagaataacctgcacgagctgtggagccttctgaattttttgctgccggacgtttttaattcagccgacgactttgacagttggttcgacaccaacaactgcctaggtgaccagaaactggttgagcgcttacacatggtgctgcggcccttcttgctccggaggattaaagccgacgtggagaagagcctccctccaaaaaaggaagtgaagatctacgtggggctgagcaagatgcaacgagaatggtacacccgaatccttatgaaagacatcgacattctaaactcggcgggaaaaatggacaagatgcgtcttctgaatattctgatgcagctgcgaaagtgctgtaaccacccctacctgttcgatggcgcggagcccggccccccttacaccaccgacatgcatctggtaacaaactcaggtaagatggtggtcttggacaagcttctcccaaagctgaaagagcagggatcgcgggtactgattttctcacagatgacgagagtacttgatatactggaagactactgcatgtggcggaactatgagtactgccgcctggacggacagacacctcatgacgagcgccaggattccatcaatgcgtataatgagcccaacagtaccaaattcgtgtttatgttgtctacaagagctggcgggcttggcataaatctggccacagctgacgttgtgattctgtacgattctgactggaatcctcaggtggacctgcaagcaatggaccgcgcacacaggataggccagaccaagacagtccgcgtgtttcggttcataacagacaacactgtggaggagcgcatcgttgagcgtgctgaaatgaaactccgcttggacagtattgtcatacagcagggccgactggtggaccagaatcttaacaaaatcggaaaagatgagatgctgcagatgatacggcacggcgctactcacgtgttcgccagcaaggagtccgaaattactgatgaggatatcgacggaattctcgaacggggcgctaaaaagactgctgagatgaatgagaaactttcaaagatgggcgagagtagtttacggaacttcacaatggacaccgaaagttccgtgtataatttcgaaggagaggactacagggagaagcagaagattgctttcacggaatggattgagccccccaagcgagaacgcaaggcaaattacgctgtcgacgcttactttagggaagccctccgcgtgtccgaaccaaaggctcctaaggcgccacgccccccaaagcagccaaatgtccaagatttccagttctttcctccacggttgtttgagcttttagagaaggaaatcctgttctatagaaaaacaattggatataaggtcccacgaaacccggaactgccaaacgctgctcaggcgcagaaggaggaacagctcaagatagacgaggctgagagtttgaatgatgaggagcttgaagagaaggagaaactcctgacgcagggctttacgaactggaacaagcgggactttaatcagtttattaaggccaatgagaagtggggtcgtgatgacatcgagaacatcgcccgggaggtggagggaaagacccccgaagaggtcatcgaatatagtgccgtgttttgggagaggtgtaatgaactccaggacatcgaaaagattatggctcagatcgagaggggagaagcccgcatccagcggcgtatcagtataaaaaaggccttagacaccaaaattggaaggtataaggcaccctttcaccagttgagaatttcttatggaacaaacaaagggaagaattacaccgaagaggaggataggttcctcatttgtatgctccacaaactggggtttgataaagagaatgtatatgatgagcttcgccaatgtatccgtaactcgccacagtttcgctttgattggtttctcaagagccggacggccatggagttgcaacggaggtgtaataccttaatcacactgatcgagagagagaacatggagctagaagaaaaggaaaaagccgagaagaaaaaacgcgggcctaagccctctacacagaagcgtaagatggacggggcgcccgatggtcgtggtcggaaaaagaagttaaagttatag

SEQ ID NO: 207571 - DNA, 2988 bp, Artificial Sequence
  Description of Artificial Sequence: Synthetic coding sequence
atggaggagatcttcgacgacgccagccccggcaagcagaaggagatacaggaacctgatcctacctatgaagaaaagatgcagactgaccgtgccaatagattcgagtacttgctcaaacagaccgagttgttcgcccatttcattcagccagcagctcagaagacaccgaccagtccccttaaaatgaagcccggccggccacgcattaaaaaggacgagaagcaaaacctgcttagtgtcggggactaccggcacagacgaaccgaacaagaggaggatgaagagctgcttacggagtcttcgaaagccacaaacgtgtgcacccgctttgaggactcccccagttatgtgaagtggggcaaactccgagactatcaagtcagaggactgaattggcttatctcactgtatgaaaatgggataaatggtattctggccgacgaaatgggactgggcaagacactgcagaccatctctctactggggtatatgaagcactatagaaacatcccaggtccccacatggtactggtccctaaatctaccctccacaattggatgtcagagtttaagcgatgggtgccaacattgagatccgtgtgtctgattggggacaaggaacagcgtgcggccttcgtgcgcgacgttctgctacctggcgagtgggatgtttgtgtcacttcatatgagatgctcattaaggagaagagcgtgttcaaaaagttcaactggaggtacctcgtcatagatgaggcccacaggatcaaaaatgaaaagagtaagctctccgagatcgttcgtgaattcaagacaactaaccgactgcttctaacaggtacaccgttacagaataacctgcacgagttatggagcttgctgaatttcttgcttccagatgtcttcaattctgccgatgattttgattcatggttcgatactaataattgtttgggggaccagaaattggtggagcggctgcacatggtcctcaggccttttctactgcgacggatcaaggccgatgtagaaaagtcgttacccccaaaaaaggaggtgaagatatacgtcggcctgtccaagatgcagagagagtggtatacacggattctgatgaaagatatcgacatattaaactcagcagggaaaatggataagatgcggcttctaaatatcctgatgcagctaagaaaatgttgtaaccacccatacctgttcgacggggccgagcccgggccaccttatactacagacatgcacctggtgactaattcagggaagatggtggttctggataagctgctgcccaaactgaaagagcaagggagtcgggtcctgattttcagtcagatgacacgggtgctggacattctcgaggactattgcatgtggaggaattatgagtattgtcggctggacggccagacaccccatgacgagcggcaggacagtatcaacgcatacaacgagcccaactcaaccaagtttgtgtttatgctgtccacccgtgctggaggccttggcattaacctggcaactgccgatgtcgttatcctgtacgattccgactggaatccccaggtggacttacaggccatggaccgcgcccatcgaatcggccaaactaaaacggttagagtgttcaggtttattaccgataataccgtagaagagcgcatagtggaaagagctgagatgaagcttagactggacagtatcgtcattcagcagggccgactggtggatcagaatcttaacaagatcggaaaggacgagatgctgcagatgattagacacggggcaacccatgtcttcgcctcaaaggaatctgagattaccgacgaagatattgacgggattttggagcgcggggccaaaaaaaccgccgaaatgaatgaaaagttgtccaaaatgggggaatctagcctgagaaacttcacaatggatactgagagcagtgtttacaactttgagggcgaggattacagggagaagcagaagattgcttttacggagtggattgagccaccaaaacgcgagcgcaaggctaattacgcagtggatgcctacttcagagaagctcttcgcgtctccgaacctaaggcccctaaggccccccgtccccctaaacagcccaacgtgcaggatttccagttcttccctccacgcttgtttgagctgttagaaaaggagattttattttaccgaaaaacaatcggctacaaagttcctaggaatccagaactacccaacgcggcacaagctcagaaagaagaacaactgaagattgacgaagctgaatctctgaacgacgaagaacttgaagagaaggagaagttgctgacacaaggctttaccaattggaacaagcgggattttaaccagttcatcaaggccaatgaaaaatggggccgggacgacatcgaaaatatcgccagggaagtggagggcaagacaccggaagaggtgatcgagtattccgcagtgttctgggagcgctgtaacgagttacaggatatcgagaagattatggcacaaatcgagaggggagaagcccggatccagcgtcgcatatccattaagaaagcccttgacactaagattggcagatataaggcaccctttcaccagcttagaatatcgtatggtaccaacaagggcaaaaactacactgaagaggaggataggttcctgatatgcatgcttcacaaactgggcttcgacaaagagaacgtctacgatgaactgcgccagtgcattcggaattccccccaatttaggtttgattggtttctgaagtcccggaccgcaatggaactgcagagaaggtgtaacaccctgataactctcatagagagagagaacatggaacttgaggagaaggaaaaggccgagaaaaagaagcggggaccgaaaccaagcacccagaaacgaaaaatggacggggcccctgacgggcgtggccggaaaaaaaagctaaagctttag

SEQ ID NO: 207572 - DNA, 2865 bp, Artificial Sequence
  Description of Artificial Sequence: Synthetic coding sequence
atgagcctgcccctgaccgaggagcagcggaagaagatcgaggagaatcgccaaaaggccttggcccgtcgcgcagagaaactgcttgctgagcaacatcaacgcacaagttctggcacctccatcgccgggaatcctttccaagccaaacagggaccttctcagaattttccgcgggaatcttgcaagcctgtgtcccatggtgtgatttttaaacagcagaatctgagctcttcttccaacgcagatcaacgcccacatgattctcactcctttcaggccaaggggatctggaagaaacccgaggagatgccaactgcatgccccggccatagcccccgtagccagatggccctcaccggaatcagtcccccacttgcccagtcaccccctgaagtgcccaaacagcaactgctgagttatgagctaggtcaaggccacgctcaggcttcaccagaaatccggtttacacccttcgctaatccaacccacaagccgctggccaaacccaaatccagccaggagacgcccgcccacagttcagggcagccgccacgtgacgcaaagctcgaggccaagacagccaaagcgagtcctagtgggcagaatatttcctatattcactccagttcagagagcgttacaccgaggaccgaaggccggctgcaacagaagagtggctcttccgtgcagaaaggagtgaacagtcagaaggggaagtgcgtccgaaatggtgaccgattccaggtgctgataggctataatgcagaattgatagcagtcttcaagaccctgcctagcaagaactacgaccctgatacaaaaacctggaacttttcgatgaacgactactctgcccttatgaaggccgcacagagcctgccaacggtgaacttgcagccacttgagtgggcttatggcagcagcgaatccccctccacctcctccgaaggtcaagctggcttaccttcggcgccttccctgagcttcgtgaaaggcagatgtatgctcatttcaagggcatacttcgaggcggacatttcatacagtcaggacctgatagccctctttaaacagatggactcgcggcgttacgacgtgaaaacccgcaagtggtcctttctactggaagaacatagcaaacttatcgctaaggttaggtgcttacctcaggtccagctggatcctttgcccacaacactcactttggcattcgcaagccagctcaaaaagacaagcttatcactgacacctgatgtgccagaagccgacttgtccgaggtggacccaaagttggtatccaatttaatgcccttccagcgagctggagtgaactttgccatcgccaagggaggccgcttgctgctcgccgacgatatgggcttgggcaaaactattcaggccatatgtattgcagccttctatcgaaaggaatggccccttttagtcgtcgtccccagctccgtgcgtttcacctgggaacaagccttcttacgctggctgccaagcttgagcccagattgtattaatgtggttgtcaccggtaaggaccggcttacagcgggtcttatcaacattgtcagttttgacctgctttctaaactggaaaaacaattaaagactccctttaaggtcgtgatcatcgacgaatcccacttcctgaagaattcacgcaccgctaggtgtagagcggccatgccagtcctgaaggttgcaaagcgggttatcctcctctcagggaccccggctatgagccggcctgctgaattgtatacccaaataatcgcagtcaaacctacattttttccccagttccacgcgtttgggctcagatactgcgacgctaaacgaatgccttggggatgggattactcaggctcctccaatctaggcgaactcaaactcctgctggaggaagccgtaatgttgcggagattgaagagtgatgtcctgagccaattacctgctaaacaaagaaaaatcgttgtgatcgcgccagggcggattaacgccaggactcgcgccgccctggacgcagccgccaaggagatgactactaaggacaagaccaaacagcagcaaaaggacgcactcatcctcttttttaatcgcactgccgaggctaagattcctagtgtgatcgagtacattctggatttgcttgaaagcggacgggaaaagttcttagtctttgcgcaccataaagtcgtgctggatgccatcacccaggagctggaacgaaagcacgtccagcacattcgcatcgacgggagcactagcagcgcggagcgggaagatctgtgtcagcagtttcagctgtccgagcggcatgccgttgctgtgctttcaattacggccgctaatatggggttgacgttctcatctgcggacttagtagtgttcgccgaattgttttggaatccgggcgttctgatccaggctgaggaccgggtgcataggattgggcagacctcaagcgtggggatccattatttagtggcaaaagggactgctgacgactatctgtggcccctgatacaggagaagataaaagttctggctgaagcagggctgtctgagacaaacttcagcgaaatgacagagtccaccgactatctctataaagatcccaagcaacagaagatctatgacttgtttcagaagtccttcgagaaagagggtagcgatatggagctactggaagcggctgaaagttttgaccctgggtcagcgagtgggacatctgggagcagctctcagaatatgggtgatacccttgacgaatcctctctaaccgcttcaccacagaaaaagagacggtttgaattttttgataactgggactcatttacctcgccactgtag

SEQ ID NO: 207573 - DNA, 2865 bp, Artificial Sequence
  Description of Artificial Sequence: Synthetic coding sequence
atgagcctgcccctgaccgaggagcagcggaagaagatcgaggagaacagacagaaggccctcgccagacgtgcggagaagctcctggcagaacagcatcaaagaacttccagcggtacctcaatcgccggcaaccccttccaagcaaagcagggaccctcacagaacttcccacgggagagctgtaaacctgtatcgcacggggttatcttcaagcaacagaatctgtcatcttcctctaacgctgatcaaagacctcatgattcccactcgtttcaggctaagggcatctggaaaaagccagaggagatgcctacagcctgccctggccattcccccagatcccagatggcccttactggcatctcgccgcctctagcacaatctcctcctgaagttccaaagcagcagttgttgagctatgaacttggacaaggtcacgcacaggctagcccagaaattagattcactccttttgctaatccgacacacaagcccctcgctaagcctaagtcttcccaggaaacacccgcccattcgtcgggacagccccctcgcgacgcaaagctcgaagctaagacagccaaagcttccccctctggccagaacattagctacattcacagttccagtgagagtgtcacacctcggacagaagggagattacagcagaaaagcggttcttctgttcagaaaggggtgaactcccagaaggggaaatgtgtaagaaacggagataggttccaggtactgataggatacaatgccgaactgattgccgttttcaaaactttaccctccaaaaactacgaccctgataccaagacctggaattttagcatgaacgactattccgcactgatgaaggcagctcagtcactgccgacggtcaacctgcaaccattagagtgggcctacggctcctcagagtcgccctccacttccagcgaaggtcaggccgggttacccagcgccccgtccctctcgtttgttaaggggaggtgtatgctgattagccgggcgtactttgaagcagatatctcatatagccaggacttaatagcactgtttaagcagatggacagcaggaggtatgacgtgaagaccagaaagtggagtttcctgctggaagagcacagcaaactgatcgctaaggtccggtgcctgccacaggtccagctggatccgctgcccaccaccttgactctggcttttgcgagccagctcaaaaaaacaagtctcagtctcaccccagatgtccccgaggccgatctctccgaggtcgaccctaaactggtctcgaacctcatgcctttccagagagccggggtgaacttcgctatagccaaagggggccgcctgctgttagctgacgacatgggattgggtaaaaccatccaagccatttgcatcgccgccttctaccgaaaagaatggccacttctggtggttgtgccgtccagcgttagattcacctgggagcaggccttcctgaggtggttgccgtcactctctcccgactgcataaatgtggtagtcaccggtaaggaccgcttgacagctggtctgatcaacatcgtgtcctttgatctgctgtccaagctcgaaaaacaactgaaaacgccatttaaggtggtgatcatcgacgaatcacatttcctgaaaaatagtagaactgcgcgctgccgcgctgccatgccagtattaaaggtggcaaaacgtgtcatcctgctgtcaggcaccccagccatgtctcggcccgctgaactgtacacccagataatcgccgtgaagccaaccttcttcccacagttccacgcttttggcttacgatattgcgatgcgaagcggatgccttggggctgggattattccggctcctccaatctgggcgaactgaaacttctgctagaggaagcggtgatgttgcgacgtctgaaaagcgacgtcctatcacaattacccgccaagcagagaaaaattgttgtcatcgcgcccggacgcattaacgcccgcacaagggctgcacttgatgctgccgctaaagaaatgaccacaaaggacaaaactaagcagcagcagaaggatgcgctaatactgttttttaatcgcactgcagaagccaaaatcccttctgtgattgagtatatcctggacctgttagagtcagggagggagaagttcctggtcttcgcacaccacaaagtggtgctcgacgcaatcactcaggaacttgagagaaagcacgtgcaacatataagaatcgatgggtctacttctagcgcagagcgggaggatctttgtcagcagttccaattgagcgaacgccacgctgttgccgtgctgtccattaccgccgctaatatgggccttacattctccagtgcggatctcgtagtgttcgcagagctcttctggaatccaggggtgctcattcaggcagaggatagggtacaccggatcggtcagactagcagcgtgggtattcattatcttgtggctaaaggaactgccgacgattacctttggccccttatccaagaaaaaatcaaggtgctggccgaggccggcctctccgagaccaacttctctgaaatgacagagtctaccgactatctctacaaagatccaaagcagcaaaagatctacgatctgttccaaaagtcctttgaaaaggaggggtctgacatggagctgttggaggccgccgagtctttcgatcccggctcggcctcaggaacttcaggctctagcagtcagaacatgggggacaccctcgacgagagctctctgacggcaagtccccaaaagaagcggcgatttgagtttttcgataattgggatagcttcacatcccccctgtag

SEQ ID NO: 207574 - DNA, 60 bp, Artificial Sequence
  Description of Artificial Sequence: Synthetic coding sequence
atgagcctgcccctgaccgaggagcagcggaagaagatcgaggagaaccgtcagaaatag

SEQ ID NO: 207575 - DNA, 441 bp, Artificial Sequence
  Description of Artificial Sequence: Synthetic coding sequence
atgagcctgcccctgaccgaggagcagcggaagaagatcgaggagaatcggcagaaggcccttgcccgacgggccgagaagttgctggccgagcaacatcagcgcactagttccgggacttccatcgctggcaacccgttccaggctaagcaagggcccagccaaaatttcccacgagagagctgcaagcccgtgagccatggagttatttttaaacaacagaatctcagttcgtctagcaatgcagaccaacgccctcacgactctcacagtttccaggctaaggggatttggaagaaacccgaagagatgcctaccgcttgtcctggacatagtccccgtagtcagatggccctcacgggaatatctccgcccctggctcagtctccccctgaggttccgaaacaacagttactctcttatgagctgggacagggatag

SEQ ID NO: 207576 - DNA, 279 bp, Artificial Sequence
  Description of Artificial Sequence: Synthetic coding sequence
atgagcctgcccctgaccgaggagcagcggaagaagatcgaggagaataggcagaaagctttggccagaagagccgaaaaactgctggccgagcagcaccagcgcacaagctctggcacatctatcgcagggaatccttttcaagcaaaacagggacccagccaaaatttccctagggaaagttgtaaacctgtgtcacatggtgtgatctttaagcagcagaaccttagcagttcaagcaacgccgaccagaggccgcatgactcacactccttctag

SEQ ID NO: 207577 - DNA, 393 bp, Artificial Sequence
  Description of Artificial Sequence: Synthetic coding sequence
atgagcctgcccctgaccgaggagcagcggaagaagatcgaggagaataggcagaaagcactggcccggagggcagaaaaactgttagcggagcagcaccaaaggacttcttctggaactagtatcgccgggaacccttttcaagccaagcagggcccctcacaaaatttcccaagggaaagttgcaagccagtgtcccacggggtgattttcaaacagcagaatctatcctccagcagcaacgccgaccagcgaccacatgactctcattccttccaagcaaaggggatttggaagaagcctgaggagatgcccaccgcttgcccagggcacagtccacggtcccagatggctcttacgggcatcagccccccattagcacagtcgccctag

SEQ ID NO: 207578 - DNA, 3318 bp, Artificial Sequence
  Description of Artificial Sequence: Synthetic coding sequence
atggccgccgccgccggcggcggcggccccggcaccgccgtgggcgccaccgggtccggcattgcggccgctgccgctggactggctgtgtaccggcgcaaagatggcggtccagctaccaagttttgggagagtcccgagaccgtctctcagttggattcggtgcgggtctggctcggaaagcattataagaaatatgtgcacgccgatgccccaacaaataagacactggccggactcgttgtgcagctgctccagtttcaggaagatgcattcgggaaacacgtgaccaacccggcattcacaaagctacccgccaaatgctttatggatttcaaagctggcggggccttgtgtcacattctgggggccgcatataagtacaagaacgagcaggggtggagacggtttgatctgcagaatccttctcggatggatcgtaacgtagaaatgttcatgaatattgagaagacattagttcaaaataattgtcttactcggccaaatatatacctcatccccgatattgatctgaaactggcaaataagcttaaagatatcattaagagacaccaggggacatttacggatgagaagagcaaagcgtcccatcatatctacccgtacagcagctctcaggacgatgaagagtggctcagaccggtcatgcggaaggaaaagcaggtgctcgtgcactggggtttctacccagacagctatgacacctgggttcattctaacgacgtggatgcagaaatagaagatccgcccattccagagaagccatggaaggtccacgtgaaatggattctcgacaccgacatatttaacgagtggatgaacgaggaagactacgaggtcgacgagaatcgcaagccagtgtccttccggcaacgtatctctactaagaatgaagaacctgtaagaagccctgaacggagggatcgcaaggcttccgctaatgcaaggaagagaaagcactctccatcccccccgccacccacaccaacagaaagtcggaagaagtctggcaaaaagggccaagcctccttgtacggtaagcgcaggtcgcagaaagaggaagatgagcaggaagaccttaccaaggacatggaagacccaactccagtgccaaatattgaagaggtggtactgccaaagaacgtcaatttaaagaaagactccgagaacacccctgttaagggggggactgtggcggatctagacgagcaagacgaagaaaccgtgacagccggcggaaaagaagatgaggacccagccaagggtgaccaaagcagaagtgtagacctgggagaagacaacgtgaccgaacagaccaaccatatcattattccttcttatgcgtcttggtttgattacaactgcattcacgtgatagagcggagggctctgccagagttctttaatgggaagaataagagtaagactccagaaatttatcttgcctaccgaaactttatgatagatacataccggctaaacccacaggaatatcttacctccaccgcatgtcggagaaacctgacgggagatgtgtgcgcggtaatgagggtgcacgcgttcctggagcagtggggcctggtgaactaccaggtggacccggaaagccggccgatggcaatgggcccccctcccactccacacttcaacgtcctcgccgacaccccaagcggcctcgtcccattgcacctgagaagtccccaggtccctgcggcacaacagatgcttaattttccggagaaaaataaagagaaacccgtcgacctccagaacttcgggcttcgcacagatatatatagcaaaaagacattggcaaagtctaagggcgcaagcgccggaagagagtggaccgaacaggaaaccttgcttctgctcgaggcgcttgaaatgtataaggatgactggaacaaggtgtcagagcacgtagggtcacgcacgcaggatgagtgcatcctgcacttcctgaggctgcccatagaggatccatacctggagaattctgacgcttccctggggcctctggcataccaaccagtgcccttctcacaatccggcaatcctgtcatgtccacagttgcattcctggcatcagtggtggaccctcgggttgcgtcagccgcagcaaaagctgctctggaagagtttagccgggttcgggaagaggtccccctcgagctggtggaggcccatgtgaagaaagtacaagaggctgcacgcgcctctgggaaggtagaccccacctacggacttgaatcctcctgtatcgcaggaacgggcccagacgaacctgaaaaactggaaggcgctgaggaggagaaaatggaggcggatcctgatggccagcagcccgagaaagccgagaacaaagttgagaacgaaactgacgagggtgacaaggcacaagacggagagaatgaaaaaaactccgaaaaggagcaggacagtgaggtttccgaggacacaaagtccgaagagaaagaaaccgaagaaaacaaggaactgacggacacctgtaaggaaagggaatccgacactggtaaaaaaaaggtagagcatgaaattagcgaaggcaatgtggcaacagctgccgccgctgcgttagctagtgccgctacaaaggctaagcatctggccgcagtcgaggagcggaagattaaatcactggttgccctgctcgtggagacccagatgaagaagttggaaataaagttgcgccatttcgaggagttagaaacaattatggacagagaaaaggaagctttggaacagcagcggcagcagttgctgaccgagcgccaaaattttcacatggaacagctgaagtacgcggaattgcgcgctaggcagcagatggagcagcaacagcacggacagaaccctcagcaggcgcaccagcattcgggggggcctggcctggctcccctgggcgcggctggccaccccggaatgatgcctcatcagcaacctcccccatatccattgatgcatcaccagatgcctccgccccacccaccacagcccggacagatacccggcccaggctccatgatgcctggtcagcacatgccaggccgcatgattcccacagtggcagccaacatccatccttccgggtcgggccctactccacctggtatgccacctatgcccggtaacattcttggaccgagggtccccttgaccgcccctaatggcatgtatcccccccctccccaacagcagcctccccctcccccacccgccgatggcgtgcctcctccaccggcacccggtccaccggcatctgccgctccttag

SEQ ID NO: 207579 - DNA, 3645 bp, Artificial Sequence
  Description of Artificial Sequence: Synthetic coding sequence
atggccgtgcggaagaaggacggcggccccaacgtgaagtactacgaggccgccgacacagttacacagtttgacaacgtgcggctctggttgggaaagaactataagaagtacattcaggccgagccccccacaaacaaatctctgtcatccttggttgttcagctcctgcaattccaggaggaggtttttgggaagcacgtgtcaaatgcgccgttgaccaagctgcctattaagtgttttctggactttaaggctgggggatctctttgtcacatccttgccgccgcatataagttcaagtctgaccagggctggcggaggtacgacttccagaaccccagcaggatggatcgcaacgttgaaatgtttatgacaatcgagaaatccctggtacaaaataattgcctgagcaggccaaacatcttcctgtgtcctgaaatcgagcctaagctcctaggcaaattgaaggacataattaaacgccaccaggggactgtcacggaagataagaacaacgcaagccatgtggtgtacccggtgcctggcaacctggaggaggaggagtgggttcgccccgtgatgaagcgcgacaagcaggttctgctgcactggggctattaccccgattcgtacgatacatggattcctgccagcgaaattgaggcttccgtggaggatgcccctacaccggagaagccaaggaaggtccatgctaagtggatcctggacaccgatacattcaatgagtggatgaacgaagaagattacgaagttaatgatgataaaaaccctgtaagtcggcgaaaaaaaatttccgccaaaaccttaactgacgaggtgaattctccagattcagacaggagggataagaaaggtggtaactataaaaagcgcaaaaggagcccttctccttcccctacaccagaagccaaaaagaagaatgcaaagaaaggaccttccactccttataccaagtctaaacgaggccacagggaagaagagcaggaggatttgaccaaagacatggacgagccatcccccgtacccaacgtcgaagaggtgactcttccgaagactgtgaatacaaagaaggactcagaaagcgcccctgtgaagggagggaccatgacagatcttgatgaacaggaggatgaatccatggagacaacagggaaagacgaggatgagaactctacagggaataaaggagaacagaccaagaatcccgatctgcacgaagataatgttactgagcagactcatcatatcatcatcccaagctacgctgcatggttcgactataatagcgttcacgccatagagcgcagagcgcttcccgagtttttcaacggaaaaaataaatctaagaccccggagatctatctggcctacagaaacttcatgatcgatacatatcgtctaaatccgcaagagtacctcacatctaccgcttgcagacggaacctggccggggatgtttgcgcgataatgcgggtgcacgccttccttgagcagtggggcctcattaattaccaagtggatgcagagtctcgccccaccccaatggggcctccgcctacatctcacttccacgtgctggcagacactccgagcggtttggtgcctctccagccaaagaccccccagcaaacttctgcatcccagcagatgttgaacttcccagacaaggggaaggaaaagccgaccgacatgcagaatttcgggcttcggaccgacatgtacaccaaaaagaacgtgcctagcaagtctaaggcagcagcatccgccacccgagagtggactgaacaggagacactgctgctgctggaagctctcgaaatgtacaaggatgattggaataaggtgtccgagcacgtcggaagtcgaactcaggatgaatgtatactacattttctccgactgccaatcgaggacccctacctcgaagattcagaagcctcgttaggtccactcgcataccagcccatacctttttcccagtcaggtaaccctgtgatgtcaacagtggctttccttgcctccgtcgtggatccacgggtggccagcgcagcagccaagtcagcactagaggagttttccaagatgaaagaggaggtcccaaccgctctggtggaagcccacgtgcggaaagtcgaggaggccgctaaggtgaccggcaaggccgatcccgcctttggtctggagtcatctgggatcgcaggtacaacttccgatgaaccagagaggatcgaagaaagtggtaacgatgaggcacgggtggaggggcaagcaacagacgagaagaaggaacccaaggagcctcgtgaaggcgggggagcaatagaggaggaagccaaggagaaaacaagcgaagcacccaaaaaggatgaggagaagggtaaggaaggtgactcagagaaggaatctgaaaagtccgatggcgatccgatcgtggatcccgaaaaggagaaagaaccaaaggagggtcaggaggaggtgttgaaggaagtggttgaatccgaaggcgagcgcaaaactaaagtagagcgggatattggtgagggtaatttaagcacagctgccgctgcagccctagcagccgcagcggtaaaagcgaagcatttagccgctgtggaggaaagaaaaattaagtcactcgtagccctgctggtcgaaacacaaatgaaaaagctggaaatcaagctacggcatttcgaagagttagaaacaattatggatagggagagggaggctctggaatatcagagacagcagctgcttgctgacaggcaggcctttcacatggaacagctgaaatatgctgagatgagggcgcgccaacagcactttcagcagatgcatcaacagcagcaacagcccccccccgccctcccaccgggctcacagccaatccctccaactggcgcagccggcccgccagcggtgcacggcctggccgtagccccagcttctgtggtcccggcacccgccggctctggggcacccccaggctctctaggcccatcagagcagattggacaagcgggcagcaccgcagggccccagcagcaacagccggccggagcgccgcagccgggagctgttccccctggggtgccacctcccggaccacacgggccatcgcctttcccaaaccagcagacccctccttccatgatgcctggcgccgttccgggctccggccacccaggagtggccggaaacgctccactagggttgccttttgggatgcctcctcctccccccccgcccgccccctctataattccttttgggtccctggccgatagcatctcaatcaatcttccagcccctcctaatctgcatggccaccatcaccacctcccattcgcccctgggactctgccgccgccaaacttaccggtttcaatggctaatcccctgcatccaaatcttcccgcgacaactacaatgcccagtagtctgcccctgggccccggtctgggatccgctgcagctcagtcacccgccatcgttgctgctgtgcaaggcaacctgctgcctagtgcaagcccccttcccgatccagggacccccctacccccagatcctacggctcccagtccaggcaccgtcactcccgtgcccccacctcagtag

SEQ ID NO: 207580 - DNA, 3393 bp, Artificial Sequence
  Description of Artificial Sequence: Synthetic coding sequence
atggccgtgcggaagaaggacggcggccccaacgtgaagtactacgaagccgccgacactgttacacaatttgataacgttagactctggctgggcaaaaattacaagaaatacattcaggcagagccccctacgaataagagtctgtcttctctcgtcgtgcaactcctacagtttcaggaggaggtgttcgggaagcacgtctccaacgccccacttactaaactgcctatcaaatgcttcctggattttaaggccggaggctccctttgtcatattcttgcagctgcttacaagtttaaatccgaccagggatggaggagatatgacttccaaaatccttcccgaatggaccgcaatgtcgagatgtttatgacaattgagaagtctttggtgcagaataactgcctgtccaggccgaacatctttctctgccccgagatcgagccaaagcttctggggaaactcaaagatatcatcaaacggcatcagggcactgtgacagaggacaaaaacaatgcttcacatgtggtctatcccgtccctgggaacttggaggaagaagaatgggtacgacccgtcatgaaaagggacaaacaagttctcctccattggggatattatccagacagctacgacacatggatccctgcttccgaaatcgaagctagcgtggaagatgcacctacccccgaaaagccaagaaaggtgcacgctaaatggatccttgacacggatacctttaatgaatggatgaacgaggaggactacgaggtcaacgatgacaaaaacccagtgtcccggaggaaaaagatcagcgcaaagacactgacggacgaagtgaacagtccggactccgaccggagagacaagaagggaggaaactacaaaaaaagaaagaggtctccatcacccagtcctaccccagaggctaagaagaagaacgcgaaaaagggccctagcaccccttacacaaaatcaaagagaggccatagggaggaagaacaggaggacttaacaaaggacatggacgaaccctcccccgtgcctaacgtggaagaggtgaccctcccaaaaactgtgaacacaaaaaaagattcagagagcgcccccgttaaagggggcacaatgaccgacttggacgaacaggaagacgagtcgatggagaccacaggcaaagatgaagatgagaatagcactggaaacaagggtgaacagaccaagaaccccgatctccacgaggataatgtgaccgagcagactcaccacattatcataccttcctacgccgcatggtttgattacaatagcgtgcatgctattgagcggcgcgccttgcccgagttcttcaatggaaaaaacaaaagtaaaacacctgagatctatctagcttacagaaactttatgatcgatacttaccgccttaatccccaggagtatttaacttccactgcctgcaggagaaacttggcgggcgatgtgtgtgcaatcatgcgcgtacacgccttcctggaacaatggggactgatcaattaccaggtagatgccgaaagccgccccaccccgatggggcccccccctacttcccacttccacgttctggccgacactccttctggactggtccctctccagcccaagacgcctcagggacggcaggttgacgccgacacaaaggcgggaagaaaaggcaaggagctggatgatttggtaccggagaccgccaaggggaagccggagctgcagacaagcgcatcacagcaaatgctgaatttccctgacaagggcaaggagaaacccacggacatgcagaactttggcctcagaaccgatatgtacacgaaaaagaacgttccctctaaatcaaaggcagctgcatctgccactcgcgagtggacagagcaggaaactctgctgctcctcgaagcattagagatgtacaaggatgactggaacaaggtctctgagcatgtggggtcacgtacgcaggatgaatgtatcctgcactttttgagactgcccatagaagacccctacctggaagactctgaggcctcactgggaccactcgcttatcagcctatccctttctcccagtcaggaaaccctgtaatgtcaaccgtggcgttcctcgcaagcgtggtcgatcccagggtggcttctgcggccgctaagtccgccttggaagaattctcaaaaatgaaggaagaagtgcccacagccctggtggaggcccatgttcgaaaagtagaggaggcagccaaagtgacgggtaaagcagatcctgcctttgggctcgagagcagtgggattgcaggtactacatccgatgagcccgagaggatcgaagagagtggcaacgatgaagcacgtgtggaaggtcaagccacagacgagaaaaaggaaccaaaagaacctagagaaggcggaggcgcaatcgaagaagaagccaaagagaagacgtccgaggctcccaaaaaggacgaggaaaaaggtaaggaaggggactcggaaaaggagtcggagaagagtgatggggaccccatcgtggaccctgagaaagaaaaagaaccgaaagaaggacaagaagaagtcttgaaggaagttgttgaatcagagggagagagaaagacaaaggtcgaacgggacattggcgagggaaatctgtcgacagcggccgccgcagctttggcagccgccgccgtgaaggctaagcacctcgctgccgtagaggagaggaagattaaatctcttgtggctctgcttgtggagacgcaaatgaaaaagttggaaattaagctgcgtcactttgaggagctggaaactattatggatcgggaaagggaggcacttgagtatcagcgacaacagctgctggcagatcgacaggccttccatatggaacagctgaagtacgctgaaatgagggcaaggcagcaacattttcaacagatgcaccaacagcagcagcagcccccaccggcgctccctcctggaagtcagcctattccacctaccggagccgccggccctccagcagtgcatggtcttgccgtggcccctgctagtgtagtgcccgcccccgccgggtcgggcgcaccgcctgggtccctgggtccatcggaacagatcggccaggccggcagcacagcggggccacagcagcagcagcccgccggagccccacagcctggcgccgtgccaccaggtgttcccccaccaggcccgcacgggccctccccattccctaatcagcagactcctccatctatgatgccaggcgcagtcccagggagcgggcatcccggagtggccgaccccggcacccccttacctcccgaccccacagctccttcccctggtactgtgactcctgtgcctcccccccagtag

SEQ ID NO: 207581 - DNA, 3459 bp, Artificial Sequence
  Description of Artificial Sequence: Synthetic coding sequence
atggccgtgcggaagaaggacggcggccccaacgtgaagtactacgaggctgccgacaccgtcacccaattcgataacgtgcggctgtggctcgggaaaaactataaaaagtacatccaggccgagccccctacgaataaatccctctctagcctcgtggtgcagctgctacagtttcaagaagaggtgttcggcaagcacgtcagcaatgcccctctgaccaagctccctattaaatgctttctcgacttcaaagccggaggctcattatgtcatatcctggcagcagcctataaatttaaatccgaccaaggttggcgacggtacgactttcagaatccatcccggatggatcggaacgttgagatgttcatgacgatcgagaagtcactggtacagaataactgtctatccagacccaacattttcttgtgtccggagatcgagcctaaactgctgggcaagcttaaagatataatcaaacgccaccagggaaccgtgacagaggacaagaataatgcctcacatgttgtatatcccgtgcccgggaacctggaggaggaggaatgggtccgccccgtgatgaaacgagataagcaagtgctgctgcactggggctactacccagacagttacgatacatggatccccgcctccgaaatcgaggcctctgtggaggatgcacctacaccggagaagccccggaaggtgcacgccaagtggattcttgatacagataccttcaatgagtggatgaacgaagaggattacgaggtgaatgacgacaagaatccagtcagcaggagaaagaagatctctgctaagacacttacggacgaagtaaatagcccagactccgacagacgagacaaaaaaggcggtaactacaagaagaggaaaaggtcccccagtcccagtccaacccccgaggccaaaaaaaaaaacgccaagaaaggaccttccacaccatatacaaagtccaagcggggccatagggaagaggagcaggaggacctgactaaagatatggacgagccaagccccgtgccaaacgttgaagaggtgacactgccaaaaactgtaaacacaaaaaaagattctgagtccgcccctgtgaagggaggaactatgaccgacctggatgaacaagaagatgagagcatggagaccacgggaaaggacgaagacgagaatagcaccggcaacaaaggtgagcagactaagaatcccgacctccatgaggacaatgtgactgagcagacacaccacatcataattccttcatatgctgcgtggtttgactacaacagcgtgcacgctatcgaacggagagcactacctgagttttttaacggtaaaaacaaaagcaaaactcccgagatctacctggcctacagaaactttatgatcgacacttaccggctgaacccccaagagtatttgacctccacagcatgccgccgcaacctggccggggacgtgtgtgccattatgcgggtacatgcattcctcgaacagtggggattaatcaattaccaggtggatgccgagtccaggcctactcctatgggccccccccccacgtcgcactttcacgtgctagccgacactccctcaggcttagtgcctttgcagcccaaaaccccccagggccgccaggtcgacgccgataccaaggccggccgcaaaggcaaagagctcgacgacctggtgccagagaccgccaaggggaagcccgaactacaaacatcagcctcacaacagatgttgaactttcccgataagggcaaagaaaaacccacagatatgcaaaacttcggactccggaccgacatgtacaccaagaaaaatgtgccctctaagagcaaggccgcagcaagcgctacaagagagtggacagaacaagaaacactcctcctgttagaagctctggagatgtataaggacgactggaacaaggtgagcgagcacgtggggagccgcacacaggatgagtgcatcctacattttttaaggctgcccattgaagatccatatctggaggatagtgaagcttccttgggcccgctagcctatcaaccaattccattctctcagtccggtaacccagtaatgtcaacagtagcattcctcgcctctgttgttgaccctcgagtagcatccgccgcagctaagagcgccctggaggagttttcgaagatgaaggaggaagttccaactgcactggtagaagcccatgtgcgcaaagtggaagaggcggcaaaggtcacaggcaaggccgaccccgcatttggtctcgagtccagtggaattgcggggactacaagcgatgaaccggagaggatcgaagaaagtggaaacgatgaagctagggtagagggacaggcaactgacgagaagaaggaaccaaaggagcctagagaaggaggtggggcgatcgaggaggaggccaaggagaagacctcggaggctcccaaaaaagacgaggagaagggaaaagagggggattctgagaaggaaagtgaaaagtcagacggggatcctattgtcgacccggagaaggagaaagaaccaaaggagggacaggaggaggttctcaaagaagttgtggagtccgagggcgaacgtaagacaaaagtggagcgtgatatcggagaaggtaatttgagcaccgcagctgccgcagcattggcagctgcggccgtcaaagccaaacacctggcagcggtcgaagaacgtaagattaagtccttagttgctctgctggtcgaaacacagatgaagaagctggagatcaagcttcggcactttgaggagttggagacgatcatggaccgcgagagagaagccttggaataccagaggcaacagctcctggctgataggcaggccttccacatggaacaactcaagtatgcagagatgcgggccaggcagcagcactttcaacagatgcatcagcagcagcagcagccgcctcccgccttgcctcccggctctcagccgatcccccctactggggccgcaggcccgcccgccgtgcacggtctagcagtcgcgccagcttcggttgtccctgcacctgccgggtcaggagcccccccaggttcgctgggcccatcagagcagatagggcaggccgggtctactgcaggccctcaacagcagcagcctgccggcgctccccagccaggagccgtgccgcccggggtgccccctccggggcctcacggcccatcaccattccctaaccagcagacgcccccttctatgatgcccggggccgtacctgggtcaggtcatcccggggttgcagcacagagtccagctatcgtcgccgccgtgcaagggaatttgttacccagcgctagtccgctgcctgatcctggtactccactccccccagaccccacagccccaagccccggaactgtgaccccggttcctccccctcaatag

SEQ ID NO: 207582 - DNA, 1425 bp, Artificial Sequence
  Description of Artificial Sequence: Synthetic coding sequence
atggccgcccgggccggcttccagagcgtggcccccagcggcggcgcgggcgcaagtggcggggctggagccgctgccgccctcggcccagggggaacacccggcccccctgtacggatggggcctgctcctggacaagggctgtaccggagtcctatgccaggcgccgcttatccgcgacctggtatgttgcctggaagtcgtatgacgccgcaaggcccctccatgggcccccctgggtatggaggcaatcccagcgtacggccgggactggctcagagtggcatggaccagtctcgcaagaggcctgcaccgcaacagatccaacaggtacaacaacaggctgtccagaatcgcaatcataacgcaaagaaaaagaagatggctgacaagatcctcccacagcggattcgtgaactcgtgcccgaatctcaggcctatatggacctgttggcgtttgaaagaaagctcgatcaaacaatcatgcgcaaacggctagacattcaggaagccctgaagaggcctatcaagcagaagcgtaaattaagaatatttataagcaatacctttaatcccgcgaagtcagacgccgaggacggggagggcaccgtcgcctcatgggaactgcgggtcgaggggcgtttactggaggatagtgctttatctaagtacgatgcgacaaaacaaaagcgcaaattttccagctttttcaagtcactcgtcattgaattggacaaggatctatacggaccggacaaccatctggttgaatggcataggaccgcaacaacccaggagacagatggattccaggtgaagagacctggagacgtgaatgtcaggtgcactgtactcctgatgcttgattaccagcccccacagtttaagcttgatcctagattagccaggttgctgggaatacacacccagacccggcctgtcataatccaagctctttggcagtatattaaaacccacaagctgcaagacccccacgagcgcgagtttgtgatctgtgataaatacctgcagcagatttttgaaagccaacggatgaagttctccgagattcctcagcgtctccatgctctgctgatgcctccagagccgatcatcataaatcacgttatttcagtggatcccaacgaccagaagaaaactgcttgctacgacattgatgtagaggttgacgatacgttgaagacccagatgaattccttcctactgtcaacagcctctcagcaggagattgctactttggataacaagaccatgacagacgtcgtggggaaccctgaagaggagagaagagctgagttctattttcagccttgggcgcaggaggctgtctgtagatatttttattcaaaggtgcagcagcgtcgccaggagctcgagcaagctctcggaatccggaatacctag

SEQ ID NO: 207583 - DNA, 1548 bp, Artificial Sequence
  Description of Artificial Sequence: Synthetic coding sequence
atggccgcccgggccggcttccagagcgtggcccccagcggcggcgccggagcctctggaggagctggcgctgcggccgctctgggacctgggggaactcccgggccccccgtgaggatggggcccgctcccggccaagggctttaccgtagcccaatgccaggggctgcttatccgagacctggcatgctgcccggctctcgaatgactccacaaggcccgagcatgggccccccaggctacggaggaaatcccagcgtgcggcccggactagctcaatccggcatggaccaatctcgcaaaagaccagctcctcagcaaattcagcaggttcaacaacaggcagtgcagaataggaatcataacgcaaagaagaagaagatggctgataagattctgcctcagaggatccgggagctggtgcccgaatcccaggcttatatggatctgctggcttttgagaggaagctggaccagactatcatgaggaagagactcgatatacaagaggcattaaaaaggcctatcaagcagaaaagaaaacttagaattttcatctctaacacattcaaccccgcaaagtccgatgccgaagacggcgagggtacagttgcatcgtgggaactgcgggtggaggggcgtctgctcgaggattctgctctgagtaaatatgatgccacgaaacagaagagaaagttttcatctttttttaaatccctcgtaattgagctggataaagacctgtacgggccagataaccacctggtggaatggcacagaaccgccaccacacaagagacggatgggttccaagtaaagcgtccaggcgatgtgaacgttcggtgcaccgtcttgctgatgcttgactatcagcccccacagttcaagctggatccacgcctcgcccgattactgggaatccatacccaaacacgccccgtaattattcaagcactctggcaatacattaaaacccataagctgcaggatcctcatgagagagagttcgtgatctgcgacaagtatctccaacagatcttcgaatcacagcggatgaagttttcggaaatcccccagcgcctgcatgctttgctgatgccgcctgagcccattatcattaaccacgtaatcagcgtcgacccgaacgatcagaaaaaaactgcatgctatgacatcgatgtggaggtggacgacaccctgaagacccagatgaacagtttcctgctgtccaccgccagtcaacaagaaattgccaccctggacaataaaatccacgagaccattgaaaccatcaaccaactcaagacgcagcgggagttcatgctgagtttcgctagagatccacagggattcattaatgactggttacaatcccagtgtagggatctcaaaaccatgactgatgtggtgggaaatccagaagaggaaagaagagctgagttttattttcagccctgggcccaagaggctgtttgccggtacttctactccaaggtgcagcaaagaaggcaagagctggaacaggcccttggaatccggaatacttag

SEQ ID NO: 207584 - DNA, 876 bp, Artificial Sequence
  Description of Artificial Sequence: Synthetic coding sequence
atgatgcccctgaacaagcggggcagcagcctgcccttcaagagcttggtgatcgaactggacaaggacctatacggtcctgataaccacctggtggaatggcatagaactgcaaccactcaggaaacggatggatttcaggtgaaaagaccaggggacgttaacgtcagatgcacagtgctgctgatgctggactatcaacccccccaatttaagctcgacccacgcctggcacgactgttggggattcatacccagacgagaccggtgatcatccaggccttgtggcagtacataaagacgcacaagttgcaggatccccatgaaagagaattcgtcatctgtgacaagtacctgcaacagatcttcgagtcacagcgcatgaaattctctgaaatcccgcaacggttacacgcattgctcatgcccccggagcctattattatcaaccacgtcatatccgtcgaccctaacgatcaaaagaagacagcatgctatgatattgacgtcgaggtcgatgacaccctcaagactcagatgaattccttcctgctgagtactgccagccaacaggagattgctacgttggataacaagattcacgagacaattgaaactatcaaccaactcaaaacacagcgggagttcatgttgagcttcgcgagggatccacagggcttcattaatgattggctgcagtctcagtgccgagatctgaaaaccatgacagacgtggtgggaaatcccgaagaagaaagaagggccgaattctattttcaaccctgggcacaagaagcagtatgccgttatttttactccaaggtccagcagagacggcaggagctggaacaggccctggggatcaggaacacttag

SEQ ID NO: 207585 - DNA, 1362 bp, Artificial Sequence
  Description of Artificial Sequence: Synthetic coding sequence
atgagcaagatcagcgaggccgtgaagcgggcccgggccgccttctcctcaggccgcacacgcccactgcaatttcgcattcagcagctggaagccctccagcgcctgatccaagaacaagagcaagagctagtgggggcactcgccgccgatttgcacaaaaacgagtggaatgcctactatgaggaagtcgtatatgtccttgaagagattgagtatatgattcagaaactgcctgagtgggccgccgacgagcctgtcgagaagactccgcagacccagcaggacgagttgtacattcacagtgaaccactgggggtggtacttgtgatcggaacctggaattacccattcaatcttacaatccagccaatggtgggagccatcgctgcaggaaattcggttgtgctgaaaccgtcagagctgagtgaaaatatggcaagcttgctcgcaacaatcattcctcagtacttggacaaagatctatacccagtgattaatggtggcgtgcccgagaccacagagctcttaaaagagcggtttgatcacatactttatacaggctcgaccggcgtcggaaagataatcatgacggctgctgctaaacatttaacccccgtgactctcgaacttggcggtaaaagcccttgctacgtcgataaaaattgcgacctcgacgtggcctgtaggcgtattgcctgggggaaattcatgaactctggccaaacctgtgtcgctccggactacatcttatgtgacccttccatccagaaccagatcgtcgagaagctgaagaaatcactgaaggagttctacggcgaggatgctaagaaatccagagattacggtcgtataatctctgcacggcatttccagcgtgtgatggggctcattgagggtcagaaggttgcatacggtgggaccggtgatgccgctacaaggtatatcgcccctaccattctgactgatgtggacccacagagcccagtaatgcaggaggagatttttggcccggtcctccctatagtatgcgtccgctcgctggaggaagctatccagttcatcaaccagcgcgagaagcccctggctctgtatatgttcagctctaatgataaagtcatcaaaaagatgatagctgaaacaagctccgggggtgttgcagctaacgacgttatagtgcacattacgctgcatagcctcccgttcgggggggttggcaattctggtatgggctcgtatcacgggaaaaaaagttttgagacctttagtcatcgcaggtcctgtttggtccggccccttatgaatgacgaaggccttaaagtacggtatcccccgagtccggctaaaatgactcagcattag

SEQ ID NO: 207586 - DNA, 1452 bp, Artificial Sequence
  Description of Artificial Sequence: Synthetic coding sequence
atgggccggcgggtgggcgtggaggtgaccccccggtgggccccccagaaatgccagggagcaaggccgcagaggccaggtatgtccccaggaaatcgcatgcccatggcaggcctccaagttgggcccccagcagggtcaccttttggggctgccgcccccctaaggccaggaatgccaccaacgatgatggacccttttcgaaagcgattgcttgtcccgcaggcacaaccccccatgcctgcacagaggaggggactgaaacgccggaagatggcagacaaggtcttgccccagaggattagagagctcgtgcctgaatctcaggcgtatatggatctgcttgctttcgagaggaagctagaccagactattgctcgcaaaaggatggaaattcaggaagccattaagaaaccactgacccagaaacggaagctgaggatctatatctcaaacacctttagccctagtaaagcagaaggggactccgcgggcactgccggcactcccggtggcacccctgccggcgataaggttgcgtcctgggaactcagggtagaaggtaagctcctcgacgacccgagcaaacagaaaaggaaattcagcagtttctttaagagccttgtgatagagttagacaaagagctctatggtccggataatcatttagtggaatggcaccgcatgccgaccacccaggagacagatggatttcaggtgaaacggcctggcgacctcaacgtgaagtgtacccttctgcttatgcttgatcaccagcccccacagtataaactggatccacgcttagcaagactcctgggggtgcacacccagactagagccgctattatgcaagcgctctggttatacattaagcacaatcagctgcaggacggccacgaacgagaatacataaattgtaacagatacttcagacagatattcagctgtggccgccttagattttcagagattccaatgaagttggctggactgctacaacatcccgaccctattgtgattaaccacgtaattagcgttgaccctaatgaccaaaagaagaccgcctgctacgatattgacgtggaggttgacgacccccttaaggcccaaatgtctaattttttagccagcaccacgaatcagcaagaaatagccagtttagatgtgaagatccacgaaacaattgaatcgattaaccagctgaagactcaaagagacttcatgctgtcctttagtacagaccctcaggactttattcaggagtggttgaggagccagcgaagggatctcaaaattataactgacgtgatcggaaatccggaggaagagagacgcgcggcattctatcatcagccttgggctcaggaggccgttgggaggcacatcttcgccaaagtacagcaacggcgtcaagagctagaacaggtgctcggcatccgtttaacctag

SEQ ID NO: 207587 - DNA, 1596 bp, Artificial Sequence
  Description of Artificial Sequence: Synthetic coding sequence
atgagcggccggggcgccggcggcttccccctgccccccctgagccctgggggaggcgctgtcgctgcagcactgggcgccccaccgccgcccgccgggccaggcatgctccccggtccagccctgcgtggccccggaccggccggaggggtgggaggcccaggggcggccgccttccggccgatgggcccagcgggccctgcggcccagtatcagagacccgggatgtcacctgggaatagaatgcccatggctggtctgcaggtcgggccccccgccggcagccctttcggcgccgccgctcccctgcgtcccggcatgcctccaacaatgatggatcctttcagaaaacgactgttggtgccccaggctcagcctcccatgccggctcagcggcgggggctgaaacggcgaaagatggccgacaaggtcttaccgcagagaatacgagaactggtacctgagtctcaggcttatatggatctgcttgcctttgaacgtaaattggaccagacaattgcacgtaaacggatggaaatacaggaggccattaaaaaacctctgacacaaaagagaaagcttcggatatacatctctaacactttttctccgtcaaaggctgagggggatagtgcgggcacagctggtacacccgggggtaccccggctggggataaagtggctagctgggagctgcgcgtcgaggggaagttactcgacgacccaagtaagcagaagcggaaatttagttccttttttaagtctttagttattgagctggataaagaactgtacgggcccgacaaccatctcgtggagtggcacagaatgccaaccacacaggaaacagatggtttccaggtgaaaagaccaggggacctgaacgtgaaatgtactctgctgctcatgttggaccaccagcctccccagtacaaattagaccctagactggctaggctcttaggcgtgcacacacagaccagggcagcaattatgcaggcactgtggctctatataaagcacaaccaacttcaggacggccacgaaagagagtacatcaactgcaaccgatacttcagacagattttttcatgcggccgtctccgcttctcagagatccctatgaaactggccggattgctgcagcatccagatccgattgtcataaaccatgtcatctccgtcgacccaaatgatcagaaaaaaactgcatgttatgatatagacgtggaggtggatgatcccctgaaggcgcagatgtccaatttcctagcctcaacgacgaaccagcaggagattgcaagtctcgatgtcaagatccacgagactatagagtccattaatcagctgaagactcagcgagactttatgctgtcttttagtacggatccccaggactttattcaggagtggctcaggtcacagcggagggacctgaaaatcataacggacgtgattggaaaccctgaagaggaaaggcgagctgctttttaccaccagccctgggcccaggaagctgtgggccggcacattttcgcgaaagtgcaacagaggagacaagagctggagcaagtgctgggtattcggctcacttag

SEQ ID NO: 207588 - DNA, 1485 bp, Artificial Sequence
  Description of Artificial Sequence: Synthetic coding sequence
atgagcggccggggcgccggcggcttccccctgccccccctgagccccggcgggggtgctgccttccgccctatgggccctgccggccctgctgcccagtatcagcgccctggaatgagccccggcaacagaatgccgatggcgggactccaggtcggccctcccgctgggagccccttcggagcagctgcaccacttcgccccggcatgcctcccacaatgatggacccgttcaggaagcgtttgcttgtaccacaggcacagcccccaatgcctgcacagcgccggggactgaagcgccgtaagatggccgataaggttctgccacagcgaattcgtgaactagtgcccgagtcgcaggcctacatggatctactggcctttgaacgtaagctggatcagaccatcgctaggaagaggatggaaatccaagaagcaattaagaagcctctcacacagaagcgcaagctcagaatttatatatctaacactttctccccatccaaagctgaaggcgactcagccggaactgcggggacgcccgggggcactccagcgggtgataaagtcgcctcatgggagttaagagtggagggcaaactgctggatgatccgagcaagcagaagcggaaattctcgtcattttttaaaagcctcgtcatcgagttagacaaggagctgtacggccctgataatcatctggtggagtggcacagaatgcctactacccaggagacggacgggttccaggtcaaacgcccaggcgacttaaatgtcaagtgtaccctgttgctcatgctcgatcatcagcctccgcaatataaattagatcctaggcttgcgagattgttgggggtgcacacgcagacaagagccgctatcatgcaggctctgtggctgtacatcaagcacaatcagctgcaagacggacacgagagagaatatatcaattgtaatagatatttccgtcaaatattctcatgtggcagacttcggttctccgagattccaatgaaactggccgggctgttgcagcaccccgaccctatagtcattaaccatgtgatctctgttgacccgaacgatcaaaagaagactgcatgttacgacatagacgtggaagttgacgacccactgaaagcccaaatgagtaactttctcgcgagcactacgaatcagcaggagatcgccagtctcgacgttaagatacacgagaccatcgagtcgattaatcagttgaagacccagcgagacttcatgctctctttcagcacagatccacaagatttcatccaggaatggctgaggtctcagcgacgagacctgaagatcatcacagacgttatcggtaaccccgaggaagagaggcgggccgcgttttaccaccaaccctgggcacaggaagcagtcggaagacacatttttgctaaagtgcagcagcggcgacaagaactggagcaggtgctgggaattaggttgacgtag

SEQ ID NO: 207589 - DNA, 1452 bp, Artificial Sequence
  Description of Artificial Sequence: Synthetic coding sequence
atggccgccgacgaggtggccggcggcgcccggaaggccaccaagtctaaactatttgagttcttagttcacggcgttcgccccggcatgccttcaggtgctcgcatgccacaccagggtgcgcccatgggaccacctgggtctccatacatgggaagccccgccgtgcggccaggcttggcgcccgccggaatggagcctgctagaaagagggctgcacctcctcccggccagagccaggctcagtcccagggtcaacctgtccctactgctcctgcacggtcaaggagcgctaagcgacgaaagatggctgataagattctgccacaacggattcgggagctggtgccggagtcccaagcctatatggaccttttggcctttgagcgcaagcttgatcaaaccatcatgcgcaagcgtgtcgatatccaggaagcactaaaaaggcctatgaagcagaagcgaaagttacggctatacattagcaacacctttaaccccgcaaagcccgatgctgaagacagcgatggcagtattgcctcatgggaactgagggtcgaaggcaaattgctggacgaccccagcaaacagaagaggaaattcagctcgttttttaagtcactggtgatcgagctcgataaggacctctatgggccagacaatcatctcgtagaatggcatcgcaccccgactacgcaagagactgatggattccaagtaaagcggcctggtgacttgtccgttagatgcactttgttgcttatgctggattatcagcccccccagtttaagttggaccctcgcctggcccgtttactgggattgcatacacagagtaggagcgcaattgtgcaagccctatggcaatacgtcaagactaacaggcttcaggactcccacgataaggaatacattaatggggacaagtattttcagcagatcttcgattgtccaagattgaaattttccgagattcctcagcgcctgactgctcttctactcccacccgatcctattgttatcaatcacgttatctcagtagacccctcagatcagaaaaagactgcctgctacgatatcgacgtggaggttgaggaacccctgaagggccagatgtcttcatttctgctgtccacagctaaccaacaagaaataagtgctctggactctaaaatccatgagaccattgaatcgatcaaccaactaaagattcagcgggacttcatgctgtcattttctagggatcccaagggctacgtacaagatttactgcgcagccagagtcgcgatctgaaagtaatgactgatgtcgccggcaaccctgaggaagaacggcgagcagaattttatcatcagccctggtcacaggaagcagtctctcgttacttttactgcaagattcagcagcgccgacaggaacttgaacaaagtcttgtggtccgtaatacttag

SEQ ID NO: 207590 - DNA, 1308 bp, Artificial Sequence
  Description of Artificial Sequence: Synthetic coding sequence
atgacccccggcctgcagcacccccccaccgtggtgcagcggcccggtatgccctcaggggccagaatgccccatcagggtgctcctatgggacctcctgggtctccctatatggggtcacccgccgctccagcgcgctcccgatccgcaaagcggaggaagatggctgataagattctccctcagaggattcgagaattagtgccagagagccaagcatacatggatctcctcgcttttgaacggaaactggaccagactattatgcggaagcgggtagacatccaggaggcccttaaaagacccatgaagcagaagagaaagttgcgtctgtatatttctaacacttttaaccctgccaaacccgacgccgaagactctgacggcagtatcgcttcatgggagcttcgggttgagggcaagctgctggatgacccctctaagcagaagcgcaaattttcttcattttttaaatctttggtaatagaactggacaaagatctgtacggaccggataaccacctagtggagtggcacaggacgcctactacacaggagacggatggtttccaggtgaagaggccaggcgaccttagcgttagatgcactctgctcctgatgttggactaccaaccaccccagtttaaactggatcctcggttggctagactcctgggcctgcatacccagtctcgcagcgcgattgttcaagccctttggcagtatgttaagaccaataggctacaagactcccacgacaaggagtatatcaacggagacaaatacttccaacagatcttcgattgccctaggctgaagttcagtgaaataccccagaggctgacagccctgctgctcccccctgatcctattgtaattaaccacgtcatcagcgttgatcccagcgatcaaaaaaagacggcatgttacgacatcgatgtggaagtggaagaaccactcaaaggccagatgtcctcatttcttctaagcacggcaaaccagcaagagatttccgctttggattcaaagatccacgaaactatcgagtcaattaatcagctgaaaattcaacgcgacttcatgctttcctttagtagggatcctaaggggtacgttcaagacctcctcagatcacagtctcgagatcttaaagtcatgacagatgttgctggcaatcctgaagaggaacgccgtgccgagttttaccatcagccatggtctcaagaggctgtgtccagatacttctactgcaaaatacaacagagacggcaggagctggagcagagtctggtcgtgcggaatacctag

SEQ ID NO: 207591 - DNA, 1413 bp, Artificial Sequence
  Description of Artificial Sequence: Synthetic coding sequence
atgacccccggcctgcagcacccccccaccgtggtgcagcggcccggtatgccaagtggggctagaatgcctcaccagggggctccgatggggccacctggcagcccctatatggggagccctgccgtccgccccgggttggcgcccgcaggcatggaaccagcccgaaaacgtgccgcccccccgccaggccaatctcaggcgcagagccagggacagcccgtccccacagcccccgcaagatcgcgatctgcaaagcgaaggaagatggccgacaaaattttacctcaaagaattagagagttggtgcctgaaagtcaggcatatatggacctgctggcttttgagaggaagctggatcagactatcatgcgcaagcgggtggatatccaggaagccctcaaacggcccatgaaacaaaaacgtaagctgaggctctatatatccaacacctttaaccccgctaaacccgacgccgaggacagcgacgggagtatcgcctcctgggagttaagagtggaggggaagttgctggacgacccctccaaacagaagagaaagttctcctcattcttcaaaagcctggtgatcgagctggataaagatttatatggcccggacaatcatcttgtggagtggcatcgcaccccaaccacccaagagaccgacggcttccaagtaaagaggccaggcgacttgagcgttcgctgcactctcctcttgatgctagattaccagccaccacagttcaaactggacccaaggcttgcccgcctgctgggcctgcacactcagtctcggtccgcaattgttcaggctctctggcagtatgtcaagacaaacagactgcaggattctcacgacaaggagtacatcaatggagacaaatatttccagcagatttttgactgcccgcggctgaagttctccgaaataccacagcgtttgaccgctctgttgttaccacctgatcccatcgtgataaaccatgtgatcagcgttgatccctccgatcaaaaaaagaccgcatgttacgatatcgacgtggaggttgaagagcctttaaagggacagatgtcttcatttctgttaagtacagcaaatcaacaggaaatttccgcactggatagtaaaatccacgaaacaatcgagtccatcaaccagctcaaaattcagcgcgactttatgctttcgttctcccgggatccaaagggatacgtacaagatctgttgagaagccaaagccgagatctcaaggtgatgactgacgtggccggaaaccccgaagaagagaggcgggctgagttttaccaccagccgtggtcccaggaggctgtctctaggtatttctattgcaaaattcagcagcggagacaggagctggagcagtccttggtcgtcaggaacacgtag

SEQ ID NO: 207592 - DNA, 1413 bp, Artificial Sequence
  Description of Artificial Sequence: Synthetic coding sequence
atgacccccggcctgcagcacccccccaccgtggtgcagcggcccgggatgccatcaggggcccgtatgccacaccagggggccccaatgggccctcccggatcaccatacatgggctcccccgctgttcgtccgggactggcgcccgccggtatggaaccagcaagaaaacgtgccgctccacccccgggccagtcacaggcccagtctcagggccagcccgtgcccacagctcctgctcggtctcgcagcgctaagcgcagaaagatggcggataaaattcttccacaaagaattcgcgaactggtgcccgagtcacaagcttacatggacctgctggccttcgagaggaagctcgatcagacaattatgaggaagagggtcgatattcaggaagcccttaagcgtccgatgaagcagaaacgcaagttaaggctgtacatcagcaatacctttaacccagccaagccagatgcggaggatagtgatgggtcaattgcatcctgggagctgcgcgtggagggaaaactgctggacgacccttcgaaacagaagaggaagtttagcagcttttttaagagcctggttatcgaactggataaggacctgtatgggcccgacaatcacttggtggagtggcaccgaactccaactactcaggagacggacggatttcaggtaaagcgacccggggacctgtccgttcgatgcactctactcctgatgttggactaccagcccccacagttcaaactcgatccacgcctggccaggctgttaggtttacacacccaatcccggagcgccatcgtccaggccctctggcagtatgtgaagaccaataggctgcaagatagccacgacaaggaatacatcaatggggataaatattttcagcagatttttgattgcccaagacttaaattttcagagataccgcagcgactgactgcactcctccttccaccagatcccattgtcatcaaccacgtgattagcgtggacccttcagatcagaagaaaactgcttgttatgacattgatgtggaagtcgaggagccactgaagggtcagatgtcatcctttctactttcaacagctaaccagcaggagatatcagccctggatagcaagatccacgaaacaatagagtctataaaccagctgaagatacagcgcgactttatgctcagtttcagccgggaccctaagggctatgtgcaggatctcctacggtctcaatcaagagatttgaaggtcatgacggacgttgctgggaaccctgaggaggagcggcgggcggagttctatcaccagccctggagccaggaggctgtgtcacgctatttttattgcaagatccagcagaggagacaggagctcgaacaaagtctggttgtacgaaacacttag

SEQ ID NO: 207593 - DNA, 420 bp, Artificial Sequence
  Description of Artificial Sequence: Synthetic coding sequence
atgacccccggcctgcagcacccccccaccgtggtgcagcggcccgggatgccatccggcgccaggatgcctcatcaaggcgcccccatgggacctcccgggtcgccctatatggggagtcctgcggtccgccccggactggcacctgccggcatggaaccagctcgaaaaagggcggcgccaccccccgggcaaagtcaggctcagagccaggggcaacctgtgcccaccgcccccgccaggtcacgctcggccaaaaggcggaaaatggctgataagatcctgcctcaacggatacgggaacttgttcccgagagtcaagcttacatggatctcctcgcttttgaacgtaaactggatcagaccatcatgcgcaagcgcgtagacattcaggaagccctgaagaggcccatgaaatag

SEQ ID NO: 207594 - DNA, 3081 bp, Artificial Sequence
  Description of Artificial Sequence: Synthetic coding sequence
atgaacctgttcaacctggaccggttccggttcgagaagcggaacaagattgaagaagctccggaggccacacctcaacctagccagccagggccatcctcaccaatttcattatcagctgaggaggaaaatgctgagggagaggtttcgcgcgcaaacacccctgatagcgacataaccgaaaagacagaagatagcagtgtgcccgagacgccggataatgagcgcaaagcctccatttcttattttaagaaccaacgagggatacagtatattgacctttctagcgatagcgaggacgttgtgagtcccaattgttccaacaccgttcaagaaaaaacgttcaacaaggacacagtcattatcgtcagcgagccaagcgaggacgaagagtcacaaggcctgcccacaatggcgcggaggaatgacgacatctctgagctcgaggatctctccgaactggaagacctgaaggacgctaaactgcagaccttgaaagaactatttccgcagagatccgacaacgacctccttaaactaatcgaatccacatccacgatggatggcgccatcgcagccgctctcttgatgtttggagatgccggaggcggccctaggaagcggaagctgagctccagttcggagccttatgaagaagacgagtttaacgatgaccagtcaatcaaaaagaccagattggaccatggcgaagagagcaacgagagtgcagagtcaagttccaactgggagaagcaggagagtatcgttctcaagctacagaaagaatttccaaattttgataagcaggaactgagggaggtgctgaaggaacatgagtggatgtacaccgaggccttagagtcactgaaagtgtttgccgaagatcaggatatgcagtatgtctctcagagcgaagttccaaatggcaaggaggtgtcaagtcggtctcagaactacccgaagaatgccaccaagaccaagctgaaacagaagttctcaatgaaagctcagaacggtttcaacaaaaagagaaagaagaatgtgttcaatccgaagagagtggtggaagatagcgaatacgactcaggttccgatgtggggtccagcttggacgaagactattcatctggggaggaggtgatggaagatggatataagggcaagattttacacttcttgcaggacgctagcattggtgaactcactttaatccctcagtgctctcagaaaaaggcccaaaagataacggagttgaggccttttaatagttgggaggccctgtttacaaaaatgagcaagacaaatggcctctcggaggacctaatatggcactgcaaaacactgattcaggagcgcgacgtggtgattcgtttgatgaataaatgtgaggatattagcaataagctgacaaagcaggttaccatgctgacgggcaacgggggaggctggaacatcgagcagcccagtatcctcaatcagagcctgagcctgaagccgtatcagaaggtcgggttgaactggctagccctggtgcataagcacgggctgaacggcatcctggctgatgaaatgggactgggcaagactatccaggcaattgcctttctagcctacctgtatcaggagggaaataatgggccacacctgatagtcgtgcctgccagcacaatagacaattggctccgggaagtgaatctttggtgcccaacactgaaagtgttgtgttactacggcagccaggaggaacgcaaacagatccggtttaatattcactcacgctatgaggactacaacgttatcgttactacatacaattgcgccattagtagcagcgacgacaggagtctcttcaggaggctaaagttaaattacgccatattcgacgagggccatatgctgaagaacatgggttctattcgctaccagcacttaatgacgataaatgctaacaatcgattgctgctgaccggcactccagttcagaataacctgctggaactcatgtccctgctgaactttgtcatgccccacatgttctcatctagcacttcggagatccgtcgtatgtttagtagcaaaactaagagtgccgacgaacagtcgatatacgaaaaggagaggatcgctcacgcaaaacagattataaagccctttattctcagaagagtgaaggaagaggtcctcaaacagctgcctccgaagaaggataggatcgagctgtgtgccatgtccgagaagcaggagcaactgtatctcggcctgtttaatcggcttaaaaagtcaattaacaacctggaaaagaacacagaaatgtgtaacgtaatgatgcagctgcggaaaatggctaaccacccccttctgcatagacagtactataccgctgagaaactgaaggagatgtcacagcttatgttaaaagagccaacccattgtgaggctaatcccgaccttatcttcgaggatatggaggtgatgactgactttgagttgcacgtgctgtgcaaacaatacagacacatcaataacttccagttggatatggacttgattctggacagcgggaaattccgcgtcctcggctgcattctctctgagttgaaacagaaaggagatagagtagttctattctctcagttcaccatgatgctggacatcctggaagtgttgctgaagcatcatcaacaccggtacctgcgtctggacggaaagactcaaatctctgaacgtatccacctgatcgacgaattcaacacagatatggacattttcgtgttcctgctgtcaacgaaagctgggggcctcgggattaatcttacctccgcgaacgtcgttatcctgcacgacatcgactgcaacccctacaatgataagcaggcagaagacaggtgccatagggtgggccaaacgaaagaagtgctagtgatcaaacttatttcacaaggaaccattgaagaaagtatgctcaagataaatcaacagaagctgaagcttgaacaggacatgacaacagtagacgagggcgacgaggggtctatgcctgcagacatcgcaacgctcttgaagacaagcatgggtttgtag

SEQ ID NO: 207595 - DNA, 3087 bp, Artificial Sequence
  Description of Artificial Sequence: Synthetic coding sequence
atgaacctgttcaacctggaccggttccggttcgagaagcggaacaaaattgaggaagctccggaagcaacaccacagccgagccagcctggcccctcgagtcccatctccctgtctgctgaagaagaaaacgcagaaggcgaggtgagccgggccaacaccccagactccgatatcaccgagaagacagaggattcatcagttcccgagacgcctgacaatgagcgcaaggcctccatcagttactttaaaaatcaacgcgggattcagtacattgacttgtctagcgattccgaagacgtggtgtcaccaaactgctccaatacagtgcaggagaaaacctttaataaggataccgtgatcatagtcagcgagccttccgaggatgaagaatcccagggcttgcctactatggccagaaggaatgatgatataagcgaactcgaagatcttagcgagctcgaagatctcaaagacgccaaactccagacactgaaggaactgtttccccagcgatcagataacgatctgttaaagctaattgagagcacaagtacaatggacggagctatagctgcagctttgttgatgtttggagatgctggggggggtccgaggaagaggaagctcagctccagttccgagccttatgaggaagatgaattcaatgatgatcagtccatcaaaaaaaccaggctggaccacggagaagagtctaacgagagtgctgagagcagctcaaactgggaaaagcaggagtcgattgtgttaaagcttcagaaagagttccccaactttgacaagcaggagctgagggaggtgctgaaggagcatgagtggatgtataccgaagcgcttgaatccttgaaggtttttgcagaggaccaagatatgcagtacgtgagccagagtgaggtgcccaatggaaaagaagtgagcagccgctcacagaactatcccaaaaacgcgacaaaaactaaactcaagcagaagttcagcatgaaggcccagaatggattcaacaagaagcgaaaaaagaatgtcttcaatccgaaacgggtggtggaggactcagagtatgactcaggctccgatgtgggtagttcgttggatgaagattacagctcaggcgaggaagtcatggaagacggctacaagggcaaaatcctgcactttctgcaggacgcttcaattggggagctcacactgatcccacagtgcagccagaaaaaagcacagaagattactgagctcaggcctttcaacagctgggaggccctgtttaccaagatgtctaagacaaatgggctgagcgaggaccttatatggcactgcaaaaccctgattcaggagcgtgatgtggtgatcaggctgatgaataagtgtgaggacataagtaacaaactaaccaagcaagtcacgatgctgactgggaacggcgggggatggaacatcgaacaaccttctatcttgaaccagagtctcagcctaaagccctaccagaaagtggggctgaattggctagccctggtacataagcatggactgaacggcattctcgcagatgaaatgggactcgggaaaacaatccaggctatcgcgtttttggcttacctgtaccaggagggaaataatgggccccacctgatcgtcgtacctgcctccacaattgataactggctgcgcgaggttaacctgtggtgtccgacgctgaaggttctgtgctactacggctcccaggaagaaaggaagcagatccggttcaacatccacagcagatatgaggattacaatgtcatagtgactacatacaactgtgcgatctctagctcagatgaccgtagcttgttccggcgcttgaagttgaattacgcaatcttcgatgagggccacatgctcaagaatatgggatcaattcggtatcagcatcttatgaccataaacgcgaataaccgcctactcctgactggtactccagtgcagaacaatcttctggagttaatgtcactacttaactttgtgatgccacacatgttttcatcctcaacaagcgagatccgccgaatgttttcttctaagactaagagcgctgacgagcagagcatctacgaaaaagagcgaatcgctcacgccaaacaaatcatcaagccctttatcctgcgtagggtgaaggaggaggtcctgaaacagcttccccccaagaaggatagaattgaactgtgtgcgatgtccgagaagcaggaacaactgtatctggggctcttcaacaggctgaagaagagcatcaacaaccttgtgacggagaagaatactgagatgtgcaacgttatgatgcaactccgaaaaatggcgaatcaccctctgttacacaggcagtactacacagccgaaaaactgaaggaaatgtcacagctcatgctgaaggagcctacacactgtgaggccaatcctgatctcatttttgaggatatggaagttatgaccgactttgagcttcacgtcttatgcaaacaatatagacatattaataactttcagctcgacatggacctgatcctcgattccgggaaattcagggtgctcgggtgtatcctgagcgagctcaaacagaagggagatcgcgtagtactcttttctcagttcactatgatgttggacatattagaggttcttcttaagcaccaccagcatagatacctcaggttagacggcaagacacagatttcagagagaattcacctcatcgatgagttcaatacggacatggacattttcgtgtttctgttgtctaccaaagccggtgggctgggcatcaacctgacgtctgccaatgtggtgattcttcatgatattgactgtaatccctacaatgacaaacaggcagaggacaggtgccaccgggtgggccagacgaaagaggtgctagttataaagttgattagtcaaggaaccattgaagaatctatgctcaaaattaaccaacagaagctcaagctggagcaggacatgacaactgtggatgaaggggacgaaggtagtatgcctgcagatatagctactttgcttaaaacatccatggggctgtag

SEQ ID NO: 207596 - DNA, 3087 bp, Artificial Sequence
  Description of Artificial Sequence: Synthetic coding sequence
atgaacctgttcaacctggaccggttccggttcgagaagcggaacaaaattgaggaggccccagaagctacaccacagccaagccagcctggaccttcttcacccatttccctgagtgctgaagaggaaaacgcagaaggcgaggttagccgagcaaacacgcctgattctgacatcaccgaaaagacggaggacagctccgtcccagagacgcccgacaatgaacgtaaggcaagtatttcctacttcaaaaatcaacggggcattcaatacattgatctgtcaagtgattctgaggatgtagtgagtccaaattgcagcaatacagtgcaagagaaaactttcaacaaggacaccgtgattatcgtttcagaaccctccgaagacgaggagagccaggggttaccaactatggcacggaggaatgatgacatcagcgagctcgaagatttgtccgaactggaggatctgaaggacgctaagttgcagacactgaaggagctcttccctcaaaggtctgacaacgacttgttaaaactcattgagagtacaagcactatggatggagcgattgctgctgctctgctcatgttcggagatgccggtggaggtcctagaaagcgtaagctcagcagttcctcagagccatatgaagaggatgagttcaacgacgaccaaagtatcaaaaaaacacggttagaccatggggaagaatcaaacgaatccgctgaaagcagctcaaattgggagaaacaggagagcatcgtgttaaaactgcagaaggaatttccaaatttcgataaacaggagctgagggaggtgctcaaagagcacgaatggatgtacacggaagccctcgaaagtcttaaagtatttgccgaagaccaggacatgcagtatgtgagccagtctgaggtgccgaatgggaaagaggtttcatcaagatcccagaactaccctaagaatgccaccaagacaaagctgaagcagaagttcagcatgaaggctcaaaacgggttcaataaaaagagaaagaaaaacgtgttcaatcccaaacgggtagtcgaggattctgagtacgactcagggtctgacgtgggttctagcctcgacgaggactattccagtggtgaggaggtgatggaggatggatataaaggcaagattctgcatttcctgcaggacgctagcatcggagaactcactttgattcctcaatgctctcagaagaaggctcagaaaattacagaactgagaccatttaatagctgggaggcgttattcacaaaaatgagcaaaactaacgggctgtctgaagacctgatctggcactgcaagactctcattcaggagcgcgatgtagtaatcaggctcatgaacaaatgtgaagacattagcaacaagttaacaaagcaggtgaccatgctgactggaaatggtggagggtggaacattgagcagccctccattcttaaccagtccctgagcctgaaaccatatcagaaagtgggtctgaactggttggccctggtgcataagcatggcctgaacgggattctggcagacgagatggggctagggaaaacaattcaagcaatcgcctttttagcgtatttataccaagagggcaacaatggaccgcatttaatcgtagtgccagcctcaaccatcgataattggctgagagaggtgaacctttggtgccctactctcaaggtgctgtgttattacggatcccaggaagaacggaagcagatcagatttaacatccactcccggtatgaagattacaacgtcatcgtgacaacctacaactgtgctatctcctcatccgatgaccggagcctatttaggagactgaaacttaattacgcgatcttcgacgaaggccatatgctgaaaaacatggggtcaattcgataccagcacctcatgaccattaacgccaataataggctgctactaacagggacaccagtacagaacaacctccttgagctcatgtctcttctgaattttgtcatgccacacatgttcagcagctcaacatccgagattcggcgcatgtttagtagtaaaaccaagtccgctgacgaacagagcatctacgagaaagaacggatagcccatgccaaacaaattattaagcctttcatcctccggagggtgaaggaggaggtcctgaagcaactgccacctaagaaggaccgtatcgaactctgtgccatgtcagagaaacaggagcaactttacttgggcctgttcaatagactgaaaaaatctatcaacaacctcgtcacagaaaagaataccgagatgtgtaacgttatgatgcagctccgtaaaatggcaaaccatcccctccttcaccgtcaatactataccgcagagaagctaaaggaaatgtctcaattaatgctgaaagagccaacacactgtgaggctaaccctgatctaattttcgaggacatggaagtgatgactgatttcgaattacacgtgctctgcaagcagtaccgccacataaacaatttccagcttgatatggatctaattctggactccgggaagttccgtgtgctcggctgcatattgtctgaactgaaacagaagggcgaccgtgtggttctcttttcccaattcaccatgatgctagacatcctcgaggtgctcctaaagcaccaccagcacagatacctgaggcttgacggtaagacccaaatctccgaaagaatccatttgattgacgagtttaatactgacatggacattttcgtgtttttgctgtcgaccaaggcgggtggtctgggcattaacctcacctccgctaatgtggtaattttacatgatattgactgtaacccgtacaacgacaaacaggccgaggaccggtgtcatagggtgggccaaacgaaagaggtcctggtcatcaagctgatatcccagggaactattgaagaatcaatgcttaaaatcaaccagcagaagcttaagctggaacaggacatgacaaccgtggacgagggagatgaaggctctatgcccgcagatattgccactctgctgaagacctctatggggctctag

SEQ ID NO: 207597 - DNA, 957 bp, Artificial Sequence
  Description of Artificial Sequence: Synthetic coding sequence
atgaacctgttcaacctggaccggttccggttcgagaagcggaacaagattgaggaagcacctgaggccacaccccaacccagtcagcccggccctagctcacctatttcactcagtgccgaagaggagaacgcggaaggggaggtcagccgcgcaaacactccagactcggatattacagagaaaacggaggactcctctgtgccggagactcccgataatgagcgcaaagcctccatctcctatttcaagaatcaacgaggcatccagtatatcgatctgagcagtgacagcgaagatgtggtttctcctaactgctcaaataccgtccaggaaaagacattcaataaggacaccgtgatcatcgttagcgaacccagtgaagacgaggagtctcagggcctgccgaccatggccagaaggaacgacgatatcagtgagctggaagatctgtccgagctcgaggacctgaaggacgccaagcttcagaccctgaaagagctgttcccacagcggagcgacaacgatctgcttaaactgatcgagagtacctccactatggacggagccatcgctgccgcattgttgatgttcggtgacgctggagggggcccgcggaaaagaaaactctcaagcagctccgagccatatgaggaggatgaatttaacgatgaccagagtattaagaaaactcggcttgatcatggagaggagtccaatgagagtgcagagtcaagcagcaattgggagaaacaggagtctattgtgctgaaactgcagaaagagttccccaatttcgacaaacaggagctgcgcgaggtgttgaaagaacacgagtggatgtatacagaagcattggagagcctcaaggtctttgctgaggaccaggatatgcagtacgtgtcgcagagcgaggtgccaaatgggaaaaagaaggctcaaaaaaagaagaagtag

SEQ ID NO: 207598 - DNA, 732 bp, Artificial Sequence
  Description of Artificial Sequence: Synthetic coding sequence
atggccgccatcgccgccagcgaggtgctggtggacagcgccgaggaaggatcccttgcagcagccgcagaactggcggcacagaagagagagcagcggctgcgcaaattccgtgaactgcatctgatgcgtaacgaagctcgcaagctaaatcaccaagaggtggtggaagaggacaagagactgaagttaccagctaactgggaagctaagaaagctcggcttgaatgggagttgaaagaggaggagaaaaaaaaggaatgtgccgctcgaggagaagattacgaaaaggttaagctgttagagatctcagccgaggacgccgagcgctgggagaggaagaagaaacgaaaaaaccctgacttaggcttctcagactatgcggcggcccaactgcgccagtaccatagacttaccaaacagattaaaccagatatggagacatatgagcgcctgcgcgagaagcatggcgaggaatttttccccacaagcaatagcttgctgcacggcactcatgtccctagcacagaggagatcgaccggatggtgattgacctggagaagcagatcgaaaagagggacaaatactcccggcgtcggccctataatgacgacgccgacatcgactatattaacgaaaggaatgcaaaatttaataaaaaggccgagcggttctatggcaagtataccgctgagatcaagcagaaccttgaacgtggcaccgctgtttag

SEQ ID NO: 207599 - DNA, 606 bp, Artificial Sequence
  Description of Artificial Sequence: Synthetic coding sequence
atggccgccatcgccgccagcgaggtgctggtggacagcgccgaggaggggtctctagccgcagccgcggaactggccgcacagaaaagagaacagaggttgcggaagtttagggaactgcacctgatgagagagtgtgcagcaagaggtgaagattacgagaaggttaaactgcttgagatttcagctgaagatgctgaacggtgggaacgtaagaagaaaaggaagaaccccgaccttgggttcagtgactacgcagcggcccagctgaggcaataccaccgtctcaccaaacagattaagccagatatggaaacttacgaacggctgagggaaaagcacggagaagagttcttccccacgtctaattcactgcttcacgggacacatgtacctagcactgaagagatcgatagaatggtcattgatctggaaaagcagattgagaaacgtgataagtactctcgaagacgtccctataacgacgacgcggatatcgattacattaacgagaggaatgctaaattcaacaaaaaagccgagcgattttacggaaaatatactgccgaaattaaacagaatctggagcggggcaccgcggtatag

SEQ ID NO: 207600 - DNA, 777 bp, Artificial Sequence
  Description of Artificial Sequence: Synthetic coding sequence
atggacggcatcatcgagcagaagagcatgctggtgcacagcaagatcagcgatgccgggaagaggaatggcctcatcaatacccgaaacctgatggccgaatctcgtgatggcttagtctcggtgtatcctgcaccccagtaccagtcgcatagggtgggcgccagcacagtgccagcaagcctggactccagccgatctgagccgatgcaacagctgttagaccctaatacacttcagcagtctgtggagagccggtaccggcccaacattattctctactctgaaggggttcttagatcgtggggcgacggtgtggccgcagactgctgcgaaactacttttatagaagatcgcagccccactaaggacagtctggagtaccctgatggaaaatttatcgacctgagtgccgacgatattaagattcatacactttcatatgacgtggaagaggaggaggagtttcaagaactagaatccgattatagttctgatactgaatcagaggataacttcttgatgatgccaccccgcgatcaccttggactgtccgtcttctccatgctgtgctgtttttggcccctgggtatcgctgcattttatctgtctcacgagaccaataaggccgtggcaaagggcgacctccaccaagccagtacgtctagtagacgggctctgtttcttgccgttctttcaatcactattggcaccggcgtatacgtcggggtcgccgtggccctcatcgcctatttgagcaagaataatcacctatag

SEQ ID NO: 207601 - DNA, 717 bp, Artificial Sequence
  Description of Artificial Sequence: Synthetic coding sequence
atggagagcctgagcgagctgcagaaccccctgctgccccggagccctgcgcacctccacggaccctatccctacccagagacaccaccttcatggtcttgtcaggaaaagctctacagctacttgctagggggggcgggtcccgcaggcgctcaccagctgctggaccctggatccctgcagctggccgtggaggcctggtaccgcccttcctgtcttctaggacgcgacaaggtgaaggagcccagggcggggagttgtgagacatcattcactgaggaccgtgagccccaggaaggcccaccagaacagcccacaggcccaggtcaagcagctgaaaatgttactattcagacagtgtcttatggagtacaggaagagctccgagaccaagaggatgaccaagaagaggaagaatccgacgcaacgtccacggagtcggagagtgaagacaacttcttaactctccccccgcgggaccaccttggcctgacactgttttcaatgctttgttgcttttggccacttggaatcgctgctttttactttagccaaggcacctccaaggctatatcgaagggtgattttcgcttggccagtactacctctcgtagagctctgttcctggctacactggccatagctgtgggagctggcctgtacgtggccgttgtggtggcactggccgcttacatgagccaaaacgggcacgggtag

SEQ ID NO: 207602 - DNA, 717 bp, Artificial Sequence
  Description of Artificial Sequence: Synthetic coding sequence
atggagagcctgagcgagctgcagaaccccctgctgccccggagccccgctcatctgcacggtccctatccatatcccgagactcccccatcatggagctgccaggaaaaattgtacagttacctgctggggggagccgggcccgcaggcgcacatcagttactagatccaggcagcctgcaattggccgtcgaagcctggtacagaccaagctgtttactgggaagggacaaagtgaaggaacctagggcaggttcttgcgagacaagctttaccgaggaccgggagccgcaggaaggcccaccagaacagcctactggccctggtcaagccgccgaaaacgtgactatacagacagttagttacggtgtgcaggaggagttacgagatcaggaagacgaccaggaggaggaggaatctgacgctaccagtaccgaaagtgagtcagaagacaatttcctgactttgcccccgagagatcatctcgggctgacactcttttccatgctgtgttgcttttggcccctgggcatcgcggccttctacttcagccagggcacctctaaagcaattagcaagggagactttagacttgcctctacaacctccagaagggcgctctttcttgctacccttgcaatagccgtgggggccggactttacgttgccgttgtcgtggcgctagctgcctacatgtctcagaacggccacggatag

SEQ ID NO: 207603 - DNA, 243 bp, Artificial Sequence
  Description of Artificial Sequence: Synthetic coding sequence
atggagagcctgagcgagctgcagaaccccctgctgccccggagccccgctcatctccatggcccctacccatacccagagactccaccttcctggagctgtcaggagaaactgtactcatatctcctaggcggggccggcccggccggagcacatcagcttctagatcccggaagcttgcagttagccgtggaagcttggtatcggcctagttgtctcctgggaagggataaagtcaagtag

SEQ ID NO: 207604 - DNA, 2118 bp, Artificial Sequence
  Description of Artificial Sequence: Synthetic coding sequence
atgaactacctgcggcggcggctgagcgacagcaacttcatggccaatctgcccaacggatatatgactgatctgcaacgccctcagcctcccccacctcctccaggtgcacactcacctggggctaccccaggccctggtaccgctacggctgagcggtcatctggtgtagcgcctgctgcgagcccagctgctcctagcccaggcagcagcggaggcggagggttcttttcgagtctgagcaacgcagttaaacagactacagcagcagctgctgccacctttagcgagcaggtaggcgggggctcaggaggagcagggaggggcggtgctgcctctagagtcttattagtgatcgacgagcctcacacagactgggccaagtacttcaaagggaagaagatacatggggagatcgatatcaaagtggagcaggcggagtttagcgacctgaacctggtcgcccacgctaatgggggttttagcgtagacatggaagtgcttcggaatggggtgaaagtggttcggtctctcaaacccgatttcgttcttattagacagcatgcttttagcatggccagaaacggcgattatcgaagtctggttatcgggcttcagtatgcaggcattccttccgtaaattctctgcatagtgtttataatttctgtgataaaccctgggtgtttgcccagatggtgagactgcacaagaagctgggcaccgaggagttccccctcattgaccagacattttatccaaatcacaaagagatgctatctagtacaacctacccagtcgtcgtcaagatgggacatgcacattctggtatgggcaaggtgaaagttgacaaccagcatgatttccaggacattgctagtgtcgtggctctcacaaagacatacgctacggcagagcctttcatcgatgctaaatacgacgtacgcgtccaaaagatcggtcagaattataaggcctacatgaggacaagtgttagcggcaactggaagactaatacggggagcgccatgctggagcagatcgctatgtctgatcggtacaagctgtgggtggatacctgcagcgagatatttggcgggctggatatatgtgctgtggaggccctacacgggaaggatgggagggaccatatcatcgaggtcgtgggttcttccatgcctttgataggtgatcaccaggatgaggacaaacagctcattgtagagctggtggtgaataaaatggctcaggccctgccaagacagaggcaaagagacgcttcacctgggaggggcagtcacggtcagacgccgagccctggcgccctgcccctggggagacagacgagccagcagccagctggtcctcctgcccagcagagaccccctccccagggtggtcccccacagccaggcccgggaccccaaaggcaaggacccccccttcagcagcggcccccccctcaaggtcagcagcatctgagcggcctgggaccccctgccggtagccctttacctcaacggttaccctcccccacctccgctccacagcagcccgcatcgcaggccgctcctccgactcaaggccagggcagacagtccagacctgttgccggtggccctggagccccaccggcagcccgccctccggcttcaccaagcccccaacggcaggctggcccaccgcaggccacgaggcagacctcagtctccggcccagcaccccctaaagcctccggagccccccccggcgggcaacagagacagggaccccctcagaaacctccaggccctgccggtccaacacgccaggctagccaggccggacctgttcctaggactggcccacctacaacccaacagccaaggccctccgggcctggacccgccggacggccaaagccccagttggcacagaaaccttcacaggatgtgcccccacccgcgacggcagctgccggtggaccaccgcacccgcaactgaataaaagtcagagcttgaccaacgcttttaatctccctgagccagcgccgccacggccttcgctctctcaggatgaagtgaaggccgagaccattaggtcactgcggaagtccttcgcttccttgtttagcgattag

SEQ ID NO: 207605 - DNA, 2010 bp, Artificial Sequence
  Description of Artificial Sequence: Synthetic coding sequence
atgaactacctgcggcggcggctgagcgacagcaacttcatggccaatcttcccaatggttatatgaccgacctccagcggcctcagcctcctcctccaccacccggagcgcattctcctggtgccacccccggccctggcactgcaactgcagagcgctcttccggggttgcgcccgcagcctcccccgctgcgcctagccctgggagttcaggaggtggtggtttcttctccagcctgtccaatgcggtgaagcagacaaccgccgccgctgctgcaaccttctctgagcaggtcggtggcggctctggcggagcaggccggggtggcgccgcaagccgtgtcctactggtaatagatgagccccacactgactgggcgaaatactttaagggaaagaaaatccacggggaaattgatattaaggttgagcaggccgaattttcagatcttaatctagtagcccacgctaacggcggcttctcggttgacatggaagtcctgcgtaatggtgtaaaggtagtccgatccctgaagccagacttcgtgctgattcgccaacatgcgttctcaatggccagaaatggggactacaggagtctggtcattggtctgcagtatgctggtattcccagcgtaaacagcctgcatagcgtgtacaatttttgtgacaaaccatgggttttcgcacagatggtacggttgcataaaaaactggggacggaggagttcccacttatcgaccagaccttttacccgaaccacaaagagatgttgtcctctaccacctaccccgtggtcgtgaaaatgggccacgcccattctggtatggggaaggtgaaggtcgataatcagcatgacttccaggatatcgcgtcagtggtggctctaacgaagacttacgcaactgcagagcctttcattgatgctaaatatgatgttcgcgtgcagaaaatcgggcagaactacaaagcctacatgaggacttcagtgagtggaaactggaaaacgaatacaggcagcgctatgctcgaacaaattgcgatgagtgataggtacaagctctgggtagatacgtgcagcgaaatcttcggggggctggacatttgtgctgtggaagccctgcacgggaaagatgggcgcgaccatattatagaggtcgtgggcagttccatgccgctcatcggcgaccatcaggacgaggacaagcagttaatcgtggaactagtggtcaacaagatggctcaggccctcccccggcagcgacagagggacgccagccctgggcgtggctcccacggccagacaccaagcccaggagccctgccgttaggtcggcaaacgagtcagcagcccgctggaccccctgctcaacagaggcctccacctcagggaggaccacctcaacctgggccaggcccgcagcgtcaagggccacctctgcaacaacgccctccaccacagggacagcagcatttgagcggacttgggcctcccgccgggagcccactgccgcagaggttgcccagtcccacatccgctcctcagcaacctgcaagtcaggctgctccgcctacacaagggcagggccgccagtccaggcccgttgccggcggcccaggcgcaccccctgccgcccggcctcccgcctctccttccccgcagcgtcaggccggccccccccaggctactcgccaaacatctgtctccggaccagccccccccaaggcaagcggggcacccccagggggtcagcagcggcaggggccgcctcaaaagccacccggaccagctggtcccacccgacaggcctcacaggcagggccagtgcctaggacgggcccacccaccacccaacagcctaggccatccgggcctggccccgcagggcggcctaagccccagctggcacagaagccctcacaggacgtacccccaccagccaccgccgccgctggcggtccaccacacccccagttgaaggcctcccccgctcaagcgcagccgtag

SEQ ID NO: 207606 - DNA, 1743 bp, Artificial Sequence
  Description of Artificial Sequence: Synthetic coding sequence
atgaacttcctgcggcggcggctgagcgacagcagcttcatggccaacctgcccaatgggtacatgaccgacctgcagcggcctgactccagcactagctcccccgcctctcccgccatggagcggaggcaccctcagcctctggcagcaagcttctcaagccctggctcatctctattctcatctctgtcttcggccatgaagcaggcaccccaggccacaagcggtctgatggaaccaccaggcccctctactcctatcgtacagcgtccaagaattctcctcgtaatagacgacgcccataccgattggtccaagtattttcacggaaaaaaggttaacggagaaattgaaatccgcgttgaacaagccgagtttagtgagcttaacctagctgcttacgtgaccgggggttgtatggtagacatgcaggttgtgcggaatgggaccaaggtggtcagccggtcattcaaaccagacttcattctggtgagacagcacgcttattccatggccctcggagaggattatcgatccctggttatcggtctgcagtacggtggactccctgcagtaaattctctttatagtgtttacaatttctgcagtaagccatgggtgttttcccagttaatcaagatcttccatagtctcgggcctgaaaagttccctctggtggaacagacgttcttccccaatcacaagcccatggtgacagcccctcacttcccagttgtggtaaagctgggccacgcccacgcaggcatgggcaaaatcaaagtggaaaatcagctggacttccaggatattactagcgtcgtggccatggctaagacatatgccaccaccgaagcgtttattgatagcaagtatgatattcggatacagaaaattggctcaaactataaagcatacatgaggaccagtatctccggaaattggaaagccaacaccgggtccgctatgctcgagcaggtggcaatgacagagcgctaccgtttgtgggtggactcttgtagtgaaatgtttggcggactggatatatgtgccgtgaaggccgtgcactctaaggacggccgagactatataatagaggttatggatagtagcatgcccttaattggcgaacatgtggaggaggatcggcagcttatggccgacctggtcgtcagcaagatgagtcagctgccaatgcctggggggaccgccccctcacccttgagaccctgggcacctcagatcaaatctgcaaagtctccgggacaggcacagctgggtcctcagctcggtcagccccagccaaggcctcctcctcaaggcgggccgaggcaggcccagagcccacagccccagcgctccgggtcgcccagccagcaacgccttagtccccagggacagcagcccctgtccccccagtcaggatcaccccagcagcagcggagcccaggtagcccccagctgtcaagggctagctccggctcatctccaaatcaggcctctaaaccaggcgccacactggctagtcagccacgtcccccagtgcagggtagatccacatcacagcagggtgaggaaagcaaaaaaccagcacccccccatccgcatctaaataaaagccagagtctcaccaattctttgagcacttcggacacctctcagcggggtactccctccgaggatgaggccaaagccgaaacaattagaaacttaaggaaaagcttcgcaagcttgtttagtgactag

SEQ ID NO: 207607 - DNA, 1743 bp, Artificial Sequence
  Description of Artificial Sequence: Synthetic coding sequence
atgaacttcctgcggcggcggctgagcgacagcagcttcatggccaacttgccaaatggctacatgactgacttacagcgccccgactcttccacctcttcaccagcaagtccagcaatggaacgaaggcacccacaacctctggcagcatctttctcaagtccgggcagcagcctcttctcttccctgtcctccgccatgaaacaagctccacaggccactagcgggttgatggagccaccaggtccatccacacccattgttcagaggccgcgtatcctcctggtgatcgacgacgctcatacagactggtcaaaatatttccatgggaagaaggtaaacggtgaaattgagattagggttgaacaggccgagttctcagagctcaacctggctgcatatgtcaccggaggctgcatggtggatatgcaggtagtccggaatggaacaaaagtagtttcccggtctttcaagcccgacttcatcttggtgagacagcacgcttacagtatggctctcggagaggactacaggagcctggtcatcggactgcagtacggaggtcttccggctgtgaatagtctctattccgtgtataacttttgcagcaaaccctgggtcttcagccagctgatcaagatcttccactctctgggaccggaaaagttcccgttagtcgagcagacttttttcccaaaccataaacctatggtgactgccccccacttccctgtggttgtgaagctgggacacgctcatgctggaatgggtaagattaaggttgaaaatcagctggacttccaagatattacaagcgtggtggcgatggccaagacatacgcgacaactgaagcattcattgactcgaagtacgacatcagaatccaaaagattggcagcaattacaaagcctatatgagaaccagcattagtgggaactggaaagcgaacacaggatcggctatgctagaacaagtcgccatgactgaacgatatcgcctgtgggtggacagttgcagtgaaatgttcggaggcctcgacatttgcgcagtgaaggctgtgcatagtaaggacggtcgtgactatattatcgaagtgatggattcttctatgcctttgatcggtgagcatgtcgaagaagatcgccaattgatggccgacctcgtcgtgagtaaaatgtctcaactgccaatgccgggcggtactgcgcctagccctctgcgcccttgggcccctcaaatcaagagcgccaagtccccggggcaggcgcagctagggcctcaactgggccaaccacagccgcggccaccacctcaaggaggcccacgtcaggcccagagtccgcagccacaacggtctggttcaccatcgcagcagcgcctaagtcctcagggtcaacaacctctcagccctcagtccggctctccacagcaacagcgctccccaggcagtcctcaactttcccgagcctccagtgggtccagccccaaccaggcaagcaagccaggggccactcttgcctcgcagccgaggccaccagtgcagggacgctctacgtctcagcagggggaagaaagtaagaagcctgctcccccgcatccacacctcaacaaaagtcaatccctgaccaactcattgtctacttctgatacaagccagagaggcactccatctgaggatgaagccaaagccgagaccatcagaaacttgcgtaaatcttttgctagcctatttagtgactag

SEQ ID NO: 207608 - DNA, 1335 bp, Artificial Sequence
  Description of Artificial Sequence: Synthetic coding sequence
atgaacttcctgcggcggcggctgagcgacagcagcttcatggccaacttgcctaatggatacatgactgatctgcagcgccccgattcaagcaccagtagcccagctagtcccgccatggaaagaagacacccacagccgctggcggcttctttttccagccctggctccagtttgttctcctccctaagcagtgccatgaaacaagcccctcaggccacatccggtcttatggaacctccaggcccatcgacaccaattgtccagagaccacgtatcctgctcgtgatcgatgatgctcacacagattggagtaagtatttccatgggaagaaggtaaacggagagatcgagattcgggtggagcaggcggagttttcagagctcaatttagctgcctacgttactggcgggtgtatggtggatatgcaggtggttcgtaatggcactaaagttgtgagcaggtcgtttaagccagactttatcctcgtgagacagcatgcctactccatggcattgggcgaggactatcgcagcttggtgatcggcctgcaatacggcgggctcccggcagttaactctctgtattccgtgtataatttttgctcaaaaccatgggtgttcagtcagttaattaagatatttcattcactggggcccgaaaagttcccccttgttgagcagacgttttttcctaaccacaaacctatggtgactgcaccacatttccccgtggttgtgaagctgggtcacgctcatgccggaatgggtaagatcaaagtggagaatcagctcgactttcaggacattacatcggtcgtagcaatggccaagacttacgccacgaccgaggcctttattgactccaagtacgatataagaattcaaaagattggatccaactataaggcatacatgaggacatcaatttctggcaactggaaggcaaacacaggaagcgccatgcttgaacaggtggctatgacagagagataccgattgtgggtggactcctgctctgagatgtttggggggctcgatatctgcgctgttaaggccgtacactcgaaggacggcagggactatattatcgaggtgatggattcctcgatgcccttaattggagagcacgtggaggaggacaggcaactgatggctgatttagtggtctccaagatgtctcaattgccaatgccaggcgggaccgcgccatctcccctgagaccatgggcaccacagataaaatcggccaagtcaccaggccaggcccaactaggcccacagctgggccagccacaaccacggccccccccacaggtctctttctctccgtag

SEQ ID NO: 207609 - DNA, 342 bp, Artificial Sequence
  Description of Artificial Sequence: Synthetic coding sequence
atgaacttcctgcggcggcggctgagcgacagcagcttcatggccaacctccccaacggatacatgactgatctgcagcggccagactcttcaaccagtagcccagcgtcccctgcaatggagagacggcacccccaacccctggccgcctccttttccagccctgggtcaagcctcttcagcagcttgtcttcagcgatgaaacaggcgcctcaggccacctcgggcctaatggagccccccggtccgtccacgcctatagtccaacgaccacggatcctacttgtgattgatgacgcacacaccgactggtccaagtatttccacggcaagaaagtgtag

SEQ ID NO: 207610 - DNA, 372 bp, Artificial Sequence
  Description of Artificial Sequence: Synthetic coding sequence
atgaacttcctgcggcggcggctgagcgacagcagcttcatggccaacctgcccaatggctatatgactgacttacagcgccctgacagtagcacctctagccctgcctctcccgcgatggagaggagacacccacagccgctcgccgccagcttttccagcccggggagctcactcttctctagtctttccagcgccatgaaacaggcaccccaggccactagtggcctgatggaaccgccggggccctcaactcctatcgtgcagagaccacgaatcctactcgtgattgacgatgctcatacagactggtccaaatatttccacggcaaaaaggtgaacggggagatcgagataagggtggaacagtag

SEQ ID NO: 207611 - DNA, 561 bp, Artificial Sequence
  Description of Artificial Sequence: Synthetic coding sequence
atggacagcagcatgcccctgatcggcgagcacgtggaggaggacaggcagctgatggctgacctagtcgtttcgaaaatgtctcagttacccatgcctggaggaacagccccaagtcccctgcggccctgggccccccaaatcaagagtgctaaatctccaggccaggctcaactagggccacagctgggccagcctcagccaaggcctcctcctcaggggggcccccgacaagctcagtctcctcagcagcaaagatcccccggttctccccagttgtcaagagccagcagcggctcgagtcccaatcaggcctccaagcccggtgcgacactggcctcacagcctcggcctccagtccaaggcaggagcacttcccaacagggcgaggagtccaagaagccagccccaccccatcctcatctcaacaaatctcagtccttgacaaactcactgagtacaagtgacacctcacagcggggaaccccttcagaagacgaggcaaaagccgagaccattcggaacctcaggaagtcattcgcttctctcttttccgattag

SEQ ID NO: 207612 - DNA, 1212 bp, Artificial Sequence
  Description of Artificial Sequence: Synthetic coding sequence
atgagccaccggaagttcagcgccccccggcacggcagcctgggcttcctgccacgcaagcggtccagccggcaccgcggaaaagtgaaaagcttccccaaagatgaccctagtaagcctgttcacctaaccgcttttcttggttacaaagctgggatgacacacatcgttcgcgaggtggatcgacccggctccaaagtaaacaagaaggaggtggtggaagctgtcacaatagtggagacacctcccatggtggtcgtcggcatcgtgggttacgtcgagaccccccgtggtcttcggacatttaagaccgttttcgccgaacacatcagtgatgaatgtaaacgccggttctacaagaattggcataaatccaagaagaaagcctttactaaatactgtaaaaagtggcaggatgaagacggtaagaaacagttagaaaaagatttcagttctatgaaaaaatactgccaggtgataagggttattgcccacactcaaatgcggctgctgcccctgcgtcagaaaaaagcccatctgatggagattcaggtaaatggcggcaccgtcgccgaaaagctcgattgggctagggagagattggaacagcaggttccagtcaatcaggtatttggccaggatgagatgatcgacgtcataggcgtgaccaagggaaaagggtataagggagtcacctccagatggcacaccaagaaactgccccggaagacccacagaggtctccgtaaggtggcatgcatcggggcttggcatcccgccagggtggctttcagcgtggcccgcgccggacagaagggctatcatcatcggactgaaataaataaaaagatctacaagattggacagggttacctgatcaaagacggaaagctgataaaaaacaacgctagcactgattacgacctctctgataagtctattaaccccctcggcgggttcgtgcactacggagaggtgaccaatgatttcgtcatgttgaaaggttgcgtggtgggaaccaaaaagagagtgctgacgttgcggaaatccctcctggtgcagacaaagcgtcgagcactggaaaagatcgacctcaaattcatcgacacaaccagcaaatttggtcatggcaggttccagacgatggaggagaaaaaggccttcatgggaccacttaaaaaggacaggattgctaaggaggaaggagcctag

SEQ ID NO: 207613 - DNA, 576 bp, Artificial Sequence
  Description of Artificial Sequence: Synthetic coding sequence
atggagggcggcgcctacggcgccggcaaggccggcggcgccttcgatccttatacacttgttcgtcaaccacacacgatcctccgtgttgtcagctggctgttttctattgtggtcttcggctctattgttaacgaggggtatttgaattccgcatccgagggggaagaattttgtatatacaaccgaaaccccaatgcgtgctcttacggcgtcgcagtcggtgtcctggcctttcttacctgtcttttgtacctggctctggatgtctacttccctcagatcagttcggtaaaagaccgaaaaaaagcggttctctccgatataggcgtgagcgccttctgggccttcctgtggtttgtgggcttctgctacctggccaaccagtggcaggtatctaaaccgaaggataacccattgaacgagggcaccgatgccgcccgagctgctattgccttctcatttttcagcatcttcacttggagcctaaccgcagcactagcggtgaggaggtttaaagacctgtccttccaggaagaatactccactctcttcccagcttccgcccagccctag

SEQ ID NO: 207614 - DNA, 702 bp, Artificial Sequence
  Description of Artificial Sequence: Synthetic coding sequence
atggagggcggcgcctacggcgccggcaaggccggcggcgccttcgacccttacaccctggtgcgccaacctcacacaattctccgcgtggtatcttggttattctctatcgtcgtttttgggtcgatcgtaaacgaagggtacttaaatagcgcatcagagggtgaggaattttgcatctacaatagaaaccctaatgcatgctcttatggcgtggctgtcggggttctggcattcctcacctgcctgttgtaccttgccttggacgtttactttccccagatatcttccgtcaaggatcgcaagaaggccgtgctgtccgacatcggagtgtccgccttctgggcgtttctgtggtttgtcgggttttgctacctggccaaccagtggcaagtgagcaaacccaaggacaatcctctgaatgagggtacagatgctgctagggcggcaatcgcgttttccttttttagcatcttcacgtgggccggacaggccgttctggcctttcagcgctaccagatcggcgccgatagcgccctgtttagccaggattacatggacccaagccaggacagttccatgccttacgctccgtacgtagaacccactgggcctgaccccgccgggatgggtgggacctaccaacagcctgctaataccttcgatacagaacctcaaggttaccaatcacagggatactag

SEQ ID NO: 207615 - DNA, 579 bp, Artificial Sequence
  Description of Artificial Sequence: Synthetic coding sequence
atgctgaccctggagttcggcatcctggagttcgaccccagctggataggctcctggacccagcgatcatgggtctcttggaggtcccgccccggatgtgagctgttcagtatcgtagtcttcggtagtattgtcaatgaggggtatctgaattccgcttccgaaggcgaggagttctgcatatacaatagaaatccaaacgcctgcagctacggtgttgccgtgggcgtcctggccttcctgacgtgtcttctctacctggccctcgatgtctacttcccccagatctcgtccgttaaagatcgcaagaaagcagtccttagcgacataggcgtgtccgccttttgggcctttctgtggtttgttggcttctgctacctggcgaatcagtggcaggtgagtaaacctaaggacaacccactcaacgaagggactgatgctgccagggcagcgatcgcctttagctttttcagcatctttacctggagtcttaccgccgcgctagctgtgcgccgcttcaaggatctgagctttcaggaagaatatagtacactttttcccgcttccgcccagccatag

SEQ ID NO: 207616 - DNA, 510 bp, Artificial Sequence
  Description of Artificial Sequence: Synthetic coding sequence
atggagggcggcgcctacggcgccggcaaggccggcggcgccttcgacccatacactctcgtgcgacagccgcatacaattttgcgcgttgtgagttggctgttttctattgtggtgtttggaagcattgtgaacgagggctacctgaactccgcatccgaaggggaggagttttgtatttacaacaggaatcctaacgcctgttcatacggggtggccgttggggtgctggctttcctcacttgtctcctgtatctggccctcgacgtgtatttcccgcagatttcctcagtgaaagatagaaaaaaagctgtgctctccgacattggggtcagtgccttctgggcattcctgtggttcgtgggcttttgttacctcgccaatcagtggcaggtgagcaaacccaaggataaccctcttaatgaaggtacggacgccgctagggctgcaatcgctttctcctttttcagcattttcacttggagatccggagccaccagcccgccttag

SEQ ID NO: 207617 - DNA, 297 bp, Artificial Sequence
  Description of Artificial Sequence: Synthetic coding sequence
atggccagcggcgccggcggcagctggggccggagccccccccagtctgctgtccccacgccctgggtgacattcttacagcccctgtcgtgggcggtgcccccagccccaccacagccaggcagagtgaaagaagatttgcttgagttgatgatgctgcagaacgcccagatgcaccagcttctgctctcccggctggtcgccggtgccctgcagcctcgccctgcgtctccttgccctcaggagtcctgcgcgcccaccccgacccctcagtgtcaccgggattgcggctgctag

SEQ ID NO: 207618 - DNA, 690 bp, Artificial Sequence
  Description of Artificial Sequence: Synthetic coding sequence
atggagggcgccagcttcggcgccggccgggccggcgccgccctggaccccgtgagtttcgcacgcagaccccagacactcctgagagttgcatcatgggtgtttagtattgctgtttttggacccatagtaaacgagggatacgttaacacggactctgggcccgagttaagatgcgtgtttaacggaaacgccggtgcttgtcggtttggtgtggctctgggtttaggcgcatttctggcgtgcgcggctttcctgttgctcgatgtgaggttccaacagatcagttcggtgagggaccggaggcgtgccgtccttctcgatctgggattttctggactgtggtcattcctgtggttcgtgggcttttgttttcttactaatcagtggcagcggacagcacctggcccggccacgacccaggccggtgatgccgctagggctgcaattgctttctcgttttttagcatcctttcatgggtggccttgactgtgaaggcacttcagaggtttcgattgggcacagatatgtccctgttcgcaaccgagcagctttctaccggggcctcccaggcttacccaggttacccagtcggctcaggggttgaagggacagagacatatcagtcaccgccttttacagagacattggacacatcaccaaaggggtaccaggttccagcttactag

SEQ ID NO: 207619 - DNA, 438 bp, Artificial Sequence
  Description of Artificial Sequence: Synthetic coding sequence
atggagggcgccagcttcggcgccggccgggccggcgccgccctggatccagtcagctttgcccgccgaccccagactttgctgcgggtggccagctgggtgttcagcattgcagtgtttggaccgattgtcaatgaaggatacgtaaatacagatagcggacccgagttacgctgtgtgtttaatggcaacgcaggcgcttgccgctttggcgtcgcacttggtctcggagcttttttagcgtgtgctgcctttcttctgctggacgttagattccagcagtccggggggcggggtaagactcccccatcgccccaggactggggatcttggccactgttcccttctcatgtcccagtcggaagcgattgccttgtttccgtgatggtcgtccggccggtacggtctcattcccccctgagcctgacggggtgttag

SEQ ID NO: 207620 - DNA, 705 bp, Artificial Sequence
  Description of Artificial Sequence: Synthetic coding sequence
atgcacatccccaagagcctgcaggagctggccaacagcgaggccgtgcagtttctcaggcggcccaagacaatcacacgggtgttcgagggagtcttcagcctaatcgtgttctcttcgctcttgacagatggatatcaaaataaaatggagtccccgcaacttcactgtatcctcaattccaactcagtggcatgctcctttgcagtgggagccggctttctggcatttctgagctgcctcgctttcctggtgttggatacacaggagacacggattgctggcaccagatttaagactgctttccaacttttagactttatcctcgccgtgctgtgggcggtggtttggttcatggggttttgcttcctggctaatcagtggcagcattctcctcccaaggagtttcttctgggcagctctagcgcccaggcagcgatcgcgtttaccttcttcagtattctggtatggatttttcaggcatacctggcatttcaagatttacgaaatgatgctcctgtaccatataaacggttccttgacgaaggcgggatggtcctgacaaccctacccctgccttcagccaacagccctgttaatatgccaacgactggaccgaactcgctgagttatgcttctagtgctttaagcccctgtctgacggcccctaagtctccgagactggcaatgatgccggataattag

SEQ ID NO: 207621 - DNA, 4722 bp, Artificial Sequence
  Description of Artificial Sequence: Synthetic coding sequence
atggccttcagcaagggcttccggatctaccacaagctggacccccctcccttttcgctcatcgtggaaaccagacacaaggaagagtgtttaatgtttgagagtggtgcagtcgcggtgctgagttctgccgaaaaggaagctatcaaagggacatattcgaaagtgctggacgcctatggcctgctgggtgtcctgaggctgaatctcggagatacgatgctccactacttagttcttgtcaccggctgcatgtcagtgggcaagatccaagagtctgaggtgttccgtgtcacctcaacggagttcattagtctgcgcatcgacagttctgacgaagatcgtatcagcgaggtgcgcaaggtcctgaactcaggaaacttttattttgcatggagcgctagcggtatcagcctcgacctgtctcttaatgcgcaccggtctatgcaggagcaaaccacggacaacaggtttttctggaatcaaagtcttcacctccacctgaagcactatggagttaactgtgacgactggctactacgactcatgtgtggcggagtcgagatccgaactatctacgcagctcataagcaagctaaagcttgcctcattagccggctctcttgtgagcgagctggtactcgattcaacgtgaggggaacgaatgatgatggtcacgttgccaatttcgtggaaacggagcaggttgtgtacttggacgactcagtctcaagtttcatccaaatccgggggtctgttcctctgttctgggaacagcctggtctgcaagtcggctcccaccgcgttcgaatgagtagggggttcgaagcaaacgcgcccgcctttgataggcacttccgcacactcaaaaatctgtatggaaaacaaattatcgtgaacctcctaggatctaaggaaggcgagcatatgttatcaaaagcattccagagtcatctaaaagcttcagagcacgctgccgacatccagatggtgaacttcgactaccaccagatggtgaagggcggaaaagccgagaaattacacagcgtgctaaagcctcaggtgcagaaattcctggactatggctttttttacttcaatggttctgaggtacagaggtgccagtctggcaccgttcggaccaactgccttgactgtcttgatcgaacaaatagcgttcaggcattcttaggactcgaaatgcttgcaaaacagttggaggccctggggcttgctgagaagcctcagctggtcaccagatttcaagaagtgttccggagcatgtggtctgtgaacggggattctatttcaaagatttacgcggggaccggcgcacttgagggaaaagccaagctgaaagacggggcccgatccgttaccaggacaatccagaataatttcttcgatagttctaagcaggaggcaattgatgttctgctgctcggcaacactttaaattcagacctcgccgataaggcccgggcactcctcactaccggcagccttcgagtgtccgagcaaacgctacagtccgccagtagcaaggtgctgaagagcatgtgcgaaaacttttataaatattctaagcctaagaagatccgggtgtgcgttggtacttggaatgtaaatggtggaaaacagtttcgcagtattgcctttaaaaaccaaaccttaactgactggctgttagatgcccctaaactcgcaggcatccaagagttccaagataagcgctccaagccaacagacattttcgctatcggtttcgaggagatggtggaattgaatgcagggaacattgtttctgcatctaccaccaatcagaaactatgggcggtggaactgcagaagactataagcagagacaacaagtacgtgcttctcgctagcgagcaattggtaggtgtgtgtctctttgtgttcatccgcccacagcacgcgcctttcattcgggatgtggctgtggatactgtcaaaactgggatgggtggggccactggcaacaagggtgccgtcgcaatcaggatgcttttccataccaccagcctgtgctttgtctgtagtcacttcgctgccgggcaaagccaggttaaagaaagaaacgaagactttattgagatcgcgcggaagctcagttttcccatgggcagaatgctgttctcacacgattacgttttctggtgcggcgactttaattaccggattgatttacctaacgaggaggtaaaagaactgatcaggcaacagaattgggattcactgattgcgggagaccaacttatcaatcagaagaacgcaggtcaggtgtttcgaggatttctggaaggcaaagtcactttcgctccaacatacaagtatgacctgttcagtgacgattatgatacaagcgagaaatgcagaacccccgcttggactgaccgggtcctgtggaggcgaaggaaatggccattcgaccgctcagctgaagatcttgatcttctcaacgcgtcctttcaggatgaatcaaaaattctgtacacatggacgccaggaacccttctgcactacggtcgagcagagttgaagacttccgatcaccggcctgtggttgctctcatcgacattgacatcttcgaagtcgaagccgaggagaggcagaacatctacaaggaggtcattgcagtacagggacctccagacgggactgtcctcgtgagcatcaagtcttctctgcctgagaacaacttctttgacgatgctctgatcgacgagttactccaacagttcgccagcttcggcgaggtgattttaatccggtttgtcgaagataagatgtgggtgacctttctcgagggaagctcagcacttaacgtgctttctttgaatggaaaagagctcttaaaccggactatcaccattgcacttaagtctcctgactggattaaaaatctagaggaagagatgagcctcgaaaaaatatccattgccctgccatcaagcacttcttcgacactgcttggtgaagacgcagaggtggctgcagacttcgacatggaaggtgatgtagacgactactcagcagaggtcgaagagcttctgcctcaacatctgcagccttcttcctcgtctgggctgggcacctcgccttccagcagccccaggacttcaccgtgtcagtcaccaaccatatccgaggggcctgttccctcactaccaatacgtccttcacgcgcgcctagcagaaccccaggccccccttccgcgcaatcttctcctatcgatgcacagcccgcaacacccttgcctcaaaaagatcccgctcagcccctcgagccaaaaagacctccgccacctcggcctgtcgcaccccctactagaccagcccctccgcaacgtccaccacccccatctggggcccgctctcctgcacccactcgcaaggaatttggagggattggagctcctccttcacctggtgttgccaggcgcgaaatggaggctccgaaatcccctggtacgactcggaaggacaatatcggtcggtcccagccctctcctcaagctgggctggccggcccgggtccagcggggtactctacagcaagaccgaccataccaccaagagctggagtaatatcagctccacagtctcatgccagggcatcagcgggcaggctaacccctgagtcccagtcaaagacttcggagaccagtaaggggagtacctttttgccggaaccccttaaaccacaggccgcgttcccacctcaatcatccctacctccccctgctcagagactgcaggagccattagtgcctgttgccgcccccatgccacaaagtggacctcaacccaacttagaaacacctccccagccaccacccagatctaggagctcccactctctaccctcagaggcgtctagccagccccaggtcaagactaacggcattagcgatggcaaaagagagagtcctctgaagatcgacccctttgaagacctgtcatttaatctcttggcagtgtctaaggcgcagctgagcgtgcagacttctccagttcccactcccgatcccaagcgcttaattcagttgccctcagccacacagtccaatgtcttaagttctgtgtcgtgtatgccgactatgccccccattcccgcaaggtcgcagtcacaagagaatatgcggtcttctccaaatccgttcatcactggcctcaccaggactaaccccttctctgaccgcacagctgctccaggaaacccctttagggcaaaatcagaggaatccgaagcaacatcttggttctctaaggaagagccagtaacgatctcgccatttccttcacttcagcccttagggcacaataaaagccgggccagctctagcttagatggctttaaagatagttttgatttacaaggacagtctaccctcaagattagcaatccgaaggggtgggtcaccttcgaagaagaagaggatttcggcgtgaagggcaaatctaagtctgcttgctccgaccttctggggaatcagcccagctcattttccggaagtaaccttaccttgaatgacgattggaacaagggcacgaatgtgagcttctgcgtgctcccttcacgtaggccccctcccccacctgtacccctgctgccacccgggacttcccctcccgtggacccttttaccaccctggcttcaaaggctagtcccaccctggattttacagaaaggtag

SEQ ID NO: 207622 - DNA, 3888 bp, Artificial Sequence
  Description of Artificial Sequence: Synthetic coding sequence
atggccttcagcaagggcttccggatctaccacaagctggaccccccaccattctctctgattgtggagacaaggcacaaagaagaatgcttgatgttcgagtccggagccgtggcagtgctgtcctctgcagagaaggaggcaattaaaggcacttattcaaaagtactggatgcttacggtctgttaggggtattgagactgaatcttggggacactatgcttcactacctggtattggtcacaggttgcatgagcgtgggcaagatccaggaatccgaggtctttcgcgtgacgagcaccgagttcatcagtctgcgcatcgactcgtccgacgaggatcggatatcggaggtaaggaaagtactgaacagcggcaacttttatttcgcgtggtctgccagtgggatcagcctggatctgagcttgaacgctcatcgtagcatgcaagaacagactactgacaatagatttttctggaatcagtctcttcacctacatttgaaacactacggtgttaattgcgacgattggctgctgagactgatgtgcgggggcgtggagattcggaccatctacgccgcacacaagcaggctaaagcttgtctaatcagtaggctgagttgcgagcgcgcaggaacacgcttcaatgtaaggggcacgaacgacgacggacacgtcgccaattttgttgagactgagcaggtggtctatcttgacgactccgtttctagctttatccaaatcagggggagtgtgcctctcttctgggagcagccaggactacaggttgggtctcaccgggttcgaatgagcaggggctttgaggctaacgctcccgcattcgatcgccacttcaggaccctgaagaacctatacggcaaacagattattgtcaatctgcttgggagtaaggagggggagcacatgttgagtaaggccttccaatcccatttaaaggccagcgagcatgcagcagacatccagatggtgaacttcgattatcaccagatggtgaaaggtgggaaagccgaaaagctccactctgtcctcaagcctcaggtgcaaaaattccttgactatggctttttttacttcaatgggtcagaggttcagcgatgccagtcgggaacagtaaggactaattgcctcgactgcttggacaggacgaactccgtccaggcttttctcgggctggagatgctggccaagcaactcgaagccttgggactggccgagaagccacagttggttacaaggttccaagaggttttccgttccatgtggtccgtgaacggtgatagtatatcgaagatttatgcaggcactggagccctcgaaggtaaggctaagctgaaggatggggctagatccgtaactcggacaatccagaataactttttcgactcgtctaaacaggaggccatcgacgtgctgttgttgggcaacaccctaaactcggacttagccgacaaagcacgcgcacttttaactactggatctcttcgcgtgtccgaacagaccctgcagtctgctagctctaaagtgctaaaatcaatgtgtgaaaatttttacaaatattctaaaccaaaaaagatccgagtctgtgttggtacatggaatgttaatggcggaaagcagttccgatcgatcgctttcaaaaatcagacactgactgactggctactggacgcccctaaactggcaggcattcaggagtttcaggacaagcgcagcaagccaacggacatctttgctatcggctttgaggagatggttgaacttaacgcggggaatattgtgtccgcatctactacaaaccagaagctatgggccgtcgagctgcagaaaactatctctcgtgataataaatacgtactattggcctctgagcagttggtgggggtgtgtctatttgtgttcattcgcccccagcacgctcctttcataagagatgtcgccgtagatacggtgaagaccggcatggggggcgctacgggaaataagggcgccgttgccataaggatgctgtttcacaccacatccctctgtttcgtgtgttcccatttcgccgctgggcaaagtcaagtgaaggaacgaaatgaggactttattgaaattgcaaggaagctgagtttcccaatgggcagaatgctattttcacatgattatgttttctggtgcggggactttaactatcggatcgacctcccaaacgaggaagtgaaggagttaatccggcagcaaaattgggacagcctgattgccggggaccagctaataaatcaaaagaacgccggtcaggtgttcagggggttccttgagggtaaggtgacattcgccccgacgtataaatatgacttattttctgacgattacgatacgtctgaaaaatgtcggacacccgcatggaccgatagggtattgtggcggagacggaaatggcccttcgaccgctctgctgaggacctggacctgctcaatgcatctttccaggatgaaagcaagatcttgtacacctggaccccggggaccctgttgcattatgggagagcagagctgaagacttccgaccaccggccagtggtggctctcattgatatcgacatcttcgaagtggaagcggaagaaaggcagaacatttataaagaggtcatcgcggtgcaggggccccccgacggaactgtcctggtgagtattaaatccagtctgcccgaaaacaactttttcgacgacgcactaatcgatgagctgctgcagcagtttgcttccttcggtgaggttatcctgatcaggtttgtggaggataagatgtgggtgacattcctggagggctcaagcgctctgaatgtcctaagcctcaatggcaaggaactcctgaataggacgattaccatcgcactgaagagtcccgattggatcaaaaatctggaagaagaaatgtcactcgagaaaatttcaatcgccctgccgtcctcgacaagttctaccttgctgggggaagatgccgaggtagcggctgacttcgatatggagggcgacgtggacgactactccgccgaggtggaagagctactgcctcagcatttgcaaccatcctcaagttccggtctcggcacctctcctagcagcagtccaagaactagcccatgtcaaagtccaacaatttccgagggaccagtgccgtctttacctatcaggcccagcagagctccatcccgcacaccggggccgccatccgcccagtcaagcccaatcgacgcacagcccgcgacacctttaccacagaaggatcccgcccagcctctggaacccaagcgacctcccccgccaagacctgtggccccccccacccgaccagctcctccccaacggcctccacctccgagcggggcacgcagcccagctcccaccaggaaggaattcggtgcccctaagagcccaggaaccacccgaaaggataacattggacggtcacagccatctccccaggcaggtctggcgggccctggtcctgctgggtatagcacagcccgcccaactataccccctcgagcaggcgtcatttctgctcctcagagtcatgccagagcaagcgctggacgcctgactcctgagtcacagtcaaagacttctgaaacttcgaaaggcagcactttcttaccagaacctctgaaaccacaagccgccttccccccccagtcgtcacttcctcctcccgcgcagaggctgcaagagccgctcgttcccgtcgcggccccaatgcctcaatccggccctcagccgaacctcgaaacacctcctcagccgccgccgcggagtcgctcatcccactctctgcccagcgaggccagctcccaaccgcagcaggaacagccatcaggttag

SEQ ID NO: 207623 - DNA, 4581 bp, Artificial Sequence
  Description of Artificial Sequence: Synthetic coding sequence
atggccttcagcaagggcttccggatctaccacaagctggacccccctcccttttctcttatcgtcgaaacacgtcataaggaggaatgccttatgttcgagtctggcgcagttgcagttctttcctcggctgagaaggaagccattaagggcacgtattcaaaagtactagacgcatacgggctcctcggagtcctccggctcaatctgggagacactatgctccattaccttgttctcgtgaccgggtgcatgtctgtgggtaagatacaggagagcgaggtgttcagggtaacatccactgaattcataagtctgcgcattgattcatccgacgaggatcggatcagcgaagtccgaaaggtgcttaacagtgggaatttttatttcgcctggtccgcctccggcattagtcttgatctgtcgctgaatgctcataggagcatgcaggaacagaccacggataatagattcttctggaaccagagtcttcacctgcacttgaagcactacggggtcaattgtgacgattggctactgcggttaatgtgtgggggggtcgagatccggaccatttacgccgctcacaagcaggctaaagcctgtctcatatcaaggctctcctgcgagagggccggaaccagatttaatgtgcgggggacaaatgacgacggccacgttgctaacttcgttgagaccgaacaggtggtgtatcttgacgattctgtttctagtttcatccaaatccgcggttcagtgccgctgttctgggagcagcccggtctgcaggttggctcccatcgagtgaggatgtcgaggggattcgaggcaaatgctccagcttttgacaggcactttaggacgctaaagaacctgtatggcaaacagatcattgtgaacctgctaggaagtaaagaaggcgagcatatgctctctaaggcgtttcagtcacacctcaaggctagcgaacacgctgctgatatacagatggtcaattttgactaccaccagatggtgaaaggcggcaaagccgaaaagctccactcggtgcttaaacctcaggttcaaaaattcctcgattatggttttttttatttcaatggaagcgaggtccaaagatgccaaagcggcacggtccgtactaactgtctcgactgtctcgaccgtactaatagtgtccaggccttcctgggccttgaaatgttagccaaacaactggaggctctcgggttagccgagaaaccacagctggtaactaggtttcaggaagtgttccgctcgatgtggagtgtcaatggtgatagtattagtaaaatctacgcgggtaccggggccttggagggtaaggccaaggctggaaagctgaaggacggcgcgagatcagtcacccgaacaatccagaataacttcttcgattcttccaagcaggaagccatcgacgtgctgctcctcgggaataccctcaactccgatctggctgacaaggcacgcgcgctgctgaccactggcagcctacgagcgagtagtaaagtcctgaagagcatgtgcgaaaatttctacaagtactctaagccaaaaaaaattcgggtttgcgttgggacatggaacgtaaatgggggcaagcagtttaggagtatcgcctttaagaatcagaccctgaccgattggctcctggacgctcctaaattagcaggcatccaagaatttcaggataaaaggtccaagccaactgacatctttgctatcggcttcgaggaaatggtggagctgaatgctggaaacattgtctctgcctctaccaccaaccagaaattgtgggctgtggagctgcagaaaactatttctcgggacaacaagtacgtgctccttgcgtcggaacagcttgtgggggtctgtctgttcgtctttataaggcctcagcacgctccctttattcgtgatgtcgccgtggacactgtcaaaacggggatggggggggccaccgggaataagggagctgtcgcaattaggatgctcttccacacaacaagtctgtgttttgtgtgttcccacttcgccgccggacagtcgcaagtgaaagagcgcaacgaggatttcatcgaaatcgcccgcaaactgtccttccccatgggtcggatgctgttctctcatgactatgtcttttggtgtggggacttcaattatcgtatcgatctgcccaatgaagaagtgaaagagctcatcaggcagcaaaactgggatagcctcattgccggcgatcagcttataaaccagaagaacgctggtcaggtctttcggggttttttagagggcaaagtgacctttgcccctacatataagtacgatttgttttctgacgactatgacaccagtgaaaaatgccgaaccccggcttggacagatagggtcctttggaggcggcggaagtggccatttgatagaagcgctgaggacctcgacctccttaacgcatcatttcaagatgaatccaagatcttatacacctggactcctgggaccctgcttcactacggccgagcagagctgaaaacatccgatcatcgaccggtcgtggccttgatcgacatcgatatctttgaagtagaagccgaagaaaggcaaaatatctacaaagaggttattgctgtgcagggtcctcccgacggaactgtcttggtaagcatcaagagtagcctgcctgagaacaatttctttgatgacgccctcatcgatgagctgctccagcagtttgcatcattcggggaagtgattctgattaggtttgtggaggataaaatgtgggtgacctttttggagggctccagtgccctgaatgtactgtcgctgaatggcaaggagctcctaaaccgaaccatcaccatcgctctgaaaagtcccgactggatcaagaatctggaggaagagatgtcacttgaaaagatttccattgccctgccctcaagcactagcagcactcttctgggtgaggatgccgaagtcgcagctgattttgatatggagggtgacgtcgacgattacagtgccgaagtggaagagcttctccctcagcacctacagccatcttcgagttctggcctgggcacatccccttcctcatctccccggacaagcccgtgccagtcaccaacaatatccgaaggcccggtcccatcactgccaatacggcccagccgagcccctagtcgaacacctggtccaccttccgctcagagctctccaattgacgcccaacccgcgacccctctcccacaaaaggatcctgcacagccactggagccaaaaaggcctcctccaccgaggccggttgctccaccaactaggcctgccccgccccaaagaccgccaccccctagcgggcgctctcagcctagtccacaggccggccttgctgggccaggccccgcgggttattcaaccgcacggcccacaattcctccaagagctggcgtaatttccgctccacagtctcacgcccgggccagcgcggggagattgacgccagagagccaaagtaaaacttctgagacctcaaagggatctacgtttctccctgaaccactgaagcctcaggctgctttcccgcctcagagctcattacctccgcctgcacagaggctgcaggagcctcttgttccagtcgccgcacctatgccccaatctggcccacagccgaatctggaaacaccccctcagcccccaccgcgatcacgcagcagccattcactgccatctgaggcctcttcacagcctcaggttaagacaaacgggattagcgacggcaagagagagtcaccactgaaaattgatcctttcgaggatctcagtttcaatctactcgccgtttcgaaggctcagctgagcgtccagacaagtcctgtccctacacccgatcccaagagactcattcaacttccatcagccacccagtcaaatgtcctgagcagcgtctcttgtatgcccactatgccaccaatacccgccaggtcccagtcacaggagaatatgcgcagtagcccaaatccgttcatcacaggtttaaccagaacgaatccattctctgacaggacagcagcaccgggcaacccattccgagcaaaaagcgaggaatctgaggcaacgagctggtttagcaaggaagagcctgttaccatcagccctttcccgtccctgcagccgttggggcacaataaaagcagggcttcctccagtctcgacggcttcaaggacagtttcgatttgcagggacagtccacccttaaaatttctaatccaaagggctgggtcacattcgaggaagaagaggactttggcgttaaaggtaagtccaagagtgcctgctcagacctacttggcaatcagccctcatctttctccgggagcaatctgaccctcaatgatgactggaataagggtaccaacgtgagtttttgcgtcctgccctctagacggcctcccccaccacccgtccctctactgcctcctggaacctctccaccagtggacccctttacaaccctggcctctaaggcatcacccacccttgacttcactgagcgctag

SEQ ID NO: 207624 - DNA, 4053 bp, Artificial Sequence
  Description of Artificial Sequence: Synthetic coding sequence
atgcggaagcggtgggcctgctggagcggcagcgacgcccccggcggctgtggcggtgggtgcggaaggaggaggagaagatcgagacggaaacgggccgcctctgaggaacggagaatggccttctctaagggcttcagaatctaccacaagctggaccctccccccttctctcttattgttgagacccgacataaagaagagtgtcttatgttcgagagtggcgctgtggcagttctgagcagtgctgaaaaagaagctatcaaggggacatactccaaagtgctagacgcctatgggctgttaggtgtgcttcgcctgaatctgggagataccatgctccactacctcgtgctggtgacagggtgcatgtctgttggcaagattcaggaaagcgaggtttttagagtgacatctaccgaattcatcagtttaagaattgactctagcgacgaagatcggatctccgaggttaggaaagtactcaattctggtaacttctactttgcatggtcggccagtggaatatctctggacctttcacttaatgcccatcgttccatgcaagagcaaaccaccgataatagattcttttggaaccagagcttgcacctccacttgaagcactacggcgtgaattgtgacgattggttgctgcggctcatgtgcggaggggtggagatccgtaccatttacgccgcacataagcaggccaaagcgtgcctgatctcccgtctcagctgtgagagagcagggaccagatttaatgtgcggggcacaaatgatgatggccatgtcgccaactttgttgaaaccgagcaggttgtatatctggatgattctgtgagttctttcatccagattaggggcagtgtcccactcttctgggagcagccggggttgcaggtcggctcacatcgggtgagaatgtctcgaggattcgaggcaaacgcccccgcgttcgatcgtcacttccggactctaaagaacctgtatggcaagcagatcatcgtgaatctgcttggctcaaaggagggcgaacacatgttgagtaaggcctttcagagccacctgaaggcttctgaacacgctgccgacattcagatggttaattttgactatcaccaaatggtgaaagggggcaaggccgagaaactacattcagtgttgaaaccacaggttcagaagttcctcgattacggcttcttttacttcaatggctccgaagtccagcgctgccagtccggtacggtccgaactaactgtctggattgcttggatcgcactaattcagtgcaggcctttttaggactagaaatgctggccaaacagttagaggctctgggactggcggagaaaccccaactagtgacacgtttccaggaagtgttcagatccatgtggtccgtcaacggagattccatttcgaagatttacgctgggaccggagcactggaagggaaggctaaactgaaagacggcgcccgcagcgtcacaaggaccattcaaaataatttttttgacagttctaaacaagaagccattgatgttctgttgctggggaatacactgaattcagacctggctgataaggctagagccctgttgaccactggatctctcagagtcagtgagcagactctccaatcagcgtccagtaaggtgctgaagagcatgtgcgagaatttttacaaatactcaaagcccaagaagattcgagtgtgcgtgggaacttggaacgtgaacggaggaaagcagttccgcagtatcgcttttaagaaccagaccctaaccgactggctgcttgacgctcctaagcttgccggcattcaggaattccaggataaaaggtccaaaccaacagacatcttcgccatcggttttgaggaaatggtggagctgaatgctggaaacatcgtgtccgcaagtaccactaaccagaagctctgggccgttgaactgcagaagaccatctcacgagacaataagtatgtgttactggcgagtgagcagctcgttggggtatgcctgttcgttttcatacgacctcagcacgcccctttcattagggacgttgcggtggatacagttaaaaccgggatgggcggtgcaactggaaataaaggcgctgtcgccatcaggatgctcttccacactacttccctgtgtttcgtgtgttctcattttgctgctggtcagtcacaggtgaaggaaaggaacgaagatttcattgaaattgcccgcaaactctctttcccaatgggcaggatgctgttcagtcatgactatgtgttctggtgcggagatttcaattaccgcatcgatcttcctaatgaggaggtgaaggagctgatcaggcaacagaactgggactcgctgattgctggagaccagctcataaatcagaagaacgctggtcaggtgttccgaggctttttggaagggaaagtcaccttcgcccctacctataaatacgacctgttctccgacgattacgacacgtcagagaagtgtcggaccccagcctggactgacagggttctatggaggagacgcaagtggcctttcgatcgatcagccgaagacttagatttgctgaacgcatcttttcaggacgagtcaaagatcctgtacacttggacccctggcactctcttgcattacgggagagctgagctgaagacttcagaccatcgcccagtcgtggccttaatcgacatcgacattttcgaggtcgaggcagaggaacgtcagaacatttataaagaagttatcgctgtgcaaggccccccagatggtaccgtcctggtttctatcaaatccagcctccctgagaataactttttcgatgacgctttaatcgatgagctcctccagcagtttgcctcattcggagaagtaatactgattaggttcgtcgaggataagatgtgggtgacattcttagaaggctcctccgcccttaatgtcctgagtcttaacgggaaggaactcctgaacagaactataacaattgccctgaagtcacccgattggattaagaatctggaagaagaaatgtctctagaaaagatctctattgccttacccagcagcacctcgtctaccctactgggtgaggacgccgaggtggcagcagatttcgacatggagggagatgtggacgactacagcgctgaagtggaagagctcttgccacagcatcttcagccatcatctagctcaggtctcggcacaagcccatctagtagccctcgcacatccccctgccagtctccaaccatctcagagggcccagttccctccctgcctatccgaccatctcgggcccctagccgaacacctggaccgccaagtgcccagtcctcacctatcgacgcgcagccagccacacctctgccccagaaagatcctgcccagcccctggaaccgaaacggcctccccccccgcgaccagtggcaccccctaccaggcccgcaccaccccagcgacctccacctccctctggtgctcgatctcctgctccgacaaggaaggaatttggagggatcggggccccccctagccccggtgttgccagacgcgagatggaggctcctaagagccccggcacgactaggaaggacaacattggccgttcacagccgtcaccacaagcaggcttggcgggcccaggccctgctggttattctacagctcgcccaactattccgcccagggccggcgtcattagtgccccccaatcccacgcacgtgcgagcgcggggcggctgactcccgaatcacagagtaagacttcggagaccagcaaggggagtacatttttgcctgagcccctcaagcctcaggcagcctttcctcctcaatcctctttgccacctccggcacagagactacaggaacctctggtgccagtggctgccccaatgcctcaatctggcccacagcctaaccttgagactccaccccagccccctccaaggagcaggtcgagccattctcttccctcagaggccagctctcagcctcagcaggaacagcccagtggttag

SEQ ID NO: 207625 - DNA, 4839 bp, Artificial Sequence
  Description of Artificial Sequence: Synthetic coding sequence
atgcggaagcggtgggcctgctggagcggcagcgacgcccccggcgggtgcggaggcgggtgcggccgccggcggcgcaggtcccgacgaaagagggccgccagcgaagaacgaaggatggctttctctaaaggatttcggatctatcacaagctggacccgccacctttttccctcatagtagaaactaggcacaaagaagagtgcctgatgttcgaaagcggggccgtagccgttctctcttctgccgaaaaagaagccatcaaaggtacatattccaaagtcctggatgcatatggcctcctcggcgtgctgcgcctcaatctcggagatactatgctgcattacctagtactagtcactggctgtatgtcagtcggaaagatccaggagagtgaggttttccgcgtcacaagtacggaattcatctcccttcgtatagattcctcagatgaggacaggatatctgaggttaggaaagtgctgaactctggaaatttttacttcgcttggtctgcctcaggtatctcactcgatctgtcccttaatgcacataggtctatgcaggagcagaccacagacaacaggtttttttggaatcaaagtctccaccttcaccttaaacactacggagtgaactgcgatgattggctgttacgccttatgtgtggtggagtcgaaatcaggacaatttatgccgcacataaacaagccaaggcctgccttatttcccggctgtcctgtgagcgagcaggcaccagatttaatgtccgcggcaccaacgacgatgggcacgtggctaacttcgtggaaacagagcaggtagtgtacctggacgatagtgtctcttcctttatccagatacgcggcagtgttccattgttttgggagcagccggggctgcaggttggtagccatagagtgcgaatgtctagagggttcgaggctaacgctcctgccttcgatcgtcacttcaggaccttgaagaacctctacgggaagcagataatcgtgaatctcttgggaagcaaagaaggtgagcacatgctaagcaaagccttccagtctcatttgaaagcctcagagcacgccgccgatatccagatggtcaattttgattatcaccaaatggttaagggcggcaaggctgagaagctgcactcagtgctcaagcctcaggttcagaaattcctggattacggcttcttttatttcaatggctccgaagtgcaacgttgtcagtccggcacagttagaaccaactgcttagactgccttgatcggacaaattctgtgcaggcgtttctgggcctggagatgctggccaagcaactggaagccctcggcctggccgagaagccacaactggtgacccgctttcaagaggtgtttcgttctatgtggagtgtgaatggtgacagcatctccaaaatttacgcaggcactggcgctcttgaaggcaaagctaaactgaaagatggagctaggtctgtgacacggaccatccaaaacaacttcttcgatagctcaaaacaggaagctattgacgtactgctactggggaacaccctgaactctgatctcgctgataaagctcgcgctctcctcaccaccggctccctcagggttagcgagcaaacactccagagtgcttccagtaaggtcttgaagtctatgtgcgagaatttctacaagtattcaaaacccaagaagattagggtgtgcgtcggaacgtggaacgtcaatgggggtaaacagttccggtccattgccttcaagaaccagaccctgaccgactggctgctggacgcacccaaactcgccgggatccaggagttccaggataagagatccaagcccaccgacatatttgctattgggtttgaagaaatggtggaactcaacgcaggcaatatcgtttctgcctcaaccacgaatcagaaactgtgggctgtggaactgcagaaaaccatcagcagggacaataagtacgtgctgttagcctccgagcagctagtgggtgtttgtctctttgtattcatcagaccccagcatgcgccatttatcagggatgtggctgtggacacagtaaaaaccggcatggggggcgctacagggaacaagggagccgtcgcaatacgtatgctgtttcataccaccagtctgtgcttcgtgtgcagccactttgcagcagggcaatctcaggtaaaggaacgtaatgaggactttattgagattgctcggaagctctcattcccaatgggacggatgctgttctctcacgactatgtgttctggtgtggcgactttaattaccgcattgatttgccaaacgaagaggtgaaggaactgatcagacagcagaactgggactcccttattgccggagatcagctaattaatcagaagaacgcgggacaggtgttccgcggttttctggaaggcaaagtgacctttgcccccacatacaaatacgacctgttttccgatgattacgatacctccgagaaatgtcggacccctgcgtggaccgaccgcgtgctttggagaagacggaaatggccctttgaccgctccgctgaagacctggacttgctcaatgcttctttccaagatgagagcaagatcctgtacacatggacacccggaaccttgcttcactatggtcgtgcggagttaaagactagtgaccaccgcccggttgtcgcactcatcgatatagacatttttgaagtggaagctgaagagcggcagaatatttacaaagaagtcatagccgtgcaggggccgccggatgggacagtcctcgtaagcataaaaagcagccttccggaaaacaattttttcgatgatgccttgattgatgagcttctccagcagtttgcaagctttggcgaagtgattcttatacgcttcgtcgaagacaagatgtgggtgaccttcctagaagggtccagtgctctgaatgtcctgagtttgaacggcaaggaattgttaaatcgtacaataacaattgcgctaaagagccctgattggattaagaacctagaagaggaaatgagcctggagaaaatttctatcgccctccccagttccaccagttccaccctcctcggcgaggatgcagaagtggctgccgacttcgatatggagggagacgtggatgattattccgctgaggtggaagaactcttgccgcagcatctgcagccttcctcatctagcgggctggggacttctccttcctcttctccacgaacttcgccatgtcagtcccccactatctcggaaggccccgtgccttcactgcccatcaggccctcacgggccccttccagaacccccgggcctcccagtgcacagtccagccctatagacgcccagcccgcgaccccgctgccccaaaaagaccctgcccagccactcgaacctaagcgtccccctccaccacgccccgtcgccccaccgacaaggcctgcaccaccacaacgccccccgccgcccagcggggccagaagccccgcccctaccagaaaagaattcggcgggatcggcgcacctcccagtcctggggtagcaagacgcgagatggaggcaccaaaatcgccagggaccacaagaaaggacaatattgggagaagtcagcctagtccacaggcaggcctggccgggcctggacccgccggatattccactgccagacctacaattccccctagggccggagttattagtgctccccagtcgcacgcccgcgcctccgcaggtcggctcacaccagagtcacagtcaaagaccagcgaaaccagcaagggatcaaccttcttacccgaacccctaaaaccccaggccgcattcccaccccaatcatcccttccaccaccggcccagcgcttgcaggaacctcttgtcccagttgccgcgcccatgccgcagtccggcccacagcctaatctggagacacccccccagccacctccacgttccaggagttcccatagcctgccctccgaagcatcttcccagccccaagtgaaaaccaatgggataagcgatgggaagcgtgagagccccttgaagatcgaccctttcgaggatttgtcatttaatctgctggcagtatccaaggcccaactttccgtgcagacatcaccagtgcctaccccggaccctaaacgcttaatccagctccctagcgcgacgcagagcaatgttctgagctccgttagctgtatgcctacaatgcctccgattcctgctcgctctcagagtcaagaaaacatgaggagcagccctaatccgttcattacggggctaacaaggactaatccatttagcgatcgaaccgctgctcccgggaaccctttccgcgccaagagtgaggaatcggaagcaacctcatggttcagtaaagaagagccagtgacaatttctccctttcccagtttgcagccgctcgggcacaataagtcccgggcctccagctctctggacggattcaaagactccttcgacctgcagggccagagtaccttgaaaatctcaaacccaaaaggttgggtcacatttgaggaggaggaggacttcggagtgaagggtaagtccaaatctgcgtgtagtgacttgttgggaaatcagcctagctctttctcaggttccaatctcactctgaatgatgattggaataagggaactaacgtgtcgttttgcgtactgcctagtcgccggccgccaccccctcccgtgcctctcctaccccccggcacatctccaccagtggacccttttactaccctcgctagcaaggctagtcctactctggatttcactgagagatag

SEQ ID NO: 207626 - DNA, 4491 bp, Artificial Sequence
  Description of Artificial Sequence: Synthetic coding sequence
atggccctgagcaagggcctgcggctgctgggccggctgggcgccgagggcgattgctcagtgctgttagaggcgaggggtagagacgattgtctgcttttcgaggccgggactgtggccacactggcccccgaggaaaaggaggtcataaagggtcagtatggcaaacttaccgacgcatacgggtgtttgggagaacttcgtctaaagagcggcggcacctcactgtctttcttggtactggtcaccggttgcacttctgtcggacgcatacccgacgctgaaatctacaaaatcaccgccactgacttttacccactgcaagaagaagccaaagaggaggagcgcctgatagcccttaagaaaatcctctccagcggggtgttctacttctcttggcccaatgacgggtcacgctttgacctcactgtccggacccagaagcaaggggatgacagttctgagtggggaaactcctttttttggaaccagcttctgcatgtgcccctcaggcagcatcaggtaagctgttgtgactggctcctcaaaatcatctgtggcgtcgtgacaatacgcacagtctatgcctcccataagcaggccaaggcttgtctggtttcccgtgtctcctgtgaacgcaccggaacgagatttcatacaagaggtgtgaatgacgacggacatgtgtcgaatttcgtcgagacagaacagatgatatacatggatgatggcgtttcaagcttcgttcaaatcagaggttcagtacccctgttttgggaacagccaggcctgcaggtgggcagccatcacctgcggctccatcggggacttgaggccaacgcccccgcttttgataggcacatggtgctgctcaaggaacagtacgggcagcaagtggtcgtgaacttgctgggttcccggggtggggaagaagtacttaaccgtgcctttaaaaagttgctgtgggcgtcttgtcacgcaggcgatacccccatgatcaactttgactttcaccagtttgctaaaggtggcaaacttgaaaagctggagacactgctgcgaccacagctcaaactgcactgggaggattttgacgtcttcaccaagggtgagaacgtgagcccccgctttcagaagggtacactgagaatgaattgtttggattgcctggaccggacaaacactgtccagtcattcattgcgctcgaagtgctgcatctccaactcaagacgctggggctttcctcaaagcccatagtagaccgattcgtggaaagcttcaaagctatgtggtctcttaacggccacagcctgagcaaagtgtttacagggagcagggctcttgagggcaaggccaaagtggggaagctgaaggacggcgctcgctccatgagtcgtactattcaatccaacttcttcgatggcgtcaaacaggaagcaattaagctcctcctggtcggagacgtttatggcgaggaagtcgctgacaagggtggcatgctgcttgactcaacagcactgctggtcaccccccgtattctgaaggccatgacagagagacagtccgagtttactaacttcaagcgaataagaatcgcgatggggacctggaatgttaatggcggcaagcaatttcgcagtaacgtcttaaggaccgccgaactcaccgactggctactggattccccacagctctctggcgctacagactcacaggatgactcttctccagcggatatctttgcagtcggtttcgaggaaatggttgagctgagtgcaggcaatattgtaaacgcctccaccacaaataaaaaaatgtggggagaacagctgcagaaagccatcagcagatcacatagatacatcctgttaaccagtgcgcagctggtcggggtgtgtctgtatatctttgtgcgaccctatcatgtgccattcatacgcgatgtggccatcgacacagtaaagactgggatgggcgggaaggcgggcaacaagggagccgtcggcattcgcttccagtttcactccacctccttttgtttcatttgtagtcatctcacagctggccagtcccaggtgaaagaacgtaatgaagactataaggaaatcacgcagaagttgtgctttccaatgggcaggaacgttttttcccatgattatgtgttctggtgtggtgactttaactacagaatcgatttgacatacgaagaagtattctactttgtgaagagacaggactggaagaagctccttgagtttgaccaacttcaactccagaagtcctcaggtaagattttcaaggatttccatgagggtgccatcaattttgggcccacttacaaatacgacgtggggtctgccgcctatgacacatcggataaatgtaggaccccggcttggaccgatcgggtgctatggtggaggaagaaacacccatttgacaaaacagcaggcgagctgaacctgttagattcagacttagacgtcgacaccaaagtccgtcatacttggtccccaggcgctctgcagtactacggcagagctgagctacaagcatctgaccaccgccccgtattagcgatcgtggaggtggaggtgcaggaggtggacgttggagctagggagcgcgtgttccaggaagtgtcgtccttccaaggacctctggacgcaactgtagtcgttaatctgcaaagtccaacactagaggagaaaaacgagttcccagaagacctccgcactgagctgatgcagaccctcggctcttacggcactattgtcctggtgcggatcaaccagggtcagatgctcgtgacatttgctgactcccattccgctctatccgtgttggacgtggatggaatgaaagtaaaaggccgggcggttaagattagaccaaaaaccaaggactggctgaagggtctccgcgaggaaatcattcgcaaacgtgacagcatggctcccgtgtcgcctacagcgaatagctgcctgctcgaagagaattttgacttcacttccctggactatgagagcgaaggagatatcctggaggatgacgaggactaccttgtagatgagtttaatcagcccggagtgtcagatagcgaattggggggagacgatctgtccgacgttcctgggccaacagcactggctccgcctagcaaatcacctgccttaaccaagaagaaacagcaccctacgtataaggacgacgccgacctggtcgaactcaaaagagaactcgaggccgtcggtgaatttagacaccgaagtccttctcggagtctctccgttccaaatagaccgcgccctcctcagccacctcagcgccccccaccaccaaccggcctaatggtgaaaaaatctgcctctgacgcatcaatatcttctggaactcatggccagtacagcatcctccagactgctcgcctgctcccaggcgccccacagcagccaccaaaggcccggactggaatatctaaaccatacaatgtaaagcagataaaaactaccaacgctcaggaagccgaggctgctatccgctgcctgctcgaggcccggggaggggcatctgaggaagccctaagcgccgtggctccacgggatctggaggcatcctcagagcctgaaccgactcccggggctgcaaaaccggaaacgcctcaggccccccctctgctccctagacgtcccccccctcgcgttcctgccatcaagaagccgactctgcgaaggaccggcaagcccttgtccccggaagaacagttcgagcaacaaacggtgcatttcaccattggacccccggagactagtgtcgaggctccccccgtggtgaccgcccctcgcgtccctcccgtgcccaagcctcgaacctttcaaccaggcaaggccgccgaacggccaagccacagaaagcccgctagtgatgaggctcccccaggggcgggggcctccgtcccgccgccactggaggccccccccctggtgcctaaagtaccccctcggcgtaaaaagtctgcccctgcggccttccacctccaagtgctgcagtcgaattcccagctgctccagggactgacttataattcttcggactcaccttctgggcatccgcccgccgctggtaccgtattccctcagggggattttctgtccacatccagcgccacctcccccgactctgacggtacaaaagcaatgaagcctgaagccgcccctcttctgggagactaccaggatcctttttggaatcttttgcaccatccaaagctattgaacaacacctggttatccaagagcagcgaccctctggactcaggaacccgcagcccaaagcgggacccaatcgaccccgtgtccgcgggcgcaagcgctgctaaagcagaactgccccctgaccacgaacacaaaacactgggacactgggttactatttccgatcaagagaagaggacagctctgcaggtattcgaccctctggccaagacctag

SEQ ID NO: 207627 - DNA, 1746 bp, Artificial Sequence
  Description of Artificial Sequence: Synthetic coding sequence
atgcagaccctgggcagctacggcaccatcgtgctggtgcggatcaatcagggacagatgctggtgacatttgccgactctcattctgctctttccgtgctggacgttgatggcatgaaagtaaaaggaagggcagttaagatccgccccaagacaaaagactggcttaaaggtctgcgagaggagatcatcagaaaaagggatagtatggcaccagtgtcccccaccgctaattcctgtttacttgaagaaaacttcgacttcacaagcctcgattatgagtctgagggtgatatcctcgaggatgacgaagattacctcgtggacgagttcaatcagccaggcgtgagtgacagcgagttgggcggcgatgacctctccgacgtgcctgggccaaccgcgcttgctcccccctccaaatcccctgctctgacaaaaaagaagcagcacccaacctataaggatgacgccgatctggtggagctcaagagggaactggaagccgtaggggagtttcgccacagatccccaagtagaagtctgtctgtgcccaatcggccaaggccccctcaaccaccgcagcgacctccaccaccaacagggcttatggtgaagaaaagcgccagtgatgcctccatatcctctggcacccacggacagtactccatcctgcagactgcccgactgttaccgggcgcaccacagcagcctccaaaggcaaggaccgggatttctaaaccttacaatgtgaaacagatcaaaaccaccaatgcccaagaggcggaggccgccataaggtgcctcttagaggctcgggggggcgcttctgaggaagccctgtccgctgtggcccccagggatctcgaggcctcaagcgagcccgagccgactcctggtgctgcgaagccagaaactcctcaggcgcccccactgttgcccagacggcccccccccagagtgcccgcaatcaagaaacccacccttaggcgcaccgggaagccgctctccccagaggagcagtttgaacagcagaccgtccattttacaatcggtccaccagaaacctctgtggaggctcctcccgtggtgaccgctcctcgggtgccacctgtgcccaagccgcgcactttccagccaggaaaagccgccgagcggcccagccatagaaagcccgcttctgacgaagcccctcccggtgccggagccagcgtgccaccccctctcgaggcaccaccattagtaccaaaggtgccaccccgcaggaaaaagagtgcgcctgcggcatttcatttacaagtcttgcagagtaactctcaacttctgcaggggctgacatataattcaagcgatagcccctcgggccacccaccagcagcgggcaccgtgttcccccaaggcgattttctctccacttcttctgcaacctcgcccgactctgacggtactaaggccatgaagcccgaagccgccccactcctcggggattaccaggaccccttctggaacctccttcaccaccccaaactccttaacaacacatggctgagcaaaagcagtgaccctcttgatagtggcacaagaagccccaagcgggacccaattgacccggtgtctgcaggtgccagtgcagcaaaggcagaactgccccccgaccacgagcacaaaaccctcgggcactgggtgacaatcagcgatcaggaaaagaggaccgccctacaagtgttcgacccccttgcaaagacatag

SEQ ID NO: 207628 - DNA, 411 bp, Artificial Sequence
  Description of Artificial Sequence: Synthetic coding sequence
tgaggccgggacgactgcctgctgttcgaggccggcaccgtggccaccctagcacccgaggagaaagaggtgatcaaaggccagtacggcaaattgacagacgcatacggctgtttaggtgaactcaggctgaagagcgggggcactagcctctctttcttggtgctcgttacaggttgcacctctgtcggaaggataccggatgctgagatttacaagataaccgcgaccgacttttaccccctgcaggaagaggccaaggaggaggaaaggctcatagcactgaagaagattctgagtagtggagtgttttatttttcttggcctaacgacggttctaggtttgacctgaccgttaggactcaaaaacaaggtgacgatagctctgagtggggcaactcattcttctag

SEQ ID NO: 207629 - DNA, 3867 bp, Artificial Sequence
  Description of Artificial Sequence: Synthetic coding sequence
atggccctgagcaagggcctgcggctgctgggccggctgggcgccgagggagactgtagcgtcttgctggaggcccgaggaagggatgactgcttgctgttcgaggccggaacagtggctactttggccccagaggaaaaagaggtgatcaagggtcagtacggcaagttaactgatgcatatggttgtctgggggagctgagactgaagtccggcggaacttccctgtctttcctggttctggttactggctgtacttccgtggggagaatcccggacgccgagatttacaaaattacagccacggatttctaccctttgcaggaagaggctaaagaggaggaaagactgatcgcccttaagaagattctgagctccggcgtgttttattttagttggcccaacgacggatcaaggtttgacctgaccgtgcgcacacagaaacagggggatgattcgtctgagtggggcaatagctttttctggaaccagctcctacacgttccattaagacaacaccaggtatcttgctgtgattggctcttgaagattatttgcggtgtggtcacgatccggactgtgtatgctagccacaaacaagcgaaggcatgcttagtgagtcgtgtgtcctgcgaacggactggcacacggttccacacaagaggagttaatgacgacgggcacgtgagcaactttgtcgaaactgagcagatgatttacatggatgacggcgtgagctctttcgttcagatcagggggagcgtcccgctgttttgggagcaacccgggttacaagtcggatctcaccacctacgcttacaccgcggtctggaggcaaatgccccagcgttcgatcggcatatggtactgctaaaagaacaatacggccaacaggtggtagttaatctgctgggcagccgagggggcgaggaagtcttgaatagggcgttcaaaaagctgctctgggctagctgtcacgcaggcgatacccccatgatcaacttcgactttcaccagttcgcaaagggaggcaagcttgaaaaactggaaaccctcctgcgtccacagttaaagctccattgggaagactttgacgtgttcaccaagggagaaaatgtgtctccaagattccagaaaggtactctgagaatgaactgcctcgactgtctggaccggactaacacagtccagtcattcatcgcactagaagtccttcacctacagctgaagaccctggggctgagctcaaagcccatcgtggatagatttgttgagtctttcaaggcgatgtggagtctgaacggccactctctgtctaaagtgttcacagggtccagggcacttgagggcaaagctaaagtggggaaactgaaggacggcgctcgttccatgtcacggacgatccagtctaacttctttgacggggtgaagcaagaagcaatcaaactgctactggtgggcgacgtttacggtgaggaagtcgctgacaagggagggatgcttctcgactcaaccgcccttctggtgacaccgcggattttgaaagctatgacagagcgacagtctgaattcaccaattttaagcgtattcgtatcgctatggggacgtggaatgtgaacggtggtaaacagtttcggtccaacgtgctgcgaacagccgaactaacagactggctattggacagtccacagttatctggtgcgacggacagccaggacgattcgagccccgcggatatatttgcggtcggcttcgaggaaatggtcgaactgtccgctggaaatatcgtgaacgcatccaccactaacaaaaagatgtggggcgagcagctgcagaaagctatatccaggtcacaccgctacattctcctcacctccgctcagcttgtaggggtatgtctctatattttcgtgagaccataccacgtcccctttattagagacgtggccatcgacacagtgaagactggcatgggcgggaaggccggcaataagggtgcagtgggcatcagattccagttccattcaacgagtttctgcttcatttgttctcacctcaccgcaggccaatcccaggttaaagaacggaacgaagattacaaagagatcacccagaaactctgttttcctatgggcagaaacgtgttctcacatgactacgtgttctggtgcggggacttcaattatcggatcgacttaacttacgaggaagtgttctacttcgtcaagcggcaagactggaagaagctgctcgaatttgaccagttgcaactccagaagtccagtgggaaaatcttcaaggacttccatgaaggcgcaattaactttgggcccacatacaagtatgatgtcggatccgcagcctacgacacttccgacaagtgtcgcacgccagcatggactgacagggtgctgtggtggaggaagaagcacccctttgacaaaaccgcaggagagctgaatctgttggactctgatctggacgtcgataccaaggtgcgacatacctggtcccctggggcactgcaatattatgggagggctgaattacaggcctccgaccatcggccagttctcgcgatagtggaagtggaagtgcaggaagtggacgtgggtgcccgagagagagtgttccaggaagtgtcatcctttcaaggccccctcgacgccaccgtagtggtcaacttgcagtcgccgacactggaggaaaaaaatgagttccccgaagacctgcgcaccgagctgatgcagaccctgggatcttatggtaccatcgtgcttgttcgaattaatcagggccagatgctcgtcacctttgccgatagccacagcgccctcagcgtgctggacgtcgatggaatgaaggtgaaaggcagagctgtgaagatacggcccaaaacgaaggactggcttaagggcctgcgcgaagagatcattcgcaagcgagattctatggctccagtaagccccacagccaacagctgcctgctggaagagaatttcgatttcacttccctagactatgaatctgagggagacatcttggaggatgacgaggattacctggtggatgagtttaatcaacccggcgtgtccgatagtgagctggggggagatgacctttctgatgtgccaggacctacagctctggcaccaccatcaaagtcccctgctcttactaaaaagaagcagcacccaacttataaggatgacgctgatctggtcgagctgaaacgtgagcttgaggctgtgggagagttccgccatcggagcccatcccgaagcctgagcgtgccaaaccggcctcgccccccacagcctccccagcgaccccctccaccgaccggactcatggtgaagaaaagtgcctccgacgcttccatcagcagcggtacacacggccaatatagcattctgcagactgccagactactccctggggcacctcagcaaccacccaaagctcggaccggcatcagcaagccatataacgttaaacagattaaaactacgaatgctcaggaagcagaagcggccatccggtgtctgctggaggcacgcggcggcgcctccgaagaagctctgtccgccgtggccccacgagacctggaggcatcctctgaacccgagcctacaccaggggccgccaagcccgagactccgcaggctcccccattgctaccacggcgaccacccccgcgtgtaccggccattaaaaagccaacactaaggagaacaggtaagattgttttctgctcacggtctcaggcttcacaaccatgcctgttgctgcagcgccacgaattcgtacgaaccgttgctgctcaacgtttagcttcggtagacacctcaggttcatcagtctag

SEQ ID NO: 207630 - DNA, 4356 bp, Artificial Sequence
  Description of Artificial Sequence: Synthetic coding sequence
atggccctgagcaagggcctgcggctgctgggccggctgggcgccgaaggggattgcagcgtactcttggaagccagaggccgagacgattgcctgctctttgaggctggcacggtggctaccttagcacccgaggaaaaagaagtgattaaggggcaatacggaaagctgactgatgcctatggatgtttgggagagctgaggcttaagagcggagggactagtttatcttttcttgtcctggtgaccggctgcacttccgtgggcagaattccggatgctgaaatctataagatcacggccaccgatttctatccattacaggaagaggccaaagaggaagaacgcctgatcgccctcaagaagatcctgtccagtggcgtattctatttcagttggccgaacgacgggtccagattcgatctgactgttaggacccaaaagcagggcgacgatagctctgaatggggtaattcttttttctggaatcaactgttgcatgtccccttgcggcagcatcaggtgagttgttgtgactggttactaaagatcatttgcggggtggtgacgattagaactgtgtacgccagccacaagcaggctaaggcctgtctggtgagtcgtgtcagttgtgagagaaccggcactagattccatacccggggcgtcaacgacgacggtcatgtgagcaattttgtggagaccgagcagatgatctacatggatgacggtgtgtcttcttttgtgcagattagaggttcagtacctctgttctgggaacagcctggcttgcaggtgggctctcaccatctcaggctccacagaggactggaggcaaacgccccagcttttgatagacatatggtgctcctgaaagaacagtacggacagcaagttgtggttaacctgctaggctcaagaggcggagaggaggtgctaaatagagcgtttaagaaactgctgtgggctagctgccacgccggtgacactcccatgatcaactttgactttcaccagttcgccaagggagggaaactggagaaattagagacactgctgcggccgcagttgaaattacactgggaggactttgatgtgttcacaaagggggagaatgtctctccaagatttcaaaaggggaccctgcgcatgaattgcctagactgtctagaccggacaaataccgttcagagttttatcgcactggaagttctgcaccttcaattgaagacgctgggactaagcagtaaacctattgtggaccggtttgtggagagctttaaagccatgtggtctttaaatgggcactccctctccaaagtcttcacagggtcccgcgcgctggaaggcaaggccaaggtgggaaagctcaaggatggggctaggagcatgtcccgcaccatccagagcaattttttcgatggcgtgaagcaggaggcaatcaagctcctcttagtcggagatgtttatggcgaagaggttgcggataagggcggcatgctgctggattccacggccctgttggttactccgagaatacttaaggccatgaccgaacgccagagcgagtttactaattttaaacgcatccgcattgccatgggaacatggaacgtgaatggtggaaaacagttcaggtctaacgttttacgaacagcagaactgaccgactggttactggactccccccagctaagcggtgccactgactcacaagacgactcgagccccgccgatatattcgccgttggattcgaggagatggttgagttatctgctggcaacatcgttaacgccagcaccacaaacaagaaaatgtggggggagcagctccagaaggctattagcagatctcataggtacatcctcctgactagtgcgcaacttgtgggtgtctgtctctacatcttcgtccggccctaccatgtgccatttatccgggacgtggccatcgatacagttaagaccggcatgggtggcaaagcaggtaacaagggggcagtgggtatcaggttccagttccacagcaccagcttctgcttcatttgttcccatctaaccgctggccagtctcaagttaaggaacggaatgaggactacaaggaaatcacccagaaactttgttttccgatgggccgtaatgtattttctcacgactatgtgttttggtgcggtgacttcaactatcgcattgaccttacatatgaagaggttttctacttcgtgaagcggcaggactggaaaaagcttctagagtttgatcagctccagctccagaagtctagcggcaaaatatttaaagacttccatgagggggctattaactttgggccaacctacaaatatgacgttggatccgcagcctatgacaccagcgataaatgtcgcacaccagcatggaccgaccgagtcctttggtggcggaaaaaacatccttttgataaaactgcgggggaactgaaccttctcgacagcgacctcgatgttgacaccaaagtgcgccatacgtggagcccgggcgcgctgcagtactacggccgcgcagaactgcaggcctcagatcaccgcccagtcttggctatcgtcgaagttgaggtgcaagaagtcgatgtgggtgcgcgagaaagagtgtttcaagaagtatcctccttccaggggccactcgacgcaaccgtcgtcgtcaacttacagagtcccactctggaagagaagaatgagttccctgaggatttaagaaccgaactcatgcagacactgggatcttacgggacaatcgttctggtaagaataaaccaggggcaaatgcttgttacattcgctgattcccatagcgcattatctgttctggacgtggatgggatgaaagtgaaagggcgcgctgtgaagattaggccgaaaacgaaggattggctgaaggggttaagagaggaaatcatacgcaagcgtgactccatggctccagtgagccccactgcaaactcttgtctcctggaggaaaatttcgatttcacttcccttgattatgaatcagagggcgacatcctggaagatgatgaggactatcttgtcgacgagttcaaccagcctggggtgtctgactcagagctggggggtgacgatttatccgatgtaccaggccccacggctttggctccgcccagcaagtctccggcgttgacaaagaagaagcagcatcctacgtataaggccggcctcatggtcaaaaagtccgcgtctgatgcctctatctcctcgggaacacatgggcaatactctattctgcagaccgctcgccttctgccgggagctccccagcaaccgcctaaggcacgcacagggataagtaaaccgtataatgtcaagcaaattaaaaccacaaatgctcaggaagctgaggccgccatccgctgtcttctcgaggccaggggtggggctagcgaagaggccctcagcgctgtcgcccctcgggatctggaagcttcatctgaaccagagcccacacctggcgccgcaaaacctgagacaccacaggcaccacctctgttgcctaggcgacctccaccacgcgtgcctgccataaaaaagccaacactgagacgaacaggaaaaccactaagtcctgaggaacagtttgagcagcaaactgtgcacttcaccattgggcctcccgaaacaagtgttgaggcacctcccgtcgttacagcacctagggttccccccgtgcccaagccaaggacctttcagcctggtaaggcggctgaacggcctagccacaggaagccagctagcgacgaagcaccacccggagcaggggccagcgtcccgccaccgctggaggctcctcccctagtgcccaaagtccctcccagacggaaaaaaagtgctccggctgcgttccatctgcaggtgttacagtccaacagccagctcctccagggtctgacttacaatagctccgattctccatccggccatcctccagcggccggcactgtctttcctcagggggactttctgtccaccagttctgccacaagcccagattcagacgggacaaaagctatgaagcccgaagcggcccctctcttaggcgattaccaggaccccttttggaacctcctacaccaccccaagctgcttaacaacacctggctgtccaagagtagtgacccgctggactcgggcacccgatctcccaagcgcgaccccattgatccagttagcgccggagcctcagcagcaaaggctgaattgccacctgatcacgagcacaagacactaggtcactgggtcacaatttctgaccaggaaaaacgcaccgccttgcaggtcttcgatcccctcgcgaaaacctag

SEQ ID NO: 207631 - DNA, 279 bp, Artificial Sequence
  Description of Artificial Sequence: Synthetic coding sequence
atgttcctgtacgccagcggccccgccccccccgccggcacctgcagatgggggggccaggggggtactagtttgtcgttcttagttttagtgacagggtgcacctcggtgggaagaatccctgacgcggaaatctacaagatcactgcgacagatttctaccctcttcaggaggaagctaaagaagaggagaggctgatcgccctgaagaaaatcctcagcagcggggtgttctacttctcttggcccaacgacggaagtaggttcgatctaacatag

SEQ ID NO: 207632 - DNA, 1551 bp, Artificial Sequence
  Description of Artificial Sequence: Synthetic coding sequence
atgttcctgtacgccagcggccccgccccccccgccggcacctgcaggtggggtggtcaggggggcacctctctgtcctttctcgtgctggtgacgggttgtacctccgtgggcaggatccccgacgcggagatctataaaattacagccacagatttctaccccctccaggaggaggcaaaagaggaggaaaggcttatcgcccttaagaagatcctctcttctggagtcttctactttagttggcctaacgatgggagccgatttgacctgaccgtcaggacacagaagcaaggggacgactctagtgagtggggcaatagcttcttctggaaccaactgctgcatgtgcccctgaggcagcatcaggtctcctgctgcgattggctcctcaaaataatctgtggtgtggtgacgattagaacagtgtatgcgtctcataaacaagccaaggcatgcctagtgagcagagtgtcctgtgagcgcacaggtactaggttccatactcgtggcgtcaacgacgatgggcacgtgagcaactttgtggagacagaacagatgatctatatggatgacggagtttcatcatttgtacagattcggggaagcgttccactcttttgggagcagccgggcctgcaggtgggctctcaccacttgaggctccatagggggttagaggccaacgcccctgccttcgatcgccatatggttctgctgaaggagcaatatgggcagcaggtcgttgtgaatctgctaggctcaagaggaggagaagaagtgctcaacagagcattcaaatttgctaaaggaggaaaactggagaagctcgagacactcctgaggccacagctgaagctgcattgggaagactttgatgtcttcacaaaaggcgagaatgtgtcgccgcgctttcagaagggcaccttaaggatgaattgccttgattgcttggaccggaccaacaccgtacagtctttcatcgccctcgaagtcctacacctccagctcaagacgctgggcctctcatctaaacccatcgtggacaggttcgtggagtcttttaaggctatgtggtccctgaatggccacagcctatccaaggttttcactggctctagagccctagaggggaaggccaaggtcgggaagctgaaagatggcgcccgctcgatgtcacgaacgattcagtccaacttctttgacggcgtgaagcaagaggccatcaaactgctcctcgttggcgacgtgtatggtgaagaggtggctgataaaggcggtatgttgttggactcgactgcccttctcgttacccccaggattctgaaagcaatgacagagcgccaatcagaattcaccaacttcaaacgaatacggatcgcgatggggacgtggaatgttaatggggggaaacagttcagatcaaatgtgctccgcacagctgaactgacagactggctgcttgattcacctcaattaagcggagctacagactcccagggcgagggctccgactttgggggagacaaaattcaacttcatctgacatag

SEQ ID NO: 207633 - DNA, 438 bp, Artificial Sequence
  Description of Artificial Sequence: Synthetic coding sequence
atgaacggccgggtggactacctggtgaccgaggaggagatcaaccttacccgcgggccttcgggcctcggttttaatatagtggggggaaccgatcagcagtatgtctctaatgatagtggaatctacgtcagcaggatcaaagaaaatggggccgccgcattagatgggaggcttcaggagggcgacaagatcctttcggttaacggtcaggacctcaaaaatctcctccatcaagacgccgtggatctgtttcgaaacgcaggttatgccgtatcgctgagggtgcaacaccggcttcaggtgcagaatgggcctatcggccatcgcggcgagggcgacccctccggtattccaatcttcatggttttggtgccagtctttgctctgaccatggtggcagcttgggccttcatgcggtaccgtcagcagttgtag

SEQ ID NO: 207634 - DNA, 957 bp, Artificial Sequence
  Description of Artificial Sequence: Synthetic coding sequence
atggccggccggagcctgaccagcaaggccgagcccaccgccggcgccgtagatcgcgcggagaaagccggcggccaggatacttcatcacagaagatcgaggacctgatggagatggtccaaaagctccagaaggtaggaagtctggagcccagggtggaggtactgattaaccggatcaacgaggtgcagcaggccaaaaaaaaggccaacaaagatctgggcgaggcaagaaccatctgcgaggctctgcaaaaggagctggactcgctgcacggcgaaaaagtgcaccttaaggagattttgtcaaagaagcaggagactctgcgcatcctgcggctgcattgtcaagagaaagagtctgaggcccacagaaaacacacaatgttgcaggaatgcaaggagaggatctccgcattaaaccttcagatcgaggaggaaaaaaacaagcagcggcagctccggctggcatttgaagagcagctggaagacctgatgggccagcacaaagacctgtgggactttcacatgcccgaacgcctggccaaagagatatgcgccctggactcatctaaagagcagctcctcaaggaagagaaactggtgaaggccacactcgaagatgttaaacaccagctctgctcattgtgcggtgcggaagggcccagcaccctcgacgaaggcctgtttctcaggagccaggaggctgccgccacggtccagttgttccaagaagaacataggaaggccgaggagctgctggcggcagcagcacaacggcaccagcagctgcagcagaaatgtcagcaacaacagcagaaacggcagcgcttaaaagaagagctggaaaagcacggcatgcaggttcccgcgcaggctcaatccactcaggaggaagaggcaggccctggcgacgtggccccgaggccgggccgcccggttacctggtggagctag

SEQ ID NO: 207635 - DNA, 1056 bp, Artificial Sequence
  Description of Artificial Sequence: Synthetic coding sequence
atggccggccggagcctgaccagcaaggccgagcccaccgccggcgcagtggatagagcagagaaggccggaggacaggacacgagcagccaaaagatcgaggacctgatggagatggttcagaagctgcagaaggtgggcagtttggaacctcgcgtcgaggtgcttatcaacaggattaacgaggttcagcaggcaaaaaaaaaagccaacaaggacctgggggaggctcggactatctgtgaagcactccaaaaggaactcgatagtctccacggagagaaagtgcacttgaaagagatcttatcaaagaaacaggagaccctgagaatcctgagacttcattgccaggaaaaagagtcggaagctcaccggaaacatactatgctccaagagtgcaaagaacggatttcggcactcaacctccaaatagaagaagagaaaaataaacagaggcagctccgcctcgctttcgaggagcaactcgaggacctgatgggacaacataaggatctttgggattttcacatgccagagagactagctaaggaaatctgcgccctggatagtagcaaggagcagttactgaaggaggaaaaacttgtgaaagcgaccttagaggatgtgaaacatcagttatgcagcctgtgcggcgccgaaggcccgagcactctagacgaaggactgtttctgcgaagccaggaagccgcggccacagtacagctgtttcaggaggaacatcgaaaagctgaggagctgcttgcggctgcagcgcagcgtcatcagcaactgcagcagaaatgtcagcagcagcaacagaagcgacagcgtttaaaggaggagctggaaaaacacggcatgcaggttcccgctcaggcccagagtactcaggaggaggaagcaggtcccggggacgtcgcatccccaaagcctttgaagggagaacggcccggtgctgcccatcaggcaggcccggacgtgctgattgggcaggaggacacattgcatccagacttatccccgagaggctttcaggaaatcaaggaactgttctag

SEQ ID NO: 207636 - DNA, 849 bp, Artificial Sequence
  Description of Artificial Sequence: Synthetic coding sequence
atggagatggtgcagaagctgcagaaggtgggcagcctggagcccagggttgaggtgctcatcaataggatcaatgaggttcagcaagctaaaaagaaggcgaataaagacctcggggaggccaggacaatctgtgaagcacttcagaaagaacttgactccctccacggagaaaaagttcaccttaaggaaatcctgtcaaaaaaacaggagaccctgcgcatcttgcgattgcactgccaggaaaaagagtccgaggcacatagaaaacatactatgttgcaagaatgtaaggaaaggatctcagcactgaacctgcagattgaggaggaaaagaacaagcagaggcagctgcgcttagcgtttgaagaacagttagaagatctcatgggccagcacaaggacctgtgggatttccacatgccagagcggctggctaaggaaatttgtgccctagattcctccaaagagcagcttctgaaagaagagaagctggtcaaggctacactggaagatgtcaagcaccaactctgtagcctctgcggcgctgaaggcccatccaccctcgacgaggggttgttcctccggagccaggaggccgcagccactgtccagctgtttcaggaagagcacaggaaggcggaggagctgcttgccgccgccgcccagagacaccagcagctgcagcagaagtgccaacagcaacagcagaaacgccagcgcctgaaagaggagctggaaaagcatgggatgcaggtgccagctcaggcacagtccacacaagaagaggaggctggcccaggggacgtggctccacgcccagggaggcctgtgacgtggtggagctag

SEQ ID NO: 207637 - DNA, 849 bp, Artificial Sequence
  Description of Artificial Sequence: Synthetic coding sequence
atggagatggtgcagaagctgcagaaggtgggcagcctggagcccagagtagaagtgctgatcaaccgaataaatgaagtgcaacaagcaaaaaagaaggccaataaagatcttggtgaagccagaaccatctgcgaggcgttgcagaaagagctcgattctctccacggcgaaaaagtccacctgaaagaaattcttagcaaaaaacaggagactctgagaattctgcgactgcactgtcaagagaaggagagcgaggctcaccgaaaacatacgatgcttcaggagtgcaaggaaagaatatccgcgttgaaccttcagattgaagaggagaaaaacaaacagaggcagctgcgcttggcatttgaagagcagctggaggatctgatggggcaacacaaggacttgtgggacttccacatgcctgagcggctagctaaagagatctgcgccctggattcttctaaggaacagctgctaaaggaagaaaaattagtcaaggctaccctggaagacgttaaacaccagctctgtagcctatgtggcgccgaagggccgtcaacattggatgagggactctttctgaggtctcaggaagcagctgcgacagtacagctgtttcaggaggaacatagaaaagctgaagagttattagcagccgctgcccagcggcatcagcagctgcagcaaaaatgccagcagcagcagcagaaacggcaacgccttaaagaggagctcgaaaagcatggaatgcaggtgcccgcccaagcacagagcacccaggaggaagaggcaggaccaggcgacgttgccccaagaccagggcggccagtgacatggtggtcctag

SEQ ID NO: 207638 - DNA, 657 bp, Artificial Sequence
  Description of Artificial Sequence: Synthetic coding sequence
atggagcggcagggcgtggacgtgccccacgtgaagtgcaaggaccaggagccacagcccctgggtgagtccaaagaacaccctcggtgggaggagaattgtgaggaggaggcaggaggtggacctgcctccgccagttgccagcttacagtgctggagggcaagagtggactgtactttagcagtttggattcatcaatcgacattcttcagaagcgtgcacaagaattaatcgagaatattaacaagtctcggcaaaaggaccatgctctgatgaccaacttccgaaatagcctgaagacgaaggtcagtgatctgacggaaaagttggaagaaaggatttaccagatttacaacgatcataacaagataatacaagagaaactgcaggagttcactcagaagatggccaagatctcgcacctcgaaacagagctgaagcaggtatgtcattcagtcgagaccgtctacaaagacctgtgtttgcagcctgaacaatctctgcgcctaagatgggggcccgatcacagccgcgggaagagccctccaaggcctggcaattcacaaccccccgacgtgttcgtgagctcggtggccgagaccacttcacaggccaccgccagcgaagtgcagacaaatagggatggggagtgctag

SEQ ID NO: 207639 - DNA, 2931 bp, Artificial Sequence
  Description of Artificial Sequence: Synthetic coding sequence
atggagaagcagaagcccttcgccctgttcgtgcccccccggagcagctcgagccaggtgagtgccgtcaagcctcagacactcggtggggactctactttctttaaaagcttcaacaaatgtacagaggacgacttcgagttccccttcgccaagaccaacctttctaagaacggagaaaatatcgatagtgatcctgctctgcagaaggttaatttcctgccagtgctcgagcaggtcggaaactccgactgccactaccaagagggcctgaaggactccgatctggaaaattcagagggactcagcagagtctactccaaactgtataaagaggcagaaaagatcaagaagtggaaagtgtctaccgaggcagaactgcgccaaaaggagtccaaactccaggaaaacagaaagatcatagaggcccagcggaaggccatccaggagctacagttcggtaacgagaaggtttctctcaaactcgaggaagggattcaggagaataaggatctgatcaaggagaacaacgctaccaggcatctatgtaacctattgaaagaaacctgtgcccgcagtgccgaaaagaccaaaaagtatgagtatgagagggaggaaacacggcaggtctatatggacctgaacaacaacattgaaaaaatgatcaccgcgttcgaggagttaagggtgcaagccgagaacagtaggttagaaatgcacttcaaactaaaggaagactatgaaaagatccagcacctcgagcaggagtataagaaagaaattaatgataaggaaaaacaggtttcacttttgcttatccagatcacggagaaggagaacaaaatgaaagatctcacctttctgctggaagagagtcgcgacaaagtcaaccagcttgaggaaaagactaaacttcagtcagaaaatcttaaacagtccattgaaaagcagcatcatttaacaaaagaactggaagacattaaggtgtcactgcagagatccgtgtcaacacagaaggcgctagaggaggatctacagatcgctacaaaaactatctgtcagctaaccgaagaaaaggagacgcagatggaggaatctaataaagcccgagccgctcactcttttgttgtcaccgagtttgagacaactgtgtgttctctagaagagctgttgcgaactgagcaacagaggctagagaaaaatgaggatcaattgaagatcttgacaatggaacttcagaaaaaaagttcagagttagaggagatgactaagttgacaaacaataaggaagttgaactagaggagctaaagaaggttttgggtgaaaaagaaacgctgctatatgagaacaagcaatttgagaaaatagctgaagaattgaaagggaccgagcaggagctgatagggttattgcaggcgcgggagaaagaagtccatgacctggagattcagttgaccgccattacgacatctgaacaatactattcaaaagaggtgaaggatctgaaaacggagctggaaaacgagaaactgaagaatacagaactgacctctcattgtaacaagctctccttagagaataaagagctgactcaggaaacatccgacatgaccctggagctgaagaatcagcaggaagacataaacaataacaagaagcaggaggaacgaatgttaaaacagatagagaatttgcaagagaccgagacgcagctcaggaatgagcttgaatacgtgagggaggaactcaaacagaaacgagacgaggtgaagtgcaaacttgataagagcgaggagaactgtaataacctgcggaaacaagtagaaaataagaataagtacattgaggagctccagcaggaaaataaggcactgaagaagaaaggcactgctgaaagcaagcagctgaacgtctacgagatcaaagtgaacaaactggagttggaactagagtcagcgaaacagaagttcggggaaataaccgacacttaccaaaaggaaattgaggacaagaagatcagtgaagagaacctgctggaggaagtggaaaaggctaaggtgatcgcagacgaggccgtaaagctgcagaaagaaatcgataagagatgccagcacaagattgccgaaatggtggccctgatggaaaagcataagcatcaatatgacaaaattatcgaggagcgcgacagtgagctggggctgtataagagtaaggaacaggagcagtcatccctccgggcaagtttggaaattgaactctccaaccttaaagcagagctcctttcggtgaagaaacagcttgagattgaaagggaagaaaaagagaagctgaaaagagaagctaaggaaaatacagctacactgaaggaaaaaaaagataagaagacccagaccttcctgctggaaactcccgagatctactggaaactggattctaaagcagttccttcacagaccgttagccggaacttcacctccgtggaccatggaatctccaaagacaagagggattacttgtggacctcggccaaaaatactctgagcacaccactgccaaaagcctatactgtcaagacccccactaagcctaagttgcagcagcgcgaaaatcttaacatccctattgaagagagcaagaagaagcgcaagatggcctttgaattcgacatcaatagtgacagttctgagacaaccgatctgctgtccatggtgtccgaagaagaaaccctgaagactctgtatagaaacaacaacccacccgcatctcatttatgcgtgaagactcccaaaaaggcgccaagtagccttacgactcctggctctacattgaagttcggcgccatccgcaaaatgagagaagacaggtgggccgtgattgctaagatggacagaaagaaaaagttgaaagaggccgaaaagctctttgtctag

SEQ ID NO: 207640 - DNA, 2931 bp, Artificial Sequence
  Description of Artificial Sequence: Synthetic coding sequence
atggagaagcagaagcccttcgccctgttcgtgcccccccggagctcgagcagccaagtatcagccgtgaaaccacagactcttgggggggattccactttcttcaaatcttttaacaaatgtaccgaagacgatttcgagtttcccttcgcgaagacaaacctgtcaaaaaacggtgaaaatattgactctgaccctgctctgcagaaggtaaacttcctgccggtgctggagcaggttgggaatagcgactgtcattaccaggaggggctcaaagatagcgatctggaaaattctgagggactgtcccgggtgtattcgaaactctacaaagaagctgagaagattaagaaatggaaggtgtctacagaagccgaactacgccagaaggaaagcaagctgcaggaaaataggaagataatcgaggcccagcggaaggccatccaggagctgcagtttgggaacgagaaggtcagcctcaaactggaggagggcattcaggagaataaagacctaataaaagaaaataacgccacaagacatctgtgcaacttactcaaagagacctgtgcaaggtctgcagaaaagactaagaaatacgaatacgaacgggaggagacccggcaggtctatatggatttgaataacaatatcgagaagatgatcaccgcctttgaagagctgcgcgtgcaggctgaaaattctaggctggaaatgcatttcaaactcaaagaggattatgagaaaatacaacatctagaacaggagtacaaaaaggaaattaacgataaggagaagcaagtgtcgttgctcctgatccaaatcactgagaaagagaacaaaatgaaggacctcacctttcttctggaagaatctcgagacaaggtaaatcagctcgaggagaagacaaaattacagtcagagaatctgaagcagtctattgagaagcagcaccatctcacaaaggagctggaagacatcaaggtgtccttgcagcggtccgtcagcactcaaaaagccctggaggaggacctgcagatcgcaacaaaaaccatctgccaactgactgaagagaaagagacacagatggaggagagcaataaagctagagcagcccattctttcgttgtaaccgaatttgagaccactgtgtgcagtttggaggaattgttgcgcactgagcagcagaggctcgagaagaacgaggaccagctcaaaattttgactatggagctacagaaaaagtcctctgaactagaggagatgacgaaattaacaaacaataaagaagttgaacttgaagagctcaaaaaagtcctcggagaaaaagagaccctgctatacgagaacaaacagtttgagaagattgcagaagaactcaaaggaacagagcaagaactgatcggccttttgcaagcgagggagaaggaagttcacgatctagaaattcagttaactgccataaccacgtcagagcagtactactctaaagaggttaaagatttgaaaactgagctggagaatgagaagctgaaaaacaccgagctaaccagtcattgcaacaagctttccctggagaacaaagagctgacccaggagacctctgatatgaccctggagctgaaaaatcagcaagaggatatcaacaacaacaagaagcaggaggagagaatgttgaaacaaattgagaatcttcaggagactgaaacacagctccgtaatgaattggaatatgttagagaggaacttaaacagaagcgggacgaggtgaagtgtaagctagacaaaagtgaggagaactgtaacaacctgagaaaacaagtagagaataagaacaagtacatagaagaactacaacaggagaacaaagccctcaagaaaaaggggaccgctgagtcaaagcagctgaatgtgtacgagatcaaggtcaacaagctcgaactcgaacttgagagcgctaagcagaaatttggagagattacggatacctatcagaaggaaattgaggataagaagattagtgaggagaatctgctggaagaagtggagaaagctaaagtgattgccgacgaggccgtgaaactgcaaaaagagatcgataaacgatgtcagcacaaaatcgccgagatggtggccctaatggagaaacataaacatcagtatgacaagatcatcgaggagcgggactcagaactgggactgtacaagtccaaagagcaggaacagagctctttgcgagctagcctcgaaatcgaattgagcaacctaaaagccgagttactcagcgtgaaaaaacagctcgagatcgagagagaggagaaagagaagctgaagagagaggcaaaggagaacaccgccaccctaaaggagaagaaggataaaaagacacaaacttttctcctcgaaacccccgaaatttattggaagctggatagtaaggccgtgcctagccagacagttagtcgcaactttacgtcagtggatcacggaatttcgaaggataagcgcgactatttgtggacaagtgccaaaaacacactctcaactccccttccaaaagcgtatactgtcaagacacccaccaagcctaaactgcagcagcgcgaaaacttaaacatacctatcgaagaaagtaagaagaagcggaagatggcctttgagtttgacatcaactccgacagttctgaaaccaccgacctgctctccatggtgtctgaggaggagactctgaagactctgtacaggaacaataaccccccagcatcacatctgtgtgtaaagacccccaagaaagctcccagctccctgactaccccgggatccacactgaaattcggcgctatccggaagatgcgggaagaccgctgggcagtgatcgctaaaatggatcggaaaaagaaacttaaggaagctgaaaaactctttgtttag

SEQ ID NO: 207641 - DNA, 2379 bp, Artificial Sequence
  Description of Artificial Sequence: Synthetic coding sequence
atggagaagcagaagcccttcgccctgttcgtgcccccccggagctcttcatcccaggtaagtgcagtgaaaccccagactctgggcggagacagcacattctttaaatcttttaataagtgtacagaggatgatttcgaatttccattcgccaagaccaatttatccaaaaacggagagaacatcgacagcgaccccgccctgcaaaaggtcaatttcctccctgtgctcgagcaagtggggaacagcgattgccattatcaagagggcctcaaggactctgatcttgagaactccgaaggcttaagcagagtgtattcgaagctgtataaggaagcggagaaaatcaaaaagtggaaagtaagtacggaggctgaactgaggcaaaaagagagcaagctgcaggagaaccgcaagataatcgaagctcaaagaaaggcaatccaggagctccagtttggcaatgagaaggttagcctcaagctggaggaagggatccaggaaaacaaggatttaatcaaggaaaacaatgcaacaaggcacctgtgcaacctcttgaaagaaacatgtgccaggtctgcggaaaagaccaagaagtatgaatatgagcgggaggagaccagacaggtttatatggatcttaataataatatcgaaaaaatgatcacagcattcgaggaactgcgagtgcaggccgagaatagccggctcgaaatgcactttaaattgaaggaggattacgaaaagatacagcacctcgaacaggaatataagaaagagattaacgacaaggagaaacaagtaagcctgttactgatccaaatcacagagaaggagaataaaatgaaggacctgactttcctactcgaggaaagccgggacaaggtaaaccaacttgaagaaaagaccaaactgcagagcgaaaatctcaagcagagcatcgagaaacagcaccatttaaccaaggagctcgaagatatcaaagtgagtctgcaacggtcggtcagcacacagaaagcactcgaggaggatctccagatcgccacaaaaaccatatgtcaactaactgaagaaaaggaaacgcaaatggaagaaagcaacaaggctcgagctgcccactcttttgttgttaccgaatttgaaaccacagtgtgctccttggaagagctgctgagaaccgaacagcagagactcgaaaaaaacgaagatcagctgaaaatactgactatggagcttcagaagaagagttctgagctggaggaaatgacaaagctgactaacaataaggaagtggagttagaggagctcaagaaggtcctgggcgagaaagagaccctcctgtatgagaataagcagttcgaaaaaattgccgaggagctgaaaggaaccgaacaggaattgatcggattactccaagcgagggagaaggaggtacacgacctggaaattcaactcacagctatcacaaccagtgagcagtattattccaaagaagtgaaagacctgaagactgagttagaaaacgagaagctcaaaaacaccgagttaacttcccattgcaataagttatctctcgagaacaaagaattgactcaggaaactagcgacatgacactggagctcaagaatcagcaggaggatattaacaataataaaaagcaggaggagcgtatgctcaagcagattgaaaacctacaggagaccgaaacccagctgaggaacgaattagagtacgtgagagaggagcttaagcagaagagggatgaagtcaaatgcaagctcgataagagtgaagaaaattgtaataacctgagaaaacaagtggagaacaaaaataaatatattgaggaactgcagcaggaaaataaagcactgaagaaaaaggggacagccgaatcaaaacagctcaatgtgtacgagatcaaagtgaacaagttggagttggaactggagtccgcaaaacaaaaatttggcgagattacagacacttaccagaaagagattgaagataaaaagatttctgaagagaacctcctggaggaagttgagaaagccaaagttatagccgacgaagcagttaagctccagaaagagatcgacaagaggtgccagcataaaatcgccgagatggtcgcccttatggaaaagcacaagcaccagtacgacaaaattatcgaagagcgcgacagtgagctgggcctttataagtctaaagagcaggagcaaagcagcctcagagcctctttggaaattgaactgtcgaatcttaaggctgagctgctgagcgttaagaagcaattggaaattgaacgggaggagaaagaaaagcttaaacgggaggcaaaggaaaatactgcaacactaaaggaaaagaaatag

SEQ ID NO: 207642 - DNA, 2388 bp, Artificial Sequence
  Description of Artificial Sequence: Synthetic coding sequence
atggagaagcagaagcccttcgccctgttcgtgcccccccggagctctagctcccaggtctctgcagtaaaacctcagaccttaggtggcgattctaccttctttaagagcttcaacaaatgcaccgaggatgactttgagttccctttcgccaaaaccaacctctcgaaaaacggcgaaaatatcgactctgaccctgccctccaaaaagtgaactttcttcccgtgctggaacaggtgggtaactccgattgccattaccaggagggcctcaaagatagcgatctggaaaattctgagggactgagcagggtatactctaagttgtataaagaggccgagaagatcaaaaagtggaaggtctctacagaagccgaactgaggcagaaggaatctaagttgcaggagaatcgcaagatcatcgaagctcagcggaaagccatccaagaactgcaatttggcaacgagaaggttagtttgaaactcgaagaaggtatccaggaaaacaaggacttgataaaggagaataatgctacacgccacttgtgcaatctgctcaaggagacttgtgcccgaagcgcagagaagaccaaaaagtatgagtatgaacgagaagagacaagacaagtttatatggatcttaacaataatattgagaagatgatcactgcctttgaagagctaagggtgcaggcagagaattcacgcctggaaatgcattttaagcttaaagaggactacgagaaaatccagcacctagagcaagagtataagaaagagatcaacgataaggagaagcaggtctctctgctgcttatccaaatcacggagaaagaaaacaaaatgaaggatttaactttcctgttagaagaaagcagagacaaagttaatcagctggaagaaaagacgaaactgcagtcagagaatctaaaacaatcgatcgaaaaacaacaccatctaacaaaggaactggaggatattaaagtgtcccttcagagatctgtgagtacccaaaaagcactagaggaggacctgcagattgctactaagactatatgtcagctgaccgaagaaaaagaaacccagatggaagagtctaataaggcaagagccgctcactctttcgtcgtgaccgagtttgaaaccacagtgtgttccctggaagagctgctgcgaactgaacaacaaagactcgagaagaacgaagaccaactgaagatcttgacgatggagcttcagaagaagagttctgaacttgaagagatgactaaactcacaaataacaaggaagttgaacttgaggagctcaaaaaagtgttgggggagaaagagactctcctgtacgaaaacaagcagttcgagaagatagccgaggagctcaaaggtactgaacaagaactgatcggactgcttcaagccagagagaaggaggtgcacgacttggagatccagctgactgcaattaccacctcagagcaatattattccaaggaagtgaaagacctgaagactgagctggaaaatgagaaactcaagaataccgagctcacatcccattgcaacaagctgagcttggaaaacaaggagctcactcaagagacctctgatatgaccctcgaattgaagaatcagcaggaggacatcaacaacaataaaaagcaggaagaacgcatgctgaaacaaatcgagaatcttcaggagactgaaacccagcttaggaatgaattagagtatgtgagagaggaactgaagcagaagcgcgatgaagtgaagtgcaagctcgataaatccgaggagaactgcaataacctgcggaagcaggttgaaaataaaaataagtatatcgaggagctgcagcaggaaaacaaagccctcaagaagaaaggtaccgccgagagcaaacagctgaatgtgtatgagattaaggtgaataagctggagctggagcttgagtcggccaaacagaagttcggtgagatcacagatacctatcagaaggaaatcgaggataagaaaatttctgaagagaatctcctggaggaggtcgaaaaggcgaaagttattgctgacgaagccgtgaagctgcagaaggaaatcgataagcggtgtcagcacaaaatcgctgagatggttgccctgatggaaaagcacaaacatcagtatgataagatcatcgaggagagagactctgaactcggactgtacaaaagcaaggagcaggagcaatccagtctccgcgcctccctggagatcgagctgagtaacttgaaggccgaactattgtcagttaagaaacagctggagatagaaagggaagagaaagagaagctgaagcgggaagccaaggagaacactgccaccctcaaagagaaaaaggataagaaatag

SEQ ID NO: 207643 - DNA, 4593 bp, Artificial Sequence
  Description of Artificial Sequence: Synthetic coding sequence
atgcccatccggcccgacctgcagcagctggagaagtgcatcgacgatgctctgcgcaaaaacgacttcaagcctctgaaaacattactgcaaattgacatatgtgaagacgtcaagattaagtgttccaaacagttcttccacaaggtggataatctgatctgccgtgaactgaataaggaggatatccacaatgttagcgcaattctagtgagcgtgggacgctgcgggaaaaatatttcagtgcttggacaggccggtcttctaacgatgatcaagcagggacttatacagaagatggtcgcttggtttgagaaatcgaaagacataatacagtcccaggggaactcaaaagatgaggctgttctgaacatgattgaggacctggtcgatctactactagtgattcacgacgtgtcagatgagggaaaaaaacaggttgtggagtccttcgtaccccgtatatgctccctggtgatcgatagccgggtgaacatctgtattcaacaggagatcattaagaaaatgaacgcgatgctcgacaagatgcctcaagatgccaggaaaatcctgtctaatcaggaaatgttaatcttgatgtctagtatgggagaacgtattctggacgctggggattatgacctgcaggtaggcatcgtggaagcactgtgccgaatgactaccgagaagcagcgtcaggaattagcacatcagtggtttagtatggattttatcgcaaaagccttcaaaaggatcaaggacagcgagttcgagaccgattgcaggattttcctcaatttggtcaatgggatgctcggggataagaggcgggttttcactttcccctgcctctccgcattcctggataagtatgaactgcagatcccgtctgatgagaagctcgaggaattttggattgacttcaacctaggatcccagaccctgagtttctatatcgcaggtgacaatgacgatcaccagtgggaggctgttaccgtgcccgaggagaaagtgcagatctactctatcgaggtgcgtgaatccaagaagctcctgacaattattctaaaaaacaccgtgaagattagcaagcgcgagggcaaggaactcctgctttacttcgatgctagtctcgaaataacgaacgtcacccagaagatttttggcgctactaagcaccgcgagtccattcgcaagcaaggaatcagcgttgctaagaccagcctccatattctgttcgatgcttctggatctcagattctggtccccgagagtcaaattagccccgttggcgaggagttggtgtcgctcaaagagaagagtaagtctcctaaagaatttgcgaagccctcaaaatatattaaaaactcggataaggggaatcgcaacaattcccagcttgaaaagaccacgccatcgaaacgcaagatgagcgaagcttccatgatcgtctccggggccgatagatatacaatgcgctctccagtgctcttctcaaacacaagcattcctcctcggcgaaggaggatcaagccgcccttacagatgaccagttctgctgaaaaaccctcggtgtcacaaacaagtgagaatcgggttgacaacgctgcgtcattaaagtcccggagcagtgaaggcaggcataggcgagataatatcgataaacacatcaaaacagcaaaatgtgtcgaaaatacagaaaataaaaacgtggaattccccaaccagaatttcagcgagctccaggacgtaatccccgatagccaagccgctgagaagagagatcacaccatcctcccgggcgttctggataacatatgtggaaacaaaatccatagcaaatgggcttgctggaccccagtcaccaacatcgagttgtgcaataaccaaagagcgtcaacttcctcaggggacacgttaaaccaggacatcgtaattaataagaagcttaccaagcaaaaaagcagctcttccatttcagaccacaactcggaaggtacaggtaaggtcaaatacaagaaagaacagaccgatcacattaagatcgataaggcagaagtcgaagtgtgcaagaagcataaccaacagcaaaaccacccaaaatatagcggccaaaaaaacaccgaaaacgctaagcagtccgactggcccgtggaatctgagaccactttcaagtcagttctgctgaacaaaacaattgaagaaagccttatttatcggaagaaatatatactatctaaagatgtaaatacagccacatgtgacaagaacccttccgcatccaaaaacgtgcagagccaccgcaaggcagagaaggaactgacatctgagttgaatagttgggacagtaaacagaagaaaatgcgagaaaagtctaaaggcaaggagttcaccaacgtcgcggagtctttaatatctcaaatcaacaaaaggtataaaaccaaagacgacatcaaatccacccggaaacttaaagaatctctgatcaactcaggtttttctaacaagcccgttgttcagctcagtaaggaaaaggtccaaaaaaaatcctatagaaagctgaaaaccacgttcgtgaatgttacgtcagaatgtccagtgaacgatgtctataactttaacctcaacggggccgacgaccccatcattaagcttgggatacaagagttccaggccacggcaaaggaagcatgcgctgatcgttcaatcaggctcgtgggaccaaggaaccacgacgagttgaaaagctccgtgaagactaaggacaagaaaattatcaccaaccatcaaaaaaaaaatctgttctccgacacggagactgagtaccgttgcgatgatagcaagacagatatttcttggctgagggagcccaagagcaagcctcaactcatagactactctaggaataagaacgtgaaaaaccacaaaagtggtaaatctcgttcatcactggaaaagggccagccaagttcaaagatgacaccctccaagaacattacaaagaagatggacaagaccatcccggagggcaggatccggctgcctagaaaggcaacaaagacgaagaaaaactacaaagacctcagcaacagtgagagcgagtgcgaacaagagttctcacacagcttcaaagaaaacatcccggtaaaggaagaaaatatacactcaaggatgaaaaccgtgaaacttcctaaaaagcaacagaaggtcttctgcgccgaaactgaaaaagagctgtcaaagcaatggaaaaatagctccctattaaaggacgctatccgggataattgcctggatttgagtccacgatcactctcaggctcacccagttcgattgaagttacaagatgtatagaaaaaatcacagagaaggattttacacaagactacgactgcatcactaaatctatatcaccgtatcccaagacaagcagcctggagtctctgaacagcaactccggggttggaggaaccatcaagtctcccaaaaacaatgaaaagaatttcctgtgtgcaagcgaatcatgcagccctatcccaagacccctcttccttcctaggcacacacccaccaagtccaatactattgtcaaccgaaagaaaatcagcagccttgtgctcacccaggaaactcagaacagcaacagctacagtgatgtttctagctactctagtgaggagcgattcatggaaatcgagagcccacatataaatgagaactatatccagagcaaacgtgaggaaagccatttggcatcctctctgtctaagtcgtccgaaggtcgtgagaaaacttggtttgatatgccctgtgatgccactcacgtttccggccccacacagcacctgtccagaaagagaatttacatagaggataatttgtctaattcaaatgaagtcgaaatggaggagaaaggcgagcgccgagctaaccttcttccaaagaagttgtgtaagatagaggacgcggaccatcacatccataaaatgagcgaatctgtgtcatctctgtcaaccaacgatttctcaatcccgtgggagacatggcaaaatgaattcgctggaatagagatgacttacgaaacttatgagcgcctgaattccgagttcaaaagacgcaataacatcagacacaaaatgctaagttactttaccacacaatcttggaaaaccgcccaacagcacctaagaaccatgaaccaccagtctcaggacagtcgcattaaaaagctggataaatttcaatttatcatcattgaggagctcgagaattttgaaaaggatagtcagtctttgaaggatcttgaaaaggagttcgtcgatttttgggagaagatattccagaaattctcagcataccaaaaatccgagcagcaacgattgcatttgctgaagactagtttggctaagtccgttttctgtaacacagacagcgaagagactgtatttactagtgagatgtgtctgatgaaagaggatatgaaggtgcttcaggatcgcttactgaaggatatgctggaggaagagcttctgaacgtgcggcgcgagctgatgagcgtgtttatgtcccatgaaaggaacgccaatgtctag

SEQ ID NO: 207644 - DNA, 4593 bp, Artificial Sequence
  Description of Artificial Sequence: Synthetic coding sequence
atgcccatccggcccgacctgcagcagctggagaagtgcatcgacgacgccctgcggaagaacgacttcaagccactcaaaactctgctgcagattgatatttgcgaagatgtgaaaattaagtgtagtaagcagttttttcataaggttgacaacctgatttgtcgcgaactgaataaggaggacattcacaacgtgtccgctatccttgtatccgtgggtagatgcgggaagaacatctccgtgctgggtcaggccggactcctcactatgatcaaacaaggcctgatccaaaaaatggtggcttggtttgagaagtccaaagatattatacagagccaggggaacagtaaagacgaggctgtgctcaatatgattgaggatctcgtggacctgcttctcgttatacatgatgtttcagatgaaggtaagaaacaggtcgttgagagctttgtccctcgcatttgcagtcttgttatcgattcgcgtgtaaacatctgcatacagcaggagatcattaaaaaaatgaatgcaatgctagacaaaatgcctcaagatgctagaaagatactgtcaaaccaggaaatgctaatcctcatgtcaagcatgggagagcggattctcgacgcaggagattatgacttacaggtcggcattgttgaggccctgtgtcggatgaccaccgagaaacaacgtcaggaactcgcccaccagtggttctcgatggactttatcgcgaaggcctttaaacgaataaaagattccgaatttgagacagattgtaggatattcctaaaccttgtgaatgggatgctgggagacaagcgaagggttttcaccttcccctgtctgtctgcattcctggacaagtatgagcttcaaatcccgagcgatgagaagttagaggagttctggatagacttcaacctgggttcacaaacattgtctttctacattgccggtgataatgacgatcaccaatgggaagcagtcactgttccagaggagaaagttcagatttattccattgaggttagggagtccaaaaagctcctaactataatcttgaagaatactgtgaaaattagtaagcgggagggcaaagaacttcttctgtactttgacgcttcgctggagatcactaacgtgacacaaaagatctttggtgcgaccaagcaccgcgaaagtatccgaaaacagggcatcagcgtggcaaaaacatctctccacattctgtttgacgcatctgggagccaaatcctcgtgcctgagtcccagataagcccagtcggagaagagctggtgagtttgaaagaaaagagcaagtcccccaaggaatttgccaagccttccaagtatattaaaaactccgataagggcaatcggaacaatagccaactcgaaaaaacaaccccaagcaagaggaaaatgtcagaggcgtcaatgatcgtgtcaggggctgaccgatatactatgaggagcccagtgctattcagcaatacaagcatccccccccgccgacggcggataaagccaccgttgcagatgacctcttccgcagaaaagcctagtgtctctcagacatctgagaaccgcgtagataatgcggccagcctgaagtctaggagcagcgagggccggcacagaagagataacatagataaacatataaagaccgcaaaatgcgtagagaatacagaaaacaagaacgtggaattccccaaccagaacttttctgaactgcaggacgttatcccggactcccaagccgccgaaaaacgggatcataccattctcccgggggtcctggataatatatgtggaaacaaaatccacagtaaatgggcttgctggacgccagttacgaacatagagctgtgcaataatcaacgcgcgtccacgagttccggcgacaccttaaaccaggatatcgtgattaacaaaaaactcacgaaacagaaatcatcttcttcaatatccgatcataattccgaaggtacaggtaaagtaaaatataaaaaagagcagactgaccatattaaaatcgataaggcggaggtggaagtgtgtaagaagcataaccagcagcagaatcacccaaagtacagtggacagaagaatacagagaacgcaaaacagagtgattggcctgtggagtccgagactacttttaagagcgtactgctgaataaaacaattgaagaatcactgatttaccgtaaaaagtatatactctctaaagatgtaaacactgccacatgtgataaaaatccctccgcgagcaagaatgtgcagtcgcacagaaaagcggaaaaagaattaaccagcgagctgaattcctgggactctaaacagaaaaagatgcgcgagaagtcaaaggggaaagagttcaccaacgttgcagagagcctgatctctcagatcaacaaaagatacaaaaccaaggacgatattaaatctacacgtaagctgaaggaatcactgataaacagcggattttccaacaaaccagtggtgcagctctccaaggagaaggtccagaagaaatcctaccgaaagctgaagaccacctttgttaatgtaacctcagagtgccctgttaatgatgtgtacaacttcaaccttaacggcgctgatgaccccatcattaaactgggtattcaggaatttcaggccaccgccaaagaggcttgcgcggaccgtagcataagattggtgggtccccgaaatcacgatgagcttaaatcgtctgtgaaaacgaaggacaaaaagatcattacaaaccatcagaagaagaatctgttttcggacaccgaaacagaatatcgctgcgacgactcaaagacagacatcagctggttgagagagcccaagtccaagccccagcttatcgactattccaggaacaaaaacgtgaaaaatcacaaatcggggaaatcgcgttcttcactggagaagggtcagccatcctctaagatgaccccctctaaaaacatcacaaagaagatggataaaacaattcccgaaggtcgtattaggctgcctcggaaggcaactaaaacaaaaaagaattacaaagacctgtcaaactccgaaagcgagtgtgaacaggagttttcacattcattcaaggaaaatatcccggtcaaagaagagaatattcactcaaggatgaagaccgtcaaattgcctaagaagcagcaaaaagtgttctgcgccgaaaccgagaaagagctctccaaacagtggaagaactcctccctgctgaaggacgccattagggacaattgtctggatttatcaccgcgaagcctgtctggcagcccctcatcaattgaggtaactaggtgtatagaaaaaatcacggagaaagattttactcaggactacgactgcataactaaatcaatctccccatatcccaagacaagtagtctggaatcactgaatagtaactctggtgttggtggaactataaaatctcccaagaacaatgaaaagaatttcctctgcgccagcgaatcttgctcgccaattcctcgcccgctgtttctcccgcgacacaccccgactaagtccaacaccattgtgaatcgaaagaaaatcagtagtttagtgctgactcaagagacacaaaattcgaatagctatagcgacgtgtcctcctacagctcagaggagaggttcatggaaattgaatcccctcacattaatgagaactatattcaatccaagagagaagagagtcacctggcctcttctctctccaaaagctcggaggggcgagagaagacttggttcgacatgccgtgcgatgccacacatgtgagcgggccaacccagcacctgtcaagaaaaagaatatatattgaggataatttatccaacagcaacgaggtcgagatggaggagaaaggtgaaaggagggctaatctcttaccgaagaaactgtgcaaaatcgaggacgctgaccatcatattcataagatgtcagaaagtgtctccagcctgagcaccaacgatttttccattccatgggagacctggcagaatgaattcgccggcatcgagatgacatatgagacctacgaaagattgaactccgagtttaaaaggagaaacaatatcagacataaaatgttgagttactttactacacagagttggaagaccgctcagcagcaccttcgtactatgaaccaccagtcccaagactcaagaatcaagaagctcgacaagtttcaattcattatcatcgaagagcttgaaaacttcgagaaagatagccaatcactcaaggacctggagaaggagtttgtggacttttgggagaagattttccagaagttcagcgcctaccaaaaatcagagcagcagcggttacacctcctgaagaccagcctggctaagagtgttttttgcaatacagattccgaagagaccgtatttacctccgagatgtgcctaatgaaagaggatatgaaggtattgcaagaccggctgctgaaggatatgctagaagaagagcttctgaacgtgagaagggagttgatgtctgtgttcatgagtcacgaacgcaacgccaatgtctag

SEQ ID NO: 207645 - DNA, 3072 bp, Artificial Sequence
  Description of Artificial Sequence: Synthetic coding sequence
atgcccatccggcccgacctgcagcagctggagaagtgcatcgacgacgctctgcgcaagaatgattttaagcctcttaaaactctgttgcaaatcgatatttgtgaggacgtaaagattaaatgtagcaagcagttcttccataaagttgataacctcatctgcagggagcttaacaaggaggatattcacaacgtgagcgccatccttgtgtccgtagggaggtgtggcaaaaatatttccgtgcttggccaggctggattactcaccatgattaagcaaggcctcatccaaaagatggtggcatggtttgagaagtctaaagatataatccagtcgcagggcaacagtaaggacgaagcagtacttaatatgatagaggacttggttgatctactcttagtgattcacgatgtctcggacgaagggaaaaagcaggttgtcgaaagtttcgtaccaagaatctgctcactggtgatcgactcccgggtcaatatctgcatccagcaggaaatcatcaaaaagatgaacgcaatgcttgacaaaatgccgcaggacgcaaggaaaatcttgagcaaccaagagatgttgatcttaatgagtagcatgggcgagagaattctggacgcgggggactatgatctccaggtgggtatcgttgaagcattgtgtcggatgactactgagaaacaacgacaggaattggctcaccagtggtttagtatggactttatcgctaaggccttcaaaagaatcaaagattctgaattcgaaactgactgtcgtattttcttgaatcttgtgaatgggatgctgggagacaagcgcagagtgttcaccttcccttgtctctcagctttcttagataagtatgaactgcagattcccagcgacgaaaaattagaggaattttggattgacttcaatctgggttcacaaaccctctctttttacatcgccggtgataacgatgatcatcaatgggaagctgttacagttcccgaggagaaggttcaaatctactcaatcgaagtgcgtgagagtaaaaagctgctaacgatcatcctcaaaaatacggtgaagatctcaaagcgagaaggcaaagaactgcttttatattttgatgccagcctcgagataacaaacgtgacacaaaaaatattcggagctaccaagcaccgggaatcaatccggaaacagggtatcagtgttgccaagacctccctgcatattctgttcgacgcctcaggctcgcagatccttgttccagaatcgcaaatctcacccgtaggcgaggagttagtttctctgaaggagaaaagtaagtcccctaaggagttcgccaagccaagcaagtacatcaagaactctgataagggcaatcgtaataattcccaactcgaaaaaactaccccttcgaagcggaagatgtccgaagcgtcaatgattgtcagtggagccgatcgctatacaatgagaagccctgttttgttcagcaacacttcaatcccccctaggaggcggcgtattaagccacctctacaaatgacatccagtgccgaaaaacccagtgtgtcacagacctctgagaacagagtggataatgcagcatctttaaaatcccgaagtagcgaagggcgacacagaagggacaacattgacaaacacatcaagactgccaaatgcgtagaaaataccgaaaataaaaatgtggagtttcccaatcaaaatttctcagagttacaggacgtaattcccgattctcaggctgcagagaagcgcgatcatacaatccttcctggagtcctcgacaatatctgcggtaacaagatccactccaagtgggcttgctggacccctgtgactaacattgagctttgtaacaaccaaagggcttcaacctcgagcggagatactctgaaccaggacatcgtcatcaataagaaattgacaaagcaaaagtcaagcagttccatcagtgaccataacagtgagggcaccggcaaggtgaagtacaagaaagaacagactgatcacatcaagattgacaaagccgaagtggaggtctgcaaaaagcacaatcagcagcagaaccacccaaaatactccggccagaagaataccgagaatgctaaacagtccgactggcccgtggagtccgaaaccacttttaaatccgtcctgctcaataagacaatcgaggagtctctaatctatcggaagaagtacatcttatccaaggacgtcaatactgccacctgcgataagaatcctagtgcatctaaaaatgtgcagtcgcaccggaaagctgagaaggagctgacaagtgaactcaactcttgggactccaaacagaaaaaaatgcgggaaaagtccaagggcaaagagttcactaatgttgctgagtctttaatcagccagataaataagagatataagactaaggacgacatcaagagtacacggaagctaaaggagtccttaatcaacagcggtttcagtaataagccggtcgtgcaactttcaaaagaaaaagttcaaaagaaaagctacaggaaactcaagacaaccttcgttaatgttacgagcgagtgtcccgtaaatgatgtctataacttcaatctaaacggcgccgacgaccccataattaaactcggaattcaggaatttcaagcgaccgcaaaggaagcatgcgcagacagatcgatacgactcgtgggccctcgaaaccacgacgagctgaagagctctgtgaagacaaaggacaagaagatcattactaatcaccagaaaaagaatttattctcagacacagaaactgagtataggtgcgatgattcgaagaccgatatctcatggctcagagagcctaagtccaagccacagctgattgactacagcaggaataaaaatgtcaagaaccacaagagtgggaaatcacggtctagcctggaaaagggacaaccgtctagcaaaatgacccctagtaaaaatatcacaaagaagatggacaaaacaatccccgagggcagaatacgcctgcctcgcaaggctaccaagaccaagaaatag

SEQ ID NO: 207646 - DNA, 711 bp, Artificial Sequence
  Description of Artificial Sequence: Synthetic coding sequence
atggtgagcagcggcaagaagtacagccggaagagcggcaagccctcagttgaggaccagttcacaagggcttacgatttcgagaccgaggacaagaaggacctgagcgggtccgaggaagacgtcattgagggtaaaacggcagtgatagaaaagcgtagaaaaaaacggagctccgccggggtggtggaagatatgggaggcgaagtacagaacatgctcgagggggtcggtgtggatatcaacaaggccctccttgcaaaacgcaaacgactggagatgtacacaaaggctagcctcaagacatcaaatcagaaaatcgagcatgtctggaaaacacagcaggatcagcgacagaagctgaaccaggagtacagccagcagtttctgacactgtttcagcagtgggacctggatatgcagaaagcggaggaacaggaggagaaaatcctgaacatgttccgccagcagcagaagattttacagcagagccgtattgttcagtcccaacgactcaaaaccataaagcagctgtacgaacagttcattaaatctatggaagagctcgaaaagaatcatgacaacctcttaaccggggcacaaaatgaattcaagaaggagatggcaatgcttcagaaaaagattatgatggagacccagcagcaagagattgccagcgtcagaaagagtttgcagagcatgctcttttag

SEQ ID NO: 207647 - DNA, 711 bp, Artificial Sequence
  Description of Artificial Sequence: Synthetic coding sequence
atggtgagcagcggcaagaagtacagccggaagagcggcaagccctccgtcgaagatcagttcacacgcgcgtacgacttcgaaacggaggacaagaaagacctgagcggcagcgaagaagatgtgattgaggggaaaaccgcagtgattgagaaacgccgaaagaagcgttccagtgcgggagtcgtggaggatatgggcggtgaggtgcaaaatatgcttgaaggcgtgggtgtcgatatcaacaaggcccttttagccaagaggaagcggctcgagatgtacacaaaggctagcctgaagacttctaaccagaaaatcgagcatgtctggaaaacccagcaggaccagcgccaaaaacttaaccaagagtattcacagcagtttctgaccttatttcagcaatgggacctcgatatgcagaaggctgaggaacaggaggagaaaatcctcaatatgtttaggcaacagcagaagatcttacagcagtctcgcatcgtgcagagccaacgcctcaaaacgatcaaacagctgtacgagcaatttatcaagtcaatggaggagcttgaaaagaatcacgataaccttctgacgggagcccagaatgagtttaagaaagagatggctatgttacagaaaaaaatcatgatggagactcagcagcaagaaatcgcatcagtgagaaagtcgctacagtctatgttgttctag

SEQ ID NO: 207648 - DNA, 711 bp, Artificial Sequence
  Description of Artificial Sequence: Synthetic coding sequence
atggtgagcagcggcaagaagtacagccggaagagcggcaagccctccgtggaggatcaattcactcgtgcttatgactttgaaaccgaggataaaaaagacctgtcagggagcgaggaggatgtgattgagggtaaaacagccgtaatcgaaaaacgcagaaaaaagagaagctccgcaggggtggtggaagatatgggcggcgaggtacaaaatatgttggagggggtgggagttgatatcaataaagctttactcgccaaaaggaagcgacttgaaatgtacacaaaggccagtttgaaaactagcaaccagaagatcgagcacgtctggaagacacaacaggaccaacgccagaagctaaaccaggaatactcacagcagtttctgactttgtttcagcagtgggatttagatatgcaaaaagccgaggagcaggaggaaaaaattttaaacatgtttaggcagcaacaaaaaatcctacagcagtctcgcatcgtgcagtcccagcgacttaagaccataaagcaactgtacgagcagttcattaaaagcatggaggagcttgaaaaaaaccacgataaccttttaaccggggcccagaatgagtttaaaaaggaaatggccatgttgcagaaaaaaataatgatggaaacgcaacagcaagagattgcgagcgtgaggaagtccctgcagtctatgcttttctag

SEQ ID NO: 207649 - DNA, 942 bp, Artificial Sequence
  Description of Artificial Sequence: Synthetic coding sequence
atgctgctgctggccgacatggacgtggtgaaccagctggtggccgggggacagttccgtgtggtgaaggaacccctggggtttgtgaaagttttacagtgggtgtttgccatctttgcctttgccacatgtggcagctactctggcgagctccagctgtctgttgattgcgcaaacaagaccgagtctgacctcagcatcgaggtagagttcgaatatccattcagactgcaccaggtctatttcgacgcaccgacatgccgggggggaaccactaaagtttttctggtgggcgactactcaagtagcgctgagttcttcgttacggtggcggtcttcgccttcctctattccatgggcgccctggctacctatatcttcttgcagaacaaatatagggagaacaacaagggcccaatgctcgactttctagcaaccgctgtgttcgctttcatgtggctggtatcaagctctgcgtgggcaaaaggcctctctgatgtgaagatggccacagatcctgagaatatcatcaaggaaatgcctgtctgccggcagacgggaaacacttgtaaagagctccgggatcctgtgacaagcggactgaataccagcgtcgtctttggatttcttaacttagtgttatgggtggggaacctgtggttcgtgttcaaggagactggatgggccgccccatttttaagggcccctccgggagctccggagaaacaaccagccccaggggatgcttacggagacgcagggtacggacaaggcccaggagggtacgggccccaggatagctacggtcctcagggagggtatcagcctgattacggccagccggccgggtccggtggatccggatatggcccacagggagattacggacaacaggggtatgggccacaaggggccccaacttcttttagtaatcagatgtag

SEQ ID NO: 207650 - DNA, 942 bp, Artificial Sequence
  Description of Artificial Sequence: Synthetic coding sequence
atgctgctgctggccgacatggacgtggtgaaccagctggtggccggcggccaattccgagtcgtgaaagaacccttgggctttgtgaaggtactgcaatgggtgtttgctatttttgctttcgcaacttgcgggtcttattccggtgagttgcagctctctgtagactgcgcgaacaaaactgaaagcgacctcagtatagaggtggagtttgagtacccgttccggttgcatcaggtctacttcgacgcgcctacttgccgcggcgggacgacgaaagtattcctggtcggcgactattctagtagcgcggaatttttcgtgactgtagccgttttcgcattcctgtacagcatgggtgccttagcaacttacatttttctacagaataagtaccgcgaaaacaataaaggtcctatgctggactttctggcaacggccgtgtttgccttcatgtggctggtttccagcagcgcttgggctaaaggcttgagcgatgtgaaaatggcgaccgaccctgagaatattatcaaggaaatgccagtttgtcggcaaaccggtaatacttgcaaggagctgcgtgatccagtgaccagtgggttgaacacatccgtcgttttcggctttttaaatctggtactgtgggtcggaaatctgtggtttgttttcaaagaaaccggctgggcagctcccttcctgcgcgccccccctggcgcccccgaaaaacaacccgcaccgggcgacgcatacggggacgcaggctacggtcaagggcccgggggctatgggccccaggatagttacggccctcaaggggggtatcagcccgactatggccagccagcaggatccggcgggtccggctacgggccccagggagactatggacagcagggatacggtccccagggcgccccgacctccttttccaaccaaatgtag

SEQ ID NO: 207651 - DNA, 588 bp, Artificial Sequence
  Description of Artificial Sequence: Synthetic coding sequence
atgggcgccctggccacctacatcttcctgcagaacaagtaccgggagaataataaaggccctatgctggattttctggccaccgccgtgttcgcctttatgtggctggtgtccagcagcgcgtgggcaaaggggttaagcgacgttaagatggccaccgaccccgaaaacatcattaaggaaatgcccgtatgtagacagaccggcaatacctgcaaggagctgagagaccctgtcacctccgggctgaatacttcggtcgtcttcggattcctaaacctcgtgctttgggtaggtaatctctggttcgtatttaaggagactggatgggcagcccccttcctgagggctccaccaggcgcgcccgagaaacagcccgccccaggagatgcctacggtgatgccggctatggtcaggggcccggtggctatggcccccaggacagttacggcccacagggtggctatcagcctgactatggacagccagctggctctggcggctctggatacggcccacaaggcgactacggacagcagggctacggaccccagggagcaccaacatcttttagtaatcagatgtag

SEQ ID NO: 207652 - DNA, 2712 bp, Artificial Sequence
  Description of Artificial Sequence: Synthetic coding sequence
atggagggctacagcgaggaggccagcctgctgcggcacctggagaaagttgcctcggaggaagaagaagtgccgttagttgtgtatttgaaagaaaacgcggcccttctcacagccaatggccttcacttgagccagaaccgagaggctcagcaatctagccctgccccccccccagccgaagttcactcacctgccgctgacgtcaaccagaatctggcatctccgagcgctacattaacgacacctacaagcaactcctcccacaaccctcccgcaacagatgtgaatcagaacccacctgccaccgtggtgccgcaaagtttgccactcagtagcatccagcagaactcttccgaggcccagcttccatcaaacgggacagggcccgctagtaagccgtcaactctttgtgcggatggccagccgcaggcgcccgctgaagaggtccggtgcagtaccctgttgatagacaaagtgtccactcctgctaccacaacttctactttttctcgcgaagcgacccttataccctcttcacggccccctgcttcagattttatgagttcctctctgctgattgacatacaaccaaacacgttagtggtgtccgccgatcaagagatgtcagggagagccgcggccaccactcccacaaaggtgtatagcgaggttcactttaccctggcgaaaccgccgtcagtagtgaatcgaaccgctagacccttcggaattcaggcacccgggggcacgtcccaaatggaaaggtctcccatgctggaacggagacacttcggggagaaagctccagccccccagccaccttccctgcctgaccggagcccgcggccccagcggcatatcatgtcaaggtcgccaatggtcgaacgtcgcatgatggggcagcggagcccagctagtgaacgtaggccactgggcaattttactgcacccccaacatacacagagaccttgtccactgctcccctagccagctgggtgcggtccccaccgtcttatagcgtgttgtatcctagctccgatccaaagtcatcccatctcaaaggccaggccgtgcctgcgtctaaaaccggtattttagaagagtcaatggcccgccgcggaagcaggaagtccatgtttacgtttgtagaaaaacctaaagttactcccaacccggatctgctagatctggtacagaccgctgacgaaaagcggaggcaaagggaccagggcgaagtcggggtcgaagaggagccgtttgccctgggtgccgaggcatccaactttcagcaggagccggcaccccgcgaccgagctagtcctgctgcagcggaggaggtggtccccgagtgggcgagttgtctgaaatctccccggatccaggctaaacccaaaccaaagcctaaccagaatttatccgaagcaagtggcaagggagctgagctgtacgctcgacgccagagcagaatggagaaatacgtaatagagagttcttctcatacgcctgagttggcccgctgcccttcccctaccatgagcctgcctagtagctggaaataccctacgaatgcccccggcgcctttcgagtggcatccaggagtcccgcccgtacgcctccagcctccctgtatcatggctacctgcccgaaaacggcgtgctgcgaccagagccaacaaagcaaccaccataccagctccggccctctcttttcgtgctgagcccgattaaagagcctgccaaagtgagcccacgggccgcatctccagctaaacccagcagtctcgacctagtgcccaacctgcccaagggcgccctccccccgagtcccgccctcccgcggccgagcaggagcagccccggactgtacacatcccccggccaggattcactccaacctacagcagtgtccccaccctacgggggtgacatttctcctgtgagcccttcaagggcctggtccccacgggccaagcaagccccccgcccatctttttcaactagaaacgccggtatagaggcacaggacagacgggaatcccttcctacttcaccaccttggactccaggcgctagtaggccaccctcaagtctggatggctgggtaagtcctggaccctgggagccaggccgcggttcgtctatgtcttctcctcctccattgcccccacctcctccaatgagtccctcttggtccgagcggagcgtgagtccgctcaggccagagaccgaggcacggccaccctcacgccagctgcaggccctgctcgctaggaatattataaatgccgcccggaggaaaagcgcatctccgcgtagcgcgggcgctgaaaatcctcggcccttcagtcctcctagagcaccaccacccccacccccccctccacccccacccccacgcatgcgaagcccccaaccggcgcgccctgggtccgctgccgtccctggggcagctttcgccccaattcccaggtcacccctccctgcaggtcccagctcatgcacatcaccgcgatctcctttgcctgctccccctcggcctttcctgtaccgacgttccccaacggacagtgatgtgtctttggattccgaagattctggggctaagagccctggaattttagggtacaatatctgccctagggggtggaacgggagcctccggctgaaaagaggctcactcccagccgaagcatcttgtaccacttag

SEQ ID NO: 207653 - DNA, 2790 bp, Artificial Sequence
  Description of Artificial Sequence: Synthetic coding sequence
atgctgggcccccacctgccccccccccccctggcccccagcgagggtcgccccaccccgtgtgcctttcagataccggatggctcctatcgttgtttggctcttgaggctgaagaatctagcggagaggagggcctgcagggtgaggtgggcccgacggatctggaggaggatgagggtgttagtagatcaggagacgattctgcctgcagggtgacccaaggcacgcctcagctgcctaaggcactcggcattcaaccccccagttgttcccgggaggaacagggcgcatcacagcatgacgaccgggcatcacaggactgggatgtggtcaaagcgggccaaatgatgacagcttctcctagcccaggaccagggcccagggtggcccagaaacccgccctcggccggagcacaagcctgaccgaaaaggacctgaaagaggccaaagccaggtcacagcaaattgccgcccagctcacaacaccaccatcgtcaaattccagaggggtgcagctgtttaaccgcagacggcagagagtgaacgagtttaccctcgagtcccatgggcagcgtggccagaaaccaagccaggagagcctgcgggtgctaccttctagcctgcctgggcacgcgcccggcctgtccctgtcaagcaccagcctgccagaaccgggcccaccccgacatccatcaccacaaagtccggacaggggtgtcccaggccactcgatggagggatactccgaggaagctagtttactccgccatttagaaaaagttgcaagcgaagaggaggaggtcccactggtagtctacctgaaagagaacgccgccctgcttactgccaacggcttgcacttaagccaaaacagagaagcacagcagagcagtccagcccctcccccagctgaggttcacagtcctgctgcggacgtgaatcagaacctggcctcgccgtccgcaacactgacaacccccacctctaattcttctcacaatccacccgctactgacgttaatcagaacccgcctgctactgtggtgccacaatcgctcccgctttcttccatccaacagaattcttccgaggcccagttaccgtccaatggcactggaccagccagcaagcccagtaccttatgcgccgacggccagccccaagcccctgccgaggaagtcagatgttccacgctgttaattgataaagtcagcactccagcgacaaccacatcaacattcagtagggaggccacattgatcccctcttccaggccaccggcttccgattttatgtcctcttcgctgctgattgatatccagccgaataccctggttgtgtcagctgatcaggagatgtcgggccgggccgccgcaactacaccaactaaggtgtactccgaggtccacttcaccctggccaaacccccctctgtggtgaatcggaccgcccgcccctttggcatacaagcacctgggggaacgtctcaaatggagaggtcaccaatgctggagcgcaggcactttggtgagaaggctcccgccccgcaaccacccagtctgcctgaccgcagcccacggcctcagcggcatatcatgtcacgaagtccaatggttgaaaggaggatgatgggccagaggagtccagcgtccgagcgcagaccactgggaaacttcaccgctccaccaacctacaccgagacactgtccactgccccccttgcctcatgggttcgaagcccaccctcttactccgtgctctacccctcctcggaccccaagagttcccacctgaaagggcaagctgtgcccgccagtaaaaccggcatcctggaggaaagcatggctaggagaggcagtcgaaagtcaatgttcacattcgtcgagaagcccaaagtgacccccaatcccgacctactggacctggtccagacagccgacgagaaacggcgacagcgggatcagggggaggtaggtgtggaagaggagccattcgccttaggcgctgaagcttctaatttccagcaagaacctgcacctcgagacagggcttcccccgccgctgcagaggaggtggtcccagagtgggcatcatgcctgaagagtcccaggattcaagcgaagcctaagcctaaacccaatcagaatctgtctgaagcaagtggtaaaggagcggaattgtacgcacgaaggcaaagccgcatggaaaagtatgttatagagtctagtagccacacccctgagctggctcggtgtccctcccccaccatgtccttgccgagtagctggaagtatcctacaaacgcccccggggcatttcgtgtggcaagccgttcaccagcccgcactccacctgcctccctgtatcacggatatttgcccgagaacggggtactgagacccgaacccacaaagcagccaccataccagctgcggccttccctgtttgtgttgtctcctatcaaagaaccggctaaggtgtctccaagagctgcctccccagcaaaacccagcagcctggacctggtgcctaatctgccaaaaggcgccctgcccccgagccccgctctgcccagaccttcccggtcctcccccggtctctacacatctcccggacaggattccctccagccaaccgcggtatccccgccttacggcggcgacatatcccccgtttccccctcccgagcctggtcaccacgcgcaaagcaggctcccagacccagcttctcaacaaggaacgcagggatcgaagctcaggtctggaagccatccttttgtttcaagtag

SEQ ID NO: 207654 - DNA, 2058 bp, Artificial Sequence
  Description of Artificial Sequence: Synthetic coding sequence
atggagggctacagcgaggaggccagcctgctgcggcacctggagaaagtggcttcagaggaggaggaggtgcctctggtagtctatctaaaagaaaacgctgccctcctgaccgccaatggcttgcatctttcgcaaaatcgtgaggcccagcaatcatccccagcacccccacccgccgaagtccatagccctgccgccgacgtgaaccagaacctcgctagccctagcgctactttgaccactcctaccagtaatagctctcacaatccaccagctacagatgtgaaccagaatcctccagctacagtcgtcccacagtcacttcctcttagttcgatccaacaaaattcttctgaagcacaactgccgtctaacggtaccgggcctgcttccaaaccctccacgttatgcgcagacgggcaaccccaggcccccgctgaagaggtacgctgtagtacgttgttgattgataaagtcagtaccccggctactaccactagcacgttcagccgtgaagcaacactgataccatcaagtaggccccccgcaagtgactttatgtccagttcactgctcattgacatccagcctaatacgctggtcgtcagcgcagatcaggagatgagtggaagagccgcagccaccacaccgacaaaagtgtattccgaggtccacttcaccctggccaaacccccaagcgtggtgaaccgcaccgcgaggccatttggaattcaggctcccggggggaccagccagatggagcgcagcccgatgctggagagacgacacttcggcgaaaaagccccggcaccacagcctcccagcttgcccgataggtctccaaggccgcaaagacacataatgtcgaggagccccatggtcgagaggcgtatgatgggtcagagaagccccgcctctgagcggcgcccccttggaaattttacggcgccaccgacctataccgaaaccctcagcaccgcgcccctggcttcctgggtcagaagtcccccctcgtactctgtattatatccttcatcagatccaaagtcatcacacttaaagggtcaggccgtccctgcaagtaaaaccggcattctggaggaaagtatggcacggaggggcagccggaagagtatgtttacctttgtagagaaacccaaggtgaccccgaaccccgacctgttggacctggtgcagacggctgacgaaaagcggaggcagagagaccagggcgaggtcggcgtggaagaagaaccatttgccctcggcgccgaggctagcaatttccagcaggaacccgccccccgcgacagagcttctccggccgccgccgaagaagttgtgccagagtgggccagctgcctcaagagcccccgcattcaggctaaacccaagcccaaaccaaatcaaaacctgagcgaggcctccggcaagggggctgaactctatgcccgtaggcagtcacggatggagaaatatgtgatagaatcgagctcccacacaccggagcttgcccgctgcccttctcctaccatgtcactcccttcttcgtggaaatacccaacaaacgcccccggtgcatttcgggtcgcttcgcgatcccccgctcggactcccccggccagtctctaccatgggtatctcccggagaacggcgtccttaggccggagccgaccaagcaacccccctaccaactgagaccttctcttttcgtactttctcctattaaagaaccggctaaggtctctccacgggcggcttcgccggccaaaccttcatcgctggatctggtccctaatctccctaagggggcgcttcctcccagccccgccttgcctcggcccagcaggagtagtccaggtttgtacacctctcctgggcaagattctctgcagcccacagccgtgtctcccccttacggcggagatatttctcccgtttctccctctagagcctggagccctcgcgccaagcaagctccaaggccttccttctcaacaaggaatgccggcatagaggcacaggtctggaaaccttccttttgttttaagtag

SEQ ID NO: 207655 - DNA, 2790 bp, Artificial Sequence
  Description of Artificial Sequence: Synthetic coding sequence
atgctgggcccccacctgccccccccccccctggcccccagcgagggaagaccaacgccttgtgcattccagatcccagacggcagctacaggtgcttggccctggaggccgaagaatcgtccggggaggagggtctgcagggcgaagtcggccctaccgacctggaagaggatgagggcgtttctcggtcaggcgatgactccgcatgtcgtgttactcagggaaccccccagctgcccaaggctctcgggattcagcccccttcttgctcaagagaagagcaaggtgcttctcagcacgatgaccgggcctcccaggactgggatgttgtgaaggcaggtcagatgatgaccgcttctccctcaccagggcccgggcctagggtcgcacagaagcccgcgctgggccgctccacatccctgactgaaaaggatcttaaagaagcgaaggcaaggtcccagcaaattgccgctcagttgacaactccaccgagctcgaattctagaggcgtccagttatttaatcgtcgacggcagcgggtcaacgagtttaccctcgaatcccacggtcagcgtggacagaaaccttctcaggagagcctgcgcgtgctgccaagctcccttcctggccacgctcccggtctgagcctctcaagcaccagcctaccagagccagggccaccccgccacccatccccacaatccccagacaggggcgttccaggccacagcatggagggctattctgaggaagccagtctcctgagacacctcgaaaaggtggcttctgaagaggaggaagtgccactggttgtgtacttgaaggagaatgctgcccttctgacagccaacggactgcacctttcccagaatagggaggcacagcagtcctctccagcccctccaccagcagaagtgcattcccctgcagcagacgtgaatcagaatttggcatctccatccgcgacattgactactcctacttcaaattcttcccacaatccccctgccaccgatgtaaatcaaaacccacccgctacagttgtcccccagtccctgcctctcagtagtatccagcagaactcatcagaggcccagctccccagcaacgggacagggcccgccagcaagccctcaacgctttgcgccgatgggcaaccacaggccccggccgaagaggtgaggtgttcgacacttttgatcgacaaagtgtccacccccgccacaaccacttccaccttcagccgagaggctaccctcatcccatcatctagaccgccagcgagcgacttcatgtcctcctcactgttgatcgacattcagcccaacactctggtcgtatcagccgaccaagaaatgagtggacgagccgccgccaccacacctacaaaggtgtacagcgaagttcattttacgctggctaagcccccgagtgtcgtcaaccgaacggccagaccttttgggatccaggcccccggggggacatcacagatggaacgcagtcccatgctggagagaagacactttggggagaaggcgcctgctcctcagccaccatcgctgccggaccgctctccacgcccacagcgacacattatgtcgagaagtccaatggttgaacgccgcatgatggggcagagatcccccgcgagtgagcgacgacctcttggcaattttaccgccccgccgacgtatacggaaacactgagcacagccccgctcgccagctgggtccgatcccccccttcatactcagtgttgtatccgtcctctgatccgaaatcaagccacctgaaggggcaggccgttcccgcttccaagacaggaatcctcgaagagtccatggcgaggaggggctcacgcaagtcaatgtttacatttgtagagaagcccaaggtgacccctaaccctgatctccttgatctcgtacagacagcagatgaaaagagacgccaacgggaccaaggggaggttggagtagaggaagaaccatttgcactcggggccgaggcatcaaactttcagcaggagcctgccccaagggatagagccagtcctgcagccgcagaagaggtggtgcccgaatgggcctcgtgcctcaaaagtccgaggatacaggccaagcctaaacctaagcccaaccagaatctgtccgaagcaagcggcaaaggcgccgaattgtacgcccggcggcaatccaggatggaaaagtatgtgatcgaatcttcctcacatacccccgagctcgcccgatgcccatccccaacgatgtcgctcccctcgtcgtggaaatacccaaccaatgcccctggcgcctttcgagtcgcctcccgtagccctgcccggactcctccggcgtcactctaccacggctatctcccagagaatggtgtactcagaccagaacccactaagcaacctccctaccagcttcgaccctctctgtttgtgttgtcaccaattaaggagcctgcaaaggtgagcccccgcgccgcatcacccgcaaagccttctagtctagacttggtgcctaatctacctaagggtgcccttcctcccagccctgcactaccacggccctcccggtcatcccccgggctgtatacttctcccggacaggattcactacagcctaccgccgtctcaccaccttacggcggagacatctcccctgtgtcaccctcccgcgcttggtctcctcgtgccaagcaagcgccccggccctccttctccacccgtaacgcgggaattgaggctcaagtgtggaaacctagcttctgcttcaagtag

SEQ ID NO: 207656 - DNA, 636 bp, Artificial Sequence
  Description of Artificial Sequence: Synthetic coding sequence
atggacaacctgagcagcgaggagatccagcagcgggcccaccagattaccgacgagagcttagagtcgacgagacggattctgggactcgctatcgagtcccaagacgccggcatcaagaccatcaccatgttggacgagcagaaggaacagttaaaccgaatagaggaaggactggaccagatcaacaaggacatgagagagacagaaaagaccctgacagagcttaataaatgctgtggtttgtgcgtgtgcccctgtaaccggaccaagaactttgagtcaggcaaggcctacaagacgacatggggcgacggcggcgagaacagcccctgtaacgtcgtgtcaaaacagcccgggccagtgactaacggccagctacagcaacccactacaggagcagctagcggcggttatatcaagcggatcaccaacgatgccagagaggacgagatggaagaaaacctcactcaggtaggctctattctcggcaacctgaaagacatggcccttaacatcggaaatgagatcgatgcacagaatccccagatcaagcgcattaccgacaaggccgacaccaacagagatagaatcgatatcgccaacgctcgggctaagaagctgattgactcctag

SEQ ID NO: 207657 - DNA, 477 bp, Artificial Sequence
  Description of Artificial Sequence: Synthetic coding sequence
atggacaacctgagcagcgaggagatccagcagcgggcccaccagatcactgacgagagtctggagtctaccagaagaatattaggcctggctattgagagccaggatgcagggatcaaaacaattactatgttagacgagcagaaggagcagctcaacaggatagaggaggggttagaccagattaataaagatatgcgtgaaactgaaaaaaccctgacagagctgaataagtgctgcggcctctgcgtgtgcccatgtaacagcattactaatgatgcacgagaggacgaaatggaagaaaatctaactcaagtggggtcaatcctgggaaatcttaaagacatggcgctcaacatcggtaatgagatcgatgcccagaatccacagattaaacggattactgataaggctgacacaaatagggacaggattgacattgctaatgcccgggccaaaaagcttattgactcctag

SEQ ID NO: 207658 - DNA, 477 bp, Artificial Sequence
  Description of Artificial Sequence: Synthetic coding sequence
atggacaacctgagcagcgaggagatccagcagcgggcccaccagataactgacgagtctctcgagagcacaagacggatcctgggcctcgccatcgagtctcaggacgccggaattaaaacaattaccatgctagacgagcagaaagagcaactcaacagaattgaagaggggctggatcagatcaacaaggatatgcgggaaaccgaaaaaacccttactgagctcaacaaatgttgcggactttgtgtgtgtccatgtaactcaatcaccaatgatgctcgggaggacgaaatggaggaaaatctaacacaggtcggttcgatcctcggcaacctgaaggatatggctcttaatataggcaacgaaatcgacgctcagaacccccaaatcaagagaattactgacaaggctgacaccaatcgcgatcggattgacattgcgaacgctagggctaagaaactgattgacagctag

SEQ ID NO: 207659 - DNA, 621 bp, Artificial Sequence
  Description of Artificial Sequence: Synthetic coding sequence
atggccgaggacgccgacatgcggaacgagctggaggagatgcagcgccgggccgatcagctcgctgacgagtccctcgagtctacccgtagaatgctgcaactcgtagaagaaagtaaagacgctggcatcaggaccctggtgatgttagatgagcagggtgagcaactcgaacgcattgaggaaggcatggatcaaatcaataaggacatgaaggaagcagaaaaaaatctgaccgaccttgggaagttctgcgggctttgtgtctgtccttgcaacaagttaaaatcctccgacgcatataaaaaggcatggggaaacaatcaggatggagtggtcgcatctcagcccgctcgcgtcgtagacgaaagagaacagatggcaatctctggtggctttattcggcgagtgacaaatgatgccagggaaaacgaaatggatgaaaatctggaacaagtttctggtattattgggaatttgcggcacatggctctagatatgggtaacgagattgacacccagaacagacagattgatcgtataatggagaaggccgattctaacaaaacacggatagatgaggctaaccagagggccactaaaatgcttggctcgggatag

SEQ ID NO: 207660 - DNA, 621 bp, Artificial Sequence
  Description of Artificial Sequence: Synthetic coding sequence
atggccgaggacgccgacatgcggaacgagctggaggagatgcagaggagagctgaccagctggccgatgagagtctcgaaagcactaggcggatgctgcagctagtggaggagtctaaggacgccggaatacgtaccctggtgatgctggacgaacaaggagaacagctggatcgggtagaggaaggtatgaaccacatcaatcaggacatgaaggaagccgagaagaacctgaaagatctcggaaagtgctgcggtttatttatctgcccttgcaataagctgaaaagttccgacgcctacaagaaggcgtgggggaacaatcaagatggtgtggtggcatcacagccagcccgggttgtagacgaacgggaacagatggccatttcgggcggttttatacgcagggtcaccaatgatgcaagggagaacgagatggatgaaaatcttgaacaggtgagcgggattatagggaaccttagacacatggccctggacatggggaacgaaatagatacccaaaacagacagattgataggatcatggagaaagctgactcaaataagacccggatcgacgaagcaaaccaaagagccaccaagatgctcgggtctggctag

SEQ ID NO: 207661 - DNA, 282 bp, Artificial Sequence
  Description of Artificial Sequence: Synthetic coding sequence
atggccgaggacgccgacatgcggaacgagctggaggagatgcagcgccgggctgatcagctcgccgacgagtcgttggaaagcacacgccggatgctgcagttggtggaggagtctaaggatgcaggaatacgaactcttgtaatgctggatgaacagggggagcaactcgagcggatcgaagagggaatggaccagatcaacaaggacatgaaagaagcggaaaaaaacctcacagatctcggtaaattctgtggcctatgtgtgtgcccttgtaactag

SEQ ID NO: 207662 - DNA, 1500 bp, Artificial Sequence
  Description of Artificial Sequence: Synthetic coding sequence
atgaagcacagcctgaacgccctgctgatcttcctgatcatcaccagtgcctggggaggaagtaagggtccactggaccagttagagaaggggggagagacagctcagagcgctgaccctcagtgggagcagttaaacaacaagaacctgtcaatgcctctcctccctgccgattttcacaaagaaaatacagtcactaacgactggatccctgagggcgaagaagacgatgactatcttgacttggaaaagatcttctctgaggacgatgattacatcgacattgttgactccctgtctgtttctccaaccgactctgatgtctcggccggaaatattttgcagctctttcatggaaagagtcggattcaaagattaaatatcctcaacgcaaagttcgcattcaatctgtaccgggtgctgaaggatcaggtgaatacatttgataacatttttatcgctccagtcgggatttcgaccgccatgggaatgattagtctgggcctaaagggggagacacacgagcaagtgcactcgatcctgcattttaaggacttcgtcaatgctagtagtaaatacgaaatcacaactattcataatttgttccggaaactgacgcataggctgttccgcagaaactttggatacacactgagatccgttaacgacctttacatccaaaaacagttccctatcctcttggattttaaaactaaggtgcgcgagtattattttgccgaagcacaaattgccgacttcagcgacccagcgttcatcagtaaaacaaataaccacatcatgaaacttaccaaggggctgattaaagatgccctggaaaatatcgaccccgccacccagatgatgatattgaactgcatctacttcaagggttcttgggtgaacaaatttcctgttgaaatgacccacaaccacaattttagactgaatgagcgagaagtggttaaagtgtctatgatgcagactaagggtaactttctcgcggctaatgatcaggaactggactgtgacatcctgcagttggaatacgtaggtggcatcagcatgttgattgtagtgccccacaagatgagcgggatgaagactcttgaagcccagcttaccccacgggtggtggaaaggtggcagaagtctatgacaaatcggacgcgagaagtgttattaccaaaatttaagctggaaaagaactataacctggtcgaatctcttaagttgatgggtataaggatgctgtttgataagaatgggaatatggccgggatctccgaccagcggatcgccatagaccttttcaaacaccaagggaccattactgtgaatgaggaagggacccaggcgacaaccgtcactacagtgggattcatgccactaagtacccaggtgcgattcactgtcgatcgccctttcctgttcctaatctacgagcacagaaccagttgtcttctgttcatgggccgggtcgccaacccctcccggtcgtag

SEQ ID NO: 207663 - DNA, 1269 bp, Artificial Sequence
  Description of Artificial Sequence: Synthetic coding sequence
atggtgagcgagagccaccacgaggccctggccgccccccccgtgaccacagtggccacagttttaccgtccaatgctactgagccggcgagccccggtgagggtaaggaggacgccttcagcaaactgaaggaaaagttcatgaatgagcttcacaagatcccacttcccccttgggccttgatcgccattgctatcgtggccgttctcttagtactgacctgttgcttctgcatctgcaaaaagtgtctgtttaagaaaaaaaacaaaaagaagggtaaggagaagggagggaaaaacgctataaacatgaaagacgtgaaagatctgggaaaaactatgaaagaccaagcgctaaaggatgatgatgcagagacagggctcaccgacggggaagagaaagaagagcctaaggaggaggagaagctcggcaagttgcagtattccctggactacgactttcagaacaaccaacttctggtagggattatccaagccgctgagctgcccgcactcgacatgggcggcactagcgatccttatgttaaggtgttcttactcccggacaaaaaaaagaaatttgagactaaggttcaccggaagacactgaatccagtttttaatgaacagtttacctttaaggtgccttacagtgagttgggaggcaagaccctggtgatggctgtttatgatttcgataggttttcaaagcatgatatcatcggcgaattcaaggtgcccatgaacaccgtggattttggacatgtaacagaagagtggcgtgaccttcagtccgctgagaaggaagagcaagagaaactgggtgacatatgcttttctctgaggtacgttcccaccgccggtaagctgaccgtggtaattctagaggcaaaaaatctgaagaaaatggatgtgggtggtctatctgatccatatgtgaaaatccaccttatgcagaatggcaagaggctgaagaagaagaagacaaccattaagaaaaatacgcttaacccttactataacgagtccttctcatttgaggttcccttcgagcagatccaaaaagtacaggtggtggtaacagtgttggattatgacaaaatcgggaagaacgacgcaatcggaaaggtttttgtcggatataacagcactggggccgaactgagacattggagcgacatgctggctaacccacgccggcccatcgctcagtggcacactctccaggttgaagaggaggtagatgccatgctagcggtcaagaagtag

SEQ ID NO: 207664 - DNA, 1269 bp, Artificial Sequence
  Description of Artificial Sequence: Synthetic coding sequence
atggtgagcgagagccaccacgaggccctggccgccccccccgtgaccactgtggctaccgttctgcctagtaacgcgacagaaccggctagccctggcgaaggcaaggaagatgccttcagtaaactgaaagagaaattcatgaatgaactccataagattccactgcctccttgggccctcatagctatcgccatcgtggccgtcttgctggtgctcacttgctgcttctgtatttgcaagaagtgtctcttcaaaaaaaagaacaaaaagaaagggaaggagaaaggagggaagaatgctataaatatgaaggacgttaaagacctgggcaagaccatgaaagatcaggctcttaaggatgatgatgcagaaaccgggctgaccgacggggaagagaaggaagaaccaaaagaggaagaaaaactgggaaaactccagtacagcctagactacgattttcagaacaatcaactgttagtaggaattatacaagcagctgagcttcctgctctcgacatgggcggcacttccgatccctacgtcaaggtgttcctgctgcctgacaagaaaaaaaagtttgaaacaaaggtgcataggaagactcttaaccccgtgtttaacgaacagttcacttttaaggttccatactcagagctgggcgggaagaccctggtgatggcagtctacgattttgacaggttttccaagcacgacatcatcggcgaattcaaggtgcctatgaatacagttgacttcgggcacgttactgaagaatggcgcgacctgcagtccgcggagaaggaggagcaggagaagctgggggacatctgcttttcactaaggtacgtccccacagccggaaagcttacagtcgtcatattggaggcaaaaaatctgaaaaagatggacgtaggcggactgagtgatccttatgtcaagattcacctgatgcaaaacggcaagagactgaagaagaaaaaaacaaccatcaaaaagaatacgctcaacccctattacaatgaatccttcagctttgaagtaccgttcgaacagattcaaaaggtccaggtggtggtgacagtgcttgattacgacaaaatcggtaagaacgatgctatcggcaaggtgtttgttgggtacaattccaccggtgccgagctccgacactggagtgatatgttggcaaatcctagacgtccaatagcccagtggcacactctccaagtggaagaggaagtggacgctatgttagccgtgaaaaagtag

SEQ ID NO: 207665 - DNA, 549 bp, Artificial Sequence
  Description of Artificial Sequence: Synthetic coding sequence
atggtgagcgagagccaccacgaggccctggccgccccccccgtgacaaccgtggccactgtccttccctctaacgctacagaacccgcaagtcccggcgaggggaaggaggatgcctttagtaagttgaaggagaagtttatgaacgagctgcataagattcctctcccaccttgggccctgattgccatcgcgatcgtggcagtgttactggttctgacatgttgtttctgtatatgcaagaaatgcctgttcaagaagaagaataagaagaagggtaaggagaaagggggcaaaaatgcgatcaatatgaaagacgtgaaagatctgggcaaaacgatgaaggatcaagctctcaaagacgacgacgctgaaaccggcctgactgacggggaggagaaggaggagcctaaagaagaggagaagctaggaaaactgcagtactctcttgactacgattttcaaaataaccagctcctggtgggcatcatccaggccgctgagctgccggcgttggacatggggggcacttccgacccgtacgtttag

SEQ ID NO: 207666 - DNA, 177 bp, Artificial Sequence
  Description of Artificial Sequence: Synthetic coding sequence
atggtgagcgagagccaccacgaggccctggccgccccccccgtgaccactgtggcaacggtcctgcctagcaatgccaccgaacccgcatcacccggtgagggaaaggaagacgccttttctaagctcaaagagaaattcatgaacgagttgcataagatccctttgcccccctag

SEQ ID NO: 207667 - DNA, 219 bp, Artificial Sequence
  Description of Artificial Sequence: Synthetic coding sequence
atggtgagcgagagccaccacgaggccctggccgccccccccgtgacaaccgttgctactgtgctgccgtccaatgcaactgagcctgcctcgcccggagagggcaaagaggacgcattctccaagctgaaggagaagttcatgaatgaactgcacaagatccctctgccaccctgggccctcattgctatagcaattgtcgctgtgctcctggtgtag

SEQ ID NO: 207668 - DNA, 222 bp, Artificial Sequence
  Description of Artificial Sequence: Synthetic coding sequence
atggtgagcgagagccaccacgaggccctggccgccccccccgtgaccacggttgctacagtgcttccttccaatgctaccgaacccgcttcaccaggggagggcaaagaggacgctttctctaaacttaaagaaaaattcatgaatgagctacacaagattcctctgccaccgtgggctctgatcgctatcgcaatcgtcgcggtactgctggttctctag

SEQ ID NO: 207669 - DNA, 285 bp, Artificial Sequence
  Description of Artificial Sequence: Synthetic coding sequence
atggtgagcgagagccaccacgaggccctggccgccccccccgtgaccactgtggccacagttctaccgtctaatgcaactgaaccggcaagcccgggggaaggaaaggaggatgccttcagcaagctgaaagagaagttcatgaacgaactgcacaaaatccccctgcccccctgggcactcattgctattgctatcgtagctgtgctgttggtcctcacttgttgtttttgcatttgcaagaagtgcctgttcaaaaaaaaaaacaagaagaaaggaaagtag

SEQ ID NO: 207670 - DNA, 1269 bp, Artificial Sequence
  Description of Artificial Sequence: Synthetic coding sequence
atggtgagcgagagccaccacgaggccctggccgccccccccgtgaccacagtcgccaccgtactgccctctaacgcgacagagccagcaagcccgggcgaaggtaaagaagatgccttctcaaagctgaaggagaagtttatgaatgagctccataagattccgcttcctccctgggcgttaatagcaatagcgattgtggccgtcctcttggttctgacatgctgtttttgcatttgtaagaaatgcctatttaagaaaaaaaacaaaaaaaaaggaaaggagaagggtggcaaaaacgccattaacatgaaggacgtgaaggacctcggcaagacgatgaaggaccaagccctgaaagacgatgatgccgagaccgggcttaccgatggcgaggagaaggaagaaccaaaggaggaggaaaagctaggaaaattgcaatattcgctcgactacgacttccagaataaccagctactggttgggatcattcaggctgcagagctgccagctctggatatgggcggcacctccgatccttatgtcaaagtttttctcttacccgacaagaaaaaaaagttcgaaaccaaggtacatagaaagaccctgaatccagtgttcaacgaacagttcacatttaaggttccctactccgaactcggcggaaagactctggtgatggcagtttacgatttcgatcgatttagcaagcacgatattattggtgagttcaaagttcctatgaatacagttgattttggtcacgtcacggaggagtggagagacctacagtcagctgaaaaggaggaacaagagaaattgggcgacatctgcttcagtctgaggtacgtccccaccgccgggaagctaaccgtcgtgattctggaggcaaaaaacttgaaaaagatggacgttgggggcttgagcgatccatatgtgaaaatccatctcatgcaaaacggtaaaaggctgaaaaaaaagaagacgaccattaagaaaaatacactaaacccctactacaacgaaagcttttcttttgaggtgcctttcgaacagattcagaaggtgcaagtggtggtgaccgtgttagactacgataagataggcaaaaatgatgcaatcggcaaggtctttgttggctataacagtactggggccgaactgcgtcactggtcggacatgctggctaatccaagaagaccgattgcccagtggcacacattgcaggtcgaagaggaggttgacgccatgcttgctgtgaagaagtag

SEQ ID NO: 207671 - DNA, 1773 bp, Artificial Sequence
  Description of Artificial Sequence: Synthetic coding sequence
atgagcggcgactacgaggacgacctgtgccggcgggccctgatcctcgtgtccgacctctgcgctagggttagagacgccgacacaaacgatcgctgccaggaatttaatgatcgcatcagggggtatcccaggggccctgacgccgatatttctgtctcactgctcagtgtgattgtgaccttctgtggaatcgttctactgggtgtcagcctgtttgtcagttggaagctctgttgggtcccatggagagacaaggggggaagcgcagtcggaggaggcccactgagaaaggatttgggtcccggcgtcggacttgcagggttggtgggcgggggaggccaccacttggctgccgggctaggcgggcaccctctccttggaggaccacatcaccacgctcacgctgctcatcaccccccatttgctgaattactagagcctggtagtcttggagggagcgacacaccagaacctagttatctggacatggactcataccccgaagccgctgcagcggcagttgcggccggcgtgaaaccgagccagacatctccggaactgccctctgaaggaggcgccgggtctggcctgctgcttctgccaccctctggcggcggcctgccttctgctcagtctcaccaacaggtcacaagcttagctccaacaacaaggtatcccgctctcccccgtccactgacacagcagacacttaccagccaacccgacccaagcagtgaagagcgccctccagccctgcctctccctttaccagggggtgaggagaaagcaaagctgatcggacagattaagcccgaactatatcagggaacgggacctggaggtcgccgctccgggggaggcccggggagcggcgaagcgggaaccggagcaccatgtgggcggattagtttcgcactgcgatacctgtatggcagcgaccagttggtcgtcagaattctccaggcgctggacctccccgcaaaagatagcaatggattctccgatccctatgtgaagatatacctgcttccagaccgaaaaaagaaattccagaccaaggtccatcgtaagacacttaacccggtctttaatgagaccttccagtttagcgtaccactggctgagttggcccagcgcaagttgcacttcagtgtttatgatttcgatcgcttcagccgacacgacttgatcgggcaggtggtactcgacaacctcctcgagttggctgaacagcctcctgacaggcccttgtggagggatatcgtggaggggggttcggaaaaggccgaccttggggaactgaacttctctctgtgctacctgcccacagcaggaagacttacagttactatcatcaaagcctctaatttaaaagcaatggatctcaccgggttctccgacccctatgtgaaggcaagtctaatcagcgaaggtaggcgtctgaaaaagagaaaaaccagcattaagaagaataccctcaacccaacttacaacgaggcccttgtgtttgatgttgccccggagagtgtggaaaacgtggggctgtcaatcgcggtcgtggactatgactgtattggccataatgaagtgattggagtttgtcgtgttggacccgatgctgcagacccccatggtcgggaacactgggccgaaatgctggcaaatccacgcaaaccagtggaacattggcaccagctcgtggaagaaaaaactgtgacttcgttcactaagggctccaaaggcctttctgagaaggaaaattccgaatag

SEQ ID NO: 207672 - DNA, 1773 bp, Artificial Sequence
  Description of Artificial Sequence: Synthetic coding sequence
atgagcggcgactacgaggacgacctgtgccggcgggccctgatcctggtcagtgatctgtgtgcccgcgtccgcgatgccgataccaatgatagatgccaagagttcaacgatagaattcgcggctacccaagaggcccagacgccgatatcagcgtctccttgctctcggtgatcgtgaccttctgtggcatagtgctccttggcgtctccctcttcgtatcctggaaattgtgttgggtgccatggagagacaagggtggttcagcagtgggggggggaccccttcggaaagatctcggacctggcgttggcctggccggattagttggcggggggggacaccaccttgctgcaggtctcggaggccacccactgctcggaggaccccaccaccacgcacacgccgctcatcaccctcccttcgcagagctcctggagccgggctccttagggggctccgacacgcctgaacccagctatcttgatatggactcatacccagaggcagccgcagcagccgtggctgcaggtgtgaaaccttcccagaccagtcctgagctcccttccgagggcggggcagggtctgggctgttgttactgccaccctcgggggggggcctacccagtgcacagagccaccagcaggttacgtctctggctcctactacaagatatcccgctctacctaggccactgacacagcagaccctgacctcacagcctgacccatccagtgaggaaaggccccccgccctgcctctgcccctgcctggcggagaggaaaaagccaaactgatcggccagatcaaaccagagctgtatcaaggaactgggcctgggggccgccggtcgggcgggggtcctggaagtggagaagccggtacaggagccccatgtggaagaattagttttgctttgcgctacctgtacgggtccgaccagctagtcgtccggatcctgcaggccctcgatctaccagctaaagactccaacggattttcagatccgtacgtgaaaatttatctactccccgacaggaagaaaaagtttcaaactaaggttcatcgtaagacactgaacccagtttttaatgagacgttccaatttagtgtgcccctggccgaactggctcaacgcaaattacatttctccgtgtacgattttgaccgcttcagtcggcacgacctcattggccaggtcgtcctggacaacctcctcgaactggccgagcagccgcctgaccgccccctctggcgggacatagtggaagggggatctgagaaagccgatctgggggaattgaacttcagtctttgctacctgccgacagcaggtagactcactgtaaccataataaaggcatccaatctcaaagcgatggacttgacgggcttctcggacccttacgtaaaggctagcctgatctcggaagggaggcggctcaagaagcgcaagacatctatcaaaaaaaataccctgaaccccacatataatgaagccctggtcttcgacgtggccccagaaagcgtggaaaatgtcgggctcagtatcgccgtggtggactatgactgtatcggtcataatgaagtgataggagtgtgtcgcgttggccccgacgctgcagacccgcacggcagagagcactgggccgagatgctggccaacccacgaaaacctgtcgagcattggcaccagttggttgaggagaaaacagtgacctcttttacaaaaggaagtaagggcctttctgaaaaggaaaattccgaatag

SEQ ID NO: 207673 - DNA, 1773 bp, Artificial Sequence
  Description of Artificial Sequence: Synthetic coding sequence
atgagcggcgactacgaggacgacctgtgccggcgggccctgatcctggtgagtgacctttgcgcacgcgtccgagacgctgacacaaacgaccggtgccaggaattcaacgatcgcatcagagggtacccacgtgggcctgacgccgacatatctgtttcactactgtccgtgatcgtgacattttgcggtatcgtcctgcttggagtcagcctgttcgtctcatggaagttgtgctgggtcccctggagagacaaggggggaagcgcggtcggtggtggtccactgagaaaggatctgggccctggcgtcggtctcgctgggttggtgggaggcgggggtcaccacttggccgcagggctgggaggccaccccctgctggggggaccccatcatcatgctcacgctgcccaccaccctccgtttgccgaactattagaacctggcagtctgggaggatccgacactcctgaaccttcctatctggacatggattcttatccagaagctgctgctgccgccgttgccgcaggtgtaaaaccctcgcagacttcaccagagcttccaagtgaaggcggcgccggcagtggactactgctactgccgccatccggtggcggccttccttcagcgcagagtcaccagcaagtgacttcgcttgcgcctaccacacgctacccggccctgcctaggccccttactcagcagaccctgacttcacaacctgatcccagtagtgaagaacgtcccccagcacttccactgcctctgcccgggggcgaggagaaagccaagcttataggacaaattaagcctgaactgtatcaggggaccggacctgggggtcgacgatcaggtggcggccctgggtcaggcgaggccggaaccggggccccctgtggacgaatttcatttgcactcaggtatctctatggatcagaccagcttgtagtgcgcatcttgcaggccctggacttacctgccaaagattctaacggattttccgatccttacgttaaaatatatttgctcccggatagaaaaaagaaattccaaactaaggtgcataggaagactctgaacccggtgtttaatgagacctttcaattttctgtacctttggctgaactcgcgcagcggaaacttcacttttctgtgtacgatttcgaccgtttctctagacacgacctgataggacaggtggtcctggataacctgctggaacttgccgaacagccacctgacagaccactgtggcgtgatattgtagaggggggtagcgagaaagccgacctgggcgaactgaatttttcattgtgttacctgccaactgccggccggttaacagttacaattataaaggcctctaacttaaaagcaatggacctgacaggcttttccgatccgtatgtgaaagcctccctgatctcggagggaagacgcctaaaaaaacgaaagacatcaattaaaaagaacacgctgaaccccacttacaacgaggctttagtctttgacgtcgcccccgagtcagtggagaatgtcggactgagtattgccgtcgtcgactatgactgcatcgggcacaacgaagtcatcggcgtgtgccgcgttggccccgatgctgcagacccccacggacgggagcactgggcagagatgctggcgaacccccgtaaacctgttgaacactggcatcagttggtggaagagaaaacagtaacatccttcactaagggtagcaagggcctctctgaaaaggagaatagcgagtag

SEQ ID NO: 207674 - DNA, 1773 bp, Artificial Sequence
  Description of Artificial Sequence: Synthetic coding sequence
atgagcggcgactacgaggacgacctgtgccggcgggccctgatcctcgtgtccgacctgtgcgccagagtccgggacgctgatactaatgataggtgccaggagtttaacgatagaatacggggctatcctcgtggccctgatgccgatatttctgtaagcctcctgtcagtgattgtcaccttttgcgggattgtactgctgggagtgagtctcttcgtgagctggaaactctgctgggtcccatggagggataagggtgggagtgccgtcggtggtggcccactgcggaaagacctggggccaggcgtgggtctcgccgggttggtcggggggggcggtcatcacctggctgctgggcttggaggacaccccctgcttggggggccccaccaccacgctcatgctgcccaccatcccccattcgctgaactgctagagccggggtcgctcggcggctctgatacccccgaaccttcatacctcgatatggactcctatccagaagcagcggcggccgcagtggcggccggggtgaaaccctcccagacgtcgcctgaactcccctccgagggcggggcaggatctggccttctgttgctgccccccagcgggggcgggttacctagtgctcagtcacaccagcaggttacatcactggcccccactacgcggtacccagcccttccccgccctctgacccaacagaccttgaccagtcagccagatccctcctctgaggagagaccccccgctctgcccttacctttgcccggaggggaggagaaagccaaactgataggccagataaagcccgagctgtaccagggcacaggtcctgggggcaggagatctggaggtggcccaggatccggcgaggccggaactggtgcaccttgtggaaggatcagctttgccctccggtacttatatggttccgatcaactggtcgtgagaatccttcaggctctggacttacccgcgaaggactccaacggcttcagtgacccttacgtgaagatctacctgttacctgaccggaaaaagaaatttcagacgaaagttcaccgcaagaccctgaacccagtttttaacgagacctttcaatttagtgtgccactggctgagctcgcacaacggaaactgcatttcagtgtgtacgactttgatcggttctcccggcacgaccttatcggtcaagtggttctggataacctgctggagctcgcggagcagcccccagaccggcctctctggcgggacatcgtggagggtggttcagagaaggccgaccttggcgagctgaacttcagcctgtgctatctgcctaccgcgggcagattaacagtgactatcatcaaggcctctaatctaaaagccatggaccttaccggtttctctgacccctacgtgaaggcttcacttatttccgaggggagacgcttgaagaaaaggaaaacatccattaaaaagaacaccctgaatcccacttataacgaagcattggtgttcgatgtggcaccagagtcagtcgaaaacgtggggctcagcatcgccgtggtagactacgattgtataggccacaatgaggtgatcggtgtgtgtcgagtgggacctgacgcggctgacccccacggacgcgagcattgggcagaaatgctggctaatccccggaaaccagtcgagcactggcaccaactggtagaagagaaaaccgtaacctcattcactaaagggtccaaaggtctctccgaaaaggaaaactctgaatag

SEQ ID NO: 207675 - DNA, 1278 bp, Artificial Sequence
  Description of Artificial Sequence: Synthetic coding sequence
atggcccccatcaccaccagccgggaggagttcgacgagatccccacggtggttggcatcttcagtgcctttggcctggtgttcactgtgtctttatttgcttggatctgttgtcagagaaaatcctccaaatcgaacaagacccccccatataaattcgtgcatgtcctcaagggcgttgacatttatccggaaaacctcaatagcaagaagaagtttggggcagacgataaaaatgaagtgaaaaacaaacctgcagtgccaaaaaatagtctacatttagatctggagaaacgcgatctgaacgggaatttccccaagaccaacctgaagccagggtcgccctctgatttagagaatgcaacgcccaaattgttcctcgaaggagaaaaggagtctgtgtcccctgagtctttgaagtcctctacaagcctcacgtctgaagagaaacaggaaaagttggggactttgttctttagccttgagtacaactttgaaagaaaggcattcgtcgtcaacattaaagaggcacggggccttcctgccatggacgagcagagtatgacaagcgatccctacattaagatgacaattctacccgagaaaaagcacaaagtgaagaccagggtcctgaggaaaacgcttgatcctgctttcgatgaaacattcactttttatggtatcccttatactcagattcaagagctcgccttgcatttcaccatcctgtcctttgaccgtttctccagagatgatatcattggcgaggtattgatacctctgagcggtattgagctcagtgagggtaagatgttaatgaaccgcgagataatcaaacgaaacgtccggaagagttctggccggggagaactcctcataagcctgtgctatcagtccaccaccaataccctgaccgtcgtggtgctaaaagcccggcatctgcccaaatctgacgttagtggccttagcgacccgtacgtgaaggttaacctttaccatgccaaaaagcgcatctcaaagaaaaaaacgcacgtgaaaaagtgcactccaaacgccgtgtttaacgaactgttcgttttcgatattccgtgcgaaggactggaagacatcagtgtggagttcctggtactcgattcggagcgtggttcacgcaatgaagttatcggacagctggttctaggagccgctgccgaaggaacagggggcgaacattggaaagagatttgcgactacccgcggcggcagatcgccaaatggcatgtcttatgtgacggttag

SEQ ID NO: 207676 - DNA, 693 bp, Artificial Sequence
  Description of Artificial Sequence: Synthetic coding sequence
atggacctgctgagcgagaagaagcacaaggtgaagacccgggtgctgagaaaaaccttggaccctgcatttgacgagacctttaccttctatggcattccctatacccagatacaagaactcgccctccactttactatcctttcgttcgatcgattttccagggatgatattatcggtgaggtcctgattcctctctcaggtattgagctgtcagagggcaagatgcttatgaatagggaaattataaagcgcaacgtcaggaagtcctccgggcgcggcgaattgttgatttcgctgtgctatcagagcacaacaaacacgttgactgttgttgttttgaaggcgaggcacctgccaaagtccgatgttagcggattgtccgacccatacgtcaaagttaacttgtatcacgcgaaaaagagaatttcaaagaaaaaaacccatgtgaagaagtgtactccgaacgccgtgttcaacgagctgttcgtattcgacattccttgcgaaggcctggaagacatcagtgtggagtttttggtgctggacagcgaacgcggcagtcggaatgaggtgattggtcaattagtactgggagccgcagccgaaggtactggaggagagcattggaaggagatctgcgactatcctcggcgccagattgctaaatggcacgtgttatgcgacggatag

SEQ ID NO: 207677 - DNA, 1476 bp, Artificial Sequence
  Description of Artificial Sequence: Synthetic coding sequence
atgcccggcgcccgggacgccctgtgccaccaggccctgcagctgcttgcagagctctgtgccagaggtgcgctcgaacatgactcctgtcaggactttatctatcacctccgcgacagagcgaggcctcgactgagagaccccgacatctcggtgtccctgctgactctcgtggtgaccgcttgcggactggccttatttggcgtgagtttatttgtgtcatggaagttgtgttgggtcccatggagagaacgtggcctgccttctggctccaaggacaacaaccaggaaccactcaattatatggatactgagaccaatgaacaggagaattccgaggattttctggacccgccaactccctgccctgatagttcaatgaaaatctcccatacaagtcctgatatccctctgtctacccaaacagggatacaggagaattgcgctcatggcgtgcgcgtacagcgacaggtaactgagccaaccagctctgctagacataactctatacgccggcagctcaacctctcaaatcccgattttaatatccaacagctgcaaaaacaggaacaattaacagggatcgggcgcatcaagcccgaactgtataaacaacgtagtttggataacgacgatggaagacgttctaactccaaagcttgcggcaagctgaatttcattctcaagtacgactgtgatctggagcaactaatcgtgaagatacataaggccgttaacttgcctgctaaggatttctctgggacaagtgatccttatgtcaagatttatctcctcccagatagaaagaccaagcatcagacaaaagtccacaggaagaccctgaaccccgtttttgacgaagtgttcctttttccagtgccttataacgatctggaggcgagaaagctgcacttcagtgtctacgatttcgatcggttctcccgtcacgacttgatcggccaagtggtggtagatcatttccttgatcttgctgattttccacgcgaatgcatcctttggaaggacattgagtatgtaaccaacgacaatgtcgacttgggtgagttgatgtttagtctgtgctacctcccaaccgccgggaggctgaccatcactataattaaggctcgcaaccttaaggctatggatattaccggggcatcagacccttatgttaaagtctcattgatgtgcgacggcagacggctgaaaaaacgcaagacgagcacaaagaggaataccctgaatccggtgtacaacgaggcaatagtctttgatgtcccccctgaaaatatcgatcagatccacctttctattgcagtcatggactatgatagggtaggccacaatgaaattattggcgtttgtcaggtgggaaacgaggctgagagattaggaagagaccactggtccgaaatgctgtcgtatccacgcaaaccgattgctcattggcatagcctcgtagaaaagaggtag

SEQ ID NO: 207678 - DNA, 960 bp, Artificial Sequence
  Description of Artificial Sequence: Synthetic coding sequence
atgctggccaaggtggtggagggcgacctggccttcaagggcggccgggatatcagcgtctcactgttgaccctggttgtgacggcctgtgggctcgcgctgtttggcgtttctcttttcgtgagctggaaactttgctgggtcccttggcgggaacgaggcctccctagcggatctaaagataataaccaagagcctctaaattatatggatactgagacgaatgagcaggagaactctgaagatttcctggacccgcccacaccctgtcctgatagtagcatgaaaatctcacacaccagtcccgatattccactatcaacccagaccggtattcaagaaaattgcgctcacggcgtacgggttcagcgccaggtcactgagcctaccagctcagcaaggcataattccattcgcagacagttaaatctcagcaacccggattttaatattcagcagttacagaaacaggagcaactgacgggcattgggcgcatcaaacccgagttgtacaaacaaaggtctcttgacaacgacgatggcagaaggagtaactctaaggcctgtggcaagctcaatttcattcttaagtatgactgcgacctggaacagctgattgttaagatccacaaggccgtcaacctgcccgcaaaggattttagcggcacctccgacccgtatgttaaaatctacctgctccccgacaggaagaccaaacaccagaccaaagttcatcgaaagaccctcaacccagtattcgatgaggtgtttctattcccagtcccctataacgatcttgaagccaggaagcttcacttctcagtgtacgatttcgatagattttcacgacatgacctgataggtcaggtggtcgtggaccactttttggatctcgcagatttcccgagagagtgcatcttgtggaaggatatagaatacgttaccaacattctatcctag

SEQ ID NO: 207679 - DNA, 1161 bp, Artificial Sequence
  Description of Artificial Sequence: Synthetic coding sequence
atgttccccgagccccccacccccggcccccccagccccgacaccccgccagatagttcgaggatctcacacgggcccgtgccgccatgggccctggcaacaatcgtgctggtatctgggctcctcatttttagctgctgcttttgcctgtatcgcaaatcctgccggaggagaaccggaaagaagtcacaggcccaagcccaggtccatttgcaggaggtgaagggacttgggcagtcatacatcgataaagttcaacccgaggtcgaagagttggagcctgccccatccggccccggccagcaggttgccgataagcacgagctgggaagacttcagtactcgctcgactatgattttcagtcaggccagttactcgtgggcatcctgcaagccatgggcttggccgccctggatctgggaggtagcagcgatccttacgtccgcgtgtatctgctcccggataaaagaaggcgatatgagaccaaggtacacagacagacattaaatcctcattttggagaaacttttgccttcaaggtcccgtatgtcgagctgggagggcgcgtgctcgtcatggccgtgtatgacttcgatcggttcagccggaatgacgctattggcgaagtgcgcgtcccaatgagttcagtggaccttgggcgccctgtacaagcttggcgagagctccaagccgctccgagggaagagcaagaaaagttaggcgacatctgcttctccctgaggtatgtgcctaccgctgggaagctgactgtcattgttctggaggcgaagaacttgaaaaagatggacgttggcgggctatccgatccctatgttaaggttcatctcctccagggcggaaagaaggttaggaaaaagaagactaccatcaaaaagaacaccctcaatccctattacaacgaggccttctcctttgaagttccttgtgaccaggttcaaaaagtccaagtggagctcaccgttctagattacgataaactcgggaagaacgaagcaatagggagagtcgccgtgggcgccgccgctggtggcgccgggcttcgccactgggctgacatgctggccaaccccagacgccccatcgcccagtggcatagtctgagacctcccgaccgggtccggctgctacctgcaccttag

SEQ ID NO: 207680 - DNA, 1161 bp, Artificial Sequence
  Description of Artificial Sequence: Synthetic coding sequence
atgttccccgagccccccacccccggcccccccagccccgacaccccacctgactcctctcgcatcagccatgggcccgtcccaccatgggctctggctaccatcgtccttgtatctggactcctgatattcagctgttgtttctgcctgtaccgtaagagttgcagacgccgaaccggcaagaaatcacaagcacaggcccaggtgcatttgcaggaggtgaaaggactgggtcagtcctacattgacaaggtccagcccgaggtcgaagaactggagcctgccccttctggacctgggcaacaggtcgcagataaacacgagcttgggagattacagtatagtttggattatgatttccagtcaggacagttgctggtaggtatccttcaagcgatgggcctcgctgccctggatctgggcggaagctcagacccatacgtcagagtgtacttgcttcccgacaagcggcgacgctatgagaccaaggtgcaccggcaaactctgaacccacattttggcgaaacgtttgctttcaaggtcccttatgtggagttgggcggcagagtgctggtaatggcagtctacgacttcgaccgctttagccgcaacgatgctatcggggaggtgagggtgcccatgtctagcgtggatctgggtaggccggtccaggcttggagagaacttcaggccgcccctcgggaggaacaagagaaacttggagacatttgcttctctctgagatacgtgcccaccgccggaaagctcacggtcattgtactcgaagccaagaatctcaaaaagatggacgtgggggggctgagtgatccatatgtgaaggtgcacctcctgcagggagggaagaaggtgcgaaaaaaaaagacaacaatcaaaaagaacaccctgaacccttattataacgaggcatttagctttgaggttccgtgcgatcaggtgcagaaagtgcaagttgaactgactgtcctggattatgataagctcgggaagaacgaagccattggtcgtgtagcggtcggcgccgcagctggcggcgcaggcttgcgacactgggccgatatgctggccaacccccgtcgccccatcgcacaatggcacagtctaaggcctcccgatcgagttcgcctcctgcctgctccctag

SEQ ID NO: 207681 - DNA, 1149 bp, Artificial Sequence
  Description of Artificial Sequence: Synthetic coding sequence
atgacccggggcggctgccccgtgagcgcccggctgttcgcccagcgcccacatggatcttggtcaagcctgctgtgtgtcgggctcaaaggtcgactcggctgggagtgggggacacgtgtcctcgaatgcctttgccgcaaagacagccgaactccccctccctgttctcgcagcccacagcccagaggcttacatcggcccaccaggctgcctactccagtcgcttctgcaactgcacaagtacagcccgaggtagaagaattagagccagcaccgtccggcccaggccaacaggtcgcagataaacacgagttgggccggctccagtacagcctggattacgacttccagtccgggcagcttctggtgggcatcttgcaagcaatgggcctagctgcactcgacttaggcggctcctccgacccatacgttcgcgtgtatctgctccccgataagaggcggaggtatgaaaccaaagtgcaccgccagacactcaatccgcattttggtgaaacatttgccttcaaggtcccatacgtcgagctggggggccgggtgctggttatggcggtgtacgactttgatcgcttcagccgcaatgacgccataggagaggtgagagtcccaatgagctccgtggacctgggccgccctgttcaggcttggcgtgagctgcaggctgcccctcgggaagaggaaaaacttggggatatctgtttctcactgcgctatgtgcctacggctggaaaactgacggtgattgttctcgaggccaagaatctcaagaaaatggatgtaggcggactgtccgacccttacgtgaaagtccacctgctccagggcggaaaaaaagtacgcaagaagaagaccactatcaagaagaatacactgaacccatactataacgaagcgttttccttcgaagtgccctgtgatcaggtgcaaaaggtccaggtggagctgaccgtcctcgattacgataaactggggaagaatgaagcgatcggccgggtggccgtgggtgcagctgcagggggtgccggtctacgtcactgggcagacatgttagccaatcctaggcgaccaattgcccagtggcattcattgcgaccaccagatcgtgtgagactactgccggctccgtag

SEQ ID NO: 207682 - DNA, 1533 bp, Artificial Sequence
  Description of Artificial Sequence: Synthetic coding sequence
atgagcggcgtgtggggcgccggcggcccccggtgccaggaggccttagccgtgttggcaagcctatgccgggcaagaccaccaccccttggccttgacgtggaaacctgtcgatcttttgaattgcagcccccagagagatctccctctgcagccggtgccggaactagcgtatcactcctagccgtcgtcgttatcgtgtgcggcgtcgcactggtggcagtattccttttccttttctggaagctgtgttggatgccgtggcgaaataaagaggcatcatcaccttcttcagccaaccctccactcgaggctctgcaatcaccctcattccgcggtaatatggctgacaagctaaaagacccgagcaccctgggcttcctagaggcagcagtaaaaatatcacataccagtccagacatccccgccgaagtgcagatgtccgtaaaggagcacatcatgagacacacacggctgcagcggcaaacgacagagcccgcctcttcaactcggcatacatcatttaagaggcacctgccacgtcagatgcatgtgagtagcgtcgactatgggaacgagctgccccccgccgccgaacagcctacatccattgggaggattaagcctgaattgtacaaacaaaagtctgttgatggagaggacgctaaatctgaggctaccaagagttgcggtaaaataaacttctcactaagatatgattacgagacggagacgttgatcgtacgtatcctgaaggcatttgatctgcctgcaaaggatttctgtggaagcagtgacccctacgtgaagatctatttgcttcccgataggaaatgcaagctgcagacccgggtccacagaaaaacactgaaccccacctttgacgaaaacttccacttcccagtaccatacgaagagctcgctgacagaaagctccatctgagcgtgtttgatttcgatcgcttttctcggcacgatatgatcggtgaggttatcctggataacctgtttgaagccagcgacctgagccgcgaaaccagcatttggaaggacatccagtatgcgaccagtgaatccgtcgacctgggagagatcatgttcagcttatgctacctgccaactgccggcaggctcactttgactgttattaagtgtcgaaacctgaaggcaatggacattactgggtatagtgatccttatgtcaaagtttcccttctgtgtgacggtaggcggctcaaaaagaagaagaccactattaaaaaaaacacgctgaaccctgtgtacaatgaggcaatcattttcgacatcccgccagagaatatggaccaagtgtcacttctcatttctgtgatggattatgatcgcgttgggcacaacgagattatcggcgtatgcagggtggggatcacggccgaagggttaggccgggaccactggaacgagatgctggcttacccacggaagcccatcgcacactggcatagcctggttgaggtgaaaaagtcttttaaggagggaaacccacgactgtag

SEQ ID NO: 207683 - DNA, 1278 bp, Artificial Sequence
  Description of Artificial Sequence: Synthetic coding sequence
atgccctggcggaacaaggaggccagcagccccagcagcgccaacccaccgttggaggcccttcagagtccctccttccggggcaatatggcagacaagctcaaggacccaagcaccctaggtttcctggaggccgcggtgaaaatctcacacacaagtccagatattcccgcggaggtgcagatgtccgtaaaagaacacatcatgcggcacacgcgcctacagcgacagacgacagagcctgctagctccaccagacacacctccttcaagcggcacctgccccggcagatgcatgtgagctcagtggattacggcaatgagctgccccctgctgctgaacagcccacttccataggccggattaaacccgaactttacaaacagaagagtgtcgatggagaggatgctaaatccgaagctaccaaaagctgtggtaaaatcaacttttctctcaggtatgattatgaaacagaaacccttatcgttcgcattctcaaagcattcgacttgcccgcgaaagatttctgtggaagttccgacccatacgtgaaaatttatttgcttcccgatcggaagtgtaagttacagaccagagtgcaccggaaaactttgaaccccacatttgatgaaaatttccattttcccgtcccctacgaagaactcgctgatcggaaactgcatctgtctgtgttcgacttcgaccgtttttctaggcatgacatgatcggagaggtgatcttggataatctgtttgaggcctccgacttatcaagagagacatctatttggaaggacattcaatacgctacatcggagtccgtggacctgggagaaatcatgttttccttgtgctatctccctacagcaggccgcctgacgctgacggtgatcaaatgccgaaacctgaaagccatggacatcaccggctactctgacccatatgtgaaagtgtctctgctgtgcgatggaaggcggctaaagaaaaagaagacgactatcaagaaaaatacattgaaccccgtgtataatgaagcaatcatttttgatattccccctgagaatatggaccaggtttccttgctgattagtgttatggattatgaccgcgtgggacacaatgagataattggcgtgtgtcgtgtcggtatcaccgcggaggggctgggacgtgaccactggaatgagatgttagcttaccctagaaagcctatagcgcactggcacagcctggttgaggtgaagaagagtttcaaggagggcaaccctaggctgtag

SEQ ID NO: 207684 - DNA, 1278 bp, Artificial Sequence
  Description of Artificial Sequence: Synthetic coding sequence
atgccctggcggaacaaggaggccagcagccccagcagcgccaaccctccattggaggcactgcagagtccctcattcagaggaaacatggcagacaagctgaaagatccttccacattgggctttctggaggcggccgttaagatctcacatacatcaccagatataccggctgaggtgcagatgagcgttaaagaacacataatgagacacaccagactccagcgccaaacaactgaaccggcttcatcaacgcggcatacctctttcaagaggcacttgcctaggcagatgcacgtgtcttcagtggactacggtaacgaactgccaccagccgccgagcagcctactagtatcgggaggatcaaacccgagctctacaagcagaagagcgttgatggggaagatgccaagtctgaggcgaccaaatcttgcgggaaaatcaattttagtttgcggtatgactatgagaccgagacgcttatcgtcagaattctcaaagctttcgatcttccagcaaaagatttttgtgggtcatctgacccatacgtgaaaatttatttgttgcctgaccggaaatgcaagctccaaacccgagtgcacaggaaaacactgaatcctacattcgatgaaaatttccattttcccgtgccatacgaggagctcgctgatagaaaactgcacttgtccgtgtttgattttgacagattttcacgacacgacatgattggagaggtgatactcgataacctatttgaggcatctgatttgtcacgggaaacttccatatggaaggatatacagtacgcgacctctgaatctgtcgatctcggggagatcatgttttctctgtgctatcttcccactgcaggtaggctcactctgacagtgattaaatgcaggaacctgaaagccatggacattaccggatattcagatccctacgttaaggtgagcttgttgtgtgacgggcgcaggctgaagaaaaaaaagactaccatcaagaagaatactttaaacccagtgtataacgaagcaatcatctttgatataccaccggagaacatggaccaggtgtctttattaatttcagttatggactatgacagggtgggacataatgagatcattggtgtgtgccgtgtgggaatcacagctgagggtctgggccgggatcattggaatgaaatgttagcatacccccgcaagcccatagcccattggcattctctcgtggaggtcaagaagagctttaaggagggtaacccacgactgtag

SEQ ID NO: 207685 - DNA, 1533 bp, Artificial Sequence
  Description of Artificial Sequence: Synthetic coding sequence
atgagcggcgtgtggggcgccggcggcccccggtgccaggaggccttggccgtcctggctagcctctgtagggcacggccaccaccactggggctggatgtcgagacgtgtcggtcatttgaattgcagccaccagagagatctccttcagcagccggggccggtacgtcagtgtcactcctcgccgtggtggttattgtgtgtggggttgctctggtggctgtattcttgttcctgttctggaagttatgctggatgccctggaggaataaagaggctagtagccctagcagtgccaatcctccacttgaagcactacaaagcccttccttcaggggtaatatggctgacaaactgaaagatccaagcaccctaggctttctcgaggcggctgtgaaaatcagccatacttctcccgacattccagctgaagtgcaaatgtctgtaaaggagcacattatgcggcacacccgactgcaaagacagactactgagccagcttccagcacgcggcatacatcatttaagaggcatctgccccggcagatgcatgtttcaagcgtggactatggaaatgagctacccccagctgccgaacagccgacttctataggccggattaagccagaactatataagcagaagtctgtggacggggaggatgctaagtctgaggcaaccaaatcatgcggcaaaatcaacttctcactccgttacgactatgaaacagaaacactgattgttaggatcctaaaggcgttcgacttgcctgccaaggacttttgtggcagctccgacccttatgttaaaatatacctcctcccggaccggaagtgcaaacttcaaaccagggtacatagaaagacgctcaaccccaccttcgacgagaacttccacttccctgtgccctatgaagaactcgccgatagaaaactgcacctctctgtttttgattttgataggttctcacgacacgacatgattggggaggtaattctagacaacctattcgaggcctctgacctctcccgtgagactagtatatggaaggatatacagtacgccacatccgaatctgtcgatctgggagaaattatgttttccctctgttatcttcctaccgccggacggctcactcttaccgtgattaagtgcaggaacttgaaggccatggatattaccggctacagcgatccttatgtgaaagtctctttactgtgcgacggcagacggctcaagaagaagaagaccaccatcaaaaaaaatacccttaatcccgtctacaacgaagccatcatttttgatattcccccggaaaacatggatcaagtgagtctgttgatcagtgtcatggattatgatagagtaggacataacgaaatcatcggagtgtgcagggtgggcattaccgccgaaggattagggcgggatcattggaacgaaatgctcgcatacccacggaaaccaatcgctcactggcattctctagtggaggtgaagaaaagcttcaaggagggaaatcctagactgtag

SEQ ID NO: 207686 - DNA, 288 bp, Artificial Sequence
  Description of Artificial Sequence: Synthetic coding sequence
atgccctggcggaacaaggaggccagcagccccagcagcgccaaccctccgctggaagcccttcagtctccttcattcaggggcaacatggctgacaagcttaaagatccatcaaccttgggttttctcgaggctgctgtgaaaatcagtcacacatcccccgacattcccgccgaagtgcagatgtctgtcaaagagcatataatgaggcatacaaggcttcagaggcagacaacggaacctgcaagcagtacacgtcacacttcattcaaaagacacttgccctag

SEQ ID NO: 207687 - DNA, 261 bp, Artificial Sequence
  Description of Artificial Sequence: Synthetic coding sequence
atgccctggcggaacaaggaggccagcagccccagcagcgccaacccacccctggaagcgctgcagtcccccagcttccgaggcaatatggccgacaaacttaaggacccgtctacccttggctttttggaagccgcggtaaagatatctcacacgagtcctgacatcccagccgaagtgcagatgagtgttaaggagcacatcatgagacatacacggctacagcgccagacgaccgagcccgcgtcttcaactcgctag

SEQ ID NO: 207688 - DNA, 1212 bp, Artificial Sequence
  Description of Artificial Sequence: Synthetic coding sequence
atgtaccgggaccccgaggccgccagccccggcgcccccagccgggacgtgctcttagttagcgctattattaccgtctcactgtccgtgacagttgtgctgtgcggactgtgccattggtgtcagcgcaagctaggcaagcgctataagaatagcctcgaaaccgtgggcactccagactccggcaggggcaggtctgagaagaaagccatcaaacttcccgctggaggtaaagcagtcaatactgcccctgtgccaggccagaccccacacgatgaatctgataggagaactgaaccccgcagcagcgtatcagatctggtaaactccttaactagcgaaatgctcatgttaagccccggatcagaggaagacgaggcccatgagggctgctctcgggaaaatctcggtaggatccagttctccgtgggctataacttccaggagagcactctgaccgtgaaaattatgaaggctcaggagctcccagcaaaagatttctccggtacctctgaccctttcgtgaaaatatacttactgcctgacaagaaacacaaactggaaacaaaggtgaaacgcaaaaatctgaatccccactggaacgagacctttctcttcgagggatttccatacgaaaaggtagtgcagcggattctgtacctccaggtactcgactatgataggttttcacggaacgatccaataggagaagtgtctattcctctgaataaggttgacctgacgcagatgcagacattctggaaggatctgaagccatgcagtgacggatccggttccaggggagaacttctcctgagtttgtgctataatccctctgcaaactccatcattgtgaacataattaaggctcgcaatctgaaggccatggacatcggcgggacttctgacccttacgtcaaagtttggttgatgtacaaagacaaaagagtcgagaagaagaaaacggtgaccatgaaaagaaacctgaaccctatatttaacgagtcttttgctttcgatataccgacggagaagcttagggaaaccacgattatcataaccgtgatggataaagacaaattgtcacggaatgacgtgataggcaagatctatctttcgtggaagtccggcccaggtgaagtgaaacactggaaagatatgatcgctagacccaggcaacccgtggcacagtggcaccaactcaaggcgtag

SEQ ID NO: 207689 - DNA, 1266 bp, Artificial Sequence
  Description of Artificial Sequence: Synthetic coding sequence
atggccgtggacgtggccgagtaccacctgagcgtgatcaagagccccccgggatgggaagtaggcgtctacgccgcaggggcgttggccctgctgggtatcgcagccgtttccctgtggaagctctggaccagcggctcgttcccaagtccatcccccttcccaaattacgattatagatatctgcagcagaaatacggcgagagctgtgctgaagccagagagaagcgcgtgcctgcctggaacgcccaacgcgcaagcaccagggggcccccaagtcgtaaggggagcctgtctattgaagatacatttgagagcatcagcgaattgggcccattagagctgatggggagagaactcgacctggccccgtatggaactttaaggaaatctcaatcggctgattcacttaactccatctccagtgtgtctaatacattcggacaggattttaccctgggacaggtagaggtgagcatggaatacgacacagcctcgcatactctcaacgtcgctgtgatgcagggcaaggacctgcttgaaagggaggaggcttcttttgaatcttgcttcatgagggtctcactcctgcctgatgagcagattgtggggatatcccgcatacagaggaacgcttacagcatcttcttcgatgaaaaatttagcatccctctcgatccaactgccctggaagaaaaaagcctgaggtttagcgtgtttggtatcgacgaggacgaacggaacgtctccacaggggtcgtcgagcttaagttaagtgttcttgacctacctttgcaacctttcagcggctggttatatcttcaagaccagaataaggccgccgacgccgtcggcgaaatcctcctctccctgtcgtacctaccaacggctgaacggctgaccgtggtggtcgtcaaagcgaaaaacctcatctggaccaacgacaagacaaccgccgacccctttgtcaaggtgtacctactgcaagatggtcgaaagatgtcaaagaaaaagacagccgtgaaacgagacgacccaaaccctgtattcaatgaggcgatgatcttctcagtgccggcaatagttctgcaagacctctcacttagggtcacagttgccgaatccagttcagacggaaggggtgataacgtgggtcatgtgattattgggcccagcgcaagcggcatgggcactactcattggaaccagatgctggcgactttaagaagacccgtctctatgtggcatgctgtccgcagaaactag

SEQ ID NO: 207690 - DNA, 1266 bp, Artificial Sequence
  Description of Artificial Sequence: Synthetic coding sequence
atggccgtggacgtggccgagtaccacctgagcgtgatcaagagccctcccggctgggaagtaggggtatacgcggctggggccctcgcgctgctcggcatagccgctgtctccttgtggaagctttggactagcggatctttcccctcccccagcccattccccaactacgactacaggtacctacaacagaagtatggcgaaagctgcgcagaagcaagagagaaaagggtgccagcatggaacgctcagcgcgcgtcgacccggggcccccccagcagaaaaggctccctgagcatagaggacactttcgagagcatctcagaactcgggccactagagttaatgggccgggaattagacctggcaccttatggcactctgcgaaagtcccagtctgctgactcactcaattctatctcgtcggtgtctaatacttttgggcaggacttcacactcggtcaggtggaagtgtccatggaatacgacaccgcgtctcacaccttgaacgtggccgtcatgcaaggaaaagatttacttgaacgcgaggaggccagcttcgagagttgcttcatgagggtgtcactgttacctgacgagcagatcgttgggattagccgcatccagagaaatgcttactctattttttttgacgagaaattttccattcccctggaccctacggccttggaggagaaatcactcagattcagtgttttcgggattgacgaggacgagcggaacgtcagcacgggcgtcgttgagctgaaactttccgtcctggatctcccactccaacccttctctggatggttgtacctacaggatcagaacaaagccgcagatgctgtcggcgagattttgctgtcactgtcttatctcccaacagcggaaagactgaccgtcgtggttgtgaaggccaagaacctgatatggacgaacgacaagacgaccgctgaccccttcgtaaaagtgtatctgctccaagatggccgtaagatgagcaagaagaagaccgcggtgaaaagagatgatccaaatcctgtgttcaacgaggcaatgattttctccgtgccagcaatagtgttgcaggatctgtccctcagagttaccgtagccgagtcaagtagtgatggccggggagacaatgtgggtcatgttataatcgggccttcagcctccggaatgggcactacacactggaatcagatgctggccactcttaggcgccccgtgtcaatgtggcatgccgttagaagaaactag

SEQ ID NO: 207691 - DNA, 1266 bp, Artificial Sequence
  Description of Artificial Sequence: Synthetic coding sequence
atggccgtggacgtggccgagtaccacctgagcgtgatcaagagcccacccggctgggaagtcggtgtctatgccgcaggggccctggccctgctgggcattgcagctgtctccttatggaaactgtggactagtgggtccttcccgagcccttcaccttttccgaactacgattaccgctatctccaacagaagtatggtgaatcctgcgctgaggcccgggagaaacgcgtcccagcatggaatgcccaaagagcatctacaaggggtccaccttcgagaaaagggtcattatccatcgaggacacctttgagagcatctcagagctcggccccttggagctgatgggccgggagcttgatctggccccctatggcacacttaggaagtcccagagcgcggacagcctgaactctatctcaagtgtgagtaatactttcggacaggatttcactctcggccaggtggaagtctcaatggaatacgacacggcaagccacacactgaatgtcgccgtgatgcaaggaaaggatctgctggagcgcgaggaggcttcatttgagtcatgttttatgcgggtatcgctgttaccggacgaacagatcgtgggcatctccagaatccagcgcaatgcctattccatattctttgacgagaagttcagtattcccctggatcccactgctcttgaagagaagtctttacgtttttcagtatttgggattgacgaggacgagcgaaacgtgtccactggcgttgtcgagttgaagctgagcgtcttagatttgccactgcagccctttagcggatggctgtacctgcaggatcagaacaaagcagcggacgccgtgggggaaattctcttaagcctaagctatctgcccacagcggagagactgacagtggtcgttgtaaaggccaaaaatctaatctggacaaatgataagactaccgcagacccgttcgtgaaggtgtatctgttgcaagacggtcgcaaaatgtctaagaaaaagactgccgtcaagcgcgacgatccaaatcctgtgttcaatgaagcgatgattttctcagttcccgctatcgtgctacaggacctatccctgcgggtgacagtagccgagagtagctcagacggcagaggagataatgtgggtcacgtgatcataggcccttccgcctctggaatgggcacaactcactggaaccaaatgctggctacactgagacggcctgttagtatgtggcatgccgtgagacggaactag

SEQ ID NO: 207692 - DNA, 1281 bp, Artificial Sequence
  Description of Artificial Sequence: Synthetic coding sequence
atggtgctgagcgtgcccgtgatcgccctgggcgccaccctgggcaccgctacttccatactggccctgtgcggcgttacttgcctttgccgacatatgcacccaaagaaaggtttactgcccagagaccaggaccctgacctcgagaaagctaagccctccttgctggggtcggcccagcaattcaacgttaaaaaaagcactgagccagtccagcctagggctctactgaaatttcccgacatttatggaccccgccccgctgttacagcgcccgaggttattaattacgccgactatagcctccgctccacagaggagccaacagcacccgcatccccacagccgccgaatgattcaagacttaagcggcaggtcacagaggaactgttcatcctgcctcagaatggggtggtcgaggacgtgtgtgtcatggagacttggaatcccgagaaggccgcctcctggaatcaagctccgaagctgcattactgccttgactatgactgccagaaggccgagcttttcgtaacgaggctagaggcagtcacatccaatcacgatgggggctgtgattgctacgtgcagggcagtgtggccaatagaaccggctcagtcgaggcccagacagcccttaagaaacggcaattgcatactacttgggaagaagggctcgttcttcccttggccgaggaggagttgccaacagccacactcacgcttacactccgaacatgcgacagattcagtcgtcactccgtggctggagaattgagactgggactagacgggacatccgtgccgctgggcgccgcccagtggggagaattaaaaacgagcgctaaagaaccaagtgccggcgctggcgaggtgcttcttagtatcagctatctccccgctgcaaatcgcctattagtcgtcttgataaaagcaaaaaacctgcattccaatcagtctaaggagctcctgggtaaagatgtgagtgtcaaggtgactctgaaacaccaggctcgaaagttgaagaaaaagcagaccaaaagagccaagcacaagattaatccggtatggaatgaaatgatcatgttcgaattgccagatgatctgctgcaggcgtcctcagtggagcttgaagtgttaggacaggacgacagtggccagtcctgtgccctgggacattgctctctgggactgcatacctccgggtccgagcgcagtcattgggaggaaatgttaaagaatcccagacgccagatcgctatgtggcaccagcttcatttatag

SEQ ID NO: 207693 - DNA, 1554 bp, Artificial Sequence
  Description of Artificial Sequence: Synthetic coding sequence
atgctgctgctgttcctgtacatcaacaagaagttctgcttcgagaatgtgggtggctttcccgacctcggctctgaatatagcacccgcaagaatagtcaggacaaaatttataattcctacatggacaaggatgagcacggcagtagctctgagtccgaggatgaagctctggggaaatatcacgaagccttatcaaggacgcataacagtagattgccactggccgactctagacagcgtaactacgcctgggagacccggcagaaatatagcccactgtccgccgagtacgacggatactcctctgaagctagcatagacgaggggaattgcatacagagaatgagacgcacccctcccctcgatgagcttcagcctcccccataccaagacgattccggatctccacacctgtcatgcaccccttccgagatcggcgattccaagtgtgagttctcccactgctcaaattcaccccgctgtagctacaacaagtgccctagcgagggctcaaccggacacgagatcgagtccttccataataaagggtacgaagaagacgtgccttctgattcaaccgcggtcctatccccagaggatatgtcggctcagggatcttcaagccaactgccaaagcctttcgacccggaaccagaagcaaaatacggtaccctggacgtgacctttgattacgacagccaggaacagaaattgctcgtaacggtgacagccgttaccgacattcccacctacaatcgtaccggagggaattcttggcaggttcatttggtgctgttgcccataaagaagcagagagccaagactagtattcagaggggcccttgcccagtattcactgagacattcaagtttaaccacgtcgagtccgagatgatcgggaactacgcggtccggtttcggctgtacggtgtgcatagaatgaaaaaagagaagatcgttggcgaaaaaatcttctatctgaccaaactcaacctgcagggaaagatgtcactccccgtgatcctcgagccaagttataaccactctggttgtgactcccaaatgtctgtgtctgagatgtcttgctcagagagcacaagctcttgtcagtcccttgagcacgggagcgtgccagaaatcctcatcgggcttctgtataacgcaacaacgggaagactcagcgccgaggtgattaaaggatcacactttaaaaacctggctgccaatcggcccccgaatacgtatgtaaaactgacgctcctcaatagcatgggtcaggaaatgagcaagtgtaagactagtattagacgcggccagcccaatccagtgtataaagaaacctttgtgttccaagtagccttattccagctttcagatgtgactcttatcctatctgtgtacaacaaaaggagtatgaagcgtaaagaaatgattggatggatctcgctgggacttaattctagtggcgaggaggagctgaaccattggacagaaatgaaggagtccaaggggcagcaggtctgccggtggcatgcactgttggaatcatag

SEQ ID NO: 207694 - DNA, 1725 bp, Artificial Sequence
  Description of Artificial Sequence: Synthetic coding sequence
atggccatcgagggcggcgagcggacctgcggcgtgcacgagctgatctgcatacgcaaggtgagcccagaggccgtcgggtttctgtctgccgtgggcgtctttattatcttgatgctattactgttcctctatatcaataaaaagttctgctttgaaaatgtgggtggcttcccggacctaggtagtgagtatagtacaagaaaaaacagccaggacaaaatctataatagttacatggataaggacgagcacggatccagcagcgagtccgaagacgaggctctggggaagtatcacgaagctctctccaggacacacaattcccggctgcctctggctgactcacgccagcgaaattacgcttgggaaacccgccagaaatattcaccattaagcgccgaatacgatggctactcctctgaggcttctatcgatgaagggaattgtatccagcgcatgcggaggacccccccactggacgaattgcagccacccccctaccaggacgattctggatctccccatctgagctgcaccccctcggagatcggcgatagtaagtgtgagttttctcactgcagcaattctccaagatgctcctacaataagtgcccaagcgagggctcaacggggcatgaaatagaaagcttccacaataaaggctatgaggaggacgttccttccgacagtacagctgtactgtcaccggaagacatgtctgcacagggttcatcttcccagctccccaagccttttgacccagagcccgaagccaaatatggcactctggatgttacatttgactacgattcgcaggagcagaagctcctggtgaccgtgaccgcggtaaccgatatcccaacttacaataggacagggggcaattcatggcaggttcatttggtcctgctgcccattaagaaacagcgtgcaaagacatcgatccagagaggcccatgtcctgtttttaccgaaacgttcaagtttaaccatgtcgagagcgaaatgatcggcaattatgccgtgaggttccgcctctacggagtgcacaggatgaagaaggagaagatagtaggggagaagattttttacctgactaaattgaatcttcagggaaagatgtctttaccggtgatcctcgagccctcctacaaccactctggatgtgatagtcagatgtccgtgagcgagatgtcatgctccgagtcaacttcaagctgccagtctcttgagcacggatcagtaccagaaattctgatcggactgctgtacaatgcgacgactggaagactgtcggctgaagtgataaaaggttcccatttcaaaaacctggccgccaaccgccccccaaacggactgttttgctgcctcaagcatctgattggcgggcaggtctacataattcgcgatacgtacgtgaagctgacactcttaaacagcatgggacaggagatgtccaaatgtaaaacgtccattaggaggggtcaacctaaccccgtttacaaggaaacttttgtgtttcaagtggcactgttccaactgtctgatgtcacattgatattgagtgtatataataagcgaagtatgaagcgtaaggagatgattggctggatcagcctcggcctcaattcttcaggcgaagaggaacttaaccactggacagagatgaaggagtctaaaggccagcaggtgtgtcggtggcatgctctgcttgaatcctag

SEQ ID NO: 207695 - DNA, 1377 bp, Artificial Sequence
  Description of Artificial Sequence: Synthetic coding sequence
atggccatcgagggcggcgagcggacctgcggcgtgcacgagctgatctgcattagaaaggtttccccagaagctgtcgggtttctgtccgccgttggagtgtttatcattctgatgctgctgctttttctctatatcaacaaaaagttttgctttgaaaacgtcggtggcttccctgacttggggtcagaatactcaacgaggaagaatagccaggataagatttacaatagctacatggacaaggacgagcacggttcatcgtccgaatcagaggatgaggcccttgggaagtatcatgaagccctctcgaggactcataactctcgcctaccactggctgattctaggcagcggaactacgcttgggaaaccaggcagaaatattcaccactctcagctgagtatgacgggtactcctccgaagcttccattgatgagggcaactgtatccagcgtatgaggcggacgcccccgctagacgaattgcaaccaccaccttatcaggacgacagcggtagccctcatctttcgtgcacaccatctgagatcggagactcgaaatgtgagttctcccattgcagtaacagcccacgctgttcatataacaagtgtcccagtgagggatccacgggccatgagatcgagtctttccacaacaagggttacgaagaggatgttccatccgatagtaccgcggttctgtcaccagaagacatgagcgcccaaggctctagctcccaacttcccaaaccattcgatcctgaaccggaggccaagtacggcacattggatgttactttcgactacgattctcaggaacagaagcttctcgttaccgtcacagctgttacagatatacctacttataatcggaccggcgggaatagttggcaggtgcacctggtgctcctgccaataaaaaaacagcgggctaagacatccattcagagaggcccgtgtccagtattcaccgaaacatttaagtttaaccacgtggagagcgagatgatcggcaactacgcagtccggttccgattgtacggagtccaccggatgaagaaggagaagatagtgggtgagaagatattttatttaactaaactgaatttacaagggaagatgtctctgcccgttatcctcgagccatcctacaatcactcaggttgcgactcccagatgagcgtctcagagatgtcttgcagtgagagcacctcatcctgccaatcactggagcatggcagtgtacccgagatcctcatcggactgctgtacaacgccactacagggaggttgagcgcggaggtgatcaaggggtcccattttaagaacttggctgcgaatagacctcccaagatggattgctcggtggtgtag

SEQ ID NO: 207696 - DNA, 1860 bp, Artificial Sequence
  Description of Artificial Sequence: Synthetic coding sequence
atggccagcgccagctggcggctgaaggtggagcgggagcccgtggaatacatgaaccttagtgtgctcgaaaaaatcggatacttctcagtggcacggctggaatatagcggtacaattctcgctcactgcaattttaggttgctcgggtccaatgatagctctgctagtgcctcacaggttacaggcaccactgtatcccccgaagcagtgggattcctgagcgcggttggggttttcatcattttgatgctgctgttgtttttgtatatcaataagaagttctgtttcgagaatgtgggcggattccccgacctggggagtgagtattccacccggaaaaacagccaagataaaatttataatagttatatggataaagacgagcatggttcctccagcgagtccgaggatgaagcccttgggaagtatcacgaggctctgagccgcactcacaatagccggttgcctctggctgactcaagacaaagaaactatgcgtgggaaacccggcagaagtattccccactttccgcggagtacgatggttactccagcgaggcaagcattgacgagggaaactgtatccagcgcatgagacgcactcctcccctggacgagctacaacctccaccctatcaggatgattccggcagccctcacctgagctgcacgcccagcgagatcggagattccaagtgcgaattctcccattgtagtaattccccaagatgcagctacaataagtgccctagtgaggggagtaccggccacgaaatcgagtcatttcataacaagggatacgaagaggacgtgccaagtgacagcacggccgtgttatcgccagaggacatgtccgcccagggctctagtagtcagctccccaaaccgttcgatcctgagcccgaagccaagtatggcactctggatgtcacctttgactacgacagccaggagcagaaacttttggtaacagtcacagccgtaaccgacatccccacctataacagaacaggtgggaactcgtggcaagtccacttggtgcttttgcctattaaaaagcaaagggctaaaacttccatccagagaggtccatgccccgttttcaccgagacattcaaattcaatcacgtggaaagcgagatgatcgggaattatgctgtacgcttccgcctttacggtgtccaccggatgaagaaagagaaaattgtaggtgaaaaaatcttctatttgaccaaactcaaccttcagggcaagatgtccctgcccgtcattctcgagccaagctacaaccactccggatgcgactcccaaatgagtgtgtcagaaatgagctgctcagagagcactagcagttgccagtcacttgaacacggaagtgtcccagaaattttgatcggactgctgtacaacgccactaccggacgtttgagcgccgaggtgatcaaagggagtcatttcaagaatttggccgcaaataggccccccaacgggctcttttgttgcctcaaacacctgattggaggacaggtttacatcatccgggacacttacgtgaaattgacgttgcttaatagcatgggacaggagatgtcgaaatgcaaaacttctatcaggagaggacagccgaatccggtctacaaggaaacctttgtcttccaggtcgccttattccagctgagtgacgtaacactcatactgtccgtttataacaagcgttctatgaagcggaaagagatgattgggtggataagcctcggattaaacagcagcggggaggaggagttaaatcattggacagaaatgaaggaatccaaaggacagcaggtctgtcgctggcacgctttgttagaatcctag

SEQ ID NO: 207697 - DNA, 1668 bp, Artificial Sequence
  Description of Artificial Sequence: Synthetic coding sequence
atggccatcgagggcggcgagcggacctgcggcgtgcacgagctgatatgtatacgcaaggtgtccccggaggcagtgggattcctgtccgccgttggcgtttttatcatattgatgctgttactgttcctttatatcaataaaaagttttgtttcgaaaacgtaggcgggtttccggacttgggatctgagtactctacacggaagaacagccaagataaaatctacaactcgtatatggacaaagacgaacacgggtcatcttcagagtccgaagatgaggccctcggaaagtatcacgaggctctgtctcgcactcataacagtaggctacctctcgccgattctcggcagagaaattatgcttgggagacgcggcagaaatatagcccactgtcagcagagtatgacggttactcaagtgaggcatctatagacgagggaaattgcattcagaggatgcgtcgcaccccacctctcgatgagctgcagccacccccatatcaggatgacagcggttctccccacctctcttgcactccctctgaaatcggtgactcaaaatgcgaatttagccactgttcaaactcaccacggtgtagttataacaagtgccccagcgaaggttccacaggacacgagatagagagcttccacaacaagggatacgaggaggacgtacctagcgatagcacagcagtgttatctcctgaggacatgagtgcccaaggatcatcctcccagctcccgaaacctttcgaccctgaacctgaggccaaatatggcaccctggacgtcaccttcgactacgattcgcaggagcaaaaactgttagtgacagtgaccgcagtgacagatatacccacctacaaccggactggcggaaactcctggcaggtgcatctcgttctgctgcccatcaagaagcaaagagcaaaaacaagcatccagcggggaccatgcccagtgtttaccgagactttcaaattcaaccatgtggagtccgagatgatcggcaactatgcagtcagattcaggctgtatggtgtacaccgaatgaagaaggaaaagatcgtgggtgaaaagatcttctacctaactaagctcaatctgcaaggcaaaatgtccctgcctgtaatcttggagccgagctacaaccactctggttgtgacagtcagatgtccgttagcgagatgagctgctccgaaagtacctcctcctgccagagtctggaacacgggagcgtccctgaaattttaatcggcttactttataacgccactacaggaagactgagcgctgaggtgattaaaggttcgcactttaagaatcttgccgccaaccggcctcccaacacctacgttaagcttaccttattgaacagcatgggccaagagatgtcaaaatgtaagacctctattcgaaggggccagcctaacccggtatataaggagacttttgtgtttcaggtggctttgttccagctctctgacgtgaccctgatcctcagtgtatataataaacgatccatgaagcgaaaggagatgataggctggatatcattgggcttaaactcgagcggtgaggaggagttgaatcactggaccgagatgaaggaatctaaaggccaacaggtgtgccggtggcacgcactgcttgaatcctag

SEQ ID NO: 207698 - DNA, 1746 bp, Artificial Sequence
  Description of Artificial Sequence: Synthetic coding sequence
atggccatcgagggcggcgagcggacctgcggcgtgcacgagctgatatgtattagaaaggtgtcccccgaagccgtcggcttcctgtccgcagttggtgtttttataatcctaatgctgctgctctttctgtacatcaataagaagttctgttttgaaaatgtgggcggatttccggaccttggatctgaatacagtactcgcaaaaactcccaggataaaatctataactcttacatggacaaggacgaacacggcagctccagtgaaagcgaagatgaggcgttggggaagtatcatgaagccctgtcccgaacacacaacagtaggctgcctcttgccgattctagacagcgaaactacgcctgggagacccggcagaagtactcgcccctcagtgctgagtatgatggctactccagcgaagcgagcattgatgaaggcaattgcatccagcggatgcgcagaaccccacctctggatgagctacaaccgccgccttatcaggatgacagcggtagtccgcacctgagctgtactccctcagaaattggagatagcaaatgtgaattttcacactgtagcaacagtcctcgttgttcgtataataagtgtccgagcgagggcagtaccgggcacgagatcgagtccttccacaataaggggtatgaggaagatgtgcctagcgatagcactgccgtactgagtccagaggacatgtcagctcaggggtcttcctcacaactgcccaaaccgttcgaccctgaaccggaggccaagtacggcactctcgatgtgacatttgattacgattctcaagagcaaaaactgctggtgacagttactgctgtgactgacattcctacgtacaaccgcactggggggaactcttggcaggttcacttggtgctcctgcctattaaaaaacagagggccaaaactagtatccagagggggccttgcccagtctttactgagacattcaagttcaaccacgtggagagtgagatgatcgggaactacgctgtcagatttcgactgtacggagttcatcgtatgaaaaaggaaaaaatagtgggtgaaaagatcttttacctgacgaagcttaatctgcaaggcaagatgagtctcccagtgattctggaaccaagctacaaccattcaggctgcgacagccaaatgtctgtctccgaaatgtcctgttcagagtctacctcttcttgccagtccctcgaacatgggtctgtacccgaaattctgatagggctgctctacaacgctacaaccgggagactctctgcagaagtcataaagggctcccacttcaaaaaccttgccgccaaccgccccccgactttccaccccctactaagcgacggcctgttttgttgcctgaaacacctgataggtggccaggtctatatcattcgggatacatacgtaaagctgactctgttaaattccatgggccaagagatgtccaaatgtaaaacctctatcaggcggggacagcctaaccctgtgtataaggaaacctttgtgtttcaagtcgccctgtttcagctctcggatgtcaccttgatcctgagtgtctacaataaaagatccatgaaacgtaaggaaatgatcggatggatctctctaggtctcaatagtagcggcgaggaagagcttaatcattggactgaaatgaaagagtctaaaggccagcaggtttgccggtggcacgctttgcttgagagttag

SEQ ID NO: 207699 - DNA, 1554 bp, Artificial Sequence
  Description of Artificial Sequence: Synthetic coding sequence
atgctgctgctgttcctgtacatcaacaagaagttctgcttcgagaacgtcggcggattccctgacctagggtctgagtactccaccagaaaaaactctcaggacaagatttataacagctacatggacaaggatgagcatggctccagcagtgagtccgaagatgaagcactcggtaagtaccatgaagcgctttctcgcacacacaacagccgtctacccctagctgattcccggcagagaaattacgcctgggaaactagacagaagtacagtcctctctccgcagaatacgatggatatagcagcgaggctagtatcgacgaggggaactgcattcagcggatgcggcgtactccccctctcgatgaactccaacctccgccctaccaggacgactcaggctcaccccacctctcgtgtacgccctcagagataggggacagcaagtgcgagttcagccactgtagcaactcacctcgttgttcctacaacaagtgtccaagcgagggatcaactggacatgagatcgagtcttttcacaacaaaggttacgaggaagacgtaccctctgattcgaccgccgtcctgagtcccgaggatatgtctgcacaagggtcttccagccagctgcccaagccctttgaccccgagccagaagccaagtacgggaccctggacgtgacattcgattatgactcccaagaacagaagctgttagtgaccgtaaccgccgtcacagacattcctacctacaatcgtaccgggggaaattcttggcaagtgcacctggtgctcctccctatcaagaagcagcgagccaaaacctccatacaacgtggaccttgccctgtattcactgagacatttaaattcaaccatgtggaatccgaaatgattggcaactacgccgtgcgcttcaggctgtacggagtacatcgcatgaagaaggagaaaatagttggagagaagattttttacctcactaaactgaacctgcagggaaagatgtctctccctgtgattctggaacctagctacaaccactccggctgcgacagccagatgagcgtgagcgaaatgtcatgcagcgagagcactagctcttgccagagcttagagcacggttctgtgcctgagatcctgataggtctcctctacaacgcaaccaccggacgtctctctgcagaggtgattaagggatctcattttaaaaacctcgccgcgaacagacccccaaacacgtatgtcaaactgactttgctgaacagcatgggccaagagatgtccaaatgcaagacaagtattaggcggggccaacccaatcctgtatacaaagaaacgtttgtcttccaggtagctctgtttcagctaagcgacgttaccttaatcctaagtgtctataataagcgttcaatgaagcgcaaggagatgataggctggatcagtctcggcctaaattcatctggggaagaggaactcaaccactggaccgaaatgaaggagtctaagggacagcaagtgtgccgctggcatgctcttctggagagttag

SEQ ID NO: 207700 - DNA, 1266 bp, Artificial Sequence
  Description of Artificial Sequence: Synthetic coding sequence
atggccgagcagctggccctggtgatcggcggcaccatcggcggcctcctgctcttgctgctgatcggagcttcatgctgtttgtggcgccgattctgcgccactctgacctatgaagagcttccaggcacacccgcaatggctacaactgcggccagttcagggcaacgtgatcggccgtgtcagcctcatgcccggacacagcttagtagaccgcctgccgtaccattcgttgttccccctaccctgcaaggtcgtgactgggtaccactgcatagcggagaatgggctgacgccccatgggacccttgcccagcatctgaactcttgccgcacacctcctccggggggctcggtgacgcatgcatggtgggagccataaacccagaactatacaagttccctgaagacaagagcgagaccgacttcccggacggttgtctcggccggctttggttctctgtggaatacgagcaggaagctgagagattgttggtgggactgatcaaagcccagcacttacaggcgccatccgaaacatgtagccccctggtgaagttatacctcctgccggatgagagaaggtttcttcagtctaagactaagagaaaaacatctaacccacagtttgatgagcactttatcttccaggtgtcgtctaagacaatcactcagagggtgctaaaattctcagtgtaccatgtcgacagacagcgcaagcaccagctgctcggccaggtgctctttccgttgaagaacgaaacattagtgggcgattgtcgccgggtgatatggagagatttggaggccgaaagcctggagcctcctagcgagttcggagaccttcagttctgcctgtcgtataatgattacctcagtcggcttacagtagtggtgcttagagcaaagggccttcgcctgcaggaagaccgcggtattgtgagcgtttttgtgaaagtatcactcatgaaccataataagttcgttaagtgtaagaaaacaagcgcagtactgggaagtattaacccggtgtataacgagacattctcattcaaggccgatgccaccgaattggatacagcttcacttagcctgacagttgtgcagaatatggagggcgataagagccaacagctcgggcgggttgtggttggtccctacatgtatactaggggcagggaactcgaacactgggatgaaatgctgagtaagcctaaagaactggttaaacggtggcacgccctgtgccggaccactgaaccctag

SEQ ID NO: 207701 - DNA, 1425 bp, Artificial Sequence
  Description of Artificial Sequence: Synthetic coding sequence
atgggcgtggtgctgagcccccaccccgcccccagccggcgggagccccttgcacccctggctcctggcacacggccaggatggtctcctgccgtcagcgggtccagccgctcagccttaaggccttccactgccggccctggccctggaccgggaaccggatggggaggtaccgctgcaagcggccggtgggtgcctgccccagcagtacattgcgcggctcctagggccgcagctgggcatcaacagcaccatggcccacctttgtgttcaccagacggagcacctcgccggtttaagaggcggccaggcagccccgcccctgccgcccagacaggtgagacatcccttcgcgaacagcctcacggagggcctcctgccgtgccatttgttgtccccccaaccctgcaaggtcgtgattgggttccactgcactccggggagtgggcggacgccccttgggacccttgcccggccagcgagctactgccacataccagcagtggtggcctcggtgatgcctgcatggttggagccatcaatccagagttatacaagttcccagaggataagagcgaaaccgattttcccgacggatgcctgggacgcctctggttctcggtagagtacgagcaggaagctgaacggctgctggtggggctaattaaggcccaacatttacaggccccttctgaaacttgctctcccctcgtgaagctgtacctgctgcccgatgaacggaggtttttacagtccaaaacgaagcgcaagacctccaatcctcaattcgatgaacactttatctttcaagtgagctctaaaaccattacccaaagagtgctgaagttcagtgtgtaccatgtggatcggcaaagaaaacaccagctcctggggcaagtgttgttccccctgaagaacgaaacactggtaggcgattgccgacgcgtgatatggagagatcttgaggccgagtctctggagccgccatccgagttcggcgatctacagttctgcctgtcatacaatgactacttgtcaagactgaccgttgtcgtgttgagagctaaggggctgcgcctgcaggaagacaggggcatcgtgtcggttttcgtaaaggtttctctaatgaatcacaataaatttgtgaaatgcaaaaagacctctgcagttctgggctccatcaaccccgtgtacaacgagacattttcctttaaagccgacgccacagagttggacaccgcaagcctttctcttacagttgttcagaatatggagggggataagtctcagcagctcggccgggtcgtggtgggtccgtacatgtatacccggggccgcgagcttgagcattgggacgaaatgctcagtaagccaaaggagctcgtgaagaggtggcacgccctatgtcgcactaccgagccgtag

SEQ ID NO: 207702 - DNA, 1173 bp, Artificial Sequence
  Description of Artificial Sequence: Synthetic coding sequence
atggccgagcagctggccctggtgatcggcggcaccatcggcggcctactgcttctgctcttgatcggcgcgtcatgctgtctctggaggagattctgcgccactttgacatatgaggaactccccggaaccccggcaatggccaccactgctgcctcaagtgggcagcgcgatcgtccttgtcagccacacgctcggacccagctctccagacctccagccgtgcccttcgtcgtccctcccaccctgcaggggcgagattgggtcccacttcattcgggcgaatgggcagatgccccatgggatccttgcccagcatccgaactcctaccacacacttcctccggcggcctcggtgacgcctgtatggtcggagcgataaaccctgagttgtataaattccccgaagacaagtccgaaacagattttccagacggttgtcttggtcgactgtggtttagtgtcgagtacgagcaagaagcagaacgccttctggtaggccttattaaggcgcagcacctccaggcaccgtccgagacgtgctctccactggtaaaactatacctcttgcctgatgaacgacgatttttgcagtctaagacaaaaaggaagacctctaatccacagttcgatgaacatttcatttttcaagtttcatctaaaactattactcaaagggtgctgaaattctcagtgtaccacgttgaccgccagcgcaagcatcagctgctgggacaagtactctttccgctgaagaatgaaactcttgttggcgattgccgccgggtgatttggagagatctggaagccgagtccttagaacccccctccgagttcggggatttacaattttgcttgagctataatgattacctgtccagactcacagtcgtggtcctccgcgccaaaggactgcggctgcaggaagaccggggtattgtatcggtcttcgtgaaggtgtctttaatgaatcacaacaagtttgtgaaatgcaaaaagacatccgctgtcctcggatccatcaatccagtgtataacgagactttcagctttaaagcagatgcgacagaattggacacagctagcctgtccttgacagttgtgcaaaatatggagggggataagcaggccaccacggtggagctgtttctcttccacctcacatctggatag

SEQ ID NO: 207703 - DNA, 543 bp, Artificial Sequence
  Description of Artificial Sequence: Synthetic coding sequence
gacgagcacttcatcttccaggtgagcagcaagaccatcacccagagagtactgaagttcagcgtttaccacgtcgatagacaacggaagcatcagctcctcggacaagttttgttcccactgaagaacgagacactggtgggagactgccggagggtcatctggcgggacttggaggccgaatctctcgaaccaccctctgagttcggtgatctccagttctgtctttcctataatgattacctcagccgcctgacagtcgtcgtgctgcgggcaaagggtttaagactgcaagaggaccggggaatcgtgagtgtgttcgtcaaggtgagcctcatgaaccacaacaaattcgtaaagtgcaagaagacgtctgccgtgctcggctcgatcaaccctgtctacaacgaaactttcagttttaaggctgatgctactgaactagacactgcgtcactgtccctgactgtagtgcaaaatatggagggagacaaacaggctacaacggtggaactcttcctttttcatctgacatccggttag

SEQ ID NO: 207704 - DNA, 783 bp, Artificial Sequence
  Description of Artificial Sequence: Synthetic coding sequence
atggtgggcgccatcaaccccgagctgtacaagttccccgaggacaagtctgagacttgctctcccctggtgaagttgtatttgcttccagatgaaaggcgatttctccagagcaagaccaagcgcaagacaagtaatccccagttcgatgaacacttcatatttcaggtgagttcaaaaaccataacccagcgcgttctgaaattctccgtgtatcacgtcgatcgccagcggaagcatcagctgttaggtcaggtgcttttccccctgaaaaacgagactctcgtgggcgactgtcgccgggtcatttggagagacctggaagccgaatccctggagcctccgagtgagttcggtgacttacaattttgcctgtcatacaatgactacctgagtcggctaacagtcgtcgtgcttcgcgcaaagggtcttcggctccaggaagacagggggatagtgagtgtgttcgtaaaggtgtccctcatgaaccacaataagttcgtgaagtgcaaaaaaacgtccgctgtgctgggttccatcaaccccgtgtacaacgagacgttctcattcaaagccgacgcaacagagctggataccgcgtcattgtcgctgacggtcgtccagaatatggagggtgacaaatcacaacagctgggcagagtggtggtaggtccctacatgtacacccgggggagggaattagagcactgggatgagatgctgtctaagcccaaggaactggttaaaaggtggcatgccttatgtagaaccaccgaaccttag

SEQ ID NO: 207705 - DNA, 1047 bp, Artificial Sequence
  Description of Artificial Sequence: Synthetic coding sequence
atggccgagcagctggccctggtgatcggcggcaccatcggcggcctgctgctgcttcttctcataggagctagctgctgtctatggaggagattctgcgccactctgacatacgaggagctgcccgggacgcccgctatggccaccactgccgcgtcctcgggccagagggatcgtccttgccagcctcacgctaggacccagctcagtagaccgcccgcggtccccttcgttgtccccccgacgctgcagggtagagactgggtcccactgcactccggggaatgggcagacgctccatgggatccttgtcccgcttccgagctgttaccccacacaagctcaggtggcttgggggatgcttgcatggtcggcgccataaaccctgaactttacaagttcccagaggataaaagcgagactgattttccagatggatgtctgggtaggctctggttcagcgtggagtacgagcaggaggctgagcgcctgttagtgggacttataaaagcccagcacctgcaagcaccttcagagacctgttcccctttggtaaagttgtatctactgcccgacgaaaggcggttcctccagagtaaaacaaagcgcaagaccagcaatccacagtttgatgagcactttatcttccaggtgtcgtcaaagacgattacacaacgagtgttaaaattttccgtctaccacgtggaccgccagcgtaaacaccagctcctgggccaggtgctcttccctctgaagaacgaaactctggtcggcgactgcaggcgggtgatttggcgcgatctcgaggccgaatcgctggagccaccatctgagttcggggatctccagttctgtttaagttacaatgactacttgagccgacttactgtggttgttctccgggccaagggactgcgcctgcaggaggaccgggggatcgtcagtgtattcgttaaagtctctcttatgaaccacaataaattcgcaaagtgtaaacccgggcccgatttaggcgaggagagcagagggtcgctgaacttaaaatag

SEQ ID NO: 207706 - DNA, 1173 bp, Artificial Sequence
  Description of Artificial Sequence: Synthetic coding sequence
atggccgagcagctggccctggtgatcggcggcaccatcggcggcctattgctgctgcttttgataggcgcatcgtgttgtctgtggaggagattctgcgccaccctgacctatgaagagctcccgggaacccctgctatggctactacggccgcatcttccggccaacgcgatcgcccctgccagccacatgcgcgcacacagttgtctcgcccgccagcggtgccattcgtcgttccccctactctgcagggccgagattgggtgcctctacacagtggggagtgggccgacgctccatgggacccttgtccagcaagcgaactcctgccacacacttcatcggggggtctgggggatgcatgtatggtgggggcgataaaccctgaactttacaaatttcctgaggataaaagcgaaacggacttccccgatggttgtttaggcaggctgtggttttccgtggaatacgaacaggaggccgaacgcctcctggtgggcctaattaaagcacagcatctgcaggccccctctgaaacttgtagcccattagtgaagctatacctccttccagatgagcgcagattcctgcagtccaagactaagaggaagaccagcaacccacagtttgacgagcacttcatcttccaggtgagcagcaaaaccataactcagcgggttctcaagttctccgtctatcatgtggatagacagaggaaacaccagttattgggccaggtattgtttccactgaaaaacgaaacgctagtgggagactgtcgacgcgttatctggagggatctggaggccgagagtctggaaccaccttcggagtttggcgacctgcagttctgcctctcctacaacgactacctttcccggctcacagtcgtagttttgagagcaaaggggctgcgcttgcaggaagacaggggtatcgtgtccgtgttcgttaaggtgagtttgatgaaccataacaaattcgtgaagtgtaagaaaacgtctgccgtcctcgggtctattaacccagtgtacaacgagacatttagttttaaggcagacgccaccgagctcgataccgcaagtctgagtctcacagttgttcagaatatggaaggagacaagcaggccaccacggtggaactctttctgtttcacctcactagcggttag

SEQ ID NO: 207707 - DNA, 1152 bp, Artificial Sequence
  Description of Artificial Sequence: Synthetic coding sequence
atggtgctggccatggccagccaggacgtgcagaacttcttccagcctttttcttcatggatttcccgtgtgtatgaggccctgcaacaggctggggacatgctcagtgcttccctagtcaatattagcaagcaagattcaaagctgagcgataaattggaccaggatctggataacatccagatccaggagacctacttcgaggacgaggagcaggataacgattggtcacaggaggatgcgaatagcctgttccttgaagtagaccactttagttgttgcaatagcgacctccaggactccgcccagaattcaagtccatccctgtcccaacacgccaaagactcttgcagtaccatgagtcagtggcctaactgggctagtgacgataggaagttgccccacgtgttgtctagtattgctgaagaggaacaccacctcgaaaagcaacgcagcggtctacaacatggctttgactcgcagctgcctggtacgctggagaccgtcaacggaaagaaacaggttaattcttttggcgatgatgaagagctatcgacaagttctgacagcgatgaagaggtcatcaagcaattcgaaatttccgtcagcaggtcgcagtctttcaggtctgtaacatccgagaaagggaaacagactggactggagcagaagcccaagttcagcaggtcgctactcacccatggcgaagatggaacggaggtgtccgcgtgtgaagatcttgacggtgccagccagcggaggtactcagagaatctctcctacggggaggatgaccatattcctgcccacagccagagcccatgcgagagaggagatgccaagcatcacggaacctcacaccaagagagctcagtggtgcagagcttaagaaggcaaagtaccgagggttcactggagatggaaacagccttcaattccaggggtttcgaggactcttatgcgacagactcctcaagcatgtggtctccagaagctaacctgaatcttaaacgcaagggctacttgctggacgtgtattgcctttcaagccctctcttattcaccacatctttgcaccggcggaaccggactggccctatttgcagatgccacccaggtagtcagagcccctcgcagtctgtcgtgacgtag

SEQ ID NO: 207708 - DNA, 1938 bp, Artificial Sequence
  Description of Artificial Sequence: Synthetic coding sequence
atggtgctggccatggccagccaggacgtgcagaacttcttccagcccttctccagctggattagtcgggtctacgaggccctccaacaggctggagacatgctttccgcatccttagtaaacatctccaagcaagactctaagctgagtgacaagctggatcaggacctggacaacatacaaattcaagaaacatattttgaggacgaggaacaggataacgactggtcacaagaagacgccaattccctgttcctggaagtggaccatttctcctgctgtaacagcgatctgcaggactccgcccagaatagctctccctcactttctcagcacgctaaagatagttgctctaccatgagccagtggcccaattgggcctccgatgaccgaaagctgccgcatgtcctttcatccatcgccgaggaagaacatcacctggagaaacagagaagtggccttcagcatggcttcgactcgcagttaccagggacgctggagaccgtgaacggtaagaagcaagtgaattcctttggagatgacgaagagctgagtaccagctcagactctgacgaagaagtgatcaagcagttcgagatcagcgtctccagatcgcagagctttagaagcgtgaccagcgaaaagggtaaacagacaggattggagcaaaagccaaagttctcaagaagtctgctgacccacggagaagatgggactgaggtgagcgcctgcgaagacctggacggcgccagccaacggcggtacagcgaaaacctttcttatggagaggacgatcatattccagcacactcccaatctccgtgtgagcggggggacgctaaacatcatggaacttctcatcaggagtcctcagtagtccagagcctgaggaggcagagtacagaaggcagcctggagatggaaaccgctttcaatagccggggcttcgaggacagttatgccaccgactcttccagcatgtggagtccagaggaacaggaccgcaccaacctgcaagtcccaagtggcgtttcagaaccgattagcaagtgtggcgatcttgacgtaatttttgagtatagagctgcaagccagaagctgacagtgaccatcgttcgagcccagggcctccccgacaaagacagatctggagtgaatagctggcaagtccatgtggtgctgctccccggaaagaaacatagaggccgcacaaacattcagcgggggcccaatcccgtgttccgcgagaaagtgacttttgccaaactcgagccaagagacgttgccgcatgtgccgttagatttcgcttgtatgctgcccgtaagatgacaagggaaaggatgatgggcgagaagcttttttacctttcccacctgcacccggagggcgaaatgaaggtcaccctggtgttggaaccccgctcgaacatcagttccggcggttctccgctgagcccaagcgctgtgagccactcagattcaacaagtagcacccagtccttgagtcatggcggcgctccagaactccttgtcggcttgagctacaatgccactacaggcaggttaagtgtggagatgattaagggcagccacttccgcaacctggccgtgaaccgcgcgcccgatacttacgggaagctgtttctgctgaattccgtgggtcaggagatgtcccgctgtaaaacctcaatccgcaggggacagccaaatcctgtgtataaggaaacttttgttttccaggtggctttgttccagctctctgatgtgactctcatgatttcagtgtacaaccggcggacgatgaaaagaaaggagatgataggatggatcgcattgggtcagaattcctccggggaggaggaacaggatcactgggaggagatgaaagagactaaaggtcagcagatttgccgttggcacactttgcttgagagctag

SEQ ID NO: 207709 - DNA, 1653 bp, Artificial Sequence
  Description of Artificial Sequence: Synthetic coding sequence
atgccccagcggggccaccccagccaggagggcctgtgggccctgccttccctgcctatggcacatggaccaaagcccgaaactgaggggctgctggatctgtccttcctgaccgaagaagaacaggaggcgattgctggggtgctgcagcgtgacgctaggctcaggcaactggaagaaggccgagtatccaagctgagggctagcgttgccgatcccggtcagctgaagatcctcacaggagattggttccaggaggcaagatcgcagcgccaccacaacgcccacttcggctcagacttggtgcgcgcttcaatgagaagaaagaagtctacccgaggagatcaggctcctggtcatgatagggaagccgaagccgcggtgaaggagaaggaagagggtcccgagccccggttgaccatcgatgaggcccctcaggagaggctgagggagaccgaggcctccgatcccgaggaggcctctcaggcccaggaggatccaggccagggcgatcagcaagtgtgcgcggaggaggcagacccagagctggagcccgcttccggcggtgagcaggagccacggccccagcaagcacaaacaaaggcggctagccagattctggaaaatggcgaagaggcccccggcccagatccatcccttgataggatgttgtcaagttcctcttccgtaagctctctgaactcttctaccctgtccggtagccagatgtctctttccggggatgccgaggctgtacaggtccgagggtcggttcactttgccctgcattacgagccgggggctgcggagctgagagtgcatgtcatacagtgccaggggctggccgccgcacgccgaagacggagcgacccatatgttaagagctacctccttcctgataaacagagtaagcgaaagaccgcagtgaagaaaagaaacctgaatccggtgtttaacgagactcttaggtatagtgtgccacaggccgaactgcagggcagggtgctctcccttagcgtgtggcaccgagagagcctcgggcgaaatatctttctgggcgaggttgaagtgcccctcgatacatgggactgggggagtgagccgacatggctgcctcttcagccccgtgtgcccccaagtccagatgacttaccatctcgaggcttgctggctctgtcactgaaatatgtgcccgctgggtcagaaggagctggcctccctcctagcggcgagttacacttctgggttaaggaagcgagggacctcctgcctctccgggccggaagtctggacacatatgtccagtgtttcgtgttaccagacgactcgcaggcctctaggcagagaacacgtgtggtaaggcgctcactcagcccagtgtttaaccatacaatggtctacgatggttttggccctgctgacctgcgtcaagcttgcgctgaactaagcctttgggaccatggcgcattggccaatcggcagctgggcgggaccaggctgagccttgggaccggctctagctatgggttacaggtcccttggatggactccacccctgaggagaaacagctttggcaagccctgttggagcagccctgcgagtgggtggatgggcttctgccattgaggaccaatttagcacccaggacctag

SEQ ID NO: 207710 - DNA, 231 bp, Artificial Sequence
  Description of Artificial Sequence: Synthetic coding sequence
atgccccagcggggccaccccagccaggagggcctgtgggccctgccttcccttcccatggcccacggacccaagcccgaaaccgagggcctgctggacctgagcttcttgaccgaggaggagcaagaggcgatagcgggcgtgttgcagcgcgacgctcgcttaaggcagctggaggagggacgagtgtcgaaacttcgggcctccgttgccgacccaggccagctgtag

SEQ ID NO: 207711 - DNA, 1065 bp, Artificial Sequence
  Description of Artificial Sequence: Synthetic coding sequence
atgccccagcggggccaccccagccaggagggcctgtgggccctgccatcgctgccgatggctcatgggccaaaacctgaaaccgaagggctgctggacctgagcttcctcacagaagaggagcaggaagccattgctggggttctgcagcgggacgctcgactccgccagctagaagaaggcagggtttcgaaattgcgagcctctgtagctgacccgggccagcttaagatcctaactggcgattggttccaggaagctaggtctcaacgccaccataacgctcactttggaagtgacttggttagggcctccatgcggcgtaagaagagcacaaggggtgatcaggcccccgggcacgatcgtgaggccgaagcggccgtgaaggaaaaagaagaggggcccgaacccaggctgaccatcgacgaagccccccaggaaaggctcagggagaccgagggccctgacttcccctcgccttccgttccattaaaggcatcagatcccgaggaagccagccaggcacaggaagaccctggacagggggatcagcaagtctgtgccgaggaagccgatccggagttagagcccgccagtgggggcgagcaggaaccgcggccacagcaggcgcaggtgggcggctcaggcccatggctgttatcaacaagcggcgccgactccgggcgcggggctcttcttccaagggcagctagtcgcccacgaccgagagctttgggtgccggggtgggcaaagaaggcgcccccaggcaccttccaccattgcagaccaaggcagcctcacagatactcgaaaatggcgaggaagcccccggcccagatcctagcttggatcgaatgctcagttcaagttcctccgtaagcagcctcaatagctccacattgagcgggtcgcagatgtccctgagtggcgatgccgaagcggtacaggtgagaggctccgtacatttcgcgctgcattatgaacctggtgccgcagaactgagagtgcacgtgatccagtgtcagggacttgccgcggcaagacgacgtaggagcgacccatag

SEQ ID NO: 207712 - DNA, 606 bp, Artificial Sequence
  Description of Artificial Sequence: Synthetic coding sequence
atgggcaccaccgccctgctgggcggcgtgcggctgagcgagaccattccggttaagagactggcgcgcggcctggccagagtcagggacggagggtggggctccccccaggctggcgagaaggctctcggaggcccgttgttaactagtgggagtcacctcccctcatacgtgaaaagttacctgctcccagacaaacagtctaaacggaaaacggccgtcaaaaagaggaaccttaacccagtgtttaatgagactctgcgatactcggtcccccaagcagagttgcagggacgggtgctctcactctctgtgtggcatagagaatcactgggccggaacatatttctgggagaggtggaagtccccctggacacctgggattggggctccgaaccaacatggcttcctttgcaaccaagagtgccaccctcaccagatgatctgccctccagaggtctcttggccttatcgctgaagtatgtaccagcaggctccgaaggcgccggactgcccccctccggcgaactccatttctgggtgaaggaggcacgcgacctgctacccctcagggccgggtccctggacacatatgtccagtggtag

SEQ ID NO: 207713 - DNA, 1083 bp, Artificial Sequence
  Description of Artificial Sequence: Synthetic coding sequence
atgccccagcggggccaccccagccaggagggcctgtgggccctgccgagtctcccaatggcccacggacctaagccggagacagaggggctgctagacttgagctttctgactgaagaggagcaggaggcgatcgccggcgtcttgcagagagacgcccgactcagacaactcgaggaggggcgggtttcaaagctccgggctagtgtggcagacccagggcagctaaaaatactcacgggggattggttccaagaagccagatctcagaggcaccataatgcacacttcgggtcagacctggtgcgtgcttccatgagaaggaaaaaatccactcggggggatcaggctcccgggcacgaccgggaagcagaagccgccgtgaaggagaaagaagagggccctgagcctaggctaactatagacgaggccccgcaggaaaggctccgagaaactgaaggcccggatttcccttcacctagtgtgcccctgaaagcttcagaccctgaagaagcctctcaggcccaagaagatccaggccagggagatcaacaggtttgtgctgaggaggcagatcccgagctagaaccggcttctggtggggagcaggaaccaagaccacagcaggctcaggtgggtgggagtggaccatggttacttagtacttctggagcagattctgggagaggggcacttctcccacgcgccgcgtcaaggccccgcccacgagcacttggcgcaggggtgggaaaagaaggcgccccacggcacctcccccccctccagaccaaagccgcatcacagattctcgagaacggagaagaggcgcctgggcctgatccaagccttgaccggatgttgtctagctcttcctcagtgagcagtctcaatagttccaccgtacgccgagagggcggcgatccagggggccgcggggttgatccttttcggtgcgttgcccctgcatgcccatcactagctgcaggtcctacagcagcagcaccacaacccgccacatatgatccaggactgaagcctccacgctgtcccagacctcgcagggagccctgtgagagaccatag

SEQ ID NO: 207714 - DNA, 879 bp, Artificial Sequence
  Description of Artificial Sequence: Synthetic coding sequence
tgaccccggccccagcaggcccaggtgggcggcagcggcccctggttgctgagcacaagcggcgcagattcaggtcgtggagcgttactgcccagggccgcctctcgcccgcggccgcgcgcactgggggccggcgttggcaaagaaggcgctccaaggcacctcccccccctccagaccaaggctgcctctcagatactggagaacggcgaggaagcgcccggccctgacccgtctctggatagaatgcttagtagtagttcttctgtgtcttctctcaatagttcaacattatccggctcacagatgtctttgagcggagatgcagaagccgtccaggtgcgggggtctgtgcacttcgccctccactatgagcctggggccgctgagctgagagtgcacgtaatccaatgtcagggcctcgccgccgcccgcaggcgacgtagtgatccctacgttaagtcctatctgctgccagacaaacagtcgaagcgaaagaccgctgtgaaaaagagaaacttgaatccagtatttaacgaaacccttcgctactcggtcccccaagcagaactacaagggcgcgtcttgagcctgtctgtctggcatagggagagtcttgggagaaacattttccttggcgaagtcgaggtgccattggacacctgggactgggggagcgaacccacctggttgcccctgcagcccagggtacctccatcccctgatgacctcccaagccgcggtttgctcgcactgtcactgaaatacgtaccagccggcagcgagggtgcaggtctccctccgtcaggggaattgcacttctgggttaaggaagcccgggatctgctcccattgcgcgccgggtctctggacacctag

SEQ ID NO: 207715 - DNA, 1689 bp, Artificial Sequence
  Description of Artificial Sequence: Synthetic coding sequence
atgccccagcggggccaccccagccaggagggcctgtgggccctgccaagtctgcccatggctcatgggccaaagccggagacggagggtttgctcgatctcagttttcttaccgaggaggagcaagaggcgatcgccggcgtgctccaaagggacgcaaggcttcgacagctcgaggaaggtagagtatcgaagctgcgtgcttctgtggccgatcccgggcagctgaaaattttaacaggcgattggtttcaggaagcaagatctcagcgccatcacaacgcccactttggaagcgacctggtgagagcctcaatgcgccgaaagaaaagcacgaggggggaccaggctcctggtcacgaccgtgaagccgaggccgcagtgaaggaaaaagaggagggacctgaaccccgactaactattgacgaggccccccaggagcgcttgagagaaaccgaggggccagatttcccctctccaagcgtgcccctgaaggcatccgaccctgaagaagctagtcaagcacaggaggatcccggacagggagaccagcaggtgtgcgcagaggaggccgacccggagctcgagccagccagcggcggagagcaggaaccccgcccgcagcaggcccagaccaaagcagcgagccaaatcctcgaaaacggggaagaagctcctggcccagaccccagtctggatcgaatgttgagttcatcctcatctgtgtcctcactgaactcctccacactatccggctcccagatgtcgctgtcaggagacgctgaggctgttcaggtgcgtggctctgtacacttcgcgttgcattatgaacctggcgccgcggaacttagggtccacgtcattcaatgccagggtttagccgcggcccggaggcgaaggtccgacccatatgtgaagtcctacctcctgcctgataagcagtctaagaggaaaacagctgtaaaaaaacggaatctcaatcctgtgttcaacgagacactccggtactctgtccctcaagccgaattacaagggcgggtgctctctctatcagtctggcatcgggagtccctgggtcgaaatatattcctcggagaggttgaagttcccctggatacatgggattggggaagcgagcctacatggcttccactgcagccccgcgtgccaccatcccccgacgaccttccctccaggggattgcttgccctatccctcaagtacgttcctgcagggtctgagggcgccggtctaccaccgtccggagagcttcacttttgggtgaaggaagcccgggacctgctgcccttgcgggccggctccctggacacttacgtccagtgttttgtcttgccagacgattcacaggcttcacgccaacgcactcgcgttgtcaggcggagcctaagccctgttttcaaccatacgatggtttacgatgggtttggacctgctgatctccggcaggcttgtgctgagctctctctttgggaccacggcgccttagctaaccgtcagcttgggggcactaggcttagccttggaactggatccagctacggactgcaggtcccgtggatggacagtactccggaagaaaagcagctgtggcaggcactgcttgagcagccctgcgaatgggtcgacggactgttgcctctgaggactaatctcgctccacgcacgtag

SEQ ID NO: 207716 - DNA, 2808 bp, Artificial Sequence
  Description of Artificial Sequence: Synthetic coding sequence
atgatcgacctgagcttcctgaccgaggaggagcaggaggccatcatgaaggtactgcagcgtgacgcggccctcaagagggccgaggaggagagggttcgccacctgcctgagaagatcaaggacgatcagcagctcaaaaacatgtcaggtcagtggttctacgaggccaaagcgaagaggcacagagacaaaattcacggggctgatatcatccgcgccagcatgcggaagaaaagaccacaaattgctgccgaacaaagtaaggatcgcgagaatggtgcgaaggagagctgggtgaataacgtgaataaggacgcgttcctgccccctgagttggctggcgtggtggaggagccggaggaagatgccgcccctgcgagcccaagttccagtgtggtgaaccccgccagcagcgttattgatatgagccaggagaatacacgaaaacccaacgttagtcctgaaaagcagagaaaaaacccctttaacagcagcaagctacccgagggacattcttcgcagcagactaagaacgagcagagcaagaatggcagaactggattgtttcaaacgtcgaaagaggatgaactctccgagtccaaggagaagtcaaccgtggcagataccagtattcagaaactggagaaatctaaacaaacactgcctggtcttagtaatggcagtcagatcaaagcccccatcccaaaggctcgcaagatgatttacaagagtacggatctcaataaagacgacaaccagagctttccacgacaacgcactgactctctgaaagcacgaggcgcaccccggggaatccttaaaaggaattcaagctcctcatctacggactcagagaccctaagatataatcacaattttgaaccgaaatctaaaatcgtgtccccgggcctgaccattcatgaaaggatcagtgagaaagagcactccctggaggacaattcaagtccaaatagcttggaaccactgaaacacgtgcgattttctgctgtgaaggacgaactcccgcagtctcccggactgatccacggcagagaggtgggggaattctccgtgttagaaagtgacaggcttaaaaacgggatggaggacgcgggagacaccgaggagtttcaatccgacccaaagccatcccagtatcggaagcccagcctgtttcatcagtcaacctctagcccatacgtgtcaaaatctgagacgcaccagcctatgaccagcggctccttccctatcaacggactgcattcccatagcgaggtactaaccgctcgaccgcagtccatggaaaattctcccacgattaatgagccgaaagataagtcatccgaactgacacgcttggagtcagtgttacctcgttcccctgcggatgagctcagtcattgcgtggaaccagaaccctcccaggtaccaggcgggtccagcagagataggcagcagggttcggaggaagagccctcgcccgtcctaaagacccttgagaggtccgcagccagaaagatgcctagtaaatcactagaagatatatcatcggattctagcaaccaggccaaagtggataaccaacctgaggaactggttagaagcgccgaggatgtttctacagtccccacacaacccgataatccattttcacatcccgataagttgaagaggatgtcaaaatccgtccccgctttccttcaagacgagtccgatgaccgggaaacggacacagccagcgagtcttcctaccagctgtcacgccataagaagtccccctcgagcctgacgaatctgtcttcaagctctgggatgacttcgctgagctcagtctccggtagcgtcatgagtgtgtattctggggatttcggaaatctagaggttaagggaaacattcaattcgcgatcgaatatgtcgaaagcctgaaagaactgcatgtgtttgtagcccagtgtaaggacctcgcagcagcagacgtgaagaaacagcgttccgacccgtacgtaaaagcctacctgctacctgataagggcaagatgggaaaaaagaagaccctagtggtcaagaagacactcaaccctgtgtacaacgagatcctgcgatacaagatcgagaagcagattctcaaaacgcagaaactgaacctgagtatctggcacagggatacctttaagcgaaattctttcctaggagaggtggaattggacttggagacttgggattgggacaataaacagaacaaacaacttcgttggtacccgctaaagcgaaaaacagcccccgttgccttggaagccgaaaacaggggcgagatgaaattggctttgcagtacgttcctgagccagtgcctggtaaaaaactgccgactaccggcgaggtgcacatctgggtgaaagagtgtttggacttgcccctgctgcggggctctcacttgaatagctttgttaagtgcactatacttccagacaccagtagaaaatccaggcagaaaactagggcagttggaaagaccaccaatcctatctttaaccacaccatggtatatgatgggttccgccctgaagatttaatggaggcctgtgtcgaactgaccgtctgggatcactacaagttgacaaatcagttcctgggtgggttgcgtatcggttttgggacaggaaagagctacgggaccgaggtagattggatggatagtacaagcgaggaggttgctctctgggaaaagatggtcaacagtccaaatacttggatcgaggccaccttgcctctcagaatgctgctcatcgccaaaatcagcaagtag

SEQ ID NO: 207717 - DNA, 3819 bp, Artificial Sequence
  Description of Artificial Sequence: Synthetic coding sequence
atggacgagcccaacgccgagcaggtgtacaaccccagccagttcgaaaatctgcgcaagttctgggaccttgaggctaatagcaacagtaaggacaacgacaagaacatcacaacaacttcacagaagaactccgcaccctttaataggcagaaacacaaggagttcagcgatattaaactaagcggcaagaacacacatgaggcggaagtcctcctatccccgaagaaggtcatggcccgagaagagatggagaaactgaattctaagggtatcctccaggtcctgcccgacgaaataaccttccctctgtcaccgctgcgcaaatacacatatcagcttcctggcaatgagtcttctaaagaaaatgttgagaaaaatacagagggcattgtcacccccgtgtttaaggaagagaaggattattcagaacaggaaattcaggaatcaatcatcaagaccaatgtgctgagtaaggattgcaaggacacttttaatgacagtctccagaagctcctatccgagaccagcactccagcaattcagccaagtggtgggaaagtccacggaaagcaggtgctggagccgtcagtttcagagaataggacctggccccagaaaaccgattttgccgacacggaggaagaggtgaagggcccagaaaagataatcaacgagcatgttgataaaacggtggtgcaccccaaggtcaaaagaaacagcctgactgcctctttagataagctgctcaaggaagccaccgggacgtcccccagtcccctccaagcgaaactggccccagtgattaccggaactaactccaagctggaagaagggagattcttcggcaagggcatcgagcaaagccataacacatccgcggataagagggagattttggccccctttccggtacgtgatgagacgtttggtaatacagccctgctgaagaaagctgaatctggcgagtgtcagctctcgacacagaatctgatccagatggcggcagaggacagtcaccctctggaccccactagccaactttcacgcaagggctcattcggcgacgttgccagtcctccacaggacatgctgtttccacaagatgctcacttggtcccccaggcccgggtgcatcccagccaaacagagattagtgaaaccgtagaaaaagtcatactcccaccccggcctgtcctgaatgatgtttcagccgctctgcagaaattgtgtggcgaggtatggctgagttacccagccggacgggaagtgggtcctggagaggtgaatccggagtttccagaagccgtgcaacccgtttgttcacccctcaaccccccgggtgttatcagtccatgggcgaccatggatacgatcgttcctgacagaaaggacttctattccagcaacgtcgtgcccgataagacacacgaagtggggtcatatttagctgcccagatgtcccccagtgaccagactttgtcttcgttcgcaagcatcgtagcgcagtacggaaaaggactgccccaggaggtggaagagatcgtgcgtgagaccattgtacaaccgaaaagtgagtttctcgaattctctgcaggccttgagaagctgctcaaagaggagaccgagacttttccctccaagtatgagtccgatacaggcaacctgtctccaagcaaacttattgggagcaccgaggagccccgaagagctacatccgaatgtcacccagaagaacttaaggaaactgtcgaaaaggctgaagcccctttgatcactgagtcggcctttgacgccggattcgagaaattactgaaggaaatcaccgaggctcccccctatcaaccccaggtgtctgtccgagaggagacccacgagaaagagagctcccagagtgagcaaaccaggttcctcggaaccgtcccgcatttctaccgggccgccagtcagacctctgagatgaaagataagagcaatggtctggaaagccaggtgaatcagtgcgacaagatgctgggaggggacgccctggtgacagaccttctggtggacttttgcgggtctagatctggggtggagattcccagaacgccccagctgtatgtggcacatgagattggaacaatcaaaaccgtcacacccccagaagacagggactctgaatccggcgtcgcgggcggtcaagggacccttcaggaaccaggcttcggcgaggccagtgaggccatttcagtctctcggaataggcagcccatcccgttgcttatgaacaaggaaaattcaaccaagacaagcaaagtcgagttaactttggcttcaccttacatgaagcaggagaaggaggaggaaaaagagggcttttccgaaagcgacttttctgatggaaatacatcctcaaatgcagagtcctggcgtaatccatcctcatcggaggaggaacctagcccagtactgaagacattggagaggtccgccgccagaaagatgccaagcaagtctctggaagacatctcctccgattccagtaatcaggcaaaggtggacaaccaacccgaggagctggtgagaagcgcagaagacgacgagaagcccgaccagaagccagtgacgaatgaatgcgtgccgagaatctctactgtccccacccagcctgataatcccttttcccaccccgataaactgaagagaatgagtaaatcagtgcccgcgtttctgcaggatgagtcggacgaccgggaaaccgatacggcttccgagagctcttatcaactgtcccgtcataagaaaagcccatcctccctgacaaacttatcttcctcctctggtatgacctccctttcctccgttagtgggtcagtgatgagcgtgtactctggtgacttcggtaacctggaggtgaagggaaatattcaatttgcgattgaatatgtggagtctctgaaggagcttcacgtatttgtggcccagtgcaaggacctggctgctgctgacgtgaaaaaacaacgatctgacccctatgtgaaagcctatttacttccagataaaggcaagatgggaaaaaaaaagaccctggtggtgaaaaaaacacttaatccagtttataatgagatactaaggtataagatcgaaaaacagattctgaaaacccagaagttgaatctgagtatttggcacagggatacatttaagaggaattcctttctgggtgaagtcgaacttgatctcgagacatgggattgggacaataaacaaaacaaacagctcaggtggtatccgctgaaacgaaagaccgcaccagtcgccttggaggctgaaaacagaggtgagatgaagctggcactgcaatatgtacctgagcctgtccccggaaagaaacttcccacaactggtgaggtgcacatctgggttaaagagtgcctggacctgccactgctgcgtggatcacatctgaattctttcgtaaagtgcacaatactcccggacactagccgcaagagtcggcagaaaactcgggcggtgggcaagacaactaaccctatcttcaatcatactatggtgtatgacggctttagacctgaggacctgatggaagcctgtgtggaactgacggtgtgggaccactataaactcactaatcagttccttggaggtctgagaattggattcggcaccggtaaatcctacgggaccgaagtcgattggatggactccacttctgaggaagttgctctgtgggagaagatggtgaactcccctaacacatggatcgaagctactcttcccttaagaatgctactaatcgcaaagatctcaaaatag

SEQ ID NO: 207718 - DNA, 5343 bp, Artificial Sequence
  Description of Artificial Sequence: Synthetic coding sequence
atgatcaacagcagcctgagcatgctgttcagctacctggagaagtacttttacgttgccgatgagctgagccactgcgtggaacctgagccctctcaggtgccaggtggatcctccagggaccgacagcaggggaaaccccccccattgcctgccctcaaagctaagacaagctcaagaagtgggccttacgctacagagattaagaagtcgacagatgacagcatctttaaagttttggactggtttaatcgttcatcgtacagcgatgacaacaaaagcttcctgcagcatccccgcgggattgagagcaaagaaaaaaccgactcaaagagtcaggtggcagttgacctcgtgacagatgacacaaccctgagagaaaacgggagcaaaactctcagcccctctaagattgagctgaagcctgtccgaagcgattccccttttcaggcagagggcgacatgctcgtgtcagaatcatgtcaggataacaatgtcaacatcaaaagcaaattcatgaacctctcacagaaaggcacacccaaggaggggcctggtatactacaaccttttgagtcatacggaacgccatcacagggttcaaaaaatatggattatagtcaagacagtaaaagtccaggaaagggtaacggcgcaagcccctctaatagcaattatagttatagtgtgctcaaagagagcgacgctgaaaaccaggtcccatgtaacactaacaatataggcaatctgggagaggaagaaccgaagttccacgcccacgaggaaaaccgtggacatagtgaggtgaatttcgatagctctacggtggtgaaggaacctggcctgaaggacaacatgaatgcagaacgtaaatccaaagtcggcaatacctatatcttgaaggcttctctggaaccggagaatatcaaatctactcccggcgtagccaacaatggctctccttggaagaagcctgaagtgcaatttcaacaggaagccggcgaagtgccgaaaaatcaggtgcagagggagaagtataaacgcgtcagtgacagaatcagtttctgggagggcgaaaaagcaggggcgaaaataacccatgagaaacctacctcgagctgtagccaagagcagcctagcgccaaggcttatcagcctgtcaaaaaaagccagggcgtgagttctatggatagccttagcactgaccagtctgagtataatcaggctattcccaagcgcgttgtgcttgacgaagacgaccaagccagtcaactcagcaactcctattcatctaataaatcgaaggaaacaaagccccaaatcgctggcccttcaagatattatctgtctgccgaacagtcagataaggtctcactgttccagaataaaaagaacgagcctattaaaaggagccaggttgctgactccctgccctcaagaagaaacataacgttacctgcgctgcaacccccttctaatgtcggatccgagcgacacgcacctttggagaaggatcggcccctggttagggagtccaacgcaaacttcaaggtgatgtccctgaaggaacgaatggacgaacccaatgccgaacaagtgtacaatcctagccaattcgaaaatctccgtaaattttgggatctggaagccaattccaattcaaaggataacgacaagaatattactacgacctcacagaagaattccgctcctttcaacaggcagaagcataaggaattttctgatatcaaactgtcaggaaaaaatactcatgaagcagaagtgctccttagccctaaaaaggtgatggctcgagaagaaatggagaagttaaacagtaaggggattctccaggtgctgcccgatgaaataacgtttcccctcagccccctgaggaaatacacatatcagctccctggaaacgagagctctaaggagaatgttgaaaagaatacagagggcatcgtcacacctgtctttaaagaggagaaagattactccgagcaagaaattcaggagagcattattaagactaatgtcctgtcaaaagactgtaaagacaccttcaacgactctctgcagaagcttctgtcggagacttccacgcccgcaattcagcccagcggcggtaaagtccacggcaagcaagttctggagccttccgtgagtgagaacagaacttggccccagaagacggacttcgcagacaccgaggaagaggttaaaggccccgaaaagatcatcaatgagcacgtggacaagacggtcgtgcatccaaaagtgaagcggaacagtctgactgccagcctggacaagctgctgaaggaggccacaggaacatccccttctccactgcaggccaagcttgctccggttatcaccgggactaatagcaagctcgaagagggcagattttttggcaaaggcatagaacaatcccacaatacgagcgcggataagcgggagatcctggccccattccctgttcgcgatgagacgtttggaaataccgccttactcaagaaagctgaatccggggagtgccaactgtctacacagaatctcatccagatggccgctgaagacagccatccccttgaccctacctcccagctcagtaggaagggctcgtttggagacgtggcgtcgcccccccaagatatgctcttcccccaggacgcgcacctcgtgccccaggcccgggtgcatcccagccagacggagatctccgaaaccgtcgaaaaagtgatcctgccccctcgtcctgtgctgaatgacgttagcgctgccctccagaaattatgtggagaagtctggctttcataccctgctggtagggaggttgggccaggggaagtgaacccggaatttcccgaggctgtgcaaccagtctgtagccccctgaatcccccaggggttatctctccctgggctactatggatacaatcgttcccgatcgaaaagatttctattcctctaatgtggtccctgataaaacgcatgaggtgggaagctacttggccgctcagatgtcgccaagcgaccaaaccctatcaagcttcgcatccatcgtagcacagtatgggaaggggttgcctcaagaggtggaggaaatcgtgagggagacaatcgtccagccaaaatcagaattcttggagttctcagcaggcctcgagaagctccttaaggaggagaccgagaccttcccatctaagtatgagagcgacactggaaacctgtcgccaagtaagctcattggatcaactgaggagcccagaagagcaacaagtgagtgccatcctgaagagcttaaggagactgtggaaaaagcggaggccccactgattacagagtcagcgttcgatgctggatttgagaagctgctgaaagagattacggaggcccctccctaccaacctcaggtgtctgtgcgcgaagagacccacgagaaagaaagctcccagtccgaacagacacgtttcctgggtactgtacctcatttttatagggccgcatcccaaacgtctgaaatgaaggataagtccaacgggctggagagccaggtgaaccagtgcgataaaatgctgggaggtgatgcattagtgactgacttgctggttgacttttgcggctcgcggtccggcgtggaaatccctcgcacacctcagctctacgtggcgcatgagatcggcaccatcaaaactgtaacgccgcctgaggatagagactccgagtctggcgtggccggcggccagggtactttgcaggagcccggcttcggggaggcaagcgaagcaatctccgtgagtcgaaatagacagcctatccccttgctgatgaataaagagaactctaccaagacctccaaagtcgaacttactctggcgtcgccatacatgaaacaggaaaaggaagaggaaaaagaagggttcagcgagtcagatttctcagatgggaatacatcttcaaatgccgaaagctggagaaacccatcttccagtgaggaggagccctcacctgttttgaaaactttggaacgatccgcagcccgcaaaatgccatccaagagcctggaagacatcagctctgactcaagtaaccaggcaaaagtcgataatcaacctgaagaattggtacggagcgccgaggacgtcagcacggtgcccactcagcccgacaacccgttcagtcatcctgataagttaaaacgcatgtcgaaatctgtgcctgcgtttttgcaggatgagtccgacgaccgcgaaacagacacggcaagcgagagtagttaccagttgtctcggcataagaagtcacctagttcactgacgaacctgtcctcatcatctggcatgacaagtttatcttcggtgtccggatctgtgatgagtgtctattccggtgattttggtaacctggaagtgaaaggaaacattcagttcgcaattgagtacgtggaatccctgaaagaattacacgtatttgtggcccagtgtaaggacctcgccgctgccgacgttaaaaaacagcggtccgatccgtacgtaaaggcttacctgctgcccgacaaaggaaagatgggcaagaaaaagactctcgtggttaagaaaacactcaatcccgtgtacaacgaaattcttcgttacaaaatagaaaagcaaatactgaagacccagaagctcaacctctctatctggcacagggatactttcaaacggaactccttcctgggcgaagtagaacttgatttagagacctgggactgggataacaagcagaacaagcagctccggtggtacccactcaagaggaagactgcaccagttgcactggaagccgagaatcgaggggaaatgaagttggcattacagtatgtccctgaaccggtccccggtaagaagctcccgacaactggggaggtacacatatgggtcaaggaatgtctggacctgcctttgctcaggggatcgcacctgaatagctttgttaaatgtaccatactgcctgacacctctaggaagtccaggcaaaaaacccgagcagtcggaaagacaacaaaccctatattcaatcatacgatggtttacgatgggtttagaccggaagacctgatggaggcctgcgttgagctgacagtgtgggatcactacaaattaacaaaccagtttctgggaggccttcggatagggtttggaactgggaaatcatatggtacagaagtggattggatggattccacctctgaagaggttgccctgtgggaaaaaatggttaatagcccaaatacttggattgaagctactctgcctctgagaatgctattgatcgctaagatctctaaatag

SEQ ID NO: 207719 - DNA, 1098 bp, Artificial Sequence
  Description of Artificial Sequence: Synthetic coding sequence
atgagcgacgaccgggagaccgacaccgccagcgagagcagctaccagctatctagacacaaaaagagtccctctagcctgaccaacctctctagcagttccgggatgaccagcctgtcaagcgtaagtggatctgtgatgtctgtctacagcggcgatttcggcaatttggaagtcaaagggaacatacagttcgcaattgagtacgtcgagtctctcaaagagctccatgtctttgtcgcccagtgcaaggatctggcagccgctgacgtgaagaagcagcggtctgatccttacgtgaaagcctatcttctgcctgacaaaggtaaaatgggtaaaaagaaaaccctggtggttaaaaaaactctgaatcctgtgtataatgaaatcctgcgttacaagattgagaagcagatccttaagactcagaagctgaacctttccatatggcaccgagacacttttaaacggaattccttcctcggcgaggtggagcttgacctggagacatgggactgggataataagcagaacaagcagctgcggtggtatcctctcaaacgcaagaccgcacctgtagccctggaggcagagaacaggggcgagatgaagctcgctttgcagtacgttcctgagcccgttccgggcaagaagctccccacaacgggggaggtgcacatctgggtaaaggagtgtttggacctgccactgctgagggggtctcacctcaacagtttcgtgaagtgtactattctcccagatacctctaggaaatcaaggcagaagaccagagccgtcgggaaaaccaccaatcccatttttaaccacacgatggtgtacgatggttttcggcccgaagatcttatggaagcgtgcgtcgaactaacagtatgggatcattacaaactgaccaatcaatttttaggcggcttaaggattggattcgggacgggtaaaagttatggaactgaggtggattggatggattctacttctgaagaggtcgctttgtgggagaaaatggttaacagtccaaatacttggatcgaggcaactctccccctgcgcatgctcctcatcgctaagatatcaaagtag

SEQ ID NO: 207720 - DNA, 2733 bp, Artificial Sequence
  Description of Artificial Sequence: Synthetic coding sequence
atgatcgacctgagcttcctgaccgaggaggagcaggaggccatcatgaaggttttgcagagagatgcagccctgaagcgagccgaggaggaaagggtgcgacacctgccggagaagatcaaggatgaccagcagttgaagaacatgagtggccaatggttctacgaagctaaggctaaacgccatagagacaaaatccacggagccgacattatcagagcctcaatgagaaagaaacgcccgcaaattgccgctgagcaatcgaaagatagggagaacggtgctaaggagagctgggtcaataacgtaaataaagacgcgtttctgcctcccgagctcgcaggggtggtcgaggagcctgaagaagacgcagcccccgcctcgcccagcagcagtgtcgtcaacccggcctccagcgtgattgacatgagccaagaaaacacgcgcaagcccaacgtttccccagaaaagaggaagaatcccttcaactcctcaaaactcccagaaggacactcgtcacagcaaaccaaaaatgagcagtctaaaaatggaagaactgggctgttccagacttctaaagaggacgaactttctgaaagcaaagaaaagtcaacagtggcagacacctctattcaaaaactcgaaaagagtaaacaaacgctgcctggactaagcaacggatcccagattaaagcaccaatcccaaaggcccgaaaaatgatttacaagtccaccgacctcaataaagatgataaccagagttttccccgccagcgtactgatagcctgaaagctcgaggtgcacctcggggaatcttgaaaaggaattcctcttctagctctacagatagtgagactctgcgctacaaccataatttcgaacccaagagtaaaatagtgagtcctggactgaccatccacgaaaggatctcagaaaaagagcacagccttgaagataattcctcaccaaattcattggaaccactcaagcacgttcggttctccgcagtaaaggacgagcttcctcagtcaccgggccttattcatgggcgggaggttggcgagttttcggtgctcgagtctgaccggttgaagaacggaatggaggatgccggagataccgaggaatttcaaagtgatccaaaaccttcacagtacagaaagccaagtctcttccatcaaagtacatcgtccccatacgtcagcaaaagtgaaacccaccagcccatgacttctgggagttttcctataaatggcctgcacagccactcagaggtgctgaccgcaagacctcagtccatggagaacagccccaccatcaatgaacctaaagacaaatctagcgagctaacgcggttggaatctgtactgcccagatcccctgcagacgagctgtcccactgtgtggagccggaaccttctcaggtgccaggtggatcctccagagaccggcagcaggggtccgaagaggaaccatcgccagttctaaagacgctggaaaggtccgccgctaggaaaatgccatccaaatccctcgaggacatctcctctgattcctccaatcaggccaaggtggataatcagccagaggaactagttaggagtgcagaagacgatgagaaaccagaccagaagcccgtgacaaacgagtgcgtgcccagaattagtacagtgcccacccagcctgataatccatttagccatccagacaagttaaaacgcatgtccaaaagtgtgcctgcatttttacaggacgaagtgtctggctccgtgatgagcgtctactcaggagacttcggaaacttggaagtgaagggcaacatccaattcgctatcgagtacgtcgagtcattgaaggagcttcacgtattcgtggcccagtgcaaagacctggcagccgccgacgtgaagaagcagcgcagcgacccttacgtgaaagcctacctactgccagataaggggaagatgggaaagaagaaaacacttgtcgttaagaaaacactcaatccggtgtataatgaaatactgcggtacaagattgaaaaacagatcctcaaaacgcagaaactgaacctgagtatctggcatagagacacatttaagaggaactcttttctgggcgaggtcgagctggaccttgagacctgggattgggacaacaagcagaataaacagctgagatggtacccactgaagagaaaaaccgctccagtggcattagaggctgagaacagaggagaaatgaagctggcattgcaatacgtgcctgaacctgtcccaggcaagaaattacccactaccggcgaagtgcacatttgggtgaaggagtgtctggacctgccccttctgagaggcagtcaccttaattcctttgttaaatgcactattcttcccgatacttcccggaagtcaagacaaaagacgcgtgctgtcggaaagaccacgaaccccatcttcaatcacacaatggtgtacgatggctttcggcctgaggacttaatggaggcttgcgttgagcttacagtgtgggaccactataagctgacaaatcagttcctggggggcctgcgcatcggattcgggacaggtaagtcctacgggacagaggtcgactggatggattcaacctctgaagaggtggcactgtgggagaaaatggtgaactcccccaacacctggattgaggcaacattgccattgcgtatgcttctcatagcgaagatctctaagtag

SEQ ID NO: 207721 - DNA, 2733 bp, Artificial Sequence
  Description of Artificial Sequence: Synthetic coding sequence
atgatcgacctgagcttcctgaccgaggaggagcaggaggccatcatgaaggtccttcagcgcgatgccgcactaaagagggcagaggaagagagggtgcggcaccttcccgaaaagattaaggatgatcagcagttgaagaacatgtctggccagtggttttacgaggctaaagctaaacgtcatagagataaaattcacggcgcggacattattagagcaagcatgagaaagaaacgcccccagatagccgccgagcagagcaaagaccgagagaatggtgccaaggaatcctgggtcaacaatgtcaataaggacgccttcctgccccccgaactggccggtgtggtggaggagcctgaagaagacgctgctcccgcatcccccagctcttccgttgtgaatcccgcttcatctgtcatcgacatgagccaggaaaatacaagaaagcccaatgtgagccctgaaaagaggaagaacccattcaacagttctaaactgccagagggccactcctcgcagcaaacgaagaatgagcagtcaaaaaacggtagaaccggcctgttccagacctccaaggaagatgagttgtcagaatccaaagaaaaatccaccgtcgctgatacctcaatccaaaagctcgaaaagtccaaacagaccttgcctggattgtctaatggctcccagatcaaagcgccaatcccaaaggcccggaagatgatatacaagtcaactgatctgaacaaagacgataatcaatccttcccccgtcagcgcactgattcgctcaaagcacgcggagccccgcgggggatactcaagcggaattcaagcagctctagtacagacagcgagaccttaagatataaccataacttcgaaccaaagagcaagattgtgtctcctggactcaccatccacgagcggatctccgagaaggaacactccttggaggacaacagctcaccgaacagtcttgagcctcttaaacacgtgcgcttctcagctgtgaaagacgaattaccccagtcaccaggtttgatccacggccgagaggtcggcgagttctccgtcctggagtcggatcgccttaagaatggaatggaggatgctggagacactgaggaatttcagtcagatccgaagccatcccagtacagaaaacctagcctgttccaccaaagcacgtcaagcccctacgtcagtaaatcggagacccatcagcccatgacatccggaagcttcccaataaacggcctgcatagtcattcggaggttctgactgcgcgcccgcagagcatggagaattcacccacaatcaatgaaccaaaggacaagtcaagcgagctgacccgactggagagcgtgctgccacgctcaccagccgacgaactgagccactgcgttgagccggagccaagccaggtgcctgggggttcgtcccgtgaccggcagcagggctcagaggaggagccaagccccgttttgaagacactggagcggagcgcggcccggaaaatgccaagtaagtccctggaggatataagtagcgatagctcgaatcaggccaaagttgacaatcaacccgaggaactcgtgcgatctgcagaagatgacgagaagccagaccaaaaacccgttaccaatgaatgtgtgcctcgcatcagcacagttcctacacagcccgataatccgtttagccacccagataagctgaagcgaatgagtaaaagcgtccctgcttttttgcaagatgaggtctctggctctgtgatgagcgtgtactcgggagattttggcaacctcgaggtgaaaggcaatattcagtttgccattgagtacgtcgagtccttaaaggagctccatgttttcgtcgcacagtgtaaggacttggcagccgcagacgtgaagaaacaaaggtccgacccctacgtgaaagcctacctgttgccggacaaaggaaaaatgggaaagaagaaaaccttagttgtcaagaaaaccttgaatccggtttataatgaaattctgcgctataaaatcgagaaacagattctcaagactcagaaacttaatttgagtatctggcatagagataccttcaagaggaactccttcctgggggaggttgaactggatcttgaaacttgggattgggacaacaaacagaacaagcagttgcgatggtatcctctcaaaaggaaaaccgcccctgtggctttggaggccgaaaaccggggcgagatgaaacttgctctccaatatgtccccgagcccgtgcccggcaagaagctgccaacgactggcgaggtccacatctgggtgaaagaatgcctggatcttcctttactaagaggctcgcacttaaatagcttcgtgaagtgcacaatcctgcctgacacgagccggaagtctcgccagaagacccgggctgtcggaaagaccacaaatccgatctttaatcatacaatggtatacgacggatttagacccgaagatctaatggaggcgtgcgtcgaactcaccgtttgggaccactacaaacttaccaatcagtttttaggggggctgcgtattggcttcggcaccggcaaaagctatggtaccgaggtggactggatggactccacaagcgaggaggtggcactttgggaaaagatggtgaacagtccaaacacgtggatcgaggcgacccttccactgaggatgctcctcatcgcaaagatcagtaagtag

SEQ ID NO: 207722 - DNA, 192 bp, Artificial Sequence
  Description of Artificial Sequence: Synthetic coding sequence
atgagcaagagcgtgcccgccttcctgcaggacgagagcgacgaccgtgagactgacactgcctctgaatcttcataccaactcagccggcataagaagagcccttcatctttaactaacctaagttcgagctcagggatgacctccttgagcagcgtcagcgggtctgtcatgagcgtttatagcggatag

SEQ ID NO: 207723 - DNA, 3771 bp, Artificial Sequence
  Description of Artificial Sequence: Synthetic coding sequence
atggacgagcccaacgccgagcaggtgtacaaccccagccagttcgagaatttacggaagttctgggacctggaggcaaactctaactccaaagacaacgataagaacatcaccactacatcgcagaaaaattccgcaccattcaacagacagaaacacaaggagttctctgacataaagttgtctggtaaaaatactcatgaggccgaagttttgctgagtcctaaaaaggtcatggcccgcgaggagatggaaaagttgaatagtaaaggaatcctgcaggttctaccagatgagatcacgttcccattgagccctctgcggaagtacacctaccagctcccaggcaatgagagttctaaagagaatgtggagaagaataccgaaggtattgtgacccctgtgttcaaagaagaaaaggattactcagagcaagaaattcaggaaagtattatcaagacaaatgtcctgagtaaggactgcaaagacacattcaacgactccctgcagaagctgctgagcgaaacttccactcctgctatacagccatcaggaggaaaagttcacggaaagcaggttctggagccctccgtgtccgagaaccgtacttggcctcaaaaaacggattttgccgacaccgaggaagaagtgaaagggccggaaaaaattattaatgagcacgtggacaagacggtagttcatccaaaagtgaagaggaatagtctgaccgcttcgctggataaactacttaaggaagctaccggcactagcccttccccccttcaggccaagctggctccagtgattacagggaccaatagtaagcttgaagagggtcggttttttggcaaaggcatcgagcagtcacacaacactagcgctgataaaagggaaatactggcacctttccccgtgagggacgagaccttcggtaatacagcgctcctaaagaaggccgagtccggagagtgccagttaagcacccagaaccttatccagatggccgccgaagatagtcatccgctagatccgacctctcagttgtccagaaagggctcttttggcgacgtggcttcaccgcctcaggacatgctgtttccccaggacgcccacctcgttccacaggcaagagttcatccctcgcagactgaaatttccgaaacagttgagaaggtcatcctccctccgagacctgtgctgaatgacgtgtctgccgcacttcaaaagctgtgcggcgaggtgtggctgtcctatcccgctggccgagaggtggggccaggcgaggtgaaccccgaatttcctgaagctgtccagccagtatgttcaccgctcaatccacctggagtgatcagtccctgggctaccatggatacaatcgtgcctgacagaaaggatttctacagctcaaatgttgttccagacaagacacatgaggtcggctcatacctcgcggcccagatgagtccttccgatcagacacttagtagttttgcctcaatagtagctcaatacggcaaagggctgcctcaggaagttgaggagatcgtcagggagaccattgtccagcccaaatcagagttcctcgagttttcggccggcttggaaaagctgctgaaggaagaaaccgaaactttcccatcaaaatatgagtccgacaccggtaatctttctcccagcaagttaatcggaagcaccgaagaaccaagacgtgctacgtcagagtgccaccccgaggagcttaaggagaccgtggagaaggccgaagctcctctgatcaccgagtccgccttcgatgcagggtttgagaaactcttgaaagagataactgaggcccccccgtatcagccgcaggtgagcgttcgcgaagaaacacacgaaaaagaatcatctcagtccgaacagacccggttcctgggaaccgtccctcatttctatcgggcagccagccagacatccgagatgaaagataagtccaatggcctagaaagtcaggtgaaccagtgtgacaagatgttgggcggagatgccttggtgaccgatctcttggttgatttctgcggatctaggtccggggtggagatccctcgcactccacagctctacgtggcgcacgaaatcggcaccatcaagacagtaacccctcccgaagatagagactctgagagcggcgtggcaggggggcaaggtactttacaggagccgggttttggagaagcttcagaggctatttccgtgagtagaaatcgtcaacccattcctctgcttatgaacaaggagaactccaccaaaactagtaaggtggaattaacactggctagcccttatatgaaacaggaaaaggaggaggaaaaagagggcttttcagagtctgattttagcgatggcaatacctctagcaatgctgaatcctggcgcaatccatccagctccgaagaggagcccagccccgttcttaagactctggaacgctccgccgcccgaaaaatgccttctaaatctttggaggacatttcttctgacagttctaaccaggctaaggtggacaaccagcccgaggaactggtgcgaagcgcagaggatgtttcaacagtgcccacacaaccagataatcctttttctcacccagataagctaaagcgaatgagcaagagcgtccccgcgtttctgcaggacgagtctgatgatagggaaaccgatactgcttcagaatcatcttaccaattgtcccgccataaaaagtccccctcatcgctgacaaatctttcatcaagctctgggatgacatctctgagctcagtgagcgggtctgtgatgagcgtttattccggagacttcggcaatctcgaggttaaggggaatatccaatttgccatcgagtatgtggaatcactgaaggagcttcacgtctttgtcgcgcagtgcaaagacctggctgcagctgatgtgaagaagcagcgatccgacccttatgtgaaggcgtatttgctcccagacaaggggaagatgggaaagaaaaagacgcttgtggtgaaaaaaactctgaatcccgtgtataacgaaatcttgaggtataaaatcgagaagcagattcttaagacgcagaagttaaatctctcgatttggcacagagacacattcaagcgcaattctttcctcggggaggtggagttagacctcgaaacgtgggactgggacaataagcagaataaacaattgaggtggtatcctctcaagcgcaaaacggctcctgtcgcgcttgaagctgaaaatcggggggaaatgaaactggccctgcagtatgtcccagagcccgtgcccggcaagaaacttccaaccactggagaggtgcatatttgggtgaaagagtgcttagacttacccttgctgcggggtagccatctcaatagctttgtcaaatgcacaatcttgccggacacatctcgaaaaagtcgccaaaaaacacgagctgtggggaagaccacaaaccctatcttcaatcataccatggtttacgacggattccgacccgaagatctgatggaagcttgtgttgagctcacagtttgggatcattataaactgaccaaccagtttctgggagggcttcgcatcggcttcggcaccggcaagtcttacggaactgaagtggattggatggatagtacatcagaagaagtggccctgtgggaaaaaatggttaacagccctaatacatggatagaagccacacttccactgcgtatgcttctgattgcaaaaatctctaagtag

SEQ ID NO: 207724 - DNA, 1131 bp, Artificial Sequence
  Description of Artificial Sequence: Synthetic coding sequence
atgagcaagagcgtgcccgccttcctgcaggacgagagcgacgacagggaaaccgatacagccagtgaaagctcttatcaactctcacgtcataagaagtccccatcttcgctaacaaacctctcctctagttcggggatgacctcactttcttccgttagcggttccgtgatgtccgtatacagcggggacttcggaaacctcgaggtaaagggcaatatacagttcgcaatagaatacgtggagtccctaaaagagctccacgtttttgtagcccagtgtaaggatttggctgctgcagacgtcaagaagcagaggtcagacccttacgttaaagcgtacctgctgcctgacaaaggtaaaatgggtaaaaagaagaccctcgttgttaagaagaccttaaacccggtatataacgaaattttaagatacaaaatcgagaagcagattttgaaaactcagaagttaaatctatccatctggcatagggacacttttaagagaaatagtttcctcggggaggttgaactggatctggaaacctgggactgggacaataagcagaataagcagctgaggtggtacccactgaagcggaagactgctccagttgcgctggaggcagaaaacagaggagaaatgaagctggccttgcagtacgtgccagaacccgtaccagggaagaagttgccaaccactggggaggtgcacatatgggtcaaagagtgtctcgacttacctctgttgcgcggaagccacctcaattccttcgtgaagtgtactatcctacccgacacatcccgaaagagtcgtcaaaaaactcgagcagtggggaaaaccaccaaccccatctttaaccataccatggtgtacgatggcttcagaccagaggatctcatggaagcatgcgtggaactgaccgtgtgggaccattataagctgacaaatcaattccttggcgggcttcgcattggatttggaaccggcaagtcctacggcacggaagtagattggatggattccactagcgaagaggttgcgttatgggagaagatggtcaatagtcccaacacatggatcgaggccactctgcccttgagaatgcttctgatagctaaaatcagcaagtag

SEQ ID NO: 207725 - DNA, 312 bp, Artificial Sequence
  Description of Artificial Sequence: Synthetic coding sequence
atgagcaagagcgtgcccgccttcctgcaggacgagagcgacgacagagaaaccgacaccgcgagcgaaagtagttaccaactgagccgccacaaaaagagcccctccagtctgacaaatctcagttcttctagtggcatgaccagcctgagttctgtgtctggaagcgtcatgtcagtctactccggtgactttggaaacctggaagtgaaaggaaacatccagttcgccattgagtacgtggaaagcctgaaagaactgcacgtgttcgtggcccagtgtaaagatctcgcagccgcagacgttaaatag

SEQ ID NO: 207726 - DNA, 2709 bp, Artificial Sequence
  Description of Artificial Sequence: Synthetic coding sequence
atgagcggccagtggttctacgaggccaaggccaagcggcaccgggataaaattcacggcgccgacataattagagcctccatgaggaaaaagaggccccagattgctgccgagcagagcaaggacagggagaacggggccaaagagtcctgggtgaataatgtcaataaggatgctttcttgccaccagagctggctggagtggtggaagaaccggaagaggatgccgcccccgccagtccctcatcgtccgtggtcaatcccgcctccagcgtcatcgatatgagccaggagaatacaagaaaacccaacgtgagcccagagaaacgcaaaaatcccttcaactcctctaaactacccgaaggacacagctctcagcagacgaaaaatgaacagtccaagaacggaaggaccgggttgttccaaacatctaaagaggacgaattgtcggagtccaaggaaaagagtacagtagccgacacaagcatccagaagttggaaaagtccaaacagactctgcccgggttaagcaatggatctcagatcaaagccccgatccccaaggctcgcaagatgatctacaaatccacagatctgaataaagatgataatcagtccttccccagacagcgaaccgacagtctgaaagcacggggcgcacctcgtggtatattgaaacgcaacagcagtagctcttcaaccgattctgagaccctccgttacaaccacaattttgaaccgaagtccaagatcgtaagtccaggcctgaccatccacgagcgaatctctgagaaagagcattcactggaagataacagctcccctaatagcttagagcctcttaagcacgtccgcttctccgctgtgaaggatgaactaccacagagccccggcctcattcacggccgcgaagtgggcgaattctcagtgctcgagagtgaccgcctgaagaacggtatggaggatgcaggggatacagaggagttccagtccgaccctaagccttctcaataccgaaagccctcgctgttccaccagagcacaagttcaccatacgtcagtaagagtgaaacccaccagccaatgaccagcgggagttttcctattaatggcctgcacagccactctgaggtcctcaccgcgagaccacagtcaatggaaaacagccccacgatcaacgagcccaaagacaaatcctcggaacttacacggcttgagagcgtgctccctagatcacctgcagacgagttatcacactgcgtggagccagagccctctcaggtgccaggcgggtcctcccgggaccgacagcaaggtagcgaagaggagccttctccagtcctgaaaaccctagagcgctcagcggcccggaaaatgccctccaaatcacttgaagacataagtagcgattcctctaaccaggctaaggtggataatcaacccgaggaactggtccgctcggccgaggacgacgagaaacctgaccagaagccagtgaccaacgagtgcgttccgagaatttcaactgtgccaactcagccagacaaccccttctctcaccccgacaaactgaaacgaatgagcaaatctgtccctgcatttctgcaggacgagtccgatgatcgagagaccgacaccgccagcgagtcttcctatcaattaagtcgtcacaagaaatccccctccagcctgacaaatctgagctcttcctctggcatgacttccctcagttccgtcagcggcagcgtgatgtccgtctattcaggcgacttcggcaacctggaagtgaaaggaaacatccagttcgccattgagtatgtcgaatccctgaaagagctgcacgtgttcgtggctcagtgtaaagatttagctgcggccgatgttaagaagcagaggtcagacccctacgtaaaggcgtatttgctgcctgacaagggcaagatgggtaagaagaaaaccctcgtagtcaaaaaaacgcttaatcctgtctacaacgaaatcctgcgttataagatcgaaaagcagattctgaaaacacagaaactgaacttaagtatctggcacagagatacctttaaacgcaatagttttctgggcgaagtggagctggacttggagacttgggattgggataacaaacagaacaaacaacttcgctggtacccgctgaaacgtaagaccgccccagtcgccctcgaggcagaaaacagaggagagatgaagctggctctacaatacgtgcccgagcccgtacctgggaaaaagctgcccactaccggagaggtccatatttgggttaaggaatgtctggacctgccgctcctgcggggttcccatctgaactcatttgttaaatgcacaatcctgcccgacacatcccgaaagagccgtcagaaaacacgagctgtgggcaaaaccacaaaccccatattcaatcatacaatggtttacgacgggtttcggcctgaagacctgatggaagcctgtgtggaactgacggtctgggatcattacaagttgaccaatcagttcctgggcggtcttcgcatagggtttggaacagggaagagctacggcactgaagtggattggatggattcgacctccgaagaggtggcactttgggaaaagatggtaaactctcctaatacatggatcgaagctacacttcctctccgcatgctcctgattgccaaaattagcaaatag

SEQ ID NO: 207727 - DNA, 483 bp, Artificial Sequence
  Description of Artificial Sequence: Synthetic coding sequence
atgagcaagagcgtgcccgccttcctgcaggacgaggtgagcggcagcgtcatgtctgtgtactctggtgactttggcaacctagaagtgaagggtaacattcaatttgccatagagtacgtagagtcacttaaggagttacacgtcttcgtagcccagtgtaaagacctcgccgctgccgacgtaaaaaaacaaagatccgacccttacgtaaaagcatacctcttacctgataagggaaaaatggggaaaaaaaaaaccctcgtcgttaaaaagactttaaaccccgtgtataacgaaattttgaggtacaagatcgagaagcagatcctcaagacccagaagttgaatctgagtatttggcatagagacacatttaagagaaattcattcctcggagaagttgaactggacctggagacgtgggactgggacaataaacagaacaaacagcttaggtggtacccactgaagcggaaatag

SEQ ID NO: 207728 - DNA, 2805 bp, Artificial Sequence
  Description of Artificial Sequence: Synthetic coding sequence
atgatcgacctgagcttcctgaccgaggaggagcaggaggccatcatgaaagtcctccaacgcgacgcggcacttaaaagggccgaagaagagcgcgtccggcacttgcccgagaagattaaggacgaccagcagttgaagaatatgagtggccagtggttttacgaggcgaaggccaagcggcaccgtgacaagatacacggggctgacattattcgcgcctccatgcgcaagaaacggccacagattgccgcggagcagtcgaaagaccgggagaatggcgccaaagagagctgggtgaataacgtcaataaagatgccttcctgccacctgagctcgccggggtcgtcgaggaacccgaggaggacgccgctcctgcctcccctagttcatcagtcgtgaatcctgcatcaagcgtgattgatatgtctcaagagaacactaggaaacctaacgtgtcaccagagaagaggaaaaatcctttcaattccagtaagcttcccgaaggccacagttcgcagcaaaccaaaaacgagcaaagtaagaacggaaggacagggcttttccagacctccaaagaagatgaacttagcgaatcaaaggaaaaatctaccgtggctgatacaagcatacaaaaactcgagaagagcaagcagacactacctggcttaagtaatgggagccaaatcaaagctccaataccaaaggctcgcaaaatgatatataaatccacagatctgaataaggacgataatcagtcttttccaaggcagcgcacagattcccttaaagcccgaggggcacctagaggaattctgaaacggaacagctcaagttcaagcacagactccgagaccctgcggtacaaccataacttcgaacccaagtctaaaatcgtgtctcctgggcttaccattcacgagcgcattagcgaaaaagagcattccctggaagataacagcagtcccaatagcttggagcctctgaagcacgtcaggttttccgccgtcaaagatgagctgccacagtcccctgggctgatccacggtcgggaagtcggtgagttctctgtactggagtcggatcgcctgaaaaatggtatggaagacgccggcgacacagaagaatttcagagcgaccctaagccttcacagtatcgcaagcctagcctgtttcaccaaagtaccagcagcccttatgtctccaaaagcgagactcatcaacctatgacctcaggatcattcccgatcaatgggttgcactcacactcggaagtgctcacagcccgaccccagagcatggagaattctcctaccataaatgagcccaaagataagtcctcagaactcacaagattagagagcgtgctgcctcgttccccggcagatgagcttagccattgtgtggagcccgagccctcacaggttcccggcggaagctctcgcgaccggcagcaaggttcagaagaagaaccatctccggtactgaagacactggagaggtctgccgcaagaaagatgccctcaaagtcactggaggatatttcctcggacagctcaaaccaggctaaagtcgacaatcagcccgaagaattggtgaggtctgcggaggacgtgagcaccgtgcccacacagcccgataatccattcagccacccagataaactgaagcgcatgagcaagagcgtgccagccttcctccaggatgagtcagacgacagggagaccgatacggcatccgagagctcctatcagttatcccgccacaagaagtcaccttcctcactcaccaatctcagctctagcagcgggatgacttctctgagtagcgtatctggaagtgtgatgtctgtctattccggtgactttggcaacctcgaggttaaaggcaacatacagttcgcgattgagtacgttgagtcgctgaaggagctccacgtgtttgtggcccaatgcaaggacttggcggccgcagacgtaaagaagcaaagatctgatccctacgtaaaggcttacctgctcccggataaggggaagatggggaaaaagaaaactttggtcgttaagaaaactctgaatccggtttacaacgagatcctacggtacaaaatcgagaagcagatcttaaaaacccaaaagctaaacctgtcgatctggcatcgggacacattcaagagaaatagcttcttaggtgaggtggagctggatctggagacatgggattgggacaacaagcaaaacaaacaactgagatggtacccgctaaaaagaaagactgcaccagtggctctggaggccgagaacagaggtgaaatgaaacttgctctccagtatgtcccggaacccgtccccggaaaaaagctgcctactacaggagaggtccatatttgggttaaggagtgccttgatttaccccttttgcgtggttctcaccttaattccttcgtcaaatgtacgatcctgccggacaccagccgcaagtcgagacagaaaacccgagccgtgggtaagacgaccaaccctatctttaatcatactatggtgtatgatggttttcgccccgaggacctgatggaagcctgcgtcgaattgacagtgtgggaccactataaactgactaatcagtttctgggagggctgaggattgggttcggtacaggcaaatcttacggtaccgaagtcgactggatggattctacctccgaagaggtggccctgtgggagaagatggtcaatagcccaaatacatggatcgaggcgaccttgcctctgaggatgttactgatcgcgaaaatctccaaatag

SEQ ID NO: 207729 - DNA, 468 bp, Artificial Sequence
  Description of Artificial Sequence: Synthetic coding sequence
atgagcaagagcgtgcccgccttcctgcaggacgagagcgacgaccgcgaaacggacaccgcatccgagtcatcgtatcagctcagtagacacaaaaagtcaccttcatctctgacaaatctctcatcttctagtggaatgacaagcctgtcttccgtcagcgggagtgtgatgagcgtttattccggcgactttggcaacctggaagtgaagggcaatatacagtttgccattgaatacgtggaaagcctgaaagaactccacgtgtttgttgctcagtgtaaggatttagctgccgcagacgtcaagaaacagagatcagacccctatgtaaaagcctatctgctcccagataaaggcaagatgggcaaaaaaaagactctggtggtgaagaaaaccttgaatcccgtatataatgaaatcctgcgctataagattgagaagcagattttaaagactcagaagtag

SEQ ID NO: 207730 - DNA, 1131 bp, Artificial Sequence
  Description of Artificial Sequence: Synthetic coding sequence
atgagcaagagcgtgcccgccttcctgcaggacgagagcgacgacagggaaactgacacggcgtctgaatcttcctatcagctctctcggcacaagaagtccccctcgtctctcactaacctgtcctcttccagtgggatgacctcgctgtcctcagtgtctggttccgtgatgtctgtctattcaggcgattttgggaatctggaggtgaaaggaaatattcaatttgctatagaatatgtggaatcgttgaaagaattacacgtgttcgtggctcagtgtaaggacttggctgcagccgacgtgaagaaacaaagatcagatccctatgtcaaggcttatctcctgcccgacaaaggcaagatgggaaagaaaaagacacttgtggtaaaaaagaccctcaacccagtttataatgagattctccggtataagatcgagaagcagatcctgaagacccaaaagctgaacttatccatttggcaccgcgatacattcaagaggaattcattcctcggcgaggtagagctagacctcgagacctgggactgggacaataagcagaacaagcagttgaggtggtatccgctgaagcgaaaaaccgcccctgtggcactcgaagctgagaacaggggcgaaatgaaactcgcattgcaatacgtgcctgagcccgttcctgggaaaaaattacccacgactggcgaggtgcatatatgggtcaaggaatgtcttgatctgcctttgttgcgcgggagtcatctcaattcatttgtgaagtgtaccattctgcccgacacatcacgcaaaagcaggcagaaaacacgggccgtgggcaaaaccaccaaccccatttttaatcacacaatggtgtacgacggcttccgcccggaagacctgatggaggcttgtgtcgaattgactgtctgggatcactataagctcactaaccagttcctgggaggccttcggattggattcggcactggcaagtcgtatggaactgaggttgactggatggactcaacgtcagaggaagtggccctctgggaaaaaatggtcaattcgccaaacacatggattgaagccacacttcctctgcggatgctgttaatagcgaagatttctaagtag

SEQ ID NO: 207731 - DNA, 1956 bp, Artificial Sequence
  Description of Artificial Sequence: Synthetic coding sequence
gagaccgtggagaaggccgaggcccccctgatcaccgagagcgcctttgacgctggcttcgaaaaactgcttaaagagataacagaggcgccaccttaccagccgcaggtctcagttcgagaggagacacacgaaaaggaaagctctcagtccgaacagacgaggttcttgggaacagtaccacacttttatcgcgcagcctcccagacttcagaaatgaaggataagtccaacggccttgagtcccaggttaatcaatgtgacaagatgctcggcggggacgcccttgtcacggatttactggtagacttttgtggtagtcgctcgggggtggaaatccccagaacaccacaattatacgtggcccacgagattggaacaattaagaccgtcacaccccccgaagacagggactccgaatccggggtggccggagggcagggcactctgcaggagcctggctttggggaagcatccgaggcaatcagcgtcagccgcaatagacagccgatcccgttgctgatgaacaaggaaaattctacgaagacgtccaaggtcgaactgacactggcgtccccctatatgaagcaggagaaagaggaggaaaaagaaggctttagtgaatccgatttctcagatggaaatacctctagcaacgctgaaagttggcgaaatccttcctcaagcgaagaggaaccttccccagtcctaaagaccttagagcgaagcgcggctcgaaaaatgcccagcaaaagtctcgaggacatttccagcgatagcagcaatcaggccaaagtagacaaccagcccgaggagcttgttcgttccgctgaagacgacgaaaagccggaccaaaagcctgtcaccaacgagtgcgtccccaggatctctactgttccgacccaacctgataatccgttctcacatcccgacaagttaaagcggatgagtaagagcgtgcccgcattcttgcaagatgaggtgtctggttctgtgatgagtgtgtattccggtgacttcggcaacctcgaggttaagggcaatattcagtttgccattgagtatgtggagtctctaaaggaactccacgtgtttgtggctcaatgtaaggatttggctgccgctgacgtgaaaaagcagaggtcagacccctacgtaaaagcttatctgctgcccgataaaggcaaaatgggtaaaaagaagacgctagtagtgaagaaaacactgaaccccgtatacaacgagattctgcggtacaagatcgaaaaacagattcttaaaacgcagaagttgaatctgtccatatggcatcgggacacatttaaaagaaactctttcctaggggaggtggaactcgatttggagacttgggactgggacaataagcaaaataaacaactgagatggtaccccctgaagcgaaagaccgcccccgtcgctcttgaggctgagaataggggggagatgaagttagccctgcagtacgtgccagaacccgtgccaggcaagaagctaccaacaaccggggaagtacatatctgggtgaaggaatgtcttgatttgccattactgagagggtcccaccttaacagctttgttaagtgtacaatcttgccagacaccagtcgcaagtcccgtcagaaaaccagagccgtaggcaagaccacaaatccaatctttaaccatacaatggtctatgacgggtttcggccggaggatctaatggaagcgtgcgtggagctcaccgtgtgggatcattacaaactcaccaaccagtttctggggggtctgcgaattgggtttggcacgggaaagtcttacgggaccgaagtggactggatggactccacttctgaagaagttgccttatgggaaaagatggtcaatagtccaaatacatggatcgaagctacactgcccttacgcatgctgctgatagccaaaatttccaaatag

SEQ ID NO: 207732 - DNA, 213 bp, Artificial Sequence
  Description of Artificial Sequence: Synthetic coding sequence
atgagcaagagcgtgcccgccttcctgcaggacgagagcgacgacagagaaacagataccgcttccgaatccagttaccagttgtcaagacacaaaaaaagcccgtcatccttgacaaacctatcttctagtagcggtatgaccagtctgagctctgtaagtgggtccgtgatgtcggtgtacagtggcgactttggcaacttggaggtctag

SEQ ID NO: 207733 - DNA, 1011 bp, Artificial Sequence
  Description of Artificial Sequence: Synthetic coding sequence
atgagcaagagcgtgcccgccttcctgcaggacgaggtgagcggcagtgttatgtcagtttactccggtgactttggcaacctggaggtgaagggtaatatccagttcgctatcgaatacgtggagtcactgaaggaactccatgtgttcgtggcgcaatgcaaggatctcgccgccgcagacgtcaaaaaacagagatcagacccttacgtcaaagcatacctgctccccgataagggtaagatggggaaaaagaaaaccctcgtggtgaagaaaactctaaacccagtgtacaacgaaattctacggtacaaaatcgagaagcagatactcaagacgcagaaattgaatctatctatttggcaccgcgatacattcaagcggaattccttcttaggcgaggtggaattagatttggagacctgggattgggacaacaagcaaaacaagcagttgcgctggtatccgcttaagcggaaaacagcccctgtggcgttggaggctgaaaacagaggcgagatgaagcttgccctccagtacgtgcccgaacccgtgcccggcaagaaattacccaccacaggggaggtgcacatctgggttaaggaatgcctggacctgccgctgttaagggggtcacacctgaactcattcgtcaaatgtacaattctgcccgacacgagtcgcaagagccggcaaaagacccgcgcagtagggaagacaacaaatcctatctttaaccataccatggtgtatgatggctttcgccctgaagatctcatggaggcatgcgtcgagctaactgtctgggaccactacaagttgacgaaccaatttctggggggtctgagaatcggttttggaacaggaaaaagctacgggacagaagtggactggatggattcgacttctgaagaggtggccctgtgggaaaaaatggtcaattcacccaacacgtggatcgaggcaacactgcctctcagaatgctactgattgcaaaaatcagcaaatag

SEQ ID NO: 207734 - DNA, 2016 bp, Artificial Sequence
  Description of Artificial Sequence: Synthetic coding sequence
atgagcgagctgctggacctgagcttcctgagcgaggaggagaaggacctgatcctatccgtgttgcaacgggacgaggaggtgcgtaaagccgacgagaagagaatccgccggctgaaaaatgagctacttgagattaagcgaaaaggtgctaagcgcgggtctcagcattactctgataggacatgtgcccgctgtcaggaaagcctgggaagactgtccccaaagacaaatacatgcaggggctgcaatcacctggtgtgtcgggactgtcgtattcaggaatcaaacggtacatggaggtgtaaagtatgcgccaaggagatcgagctgaagaaggccacaggtgattggttctacgaccagaaagtcaatagattcgcataccggacagggtctgaaatcattcgcatgagtctgagacacaagcctgctgtctctaagagggaaactgtaggccagtcactgctgcaccagacacagatgggtgacatttggccaggccggaagataatccaggagcggcagaaggagccatccgtcctgtttgaggtgcctaagttgaaaagcggaaaatctgccctggaagctgaatcagaatctttggactctttcaccgccgacagcgactctacttcccggcgtgacagcctggacaaatccggactgttcccggaatggaagaaaatgagtgctccaaaatcacaggttgagaaggaaactcagccggggggccagaacgtggttttcgtggacgaaggcgagatgattttcaaaaagaacacccgtaaaatactcaggccctcagagtataccaagtccgttattgatcttcgacctgaggacgtggttcacgagtctgggtcactcggggatcggagtaagtccgttcccgggctaaatgtggacatggaagaggaggaagaggaggaagacatcgaccacttagttaaactccacagacaaaagcttgcaagatcaagcatgcagtccggctcaagtatgtctaccatagggagtatgatgtccatctactcggaagcgggggattttggcaatatttttgtaactggcagaatagcattttcactcaaatacgagcagcagacacagtcattagtcgttcatgtgaaggagtgtcatcagctcgcctacgccgatgaagcaaaaaagcgctccaatccctacgtaaagacatatctgcttcctgacaaaagtcgtcaaggcaagcgcaagacaagcatcaagagggatactattaaccccctgtatgatgagacccttcggtatgagatacctgagagtttactggctcagcggactctccagtttagcgtctggcaccatggtcggttcgggaggaatacgttcctgggcgaagctgagattcagatggatagctggaagttggataagaagttggatcattgtcttcctctccacggcaaaatatctgcagagagtcccaccgggcttccctcacacaaaggcgagctcgtcgtgagcctcaaatatattcctgcaagtaaaactcctgtcggaggcgatcgtaagaagagcaaaggcggtgaggggggggaactgcaggtgtggattaaggaggctaaaaatctgacagctgctaaagctggtggcacttcggactcctttgttaaaggttacctgctgccaatgagaaacaaggcctcaaaaagaaagactcccgtgatgaaaaaaaccctgaatccacattacaaccacacttttgtgtataatggtgttcgcctcgaggatttgcagcacatgtgtcttgagttgaccgtctgggatcgcgagccgctggcaagtaatgacttcctcgggggagttcggctgggtgtaggtacaggaatatcgaacggcgaggtggtcgattggatggactccacaggtgaggaagtgtccctttggcagaaaatgcgacagtaccctggcagctgggccgaaggcacactgcagttgcggtcttcaatggctaaacagaagctcggcttatag

SEQ ID NO: 207735 - DNA, 2016 bp, Artificial Sequence
  Description of Artificial Sequence: Synthetic coding sequence
atgagcgagctgctggacctgagcttcctgagcgaggaggagaaggacctgatcctgtctgtcttacagcgcgacgaagaagttaggaaggccgacgaaaaaagaatccggcgccttaaaaatgaactgctggagataaaacgcaaaggagccaaaagaggcagccagcattatagcgaccggacatgtgctcggtgccaagagagcctcgggagactatctcctaaaactaatacatgccgcggctgtaatcatctcgtgtgtagagactgtcggatccaagagtcaaatggtacatggcgctgtaaggtctgtgcaaaagaaattgaacttaagaaggctacgggggattggttctacgaccaaaaggttaacagattcgcttatagaacaggctctgaaattattagaatgtccttgcgacacaagccagcagtctccaagcgagaaacagttggtcagagtttgctgcaccagacgcagatgggagacatatggccaggaagaaagatcatccaggagcggcagaaggagcccagcgtcttgttcgaggtacccaagttgaaatcaggcaagagcgcactggaagccgagagcgagagcttggacagtttcactgcggattccgactcgacctctagacgcgattcacttgacaagtccggtctctttccagaatggaaaaagatgtccgcacctaaatctcaggtcgaaaaagaaacgcaacccggtgggcagaacgtcgtgttcgtggacgaaggagagatgattttcaagaaaaatactcggaagattcttaggcctagcgagtatacaaaaagtgtgattgatttgaggcctgaagacgtggtgcacgagagcggttcattgggtgaccggtccaagagtgtcccaggcctgaacgtcgatatggaagaggaggaggaggaggaagacatagaccaccttgtgaaactccatcgccaaaagcttgctcgaagttcaatgcagagtggctcctccatgtctaccattggatccatgatgtccatctattcggaggctggcgacttcggaaatattttcgtaacagggaggatagctttttctctgaagtacgagcaacagacccagagtctggtggttcacgtcaaggagtgccaccaacttgcatacgcagacgaggcaaaaaaaaggagcaacccgtatgtgaaaacatacctcctacctgacaaaagccgccagggtaagagaaagacatcaattaaaagagacacgatcaaccctttatatgacgaaaccctgcgctatgaaattcctgagagccttctggcccaaaggactctgcagttttcagtatggcaccatggtaggttcggacgtaatacgttcctcggcgaagccgaaattcagatggacagttggaaattagacaagaagctagatcactgtctgccacttcacggaaaaatttcagctgagtcccccacggggctgccgagtcataagggagaactggtcgtgtccttgaaatatatccctgcatcaaagacaccagtcggcggggatcggaagaagagcaagggcggtgagggaggggaacttcaggtctggatcaaggaggcaaagaacctcacagcagccaaggctggtggcacctcagattcttttgttaagggctacctcttgcccatgcgcaataaagcatcgaaacgcaagacacctgtcatgaagaagaccctcaatccccactataaccacacatttgtgtataatggcgtgagactggaagaccttcagcacatgtgcctcgagcttaccgtatgggatcgcgagcccctcgctagtaacgattttctcggaggtgtcaggctgggcgtgggaacgggaatatctaacggggaggtcgtggactggatggactccaccggggaagaggttagcctatggcagaagatgaggcagtaccccggaagttgggccgaggggactttgcagctgaggagctctatggctaaacagaagctgggactttag

SEQ ID NO: 207736 - DNA, 1050 bp, Artificial Sequence
  Description of Artificial Sequence: Synthetic coding sequence
atgagcgagctgctggacctgagcttcctgagcgaggaggagaaggacctgattctttctgtattacagagggatgaagaggtgagaaaggctgacgagaagagaatccgaaggttaaagaatgaacttcttgagatcaaaagaaagggagctaagaggggtagccagcattacagcgataggacatgtgcccggtgtcaggaatctctaggacgactgagcccaaaaactaacacctgtagaggctgcaatcatctggtgtgtagagattgccggattcaggagtctaacggcacctggaggtgcaaggtgtgcgcaaaagaaatagagcttaagaaggctacaggggactggttctatgatcagaaggtaaataggttcgcttaccggacagggagtgaaatcattcgcatgtcacttcgccacaagcctgccgtctcaaagcgggaaacagtcggtcagtccctactccaccagacccagatgggcgacatctggcccggccgtaaaatcatccaggaacggcagaaggagccctctgtcctgtttgaggtgcccaagctgaaaagcggtaagtctgcgctcgaagcagagagcgaatctctggactcattcacagccgatagcgactccacgagtcggcgagactccctggataagagcgggctattcccggaatggaagaaaatgagcgccccgaaatcccaggtggaaaaggagactcagcccggcggacagaacgttgtcttcgtcgacgagggtgagatgatttttaagaagaatacacgtaaaattctgaggccatccgaatatacaaaaagcgtgatcgaccttaggccagaggacgttgtgcatgagtcagggagtctcggcgacagaagcaagtccgtgcccggtcttaatgtggacatggaggaggaagaagaggaggaagatatcgatcacctggttaaattgcatcgccagaagctggctagatccagcatgcaaagtggaagttcgatggtatcctcaattcggtcggtggtaaccggaatgctgggctattag

SEQ ID NO: 207737 - DNA, 2016 bp, Artificial Sequence
  Description of Artificial Sequence: Synthetic coding sequence
atgagcgagctgctggacctgagcttcctgagcgaggaggagaaggatttgatcctttcagtgctgcagcgggacgaggaggtaaggaaagccgacgagaagagaattaggcggctgaagaatgaactgttagagattaaaaggaagggtgcaaaacggggttctcagcattactccgacagaacgtgcgcccggtgtcaggaatcactggggcggctgtccccgaaaacaaacacttgtaggggttgcaaccacctcgtatgtcgcgactgccgcatccaggagtcaaacggcacttggcggtgtaaagtctgtgcgaaagaaatcgagctgaaaaaggcgaccggagactggttttacgaccagaaagttaaccggttcgcataccgaaccggatcagagatcatacgcatgagcctgcgacacaagccggcggtgtccaagagggaaaccgtaggtcagagtcttctgcatcagacccagatgggtgatatttggcccggcagaaaaattatccaggaaaggcaaaaggagccatctgtgctgttcgaggtgcccaagttgaaaagtggaaagtctgcactcgaggccgaaagcgagtctctggattcctttactgcggacagcgactctacaagccgccgagacagcctggacaaatctggactgtttcctgagtggaagaagatgtctgcacctaaatctcaagtggagaaggagacccaacccggcggccagaatgtggtgtttgtggacgaaggagaaatgatttttaagaagaatacacgcaagatcctgaggcctagcgaatatactaagtccgtgattgacctcaggcccgaagatgttgtgcatgagagtgggtctctcggcgatcgatcgaagagtgtgcccgggcttaacgtcgacatggaggaggaagaggaggaagaggatattgaccacttggttaagctccacagacagaagctagctcggtctagcatgcagagtggctcaagcatgtcaaccattgggtctatgatgtcaatctactccgaagcaggagatttcggcaatattttcgtcacaggtagaattgcatttagcctgaagtatgagcagcagacacagtctctggtggtacacgtgaaagagtgccatcaactggcgtacgcagacgaggccaaaaaacgatccaatccctatgtgaaaacttatctgttgccagataagtccagacaagggaagagaaagacttcaattaagcgcgataccattaaccccctctacgacgagaccctgagatatgagattcccgagtccctgctcgctcaacgaacactccaattttctgtgtggcaccatggcaggttcggaaggaacacatttctaggtgaagcagaaattcagatggactcgtggaaacttgacaagaagctagatcactgcctgccactgcacggcaagatttcagccgaatcgcccaccgggctcccctcccataaaggggaattagtggtgagcctgaagtatattccagccagcaagacccctgtcggtggagatcgcaaaaaaagcaagggaggagagggaggcgagctccaggtgtggataaaggaagctaaaaatctcaccgcggcgaaggccggcggcacctcagattcatttgtgaaaggatacttgcttcccatgcgcaataaagcgagcaaacggaaaacacctgtcatgaagaaaacactcaaccctcattataaccacacatttgtgtataacggcgtcaggctcgaggatctgcagcacatgtgcctggaattgaccgtgtgggaccgggagccgttagcttccaatgacttcttggggggagtgagactgggggtgggaactggcatcagtaatggggaggtcgttgactggatggattccacaggggaagaggtgagtctctggcagaagatgcggcagtatcccggctcatgggctgagggcactttacagctgcggtcatcaatggctaagcagaagttggggctgtag

SEQ ID NO: 207738 - DNA, 2022 bp, Artificial Sequence
  Description of Artificial Sequence: Synthetic coding sequence
atgagcgagctgctggacctgagcttcctgagcgaggaggagaaggacctgattctttccgttctgcaacgggatgaagaggtccgcaaagccgatgagaaaaggattaggagactgaaaaacgaactgcttgagataaagcgtaaaggggctaaaagggggtctcagcactatagtgaccgaacctgtgcccggtgccaggagtcactcggacgactgtcacctaaaactaatacgtgcaggggttgcaaccacctggtgtgcagagactgtcggattcaagagagcaatggcacttggcggtgcaaagtttgcgccaaggagatagagctgaagaaggccacaggcgattggttttacgatcagaaggttaaccgtttcgcttaccgaaccggtagtgaaattattaggatgtcgctccggcacaagcccgctgtgtccaaacgggagactgtcgggcagagtttacttcaccaaacccagatgggggacatctggcctggacgaaagatcatccaggaacggcagaaggagcctagttctgtgttgtttgaggtgcctaaactgaaaagcggtaaatctgctttggaagccgaaagtgaaagcctcgattcctttacggcagatagcgacagcacatcccgcagggactctctggataagtcaggcctgttccctgagtggaagaaaatgtcggcgccaaagtcccaggtggaaaaagagacacagcctggaggtcagaatgtggtcttcgtggatgaaggcgagatgatttttaaaaagaacacccggaagattttgagaccatcagaatataccaagagcgtcatcgacctccggcctgaggacgtagtacacgaatcggggagccttggagacaggagtaagtccgtccctggccttaatgtggacatggtagaggaagaagaggaagaggaggatattgaccatctggtgaaactccacagacagaagctggcgagatctagtatgcagtctggctcatctatgagcacaattggctcaatgatgagtatctactccgaagcaggcgacttcggaaacatttttgttaccggccgcatagccttttccctgaagtacgagcagcagacacaatcacttgtggtgcatgtgaaggagtgtcaccagctcgcgtacgcggacgaggctaaaaagagatccaacccatacgtgaagacctatcttcttccagataagtcccgacagggtaaacggaaaacgagtatcaagcgtgacacaattaacccactgtacgacgagaccctccgctacgagataccagagagcctgcttgcacaaagaacactccaattcagcgtgtggcatcacggccgcttcggcagaaacactttcttaggggaggccgaaattcagatggattcatggaagttggacaagaagcttgatcactgtctcccacttcacggcaagatctctgccgagagtccaaccggtttgcctagtcataagggcgaactagtggtatcgctcaaatacattcccgcttccaagaccccagtagggggagacagaaaaaagtcaaagggaggtgaaggcggcgagcttcaggtctggataaaggaggccaagaacttaacagccgcgaaggctgggggaactagcgacagtttcgtgaaagggtacctgctgcccatgcggaacaaagcctcaaaacgaaaaacaccagttatgaagaagaccctgaaccctcactataatcacaccttcgtgtacaacggggtccggctggaagacctgcagcacatgtgtctcgagctgacagtatgggacagggaaccactcgcctctaatgacttcttgggtggggtgcggctcggggtgggtacaggcattagtaatggcgaagttgtcgattggatggactctaccggcgaagaagtaagcttgtggcagaagatgcggcaatacccagggagctgggcggaggggacactgcagctccgttctagcatggccaagcagaaactcggactctag

SEQ ID NO: 207739 - DNA, 2016 bp, Artificial Sequence
  Description of Artificial Sequence: Synthetic coding sequence
atgagcgagctgctggacctgagcttcctgagcgaggaggagaaggatcttatactctccgttctgcaaagagacgaggaggtgagaaaggccgacgagaaaaggatcaggaggcttaagaatgaactgcttgaaattaagcgtaaaggggcgaaaagaggttcccaacattattccgatcggacttgcgcaagatgtcaagagagcctcggtcgactatcacccaaaactaatacctgtcgagggtgcaaccacctagtgtgccgcgactgtcgcattcaggagagtaatggcacgtggagatgtaaggtgtgcgctaaggagatagaacttaaaaaggctacaggcgattggttctacgaccagaaggtaaatcgatttgcctatcggaccggcagcgaaattattaggatgagtttacgacataagccagccgtgtccaagcgggagacagtgggacagagcttgctgcatcagacccagatgggcgacatctggcctggcagaaagatcatacaggagcgccagaaagaaccaagcgtgctgtttgaagtcccgaagttgaaatctgggaaaagtgcattagaggccgagtccgagagcctagactcattcacagcagacagtgactctacgtccagaagagactctcttgataagtccggtctgttccctgaatggaaaaagatgtctgcccccaagagccaggtggagaaagagacacagcctggcggccagaacgtcgtgtttgtggacgagggcgaaatgattttcaaaaagaatacccgcaaaattctgaggccaagcgaatataccaaaagcgtgattgacctgcgccccgaagacgtcgttcacgaatcaggcagcctaggtgatagatccaagagcgtgcccggactgaatgtggatatggaagaagaagaggaagaagaagatattgaccatctggtgaaactacacaggcagaaactggcacggagctcgatgcagtcaggatccagcatgtccacaattggttcaatgatgagtatctactccgaggccggcgacttcggcaacatctttgtgactggccgcatcgctttttccctgaaatacgagcaacagactcaatccctggttgtccatgtgaaggagtgtcaccaattggcctatgccgacgaggcgaagaagcgcagcaatccgtacgtgaaaacatatctgctgccagataagtcacgccaagggaagagaaagacatccattaaacgggacaccatcaatccactgtacgacgagaccttgcgctacgaaataccagaaagtttacttgcacagcgaactctacagttttctgtctggcaccatggcagattcggacgcaatacattcttaggcgaggctgagattcagatggacagttggaaattggacaaaaagcttgaccattgcctgcccctccatgggaaaataagcgccgagtctcccaccggattgccatctcataaaggcgagttagtagtgagtctcaagtacattcccgcatccaaaacgccagtcggaggcgatcgaaagaagagtaaagggggggagggtggagagcttcaggtatggattaaagaagccaagaacctgacagctgctaaggctggcgggaccagcgacagttttgtgaagggctaccttctgcctatgcggaataaagcctccaaaagaaagactcctgtgatgaagaagactctgaaccctcattataaccacactttcgtttataacggcgtgcgcctggaagatctgcagcatatgtgcctcgagctgaccgtatgggacagagaaccattggcctccaacgacttcctgggtggggtgcggctaggagtgggcacaggaattagtaatggcgaggtggtggactggatggatagcactggcgaggaggtgtcactttggcagaagatgaggcagtaccccggatcctgggctgaaggcacgctccaactgcgaagctctatggcgaagcagaagctcggactctag

SEQ ID NO: 207740 - DNA, 933 bp, Artificial Sequence
  Description of Artificial Sequence: Synthetic coding sequence
atgcggcgggccgccctgtggctgtggctgtgcgccctggccctgtccctccaacctgctcttcctcagatcgtggcgactaacctgccgcccgaagatcaggacggatccggcgacgactccgataatttctccggatccggcgctggagccctgcaggatatcactctttctcagcaaacgcccagtacttggaaggatacacaactcctaacagccatccctacttctccggagccaaccggcttagaggcaaccgcagcctcaacatctaccttgccagcaggcgagggcccaaaagagggggaggccgtggttttgccagaagtggaaccgggcttgaccgctagagagcaggaggcaaccccccgccctagggagacaacacagctcccgactactcacctcgcgtccactaccacagccacaaccgcccaagaacccgccacaagccacccgcaccgcgacatgcagcccggccaccatgagacttccacacccgctgggccctcacaagctgacctacacacccctcatacagaggatggcgggccctccgctacagaacgagctgctgaggacggcgcgtcatcacagttgcctgccgcagagggttccggtgagcaggattttaccttcgagacaagtggtgaaaacacagccgtggtagctgttgaacccgatagaagaaatcagtctcccgtggaccagggcgccacaggagcttcacagggtctgctggacagaaaggaagtcttgggcggtgtgattgccggcggactggtgggtctgatatttgctgtttgcctggtcggcttcatgctataccggatgaagaaaaaggatgaaggttcctactcactggaagaacctaagcaggctaatgggggggcctaccagaaacccaccaagcaagaggaattctatgcgtag

SEQ ID NO: 207741 - DNA, 933 bp, Artificial Sequence
  Description of Artificial Sequence: Synthetic coding sequence
atgcggcgggccgccctgtggctgtggctgtgcgccctggccctgagcctccagcctgcccttccacagatcgtggccactaacctccctccagaggaccaggacgggtctggggatgattctgacaatttttcaggctctggcgcaggcgcactacaggatattaccctttcacagcagacaccgagcacctggaaagatacgcaactcctcactgccattccgacatctcccgagccaacaggcctggaagccaccgccgccagcacctcaacactgccggccggagaagggcctaaggaaggcgaggccgttgtactccccgaagttgaacccggcttaaccgctcgtgagcaggaagcaacaccacggccacgggagacaactcagctaccaactacacacctggcttcaacaacaactgccactaccgctcaggagccggccactagtcatccacatagggatatgcagcctgggcaccatgaaacctcaacccccgccggaccgtctcaggcagatctacacacccctcatacagaggatggtggcccctccgccaccgaaagagctgccgaggatggagcctcctcccagctcccagctgcagagggaagtggggagcaggacttcactttcgaaacctcaggcgagaataccgccgtcgtagcagtggagcctgacagacgcaaccagtctcctgttgaccagggcgcaacaggggctagtcagggactactcgacaggaaagaagtactcggcggcgtgattgctggtggactggtcgggttaatcttcgccgtgtgcctcgtaggcttcatgctgtaccggatgaagaagaaggatgagggttcttactctctggaggagccaaagcaggctaacggaggcgcttatcagaagccgaccaaacaagaagaattttatgcttag

SEQ ID NO: 207742 - DNA, 606 bp, Artificial Sequence
  Description of Artificial Sequence: Synthetic coding sequence
atgcggcgggcctggatcctgctgaccctgggcctggtggcctgcgtcagcgccgagtcaagggcagaactaacaagtgacaaggatatgtacttagataatagtagcatagaagaagcctccggtgtgtatcccatagacgatgacgattacgctagtgctagtggctccggcgcagacgaggacgttgagtcacccgaactcacaaccagcaggcctttgcccaagatcctgctgacaagcgccgcccccaaggtcgagaccacgaccctaaacattcagaataagataccagcccagactaagagcccagaggagacagacaaggagaaagtgcacctgagtgactcagaacgcaaaatggatcccgccgaagaggatacaaacgtttacacagaaaagcatagtgactccctctttaaacggacagaagtgctggcagccgttattgccgggggggtgattgggtttctgtttgctatttttctcattttgctgctggtatacagaatgagaaaaaaggacgaagggtcctacgacctcggagagcgcaaaccatcctccgcagcttaccaaaaggcgccgacgaaagaattttacgcctag

SEQ ID NO: 207743 - DNA, 498 bp, Artificial Sequence
  Description of Artificial Sequence: Synthetic coding sequence
atgcggcgggcctggatcctgctgaccctgggcctggtggcctgcgtgagcgccgaatctgtgcgggctgacgaagacgtagagtctcctgaactgacaactagccggccactgccaaaaattttgctgacctccgccgctcccaaggtggaaacaaccaccctgaatattcaaaataaaattccagcacaaacgaagagccctgaggaaactgacaaggaaaaggttcacttgagcgactctgagagaaaaatggaccctgccgaagaagacaccaatgtgtacacagaaaagcattcagactccctcttcaaacggacggaagtccttgcggctgtgattgccggtggcgtgataggatttctgtttgccatctttcttatactgcttctggtctatcgtatgcgcaaaaaggacgagggcagctatgatttaggcgagcggaagccatcttccgcagcttatcagaaagcccccactaaggaattttatgcctag

SEQ ID NO: 207744 - DNA, 519 bp, Artificial Sequence
  Description of Artificial Sequence: Synthetic coding sequence
atgtacctggacaacagcagcatcgaggaggccagcggcgtgtaccctatcgatgacgacgactacgcctcagcatctggctcaggagcggacgaggacgttgagtcccccgaactcaccacgtccagaccactgcctaaaatcttgcttacaagcgccgcacctaaggtggagaccacgacactgaatattcagaataaaatcccagcacaaaccaagtccccggaggaaactgacaaggaaaaggtccacctctccgacagtgaacggaagatggatcccgcagaggaggacaccaacgtgtacacagagaagcatagtgactccctgtttaaaagaacagaggtgctcgcagcggtgatcgcaggtggagtaattggatttttatttgctatcttcctcatactcctattggtgtaccgtatgaggaagaaagatgaaggcagctacgacctcggggaaagaaagccttcatcggctgcatatcagaaggctcccaccaaggagttctatgcgtag

SEQ ID NO: 207745 - DNA, 519 bp, Artificial Sequence
  Description of Artificial Sequence: Synthetic coding sequence
atgtacctggacaacagcagcatcgaggaggccagcggcgtgtaccctattgatgatgacgattacgcaagtgcctcaggtagtggggcggatgaagatgtggagagccccgagttgaccacctctcggcccttgccaaaaatcctcttgaccagcgcggctcccaaggtagaaaccacgacgttgaatattcaaaataagatccccgcccagactaaaagcccggaggagacagacaaggaaaaggtgcacctcagtgacagtgaacggaaaatggacccagcagaggaagatacaaatgtctacactgaaaaacattccgattccttgtttaaacggaccgaggtcttagccgccgtgatagcaggtggcgtcattggctttctgttcgcaatctttctcatcttgctgctggtgtatcgcatgaggaagaaggatgaaggatcttacgacttgggcgaacgcaagccctcctccgctgcctaccaaaaggcacctacaaaggaattctatgcctag

SEQ ID NO: 207746 - DNA, 606 bp, Artificial Sequence
  Description of Artificial Sequence: Synthetic coding sequence
atgcggcgggcctggatcctgctgaccctgggcctggtggcctgcgtgtcagcagagtctcgcgcggaattgacttccgataaggacatgtatctggataattcgtcgatcgaagaggccagcggggtgtatccgatcgatgatgacgattatgctagcgctagcggatccggcgcggacgaggatgtcgaatccccagagctgactacatccagacccctgcccaagatcctcctaacctctgccgctccaaaggtcgagacaactacactaaacatccagaataagatacccgcccagaccaaatcccccgaggagaccgataaagagaaagtccacctctcagattcggaaagaaaaatggaccctgctgaagaagataccaacgtgtacacggagaagcactccgacagtctatttaagcgcacagaggtcctggctgccgtgattgctgggggagtgataggttttctatttgctatcttccttatcctgctgctggtatacaggatgcggaaaaaggacgagggcagttacgatctgggcgagcgcaaaccgtcctcggctgcatatcagaaggctccaaccaaagagttttatgcctag

SEQ ID NO: 207747 - DNA, 576 bp, Artificial Sequence
  Description of Artificial Sequence: Synthetic coding sequence
atgcgggtggcctgcgtgagcgccgagagccgggccgagctgaccagcgataaagatatgtacttagacaattcttctatcgaggaagcttcgggtgtttatcctattgacgacgatgattatgcctccgcaagcggctctggtgccgacgaggacgttgaaagtccggagttaactacatcccgacctcttcctaagatcctgcttacctccgccgccccgaaagtggaaacaacgactctgaatatacagaataagatcccagcacagactaaatctcccgaggagacggacaaggaaaaggtgcacttaagcgactcagagcgcaagatggatcccgcagaagaagacacgaatgtatacaccgagaaacactccgactcgctgttcaagcggactgaagtactggccgccgtgattgcgggtggcgtgatcggatttctgttcgccattttcttgattctgcttcttgtgtaccgaatgcggaaaaaggacgaaggcagctatgacttaggagaacggaagcccagcagtgccgcatatcagaaagccccaactaaggaattttatgcgtag

SEQ ID NO: 207748 - DNA, 1155 bp, Artificial Sequence
  Description of Artificial Sequence: Synthetic coding sequence
atggccatcgcctacctgggcagcagctgccccagccagccccccagctcgctagcactgtccctgagtcctacacctagcgatttcgagcaggaatcgggcattgagactgctatgcggttctccccagatgtggctttagcggtcagtacaactccagccgtgctgccgacaacaaacatccaacctgtcgggaccccatttgaggaactccctagtgagcgtcctactttggagcccgccacaagccctttagtcgtgacagaggtacccgaggagccttcacagcgggcgacaactgtgagcactactatggccaccaccgcagcaacctcaacgggagatcccacggtggcgactgtgcccgcaacagtcgctacggccaccccctccactcccgctgcccctccttttactgctacgaccgcggtgattagaacaacaggtgtgcgtcgcctgctacctctccccctaactacagtggcaactgccagagccacaactccagaggctccctcccccccaactacagcagccgtgctggatacagaggcacctacgcctcggctcgtgtctaccgctacctcccgaccaagggctttgccaagacctgcaactacccaggaaccagacatcccagagaggtctacactgcccttgggtacaactgctcccggtcccaccgaagtggcccagacacctactccagagacattcctgacgacgatcagagatgagcctgaagtcccagtgagtggaggtccatccggagacttcgaactccctgaagaggaaaccacacagcctgacacagcaaatgaggtggtcgctgtgggaggcgccgccgccaaagcctcctcacctcctgggaccctgccaaaaggcgctaggcctggtccaggcctcctggacaacgcaattgactcagggtcttccgccgcccagttgccccagaaatctatcctggagagaaaagaagtgctggtggccgtgatcgttggaggggtggtcggggcgctgtttgcagcatttctggtcaccctgttaatctacaggatgaagaaaaaggacgaaggttcatatacactcgaggaacccaagcaggcaagcgtgacctaccagaagccagataagcaagaggagttttacgcctag

SEQ ID NO: 207749 - DNA, 1329 bp, Artificial Sequence
  Description of Artificial Sequence: Synthetic coding sequence
atgaagcccggccccccccaccgggccggcgccgcccacggcgccggtgcaggcgccggcgcagccgccggacccggagcaagaggcctacttttgccaccacttttacttctgctgctcgccggcagagctgccggggctcaacgctggcgaagcgagaacttcgaacgccccgttgatcttgaggggagtggtgacgacgattctttccctgatgacgaattggacgacttatattcagggtctgggagcggatattttgagcaggagtcaggaattgagaccgctatgcggttctctccggacgttgcattggcagtgtccacaaccccagccgtgctccctactacaaacatccagccggtagggacccccttcgaggagctgccaagcgagcggcccacacttgaacccgccaccagcccccttgtagtgactgaggtgcccgaagagccttctcaacgcgccactacagtgtccacgaccatggctaccactgcggcaacttccactggcgatcctaccgtcgctacggtgcccgccacagttgcaacagccaccccaagtactcctgctgccccaccatttaccgctactaccgcggtgattcgaacaaccggtgtgcgccgtctgttaccactccccctcacaaccgtggcaacggcaagagccaccactccagaagcaccatccccgcccacaaccgccgctgtgctggacacagaggcccccactcccaggttggtctccactgctacctcacggcccagagccctgcctcgtcccgcaactacacaggaacccgatatccctgagcgttctacgctgcctttgggtacgacagcccctggtccaactgaagtggcacagacaccaacaccagaaacatttctcaccaccattcgggacgagccagaggtacccgtctcaggcggcccaagcggtgactttgaactcccagaagaagagacaacccagcccgacaccgccaatgaagtggtcgccgtgggcggcgccgcagctaaggcctccagtccccctggaacactccccaagggcgccagaccagggcccggcctgttggacaacgccatcgactcaggctcaagcgcagctcaactgccacaaaaatccattttagaacggaaagaagtacttgtggcagttatcgtcggaggcgtggttggagcactgtttgcggcctttttagtcaccctgttgatttaccggatgaaaaaaaaggacgagggatcttacaccctcgaggagcccaagcaggccagtgtcacctatcaaaaacccgacaagcaggaggaattttacgcatag

SEQ ID NO: 207750 - DNA, 597 bp, Artificial Sequence
  Description of Artificial Sequence: Synthetic coding sequence
atggcccccgcccggctgttcgccctgctgctgttcttcgtgggcggggtcgctgaatccatacgtgagaccgaagtgattgatccccaggacctacttgagggaaggtacttcagcggagctctgccagacgatgaagatgttgtgggacccggacaggaatcagatgacttcgaactcagcggcagtggtgatctagatgacctggaggacagcatgattggcccagaggtagttcaccctctagtgccactcgacaaccatataccagagcgcgcagggtctgggtcccaggtgccaaccgagcctaaaaaactcgaagaaaacgaggtcatcccaaagcgcatctcccccgtggaggagtcagaagatgtaagtaacaaggtgtccatgtcatctactgtccaaggctccaacattttcgagagaaccgaggtgttggcagccctgatagtgggtggaattgttgggatcttgtttgccgtcttcctgatcttgctgctcatgtacagaatgaaaaagaaggatgaaggaagttacgacttaggtaagaagcctatctacaaaaaagccccaacaaacgaattttatgcttag

SEQ ID NO: 207751 - DNA, 381 bp, Artificial Sequence
  Description of Artificial Sequence: Synthetic coding sequence
atgatcggccccgaggtggtgcaccccctggtgcccctggacaaccatataccggaacgtgcaggcagcgggagccaggtccctacagagccgaagaaattagaagaaaatgaagtcatccccaaacgtattagcccagtggaggagtctgaggacgtttctaataaagtctcaatgagctcaactgtgcagggctcaaatatttttgaacggactgaggtgttggcagctctgattgtggggggtatagtgggtatcttgtttgcggttttcttaattctcctactgatgtaccggatgaaaaaaaaggacgaggggagctacgatctgggtaagaagcctatttataagaaggcccctaccaacgaattctatgcctag

SEQ ID NO: 207752 - DNA, 1851 bp, Artificial Sequence
  Description of Artificial Sequence: Synthetic coding sequence
atgttccggaccgccgtgatgatggccgccagcctggccctgaccggagcagtggttgcccatgcctactacctgaaacatcagttttatcccacggtcgtctatctcactaaaagttctccgtccatggccgtgctctacattcaagcattcgttttggtgttcctgctaggcaaggtgatgggtaaggtgttttttggtcagctgagggcggctgagatggagcatttacttgaacgttcctggtatgccgttactgagacctgcctagcttttaccgtgttccgagacgactttagcccccggttcgttgctttgtttacacttctgctgtttctgaagtgcttccactggttggctgaagatcgtgttgatttcatggagcgatcccctaatatatcgtggttgttccattgccgcatcgtgtcgctgatgtttttgctgggcattctcgattttctctttgtttcacacgcctatcatagtatcctgacccggggagcgagcgtacagctggtgtttggcttcgagtacgccattctcatgaccatggtacttacaatcttcatcaagtatgtactccatagcgtcgatctccagagcgaaaacccatgggataacaaggctgtgtacatgctctatactgagttgtttactggcttcattaaagtgcttctgtatatggcatttatgacaatcatgataaaggtgcataccttccctctcttcgcaattcgacccatgtacctggccatgcgccagtttaagaaggctgtgactgacgcgatcatgtcacgccgagccatcagaaacatgaatactctttacccggacgctacccccgaagagctccaagcaatggataatgtctgtatcatttgtagggaggagatggtaacaggagcaaagcggctgccctgcaatcacatctttcacacaagttgcctcagaagttggttccagaggcaacagacctgcccgacatgtcggatggatgtgctgcgagcctctctgcccgcccagagtccccctccccccgaaccggcagatcaggggccgccccccgcaccacaccccccacctttgctgccccagccgcccaatttccctcagggactgctgccccctttcccccctggaatgttccctctttggccccctatgggacctttcccccctgtgccacctcccccctcctcgggcgaagcagttgctcccccgagcacaagtgccgccctgagcaggccgtcaggagctgcgactacaacagcagccggcaccagcgccaccgccgccagcgctaccgcttccggccccggatcagggtctgcccctgaggctggccccgcgcctggattccctttcccgcccccatggatgggtatgccattgccccccccattcgcctttccacccatgcccgttcctccagctgggtttgcggggctgactccagaagagctgcgggcgcttgaagggcatgaacgtcaacacctggaggccaggctgcagagccttcggaacatacacactttacttgacgcagctatgctgcagatcaatcagtatttgacagtgctggcctccctgggcccgccacgccccgccacaagcgtgaactccaccgaagagactgcgactactgttgtagcggctgccagcagcacctcgatcccctcctccgaggcgactactcccacacctggcgccagcccacctgctcccgagatggaacgccccccggctcccgaaagcgtgggcacagaggagatgcccgaggacggggaacccgatgcagctgaactcagacgccgacgcttgcagaagttagagtctccagtggcccattag

SEQ ID NO: 207753 - DNA, 1698 bp, Artificial Sequence
  Description of Artificial Sequence: Synthetic coding sequence
atgttccggaccgccgtgatgatggccgccagcctggccctgaccggggccgtggtggcacacgcctactaccttaaacatcaattttacccaactgttgtgtacctgactaaaagttctccttcaatggcagtgctttatatccaagccttcgtgctcgtgttcctgttaggcaaggtcatgggcaaggtcttttttggccagctgagagctgcagaaatggaacatctcttggaacgctcctggtatgctgtgacagaaacttgcctcgcttttactgtcttccgcgatgatttcagtcctcgcttcgtcgcgctgtttacacttctattattcctaaaatgctttcactggctcgctgaggacagggtggacttttatgctatcctcatgacaatggtgctgaccatttttataaagtacgtcttgcacagtgtggacttgcagtctgagaacccttgggacaataaagccgtgtatatgctttacaccgaactgtttacaggcttcatcaaagtactgctttatatggctttcatgaccatcatgatcaaggtccacaccttccccttatttgcgatacgcccaatgtatcttgccatgcgacaatttaagaaggccgtcacggacgccatcatgtcccgtagagctataaggaacatgaacacactgtatcctgacgcgacaccagaggagctgcaagccatggacaatgtatgcattatctgtagggaagagatggtgactggcgccaaaaggctgccttgcaaccatatttttcacacatcatgcctcagatcctggttccaacgccagcagacgtgtccaacctgtagaatggacgtactgcgcgcatctttacctgcccagtctcccccccctcccgagccagccgatcagggtccacccccagcgccacacccccctcctctgctgcctcaaccgccaaattttccccaaggcttattacccccattccctcccggcatgtttcccctctggcctccaatgggaccgtttcctccagttcctcctccaccctcatcaggtgaggccgtagccccaccctcaacgagcgccgccctttcaagaccctcaggagctgccaccacaaccgccgccgggacctctgcaacggcagcatcagccaccgcgtctggaccaggaagcggatccgccccggaggccggtcccgccccaggcttcccttttccccccccttggatgggtatgcctctgcctcccccatttgcctttccaccgatgcctgtgcctcctgccggatttgcaggactgacccccgaagagctgcgtgcgctcgaagggcatgagcggcagcatctggaagcgcgcctgcagtcgctcaggaatattcacactctgctggacgccgctatgttacagattaaccagtacctgactgtgctggcttctttgggcccgccccgccccgctaccagcgtgaattccactgaggaaaccgcaacgacagtggtagcggccgcgtcctctacctctatccccagttctgaggcaacgacacccacgcccggggcctcccctcctgccccagagatggagaggccacccgctcctgagtctgtgggcacagaagagatgccggaagatggtgagcccgatgctgccgaactaaggaggagaaggttgcaaaagttggagtctccagtggcacactag

SEQ ID NO: 207754 - DNA, 1854 bp, Artificial Sequence
  Description of Artificial Sequence: Synthetic coding sequence
atgttccggaccgccgtgatgatggccgccagcctggccctgaccggtgctgtggttgcacatgcctactacctaaagcaccagttctatcccactgtcgtctatctgactaaatcctctccgtctatggctgttctgtatatccaggctttcgttctggtcttcttgctaggcaaggtgatgggcaaggtcttcttcgggcagctacgggcggcagaaatggagcatctcctcgaacgttcttggtacgcagtgaccgagacttgcctggctttcactgtgttccgcgacgacttttctccccgttttgtcgccttgttcactctgctgcttttcttgaagtgctttcattggctggccgaggatcgcgtggacttcatggagcggtcgccaaatataagctggctattccattgccgcattgtctcccttatgttcctgttggggattctggactttctattcgtgagccatgcctaccactcgatcctgacgagaggagcttcagtgcagctagtctttggatttgaatatgccatcctcatgaccatggtgttaacaatcttcatcaaatatgtgctccatagcgtggacttgcagagcgaaaacccatgggataataaggccgtgtatatgctgtatactgagttgtttaccggcttcatcaaagtgctactctacatggcctttatgaccatcatgataaaggtccacacattcccactatttgcgatacggcctatgtatttggcgatgcgtcagttcaagaaggcggtgactgatgccatcatgagccgccgagcgatcagaaacatgaacactctgtaccctgacgccacccctgaggagctgcaggcgatggacaatgtgtgcatcatatgcagagaagaaatggtgactggggccaaacgcctcccgtgtaaccatatttttcacacaagctgtctgagaagctggttccagcgtcagcagacatgcccaacatgccgcatggatgtgttacgtgcttcactgcctgcccagagtccccctcccccagagcccgccgatcaggggcccccacccgcaccccacccacccccgctgctcccccaaccgcccaacttcccacaaggcctgctgccgcctttcccgccagggatgtttcctttgtggccccctatgggtccatttccacccgtccctccccctccatcctctggcgaggcggtcgcaccaccaagtacaagcgcagctgctctttcacgcccatccggtgcagcaacaactacagcggccgggactagcgccacggccgcttctgccacggcttcagggcccggaagcgggtccgcaccagaggcagggccagccccggggtttccctttcccccgccttggatgggcatgcctctaccaccacccttcgccttccctcccatgccggtacctcccgcaggcttcgccggactgacccctgaggagctgcgagccctcgaggggcacgagcgtcaacacctggaggctaggctgcagtctctgaggaatattcacacgctgctcgatgccgctatgctccagattaaccagtacctcacagtgctcgcatccctgggccctcccagaccggctaccagtgtgaacagtactgaggagacagctaccaccgtggtcgcggcagcttcttccacttcgatccccagttctgaagcaaccacgcccacgcccggcgccagcccaccagctccggagatggagcgaccgcctgctccagagagtgtgggtacagaagaaatgcctgaggatggtgagcccgatgcagccgagctccgaaggcgcaggcttcagaagctcgaatcccctgttgctcattag

SEQ ID NO: 207755 - DNA, 1890 bp, Artificial Sequence
  Description of Artificial Sequence: Synthetic coding sequence
atgttccggaccgccgtgatgatggccgccagcctggccctgaccggggcagtcgtggcccatgcctactatttaaagcatcagttttaccctacagtggtttacctgactaaaagctcaccatcaatggcagtgctgtacatccaggctttcgtgcttgtcttcctgctcggcaaggtgatgggtaaggtgttttttggacagctccgcgccgccgagatggagcacctattagagaggtcctggtatgcagtaaccgaaacatgcctggcttttacagtttttcgcgacgacttctccccaaggttcgtggcactcttcacactgctattgtttctaaagtgcttccactggcttgcagaagatagggttgacttcatggagcgctcaccaaacatcagctggctgtttcattgcaggatagtgagtctcatgttcctactggggattctcgactttttattcgtcagtcacgcttaccacagtattctaacaaggggagcctccgtccagttggtgtttggatttgagtacgctattctgatgaccatggttctgactatattcatcaagtacgtactccacagtgtggacctgcaatctgagaatccctgggacaacaaggctgtgtatatgctctataccgagctcttcaccgggttcatcaaggtactgttgtatatggcttttatgacaattatgattaaggtccacacattccccctgttcgccatccgtcctatgtacctcgctatgaggcagtttaagaaggctgttaccgacgcaataatgtcacgtcgtgctatcaggaatatgaataccctttatcctgatgccacgccagaggagctccaggccatggataatgtttgcataatctgccgggaggagatggtgacaggagctaagcgtcttccatgcaaccatatctttcacacctcctgcctccgctcctggttccagcgacagcagacctgtcctacatgccgaatggacgttctccgggctagtttgccggcccagagtccgccccccccagaacctgccgatcagggaccacctccagctccacatccgccacctctcctcccccagccaccaaacttcccccagggcctactgccccccttccctccgggtatgttcccactatggcctcctatggggccctttccaccggttccacccccaccttcttctggagaggccgtcgcgcctccctcaacaagcgccgccgcactgtcacgcccaagcggggcagcaactactactgctgccggaacctccgccactgccgcgtcagccaccgcaagcggacctggctctgggtctgccccggaggcaggccctgccccaggttttccattccccccaccatggatggggatgccactgccacccccgttcgccttccctccaatgccagtgcccccggctgggttcgcagggctgacccccgaagagctcagggcccttgagggccatgagagacagcatttagaggctcgcctgcagtccctgcggaacattcacacgctgctcgatgccgcaatgctgcaaattaatcagtacctgactgtgctggctagcttgggtccacctggcctgccgctacagagcacccctttgaggaggctaccattgcagctgctattgctccctccacctcccgcttccctggcccaacggccgcgcccacagccacaagagcccccccatcaacccctgaaatggaagggcctgcagctgctgagtcagtgggctcagcggaggtgtctcagaatggagagcccaatgcagcaatcctcagccggggccgcttgcagaagctggtccttgttgttgccaacggataccgcccctgcccagccacaaccacttcttttttag

SEQ ID NO: 207756 - DNA, 1851 bp, Artificial Sequence
  Description of Artificial Sequence: Synthetic coding sequence
atgttccggaccgccgtgatgatggccgccagcctggccctgaccggcgccgtggtagcccacgcttactatctaaagcatcagttttatccaacggttgtatatttgactaagagctcgcccagcatggccgtgctgtacatacaagcgttcgtcctggttttcctgctcggtaaggtaatgggcaaagtcttctttggacagttaagggctgcggagatggagcatcttcttgagagatcttggtacgctgtgactgaaacctgtctcgccttcaccgttttccgcgacgatttttctcctcgctttgtcgctctgttcacactgcttctgtttctcaaatgcttccactggttggcagaggaccgggtagactttatggaaagatccccaaacatctcgtggctgttccattgtaggattgtctccttgatgttcctcctgggcattcttgactttctctttgtgagtcatgcatatcacagtatcctgacgagaggggcctcagtgcagttggtgtttggtttcgaatatgcgatactcatgactatggtcctcacaattttcattaagtatgttctgcacagtgtggacctgcagtctgaaaatccctgggacaacaaggcagtttacatgctttacaccgaactatttaccggctttatcaaagtcttgctttacatggccttcatgaccatcatgatcaaagtgcacacatttccattatttgcaatcaggcctatgtatctcgctatgagacagtttaaaaaggcggtgaccgatgcaattatgtcaaggagggccatacggaacatgaacaccttgtaccccgatgccacaccagaagaattacaggctatggataatgtgtgtataatttgcagagaagagatggttaccggggccaaacgtctcccatgcaaccacatctttcatacgagctgtctgaggagctggtttcagcgccagcagacatgccccacctgcagaatggacgttctgagggcctccctccccgcacaatcgccgccacctccagagcccgctgaccagggaccccctccggcccctcacccaccacctctgctcccacaaccaccaaattttccccaaggcttgctccctcccttcccccctggaatgtttcccctatggcctccaatgggccctttcccacctgtgcccccaccaccttcctctggcgaggctgtggcaccacctagtaccagtgcggcactctctagacccagtggggctgccacaacaactgccgctggaactagtgcaaccgcagcaagtgccactgccagcggtcctggatccgggtcagctccggaggctgggcctgccccaggtttcccatttccccctccttggatgggaatgcccctgccaccgccgttcgcattcccccccatgcccgtccccccggccgggttcgccggtttaacgcctgaggagctgagggctttagaaggtcatgaaaggcagcacctggaggctaggttgcaatccctcagaaacattcacaccttactggacgcagcgatgctacagattaaccagtatctgaccgtcctggcttccctgggtccacctcgccctgcaacctccgtcaacagcaccgaagagaccgcgaccacagtagtggccgccgctagttccacgagcatcccatcaagcgaagcgacaacccccacccccggtgcttccccacctgcccctgagatggagaggcccccggccccagaatccgtgggcaccgaggaaatgcccgaagatggggagccagacgctgcagagctgcggaggcgaaggctgcagaaactggaatccccggtagcacactag

SEQ ID NO: 207757 - DNA, 1191 bp, Artificial Sequence
  Description of Artificial Sequence: Synthetic coding sequence
atgagcgtggccttcgccagcgcccggccccggggcaagggcgaggttacccagcagacaatccaaaaaatgctcgatgaaaaccatcatctcattcaatgcatcctggagtaccagtcaaagggcaaaacggcagaatgtacccagtaccaacagattctgcaccgcaatctcgtatacctagccacaattgccgactcaaaccaaaatatgcaatccctgcttcccgccccccctacgcagaacatgaatctcggacccggcgctctgacacagagtggatcttcccagggtctgcacagccagggatctctgtccgatgccatatctacaggcctgccgccttcttccctgcttcaggggcagatcggcaatgggccttctcatgtcagtatgcagcagactgcgccaaacaccctgcctactacgtccatgagcatcagcggacccggatattctcacgctgggcccgcatcccagggggtccctatgcagggacagggcacgataggtaactatgtgagcaggacaaatatcaacatgcagagtaatcccgtatctatgatgcagcagcaggcagctacaagccattatagttctgcacagggggggtctcagcactaccagggacagagctccatcgcaatgatgggccaaggctcacaggggtcctctatgatgggccagcggcccatggcgccttataggccctctcagcagggctcttcccagcagtaccttggccaggaagagtattacggtgagcaatattcacatagccagggcgcagctgagcccatgggtcagcagtactacccagacggccatggagattacgcctatcaacaatcttcttacactgaacagtcctatgacagatcttttgaagaatcaacccagcattattacgaggggggaaactctcagtactcccagcaacaggccggttaccagcagggagctgctcaacagcaaacatattctcagcaacaataccccagccagcagtcttatcccggacagcaacaggggtacggaagcgctcagggggctccaagccaataccctggataccagcaggggcaggggcagcagtacgggagttatcgggcccctcaaacggctcccagcgcacagcagcagcggccatatggttacgaacagggacaatacggaaattaccaacagtag

SEQ ID NO: 207758 - DNA, 1200 bp, Artificial Sequence
  Description of Artificial Sequence: Synthetic coding sequence
atgcagagcctgagcaccgaggcccggtacgtgccccgggtgccccagcatagggatcagattagtcccaggtctcctcaacacggaggacagatctgcccccgttcacctctgcacagaggccagatctgcccgcggtctcctcccgccagaaggtatcagcagattctgcataggaacctggtttacctggctaccatcgctgactccaatcagaatatgcagtctttgttgcccgcaccacccactcagaacatgaacctcggacctggcgcactcacccagagcggaagctcccagggcttgcactcccagggaagcttgtcagatgccatttcgactgggctcccccccagctcacttctccagggtcaaatcggcaatgggccctcacatgtatccatgcagcagaccgctcccaacacattgcctactactagtatgagtatttccggaccaggctatagtcacgccggcccagcctctcagggcgtcccgatgcaaggacaaggtaccattggtaactatgtcagcaggacaaatatcaatatgcagtcaaatccagtgtcaatgatgcagcagcaggcggcaacaagtcactacagttcagcacagggaggttctcagcattaccaggggcagagcagcatcgctatgatgggccagggctcccaaggaagctccatgatgggccagcggcccatggccccttaccgcccctcgcagcagggtagctctcaacagtaccttggtcaggaggagtactatggggagcaatactcacacagtcagggcgcagccgaaccaatgggacaacagtactacccagacgggcacggagattacgcgtaccagcaatcctcatatactgagcagtcctatgacaggtcatttgaggaaagcacccagcactactatgagggcgggaattcccagtactcacaacaacaggccggataccaacagggcgcagcccagcaacagacctactctcagcagcagtatccttcccagcagagctatccgggacagcaacaaggctacggctccgctcaaggggccccaagtcaatacccgggctaccagcaggggcagggacaacagtacggaagctaccgagcccctcagaccgcacccagtgcacagcagcaaagaccatacgggtacgagcagggacagtacgggaattatcagcagtag

SEQ ID NO: 207759 - DNA, 1191 bp, Artificial Sequence
  Description of Artificial Sequence: Synthetic coding sequence
atgagcgtggccttcgccagcgcccggccccggggcaagggcgaggtgacacagcaaaccattcagaagatgctggatgaaaatcatcaccttatccaatgcatactggagtaccagtccaagggaaaaaccgcggaatgcacccagtatcagcagattctccaccggaacctggtttatctcgctactatcgctgacagcaaccagaacatgcaaagcctgctgcctgcaccacccactcaaaacatgaacctgggacccggagcgctgacacagagcggttcatcccagggacttcacagccagggctcactgtcagatgccatatcgactggcttgcccccgagcagcctgcttcagggacagatcggcaacggcccgtctcacgtttctatgcaacagactgcccctaatacactgccaaccaccagtatgagcataagtggacctggctacagccatgccggcccagcctcccaaggcgtgccaatgcagggccagggcacaatcggcaactatgtgagtagaactaacatcaatatgcaatctaaccccgtgagtatgatgcagcagcaggccgccacaagtcactacagctccgcccaaggtggatcccaacactaccagggtcagtcttcaattgccatgatggggcaggggtcgcaaggcagtagtatgatgggccagcgccctatggccccgtacaggccctctcagcaaggtagctctcaacaatacctcgggcaggaggagtactatggggaacagtactcccacagccagggagctgccgagcctatgggacagcagtactatccagacggccacggagactacgcctaccaacaaagttcttatactgagcagagctatgacaggagtttcgaggagtcaactcagcactactacgagggaggcaactcacagtattcacagcagcaggcaggatatcaacagggcgccgcccaacagcagacctattcacagcagcagtacccaagtcagcagagctatcccggccagcagcagggatacggttccgcgcagggtgccccgtctcaataccccgggtatcagcaggggcaaggacaacaatacgggtcctatagggcaccccagactgcacccagcgctcagcaacaacgtccatatggatacgaacaggggcagtacggcaactatcagcagtag

SEQ ID NO: 207760 - DNA, 387 bp, Artificial Sequence
  Description of Artificial Sequence: Synthetic coding sequence
atgcagagcctgagcaccgaggcccggtacgtgccccgggtgccccagcatcgcgaccagatctctccccgtagtccacagcacggtggacagatttgccccagatcgcctctccatagaggccagatttgcccccgtagcccccctgctagaaggtatcagcagattcttcatagaaacctggtttacctggccacaatcgcagactccaatcagaacatgcagagccttctgcctgccccacccacacaaaacatgaatctggggcccggagcattgactcagtcgggcagttcccaaggcttacacagccaagggtccctttccgacgctatctctaccggacttccgcccagttccctgttgcagggacagataggcaactag

SEQ ID NO: 207761 - DNA, 234 bp, Artificial Sequence
  Description of Artificial Sequence: Synthetic coding sequence
atgagcgtggccttcgtgcccgactggctgcggggcaaggccgaggtgaaccaggaaactatccaaaggctgcttgaagaaaacgatcagctgatcaggtgtattgttgagtatcagaacaagggaagagggaacgagtgtgtgcagtatcagcatgtattgcaccggaacttgatttatctcgccactatcgccgacgcctcaccaacatcaaccagtaaagccatggaatag

SEQ ID NO: 207762 - DNA, 234 bp, Artificial Sequence
  Description of Artificial Sequence: Synthetic coding sequence
atgagcgtggccttcgtgcccgactggctgcggggcaaggccgaggttaatcaggaaactattcagcgtttgttggaggagaatgaccagttgattcgttgcattgttgagtaccagaataaagggaggggcaacgagtgcgtgcagtaccagcatgtgctccatagaaacctgatttacctagcaaccatcgcagacgctagtcctacatcaacatccaaggcaatggagtag

SEQ ID NO: 207763 - DNA, 1164 bp, Artificial Sequence
  Description of Artificial Sequence: Synthetic coding sequence
atgagcgtggccttcgccgccccccggcagcggggcaagggcgagatcacccccgccgccatccagaagatgctggatgacaataatcatctgatccaatgcatcatggattcccagaacaagggcaaaacatctgaatgtagccagtaccagcaaatgctgcacacaaatctcgtctatttggctactattgcagattccaaccagaacatgcaatcccttcttccggccccccccactcaaaatatgcccatggggcctgggggcatgaatcagtccggccccccaccccctccaaggagccacaacatgccttccgatggaatggtgggaggtggaccccccgcaccacacatgcagaaccaaatgaatggtcagatgcccggacctaatcacatgcctatgcaggggccgggaccaaatcagctcaacatgaccaattcctcgatgaatatgccttctagctctcatgggagcatgggcggatacaaccatagcgtgcccagttcacaaagcatgccggtacagaatcagatgaccatgtctcagggccaacccatgggcaactacggaccacggcctaatatgtccatgcagcctaaccagggccctatgatgcaccagcagcctccttctcagcagtacaacatgcctcagggtggggggcagcactatcaggggcagcagcctccgatggggatgatggggcaagtgaaccaaggcaatcatatgatgggtcagagacagattcccccttatcgccctccccaacaagggccccctcagcagtactccgggcaggaagattattacggagatcaatactcccacggcgggcagggaccaccggaaggaatgaatcagcaatattaccccgatggcaattctcaatacggccagcagcaagatgcataccagggcccgcccccgcagcagggttaccctccccagcaacagcagtatccagggcagcagggatatccgggccaacagcaaggttacggcccgagccaggggggtccagggccccagtacccaaactacccgcagggtcaagggcagcagtatggcggataccgccccacacagcccggtcctcctcagccgccacagcagcgaccctacggctacgatcagggccaatacgggaactaccagcagtag

SEQ ID NO: 207764 - DNA, 1257 bp, Artificial Sequence
  Description of Artificial Sequence: Synthetic coding sequence
atgagcgtggccttcgccgccccccggcagcggggcaagggcgagattacccccgcggcaatccaaaagatgctggatgataacaaccacctcattcaatgtatcatggacagtcagaacaagggcaagacgagcgagtgctcacagtaccagcaaatgctacacaccaatctcgtgtacctcgcgactattgctgactccaatcaaaatatgcaaagtctactgccagctcctcctacacagaacatgcccatggggcccggcggcatgaatcagtccggcccgcccccccctccccggtctcacaacatgcccagcgacggcatggtcggcggcggccctcccgctcctcatatgcagaatcagatgaatggccagatgccaggacccaatcacatgccaatgcaagggcccggcccaaatcagttgaacatgaccaactcttcgatgaatatgccatccagcagccacggtagtatggggggatacaaccattctgtgccttcgtcgcagtcgatgccggtgcagaaccaaatgacaatgagccaggggcagccaatgggaaattacgggcctcgtcctaacatgtccatgcagcccaatcaaggaccgatgatgcatcagcagcccccatcccagcagtataatatgcctcagggggggggtcaacactaccagggacaacagcctccaatgggaatgatggggcaggtgaatcaggggaaccacatgatgggccagagacagatcccgccctataggccaccccagcaaggaccccctcaacagtacagcggccaagaagattactacggagaccagtactcccacggcggacagggcccccctgaaggtatgaaccagcagtactaccccgatggtcataatgattacgggtaccagcaacctagctaccccgagcagggatatgatcggccgtacgaagactccagccagcactattacgaaggcggtaacagtcagtacggacaacagcaagatgcctaccagggcccccccccccagcagggatatcctccgcagcagcagcaataccctgggcagcagggatacccgggccagcagcaaggctatggaccctcacaaggcggccccggacctcagtatcccaattacccccagggccaaggacagcaatacggtggctacagaccaacgcagccaggaccacctcagccacctcagcagcggccatacggctacgaccagggccagtatggcaattaccagcagtag

SEQ ID NO: 207765 - DNA, 1266 bp, Artificial Sequence
  Description of Artificial Sequence: Synthetic coding sequence
ggcggcaacatgagcgtggccttcgccgccccccggcagcggggcaaaggtgaaatcacaccggccgcaatccagaagatgctcgacgataacaaccacttaatacaatgcatcatggatagccagaataagggcaaaacatcggaatgcagccagtaccagcagatgctgcacaccaatttggtgtatttagccacgattgccgattcaaaccaaaacatgcagtcattattaccagcccctcctacccagaacatgcccatgggccccggggggatgaatcagagtgggccaccacctccacctagatctcacaatatgccctccgatgggatggtcggcggcgggcccccagcacctcacatgcagaaccagatgaacggacagatgcccgggccgaaccacatgccaatgcaagggccagggcccaaccaacttaacatgaccaacagctctatgaacatgcctagtagctctcatggaagtatggggggttacaatcactcagtgccatcgagtcagagcatgcctgttcaaaatcagatgactatgagccaaggccagcccatgggcaattacggtcccaggccgaatatgtccatgcaacctaaccaaggacctatgatgcaccagcagccaccatcgcaacaatataatatgccccagggcggcggccaacattaccagggccagcagcccccaatgggcatgatgggtcaagtcaatcagggaaaccacatgatggggcagaggcaaatacccccgtaccggcctccccaacagggacccccgcagcagtattctggtcaggaagattactacggggaccagtactcccacggtgggcaaggcccacccgaagggatgaatcagcagtactatccggatggtcataacgattacggatatcagcagcctagctaccccgagcaggggtacgataggccctacgaagacagttcacagcattattatgagggagggaattctcagtacgggcagcagcaagatgcgtatcagggccctccacctcagcagggctacccgccacagcagcagcagtacccaggtcaacagggctaccctggccaacaacaaggttacgggcccagtcaaggaggccccggcccccagtacccaaactaccctcagggccagggacagcagtacggaggatatagacccacccaacctggacctcctcagccgcctcagcaacggccttatgggtacgaccaggggcagtatggcaactatcagcagtag

SEQ ID NO: 207766 - DNA, 399 bp, Artificial Sequence
  Description of Artificial Sequence: Synthetic coding sequence
atgaaccagcagtactaccccgacggccacaacgactacggctaccaacaaccatcctatcccgagcaggggtatgatcgaccgtatgaagatagctctcagcattactatgaaggggggaactcccaatacggtcagcagcaggacgcctaccagggaccgccaccccaacaggggtaccccccccaacagcagcaataccccgggcagcagggctaccctgggcagcagcagggatacggacctagccaaggcggaccaggcccccagtatccaaactaccctcagggccagggccagcagtacgggggctatcgtcccacccagcccggacccccccaacctcctcagcagcggccatacggatacgaccagaatagcaggtggactgtatgttag

SEQ ID NO: 207767 - DNA, 1011 bp, Artificial Sequence
  Description of Artificial Sequence: Synthetic coding sequence
atgcccatgggccccggcggcatgaaccagagcggccccccccccccaccacgcagccataatatgccgagtgatggtatggtcggtggaggtcccccggcaccacatatgcagaaccagatgaacgggcagatgcccggacccaatcacatgccaatgcaaggccctggccctaaccagctcaatatgacaaattccagtatgaacatgccttcaagctctcacgggagcatgggaggctacaatcattcagtgccatcatcccagtcaatgccagtccagaaccagatgactatgtcacagggccaacctatgggcaattatggccccaggcccaatatgtctatgcagcccaatcagggacccatgatgcatcagcagcctccttcacagcagtataatatgcctcaggggggagggcagcactaccaaggacagcagcctcctatgggtatgatggggcaggttaatcagggaaaccacatgatggggcaacgccagattccaccctacaggccacctcagcaaggacctcctcagcagtactctggccaggaggattattacggcgatcagtacagccatggtggtcaagggccaccagaggggatgaatcaacaatattatcccgacggacataatgactacggataccagcagccgagttacccggaacaagggtacgatcgaccatatgaggattcctcccagcactactatgagggcggcaactcccagtatggtcagcagcaagatgcctaccaggggcctccaccacagcaggggtacccaccacagcagcaacaataccctgggcagcagggctacccaggccagcagcaaggctatggtccatctcaaggcgggcccggtcctcagtatcctaattacccccaggggcagggccagcagtatggaggctacagacccactcaacctggcccaccacagcccccacagcagcgaccgtatggatacgatcagggccagtacggcaactaccagcagtag

SEQ ID NO: 207768 - DNA, 1188 bp, Artificial Sequence
  Description of Artificial Sequence: Synthetic coding sequence
atgctggacgacaacaaccacctgatccagtgcatcatggacagccagaacaagggcaaaacttctgaatgctctcaatatcagcagatgcttcatactaacttggtgtacctggctaccatcgccgactcgaatcagaacatgcaatccctcctgccggctccaccaactcaaaatatgccaatgggcccagggggcatgaaccagtctgggccaccccccccccccagaagccataatatgccatcagatggcatggtcggtggcggcccccccgctccacacatgcagaaccagatgaatgggcaaatgcccggaccaaatcacatgcccatgcagggtccagggccgaatcagctgaacatgactaacagttctatgaacatgccttcatcttcgcatggctccatgggcggttacaaccacagcgttccttcctctcaatcgatgcccgtgcagaaccagatgaccatgtcccaaggccaacccatggggaattatggacccaggccgaacatgagcatgcagcctaatcagggtcccatgatgcaccaacagcccccgtcacagcaatacaacatgccccagggcggcggccaacactaccagggacagcagccgccaatggggatgatgggacaggtgaaccagggcaaccatatgatggggcagcgccagatacctccataccggcccccacaacagggaccaccccagcagtacagcggacaggaagactattacggagaccaatactcacacggggggcagggcccccctgaagggatgaatcagcagtactaccccgacggacataatgattatgggtaccagcaaccaagctatcccgaacagggttacgacaggccctacgaagattcgagccagcattattatgagggaggaaacagccaatacgggcaacagcaagacgcatatcagggtccaccccctcagcagggatatcccccacagcagcaacagtaccccggccagcagggctacccaggtcaacagcaaggatatggtccgagtcagggaggtcccggccctcagtaccctaactacccccagggccagggacagcagtacggagggtacaggcctactcaacctggcccacctcagcctccacagcaaagaccatatgggtatgaccagggccagtatggaaactatcagcagtag

SEQ ID NO: 207769 - DNA, 1008 bp, Artificial Sequence
  Description of Artificial Sequence: Synthetic coding sequence
atgctgcacaccaacctggtgtacctggccaccatcgccgacagcaaccaaaatatgcagtctctgctcccagccccacccacccagaatatgccgatggggccaggggggatgaatcagagcgggccacctcctcccccgagaagtcataacatgccatcagacgggatggtcggcgggggcccgcccgccccacacatgcagaaccagatgaacggccagatgccaggacctaaccacatgcccatgcagggtcccgggcccaatcaactcaacatgactaattccagcatgaatatgccctcaagctctcatgggtcgatggggggttacaatcacagcgtaccatcaagccagtccatgcctgtgcagaatcagatgaccatgtcccagggccagcccatgggcaactacggtcctcggccaaacatgagcatgcagcccaatcaagggcccatgatgcatcaacagcctccaagccagcagtataacatgccacaggggggcggccagcattatcagggccagcagccacccatgggcatgatgggccaggtgaaccagggcaatcatatgatgggacagagacaaatacctccttaccggcccccccaacagggcccgcctcagcagtattcaggacaggaggattattatggagatcagtactctcatggaggccagggacctcctgagggaatgaatcagcagtactaccccgatgggaacagtcagtacgggcagcagcaggatgcttaccagggacctcctccgcaacaggggtatcctccccagcaacagcagtaccctggccagcaaggatatcctggccagcagcaggggtatggaccctcacagggcggccccgggccacagtatcctaattacccacagggccaggggcaacagtacggcggttacaggcctacccagcccggaccaccacaacctcctcagcagcgcccatatggatacgatcagggacagtacggcaattatcagcaatag

SEQ ID NO: 207770 - DNA, 1008 bp, Artificial Sequence
  Description of Artificial Sequence: Synthetic coding sequence
atgctgcacaccaacctggtgtacctggccaccatcgccgacagcaaccagaacatgcaatcactcctccccgcgccccccacgcagaacatgcctatgggcccaggcggcatgaaccagtcaggcccaccccctcctccacgaagtcacaacatgcctagtgacgggatggtgggcggaggccctcctgcccctcacatgcagaaccagatgaacgggcagatgccgggcccaaaccacatgcccatgcagggccctggcccgaaccagttgaatatgaccaacagtagcatgaatatgccttcgtctagccatggttcaatgggaggatataaccactctgtaccctcctcacagagtatgcccgtccagaaccaaatgactatgagtcaggggcagccaatgggaaattatggcccacgtccaaacatgtctatgcagccaaatcaggggcccatgatgcaccagcaacctccgtcacaacaatacaacatgcctcagggcggaggccagcactaccaggggcaacagccacccatggggatgatggggcaggttaaccaagggaaccatatgatgggccagcgccagatccctccctatcgtcctcctcagcagggacccccacaacagtactcaggccaggaggattactacggagatcagtactctcacggcggacaaggaccgcccgaagggatgaaccagcaatactaccccgacggcaattcacagtacggtcagcagcaagatgcctaccagggacctccaccacagcagggctatccgccccaacagcagcagtatcctggccaacaaggttaccccgggcagcagcagggttatggcccctcccagggcggtcccggtccgcaataccccaactatccccaaggccagggtcaacaatacggcggataccgtccaactcaacctgggccacctcaaccgcctcaacagcgaccatatggctacgaccagggtcagtatggaaattatcaacagtag

SEQ ID NO: 207771 - DNA, 567 bp, Artificial Sequence
  Description of Artificial Sequence: Synthetic coding sequence
atgaacggcgacgacaccttcgccaagcggccccgggacgacgccaaagcttcggagaaacggagtaaggcattcgatgatattgccacgtacttctcaaagaaggaatggaagaaaatgaaatacagcgagaaaatatcctacgtgtatatgaagaggaattacaaggccatgacgaaactgggttttaaggtcacgctgccgccgtttatgtgtaataaacaggccactgactttcagggcaacgattttgataacgaccacaatagaaggatacaagtagagcacccgcagatgactttcgggcggttgcatcgaataattcctaagatcatgccaaagaagcctgccgaggatgagaacgactccaaaggcgtctctgaagcttctggccctcagaacgatgggaagcagctccacccgcctggaaaagccaacatttccgagaagataaataagcggtctgggccgaaacgtggcaaacacgcctggacccatcgccttcgagagcggaagcagctggtgatctacgaagagatttctgatccagaagaagacgacgagtag

SEQ ID NO: 207772 - DNA, 672 bp, Artificial Sequence
  Description of Artificial Sequence: Synthetic coding sequence
atgaacggcgacgacgccttcgcccggcggcccaccgtgggcgcccagatacccgagaaaatccagaaagcgtttgatgacatcgcgaagtacttctccaaggaagagtgggagaagatgaaagcttccgagaaaatcttttatgtgtatatgaaacgtaaatacgaggcaatgactaaactcgggtttaaagcaaccctccctccttttatgtgcaataaaagggcagaggacttccagggaaacgacctggacaatgatcccaatcgcggtaaccaagtcgagcggcctcagatgacgttcgggaggctgcaaggcatctctccaaagattatgcccaagaagcctgctgaggaagggaatgattcagaagaagttccagaggccagcggcccacagaatgatggcaaggagctctgcccgcctggaaagcccacaacatccgaaaaaatccacgagcgatccggcaatagggaagctcaggagaaggaggaacggcgcggtactgcacaccgctggtccagccagaacacgcacaatataggaaggttcagcctgtccaccagtatgggcgctgtccacggaactcctaagacgattacacataaccgcgatcccaaaggtggaaatatgcccgggcctaccgactgtgtgcgggagaacagctggtag

SEQ ID NO: 207773 - DNA, 567 bp, Artificial Sequence
  Description of Artificial Sequence: Synthetic coding sequence
atgaacggcgacgacgccttcgcccggcggcccaccgtgggcgcccagatacctgaaaagatacagaaggctttcgacgatatcgcaaaatactttagtaaggaggaatgggaaaaaatgaaggcatctgaaaaaatcttctacgtttacatgaagcgcaagtatgaggccatgaccaagctcggttttaaggccactcttcccccattcatgtgtaataagagggccgaagattttcaagggaacgacctcgacaacgatcctaatagaggcaaccaggtggagcgaccccaaatgacattcgggaggctacagggtatcagccctaaaattatgccaaaaaagcctgcagaggaaggcaatgacagcgaagaagtcccggaggcttccgggccacaaaatgatgggaaggagctatgtccaccaggaaaacctacaacgagcgagaagatccacgaaaggtccgggcccaaacggggagaacacgcctggacacatcggctccgcgagagaaagcaactggttatctacgaggagatcagcgatccggaggaggatgacgagtag

SEQ ID NO: 207774 - DNA, 567 bp, Artificial Sequence
  Description of Artificial Sequence: Synthetic coding sequence
atgaacggcgacgacaccttcgcccggcggcccaccgtgggcgcccagattcctgagaagatccagaaggcttttgacgatattgccaaatacttctcgaaggaggagtgggaaaagatgaaggtgagtgaaaaaatcgtgtacgtgtatatgaagagaaagtacgaggccatgaccaagctgggttttaaagccatccttccgtcttttatgcgcaataaacgagtgaccgattttcagggaaacgactttgacaatgaccccaacagagggaaccaggtgcagcggccccagatgacttttggcaggctacaggggatatttccgaagataatgccaaagaagccggccgaggaaggtaacgtgtctaaggaggtgccagaagcaagcggcccgcagaacgacggaaagcaactatgccctcctggcaagcccacgacaagcgagaaaataaacatgatctcgggacccaagcgcggagaacacgcttggacacatcgcctacgtgaacgtaagcagttagtgatatatgaggagatctcggatcctgaggaagatgatgagtag

SEQ ID NO: 207775 - DNA, 513 bp, Artificial Sequence
  Description of Artificial Sequence: Synthetic coding sequence
atgaacggcgacgacaccttcgcccggcggcccaccgtgggcgcccagatacctgagaagattcagaaagccttcgatgacattgctaaatatttctctaaggaagaatgggaaaagatgaaggtcagcgaaaagattgtctacgtgtatatgaaaagaaaatacgaggcgatgaccaagttagggtttaaggccattctgccttcttttatgcgcaacaagagagttacggacttccagggaaatgatttcgataacgacccgaacagagggaatcaggtgcaacgccctcaaatgacattcggccgcctgcagggaatttttcccaagatcatgcccaagaagccagccgaagagggtaacgtcagtaaggaggttcctgaggctagcggtccgcagaacgatggaaaacagctgtgcccaccggggaagcccaccacatccgaaaaaatcaatatgattagcggggtgcttcagaggtactgccggttcggcagccgtcctcttcagtag

SEQ ID NO: 207776 - DNA, 303 bp, Artificial Sequence
  Description of Artificial Sequence: Synthetic coding sequence
atgtacagcctgagcgtgcagcggccccagatgaccttcggccggctgcagggaatttttcccaaaatcatgccaaaaaagccagccgaggagggaaacgtgagcaaggaagtgcccgaagctagtggccctcagaatgatgggaagcagctgtgcccacccggcaaacctacgacatccgagaaaattaacatgatctctggccccaagcgtggcgagcacgcctggacacaccggttaagggaacgaaagcagctcgtcatctacgaagagattagcgaccccgaagaggatgacgagtag

SEQ ID NO: 207777 - DNA, 462 bp, Artificial Sequence
  Description of Artificial Sequence: Synthetic coding sequence
atgaacggcgacgacgccttcgcccggcggccccgggacgacgcccaaatcagcgagaagctccggaaggcctttgacgacatagccaaatacttttcgaagaaagagtgggagaagatgaagagtagcgagaagatcgtctacgtttatatgaaactgaattatgaagtcatgacgaaactgggatttaaggttaccttacccccatttatgaggtctaagagggctgcagatttccatggcaacgatttcggaaatgaccggaaccatagaaatcaggtagagaggccacagatgaccttcggctctctgcagagaatctttcccaaggaccccaagggcggcaacatgcccgggcccacggactgtgttcgtgagtcaagttggtggttcatgaagaggtcggcgacactccgcaaaatgacctctaacagcccaagaggctatgatacctgtccctag

SEQ ID NO: 207778 - DNA, 567 bp, Artificial Sequence
  Description of Artificial Sequence: Synthetic coding sequence
atgaacggcgacgacgccttcgcccggcggccccgggacgacgcccagatctcagaaaaactgaggaaagcattcgatgacatcgcaaaatacttctctaagaaagagtgggaaaagatgaaatcctcagagaaaatagtgtacgtgtacatgaagctgaactacgaagttatgaccaagctgggatttaaggtcactctcccccctttcatgaggagcaaacgcgccgccgacttccacggaaatgattttggcaacgataggaatcataggaaccaagtggaacgcccacagatgacgttcgggtctctgcagaggatcttccccaagattatgccgaaaaagccagccgaagaggaaaacggccttaaggaagtgcctgaagcctcaggcccacagaatgacggcaaacagctctgccccccaggaaacccaagtacacttgagaaaataaataagacaagtggaccgaaaagaggaaagcacgcatggacccaccgcctgagggagagaaagcaactggtggtgtatgaggaaatctccgatccagaagaggatgatgaatag

SEQ ID NO: 207779 - DNA, 1992 bp, Artificial Sequence
  Description of Artificial Sequence: Synthetic coding sequence
atgggccccctgcgggagagcaagaaggagcaccgggtgcagcaccacgacaaggagatatctaggtctcggatccctcggcttattctgcgacctcacatgccacagcagcagcacaaggtgagccctgctagcgagagcccgttcagcgaggaggagagtcgtgagttcaacccctcatcctccgggcgcagcgcacgtacagtgtcttcgaactccttttgcagcgacgataccgggtgtccttccagtcagagtgtgtcgccagtgaaaacccccagcgatgccggaaattctccaattggcttttgcccgggttccgatgaaggctttacccgtaagaagtgcacaatcgggatggtgggtgagggcagcattcagtcctctaggtacaaaaaggaatctaagtccgggttggtgaaacccggatcagaggccgacttctcgtcgtcatcctccactggcagcatcagtgcgcccgaagtgcatatgagcactgctggcagcaaaaggtctagctcaagccgaaaccggggcccacatgggcggtctaatggagctagttcccacaaacccgggtctagccccagctcacccagagagaaggatctgctgtccatgttgtgccgaaaccaattgtcacctgtgaacatccatccctcctatgctccctcctccccgagttcatccaacagcggctcgtataagggttccgactgcagcccgatcatgagacggtccggccgctatatgagttgtggtgagaatcacggggtcaggcctcccaacccagagcagtatctgacgccactgcagcaaaaagaagtcacagtccgacatctgaagacaaagctcaaagagtctgaacgcagactacatgagcgggaaagcgagattgtcgaactgaagtctcagcttgcgcgcatgcgcgaggactggattgaggaggagtgccacagggtggaagcgcaactggcgctcaaagaggcgaggaaggagatcaaacagcttaaacaggttattgagacaatgcggagctccttagctgataaagataagggcattcagaagtactttgtagacatcaacatccagaacaagaaattagagagcctcctccagtctatggagatggcacacagcgggtccttacgcgacgaactgtgtcttgacttcccatgtgatagccccgagaaaagcctgaccctgaacccgcccctcgacaccatggcggatggactatcacttgaagagcaggtgacaggggagggggcggacagggagctcctggtcggagacagtatagccaacagtacagatctctttgatgaaattgtcacagcgaccacgaccgaaagcggggatctggagctggtgcattccactccaggcgcaaacgtgcttgagctccttccaattgtcatgggtcaagaggaaggcagcgttgtggtcgagagagccgtgcaaaccgacgtggtgccatacagtccagctatcagcgagctgattcagtccgttcttcagaaactgcaagatccatgtccttcctctctggctagtcccgacgaatcagaaccagacagtatggagtcatttcctgagtccctctccgcgctcgtggtcgatcttacacccaggaatcccaactcagcgattctactgagcccagtcgagactccctacgcgaatgtggacgccgaggttcatgccaacagattgatgcgggaacttgacttcgccgcctgcgtggaagaacgcctcgacggcgttattccacttgccagggggggagtggtgcgacagtactggtcctcttcttttctggtcgatttgcttgcagtggctgcccccgtggtcccaacagtgctgtgggcatttagtacccaacgaggtggaacagatcctgtgtacaacattggagctctgctaaggggctgctgtgtcgttgccttgcactcattgagaaggaccgcatttcgaatcaaaacctag

SEQ ID NO: 207780 - DNA, 1983 bp, Artificial Sequence
  Description of Artificial Sequence: Synthetic coding sequence
atgagcaacttcgagaaggagcaccgggtgcagcaccacgacaaggagattagccggtcccggatacccagactcatcctacgccctcacatgccccagcagcagcacaaagtatctccagcctcggagagccccttcagcgaggaagaatcaagggagttcaaccctagctcctctggacggagcgctaggacagtgtcatccaactcgttctgcagcgatgatacgggatgcccatcctcccagtcagtttctcctgtaaagacacccagcgacgctggaaactctcccataggtttttgcccgggctctgatgaggggtttactcgcaaaaagtgtacaataggcatggtgggagagggaagcatccagtcaagccgatacaagaaagagtcaaagagtgggctcgtaaaaccgggtagcgaggctgatttttcctcaagttcatctacaggctctatatcagcccctgaggttcatatgtctaccgccggctctaagcggagcagcagctcaagaaaccgcggtccccatggcagaagcaacggggcctcaagtcataaaccaggtagctctccttcatccccccgcgaaaaagatctgctgtcaatgctgtgccgcaatcagctgagtcccgtcaatatacacccttcatacgctccgagttcaccttccagttctaattctggttcatataaagggtcagactgtagtccaatcatgcgacgaagcggtcggtatatgagttgtggagagaaccacggggtgcggcctccaaaccccgagcaatacctcactcctctgcaacagaaggaggtgacggttcggcatctaaaaacgaaattgaaggagtcagaaagaaggctccatgaacgcgagtccgaaatcgtggagctgaaaagccagctcgccaggatgagagaagactggatcgaagaagagtgccacagagtagaagcccagctcgccctgaaggaagccagaaaggagataaaacagttaaagcaggtgattgagacaatgcgcagttcactagccgataaggacaagggcattcagaagtattttgtggacattaatattcaaaataaaaagcttgagagtcttctccagtccatggaaatggcccattctggttctctgagagacgagctgtgtttagattttccgtgcgattctccggaaaaatcactgactctgaacccccccctggataccatggctgatgggctcagcttggaagagcaggtaacaggagagggtgccgatcgtgagctcttagtgggcgacagtatcgctaatagcactgacctgttcgacgagattgtaactgccacaacaacagaatcaggagacctcgaattggtccactccactccgggcgcaaatgtcctggagctgctgcctatcgttatgggacaggaggagggatcagttgtggtggaacgggctgttcagactgatgttgtaccctactcacctgccatatctgagcttatccagagtgtgctgcagaagctccaagacccgtgtccatcttccctcgcatcccccgacgaatccgagcccgacagcatggagtcctttccagagtccctgtctgccctggtcgtagacctcactcctcgcaaccctaattctgctattctgctgtcccccgtggaaaccccttatgccaacgttgacgctgaggtgcacgcaaatcgcttgatgagggagctcgacttcgccgcctgtgtggaggaaaggttggatggagtaatacctctggcacgaggaggcgttgtgcgtcagtactggtccagttctttcctggtggacttgctggcagtggctgcacctgtagtaccaacagtgctatgggcttttagcacccagcggggcggaaccgacccagtgtataatattggtgccctgctaagaggatgttgtgttgtcgcacttcactctctccggcggactgctttccggatcaaaacgtag

SEQ ID NO: 207781 - DNA, 1635 bp, Artificial Sequence
  Description of Artificial Sequence: Synthetic coding sequence
atggtgggcgagggcagcatccagagcagccggtacaagaaggagtcgaaatccggcttagtcaagcccggatccgaagcggacttctcatcctcttcaagcaccggttcaatttctgctccagaagtgcacatgtcgacggccggatctaaaagatcctccagctcacggaatagaggaccccacggccggtccaacggtgcctcatctcacaagcctggcagctcgccgtcatcacccagggagaaggacctgctcagcatgctgtgtcgcaaccagctgtcccccgtgaatattcacccttcctatgctcctagcagccctagtagcagtaattcgggttcatacaaggggagtgactgctcgcccattatgcgaaggtccggaaggtacatgtcttgcggcgaaaaccatggggtgcgcccgcccaaccccgagcagtatctgactcctctgcaacaaaaagaagttaccgttaggcacttgaagacgaaactcaaggagagtgaacggaggcttcatgagagagaatctgagattgtcgaattgaaatcgcagctggctagaatgagagaagattggatcgaagaggagtgtcaccgggtggaggcacagctcgcgcttaaggaggctcggaaagaaatcaagcaactgaagcaggttattgagacgatgcgcagtagcctcgctgacaaggacaaaggcattcaaaaatacttcgtagatattaatatacaaaataaaaagctcgagtctcttctgcaaagcatggagatggcacattcaggatctctccgcgatgaattatgtttggattttccttgcgattctcccgaaaagagtctgacactaaacccaccattagatactatggcagatggactgtccctggaagaacaagttacaggggagggcgcagatagagagctgctggttggagacagcattgccaactctactgacttgttcgacgaaatcgtaactgctactaccaccgagtcaggggacttggagctggttcattcgactcccggtgcaaatgtgttggagctcttacctatcgtcatgggccaggaggagggctcagttgtggtcgaacgcgcagttcagactgacgtggtgccctactctcccgcaatcagtgagcttattcagtccgtcttacagaagctgcaagatccctgcccgtcttcactggctagccctgatgagtcagagcccgattcaatggaaagcttccccgagtctctgagcgctctggtggtggatctcacgcctaggaaccccaacagcgcaatcctgctcagtcccgttgaaacgccgtacgctaatgtggatgctgaggtacacgccaatcggctgatgcgagagttggactttgccgcatgtgtagaagagagactggacggcgtgatcccgctggcccgaggcggggtagtacggcaatactggtcttctagcttcctcgtggacctactggccgttgccgctcccgtagtaccaacagtgttgtgggcgttcagcacccaaagaggtggcactgacccagtgtacaatattggggccctgttgagagggtgctgcgtagtagcccttcactcacttaggcgcactgccttcagaataaaaacctag

SEQ ID NO: 207782 - DNA, 1992 bp, Artificial Sequence
  Description of Artificial Sequence: Synthetic coding sequence
atgggccccctgcgggagagcaagaaggagcaccgggtgcagcaccatgacaaggaaattagtcggagccggattcctcgcttgattctacgcccgcatatgccacagcaacagcacaaagtttcccctgcttctgaatctcccttctctgaggaggaaagtagagaatttaacccctcctcgagtggccggagtgccaggactgtatcatcgaacagcttttgctccgatgacaccggctgcccatcttcacagtccgtgtccccggtcaaaacaccaagtgatgcgggcaactcccccataggcttctgccccggctcagacgaaggattcactaggaagaagtgtaccattggtatggtcggagaaggatcaatccagtcatctcggtacaaaaaagagtcaaagagcggtctcgtgaagccggggagtgaggccgatttctcatcctcctcgtcgacgggcagcataagcgccccagaggtacatatgagcactgcgggcagcaagaggtctagttcttcccggaaccgcggccctcacggtaggagcaatggagcaagttctcacaaacccgggagcagcccgtcaagcccgcgagaaaaggatctcctgtcaatgctgtgtcgcaatcagctgtcacctgtcaacatccaccctagttacgccccatcctctccttcaagttccaactcaggaagttacaagggcagcgactgctctcccatcatgcggcgttctggcaggtacatgagttgtggggaaaatcacggagtccggcctccaaatcctgagcaatatctcacacccttgcagcagaaagaggtgaccgtgcgccacttgaagacaaagctgaaagagagcgaaagaaggttacatgagagggaatccgaaatcgtggaattaaaaagtcagctggctcggatgagagaggattggattgaagaggaatgtcacagggtcgaggctcagctggcactgaaggaggcgcgaaaagaaatcaagcaattgaaacaggtgatcgaaacgatgcggtctagcctggcagataaggataagggtattcaaaagtattttgtcgatataaatatacagaacaagaagctcgagtcactgctccagtccatggagatggcacatagcggcagcttgcgtgatgaactctgtcttgactttccatgtgattccccagagaaatccttgacactgaatccacccttagacacaatggcggatggactgtctctggaagagcaggttaccggagaaggggccgacagggaacttttagtgggggacagcattgccaacagcactgatttgtttgacgaaatagtgactgcaacaaccacggaatccggggacttggagctagttcacagcacaccaggggctaacgtgctggaacttctgcccatcgtgatgggtcaggaagaggggagtgtagtagtcgaaagggctgtgcaaacggatgtggttccctacagtcctgccatttcggagctgatacaatcagtgctacaaaaactccaggatccctgcccatcctctttagcttctccagacgaatctgaaccagactcgatggaaagttttccagagtctctgtccgccctggttgttgatcttacacctaggaaccccaatagtgccatattactcagtccagtggagacaccgtatgccaacgtcgatgctgaagttcacgctaaccgcttaatgagggaattggattttgctgcatgtgtggaagagcggctggatggcgtcattccactagctagaggaggagtcgtgcgtcaatattggtcgagttcatttttggtggacctgctcgcggtggccgctccggtcgtcccgactgtgctttgggcattttcaactcagcgcgggggcactgaccctgtctataatatcggcgcacttctcagaggctgttgtgtcgtagctctccatagcttacgtaggactgctttccgcattaagacatag

SEQ ID NO: 207783 - DNA, 1989 bp, Artificial Sequence
  Description of Artificial Sequence: Synthetic coding sequence
atgggccccctgcgggagagcaaggagcaccgggtgcagcaccacgataaggaaatcagcaggtcaagaattcccaggcttattttaaggccgcacatgccacaacagcaacacaaagttagcccagcgtccgagtctccattctctgaagaagagagcagggagtttaaccctagctcgtccggacggagtgcccgaacagtctcgagcaactctttttgctccgatgacacgggctgtccctccagccagagtgtgtcccccgtcaaaaccccatccgacgctggcaatagcccgatcggtttctgtcctggatctgatgaaggcttcactcggaaaaaatgcactatcggcatggtgggtgagggcagcatacagtcatcacgttataagaaagagagcaaatccggtctggtaaagcctgggtctgaagcagatttctccagctcctcatccacagggtctataagcgctccagaagtgcatatgagcaccgccggcagtaagagaagcagctcaagccgaaaccgcggaccccatggcaggtctaacggtgcaagctcccataagccaggaagcagccccagttcccccagagaaaaagacctgctgtccatgctctgtcgcaaccaactgagcccagttaatatccacccgtcttatgccccctctagtccttcttcctctaacagcgggtcctataaaggatcagactgtagccccatcatgagacggtcagggcgctatatgagctgcggcgagaatcacggagttcgcccacccaaccctgagcagtatctcaccccacttcagcagaaggaggtgactgtccgacacctcaaaaccaagctcaaggagtctgaacggcgcctccacgagcgcgaatctgagatcgtagaactgaaatcgcagttggccagaatgcgagaggactggattgaggaggaatgtcaccgagttgaggcccaactggccctgaaagaggctcgcaaggaaatcaagcagttgaaacaagtcatcgaaaccatgcgcagctccttagccgataaagacaagggtattcagaagtatttcgttgatattaatattcagaataaaaagctggagtcactcctccagagcatggaaatggcccattctggctcactgagggatgagctctgtctggacttcccttgcgatagccccgaaaagtcgttgactctgaaccccccactggacaccatggctgatgggctcagtctagaagagcaggtgactggggagggggccgacagagaactactcgttggcgacagcatcgccaatagtacggatttgtttgatgaaatcgtgacggctacaaccacggaatccggggaccttgagctggtgcactctacgcctggtgccaatgtgctggaactcctgccaatcgtcatgggtcaggaagagggaagtgttgtggttgagcgtgcagtgcagaccgatgtcgtgccctactctcctgcgatctcagagctcattcagtccgtcctccagaaacttcaagatccatgcccgtctagtctggcatcccccgacgaaagcgaaccggactccatggagagctttccagagtctctgtccgccctcgtggtggacctcactccccggaatcccaactcagcaatccttctttcccccgtggagacaccctacgcgaacgtggatgccgaagtccacgccaatcggctcatgcgtgagttggactttgcagcgtgtgtggaagagaggctggatggcgtcatcccattggctcgcggaggcgtcgtccgtcagtactggagctccagctttctcgtcgacctcctcgccgttgccgctcccgtcgtgcccaccgttctctgggccttttcaacacagcgtggaggtacggatcccgtgtataatattggtgccctgctgcgaggatgctgcgtggtcgctttacattccctaagacgcacagcctttcgcattaagacctag

SEQ ID NO: 207784 - DNA, 1992 bp, Artificial Sequence
  Description of Artificial Sequence: Synthetic coding sequence
atgggccccctgcgggagagcaagaaggagcaccgggtgcagcaccatgacaaggaaatctctcggagccgaattccaagattgattctgcgaccccatatgccccagcagcagcacaaagtttccccagcaagcgagagccctttcagcgaagaagagagccgtgagttcaatccctccagtagtggaaggagtgctcggacggtgtctagcaactctttttgttcggacgataccggctgcccatcgtcacagagtgtgtctccagtgaaaacaccatcggacgccggcaactcaccaattgggttttgtccaggtagcgacgaagggttcacaaggaagaagtgtacaatcggcatggtcggcgaaggaagcatacagagtagtagatacaaaaaggagagcaaaagcgggctcgtgaaacccggctcagaagccgacttttcaagctcaagcagtacagggagtataagtgcccctgaagtccatatgtcaaccgctgggtccaagcgctccagctctagcaggaataggggacctcacgggagaagtaacggtgcaagcagccacaaaccaggctcttctccatccagcccccgcgagaaagatcttttgagtatgctgtgcaggaaccagctgtcacctgtgaatatacatccgtcctacgccccctcaagtccctcatcatctaattcaggcagctataaggggagtgattgttctcctattatgaggcggtctgggcggtacatgtcctgcggtgagaatcatggggtcaggccgcctaacccagagcagtatctcaccccactgcagcagaaggaggtgaccgtgcggcacctcaagacgaagttgaaagagagcgagagaaggttgcacgaacgtgaaagtgagatcgtggaactcaaatcccagcttgcccggatgagggaggattggatcgaggaagagtgtcaccgcgttgaggcccaactggcactgaaagaagcccgtaaagaaataaaacagctgaaacaggtaatcgaaactatgagatcgagcttggcggataaggataagggaattcagaaatattttgtggacatcaatatccagaataaaaagcttgaaagcctgttgcagtcaatggaaatggcccatagcggctccctgagagatgagctatgcctggattttccttgcgactctcccgagaagtcccttactttgaatcctcccttggatacgatggctgacggtttgtcgctggaagagcaggttaccggggagggagcagatcgggagttactggtcggagatagcattgcgaacagtaccgacctgttcgatgaaatcgtaaccgcaaccacaaccgaatctggtgacctggaattagtccattctaccccaggtgccaatgtgttagagctcctgcctatcgtgatgggacaggaggaagggagcgtggtcgtggagagagcagtacagaccgatgtggtgccttacagcccggcgatttcagagcttatacagtcagtcctccagaagctccaggatccttgcccatcctccttggcgtcacccgatgagagcgagcctgattcgatggaaagcttccctgagtccttgtctgcattagtcgtggatctaacaccccgcaaccctaacagtgctatcttgctttctcccgtggagaccccttacgccaatgtggatgccgaggtacacgctaatcgcctgatgagggaactggacttcgcagcctgcgtggaagaacgcctggacggggtgatacctctggcacgggggggagtggtccgtcaatattggtccagttcattccttgttgaccttctggccgtggctgcccctgtggtccccaccgtactgtgggccttttctactcaaagaggcgggactgaccctgtttataacatcggtgccttgctccgtggctgttgcgtcgtggcactgcatagcctgaggcggactgccttcagaattaaaacttag

SEQ ID NO: 207785 - DNA, 1992 bp, Artificial Sequence
  Description of Artificial Sequence: Synthetic coding sequence
atgggccccctgcgggagagcaagaaggagcaccgggtgcagcaccacgacaaggagatttcgaggagccgcattcctcgcctcattctgaggccacatatgccacaacagcagcacaaggtgagtcccgctagtgaatcaccattttccgaagaggaaagtcgcgagttcaatccaagcagctctgggagaagcgcacgtactgttagttctaattcattctgtagcgacgacaccgggtgtccttccagccagtccgtttccccagtgaaaacaccttccgacgctggcaacagccccattggcttttgtcccggaagcgatgaggggttcactcgtaagaagtgtacaattggaatggtcggggagggctccattcagagctcccgatacaagaaagagtccaagtctggcttggtgaagcctggcagcgaggcagatttttcttctagttcgagcaccggttccatctccgcgccagaagtacacatgtctacagcagggagcaaaagatcttcaagcagtcgcaaccggggcccccacgggcggtctaatggggcttcatcgcataagcctgggtctagtccatcctctccgcgggaaaaggaccttctctccatgctctgccggaatcagctatctccggtgaatatccacccgtcctacgccccctccagcccatcttcaagcaattcgggctcttacaaagggtcagattgttctccaatcatgagaagatcaggacggtatatgtcttgtggcgaaaaccacggggtaagaccccccaatcccgaacagtacctaacacctttgcagcagaaggaagtgaccgtgcgtcatctgaaaaccaagctgaaagaatccgaaaggcggctacacgaaagggaaagcgaaattgttgaactgaagagccaattagcccgcatgagggaggattggattgaagaagagtgtcatcgtgtcgaggctcagttagccctgaaagaggccagaaaagaaattaagcaactcaaacaggtaattgagacgatgaggagtagcctggccgacaaagacaagggcatccaaaagtattttgtggatattaatatccagaacaagaaactggaatccttgctgcagtctatggagatggcccactcaggcagcttgcgcgacgaattatgccttgatttcccctgcgactctcccgagaagtccctcacactcaacccaccactggacactatggcggatggtctgagcctcgaagaacaggtgaccggtgagggtgcagaccgggaactgttggttggcgatagcatagccaattccacagatctcttcgatgaaatcgtcactgctaccaccacagaatccggcgatcttgaactcgtgcattctactcctggcgccaacgtgctggaactgttgccaatcgtcatgggccaggaggagggtagcgtggtcgtggaacgagctgtgcagacagacgtcgtcccttacagcccagctatctcagaactcatccaatcagtgctgcagaagttgcaagacccttgtccgagttcgctggcaagcccagacgaatcagaacccgatagcatggaaagttttcctgaatccctgtcagctcttgtggtagacctgacaccgagaaaccccaactccgctattctcctgagtcctgtcgaaacgccttacgcaaatgtggacgctgaagtacacgcgaaccgactgatgcgagaacttgactttgccgcctgcgtcgaagagagactggacggtgttatccctctcgctcgggggggggtggtcaggcaatactggtcatccagcttcttggtggatctcctggcggtggctgcccctgtggtgccaacagtgctgtgggctttctctacacagaggggaggcaccgaccccgtctataacatcggtgccctgctgagaggttgctgcgtagttgctttgcatagtcttcgaaggactgcctttcgaattaagacctag

SEQ ID NO: 207786 - DNA, 1992 bp, Artificial Sequence
  Description of Artificial Sequence: Synthetic coding sequence
atgggccccctgcgggagagcaagaaggagcaccgggtgcagcaccacgacaaggagatctcccggtcacggatcccacgactcatcctgcgcccccacatgccacagcaacaacacaaggttagccctgcatccgaaagccctttcagcgaagaggaaagtcgggagttcaacccctctagctctggcaggtctgctcggactgtgtctagcaatagtttctgcagcgacgacactgggtgtccatcatcacaatcagtgtcccctgtaaagacaccaagcgacgctggtaatagtcctatcggattctgccccggctcagacgaggggttcacacggaaaaaatgtacaatcgggatggtcggcgaaggatccatacagtcatcacggtataaaaaagaatcgaagagtggtttggtgaagccagggtctgaggcggatttctcaagtagtagctccacaggaagcatatccgctcctgaggtgcatatgtcgactgccgggtcgaagcggagtagttcttctcggaaccgcggacctcacggtcgcagtaatggcgctagcagtcataagccaggcagctcccctagctctcccagggaaaaggatctgctgtcaatgctctgtcggaaccagctttcacccgtcaacattcaccctagctatgcgccctcatccccaagctccagtaatagcgggtcctataaagggtctgattgcagtccaatcatgcggcgctccggccgatacatgagctgcggcgagaatcacggtgtgcggccgccaaaccccgagcagtaccttactccactccaacagaaggaggttaccgtgcggcatcttaaaactaaactcaaggagtctgaacgacgtctacacgagagggaatccgagattgtcgaactaaaatcgcaacttgcccgtatgagagaggactggattgaggaggagtgccatcgggtggaggcccagctggctttaaaggaagctcgtaaggaaatcaagcaactgaaacaggtcattgagaccatgagatccagcctggccgataaggacaagggaatccagaagtatttcgttgacataaatatacagaataaaaaactggagtccctgctccagtctatggagatggcccactccggctcactgagagatgagctttgtctcgacttcccgtgcgatagccccgaaaagagtctaacactaaaccctccactcgatacaatggccgatggtctttccctggaggaacaggtcacaggagagggagccgatagggaactccttgtgggagatagcatcgccaattccacagatctgtttgacgaaatcgtaactgccactactaccgagtccggagacctcgaactggtccactctacacctggggccaatgttctggagctcctgccgatcgtaatgggccaagaagagggatcagttgtggtggagcgcgctgtccaaaccgacgtcgtgccatactctccagccatcagcgagctgattcagtccgtgctgcaaaaattgcaagatccctgtccctcgagtttggcgtcacctgatgagtcagagcccgacagtatggagtctttcccggagtctcttagcgcgctggtggtggacttaacacctcgcaaccccaactcggccatcctactctctcctgttgagacgccatacgctaacgtcgatgcagaggttcacgctaacaggttgatgcgtgagctggatttcgcggcatgcgtagaggaaagactggatggtgtgatcccactggcgcggggcggggtggttcggcaatattggagcagctcatttttggtggatcttttggctgtggcagctcctgtggtgccaaccgtgttgtgggcgttttccacccaaagaggtggaacggaccccgtctacaatatcggcgccctcctgaggggatgctgcgtggttgccttgcactctctccggagaacagccttcagaatcaaaacctag

SEQ ID NO: 207787 - DNA, 1989 bp, Artificial Sequence
  Description of Artificial Sequence: Synthetic coding sequence
atgggccccctgcgggagagcaaggagcaccgggtgcagcaccacgacaaggaaatctctaggtcccggattccaagattaatacttaggccacacatgccccagcaacagcacaaagtgtcacccgcaagcgaatctcctttttctgaagaggagagtcgcgagtttaacccctcttcatctggacgaagtgccaggactgtaagctcaaattcattttgtagtgatgataccggttgcccttcttcgcaatcagtatctcccgttaaaactcccagcgatgcagggaattcccctatcgggttctgtcctggcagcgacgagggcttcaccagaaaaaagtgcacaatcgggatggtgggggaagggtccatacagagttcacgctacaagaaagagagtaaaagcggtctggttaagcctgggtctgaagctgacttttcctctagtagctctacaggttctataagcgcccccgaggtgcacatgtccacagctggctccaagagatcgtcttcttctcggaatagggggccacacgggagatcaaacggagccagtagtcataaacccggtagctctcctagctccccccgggagaaagacctgctctcaatgctgtgccggaaccagctgagccccgtgaatatccatccctcgtacgccccttcttctcccagcagcagcaacagtggcagttacaaaggaagcgattgctctcccatcatgaggcggtcaggacggtatatgtcctgcggcgaaaaccacggagtgagaccccctaatccagagcagtacctgacaccacttcagcaaaaagaagtaaccgtgcgccacctgaaaacaaagttgaaagaatccgaacggcgtttgcacgagagagagagcgagatcgtggaactgaagagccaactggccaggatgcgcgaggattggattgaggaagaatgtcaccgggtagaggcacagcttgcactgaaagaggcacgcaaagaaattaaacagctgaagcaggtcattgaaaccatgagaagctcacttgctgataaagacaaagggatccagaaatatttcgttgatattaacatacagaataaaaagttagaatcacttctgcagtcaatggagatggcacatagtggctccctgcgcgatgagctgtgtttagacttcccttgcgattcaccagaaaagagtttgaccctaaatccgccattagatacgatggccgacggattatctttagaggagcaagtcacaggtgagggcgctgacagggaattacttgtcggggatagtatcgccaactctacggatctgtttgacgaaatcgttaccgctacaaccacagagagtggggacctggaactggtacatagcacacctggagctaatgttctggaattactgcccattgtgatgggccaggaagaaggaagcgtggtcgttgaacgagccgtccagacagacgtggtcccatactcaccggctatctccgaattgatccaaagtgtcttacagaaactgcaggatccctgcccgtctagccttgcctctccagatgaaagcgagcctgatagtatggaaagctttccggagagtctgtccgcgctggtggtggaccttacaccaagaaaccctaatagcgctatcctccttagccccgtggaaaccccctatgctaacgtggacgctgaggtgcacgccaacagactgatgagagaactagattttgcagcctgcgtggaggagcgcctggatggggtgatccctctggcacgcggcggggtggtgagacaatattggagctcctcgtttctggtagacctcctagcagtcgctgctcccgtcgttcccacagtgctttgggcattttcaacacagagaggaggaaccgatcctgtctataacatcggcgccttgctaagaggctgttgtgtggttgccctgcactcactgcgccggacagcctttcggatcaagacgtag

SEQ ID NO: 207788 - DNA, 414 bp, Artificial Sequence
  Description of Artificial Sequence: Synthetic coding sequence
atgggccccctgcgggagagcaagaaggagcaccgggtgcagcaccatgacaaggagatatcacggagccggatcccacggctcatcctgaggccacacatgcctcagcaacagcacaaagtttcacctgctagtgagtctcccttttctgaggaagagtccagggagttcaacccctcgtcatccggaagatcagcgcggaccgttagtagtaactctttttgttcagacgacaccggctgcccttccagccaatctgtgagccctgtaaagaccccttccgatgctgggaatagccccatcggattttgtccaggctcggacgagggttttactaggaagaagtgcactatcggcatggtgggcgaggggagcatccaatctagccggtataagaaggagtctaagagctag

SEQ ID NO: 207789 - DNA, 231 bp, Artificial Sequence
  Description of Artificial Sequence: Synthetic coding sequence
atgggccccctgcgggagagcaagaaggagcaccgggtgcagcaccacgacaaagagatctcccgctcccggataccaagactgattctaagaccccacatgccccagcagcagcacaaggtgtccccggcttcagaatccccgttctcagaggaggagtcgagggaatttaacccttcatcatcaggcagaagcgcacgaactgtgtcctccaattctttttgtagttag

SEQ ID NO: 207790 - DNA, 222 bp, Artificial Sequence
  Description of Artificial Sequence: Synthetic coding sequence
atgggccccctgcgggagagcaagaaggagcaccgggtgcagcaccacgataaagagatttctcggtcccgcatcccccgactcatactaaggccacacatgcctcagcagcaacacaaggtgagtccggctagtgaatcgcccttcagcgaggaggagtctcgagaattcaaccccagtagctccggccgatccgctcgaaccgtcagctccaactcctag

SEQ ID NO: 207791 - DNA, 378 bp, Artificial Sequence
  Description of Artificial Sequence: Synthetic coding sequence
atggtgggcgagggcagcatccagagcagccggtacaagaaggagtctaagtctggcctggttaagcctgggagcgaggcagacttctcaagcagctcctctaccggcagtatctctgcacccgaggtacatatgtccactgccggctcgaaacgctcttcctcaagcaggaataggggaccacacggccgcagcaacggcgctagttctcacaaacctggctcctccccatcatcccctcgcgagaaggacctgctatcaatgctgtgccggaaccaactcagcccagtaaacatacatccgagttacgcccccagctcgccttcttcctcgaactctgggtcctacaaagggagcgattgttcccccatcatgtag

SEQ ID NO: 207792 - DNA, 1635 bp, Artificial Sequence
  Description of Artificial Sequence: Synthetic coding sequence
atggtgggcgagggcagcatccagagcagccggtacaagaaggagagcaaatcaggcttagtcaaacccgggtcagaagcggatttctccagttcttccagcacgggctccattagcgcccctgaagttcacatgagcaccgccggcagtaaacgaagctcttcgagtaggaacaggggcccacatgggcgctccaacggcgcatcctctcacaagcctgggtcttctccaagcagtcctcgagaaaaggacctactgtctatgctgtgtcgcaaccaattgtccccagtgaacatacatccaagctatgccccatcatcacctagtagctctaacagcgggtcctataagggaagcgactgcagccccatcatgagacgcagcggaaggtacatgagttgcggcgaaaatcacggagtaagacctccgaatcccgaacagtatttaacgccccttcaacagaaggaggtgactgtgagacatttaaagaccaagctaaaggagtccgagcgtagattgcatgaaagagagagcgagatcgtcgaactgaagtctcaactggcacgaatgagagaggattggattgaagaagagtgccacagggtggaggcccaactcgccctgaaagaggcccgcaaagagattaagcagctgaaacaagtcatagagactatgcggagctcactggccgacaaagacaaagggatccagaagtacttcgtggacattaatatacagaataagaagctcgagtccttactgcagagtatggaaatggctcatagcggcagtttgagagatgaactgtgcctggacttcccctgcgatagccccgagaagtctctgaccctgaacccccccttggataccatggccgacggcctgtccctagaggaacaagtgacaggggagggagctgatagggaattgcttgttggggattcaatcgcaaactcaaccgacctgtttgacgaaatcgtcaccgccaccaccactgagagtggagacttggaattggtacatagcacccccggcgctaacgtcctcgaactcctgccaattgtgatgggacaggaagagggatcagttgtcgttgagagagcggtacagaccgacgtcgtcccttattcacccgcaatctctgagctgatccagagcgtgttgcagaaactacaggatccctgtcccagtagtctcgcctcgcccgacgaaagtgaacccgatagtatggaatccttcccagaatccttaagcgccctggttgtggacttgaccccaagaaaccctaattctgcgatccttctgtccccggttgaaacaccttacgccaatgtagacgctgaggtccacgcaaataggcttatgcgggagttggatttcgctgcctgtgtagaagagcgtctggatggggtcattcccctcgcccgaggcggagtggtgcgtcagtactggtcgtcaagctttctggtagacctgctggcggtggctgcaccagttgtacctaccgtactgtgggcatttagcacacaaagaggcggcacagatcccgtgtacaatataggtgctctgctgcgcggatgttgtgtggttgccctgcacagtctgagaaggactgccttcagaattaagacatag

SEQ ID NO: 207793 - DNA, 243 bp, Artificial Sequence
  Description of Artificial Sequence: Synthetic coding sequence
atggtgggcgagggcagcatccagagcagccggtacaagaaggagtccaaaagcggattggtaaagcctggaagcgaggctgacttcagtagcagcagctctaccggaagcatctccgctccagaagtacatatgagtacagcgggttctaagcgctcgagtagctccaggaacaggggtcctcacggacggagcaacggggcatcctctcacaaaccgggtagttcgccgtcgtccccttag

SEQ ID NO: 207794 - DNA, 1989 bp, Artificial Sequence
  Description of Artificial Sequence: Synthetic coding sequence
atgggccccctgcgggagagcaaggagcaccgggtgcagcaccacgacaaggagattagcagatcccgcatacccagactgatattacggccccatatgccccagcagcagcacaaagtgtccccggcctcagagtcccctttctccgaagaagaatctcgcgaatttaaccccagttcctccggccgatcagcaaggacagtctcaagtaattctttctgcagcgacgataccggttgtccaagctcgcagtcggtaagtcctgtgaaaacgccgtctgacgctggcaattctcctatcggtttctgccctgggtctgacgagggcttcactcggaagaagtgcacaattggcatggtgggcgagggctcgattcagtcctcccgatacaagaaggagtcaaagtccggcctggtgaagcctggcagcgaggccgatttctctagcagcagctctaccggctccataagtgctccggaagtgcacatgagtacggctggaagcaaacgatcttctagttcgcgcaacagagggccacacggccggtcaaatggtgcgtcgagccataaacccgggagttcacctagctcccctcgggaaaaagatttgctttcaatgctctgccgaaaccagctgagtcccgtgaacattcatcccagctatgccccatcctccccttctagctcaaactccggctcttataaaggaagcgactgctcacctattatgaggcggtcagggcggtacatgtcatgcggagagaatcatggcgtacgcccaccgaatccagagcaataccttactcctctgcagcaaaaagaggttaccgtccgacaccttaaaaccaaactcaaagagtctgagcgcagactccacgagcgggagagcgaaattgtcgagctcaagagccagctcgcacgcatgcgagaggactggatcgaggaagagtgccaccgcgtggaagcacagctcgccctgaaagaagcccgcaaggagatcaaacagctgaagcaggtgatagaaacgatgaggtcctccctggccgataaggataaaggaatccaaaagtatttcgtggacattaatatacagaacaaaaagctcgaaagcctgctacagagcatggaaatggctcattcagggagccttagagatgaattgtgtctcgacttcccctgcgatagcccagaaaagtccttaacactgaacccccctctggacacaatggccgatgggctgtccctggaggaacaggtgactggggaaggcgctgacagagagctgctcgtcggcgacagcatcgccaattccacagatttgtttgacgaaatcgtcactgctacgacaacggagtcgggggacttggagttagtgcattctacccccggcgcaaacgtcctagaactgcttcccattgtaatggggcaagaagagggatcagtagtggtcgaaagagctgtgcagactgatgtggtgccttactctccagctatctccgagctgatccagtctgtgctgcagaaactgcaagacccatgtccctcttcactggcgagtcctgatgaatccgaaccagactctatggagtcctttccagagagcttgagtgctctggtggtcgatctgactccaaggaaccctaactctgctattctcctttctccagtggagacaccttatgctaacgtggatgctgaggttcacgccaatagactgatgagagagctcgatttcgccgcttgcgtagaagagcggctcgatggcgtaattcccttggcacgaggaggtgtcgtcaggcagtattggagttcctccttcctggtggacttattggcagtggcagcacctgtagtcccaacagtactgtgggccttttcaactcagaggggaggtacggacccagtctacaacatcggcgccctgctgcgtggatgctgcgtggtcgccctccactccttacgacgcactgcttttcggattaagacatag

SEQ ID NO: 207795 - DNA, 288 bp, Artificial Sequence
  Description of Artificial Sequence: Synthetic coding sequence
atgggccccctgcgggagagcaagaaggagcaccgggtgcagcaccacgataaagagatttcacgtagcagaattcccagactaatattgaggccccatatgccccagcaacagcacaaggtgtcacccgcatctgagtctccgttctccgaggaggagtcacgagaatttaaccctagtagttccggaaggtcagcccggaccgtaagctcgaacagtttttgcagcgatgacacaggctgccctagttcacagtctgtgtctccagtcaaaacgccgtccgactag

SEQ ID NO: 207796 - DNA, 615 bp, Artificial Sequence
  Description of Artificial Sequence: Synthetic coding sequence
atgggccccctgcgggagagcaaggagcaccgggtgcagcaccacgataaggagatctcccgaagtaggatcccacggcttatattacggcctcacatgcctcaacagcagcacaaagtgagcccagcctcggaaagccccttctctgaagaagagagccgggagttcaacccgtcttcctcaggtagatccgcccggactgtttcctccaattccttttgtagcgatgacaccggatgccctagcagccaatcagtaagtcccgtcaaaacaccgtcagacgccggaaattcccccataggtttttgtccaggcagcgatgagggatttaccagaaaaaagtgcacgatcggaatggtgggggagggtagtatacaatccagtcgctacaagaaagagtctaagtcaggacttgtgaaacccggcagcgaagccgacttctcgagttcctccagcactggcagcattagcgcaccggaggtgcatatgtctactgccggctctaaaagatcaagcagttcgcggaatcgggggccccatggtagatcaaatggggcctcttcgcacaagccaggctcctccccgagttcacctcgtgagaaggaccttttgtag

SEQ ID NO: 207797 - DNA, 108 bp, Artificial Sequence
  Description of Artificial Sequence: Synthetic coding sequence
atggtgggcgagggcagcatccagagcagccggtacaagaaggagtccaaatccggcctcgtgaagccaggatctgaagctgactttagtagctcctcttcaacatag

SEQ ID NO: 207798 - DNA, 105 bp, Artificial Sequence
  Description of Artificial Sequence: Synthetic coding sequence
atggtgggcgagggcagcatccagagcagccggtacaagaaggagtcgaaaagcggccttgtcaaaccaggctccgaagccgactttagctcttcatcgtcttag

SEQ ID NO: 207799 - DNA, 243 bp, Artificial Sequence
  Description of Artificial Sequence: Synthetic coding sequence
atggtgggcgagggcagcatccagagcagccggtacaagaaggagtccaagagtgggctggtcaagcctggttccgaggccgacttttcatctagcagctctacaggatccatttcagcccctgaggttcacatgagtaccgcgggctccaagagaagttcatcaagtcgcaatagagggccccatggcagaagcaatggcgcttcttcacacaagccaggatctagcccgagcagtccatag

SEQ ID NO: 207800 - DNA, 1788 bp, Artificial Sequence
  Description of Artificial Sequence: Synthetic coding sequence
atgggccccttctgggcccggaaggacgacaccggctgccccagcagtcagtctgtgtctcctgtgaagaccccttcagacgccgggaattctcccatcgggttctgccccgggagcgacgagggatttaccaggaaaaagtgtaccatcggcatggtgggcgaggggtctatacaatcaagcagatacaaaaaagagtccaagagcggtctagtgaaaccaggctcagaggccgacttctctagtagtagttctacaggcagtatcagcgcacccgaagtgcacatgtctaccgccggaagtaagcgtagcagctcctcaagaaatcggggcccacacgggagatccaacggtgctagctcacataaacccggaagctctcccagttccccgagagaaaaagatcttctgtcaatgttatgcaggaatcagctgagccctgtgaatattcatccctcctacgcaccaagctcacccagctcctctaattcagggtcttacaagggaagtgactgcagcccaatcatgcgtcgatctggccgctacatgtcctgcggggagaaccacggtgtgagaccaccaaatcctgagcaatatttaacccccctgcagcaaaaggaagtgaccgtccgtcacctaaagacgaagctaaaggaatccgagaggcgcctgcatgaacgggagagtgagatcgtggagctaaagagtcagttggcgaggatgcgcgaggattggatcgaggaagagtgtcatcgggttgaagcgcaactcgcactgaaggaagctcgtaaggaaattaaacagctcaaacaggtgattgagactatgagaagttctctggccgataaggataagggtatacagaagtacttcgtggacattaacattcagaataagaaactcgagtcccttctccagagtatggagatggcccactccggatcactacgcgatgagctttgcctagactttccctgcgactcaccagagaagagtctcacactgaaccccccactggataccatggctgacggtttatcccttgaggagcaagtgacaggggagggggctgatagggagctgcttgtgggcgactccatcgccaacagcactgatctgttcgacgaaatcgtgaccgctacaaccacagagtctggagatttggaactggtgcacagtactcctggtgccaatgtgctcgagttgcttcccatagtgatgggtcaggaagaaggctccgtcgtcgtcgaaagagctgttcagacggacgtggtgccgtatagtcccgccatttctgagctgatccagtccgtgctgcaaaagctgcaagatccgtgccctagctccctcgctagcccagacgaatcagagcctgacagtatggagtctttccccgaaagtctcagcgcactggtggtcgatctgacaccacgcaaccccaactctgccattttgctaagtcctgtggaaaccccctacgccaacgttgatgcagaggtacacgccaatcgactgatgcgggagctcgactttgcggcttgcgtagaagagagactggacggtgttatacctctggcaagggggggtgtcgtacggcaatattggtcgagctccttccttgtggatctgctggctgttgctgccccagttgtcccaaccgttttgtgggcttttagtactcagcgcggcggcaccgatccagtgtacaacataggcgcgctactgcgcggatgttgtgtggtcgctctccactctttgcgtcgcacagcctttcgcattaagacctag

SEQ ID NO: 207801 - DNA, 1635 bp, Artificial Sequence
  Description of Artificial Sequence: Synthetic coding sequence
atggtgggcgagggcagcatccagagcagccggtacaagaaggagtccaagagtgggttagtaaagccagggtccgaagctgacttctcaagctccagcagtacagggagtatctctgcccccgaggtgcacatgtccactgcaggctctaagcggtcctctagttctcgcaaccgaggcccacacggtcggtccaacggcgcatcatcacataagccaggcagcagtccgtctagccccagggagaaggatctcctcagcatgttatgtaggaatcagctgagcccagtgaatattcatccgtcctacgcaccatcaagccctagctcaagcaattcaggcagctataaaggatctgactgctcgcccatcatgagacgctctggccggtacatgtcctgtggtgaaaaccatggcgttcggccccctaaccctgagcagtacctgacccctctccaacagaaagaggtgaccgttcgtcacctgaagaccaagctgaaggagtctgaacgaagattacatgagagggaaagtgaaatcgttgagctaaagtcccaactcgcaaggatgcgcgaagactggattgaagaagaatgtcaccgagtggaggctcagctggctctgaaggaggcgcgaaaagagatcaaacagctgaaacaagtcatagaaaccatgcgtagctctctggctgataaggataagggtatccagaaatattttgtggacattaacatccagaacaagaaattagagtctttgctgcagagcatggaaatggctcactctggcagccttcgggacgagctgtgcttagacttcccatgcgactctccggaaaagtcgttgacgctgaatcctccactagatacaatggccgatgggcttagtttggaggagcaggtcaccggggaaggagctgaccgcgagttgctcgtgggagactcaattgcaaatagcactgatttgttcgacgagatcgtgactgctactacgacagaaagcggagatctagaactcgtgcattccactccaggagcaaacgtgctcgagctgctgcccatagtgatgggccaggaggaaggcagcgttgtggtggagagagcagtccagaccgatgttgtgccgtactctcctgcaatatccgaactcattcagtctgtgcttcagaagctgcaagatccctgtcctagcagtctcgccagtcccgacgagtctgagccagactcgatggaatccttccccgagagtctgtctgccctggtagtggacctgacgccgagaaaccctaactcagcgatactcctgtctccagtcgagaccccttacgccaatgtggacgccgaggtacatgccaaccgcctgatgcgagagttggattttgccgcttgtgttgaagaaaggctggatggtgtgatcccacttgcccgaggcggagtggtccggcagtactggagttctagttttctcgtcgacctactggccgttgcagcgcccgtagtccctacggtgctgtgggccttttccacacaacgcggcggaactgacccagtttataacataggtgcccttttacggggatgctgcgtggtcgcgcttcactccctgcgccgaactgccttccgcattaaaacttag

SEQ ID NO: 207802 - DNA, 1992 bp, Artificial Sequence
  Description of Artificial Sequence: Synthetic coding sequence
atgggccccctgcgggagagcaagaaggagcaccgggtgcagcaccatgacaaagagatttcgcgaagcaggatccctcgcctcatccttcgcccacatatgccacagcaacaacacaaagtttcgcccgccagcgagtctcctttctccgaggaagaaagccgggagttcaacccaagttcctctgggcgttctgcgcgcacagtcagcagcaacagtttttgctccgacgacacaggctgcccctcaagtcagtcggtcagccctgtgaagacaccctctgacgcggggaactcaccaattggcttctgtcccggcagcgacgagggctttaccaggaagaagtgcaccattggaatggtcggggaaggaagcatacagtcaagcaggtataaaaaggaatcaaaatccgggcttgttaaacccgggtccgaagctgatttttcctcaagcagcagcacaggttctatctccgctccagaagtccacatgtccactgccggcagcaaaagatcgtcctcaagtagaaaccgcgggcctcatggccggtcaaatggcgccagctcacacaaacccggatcttcaccttcatcgccacgcgagaaggatctgcttagtatgctgtgtcggaatcaactttcacccgtgaacatccatccttcctatgctccgagctctccctctagctctaatagcgggtcttacaaaggtagcgattgttcccctatcatgagaaggtccgggcggtatatgagctgtggggagaaccacggtgtgagacctcctaaccccgagcagtacttgactcctctccagcaaaaagaggtgacagtgcgtcatttgaagactaagctgaaagagagcgaacgccggttacacgaaagggagagtgagatcgttgagctgaaatcccagctcgccaggatgcgggaggactggatcgaggaggagtgccacagggtagaagcccagctggcactgaaggaggctcgcaaggagatcaagcagctgaagcaggtgattgagaccatgaggtcttctctagccgacaaagacaaagggatacaaaagtacttcgtagatataaatattcagaacaagaaactagaatccctcctacaaagtatggagatggcccattctggatctctgagggatgagttgtgcctggattttccttgtgatagccccgagaaatccctgacattaaacccacctttagacacaatggccgacggactgtccttggaagaacaagtgaccggtgagggagctgatcgggaactgttagtgggagactctatcgccaatagtacagacctgtttgatgaaatcgtgacagctacaactactgagagcggagatcttgagttagtacatagcacgccgggtgcaaacgtgctggaactactgccaatcgtgatgggccaggaggaaggaagtgtagtggtcgagagggcggtacagaccgatgtcgtcccctattccccagcaattagcgagctaattcagagcgtgctgcagaagcttcaagacccttgtccctccagcttggcaagtcccgacgagagtgagcctgattctatggagtccttccccgagagcctttctgctctcgttgttgacctcaccccccgaaaccccaactctgcaatcctcctttcacctgtcgagacaccttacgcaaacgttgacgcagaggttcacgccaaccgcctgatgcgagagctggatttcgcagcctgcgttgaggagcgcttggatggagtgatcccgctcgcacgcggcggcgtggttcgtcagtattggtcatccagttttctggtagatctgttggctgtggcagctcctgtggtgccaactgtgctttgggcattctcaacccagcgaggcgggaccgaccctgtgtataacatcggagccctgcttcgcggctgttgtgtggtggccctccatagtctccggcgcacagcttttcgaataaagacatag

SEQ ID NO: 207803 - DNA, 489 bp, Artificial Sequence
  Description of Artificial Sequence: Synthetic coding sequence
atgggccccctgcgggagagcaaggagcaccgggtgcagcaccacgacaaggaaatcagcagaagcaggattccccgcctgattctccggccccacatgcctcaacaacaacacaaagtgagccccgcatctgagtcaccattcagcgaagaggaatcccgagagtttaatcccagttccagcggccggagcgccagaacagtttccagtaattcgttctgttcagacgacactggctgcccatctagccaatctgtaagccctgtcaagacaccgtctgatgctggtaattccccaatagggttttgccccggctccgacgagggatttacgagaaagaagtgcacaattggaatggtgggagagggcagcatacaatctagtcggtacaaaaaagaaagcaagtctggccttgtgaaaccaggctctgaagcggacttcagttcctcttctagtactgggagcatctccgcccccgaggttcactag

SEQ ID NO: 207804 - DNA, 1989 bp, Artificial Sequence
  Description of Artificial Sequence: Synthetic coding sequence
atgggccccctgcgggagagcaaggagcaccgggtgcagcaccacgataaagagatttcccgcagtagaataccacgcttaattttgcgacctcatatgccccagcagcagcacaaggtgagtccagcttctgagagcccatttagtgaagaggagtcacgcgagtttaatccgagctctagcggccggtccgccagaacagtgtctagcaacagcttctgctcagacgacaccggctgtcccagtagccaatctgtgagtcccgtgaaaaccccaagtgatgccggaaattcaccaattggattctgcccagggtccgacgaaggatttactagaaagaaatgtacgataggaatggtgggggaaggtagtattcagagttcccggtataagaaggaatccaagagcggcctggttaaaccaggctcagaggctgatttctcctctagttcctcaactggctccatctctgctcctgaagtgcacatgtccaccgccggatcgaaaaggtcctcctcctctcggaatagaggcccacacggccgtagcaacggggctagttcccataaaccaggtagtagtccttccagtccccgggagaaggatctgttgagcatgttatgcagaaaccaactctcccccgtcaacattcatccttcctatgctccctcttctccatcatcttcgaactcgggatcctacaaggggagcgattgctcccctataatgagaaggagtggaagatatatgagttgtggagaaaatcacggggtccgccccccaaacccagagcagtacctcacccccctccagcaaaaggaggtcactgtaaggcatttgaagactaagctgaaggagtcagaacggaggctgcacgaaagagaaagcgagattgtcgagctgaagagccagttggcaagaatgcgggaggattggatagaggaggaatgtcaccgcgtagaggcccagcttgccttaaaggaggctcgaaaagagatcaagcagcttaagcaggtcatcgaaacaatgcggtcatcattggctgataaagataagggtatccagaaatactttgtagacattaatattcaaaacaagaagctcgagtctttactccagtctatggaaatggcccacagcggtagcctgcgcgacgagctgtgtctggatttcccctgcgactcccccgagaagtcccttactctgaacccgcccctggatacgatggcggacgggctctccctagaagaacaggtgacaggggaaggagcagatcgtgaattgcttgtcggtgattcaattgccaactctacggacctcttcgacgagatagtaaccgcgactacaaccgagtcgggggatctggagctggtacacagcacccccggtgccaatgtcttggagctactgcccatcgtgatggggcaggaagagggttccgtagtggtcgaacgggctgttcagacagatgtcgttccctattcgccggctatcagtgaactgatccagtcagtgcttcagaaactgcaagacccttgcccctcctctcttgcaagccctgacgagtctgaaccggacagcatggagagttttcctgaaagcctgtctgcgttagtcgtcgatttgactccacgtaacccaaacagtgctattttactcagtcctgttgaaaccccgtacgcaaatgttgatgccgaggtgcacgccaacagactcatgagggagctggactttgcggcttgcgtcgaggagaggctcgatggcgtcatccctctcgctagaggaggggtagtccggcagtactggagttcatcttttctcgttgacttattagcagtcgctgcaccagtagtacccaccgtcttgtgggcctttagtacccagcgcggtggcaccgaccccgtctacaatattggcgcgttactgagaggctgctgcgttgttgccctgcactctctaagacggactgccttcaggatcaaaacttag

SEQ ID NO: 207805 - DNA, 315 bp, Artificial Sequence
  Description of Artificial Sequence: Synthetic coding sequence
atgggccccctgcgggagagcaaggagcaccgggtgcagcaccacgacaaggaaattagtaggagtcgtatacctcgactgatcttacggccgcacatgcctcagcagcagcataaggtttccccggcctccgaaagccctttcagcgaggaagagtctagggagtttaatccatcttcctccgggcgaagtgcccgcacggtatctagcaatagtttctgcagcgatgacacaggctgcccttctagccagagcgtgagcccggtgaaaaccccctccgatgccggcaatagccccattggtttctgtccctag

SEQ ID NO: 207806 - DNA, 456 bp, Artificial Sequence
  Description of Artificial Sequence: Synthetic coding sequence
atgggccccctgcgggagagcaagaaggagcaccgggtgcagcaccacgacaaagaaattagtcgcagtagaattccacggctaatcctgcgacctcatatgccccagcagcaacacaaggtctctcctgccagtgaatccccgtttagcgaagaggagtccagagagttcaacccttcttcgtctggacgctccgctcgaaccgtttctagcaactccttctgtagcgatgacaccggctgtcccagttcccagagcgtctctccagtgaagaccccctccgacgccggcaacagtcctatcggattttgtccaggcagcgatgaaggcttcacgcggaaaaagtgcaccatcggcatggtaggagaaggttcgattcagtcctctcgttataaaaaggagtccaagtcaggtctagtgaagcccggctccgaagcagatttctccagctcttag

SEQ ID NO: 207807 - DNA, 231 bp, Artificial Sequence
  Description of Artificial Sequence: Synthetic coding sequence
atgggccccctgcgggagagcaagaaggagcaccgggtgcagcaccacgataaggagatatcccgatctaggatcccaaggctaatactgcgacctcatatgccacagcagcagcataaggtgtcccccgcctccgagtcgcctttttccgaggaggagtcacgggaattcaacccctctagttccgggcggtccgcccgaacggttagcagtaacagcttctgttcctag

SEQ ID NO: 207808 - DNA, 1617 bp, Artificial Sequence
  Description of Artificial Sequence: Synthetic coding sequence
atgcccggcagcggccccagcgagcggatgacctggcccggccccgctctgtcggccggaccccccacccgccctctctcttccgcaccaggcatcccaccgataccacctctgactagaacccattctctgatggctatgtccctgcctggcagcaggaggacatcggcagggagcagaagaaggacgtcaccccccgtgtcagttagagacgcttacggcacctcatccctgtcctccagctccaatagtgggagctacaagggatctgattcctcgccaacccctcgccggtcaatgaagtacaccctctgctctgacaatcatggcataaaacctcccacaccagagcagtatttgacgccactccagcagaaggaagtgtgtatcaggcatttaaaggcccgcctgaaggacacccaggatcgactgcaagatagggataccgagattgacgatttaaagacgcagctgagcagaatgcaagaagactggattgaggaggagtgccatagagtggaggcgcagctagccctgaaggaggctcgaaaggagatcaagcaacttaagcaggtgattgacactgttaaaaataacctgattgataaggacaagggcctccagaaatactttgtcgacattaacatccaaaataaaaagctggagaccctgctgcactccatggaggttgcccagaacggaatggcgaaggaggatggaacaggggaatccgcaggaggctctcccgcacgcagccttacccgctccagcacatacacaaagctgagtgatccagccgtgtgtggtgaccgtcagcccggggacccaagctccggcagcgccgaggatggggcagattcagggttcgctgcagccgacgataccttaagcaggactgatgccctcgaagccagcagtctgttatccagcggagtggattgcggcaccgaggagaccagccttcatagctctttcggcctggggcccagattccccgcatcaaacacctatgaaaagctgttatgcggcatggaagcgggagtgcaggcatcctgtatgcaggagagggccatacagaccgactttgtgcagtatcagcccgatctggataccattctggagaaggtgacacaggctcaggtttgcggtaccgatcccgaaagtggggacaggtgcccggaattggatgcacacccgtccggtcctcgggaccctaactcagccgtagtggtcacagtgggggatgaattggaagctccagagcctattactagaggtccaacccctcagaggcctggtgctaaccccaaccctggccagagtgtctccgtggtatgtcctatggaagaggaggaggaagccgctgtggccgagaaggagcccaaatcatattggagccgacactacatcgtcgaccttttggccgtagttgtcccagccgtgccaactgtggcttggctgtgtagatcacaaagacggcagggccagccaatctacaacatctcatctcttctgcgcggctgttgtactgttgcacttcacagcatcagaaggattagttgccgatcactgtctcagccatccccaagcccggcaggtggaggctctcaactttag

SEQ ID NO: 207809 - DNA, 1485 bp, Artificial Sequence
  Description of Artificial Sequence: Synthetic coding sequence
atggccatgagcctgcccggcagccggcggaccagcgccggcagccgcaggaggacatccccccctgtgagcgttcgagacgcctacggcacctcgtccctatcaagctctagtaactcaggatcctacaagggatctgactcttcacctacccccagaaggagcatgaagtacaccctgtgttctgacaaccatgggattaagccgccgacccctgaacagtacctcactccactccagcaaaaggaggtatgtatcagacatttaaaggctaggctgaaggatactcaggatagactccaagatcgcgatacagagattgacgaccttaaaacccagctgtcgcgtatgcaggaggactggatcgaggaggagtgccaccgggtcgaggcccagcttgcactgaaagaagcaaggaaggagatcaagcagctgaagcaggtgatcgatactgtgaagaataaccttattgataaggacaagggcctccagaagtatttcgtcgacatcaatatacaaaacaaaaaactcgaaaccctgcttcattcaatggaggtggctcagaacggcatggccaaagaggacggcaccggggagtctgctggaggctcacctgcccggtcccttactagatcttctacctacactaaactttccgacccggcagtctgcggagacaggcaacctggtgacccatctagcgggagcgcagaagacggcgctgattctggatttgcggccgcagacgatacactgtccaggaccgatgccctggaggcttcatcgttgctgagcagtggtgtagactgcggcaccgaggaaacatccctgcactcttctttcggcctgggcccgcgcttcccagcgtcaaacacctacgagaaactcctgtgtgggatggaagccggcgtgcaggcaagctgcatgcaggagagagccattcaaaccgacttcgtgcagtatcagcccgacctggatacaatcctcgagaaggtcacccaggcccaagtatgcggaactgatccagagtctggcgatcgatgtccggaactcgacgcccacccatcagggcccagggatcccaacagcgctgtagtggtgacagtaggcgatgaactggaggcccccgagcctatcacccgtgggcccacgccacagcgccccggtgctaatcctaacccgggccagtctgtctccgtcgtatgcccaatggaagaagaggaggaagccgccgtcgccgagaaagaaccaaaatcatattggagccgccattatatagtggatctgcttgccgttgtggtgcccgccgttcccaccgtggcatggctctgtcggtcacagaggcgccagggacagccgatatataacatttcaagcttgctcaggggctgctgtaccgtggccctacactccattcggagaatctcttgtcggtccctttcacagccgagtccctcaccagcaggcggcggctctcagctttag

SEQ ID NO: 207810 - DNA, 864 bp, Artificial Sequence
  Description of Artificial Sequence: Synthetic coding sequence
atgaaggaccggctggccgagctgctggacctgagcaagcagtacgaccagcagttccctgacggggacgatgagttcgactcaccccacgaggatatcgtctttgagacagaccacatcctcgagtctctgtatcgcgacattcgggatatacaggatgagaaccagctcctggtggcagatgtcaagcgtcttgggaagcaaaacgctcgctttttgacctccatgcgacggctttcgagtattaagcgggataccaatagcatagcgaaagccatcaaagcacggggcgaagttatccactgcaagcttcgggccatgaaagagctgagcgaggcggccgaagctcagcacggcccccacagtgccgttgccaggatatcgagggcccagtataacgctcttacactgacctttcagagagccatgcatgactataatcaagcagaaatgaagcaaagggataattgtaagatccgcattcagagacagctcgagatcatgggaaaggaagtcagtggggaccaaatcgaggacatgtttgagcaaggtaagtgggacgttttctcagagaatctgttagcagacgtcaaaggggcccgggcggctttgaacgagatcgaatcacgtcaccgggaactactgcggctggagtccagaataagggacgtgcacgaacttttcttgcagatggcagtgcttgtagaaaaacaagctgacaccctcaacgtaattgaacttaacgtgcagaagaccgttgactacaccggacaggccaaggcacaggtccggaaagcagtgcaatacgaagagaaaaacccctgcaggacactatgttgtttctgctgtccatgcctcaagtag

SEQ ID NO: 207811 - DNA, 615 bp, Artificial Sequence
  Description of Artificial Sequence: Synthetic coding sequence
atggccctggtgagcggcatcagcctggaccccgaggccgccatcggggtcactaagagaccacccccaaagtgggtggatggtgttgacgagatccaatatgatgtcggacggataaaacagaagatgaaagagctcgccagtcttcatgacaagcacctcaatcgcccaacgctggatgactcctctgaagaagaacatgcgatagagattacgacacaggagatcacccagctcttccaccggtgccagagagctgttcaagccctcccctcaagagctcgcgcttgcagcgagcaagaagggagactcctgggcaacgtggttgcaagcttggctcaagcactccaggagctgtctacttcgttccgtcacgcacagtctggctacctgaaacgtatgaagaacagggaagagcgaagccaacattttttcgatacttcagttccgttgatggatgatggcgatgataatacactctaccatcggggcttcaccgaggaccagctcgtgctggtggaacagaataccttgatggtcgaagaacgtgaacgggagatccgccaaatagtgcagtcaatcagtgatctgaacgagattttcagagacctgtag

SEQ ID NO: 207812 - DNA, 927 bp, Artificial Sequence
  Description of Artificial Sequence: Synthetic coding sequence
atggccacccggcggctgaccgacgccttcctgctgctgcggaacaatagcatacagaacagacagctcctcgcagaacaagagctcgatgagttggctgatgacaggatggctctcgtaagcggaatttccctggatcccgaggctgccatcggcgtcactaagcgccctccgcctaagtgggtcgatggcgtagatgagatccagtatgatgtcggtcgaattaagcagaagatgaaggagctcgcatccctgcatgacaaacacctgaaccgcccaaccctagatgatagcagtgaggaggaacatgcaattgagatcactacccaagagattacccagctctttcaccgctgccaaagggcagtccaggcattaccgtcgcgggcacgcgcttgctcggaacaggagggcagattactcgggaacgtagtcgcctcactagctcaggccttacaggagctgtctacgagcttcaggcacgcccagagtggatacttgaaaagaatgaagaacagagaagagcgcagtcagcacttcttcgatacatcagtgccactcatggatgatggagacgataacaccctgtaccatcgaggatttaccgaagaccagctggtgctggttgagcagaatacgcttatggtggaggaaagagagagggagattcggcaaattgtacaaagtatatccgacttgaacgaaatctttagagatctcggtgcaatgatagtagaacagggcacagttctcgaccgcatcgactacaacgtggagcaatcgtgtatcaaaacagaggatggtctcaagcagttgcataaggcagagcagtatcagaagaagaatcggaaaatgttggtaatcctgatactgtttgtaattatcatcgtgcttatcgtcgtgctggtaggcgtcaagtcacgctag

SEQ ID NO: 207813 - DNA, 966 bp, Artificial Sequence
  Description of Artificial Sequence: Synthetic coding sequence
atggccacccggcggctgaccgacgccttcctgctgctgcggaacaacagtatccagaacagacagctgttggccgaacaagtcagctctcacatcacctcttccccactgcattcccggagtatcgcagcattggccgacgacaggatggcactagtatccggaatctcacttgatcccgaggccgctataggtgtaacaaaaagaccacccccgaagtgggtggatggcgtcgacgagattcagtacgacgtgggaaggatcaaacagaagatgaaggaactggcatctctgcacgacaagcacttaaatcgaccaaccctggacgactcgtccgaggaggaacatgctattgaaatcactactcaggaaataacccagctattccaccggtgccaaagagcagttcaggctctaccctctagggctcgagcttgttctgaacaggaaggcaggttgctcggcaacgtcgtagcttcacttgcccaggcgctccaggagttaagcaccagtttccgacatgctcagtcaggttatctcaaaaggatgaaaaaccgagaagaacgttcgcagcactttttcgacaccagtgtgcccctgatggacgacggggatgacaataccctgtaccatcgaggattcactgaggaccagttggtactggtcgagcagaacaccctcatggtcgaagaacgcgagcgggaaataagacaaatagtacagtcgattagtgacctaaacgagattttcagggacctcggtgcaatgattgttgagcagggaaccgtcctcgacaggatcgattacaatgtggagcagagttgcattaagaccgaagatggccttaaacaactgcacaaagccgaacagtatcagaaaaaaaacagaaaaatgctggtaatccttattttgttcgttattattatcgtgctcattgtggtgctcgtcggcgtgaaaagtcggtag

SEQ ID NO: 207814 - DNA, 756 bp, Artificial Sequence
  Description of Artificial Sequence: Synthetic coding sequence
atggccctggtgagcggcatcagcctggaccccgaggccgccatcggtgtgacaaaacgacctcctcccaagtgggtggatggcgtggatgaaatccagtatgatgtggggcggatcaaacagaaaatgaaagagctggctagcctccatgataagcacttgaacaggcctacgctggacgactccagcgaggaagaacatgcaatcgaaatcacgacccaggagatcacacagctgtttcacaggtgccagcgggccgtgcaggctctgccttccagagcaagagcatgtagcgagcaggagggacgtctgttagggaacgtggtggcttctttggcccaagcgttgcaggaactaagcactagcttccgccatgcccagtcgggatacctgaagcggatgaaaaacagagaggaacgcagtcagcatttcttcgatacttccgtccctctcatggacgatggggacgataacacattgtatcacaggggatttaccgaggaccagctggttctcgtcgaacaaaacactctgatggttgaagaacgggaaagagagatcaggcagattgtccagagcatctccgaccttaacgaaatttttcgcgatttaggagccatgattgtggaacaggggaccgttctggaccgcatcgattataacgttgagcaatcctgtatcaagaccgaagacgggttgaagcaactccataaagcggaacagtaccagaagaaaaatcgcaagatgctggtttag

SEQ ID NO: 207815 - DNA, 927 bp, Artificial Sequence
  Description of Artificial Sequence: Synthetic coding sequence
atggccacccggcggctgaccgacgccttcctgctgctgcggaacaactctattcaaaaccggcagttactggcagaacagcaattgtcaaagctggctgacgataggatggccctggtttctggcatcagtctggaccctgaagccgccatcggagttactaagaggcccccacctaagtgggttgacggcgtcgacgagatacagtacgacgtaggccgcattaaacagaaaatgaaggaactggcctccctgcacgataagcacctaaacaggccaacattggacgacagctcagaagaagagcacgccatagagattaccactcaggagatcactcagttatttcaccgctgtcagagagcagttcaggcactcccaagccgagccagggcctgttccgagcaggaggggcgccttctgggcaatgtggttgcctcgttggctcaggcactgcaggaactgagtacgagcttccgccacgcccagagcgggtaccttaagagaatgaagaaccgggaagagcggtctcagcatttctttgacacatctgtcccacttatggacgacggggacgacaataccctctaccataggggctttacggaagaccagttggttctggtggaacagaatactcttatggttgaagagagagagagggaaattagacagattgttcagtccattagtgacctcaacgagatttttcgcgacttaggtgcaatgatagtcgagcagggcactgttctcgatcgtatcgactacaatgtagagcagtcctgcattaagacagaagacggcctgaagcagctgcacaaagccgaacagtatcagaagaaaaatcgaaagatgcttgtcattttgatactattcgtaatcatcattgtcttgatcgtggtccttgtgggtgtcaaatcccgttag

SEQ ID NO: 207816 - DNA, 978 bp, Artificial Sequence
  Description of Artificial Sequence: Synthetic coding sequence
atggccacccggcggctgaccgacgccttcctgctgctgcggaacaactctatccaaaatcggcagctattagcagaacaggtgagctcgcacatcacttcctccccacttcactctagatccatcgcagcagctctggacgaactggcagacgatcggatggcgctcgtgtctggcataagcttggaccccgaagccgctattggggtgacaaagcggccgccaccaaagtgggtcgacggggtggacgagatacagtatgacgttgggcgtattaaacagaaaatgaaggagttagccagcctgcacgataaacacctgaatagaccaaccctggatgatagcagcgaggaggaacatgctatagagattacaacacaggagattacacagctgttccacagatgccagcgcgccgttcaggctcttccgagtcgtgcccgagcctgctcagaacaggagggaaggcttctgggaaacgtagtggctagcttggcacaagcgttgcaggagcttagcacgtctttccgccatgctcagtccggctacctgaagcgaatgaagaatagggaggagagaagtcagcatttctttgatacaagcgttcctctcatggatgacggcgacgataatacgctgtaccaccgaggatttaccgaagatcagctcgtgctggtcgaacaaaacactctcatggtcgaagaaagggaacgcgagattcggcagattgtccagtctattagtgacctcaacgagattttcagggacctcggagccatgatcgtggagcaggggacagtgctggatcgcatagactacaacgtggaacagtcatgtatcaagacggaagacgggctgaaacagttgcacaaggctgagcagtaccaaaagaagaacagaaaaatgctcgtaattctcattctgttcgtcattattatagtcttgattgttgtgctggtgggggtgaaaagcagatag

SEQ ID NO: 207817 - DNA, 915 bp, Artificial Sequence
  Description of Artificial Sequence: Synthetic coding sequence
atggccacccggcggctgaccgacgccttcctgctgctgcggaacaattccattcagaatagacagctgctggctgagcagctggccgatgacaggatggcattggtgtctggcatcagcctcgatccagaggcagccattggagtcactaaacgcccccctcccaagtgggtggacggagtggatgagattcagtatgatgtgggaagaattaagcagaaaatgaaggaattagcaagcctccatgacaagcatctgaaccggccaaccttggatgattcctcggaagaggaacatgctatagagatcactacgcaggaaataacgcagctgttccaccgatgtcagcgggctgttcaggcgctaccgagccgtgctcgggcatgcagtgagcaggagggacgccttttaggtaatgttgtagccagtctcgctcaggcactgcaggaactcagtacaagcttccggcacgcacaaagcgggtaccttaagagaatgaaaaaccgggaagagcgtagccagcacttctttgacacaagcgttcctctgatggatgatggagacgacaatactctctatcatcgagggttcaccgaggaccaacttgtgcttgtggagcagaatacattgatggtcgaggaacgtgaacgcgagattcgacaaattgtccagtctatttctgacctaaatgaaatctttcgcgaccttggagccatgatagtggaacaaggcaccgtgctggaccggatcgattataacgtggagcagtcctgcattaagaccgaggacgggctgaaacagctccacaaggcagagcagtaccagaagaaaaataggaaaatgctggtcatccttatccttttcgtgattatcattgtcctgattgtcgtgctcgtgggagtaaagtcaaggtag

SEQ ID NO: 207818 - DNA, 819 bp, Artificial Sequence
  Description of Artificial Sequence: Synthetic coding sequence
atggccctggtgagcggcatcagcctggaccccgaggccgccatcggagtcactaagaggcccccgccgaagtgggttgacggcgtggatgagatccaatacgatgtaggcaggattaaacagaagatgaaagagctcgcctccctgcacgacaaacacctaaatcggccgacactcgacgactcctcggaggaggaacatgcaattgaaatcacgactcaggagatcacacagttgtttcatcgctgtcagcgggccgtgcaggcattgccatcaagagcccgcgcctgctccgaacaggagggccgcttgttggggaacgtggtcgcgagcctggcgcaagccctgcaggagctctctaccagttttaggcacgcacagtctggctatctgaagcggatgaagaatcgcgaagaaagatctcagcatttttttgacactagcgtgcccctcatggacgacggagacgacaataccctgtatcaccgcggctttaccgaggatcagcttgttctggttgaacaaaatacattgatggtcgaagagcgcgagcgcgagataagacaaattgttcagtccatctccgacctcaacgagatcttccgggacttaggcgcaatgattgtggaacagggaacagtgctcgatcgaatcgattacaacgtagagcagtcgtgcattaaaacagaagatggtcttaagcagctccacaaggccgagcagtatcagaagaagaatcgcaagatgctggtaattctcattctgtttgtcattatcatcgtgttaatcgtggttctggtcggggtgaaatctaggtag

SEQ ID NO: 207819 - DNA, 978 bp, Artificial Sequence
  Description of Artificial Sequence: Synthetic coding sequence
atggccacccggcggctgaccgacgccttcctgctgctgcggaacaatagcatccagaataggcagctcctggcagaacaagtatcaagtcacatcacaagcagccccctgcatagtcggtcaattgctgctgagctcgacgagctcgccgacgatagaatggccctagtctccggtatctcactggaccctgaagcagccatcggggtcactaagaggcctcctcccaaatgggtggatggcgtggatgaaatccagtacgatgtcggaagaattaaacaaaagatgaaggaacttgcctcattgcacgataagcacttaaaccgccccacactagatgattccagcgaggaagagcacgccattgaaatcactacacaggagattacacagctctttcaccgctgccaacgggcagtgcaggccctgccctctcgcgcccgggcgtgctcagagcaggagggccgtttactcggcaatgtggtggcttcacttgcacaggccttacaggagctatctacatcctttagacacgcgcagtccggctacttgaagaggatgaaaaacagggaggagaggtcacagcactttttcgatacgagcgttcccctgatggacgacggggacgacaatacgctttaccatcgcgggtttacagaagatcagctggtgttagtggaacaaaacacgttgatggtggaggagcgggaacgtgagatcaggcagatcgttcaaagtatttctgacttgaacgaaatttttcgggatctcggggctatgatcgttgagcagggaaccgtactagatcggattgactataacgtggaacagtcgtgtattaaaactgaagatggactcaagcagttgcacaaagctgagcagtatcagaagaaaaaccgaaaaatgctcgttattctcattttgtttgtcatcatcatcgtgctgattgtcgtactggtgggagtgaagtcgcggtag

SEQ ID NO: 207820 - DNA, 366 bp, Artificial Sequence
  Description of Artificial Sequence: Synthetic coding sequence
atggccctggtgagcggcatcagcctggaccccgaggccgccatcggtgttacgaagaggccgccaccaaagtgggtggacggcgtggatgagatccagtacgatgtaggcagaataaagcagaagatgaaagagttggcgagtttacacgataaacacctcaatcgacctaccctagacgatagttctgaggaggagcacgcgatcgagatcaccacccaggaaatcacccagctgtttcatcgctgccagcgcgcagttcaggcactgcctagcagagctcgggcttgcagtgagcaggaagggcgactactgggaaatgtggtggcctcacttgcacaggctcttcaggaactctcgacctag

SEQ ID NO: 207821 - DNA, 420 bp, Artificial Sequence
  Description of Artificial Sequence: Synthetic coding sequence
atgaagaaccgggaggagcggagccagcacttcttcgacaccagcgtgccgctgatggacgatggtgatgacaataccttataccaccgcggtttcacagaggaccagctggtgctggtcgagcagaacaccctgatggtggaggaacgggaaagggagatcaggcaaatcgtgcaatcaatttctgacctgaacgaaatctttcgcgatctgggagctatgatcgttgagcagggcactgtgctagacagaatagactataatgtggaacagagttgtatcaagaccgaggacgggctcaagcagctgcacaaagctgagcagtaccagaaaaaaaaccgaaaaatgcttgttatcctgattctctttgtgattattatagtgctgattgtggtgctagtcggagttaaatctcgctag

SEQ ID NO: 207822 - DNA, 660 bp, Artificial Sequence
  Description of Artificial Sequence: Synthetic coding sequence
ggcatcagcctggaccccgaggccgccatcggcgtgaccaagcggccacctcccaagtgggtcgatggggttgacgagatccaatatgacgtgggcagaattaagcaaaagatgaaggagctggcctcactgcacgacaaacaccttaatcgacccacactggatgattcttccgaggaagagcacgccatcgaaataacaacacaggagattactcagttattccaccgctgccagagggcggtgcaggcgcttccaagtcgcgctcgcgcgtgctcggagcaggagggaaggttgctaggcaacgtcgtggccagcttggcacaggccctccaggaactctccacttctttccgacatgctcagagcggatatctaaaacgcatgaaaaaccgcgaagagagatctcagcacttcttcgatacctcagtgccgctgatggatgacggcgatgacaacacactttatcaccggggtactgtgctggaccgcatagactacaatgttgagcagtcctgcattaaaactgaagacgggctaaagcagctccacaaggctgaacaataccagaaaaagaaccgaaagatgctggtgatcctaatcctgtttgtaataattattgtgttgatcgtggtactggttggggtgaagtcaaggtag

SEQ ID NO: 207823 - DNA, 369 bp, Artificial Sequence
  Description of Artificial Sequence: Synthetic coding sequence
atggccctggtgagcggcatcagcctggaccccgaggccgccatcggcgtcacaaagcgccctcctcctaagtgggtggatggggtggacgagatacagtacgatgtgggacggattaaacagaaaatgaaagagcttgcctcattacacgacaaacatctgaataggccgaccctggacgattctagtgaggaggaacatgcaatagaaattacgactcaggagattactcaactgttccaccggtgtcagcgtgctgtgcaggcactccccagcagagcccgagcctgctcggagcaggaggggaggctcctcggcaacgtcgtggcctcgcttgctcaggcactacaagaattgagcacttcttag

SEQ ID NO: 207824 - DNA, 609 bp, Artificial Sequence
  Description of Artificial Sequence: Synthetic coding sequence
atggccacccggcggctgaccgacgccttcctgctgctgcggaacaactccatccagaatagacagctcctggcggagcaggagctggacgaattagctgatgaccgtatggctcttgtaagcggcatttccttagaccctgaggccgccatcggcgtcaccaagaggccaccacctaagtgggtggacggagtggatgagatccagtacgacgtggggcgtattaaacagaagatgaaggaactggccagcctgcatgacaaacacctaaacaggccaaccctcgacgactctagcgaagaagaacacgctatagaaatcactacccaggagatcacccagctcttccacagatgccagcgcgctgtgcaagcattgccgtccagggcacgggcatgtagtgagcaagagggcaggcttctgggaaacgtggtggcatctctggcccaggcactgcaggagctttcaacttcttttcggcatgcacaatccggttaccttaagagaatgaagaacagggaagagaggtcacagcatttcttcgatacctctgttcctctgatggacgacggcgatgataataccctttaccaccgccgcacctcctag

SEQ ID NO: 207825 - DNA, 909 bp, Artificial Sequence
  Description of Artificial Sequence: Synthetic coding sequence
atgagcgaggacgaggagaaggtgaagctgcggcggctggagcccgccatccagaagttcatcaagattgtgattccaaccgatctcgaaagacttcggaaacatcagattaatatcgagaagtatcagagatgtcggatctgggacaaactgcacgaagaacacattaatgccggtcgcacggtccagcagctgcgcagtaatattagagagattgagaagctgtgtctgaaggtccggaaagacgatctggtgttactgaaacggatgatcgacccagttaaggaggaggctagtgctgcaaccgcagaattcttgcaactgcaccttgagtcggttgaggagcttaaaaaacaatttaatgatgaggagacattgctgcagccccctctgacacgcagtatgactgtcggaggggcgttccatactacggaggccgaggcatcatcacagtctctcactcagatttatgcactgccagagatccctcaggatcaaaatgccgcagagtcttgggaaaccctcgaggccgatctgattgagctatcacagctggtgaccgatttttccttgctggtgaactcccagcaggagaagatcgatagtattgcagaccatgtcaatagcgccgctgtgaatgtcgaagaaggtaccaagaatctgggcaaagcggctaaatacaaattagccgcgctacccgtagcaggcgcgttaattggcggtatggtggggggccccatcgggctcctcgccggcttcaaggtggccggaatcgcagccgccttaggcggaggagtgcttgggtttactggtgggaaactcatacagcgcaagaagcaaaagatgatggagaagcttacaagcagttgtccagacctcccctctcagacagacaagaaatgttcttag

SEQ ID NO: 207826 - DNA, 909 bp, Artificial Sequence
  Description of Artificial Sequence: Synthetic coding sequence
atgagcgaggacgaggagaaggtgaagctgcggcggctggagcccgctatccagaaatttatcaaaattgtcattcctaccgatcttgagagactgcgcaagcaccagataaatattgaaaagtaccaacgatgtagaatctgggataaactgcacgaggagcacataaacgccggccgcactgtgcagcaattgcgtagcaatatccgagagatcgagaaactctgtctgaaggtgagaaaagatgacttggtgttgctgaaacgcatgatcgaccctgtgaaggaggaagcttccgctgctaccgccgaatttctgcagctgcatcttgagagtgttgaagagctcaaaaagcaatttaacgacgaagaaacactgttacagccccccctgacccgctccatgacggtgggcggcgctttccatacaaccgaggcggaagccagctcccagagcttgacccagatctatgcgctgcccgaaatacctcaagaccaaaatgcagccgagagttgggagactctcgaggccgatctgatcgagctgtctcagttggtaaccgattttagcctcctcgtcaatagccaacaggagaaaatcgactcaatcgccgaccacgtgaacagtgcagctgtcaatgtcgaggaaggcacaaaaaacctcgggaaggcggctaagtacaagctagcagccttgcccgtagctggagctctaatagggggaatggtaggcgggcctattgggttactggctggtttcaaggtggccggcattgcagctgccctgggagggggggtgttgggttttaccggggggaaactgatacaaaggaaaaaacaaaagatgatggagaaactgacctcaagctgtccagacctgcctagtcagaccgataaaaaatgctcatag

SEQ ID NO: 207827 - DNA, 126 bp, Artificial Sequence
  Description of Artificial Sequence: Synthetic coding sequence
atgagcgaggacgaggagaaggtgaagctgcggcggctggagcccgccattcagaaattcatcaagatcgtcatcccaaccgaccttgagaggctgagaaagcaccagatcaacatcgagaagtag

SEQ ID NO: 207828 - DNA, 126 bp, Artificial Sequence
  Description of Artificial Sequence: Synthetic coding sequence
atgagcgaggacgaggagaaggtgaagctgcggcggctggagcccgcaatccagaagttcattaagatagtgattcctaccgacttggagagactcaggaagcaccaaattaacattgaaaagtag

SEQ ID NO: 207829 - DNA, 909 bp, Artificial Sequence
  Description of Artificial Sequence: Synthetic coding sequence
atgagcgaggacgaggagaaggtgaagctgcggcggctggagcccgcaatccagaaattcatcaaaatcgtgatacccacagacttggaacggctgcgcaagcatcaaatcaatattgagaagtatcagcgttgccgcatctgggataagctgcacgaggagcatatcaatgccggacgcaccgtgcagcagttgagaagcaatatccgcgaaatcgaaaagctgtgtttaaaagtgcggaaggatgatttggtattgctgaaaagaatgattgacccagtcaaggaggaggcctccgcggcaactgccgagtttctccagctgcacctggagagtgtggaggaactgaagaagcagttcaacgacgaggagaccttgttacagccccctctcaccaggtcaatgacagtgggcggagcattccacacaactgaagcagaagcaagttcccagtctctgactcagatttatgccttacctgagatcccacaggatcagaatgcggcagaaagttgggaaacactcgaggcagatctcattgagctgagtcagttagtgacagacttttctctcctggtgaacagccaacaggagaagatcgatagcatagcggaccacgtgaatagtgctgctgtgaatgtggaagagggcactaagaacctcggaaaggctgctaaatacaagttagcagctctgcccgtggcaggtgcactaataggaggaatggttggggggccgattgggttgctggctggctttaaagtcgcaggtattgccgccgctctgggaggcggggtgctggggttcaccgggggcaaactgatccagcgcaaaaagcaaaagatgatggagaaactaacatcttcttgcccggacttaccttcccagacagacaagaaatgcagctag

SEQ ID NO: 207830 - DNA, 636 bp, Artificial Sequence
  Description of Artificial Sequence: Synthetic coding sequence
atgcggctgttcctgtggaacgccgtgctgaccctgttcgtgaccagtctcataggtgccctcatcccagaacctgaagtgaagatagaagtgctccagaagccttttatctgccatcgtaaaactaaggggggagacctgatgttggtgcactacgagggttaccttgaaaaagatggtagtcttttccactcgacccataaacacaacaatggtcagcccatctggtttactttgggtatcctagaggcccttaaaggctgggaccagggactgaaaggcatgtgcgtgggcgagaagcgtaaattaattattcctcccgccctaggttacggaaaagagggaaagggaaaaattccacccgaaagcactctcatattcaacatcgatctgctggaaattcgcaacggtcctcggtcccacgagtccttccaagaaatggatctgaatgatgactggaagctgtccaaagacgaagtcaaggcttatctcaaaaaagagtttgagaaacacggagcggtggttaatgagagtcaccacgatgctctcgtggaagacatttttgacaaggaggacgaggataaggatggcttcatcagtgcacgcgagtttacatacaagcacgatgagctgtag

SEQ ID NO: 207831 - DNA, 783 bp, Artificial Sequence
  Description of Artificial Sequence: Synthetic coding sequence
atgaaggaccggacccaggagctgcggaccgccaaggacagcgacgatgacgatgatgtagctgtgacagtggacagggatcggtttatggacgagttctttgagcaagtggaggagatacggggcttcatcgataagattgcagagaatgtagaagaagtgaaaaggaagcattcagccattctggctagccccaaccctgacgaaaagacaaaagaggaactggaggagttgatgagcgacattaaaaagactgcaaataaagtaagatcaaaacttaagagtatcgagcagagtatcgaacaggaagaaggactgaatagatcaagcgctgacttgcggatcagaaagacccagcatagcactctttcaaggaagttcgttgaagtgatgtcagaatacaacgccacccagtcagactatagggagcgctgtaaaggcagaattcagcgccagctggagatcacagggcggaccacaacatcagaggagctagaagacatgcttgaatccggcaatcccgccatctttgcttccggtatcataatggacagttccatttccaagcaggcactgagcgaaatcgagacacgtcattccgaaattataaagctggaaaactccatccgggaactccacgacatgttcatggatatggccatgttggtagagtctcagcctcaaggagcattcctaaagtcttgcccagagcctcagcctaatccagaggagggggctctatggagttctggcgccccagggcctgctggacgggatgattag

SEQ ID NO: 207832 - DNA, 516 bp, Artificial Sequence
  Description of Artificial Sequence: Synthetic coding sequence
atgaaggaccggacccaggagctgcggaccgccaaggacagcgacgatgacgatgatgtcgctgtgactgtcgatcgggaccgtttcatggatgaatttttcgagcaggtcgaggtgatgtccgagtataacgcgacacagagtgactaccgcgaacgctgtaaaggacggattcagcggcagttggagataacggggcgtaccaccacatccgaagagctcgaggatatgctcgaatccggcaatccagccatatttgcatctggaatcattatggacagctctatcagcaagcaggccctgtcagagattgaaacgagacactccgagataattaaactggaaattgaatataacgtggagcatgctgtagactacgttgaacgagccgtctccgatactaagaaggctgtgaaatatcagagcaaagcccgccgaaaaaagataatgattatcatttgctgtgttatactggggatcgtcatcgccagtaccgtaggaggtatctttgcatag

SEQ ID NO: 207833 - DNA, 756 bp, Artificial Sequence
  Description of Artificial Sequence: Synthetic coding sequence
atgaaggaccggacccaggagctgcggaccgccaaggacagcgacgacgatgacgacgttgcagtcaccgtggacagggatcgctttatggacgaattcttcgagcaggtcgaggaaattaggggttttatagacaagatcgctgagaacgttgaagaggtgaaacggaaacatagcgcaatacttgcatcgcccaatcccgatgagaagacgaaagaggaattggaagagctcatgagcgatatcaagaagacagctaacaaagtacggagtaagctgaagtccattgagcagtctatcgagcaagaagaagggctaaatcggagcagcgcagatttgaggattcggaaaacccaacatagcaccctgtctcgaaagttcgtcgaggtgatgtcagagtacaatgctacacagagtgattacagagaaaggtgcaagggccgaatccaaagacagttggagatcaccggccgcactacaactagtgaggagcttgaggatatgctggagtctggcaatccagctatttttgcgagtggcatcattatggacagctccatctccaaacaagcactctctgaaatagaaactcgacacagcgagataatcaaacttgaaaattctattagggagctgcacgacatgtttatggacatggcaatgttggtggagagccagaccatgtggcgaggcccttgccttactccacgtagaccctcttctacccgtgctaggcgggctgggcggaaatcctag

SEQ ID NO: 207834 - DNA, 1053 bp, Artificial Sequence
  Description of Artificial Sequence: Synthetic coding sequence
atgttcatcaagggccgggccccccgggcccccccccgggagcggcgccgcgctacccgtggtggtctcaggcaggtggtggccccgcccagagcacttggaagcactagccgcccccacttccgacgggcatcagtttgtcgcaggcgctgtcgaaagtcaggggggctgttggccgccagccggaagatggctgcagctgctgtgaatggggcagctggattttcatcttctgggccggccgcaacgtcaggcgccgtgctgcaagccgccactggcatgtacgaacagctgaaaggtgaatggaatcgaaaatcccctaacttaagtaagtgcggcgaagaactcggccgcttgaaactagttttacttgaattgaactttcttcccaccactggaacaaaattgactaaacagcagctcattctggctcgagatattctggagatcggagcccagtggagcatacttaggaaggatattccatcctttgagcgctatatggcccagctgaaatgctactattttgactataaggagcaattgcccgagagtgcttacatgcatcagctgctggggctgaacctcttattcctcctgagccagaatcgtgtggccgagtttcataccgaattggagagacttcctgccaaagacatccagacaaatgtatacattaaacaccctgtatccttagagcagtacctgatggagggctcttacaacaaggttttcctggctaagggaaatattcctgccgagagttacacgttcttcattgatattttgttagacacaattcgggacgaaattgcaggctgcatcgagaaagcctatgagaagatcctttttactgaggccactcggatcctattcttcaatacccccaagaaaatgacagattacgcaaagaagcggggctgggtgctagggcctaacaattactactcttttgcatctcaacagcagaaaccagaggataccaccataccatcaacagagctcgccaaacaagtgatcgaatacgccagacagctagaaatgatagtgtag

SEQ ID NO: 207835 - DNA, 864 bp, Artificial Sequence
  Description of Artificial Sequence: Synthetic coding sequence
atgcgggaccggctgcccgacctgaccgcctgccggaagaacgacgacggagatacagtcgtggtggtggagaaggatcacttcatggatgacttctttcatcaggtggaggagattagaaatagtattgataagatcacccagtacgtagaagaggttaagaaaaatcattccatcatcctgagcgcacccaacccagaaggcaaaatcaaagaagagctcgaagacctgaataaagagatcaagaagactgcaaacaaaataagagccaagttgaaggctattgagcaatcatttgatcaagacgaatcagggaaccgtacctccgtcgatctgcgtatacgtaggacccaacactccgtcctgtcccggaaatttgtagaggcaatggccgaatataatgaggcgcagactttattccgcgaacgatccaaaggcagaatccagcggcaattagaaataactgggcgcactaccaccgatgacgaattggaggagatgcttgaatctggtaaaccgtccatctttaccagcgatattatttctgacagtcagattacacgtcaggcactcaacgagatcgagagtaggcacaaggacattatgaaactagaaaccagcatccgtgagcttcatgaaatgtttatggacatggccatgttcgtagagacgcagggagaaatgataaacaacatcgaacgcaacgtgatgaacgcaacagactatgttgaacacgccaaggaagagacaaaaaaagctattaagtaccaatccaaggccagacgcaagctgatgtttatcatcatttgtgtcatagtgctgctggtcattttgggcatcatcctggccactacactgtcttag

SEQ ID NO: 207836 - DNA, 867 bp, Artificial Sequence
  Description of Artificial Sequence: Synthetic coding sequence
atgcgggaccggctgcccgacctgaccgcctgccggaagaacgacgacggagacaccgtcgtcgtcgtcgaaaaggaccacttcatggatgacttttttcaccaggtggaggaaatacgcaatagtatcgataaaatcactcagtacgtggaggaagtgaagaagaatcacagcataatactctctgctcctaatcctgagggaaaaatcaaggaagagctggaagacctgaacaaagaaatcaagaaaacagcgaataaaatccgtgcaaagctgaaagctatcgagcagagcttcgaccaggacgagtccggaaatcgtacatcggttgatctccgaatcagacggactcaacactcggttctgtctcgtaaatttgtcgaagccatggccgaatacaacgaggctcaaacactgtttcgggagagaagcaagggtagaattcaaaggcagctcgaaatcacaggaagaacaaccaccgatgacgagcttgaagagatgctggagagtggaaaaccctctatttttacttctgatatcatctctgatagtcagatcactcgccaggcccttaacgaaatcgaatctcgccacaaagatattatgaagctggaaaccagtatccgggaacttcatgagatgtttatggacatggcaatgtttgtcgaaacccaaggagagatgatcaataatatcgagaggaacgttatgaatgcgacagattacgtggaacatgcaaaagaggagaccaagaaggccatcaagtaccaaagcaaggctcgtagaaagaagtggatcatcatcgccgtgtctgtggtgctggttgccattatagcgctcatcataggactgtcggttgggaaatag

SEQ ID NO: 207837 - DNA, 777 bp, Artificial Sequence
  Description of Artificial Sequence: Synthetic coding sequence
atggacgagttcttcagcgagatcgaggagacccggctgaacatcgataaaatttcagagcatgtagaagaggccaaaaagctctattcaattatactgtcggctcctattcccgaacccaagactaaggacgatctggagcagctgactactgaaatcaagaaacgggctaacaatgtacgaaacaaacttaaaagcatggaaaaacatattgaagaagatgaggtgagatcaagcgctgatctcaggatccgcaagtcccaacactcggtactctcgcgtaaattcgtggaggtgatgaccaagtacaacgaggcccaagtggattttcgggagagaagtaaagggaggattcagagacaacttgaaattaccggcaagaagacgactgatgaggagctggaggagatgcttgagagcgggaatcccgccattttcaccagcgggattattgattcacagatctcaaaacaggctctttctgaaattgagggcaggcacaaggacatcgtgaggctcgagtcttccattaaagagcttcacgatatgtttatggatatcgctatgttggtggagaaccagggagaaatgttggacaatatcgaactgaacgtcatgcacactgtggatcacgtcgagaaggccagagatgagactaaaaaggcggtgaagtaccagtcacaagcaagaaagaagctgatcattatcattgtgctcgttgtggtactcttgggcatcctcgctttgataatcggtctcagtgttggcctgaattag

SEQ ID NO: 207838 - DNA, 870 bp, Artificial Sequence
  Description of Artificial Sequence: Synthetic coding sequence
atgaaggaccggctggagcagctgaaggccaagcagctgacccaggatgacgatacagacgcggtggaaatcgcaattgacaatacagcttttatggacgagttcttctcggagattgaagaaacacgattaaacatagataagatatctgagcacgtggaagaagctaagaagttatactccatcatcctgagtgcaccgatacctgagcccaagacaaaagacgaccttgagcagctgactaccgagattaaaaagcgagcgaataacgtacgcaataagctgaagtccatggaaaagcatattgaagaagacgaagtccggtcctcggcagacctgaggatcaggaaatctcagcactcagtcctgagtaggaagttcgtcgaagtcatgaccaaatataacgaggctcaggtggatttcagggagaggtcaaaaggtagaatccagaggcagctggaaattacagggaagaagaccaccgatgaagaacttgaagagatgttagagtccgggaatccagccatttttacctctggtattatcgacagccagattagtaagcaagccttgtccgagatcgagggtcggcataaggatattgtgcgccttgagagcagtataaaggaactgcacgatatgttcatggacatcgctatgctcgtggagaaccagggtgaaatgcttgacaacattgagctgaatgtgatgcacactgtcgaccacgtcgaaaaggctcgcgatgaaacgaaaaaagcagttaagtaccagagccaagctagaaagaaacttataataatcattgtgctggtggtggtgttgcttgggattcttgcactgattataggcctgtctgtgggcctcaattag

SEQ ID NO: 207839 - DNA, 543 bp, Artificial Sequence
  Description of Artificial Sequence: Synthetic coding sequence
atggagaagcacatcgaggaggacgaggtgcggagcagcgccgaccttaggattcgtaagagccagcacagtgttctgagcagaaagtttgtcgaggtcatgacgaagtacaacgaggcccaggttgactttagagaaagaagcaagggacgcattcaaagacaattggaaatcaccggtaagaagactacagacgaggagctcgaggagatgctggaaagcgggaaccccgccatctttacctccgggataattgacagccaaatcagtaagcaagctcttagcgaaattgaggggagacacaaagatattgtgaggttagaaagcagcattaaagagctgcacgacatgttcatggacattgccatgttggtcgagaaccagggatccatgattgaccggatcgaaaacaatatggaccagtctgtgggcttcgtggagcgggccgttgcagacactaaaaaggccgttaagtaccagtccgaagcacgacggaaactgatcagtctacagacaggggtggccacgctcgtatttcggtag

SEQ ID NO: 207840 - DNA, 834 bp, Artificial Sequence
  Description of Artificial Sequence: Synthetic coding sequence
atgaaggaccggctggagcagctgaaggccaagcagctgacccaggatgacgataccgacgctgtcgagatagctatcgataatacagcattcatggatgagttcttctctgaaatcgaggagactcggctgaatatcgataagatctccgaacacgttgaagaagctaagaaattgtattccattatcctgtcagcccccatccccgagcctaagacgaaggatgacctagaacagttgacaactgaaattaagaagagagcgaacaatgtgagaaataaactcaagtcaatggaaaagcatattgaagaggacgaagtgaggtcatcagcagatttgcgcatccgcaaatcacagcacagtgtgctgagtagaaaatttgtggaggtgatgaccaagtacaatgaggcccaggtggacttccgggaaaggtctaaaggcaggattcagcgacagttggagattaccgggaagaagacgactgacgaggagcttgaggagatgctcgaaagtggtaaccccgccatcttcacttccggaattattgatagtcagatcagcaagcaagcactttctgagatagagggccgtcacaaggacatagtacgcctcgagtccagtatcaaggagctccacgacatgtttatggatattgctatgctcgtggagaatcagggcgagatgctggacaatatcgagctgaacgttatgcataccgttgatcacgtcgagaaggcccgcgacgagaccaaaaaagccgtcaaatatcagtcgcaagcccggaaaaagctgatttctctccagacgggagttgccacactggtgtttcgttag

SEQ ID NO: 207841 - DNA, 231 bp, Artificial Sequence
  Description of Artificial Sequence: Synthetic coding sequence
atgttcatggacatcgccatgctggtggagaaccagggcgagatgctagataatatcgaactcaacgttatgcatactgtggaccacgtagagaaggccagagatgagaccaaaaaagccgtgaagtatcaatctcaagctcgtaagaaattaattattattatcgtgctcgtcgtcgtgctcctcggcattctggcgctcatcatcggcctgagcgtggggttgaactag

SEQ ID NO: 207842 - DNA, 759 bp, Artificial Sequence
  Description of Artificial Sequence: Synthetic coding sequence
atgaaggaccggctggagcagctgaaggccaagcagctgacccaggatgacgataccgatgctgtggaaattgccatcgataatactgcttttatggacgagtttttctctgaaattgaggaaactcggctgaatattgataagatatccgagcacgtggaggaagctaagaagctctacagcattattctttctgctcccattccagagcccaagacaaaagatgacctcgagcaactgactactgaaattaagaagagagccaataacgtgaggaacaagctgaagtccatggagaagcatatcgaggaggacgaagtgcgctcatctgcggatctgcgaatcagaaaatcccaacactccgtgctatctcgtaagtttgtagaagtgatgaccaaatacaatgaagctcaggtggattttcgtgagcgcagtaagggaagaatacagagacagctggagattactggcaagaaaaccaccgacgaggaactggaggagatgctcgaatctggcaatccggctatttttaccagtggcataatagattctcagatctcaaagcaggctctgagcgagatagagggccgccataaggatatcgtgaggttagaatcttcaataaaggagcttcacgacatgttcatggatattgccatgctggtggaaaatcaaaagttgatcatcatcatagtgctggttgtcgtgttactgggaatcctggcactcattatcggcctctcagtcgggcttaactag

SEQ ID NO: 207843 - DNA, 894 bp, Artificial Sequence
  Description of Artificial Sequence: Synthetic coding sequence
atgcgggaccggacccacgagctgcggcagggcgacgacagcagcgacgaagaggacaaggagcgggtggcattggtggtgcacccaggaactgccagactaggtagtccagatgaggagttcttccataaagtccgaactatccgtcaaaccattgtcaaattaggtaataaagttcaggagcttgagaagcaacaggttaccatactggcaacgcctttgcccgaggagtccatgaagcaagagctacagaatttaagagacgagatcaaacaattaggtcgcgaaatccgactgcaacttaaagctattgagccgcaaaaggaagaggcggacgagaattataattccgtgaatacgcgaatgagaaagacacagcacggggtgctgtcccaacagtttgtggaacttatcaacaaatgtaattcaatgcaatcagagtacagagagaagaacgttgaacgaattagacgacagctaaaaattaccaacgctggaatggttagtgacgaagagcttgagcagatgcttgactcagggcagtccgaggttttcgtatccaacatcctgaaggacacccaggtaactaggcaagctctcaacgagatttcagctaggcattctgagatccaacagctcgagaggtccatccgcgagctgcatgatatcttcacatttctagcaacagaagtggagatgcagggcgaaatgattaataggattgagaagaacatcctctccagtgctgattacgtcgaacgcgggcaggaacacgtcaagaccgctctggagaaccagaaaaaagcacgcaagaagaaggtcttgatagctatctgtgtgagcatcaccgtggtcctgctggcggtcatcatcggcgttacagtcgtgggttag

SEQ ID NO: 207844 - DNA, 888 bp, Artificial Sequence
  Description of Artificial Sequence: Synthetic coding sequence
atgggcatgaccgcccggaccaagcggacccggagcggcagccggtggtggtgcacacgggctcgccacggatggggggcccgcaccaggtcatcttccacatctccgctcgggcacccacctcaggtgcgtaccataaggcagactatcgttaaactggggaacaaagtccaagaattagagaagcaacaagtgacaattcttgctacacctcttcctgaggagagcatgaagcaggaactgcaaaacctgcgcgatgaaatcaagcagctcggtagggagatccggctgcagctgaaagccatcgagcctcagaaagaggaagcagacgagaactacaattccgtcaacacacggatgcggaaaacacagcacggagttctctcccagcaattcgtggagctcataaataagtgtaacagcatgcagtctgaatatagggagaaaaatgtggagaggatcagaagacagctgaaaattacgaatgccgggatggtgagtgatgaagaactggagcagatgctggatagcggccagtcagaggtatttgtgtcaaatatcctgaaagatactcaggtaacccggcaagcattaaatgagatttcggcgcgacatagtgagatccaacagctcgagcggagtattcgggagctccacgacatttttactttcctcgctactgaagttgagatgcagggcgaaatgatcaatcgaatcgaaaagaatatcctgagttcagcagattacgtggaacgtggacaagagcatgtgaaaacagcattggagaatcaaaaaaaggctcgcaaaaagaaggttctgatcgccatatgtgtctcaatcaccgtcgtacttctggctgttatcattggggttactgtggtgggttag

SEQ ID NO: 207845 - DNA, 1068 bp, Artificial Sequence
  Description of Artificial Sequence: Synthetic coding sequence
atgatcccccggaagcggtacggcagcaagaacaccgaccagggcgtctatctcgggctgtctaagacacaagtactaagcccagccactgcaggaagcagcagctccgacatcgcccctctaccacctcccgttacgctggtgccgccaccacctgacactatgtcttgcagagacagaacgcaggaatttctgagcgcctgcaagtcactccagaccagacaaaatggtatacagaccaacaaacctgcccttagggcggttcggcagcggtccgagtttactctgatggctaagaggatcggcaaggacctgagcaacacgtttgccaagctcgagaagcttaccatcttggccaaaaggaagagtttatttgacgataaggctgtcgagatcgaggagctgacatacattattaaacaggacattaacagtctgaataagcagatcgcgcaacttcaagatttcgtgcgtgccaaagggtcccagtctggtcgtcatctgcagacacactcaaatacaatagtggtctccttgcaatctaagctagccagcatgtccaatgacttcaaatctgtgttggaagtacgtacagagaatttaaaacagcaaagatctaggagggagcagtttagccgcgcaccagttagcgccttaccccttgctccaaaccacctgggcggtggtgccgttgtcctaggggccgaaagccacgcttcaaaagacgtcgccattgacatgatggattcacgaacctctcagcagctgcagctgatcgacgaacaggattcctatatccagtccagggccgataccatgcagaacatcgagagcaccatcgtggaattggggagtatttttcagcagctggcacacatggtaaaagaacaggaggagacaatacagcggattgacgagaacgtgctgggcgcacagttggacgttgaagccgctcattccgaaatactaaagtatttccaaagtgtgacaagcaacagatggctaatggtgaagattttcttgattctaatcgtcttcttcatcatttttgtcgtgtttttggcctag

SEQ ID NO: 207846 - DNA, 966 bp, Artificial Sequence
  Description of Artificial Sequence: Synthetic coding sequence
atgatcccccggaagcggtacggcagcaagaacaccgaccagggcgtgtacttaggtctgtcaaagacccaggttctatctccagccactgcaggtagctctagttctgacattgccccgctgcctcccccggtcaccctggtcccccccccgcctgataccatgtcctgccgcgaccgcacccaggagttcctctcggcctgcaaatctctacaaacgcgccagaacggaatccagacaaacaaacctgctctgagggcggtacgtcagagatcggagttcactcttatggctaaacgcatagggaaagatctgtctaatacattcgctaaactcgaaaaacttacgatcctggctaagcgtaagtctttatttgatgataaggctgttgaaatcgaggaacttacgtatattattaaacaggacatcaactcccttaataagcaaatcgctcaacttcaggatttcgtaagggcaaagggtagtcagtcgggtcgccacctccagacccactctaatactattgtggtatccctccagtccaagctggcttcgatgtctaatgatttcaagtccgtgctcgaggtgagaactgagaacttaaagcagcaaagaagccgaagggagcaattcagccgagctcccgtttctgctttacccctggcccctaatcacctgggagggggggctgtagtgctgggagccgagtcacatgcctcaaaagacgtcgctatcgacatgatggactccaggacatcccagcagttacaactcatagatgaacaagacagctacatccagagccgggcagacacaatgcagaatatcgagtctactatcgtcgagttaggttccatctttcaacagctggcacacatggtaaaagaacaggaggaaacaattcagagtgtccttctgtttcccctgctccccgccctgagtcctggctcaacccgaacgtgttag

SEQ ID NO: 207847 - DNA, 906 bp, Artificial Sequence
  Description of Artificial Sequence: Synthetic coding sequence
atgagctgccgggaccggacccaggagttcctgagcgcctgcaagagcttacagacccggcagaatgggatccaaaccaataaaccagctctgagggctgttcggcagcgttccgagtttacattgatggccaaaagaattggcaaagatctgtccaatactttcgctaagcttgagaaacttacaatactcgccaagcggaagtctctgtttgatgataaagctgtagaaattgaggagcttacttatattattaagcaggacatcaattccttgaataagcaaatagcccagttacaggatttcgtgcgggcgaaggggagtcagtctgggaggcacctgcagacccattctaatacaattgtagtcagtttgcagagcaagttagccagcatgagcaacgatttcaaaagtgttctcgaagtgaggacagaaaacctgaagcagcagcgctcccggcgtgaacagttctcaagagcgcctgtatctgccctgcccctggcccctaatcacctggggggaggggcagtggtgctcggagccgaatcacacgcctctaaggatgtggcaattgatatgatggatagccgcacctctcaacaactgcagctgattgatgagcaggatagttacatccagtctcgggccgacaccatgcagaatattgagagcaccattgtggaactcggatccatttttcaacagctcgctcacatggtaaaagagcaggaagaaactatccagagaatcgacgagaatgtgttgggggctcagctggacgttgaagccgctcacagcgagatactgaaatattttcagtcagtgaccagcaacagatggttgatggtcaaaatctttctcattctgattgtgttcttcattatcttcgtggtattcttagcctag

SEQ ID NO: 207848 - DNA, 780 bp, Artificial Sequence
  Description of Artificial Sequence: Synthetic coding sequence
atggccaagcggatcggcaaggacctgagcaacaccttcgccaagctggaaaaacttacaatactggctaaaagaaagagcctctttgatgacaaagccgtggagatcgaggaactcacttatataatcaaacaggatatcaattctttgaacaagcagattgcccagctgcaggacttcgtgcgagccaaaggttcccaaagtggtcgccatctacagacccactcaaacacaatagttgtgagcctgcagtctaagctcgccagtatgtctaacgatttcaagtctgtccttgaggtgcggacagagaatctcaagcagcagcgcagcagaagggagcagtttagtagagcgcctgtgtctgcactgcccctggcccctaatcatctgggcggcggcgccgtggttctgggtgcagagagtcacgcttctaaggacgtggcaatcgacatgatggattcaagaacgtcccagcaactgcagctgatcgatgaacaggactcctacatacagtctcgcgctgatacaatgcagaatattgagtctacaatcgtcgaacttgggagtattttccagcagcttgcgcacatggtgaaggaacaggaggaaacaattcagcgtattgacgagaatgtgctaggggctcagctcgatgtcgaagctgcccacagtgaaattctcaagtatttccagtccgtgacaagcaaccggtggctgatggtcaaaatatttctgatccttatagtgttctttattatcttcgtggtcttcttagcctag

SEQ ID NO: 207849 - DNA, 720 bp, Artificial Sequence
  Description of Artificial Sequence: Synthetic coding sequence
atgagctacacccccggcgtgggcggcgaccccgcccagctggcccagcggatctcatccaacattcagaaaattactcagtgtagcgtggagatccaaagaactctcaaccagctagggactccccaagacagtccagagctgcggcagcagcttcagcaaaagcagcagtataccaatcagctggccaaagagaccgataaatacattaaagaatttggttccctgccgacaactccttccgagcagagacagaggaaaattcagaaagaccgactcgtcgcagagtttaccacctctttgacaaattttcagaaggtgcagagacaggccgcagagcgagagaaagaattcgtcgcccgggtacgagctagctcacgggtgagtggatcattccccgaggacagttcaaaggaacggaacttggtgtcctgggaatcacagacacagcctcaggtgcaagttcaggatgaggagataacagaggatgaccttcggctgatccatgagcgggagagtagcatccggcagctcgaggcggatataatggatatcaacgagatttttaaagacttaggcatgatgatccatgagcaaggggacgtgatagactccatcgaggcaaatgtcgaaaatgctgaggtgcacgtgcagcaagccaaccagcagctgagcagggctgctgactaccagaagaaggactcctgcatgctcatgtag

SEQ ID NO: 207850 - DNA, 786 bp, Artificial Sequence
  Description of Artificial Sequence: Synthetic coding sequence
atgagctacacccccggcgtgggcggcgaccccgcccagctggcccagcgcatcagctctaatattcaaaaaatcacccagtgtagtgtcgagattcagagaacattaaaccagctcggcaccccacaggacagtccggagttacgacaacagctccagcaaaagcagcagtataccaatcagttggccaaggagaccgataaatatattaaagagtttggctccttgcctaccactccaagcgaacagcggcagagaaagattcagaaagatcgcctggtcgccgagtttaccacctcactgacaaatttccagaaggtgcagaggcaagctgccgagcgggaaaaagaattcgtggcccgggtacgggccagttctagagtttcgggctcctttcctgaggactcatcgaaagaaaggaacttggtctcctgggagagtcagacacagccgcaagtgcaggtacaggatgaagagatcaccgaagacgatctgcgccttattcatgagagagagtcatccattcgccaactggaagctgatatcatggatataaatgaaatctttaaggacctcgggatgatgattcacgagcagggcgacgtcattgacagtatcgaagcgaacgtggaaaacgccgaagtgcacgtgcagcaggccaatcaacagctcagccgcgctgccgactaccagagaaagtctaggaaaaccctctgcattattatcctgatactagtcatcggggtggcaattatctcactgatcatttggggcctgaaccactag

SEQ ID NO: 207851 - DNA, 786 bp, Artificial Sequence
  Description of Artificial Sequence: Synthetic coding sequence
atgagctacacccccggcgtgggcggcgaccccgcccagctggcccaacggatcagctccaacatacagaaaataacccagtgttcggttgagatccaaaggaccctgaaccagttaggaacccctcaggattctcctgaactcagacagcaactgcagcagaagcagcagtacaccaaccagctggccaaagaaacagacaaatacatcaaagaattcggatctctgcccacaacgccctctgaacaaaggcaacgcaagatacagaaggaccgcttagtggcggaattcactacgtctctcacaaatttccaaaaggtgcagcggcaggcagccgagagggagaaagaattcgtggcccgcgtgagagcctctagccgggtgagcgggtctttccctgaagatagttccaaggaaagaaatctggtttcgtgggaaagtcaaactcaaccccaggtgcaggttcaagacgaagagatcaccgaggacgacctcaggctgatccatgagagagaaagctctatccggcagctcgaggcagatatcatggacattaatgagatttttaaggacctcggaatgatgatccacgagcaaggggacgtgattgatagtatcgaggccaacgtcgaaaatgctgaggtgcatgtgcagcaggctaaccaacagctatcacgggcggctgactaccaaaggaagtctcggaagactctgtgtatcatcattctcatcctcgtcatcggcgtcgccattatcagcttaatcatttggggtctgaatcactag

SEQ ID NO: 207852 - DNA, 711 bp, Artificial Sequence
  Description of Artificial Sequence: Synthetic coding sequence
atggcccccgacccctggttcagcacctacgacagcacctgccagattgcgcaggagattgcagagaaaattcaacagcggaaccaatatgagcgcaaaggggagaaggctcccaaacttacagtgaccattcgggccttgctgcagaatctgaaggagaaaattgccctgttgaaggacctcctgctccgagctgtcagtactcatcagatcacgcagcttgagggcgataggcggcaaaatctcctcgacgatctcgtcacgagagagcgtctgttgctggcctcctttaaaaatgagggggctgagcctgacctcatccggagttccctgatgtccgaggaggccaagcgcggtgcccccaacccctggttgtttgaagagccggaggagacccggggactcggttttgacgagatccgtcagcagcagcagaagatcatccaggagcaagatgcaggcttagacgccttaagctcaattatctctagacagaagcagatgggtcaggaaattggaaatgaactcgacgagcaaaatgaaatcatcgacgatctggccaatcttgtggagaacaccgatgagaaactgaggaatgaaacccgccgagtaaacatggttgatagaaagtcggcatcatgcggaatgattatggtgattcttctgttgctggtggccatcgtggtcgtcgctgtgtggcccaccaactag

SEQ ID NO: 207853 - DNA, 1785 bp, Artificial Sequence
  Description of Artificial Sequence: Synthetic coding sequence
atggcccccatcggcctgaaggccgtggtgggcgagaagatcatgcacgacgtgattaagaaggttaagaagaagggcgagtggaaggtactggtggtcgaccaactgtctatgagaatgctgagcagttgttgcaaaatgaccgatatcatgaccgaaggcatcaccatagtcgaggacataaacaagcgccgagagcctctgcctagcctcgaagccgtctatctgattacaccaagcgagaagtcagttcattcactgattagtgactttaaagatccccctacggcaaagtatcgggcagctcacgttttctttacagattcatgtcctgacgctctttttaacgagctcgttaaaagccgcgctgccaaagttattaagaccttgaccgagattaacatcgccttcttgccttacgagtcacaggtgtacagcctggattccgcagacagctttcaatcattttacagcccacataaagctcaaatgaagaaccccatcctggagcggctggctgagcagatcgcgactctatgtgcgacgctcaaggaataccccgccgttcgttaccgaggagaatacaaggacaatgctctactcgcacaactcatacaggataaattggatgcgtacaaagccgacgaccccacaatgggggagggccccgacaaagccagatctcagcttcttatcctcgaccgtggctttgacccatcctccccggtactccatgagcttacattccaagcgatgtcctacgatctgcttcccatcgagaatgatgtttataagtacgagacctctggaattggtgaggcccgcgtgaaggaagtcctgctggacgaagacgacgacctgtggatagccttgagacacaagcatattgcagaggtttcccaggaggtaactagatcattaaaggacttctcatctagcaaacgcatgaacactggcgaaaaaacaacgatgcgtgacttatcacagatgctgaagaagatgccacagtatcaaaaagaattatctaagtatagtacgcacctacaccttgccgaggattgcatgaagcactatcaggggactgtggataagctgtgccgggtggagcaggacctggcaatgggcaccgatgccgagggcgagaaaattaaggatccgatgagggccatcgtccctatactgctcgacgcgaatgtcagtacttacgacaagattagaattatcctgctgtacattttcttgaagaacggaattaccgaggaaaaccttaataaactcatccagcacgcacagatccccccagaagactccgaaattattaccaacatggcccatctgggagtgccaatagttactgactctacgttgagacgtcgatccaaaccggagaggaaagaaaggatcagtgaacaaacataccaacttagtagatggacgcctattatcaaagacattatggaggacactatcgaagataagcttgatacgaaacactatccatacattagcactcgttcttcagccagcttcagcaccaccgctgtgagtgcgcggtacgggcattggcacaaaaacaaggctcccggcgagtatcgcagtggaccacgactgataatcttcattctaggcggcgtgtcactaaatgaaatgcgctgcgcctatgaggttacccaagccaatgggaaatgggaagtcctcataggatccacacacatcctgactccacagaagctcttagatacactgaagaaactgaacaagacagatgaggaaattagttcctag

SEQ ID NO: 207854 - DNA, 1674 bp, Artificial Sequence
  Description of Artificial Sequence: Synthetic coding sequence
atgaccgacatcatgaccgagggcatcaccatcgtggaggacatcaacaagcgtagagagccactcccctcattggaggcagtatacctcataacgccctctgagaaaagtgtgcactcactgatttccgacttcaaggatccgcccacagccaagtatcgggccgcccacgtgttttttactgattcatgccccgacgccctttttaatgagttggtgaagagcagagcggccaaggttatcaaaactttaaccgagatcaatatcgcattcctcccctacgaatcacaagtttatagtctggatagtgctgattccttccagtccttctactctccacacaaagcccagatgaagaaccccattcttgagcggctggcggaacaaattgcaacgctgtgcgctactttgaaggagtatcccgcggtgagatatagaggcgaatacaaggacaatgccctgttggcccagctgatccaagataagttggatgcctacaaagctgatgatccaacaatgggagaagggccagataaggcacggagccagctgttgatactggatagaggctttgacccctcgtctcccgtcctgcatgaacttaccttccaggccatgtcttatgatctcctgccaatcgagaacgacgtctataagtatgaaacttctggcattggggaggcaagggtcaaggaggtgctgttggacgaggatgacgatctctggattgctttacgccacaagcatatcgcagaggtctcccaggaagtcacaaggagcctgaaagatttctcgtccagcaaaagaatgaacaccggggagaaaaccaccatgagagacctctcccaaatgctgaaaaagatgccacagtatcagaaggaactctccaaatatagcacacatctccacttggccgaggattgtatgaagcactatcagggaacagtggacaaattatgcagagttgagcaggacctcgctatggggacggatgcggagggagagaaaataaaggatccgatgagggccattgtgcccatcctcctggacgcgaacgtgtccacttacgacaaaatccgcatcatcctgctttacatatttctgaagaatggcataactgaagagaacctgaataagctcatccaacacgcccaaattccaccagaagacagcgaaattattaccaatatggcccacctgggcgtgccaatcgtgaccgattccaccctcagacgacggtcgaagcccgagcggaaagagcggattagtgaacagacatatcagctttcaaggtggacaccaatcataaaagacatcatggaggacaccatcgaagacaagcttgacacaaagcattacccctacatatccacgcgtagcagtgcctctttttccacaaccgccgtgtccgcacgttacggccattggcacaaaaataaagcccccggggagtataggtctggcccaagactaatcatcttcatcctcggaggtgtgtctctcaacgaaatgcgctgcgcctacgaagtgacgcaggcgaatgggaaatgggaggtgctgattggctctacgcacatattgacccctacgaaattcctaatggatttgcgacatcctgatttcagagaaagttcccgcgtgtcttttgaggaccaggcgccaacaatggagtag

SEQ ID NO: 207855 - DNA, 1308 bp, Artificial Sequence
  Description of Artificial Sequence: Synthetic coding sequence
atggcccccatcggcctgaaggccgtggtgggcgagaagatcatgcacgatgtgataaaaaaggtgaaaaagaagggagaatggaaggtgctggtggttgaccaactgtccatgagaatgctgtcgagttgctgcaagatgacagacatcatgaccgaaggaccggacaaggctcgttcgcagttgcttatcttggatagagggttcgatcccagctcgccagtgttacacgagctgacgtttcaggccatgtcgtatgacctcctgcctattgagaacgatgtctacaagtatgaaacatcagggatcggcgaggcccgtgtcaaggaggtgcttctggatgaagacgacgacttgtggatagccctgcgtcacaagcacattgctgaggtcagccaggaagtcactcgttcactgaaagacttctcgagttcgaaaaggatgaatactggcgaaaagacaaccatgcgtgacctgtcccaaatgctgaagaagatgccacagtaccaaaaggaactcagtaaatattcaactcacctacacctcgccgaagattgtatgaagcactaccagggaaccgtggataaactgtgccgggtggaacaggaccttgctatgggtacagacgctgagggggagaagataaaggatccaatgcgagcaattgtaccaatcctgctggatgccaatgtgtcgacctatgataagatccgcataatacttctctatatttttctcaagaatggcattaccgaggagaacctcaacaagttgattcagcacgcacagattccgccagaggattccgaaattatcaccaacatggctcatcttggcgtgcctatcgtcactgactcaacccttagaagacgctcgaagccagaaagaaaagagcgcatcagtgaacagacctatcagctatcaaggtggaccccgatcatcaaagacatcatggaggacactatcgaggacaaattggatacaaaacactacccttatatttccacccgctccagcgcttcattctcgactacggcagtgtctgcacgatatggtcactggcacaagaacaaagcgcccggggagtaccgcagcggcccaagactgattatattcatcctaggtggagtctcgttgaacgaaatgcgctgcgcctacgaggtgacccaggccaatggaaagtgggaggtccttattggcagcacgcacatcctcacacctactaagttccttatggatctgagacaccctgacttcagagagtcaagcagagtgtccttcgaagaccaggcacctaccatggaatag

SEQ ID NO: 207856 - DNA, 1812 bp, Artificial Sequence
  Description of Artificial Sequence: Synthetic coding sequence
atggcccccatcggcctgaaggccgtggtgggcgagaagatcatgcatgatgtgattaagaaggtcaagaaaaaaggagagtggaaagtcctggtagttgaccagctgtctatgcgaatgctgtcaagttgctgtaagatgacagacatcatgaccgagggcatcacgatcgttgaagatataaacaagcggcgagagcctttgccatcactggaagctgtgtacctaataacgcccagcgagaaaagtgtgcacagtcttatatccgacttcaaagatccccctactgcgaagtaccgcgctgcgcatgtgttttttacagactcctgccctgacgccttgttcaacgagctcgtcaagtccagggcagctaaggttatcaaaacgctcaccgagatcaatatcgccttcctgccctacgaaagccaagtgtactccctggattccgccgactcattccaatcattttattctccacacaaggcgcagatgaagaacccgatcttagagaggctggccgagcagattgctacactgtgcgcaacgctaaaggaatacccagctgtgagataccgcggagaatacaaagacaacgccttgctggctcagctcatccaggataagctggatgcttataaggctgacgatcctacgatgggagaagggcctgataaagcccggagtcaactactgattctcgaccgaggctttgatcctagctctcccgtgttgcacgaactgactttccaggccatgtcatatgaccttttgccaatcgaaaatgatgtctacaaatatgagacctccgggattggggaagctcgtgtaaaggaagtactcctggacgaggatgatgatttgtggatagctctgcgacacaagcacattgctgaagtgtcccaagaagtgactagatcactgaaggacttcagctcatccaagcggatgaatacaggtgaaaagaccaccatgcgggatctgagccagatgctcaaaaaaatgccgcagtaccagaaggagcttagcaagtattccacacatctacacctggccgaagattgcatgaagcactaccagggaacggttgacaaactctgtcgagtagagcaggatctggccatgggtacagacgctgaaggggagaagatcaaagacccaatgcgggcaatcgtccccattctgttagacgcgaacgtgtcaacctacgataagattcggataatcctgctctatatcttcctaaagaatgggatcacggaagagaatttgaacaagcttattcagcatgctcagattcctcctgaggactctgagattattacgaacatggcccacctcggggtccccattgtgaccgattccaccctgagaagaaggagcaagccggaacggaaggagagaatctcagaacaaacataccagctatcccgatggactccaatcatcaaagatattatggaggatacgatcgaagataaacttgacacaaagcattacccttatatcagtactcggtcttctgcgtcgtttagcacaacagcagtctcagctcgctatgggcactggcataaaaacaaggctcctggcgaataccgcagcgggcctcgcttgatcatcttcatccttggtggggtctcccttaatgagatgagatgtgcttacgaagttacccaggcaaacggaaaatgggaggttcttatcggatcaacgcatatcctgaccccaactaaatttctcatggacctgcgacaccccgacttccgggaaagctcaagagtgagtttcgaggaccaagccccaaccatggaatag

SEQ ID NO: 207857 - DNA, 1389 bp, Artificial Sequence
  Description of Artificial Sequence: Synthetic coding sequence
atggcccccaccatccagacccaggcccagcgggaggacggccaccggtccggggtggtatgccgagtcaagtactgcaattctctgcccgatattccattcgaccctaagttcataacttatcccttcgaccagaatcggtttgtgcaatataaggcaactagccttgagaaacagcacaaacatgatctgttgaccgagccagacctgggtgtcacaatcgacctgatcaacccagacacataccggattgatcctaacgtgctgctggatccagcagatgaaaaactgctggaggaggagatccaggccccgacctctagcaagaggtcccaacagcacgccaaggtggtcccatggatgcgcaagactgaatacattagcacggagtttaataggtatgggatttccaatgaaaaaccagaggtgaaaattggcgttagcgttaaacagcaattcaccgaggaggaaatttacaaggaccgggatagtcagatcactgcaatcgagaaaaccttcgaggacgcccaaaaaagcatgtggatcaatccttgcgctcaggtcatcttcgactcagatcccgcccccaaggatacatccggggccgcagcactcgaaatgatgtcacaggctatgattagaggtatgatggatgaggagggtaatcagtttgttgcttatttcctgcctgttgaagagacccttaaaaaaagaaagcgcgatcaggaagaggaaatggactatgccccagacgacgtctatgactacaaaattgcccgtgagtacaactggaatgttaagaacaaggcctccaaggggtacgaagaaaactactttttcattttcagggagggcgacggagtttactataacgaattagaaacacgggtgagactttcaaaacgtagggccaaagctggcgtgcagtcagggacaaacgcactgctggtggttaaacaccgggacatgaacgagaaggagctggaagcccaggaggcacgcaaggcacaattggaaaaccacgaacccgaagaagaggaggaagaagaaatggagactgaagaaaaggaggccggagggtccgtcatgctgatactgcgtaccatgccgaccttaatgatgcgcacggaagacagacccaaggtggctgtgaccatgatccagaccgctgccgccatgggcgtggccagcggcgctggtgcgactgccgcagctcctgtgcctagccccgtggccgcatcgacacggccccggagaatggccgtcaaactgcagcttctaatccctgtgaagcttatcgtgacggtcaccgaatcgcaaggaatacagggatggtttaggcatcattactgcgaacagcagtctactttcctggtcgtgtgtctgtag

SEQ ID NO: 207858 - DNA, 1197 bp, Artificial Sequence
  Description of Artificial Sequence: Synthetic coding sequence
atgtgcatccgggtgcacgtgagcatgtgcatgtgcatgtgcgtgcatgtgtgtgtgcatctctgcatgcacgtgtgcgccgtgtgcatgtgcgtttacgtttgcgtgtgtgtgcatgtgcacgtttgtgcgagcgtctgcgctttcgtgtgcatgtgcgtgtgcgtgtgcgtgtgtgggagcgtgtgcgcctttgtttccgtgcacgtgtgcatgcgggtgtacgtctgcgtgtgcatctgtgtccatttgtacgtctgtgtctgcgtgtgtctatgcgcctgcgtttatgcatgtgtctgcatgtgcctgcgactatgcgtcaggttgtgcgtgagcgtttgcgcatgcgtgtatgcttgcatctgtatgtgtatatgcgtgcacgtttccatgtatgtgtgtgcttcagtgtgcgcatgcgtctgcgtctgcgtctgcgtgtgtgtgtgcatgcgtgtttgtgcccaccaatgcctccacgtatgcatttgtgtttatgtgtgcgcacgaatctgtgtgtgtgcttgtgtgtatgtgtgcgtctgtatctctgtgtgcgcttgcgtgtatgtctgcgtccacctgtgcgtgtgtgcatgtgtacatgcctgtgtctgcgtgtgtgcttgtgtgcatctgtgtgtgtgcgcctgcgcacatgtgggagccaccctggtttgcatatgtacatatacatgccctagacctagcatgtttgcccacggcggcaggtggggggtggcgggaaggcctcggcagcccatgagtcttggggtgcaggcgcaggctcagagagtgattcacttgccccagtccgtgcaggcactgattaaggatttccagggcactcccaccttcacctataaagccgcacatattttctttactgacacatgtcccgaaccacttttttcggagctaggccggtcacggctggcgaaagtggtgaagaccctcaaagaaatacacttagcctttctaccgtacgaagcccaggtgcgcccggggttaattctggggagaggatggggcttcgtgaccaagtgccccctgtttcctcagaaacagactctgagactgggtgcagtcgcccatacatgcaacccgtctgctgttgggggtcagggacgcagaataacctggggtcaggaattcgaaacatcattgggtaccgagcaggacccagtgtcatag

SEQ ID NO: 207859 - DNA, 1773 bp, Artificial Sequence
  Description of Artificial Sequence: Synthetic coding sequence
atggcccccagcggcctgaaggccgtggtgggcgagaagatcctgtctggggtcatccgttcagtcaaaaaggatggggaatggaaggtgctgattatggatcacccatccatgaggatcctgtcctcttgctgtaagatgtccgatattcttgctgaagggattacaatagtggaagatatcaataagcgacgtgagccaatcccttctctggaagctatatatcttctgtccccgaccgagaaagccctgatcaaagacttccagggaactcccaccttcacgtacaaggccgcccacattttctttacagatacctgtccggagccactgtttagcgagctcggccggagtaggttagccaaagtcgtgaagacactgaaggagattcacctcgctttcctgccctatgaggcccaagtgtttagcctcgatgcgcctcattccacctataacctctactgtccgttccgcgctgaggagcggactcgacaactcgaagtgttggcccaacagatcgcaactctctgtgccactctccaagagtatcccgctatccggtatagaaaaggtcccgaagacactgcacagctggcccacgctgtgctggccaagcttaacgcattcaaagcagacactcctagcctgggcgaaggcccagagaaaacgaggagtcaacttctgattatggaccgagctgcagacccagtgagtcccttgctccatgagttaaccttccaggccatggcatacgacctgttagatatagagcaggacacctatcgatacgagacaactggcttaagcgaagcgagggagaaagctgtattgctggacgaagatgatgatctatgggtagagctgcgccacatgcatatcgcagatgtatccaagaaggttaccgaactgctgagaacgttctgcgaaagcaagaggcttactacagataaggcgaacattaaggatcttagccagatcctgaagaaaatgccacagtatcagaaggaactgaacaagtattccacacatctgcacttggccgacgactgcatgaagcactttaagggttccgtcgagaaactgtgctcagtcgaacaggatctcgccatggggtccgatgctgagggggagaagattaaggattcaatgaaactgatagttccagtactgctggatgcggctgtgcctgcttatgacaagattcgtgtgttgctgttgtacatcctgctgcgaaacggcgtttccgaggagaatctggccaagctgatccagcacgctaacgtgcaggcccactcttctctgatccgcaaccttgagcagctcggaggcaccgtgaccaacccaggcgggagcggaacgagctccagactcgaaccccgggaaaggatggagccaacgtaccagttgtcaaggtggactcctgtgatcaaggatgtgatggaagacgcagttgaagaccgtcttgaccgcaatctgtggccctttgtgtcagatcctgccccgaccgcctcctcacaggctgctgtgtccgccaggttcggccattggcacaagaacaaggcgggtatcgaggctcgggcggggccaagattaatcgtatacgtgatggggggagtggccatgagcgagatgcgggcggcctacgaagtaactcgcgctacggaggggaaatgggaagtgctgatcggaagtagtcacatcctgactcctacacgcttcctagacgacctgaaggctctggataaaaaactggaagacatcgctctcccgtag

SEQ ID NO: 207860 - DNA, 1815 bp, Artificial Sequence
  Description of Artificial Sequence: Synthetic coding sequence
atggcccccagcggcctgaaggccgtggtgggcgagaagatcctgtcgggcgtgatccgttctgtaaagaaggacggggaatggaaggtcctcataatggaccaccccagcatgcggatactgtccagctgttgtaagatgagcgatatcctggcagaaggaattacaatcgtcgaggatatcaacaagaggcgggaaccaatccctagtctcgaggccatctacctgctatcacccaccgaaaaggcccaggcgcagcgcgtaattcatctgcctcagagcgtgcaggccctcatcaaggatttccaaggtacaccaacctttacctataaagcagctcacatcttcttcaccgatacatgtccggagccgctcttctctgagttgggcaggagtcgacttgctaaagtcgtgaaaactttaaaagaaatccatctcgcctttctgccctatgaggctcaagtatttagtctggacgccccacactccacgtacaacctgtattgtcctttccgcgcagaggaacgaacccgacagctggaggtcctggcccagcaaatcgccacattatgcgcaacgcttcaggagtaccccgccatccggtatcggaagggacccgaggacaccgctcagctcgcgcacgcagtgcttgccaaacttaacgcttttaaggccgatacaccgagtctgggcgagggccctgagaagacccgcagccaacttctcatcatggaccgagccgcggatccagtgtcccctctgctccacgaactcactttccaggccatggcatatgacctgttggacatcgagcaggacacttatcgctacgaaacgacagggttatccgaagcgcgtgagaaggctgtactgcttgacgaggatgacgacctatgggttgagctgcggcatatgcatatcgcggatgtatcaaagaaagtgacagagttgcttaggaccttctgcgaatccaagaggctgacaaccgataaggctaatatcaaagacctgtctcaaattcttaagaaaatgcctcaataccaaaaggagctgaataagtactccacacatctgcatcttgcagacgactgcatgaaacactttaaaggatccgtggaaaagctctgctccgtggagcaggatctggctatgggttcagatgccgagggggaaaagattaaggacagcatgaagctaattgtgcccgttctcctggatgctgcggtgcccgcctacgataaaatcagagtcctgctgctctacatcctgctacggaacggcgttagtgaagaaaacctcgctaagctcatccagcacgctaatgtgcaagctcacagcagtctaatccgcaacctggagcagttgggtggaactgtgacgaatcccggcggatctggtacgtccagcagactcgagcctagagaacgtatggaacccacctaccagctgtcccgttggactccggtcataaaagatgttatggaggacgccgttgaagacagactggaccgcaatttatggcccttcgtcagcgacccagccccaaccgccagctcacaggccgcagtgagcgccagatttggacactggcataagaataaggctgggattgaagcgcgggcggggccacgtctaatagtatacgttatgggaggggtggccatgtccgagatgagagcagcgtacgaggtgaccagagctaccgagggcaagtgggaagtcctcattggttcctctcacatactaacacctactagattcctggatgacctgaaggccctcgacaaaaagttagaggacatcgcactgccatag

SEQ ID NO: 207861 - DNA, 1740 bp, Artificial Sequence
  Description of Artificial Sequence: Synthetic coding sequence
atggcccccagcggcctgaaggccgtggtgggcgagaagatcctgtcgggggtgatacggagcgtgaaaaaagacggtgaatggaaggtactgatcatggatcaccctagcatgaggattctgagctcctgttgtaaaatgtccgacattctggctgaaggcatcaccatagtggaggatattaacaaacgtcgcgaacctatacctagcctcgaggccatatatctgctatctcccactgaaaagagtgtccaggccctgatcaaggactttcaagggacccccaccttcacgtataaggcggcgcatatctttttcactgatacttgtcccgaaccattattctctgaactagggcggtccagactcgctaaggtagttaaaactctgaaggaaattcatctggccttcttgccatacgaagcccaagtcttctccctggatgcgccccactctacttacaacctgtactgtccatttcgcgccgaagagcgtactcgacaattggaggtccttgctcagcagatcgcgactctttgtgcaaccttgcaagagtatcctgccatcaggtaccggaaaggccccgaggacacagctcagctggcgcatgcagtgcttgctaaacttaacgccttcaaggcagacactccatctttgggtgaaggccccgaaaagacccgaagtcaactactcataatggaccgcgcggccgatccagtaagtcccctgcttcacgaacttacattccaggccatggcatatgacctactggatatcgagcaggatacttacagatatgaaacaacaggactgtctgaagcgcgcgagaaagctgtgctactggacgaagacgatgacctgtgggtagagttgaggcacatgcatatcgccgacgtgtcaaaaaaagtaaccgaactgctccggaccttttgtgaaagcaaacggctcaccaccgacaaggcaaacatcaaggacctttcccagatcctgaagaagatgccgcagtaccaaaaggagctgaataagtactctactcacctgcatttagctgacgattgtatgaagcactttaaaggtagtgtagaaaagctctgtagtgtcgaacaggacttggccatgggttccgatgcagagggtgaaaagatcaaggattctatgaaactcatcgtacccgtgttgttggacgccgcagttcccgcatacgacaaaatcagggttctcttgttgtacatactccttagaaatggcgtatctgaggaaaacctcgcaaaacttattcagcacgctaacgtgcaggcccactcatctcttatccggaacctcgaacaactggggggaacagtgaccaatccgggggggagtggtacatccagccgactggagccaagggagcgtatggagcccacctatcagctttcaagatggaccccggtgataaaggacgttatggaggatgcagttgaagataggctagatcgcaacctatggcctttcgtaagtgatccggcgcccacagcttctagccaagccgccgtgagtgccagatttgggcactggcacaaaaacaaagctgggattgaggctagagcagggccccgattaatcgtctacgtcatgggcggcgtcgccatgtctgaaatgagggccgcatacgaggtgacaagggcaacggagggctccggacgatgttctctggcacctcacacaagttctcctaggcctgcctcgtggatgacgtag

SEQ ID NO: 207862 - DNA, 2421 bp, Artificial Sequence
  Description of Artificial Sequence: Synthetic coding sequence
atgcacggcaagagcaccgccgtgctggagatggactacagcatcgtcgactttctgacattatgcgagaccccatacccaaacgattttcaagaaccgtatgctgtagttgttctgcttgagaaagatctagtgctcatcgaccttgcacagaatggataccccatatttgagaacccttacccgctgtcaatccacgaatccccagttacctgctgcgagtattttgcagactgtccagtggacttaatccccgcactatatagcgtgggagcccggcagaaacggcaagggtacagcaagaaggaatggccaatcaatggtggcaactggggtttgggcgctcagagttatcctgaaattattatcaccgggcacgcagacggaagcgtaaagttctgggatgctagcgctattactctgcaggtgctgtacaaactcaagaccagtaaagttttcgagaagagcagaaataaggacgatcgccccaacactgacattgttgatgaagacccttacgctattcagatcataagctggtgcccagagagccgcatgctgtgtatcgccggggtttctgcccacgttataatttatcgtttcagcaaacaggaggtgattacagaggttatccctatgcttgaagtacgactcctgtacgagattaatgacgtggaaacccctgaaggggagcagccccccccactgcccaccccggtgggcggctccaacccgcaacccatccctccccagtctcacccatcgactagtagctcaagctctgatggtctgcgcgataatgtcccctgtttaaaggttaaaaactccccattgaagcaaagcccaggataccaaacagagttagtgatacagctagtctgggtcggcggagagccaccacaacagattacatccctggctgtgaactcctcttacggtttggttgtgttcggcaactgtaacggcattgctatggtcgattacctccaaaaagcagtgcttctcaacctggggacgatcgaactctacggttctaacgacccataccgacgggagccccgctccccgcggaagagtcggcagccctctggagccggtctctgtgacatatctgagggaacagtcgtgccagaggacagatgtaagtcaccgacctcagggtcatcctcccctcacaattctgacgacgaacagaagatgaacaatttcattgagaaagcaaagatgtcccgcaagctgagtctgcctactgaccttaagccagatctggacgtgaaggacaattcttttagcagaagtaggtcgtccagcgtgacctccattgataaggagtcaagagaagctatttccgccctacatttttgtgaaacatttacccgtaagactgactcgagcccttcaccgtgcctttgggtgggaaccacgctcgggaccgtcctagtgattgcgctcaatctccctcctggaggcgaacaacggttgctacagccggttattgtgtctccctccggcacaatattgaggctgaagggtgcaattcttcgcatggcgttcctcgataccactgggtgtcttatacccccggcgtacgaaccttggcgagaacataacgtccccgaggagaaggatgagaaggaaaagctgaagaaacgccggcccgtgtcagtgtcgccttctagcagtcaggagatctctgaaaatcagtacgctgtgatatgctcggagaaacaggccaaggtgatcagtctgcccacccagaattgcgcatacaagcagaacataaccgagacttcctttgtccttcgaggagacatcgtcgccttatccaactccatttgtctggcctgtttttgcgccaacgggcacatcatgaccttttcccttccctccctgcggcccctgctcgatgtctactaccttcctcttaccaacatgcggattgctaggaccttttgctttaccaataacggccaggctctgtacctggtttccccaacagagatccagcgactgacctattcccaggaaacttgcgagaatctgcaggaaatgctgggagaactgtttacacccgtggaaacaccagaagcacccaacaggggcttctttaaaggtctcttcgggggaggcgctcagtctcttgaccgcgaagagttgttcggggagtcgagttctggaaaagcgtctcgctcgctcgcccaacatatacccggccccggtggcatcgagggcgtgaagggcgccgcaagcggcgtggtgggggagctggcccgcgctcgccttgcactcgatgagcggggccagaagctaggagatttagaggaacgcacagccgccatgctgtcgtcagcagaaagtttctctaagcacgcacacgaaataatgctgaagtataaggacaagaaatggtaccagttttag

SEQ ID NO: 207863 - DNA, 3456 bp, Artificial Sequence
  Description of Artificial Sequence: Synthetic coding sequence
atgcggaagttcaacatccggaaggtgctggacggcctgaccgccggatccagttctgcgtcccagcagcaacagcagcagcatcctcccggaaatcgcgagcccgaaatacaagaaacattgcagtccgaacatttccagctgtgcaaaacagtccgccatggattcccatatcagccctccgctttggcctttgaccccgtccagaaaatccttgctgttggaacgcagacaggagccttaagactgttcggcagaccaggggtggagtgctattgccaacacgattcaggagcagctgtgattcaactgcaattcctgattaatgaaggagccttagtcagcgcactggcggatgatactctacacctctggaacctccggcaaaaaagacccgccattcttcattccctgaagttttgtagggaaagggtgaccttctgccaccttccatttcaatctaaatggctgtacgtggggacagagcgcggaaacattcatattgtaaacgtggaatcattcaccttaagcggctacgtgattatgtggaacaaggccattgaactcagctctaaatctcacccgggccctgttgtgcatatatctgataacccaatggatgagggaaagctgctcattggctttgagtctgggactgtggttttatgggacctgaaatccaagaaagcggactaccggtacacgtacgacgaggctattcattcagtggcgtggcaccacgaaggaaagcagtttatttgtagccactctgacggaacactgacaatttggaatgtacggtccccagcaaaaccggtccagaccataacaccccacggcaagcaactaaaggacggaaaaaaacctgaaccatgtaaaccaatcctgaaagtggaatttaaaaccacaagatctggcgagccctttataatcctgtcgggcgggctgagctacgacactgtcggcaggagaccctgcctaacggtgatgcacgggaagtcaacagccgtgctcgagatggactactctattgtggactttctgacattgtgcgagacgccatatccgaatgacttccaggaaccctatgcggtggttgtgctgctagagaaggatctggttctcattgatctggctcagaatggatatccaatattcgaaaatccctatccattgagcatccacgagtctccagtaacctgctgtgagtacttcgccgattgtccggtggatctgatccccgccctgtactctgtaggagcccgccagaagcgacaggggtacagtaagaaagagtggcctattaacggtggaaattggggtttgggcgcacagtcctatccggagattatcatcaccggccatgccgatggttcggtgaagttctgggacgcgtccgcaattacgttgcaggtgttatataagctgaagacatctaaggtgttcgaaaagtctagaaataaggatgatcggcctaacactgacattgtggatgaggatccatacgccatccagattatctcttggtgcccggagagcaggatgctctgcatcgcaggcgtaagtgcgcatgtcattatttacagattttctaaacaggaagtgattacagaggtgatccccatgttggaagtgcgcctcctgtacgagattaacgacgtggagactcccgagggagagcagccacctcccctccctacaccggtcgggggatctaacccacagcccattcccccccaaagccacccaagcactagtagtagcagcagtgatggactgcgggataacgtgccatgtttaaaggtgaaaaattccccactcaaacaatcaccgggatatcaaacagagctcgttatacagctggtttgggtggggggtgaaccccctcagcagatcaccagccttgctgtcaatagttcctatggactggttgtcttcggcaattgtaacggaattgccatggtggattacctacagaaggcggtcctcttgaatctcggaacgattgagctgtacgggtctaatgacccataccgaagggagcccagaagtcctaggaaaagcaggcaacccagtggggcgggtctgtgtgatatatcagaagggacagtcgtaccagaggataggtgtaaatctccgacatccggaagcagttcaccacacaactctgacgacgaacagaaaatgaacaacttcatcgagaaggtgaaaaccaagagtaggaagttctccaaaatggtggccaacgacatagcaaagatgagtcgcaaactttcattgcccacagacctgaaacctgatcttgatgtaaaggataatagcttttcgagaagccgctctagcagcgtgacctccattgataaggagtcccgggaggctatctcagctctgcatttttgtgaaactttcactcgcaaaacagattcgagcccctccccgtgcctgtgggttggaaccacccttggcactgtactggtgattgcgttaaatctgcccccaggcggcgagcagcgattgctccagcccgtaattgtgtcgccaagcggcacaattctgcggctaaagggggcaatcctgagaatggcattcttagacaccacgggatgcctaattcccccggcctacgaaccttggcgcgaacacaacgtgccggaagagaaggatgagaaagagaagctgaagaaacgacggcccgtgtcagtgagcccatcctcaagccaggagattagcgaaaaccaatacgccgtgatttgttcagaaaaacaggcaaaggttatatccctccctacacagaattgcgcatataagcagaatatcacggagacatcatttgtgctcaggggcgatatcgtcgctctttctaacagtatctgtctggcatgtttctgcgcgaatggccatattatgaccttctccctgccttccttgcgaccattgttggatgtttactacctcccgcttacgaacatgaggattgcccggactttctgttttacaaacaacggccaggccctgtacctggtgtcaccaactgagattcagagactgacttattcccaagagacatgcgaaaatcttcaggaaatgctcggagaactctttactccggtcgaaacccccgaagccccaaatagagggttctttaaagggttgttcggtggcggcgcgcagtctctagatagggaagaactgttcggcgaatcctcatctgggaaagcgagccgttccttagctcagcacatccccggtccaggtggcatagaaggagttaaaggggccgctagcggagtggtcggagaattggctcgggcaaggttagctctggatgagcggggtcagaagctgggtgatctcgaagaacgaactgcagccatgctctcctctgcagagtccttttcaaagcacgctcacgagatcatgctcaagtacaaagataaaaagtggtatcagttctag

SEQ ID NO: 207864 - DNA, 525 bp, Artificial Sequence
  Description of Artificial Sequence: Synthetic coding sequence
tgaaaggccgtgctgctgaacctgggcaccatcgagctgtacggctccaatgatccctaccggcgcgagcccagaagcccccgaaagtcccgtcagccatccggagcgggattatgcgacatttcagaagggacagttgtgccagaagatcggtgcaagtctccaaccagcggcagttcctcaccccataactctgacgacgaacagaaaatgaacaacttcattgaaaaggccaaaatgagcaggaagttatccctgccaacggatctcaagccagatcttgatgttaaggataacagtttttctaggtcacgtagcagtagtgtgacctctattgataaagagtctagggaggctatctccgcgctccacttttgcgaaacttttactaggaagactgactcgtcaccctcgccttgcctgtgggtaggaaccacactcggtacagtgttggtgatagctctaaacctccccccgggtggcgaacaaaggttgctccaaccggtgatcgtgtctcccagttag

SEQ ID NO: 207865 - DNA, 840 bp, Artificial Sequence
  Description of Artificial Sequence: Synthetic coding sequence
atggtggactacctgcagaaggccgtgctgctgaacctgggcaccattgagctttatggaagtaacgatccataccggagagagccccggtcacctaggaagtcccgacagcctagtggcggagtcttgatcgttacatcttgtatgtgcggactcagcagtctgtacagtgagagcatgaagaagttgcgttctagctttctgacgggtttatgtgatatttcagagggaaccgtagtccccgaggaccgctgcaagtctcctacctctgcgaaaatgtcacggaagttgtcgctaccaacagatctcaagcctgatttagatgtaaaggataacagtttcagccgtagccgaagctccagcgtgacatcaattgacaaggagtcgcgcgaagccattagcgcgcttcacttctgtgagaccttcaccaggaagaccgatagctccccatccccatgtttgtgggttggcactactctgggaactgtgctggttatcgctcttaacctgcctccgggcggagagcagagactgttacagccagtgatcgtcagcccatctggaacaattctccgcctcaagggggcgattcttagaatggcctttttggacaccacaggatgtttgatcccaccagcctacgagccgtggagagagcacaacgtgcctgaggagaaggacgagaaggagaaactgaagaagcgacggccagtgagtgtgtcgcctagctcaagccaggagatctctgaaaatcagtatgcggtgatatgctccgagaagcaggcaaaagttatctctttacctacacagaattgtgcctataaacagaacatcacttag

SEQ ID NO: 207866 - DNA, 3297 bp, Artificial Sequence
  Description of Artificial Sequence: Synthetic coding sequence
atgcggaagttcaacatccggaaggtgctggacggcctgaccgccggctcttcttccgcctcccagcagcaacagcaacagcacccaccagggaatcgcgaaccagagatccaggaaacattgcagtctgaacatttccagctgtgtaagaccgttcggcatggcttcccgtaccagccttcagcccttgccttcgaccctgtgcagaagatcctggcagtcggcacacaaaccggggctctacgtctctttggccggccaggtgtggagtgctactgtcagcatgactcaggagctgccgttatccagctgcagtttctgatcaacgagggagcccttgtgtcggctctggccgacgacaccctgcacctgtggaacttgaggcagaagcggcctgccattctgcactcactcaagttttgtagagagcgggtgacgttctgccacctcccctttcagtcaaagtggctgtacgtgggcactgagaggggtaacatccacatcgtgaacgtggagtcctttaccctgtctggctatgtgataatgtggaataaggcgatcgagctatctagtaagtctcacccaggcccggttgtgcatattagtgataacccgatggacgaagggaaactgttgattggtttcgaatccggaacagtcgtgttgtgggatctgaaatccaaaaaagctgattaccgatacacttatgatgaggcaattcactccgtggcctggcatcatgaggggaagcaattcatctgctcacattctgatggaacactgacgatatggaacgtccgatccccagccaagcccgtgcaaaccatcacaccacatggcaaacagctgaaagacggaaagaaacccgaaccttgcaagcctattctcaaggtcgagtttaagactacccgtagcggagaaccattcattatcctcagcggtgggttatcatacgacaccgtgggccgacgcccttgtctgacagtgatgcacggcaaatcgaccgccgtactggagatggattacagcatcgtcgactttttgaccctgtgtgaaaccccatatccaaacgattttcaagagccatatgctgtcgtggtgcttctggagaaggaccttgttctgatcgacctcgcgcagaatggataccctatcttcgagaacccctaccctctgtcaatccatgaatccccggtgacatgttgcgaatacttcgccgactgcccggtggatctgattcctgcactttattcggtcggagcacgccagaaaagacagggctactctaaaaaagaatggcccattaacggcggcaattggggcttaggggcccagtcatatcctgagataataattacaggccatgctgatggatccgtgaaattttgggatgcatctgccatcacactacaggtcctgtacaagctcaaaaccagtaaggtattcgaaaaatcacggaataaggacgatagaccaaatactgacattgtggacgaggatccatacgcaatccagatcatttcctggtgcccagagagccgcatgctatgcattgccggagtgtctgcgcacgtgatcatctacagatttagcaagcaggaggtcatcacggaggttattcctatgctagaagtgaggcttctatacgagatcaacgacgtagaaacacccgaaggcgaacagccacccccactgcccacccccgttggcggctccaaccctcaaccgattccaccgcagtcccacccgtccacctcatcaagctcctccgacggacttagggacaacgtcccttgtctgaaagtgaaaaactcacctctgaaacagtccccggggtatcagactgagctcgtcatccagctagtatgggtgggaggtgagcccccccagcaaatcacatccctagcagtcaacagctcatacggcctcgtggtattcggcaattgcaacggcatcgctatggtggactatctacaaaaagctgttctgctcaacctgggcacgatagagctgtatgggagtaatgatccttacaggcgagagccacgtagtcctagaaagagcaggcagccttccggcgcgggcctctgtgacatttccgagggaacagtagtacccgaagacagatgtaaaagccccaccagcgatgtcaaagataacagctttagcagaagccgcagctcaagcgtaacttccattgacaaagagtccagagaggctatctctgccctgcatttttgcgaaacatttaccaggaagaccgattcctctccctcaccctgtctttgggtcggaaccaccctagggaccgtgctggtgatagctctcaatctgccccccgggggagaacaaagactccttcagccggtgatcgtgtccccctccgggacgattttacgactgaaaggggccatccttcgcatggctttcctcgacacgaccgggtgtttgatccctccagcttacgagccctggcgtgaacataatgtcccagaggaaaaagatgagaaagagaagctcaagaagcgccggccagtgagtgtttctcccagctccagccaagaaataagtgagaatcagtacgctgtgatttgtagtgagaaacaggccaaggtaatctcccttcctacccagaattgtgcgtacaagcagaacatcaccgaaacatctttcgtccttcgcggggacatagtcgcactttctaatagcatctgtctggcctgcttctgcgccaatggccatattatgactttctcactgcccagtttgcgtcctctgcttgacgtgtactacctcccgctgacaaacatgcgaattgcacgcacattctgttttacaaacaacggacaggctctctatctggtcagtccaactgaaattcagcggctgacgtattcccaggaaacttgcgaaaacttgcaggagatgctgggggagctgtttacacccgttgagacccctgaagcaccaaaccgcggctttttcaagggactgttcggtggtggtgcgcagtccctcgatagggaggaattatttggtgagtcatcgagcggcaaagcaagcagatccctagcccaacacatccctggccctggcggtatcgagggggtcaaaggagcggcaagcggcgtggtgggggagctggctcgcgctagattggcacttgacgaacggggacaaaagttgggagatctggaagagcgcacagcagctatgctgtcctccgccgagtcttttagtaagcacgcccacgagataatgcttaaatacaaggataagaaatggtaccagttctag

SEQ ID NO: 207867 - DNA, 3348 bp, Artificial Sequence
  Description of Artificial Sequence: Synthetic coding sequence
atgcggaagttcaacatccggaaggtgctggacggcctgaccgccggctcgtcatctgccagccagcaacagcaacaacagcacccccccggaaacagggaaccagaaattcaagaaaccttgcagagcgagcatttccagctgtgtaagacggtcaggcacggattcccataccagcctagcgccttggctttcgatcccgtacagaaaattctagcagtgggaactcagaccggcgctttaaggctctttggcagaccaggcgtagaatgctattgtcagcacgatagtggggccgccgttatccagctccagtttctcatcaacgagggggcactagttagtgcactggcggatgacactctgcacctgtggaacctgaggcagaagaggcccgccattctgcacagcttaaaattttgccgcgagcgggtcactttctgtcacctcccttttcagtccaagtggttatatgtcgggaccgagcgggggaacatacatatcgttaacgtcgagagttttacactgagcggttacgtaataatgtggaataaggctatagagctaagcagtaagtcacaccccggtccggtagtccacattagcgacaatcccatggatgaaggaaagctgttgatcggtttcgaatccggaactgttgtcttatgggatcttaaatcgaagaaagctgactatagatacacatatgatgaggctatccactcagtggcgtggcaccacgaagggaagcagttcatttgttcacactccgatggaactctcacaatctggaacgtgcggagccccgcgaagcctgtccaaacaatcacaccacacggtaaacaactaaaagacggtaagaagccagagccctgcaagccaattcttaaggtcgaatttaagactaccaggtctggcgaaccatttattatcctgtccggcggcctttcctacgacaccgtgggccggcgcccttgcctcacggtgatgcacggtaaaagcacagcagtgctcgaaatggattatagcattgtggacttcctgactctgtgcgagacaccctaccccaacgacttccaagagccttatgccgtggtggtgctgcttgagaaagacctagtcctcattgacctggcgcagaatggctatcccatctttgaaaacccctacccattaagtatccatgaatctcctgtcacttgctgcgaatactttgctgattgtccagtggatttaattccagccctttacagcgtcggcgccaggcagaagcgacagggttactctaagaaggagtggccgataaatggagggaactggggcctgggggcccagagttaccctgaaatcataattacgggccatgccgacgggtccgtcaagttctgggacgcaagcgcaatcactctccaagtcctctacaaacttaagacttccaaagtttttgaaaaatcgcgcaacaaggacgatagacctaacactgacatcgtcgatgaagacccgtacgccattcagatcatctcctggtgtcccgaatcgcgaatgctgtgcatcgcgggcgtgtccgcccatgtgattatatacaggttctccaaacaagaggtgatcacggaggttatacccatgcttgaggtcaggctgctatacgagatcaacgacgttgaaacaccagaaggtgagcagcctcccccactgcccacccccgtcggcggctcgaatcctcagccgatccccccacagtctcacccgtcaacttcctcctcttcctccgacggcttgcgagacaatgtcccttgcctgaaggtgaagaattcccctttgaaacaaagtcctggctaccaaacggagctcgtgatacaactagtctgggttggaggagagcctccacagcagatcacttcgctagcagtcaactcgtcttatggactcgttgttttcggcaactgcaatggcatcgcaatggtggactatcttcaaaaagctgttctccttaaccttggcaccattgaactctatggatccaatgatccttataggagagaaccaaggagccctagaaaatcgcgacaacctagcggagcaggactgtgtgacatctccgaaggcaccgtggtgcctgaagatagatgcaagtcacctacatcagcaaaaatgagtaggaagctatcgctgcccaccgacctcaagcccgacctggatgtgaaagacaactcatttagcaggtccaggtcttctagcgtgacttctatcgacaaggaatctagggaggccataagtgccctccacttctgcgaaacattcacccgaaagacagactcttcaccctccccttgcctctgggtcggaacgactctcgggaccgtgcttgtcatcgcactcaacttacccccaggcggggagcagcgcctgctgcaacctgtcattgtgtcaccatcagggaccatattgcgcctgaagggcgccattttaaggatggcttttctcgacacaaccgggtgcctgattccccccgcctatgaaccatggcgtgaacacaatgtacccgaggagaaagatgagaaggagaaattaaagaaaagaaggcctgtctccgtttctccctccagttcgcaagaaatttccgagaaccagtacgccgtgatatgttcagagaagcaggccaaggtgatttctctgccaacgcagaactgtgcctataagcagaacatcacagagacatcttttgtccttaggggggacattgtagccctgtctaatagcatctgtctggcatgcttttgtgctaatggtcatataatgacattctcgctgccttctcttcgacctctcctggacgtgtattatctccccttgacaaacatgcgcatcgcccgtactttctgcttcaccaacaacggccaggcactgtatcttgtttctcctacagagattcagaggcttacctacagccaggagacctgcgagaacttgcaggagatgttgggcgagctgttcacacctgtagaaacccccgaggccccaaaccgggggtttttcaaaggcctgtttggtggcggggcgcagtcgcttgatagggaggagttgttcggcgaatcgagctcgggtaaagcctctcggtccctggcacaacacataccgggacctggaggtatcgagggagtgaaaggggccgcctcaggtgttgtgggcgagcttgcaagagccagattagcgctcgatgagaggggacaaaagttgggcgatcttgaagaaagaactgctgcaatgctgagttcagctgaatctttctccaaacacgcacacgaaataatgttaaaatacaaggacaagaagtggtaccagttttag

SEQ ID NO: 207868 - DNA, 795 bp, Artificial Sequence
  Description of Artificial Sequence: Synthetic coding sequence
atcgagctgtacggcagcaacgacccctaccggcgggagccccggtcgccacggaaatctcgacagccctccggaggagtgctgattgtgactagttgtatgtgtgggctgtcctctctctatagcgaatccatgaaaaagctccgtagtagcttcctgacaggcctttgcgatatttctgaagggaccgtagtccctgaggatcgttgtaagtcaccaacctctgccaaaatgtcgcgaaagttgtctcttcccacagatctgaagcccgatttggatgtaaaggataactcctttagccgaagtcgaagctcctctgtgactagtatcgataaggaatctcgtgaggcgatctccgccttgcacttttgcgaaacatttacacgcaagactgatagttccccatccccttgcctctgggtagggactacactcgggactgttctagttattgccctgaatttaccacccggtggcgagcagaggctgctgcagccagttatcgtgtccccctcaggcacaatattaagacttaaaggggcaatcttgaggatggcatttcttgataccaccggctgtcttatcccacctgcgtacgagccatggcgtgagcacaatgtgcctgaggagaaggacgaaaaagaaaagctgaaaaaaagaagacccgtctctgtatccccttcatcatctcaagagatctcagaaaatcagtacgctgtgatctgctccgagaaacaggctaaggtgatcagcttgcctacccagaattgtgcctacaagcagaacatcacctag

SEQ ID NO: 207869 - DNA, 927 bp, Artificial Sequence
  Description of Artificial Sequence: Synthetic coding sequence
atgcggaagttcaacatccggaaggtgctggacggcctgaccgccgggagctcttccgcatcacagcaacagcagcagcagcacccacccggtaacagggaacccgaaatccaggagacactccagtccgagcattttcaattgtgcaagacagtcaggcatggctttccataccagcccagcgccctcgccttcgacccagttcagaagatcctcgccgtggggacccagaccggagcgctgcggctgttcgggcgacctggagtggagtgctactgccagcatgattcaggagccgccgtgattcaattacagttcctgatcaacgaaggggcgttagtatccgcattggctgacgataccctgcacctgtggaatttacggcagaaaagacccgccatactacactctctgaagttctgccgagagagagttacgttctgccacctgccattccagtccaagtggctgtatgttgggacagaacgcggaaatatccacatcgtgaatgtggaatctttcactctgtctggctatgttatcatgtggaataaagccattgagctatcatctaagtcccaccctggccctgtggtacatatatccgataatccgatggacgaaggaaagctactgatcggctttgaatcagggacagtcgtgctttgggaccttaagtctaaaaaagcagattacagatatacttatgacgaagccatacattccgtagcctggcatcatgaagggaaacaatttatttgcagtcactccgacggaacgctaactatttggaatgtgcgcagccctgcgaagcccgtccaaacaatcactcctcacggcaagcagttgaaggacgggaagaaacccgagccctgtaaaccgatcctgaaggtggagttcaaaaccacacgctccggcgtttgttag

SEQ ID NO: 207870 - DNA, 3561 bp, Artificial Sequence
  Description of Artificial Sequence: Synthetic coding sequence
atgaagaagttcaacttccggaaggtgctggacggcctgaccgcctcctcgcccggaagcggttcgagttccggttccaactctggaggaggcgccggttctggcagcgtgcacccagctggcaccgcgggagtgctgcgcgaggagattcaggaaacactgacttccgaatacttccagatctgtaagactgtgaggcatggattcccacatcagcccaccgcccttgccttcgacccagtccagaagattttggctataggcactcgaaccggcgccattcgaattcttggccgccctggcgttgactgctactgccaacacgagagtggggctgccgtgctgcagctgcagttccttatcaacgagggcgccttggtttccgccagctccgacgacactctgcacttgtggaacttacgacagaagagaccagccatcctgcactctcttaagttcaatagggagcggatcacatactgtcatctcccatttcaaagtaagtggctgtacgtcgggacagagcgcgggaacacacacatagtgaatattgagtctttcattctgagcggctacgtaatcatgtggaacaaggctatagagctctcaaccaagacccatcctggtcccgttgtccacttgtcagacagcccacgggacgaaggtaagcttctgatcgggtatgaaaacggcacagtcgtcttctgggacttgaagtccaagcgggcagaactgcgcgtgtactatgatgaagccatccattccattgactggcatcatgaagggaaacaattcatgtgtagccactcagacgggtctctcacactgtggaacttaaagagcccttcccgtccgttccagacaaccattccacatggcaaaagccaaagggaagggagaaagagtgagtcatgcaaaccgatactgaaagtggagtacaaaacttgtaagaacagcgagccctttattatctttagtggagggctgtcatacgataaggcatgccgccggccaagtctcaccatcatgcacggtaaggccattacggtccttgaaatggaccatccgattgttgagttccttacactgtgcgagaccccttatcctaacgagtttcaggaaccatacgcggtcgtcgtccttctggagaaggatttgatcgtagtggatctgacccagtcaaatttccctattttcgagaacccctaccccatggacatccacgagtcgcccgtgacttgcacagcttatttcgctgattgtccacccgatctcatcttggtgctttacagtatcggtgttaagcataaaaaacaagggtattccaataaagaatggcctatatcagggggcgcttggaacctcggtgctcagacctaccccgagataattattactgggcacgccgatggctcaatcaaattctgggatgcatctgcaatcactttgcagatgctatataagctcaagacctctaaagtatttgaaaaacaaaaagtcggggaaggaaagcagacatgcgaaattgttgaggaggaccctttcgccatccaaatgatctactggtgccccgaatcacggattttctgtgtgagcggagttagcgcctacgtaatcatctacaagttctccagacatgaaatcactaccgaaattgtctccctggaagtcagactgcaatacgacgtcgaggacataatcactcccgaacctgaaacctctcctccctttcctgacctctctgctcaacttccttcttctcgcagcttatctggtagcaccaataccgtggcctcagagggtgtgaccaaggattccatcccctgcctcaacgtaaagacacgtcccgtgcgtatgcctcctggataccaagcagaactcgtcattcagctggtttgggtggatggtgagcccccccagcagatcacaagcctcgcggtatccagtgcctatggaatcgtagccttcgggaattgtaacgggctggcagtagtggactttatacagaagactgtgctgttatccatgggcactatcgatctctaccggagttcagacctgtaccaaagacagccaagaagtccgcggaagaataagcagtttattgcagacaacttttgtatgagaggactgtccaatttctatcccgacctcaccaaacgcatccggacgtcttaccaaagcctgactgagctgaacgactcaccggtacccctcgaactggagagatgcaaaagtcctacctccgaccacgtcaacggccactgcacttcacctaccagtcagagttgctcctctggaaaaaggctgtcgagtgccgatgtttcgaaagtaaataggtgggggccagggcgcccacccttcaggaaagctcagtctgcggcctgcatggagatctctctacccgtgactaccgaggagaaccgggagaactcctacaacaggtcccgcagttcatccatctcctcaatagataaggacagtaaagaagccatcactgcgctgtattttatggatagtttcgcacgcaaaaacgatagcacaataagtccttgcctctttgtgggcacatcccttggcatggttctgataatctcactgaacctcccactggctgatgagcaacgcttcaccgagcccgtaatggtgcttcccagtggaactttcctcagtctgaagggcgccgtcctgaccttctcatgcatggaccggatggggggtctcatgcagcccccatacgaggtctggagggatccaaacaatatcgatgagaatgagaagagttggcgcagaaaggttgtgatgaattcttcaagcgcctcacaggaaatcggtgaccatcagtatactatcatttgttctgagaagcaagctaaagtgttttcacttccctcgcagacctgcctttacgtgcataatatcacagagacctcctttatcttgcaggctaatgtggtagtgatgtgctccagcgcctgcctggcgtgcttttgcgccaacgggcatatcatgataatgagcctcccctcactcaggcctatgctggatgtgaactacctgccattgacagacatgcggatcgcacggacattttgcttcacaaacgagggtcaggctctctatctggtgtctccaacagagattcagagacttacttattcacaggagatgtgtgataatctgcaggacatgttgggcgacctatttactccaatcgaaaccccggaggcacaaaataggggattcttgaaggggctgttcggaggtagcggccagacttttgatcgggaggagcttttcggagaagcctccgcagggaaggcctctagaagtcttgcccaacacatccccggccccgggtcgatcgaagggatgaaaggtgccgcaggcggggtgatgggagaactaacacgggctcgcattgccctcgatgagcgcggacaaaggttgggggagctggaggaaaagaccgctggcatgatgacatcagccgaggccttctctaaacacgcacatgaactcatgctgaaatacaaagataaaaagtggtaccagttctag

SEQ ID NO: 207871 - DNA, 384 bp, Artificial Sequence
  Description of Artificial Sequence: Synthetic coding sequence
atgaagaagttcaacttccggaaggtgctggacggcctgaccgcctctagccctgggagcggctccagcagtggatcaaattccggcggcggcgcaggtagtggcagtgtccacccagccggcacagccggggtgctgagggaggagattcaggagacattaacttctgagtatttccagatctgcaagacagtccggcatgggttcccccatcagccgaccgctctcgcatttgatccggtgcagaaaatcctagctattggcacccgcactggcgccattcggattttgggacgccctggcgtggactgttactgtcagcatgagtcaggagccgccgtgcttcagttgcaatttttgatcaatgagggcgcattggtgtag

SEQ ID NO: 207872 - DNA, 633 bp, Artificial Sequence
  Description of Artificial Sequence: Synthetic coding sequence
atgagcgccaagagcgccatcagcaaggagatcttcgcccccctggacgagagaatgctgggagcagtgcaggtgaagcgacgaactaagaagaaaattccctttctcgcaactggtggacagggcgagtatctaacgtacatttgtctctctgtgaccaacaaaaagcctacccaagctagcattaccaaggtcaagcagttcgaaggatctacctcattcgtccgacggtcacaatggatgttggaacagctgagacaggtaaatggcattgatccaaacggagactccgccgagttcgatttgctcttcgaaaacgccttcgatcagtgggtggcctcgaccgctagcgagaagtgtacatttttccaaatactgcatcatacatgccagagatatctgaccgatagaaagcctgaatttataaactgtcaatccaaaataatgggcggaaattccatcctgcacagtgctgcagattccgtaacctcggctgttcagaaggcatcccaggcattgaatgaacggggagagcggctcggcagagccgaagagaaaacggaagaccttaagaatagcgcccagcagtttgccgagaccgcacacaagttggccatgaagcataagtgctag

SEQ ID NO: 207873 - DNA, 633 bp, Artificial Sequence
  Description of Artificial Sequence: Synthetic coding sequence
atgagcgccaagagcgccatcagcaaggagatcttcgcccccctggacgagcgcatgcttggtgctgtgcaggtcaaacgccgaacaaagaagaagatccccttcttagcgacaggcggtcagggcgagtaccttacctacatttgtctgagtgtgaccaacaagaaaccaactcaggcatccatcacaaaagtcaaacaatttgaaggcagcactagtttcgtgcgaagatcacagtggatgctggagcaacttcgccaggttaacgggatcgacccaaacggcgactctgccgagtttgacttactgttcgaaaatgccttcgaccaatgggttgccagtactgcctctgagaaatgcaccttttttcaaattcttcaccacacgtgccagagatatctgaccgaccgcaagccagaattcattaactgccagtccaagatcatgggcggaaactcaatcctgcatagcgcagcagattcggtgacatcggctgtccaaaaggccagccaggccctgaatgaaaggggggaacggctaggcagagccgaagagaaaacagaagatttgaagaattccgctcagcagttcgcagagaccgctcataaagtcactttccggggccgcaaatag

SEQ ID NO: 207874 - DNA, 633 bp, Artificial Sequence
  Description of Artificial Sequence: Synthetic coding sequence
atgagcgccaagagcgccatcagcaaggagatcttcgcccccctggatgaacggatgctgggggcggtacaggtgaagcgccgcacaaagaagaaaatcccctttctcgccactggtggacagggtgagtatcttacttacatttgtctatccgtgaccaataaaaagccgacgcaagcttccattacaaaggtcaagcagttcgaaggctccacttcctttgtgcgtcgaagtcagtggatgctagagcaattgcgtcaggtcaacggaattgatcccaatggcgacagcgccgagtttgacttgctgttcgagaatgcctttgatcagtgggttgcaagtaccgcctccgaaaagtgcaccttttttcagatcttgcaccacacgtgtcagcgatacctgacagaccgcaaacccgaattcattaattgccagtctaagatcatggggggcaactctatcctacatagcgctgccgactccgtgacctctgccgtacaaaaggcatcacaagccctgaatgaaagaggtgagcggcttggtagggcagaggaaaagacagaagatctgaaaaactcagctcagcagttcgcggagaccgcccacaaactggccatgaaacacaagtgttag

SEQ ID NO: 207875 - DNA, 633 bp, Artificial Sequence
  Description of Artificial Sequence: Synthetic coding sequence
atgagcgccaagagcgccatcagcaaggagatcttcgcccccctggatgagcgaatgctgggagccgttcaggtcaaaagacgtactaagaaaaaaatcccattcctggccacagggggacagggggaatatttgacttacatatgtctgtccgtgaccaacaaaaagcctactcaggccagcataacgaaagtgaaacagtttgagggctcaacatcatttgtgcggcgctctcaatggatgttggaacaactccggcaagtcaatggcatcgaccccaatggcgatagcgcagaattcgacctgctcttcgagaacgcattcgaccagtgggtcgcttctacagctagcgaaaagtgtaccttctttcaaatcctgcatcacacctgtcagcgctacttaacggacagaaaacctgagtttattaactgccaaagtaagatcatggggggcaactccatactccattctgccgccgactcagtaacgagtgctgtgcagaaagcttcacaagcacttaacgagaggggtgagaggcttggtcgagccgaagaaaagacggaagacttgaaaaattctgcccagcaatttgctgagaccgcacacaagcttgcaatgaagcacaaatgctag

SEQ ID NO: 207876 - DNA, 633 bp, Artificial Sequence
  Description of Artificial Sequence: Synthetic coding sequence
atgagcgccaagagcgccatcagcaaggagatcttcgcccccctggatgagcgcatgctgggcgccgtgcaagtgaagaggaggaccaagaagaagatccctttcctagccacagggggacagggagagtacttaacatatatctgcttgagtgtcacaaataaaaagcccacccaagccagcattaccaaagtgaaacaatttgaagggtccacaagtttcgtgcgcaggtcccaatggatgctggaacagctgaggcaggtcaacggcatagacccaaatggtgattccgccgagtttgacctactattcgagaatgcatttgatcagtgggttgccagcactgcttcggagaagtgcactttcttccagatcctgcaccacacttgccagcgttaccttacggaccgtaaacccgaattcatcaactgtcagtccaaaataatgggcggcaactccatcctgcactccgcagccgacagtgttacgagcgccgtccagaaagccagtcaggccttgaacgaacggggtgaaaggctcggacgagctgaagagaaaacagaagacttgaaaaactcagcccagcagttcgctgagaccgctcataaattggctatgaagcataaatgctag

SEQ ID NO: 207877 - DNA, 327 bp, Artificial Sequence
  Description of Artificial Sequence: Synthetic coding sequence
atgagcgcctgcttcctggacacccggcgggccgccttcctgcagtgtgatctcccttctagttacaggatcctgaccctaccggagtcagggcattgcggaagcgccgagcctgtgtcagatgcccctgcgttactcctaagtggaaacagcatccttcatagtgctgcagacagtgtgacctccgccgtgcaaaaggcttcacaggcactcaacgagcggggggagagactggggagagccgaggagaaaactgaagacctgaaaaattccgctcaacagttcgcagagacggcacacaaacttgcaatgaaacataagtgttag

SEQ ID NO: 207878 - DNA, 633 bp, Artificial Sequence
  Description of Artificial Sequence: Synthetic coding sequence
atgagcgccaagagcgccatcagcaaggagatcttcgcccccctggatgagaggatgctgggcgccgttcaggtgaaaaggaggacaaaaaaaaaaatccccttcctcgccacaggaggtcagggggaatacctgacttacatctgtctgagcgtgaccaataaaaagcccacccaggcttctatcactaaagttaagcagtttgaagggtctactagtttcgtcaggcggtcccaatggatgctggaacaactgcgccaagtgaatggtattgatcccaatggggactccgccgagttcgatctgctgttcgagaacgctttcgatcaatgggtggctagcacagcatcagagaagtgcacattctttcagattctacaccatacctgccagagataccttaccgaccgcaagcccgagttcatcaactgccagtctaagatcatgggcgggaactccatactgcatagcgccgctgatagcgtgacttctgcagtacagaaggctagtcaggccctcaatgaacggggagagcggctgggacgagctgaggagaaaacagaagatctgaagaatagcgcccagcagtttgccgagacagctcacaagttggccatgaaacacaagtgctag

SEQ ID NO: 207879 - DNA, 633 bp, Artificial Sequence
  Description of Artificial Sequence: Synthetic coding sequence
atgagcgccaagagcgccatcagcaaggagatcttcgcccccctggacgaacgaatgcttggagcagttcaggtgaagcgaagaaccaagaagaaaatcccctttctggccaccggaggccagggagagtatcttacttacatttgtctgtctgtgacaaacaagaaacctacacaagccagcattacgaaggttaagcagtttgaaggttccacatcattcgtgcggcggtcccagtggatgcttgagcagctaagacaggtgaacggtatagacccaaatggcgacagtgccgagtttgatctgctgtttgaaaacgcctttgatcagtgggttgcttctacagcctctgaaaaatgcacattttttcagatcctacaccacacctgccagagatacctaactgaccgcaaacctgaattcattaactgccagtccaaaattatgggaggtaatagtatcctgcattcagctgcggactcagtcacgagtgccgtacagaaggccagccaggctctgaacgaacgaggtgaaagactgggaagggccgaggagaaaaccgaggaccttaagaacagtgcccaacagttcgctgaaaccgcacacaaattggccatgaagcacaaatgctag

SEQ ID NO: 207880 - DNA, 1617 bp, Artificial Sequence
  Description of Artificial Sequence: Synthetic coding sequence
atggccgtggccgccgccgccgccgccgccggccccgccggcgccggcggaggtagagcacagagatcaggcctgctagaggtgcttgtccgtgacaggtggcataaggtgctggtcaatctctctgaagatgctctggtactgtcctctgaagaaggcgccgcagcctacaacggcatcggcaccgcgactaatggctcattttgtcgcggagccggagccggacatccaggggctggtggtgcccagcctcccgactccccagctggcgtccggaccgccttcacggacctacctgagcaggtgcctgagagcatcagcaatcagaaaagaggcgtaaaagtgcttaagcaagagctggggggactcggcatctctattaaagggggaaaagagaataaaatgccaatcctgatcagcaagattttcaaaggactcgctgcagaccagacccaagctctatacgtcggagacgctattctttccgtaaatggcgctgatctccgcgatgctacccacgacgaagccgtacaagcgctgaaacgagccggaaaggaggtgctcctcgaggtgaaatatatgagggaagccaccccatacgttaaaaagggaagccctgtatctgaaattggttgggaaacaccccccccggagtctccccggcttgggggtagcacatcggaccccccttcctctcagagcttctcatttcacagagaccgcaagagcatcccgttaaagatgtgctatgtgacacgctctatggcacttgctgatcccgaaaatcgccaactcgagatacattcccccgatgctaagcatacagtgatcctgaggtcaaaagacagcgccaccgcccaggcctggttctcagccattcattccaatgtgaacgacctcctgacacgggtgattgcggaggtccgcgaacagctgggcaaaacgggcattgctgggtcacgcgagatccggcacctaggttggctcgcagagaaggttccaggggaatccaaaaagcagtggaaacctgcgttagtggtcctaactgagaaagatctcctgatctatgacagcatgccccgacgcaaagaagcttggttctctcctgtgcacacataccctctgctggctacaaggctcgtacattctggccctggtaaaggaagcccacaggcaggggtggacctcagctttgctacacggaccgggacgcgccaaggaatcgaaacccacttgttccgagcagagacctctagagatttgagtcattggacaagatccatagtgcagggttgtcataacagcgcagagctgatagcagagatcagtacagcttgcacttataaaaatcaggagtgcaggctgacaattcattatgaaaacggtttctcaatcacgaccgagccccaagaaggggcatttcctaagactatcattcagtcgccatacgaaaagctcaaaatgagttctgacgacggcatcagaatgctgtacctggacttcggggggaaagacggggagatccagctggacctccacagctgtcccaagcctatcgtcttcatcattcattcctttcttagcgcaaaaataactagactggggctcgtggcctag

SEQ ID NO: 207881 - DNA, 1617 bp, Artificial Sequence
  Description of Artificial Sequence: Synthetic coding sequence
atggccgtggccgccgccgccgccgccgccggccccgccggcgccggtggcggtagagctcagcggtctggtctgttagaagtgcttgttcgcgacagatggcataaagtcctggtgaatctgtccgaggatgcacttgtcctgtcatcagaagaaggggctgcggcctacaacggaattggtacagccactaacgggtcgttttgccgtggcgccggtgctgggcacccaggggcagggggcgctcagccccccgactccccagctggcgtgaggactgcatttacagatcttcctgaacaggtcccagagagtatctccaaccaaaagcgcggcgtgaaagtgctgaaacaggaactcggaggtctgggcatcagcatcaagggagggaaggagaacaagatgcccattctcatttctaaaatcttcaagggcctcgccgcagaccaaacccaggcactgtatgttggggatgccatcttatccgttaatggggcagatctccgggatgccactcacgacgaagccgtgcaggcactgaagcgggccggtaaagaagtcttgctggaggtcaaatacatgcgtgaggccaccccatatgtgaaaaagggctctcccgtgtcggagatcggatgggagaccccgccccccgaatcgccaaggctgggcggctctacttccgaccccccctcttctcagtcatttagcttccacagggacaggaagtccatcccactgaagatgtgttatgtgacccgctcaatggctctcgccgatccagaaaaccggcagttggagattcattcccctgacgccaagcacaccgtgatactgagatccaaggattcagccacagcgcaggcctggtttagtgcaatccatagcaacgtgaacgacctcttgactagggtcattgccgaggtccgcgaacagctaggcaaaaccggaatcgctgggagcagggagataaggcatttaggatggctggcagagaaggtgcctggcgaatccaagaaacaatggaaacccgcattagtcgtcctgaccgaaaaggatctgctgatctacgacagcatgccaagaagaaaggaggcttggttttccccagtacacacctaccctctactggcaacacggcttgtgcattcggggccggggaaaggatccccccaagccggggttgacttatctttcgccacacgaacagggactagacaggggatcgagacacatttattccgcgccgagacttcaagggatctgtctcactggaccagatctatcgtccaaggctgtcataatagcgccgaactaatcgcagagatcagtaccgcctgtacatacaaaaaccaggagtgtagactaaccatccactatgagaacgggttctccatcactaccgaaccacaggagggcgcatttcccaagacgataattcagtccccctacgagaagctgaagatgtcctctgacgatggaatcagaatgctctacttagattttggcggaaaggatggcgagatccagttggatcttcattcctgccctaagccaattgtattcatcattcacagttttctatccgccaaaatcacgcgcctgggcctggtagcctag

SEQ ID NO: 207882 - DNA, 87 bp, Artificial Sequence
  Description of Artificial Sequence: Synthetic coding sequence
atggccgtggccgccgccgccgccgccgccggccccgccggcgccggagggggcagagctcagcgttctggtctgctggaggtctag

SEQ ID NO: 207883 - DNA, 1623 bp, Artificial Sequence
  Description of Artificial Sequence: Synthetic coding sequence
atgcgggtggccgccgccaccgccgccgccggcgccggccccgccatggcagtttggaccagggccaccaaggctggcctcgtcgagctactccttagagagcgctgggtgcgggtagtggcagagctttccggcgagagcctgagcctgactggcgatgccgctgctgccgaactggagcccgctctcggccccgccgcggccgccttcaacggactgccaaatggaggtggagctggcgactcgcttccaggcagcccgtccagggggctcgggccaccttcacccccagctcccccacgcggaccagccggtgaagctggcgcaagcccaccagtgagacgcgtacgcgtggtcaaacaggaagcaggagggttaggcatctccatcaagggaggaagagagaaccggatgcccatcctaatctccaagatcttccctggcctcgcagccgatcagagtagagcattgcggctgggcgacgcaatcctctctgtcaacgggacagacttgcgccaggccactcatgaccaagccgtccaagccctcaaacgggccgggaaagaggtcttgctggaggtaaaattcattagggaggttaccccctacattaagaaaccatctctcgtctccgacctgccctgggaaggggcagccccacagtccccgtcattctcagggtccgaggacagcgggtctccaaagcatcaaaacagcaccaaagatcgtaaaatcatccctctgaaaatgtgcttcgctgccaggaacttgtcaatgcccgatctagaaaacaggctcattgaactgcactcacccgacagccggaatactctcatacttagatgtaaggacaccgcaacggcccattcatggtttgttgccattcataccaacattatggcactgctcccccaggtgttagcagaactgaatgccatgttaggagccacgtcaacagcgggcggatctaaggaggttaaacacatcgcttggctcgctgagcaggccaaactcgatggaggtcgtcagcagtggcggcctgtgcttatggccgtgacggagaaggatctgctcctatatgactgtatgccttggacaagggatgcctgggcatctccctgtcactcttaccccctggtagccacacggttagtccacagtggaagcggctgtcggtctcctagcctggggtcagacttaacatttgccacgagaactgggagtagacagggcatcgagatgcacctgtttcgcgtggagacacatcgagacctatccagctggaccagaattttagtccaaggatgccacgcagctgctgaactcattaaagaggtgtcacttggctgcatgctgaacggccaggaggtacgactcaccattcactacgagaacggattcaccattagtcgggaaaatggaggcagcagctctatcctgtatcgatatccattcgagcgcctgaagatgtcagccgatgatggcatccgcaatttgtacctggactttggaggaccagagggagaattgaccatggatctccacagttgccccaaacccattgtgttcgtccttcacacattcctctcagcaaaagttacccggatgggactgctcgtatag

SEQ ID NO: 207884 - DNA, 1443 bp, Artificial Sequence
  Description of Artificial Sequence: Synthetic coding sequence
atggacttccggaccgcctgcgaggagaccaagaccggcatctgcctcctgcaagatggtaaccaagaaccattcaaagtgcgattgcacttggcgaaagatatcctgatgatccaggagcaggatgttatctgcgtatctggtgaaccattctactccggtgagcgcacggttacaattaggcggcagaccgttggtggatttggactgtcgatcaaaggcggtgccgagcacaatattcctgttgtagtgagtaagatttcaaaagagcaaagagcagagctgtcagggttgctcttcatcggggacgccatcctgcagattaatggtataaatgtgaggaagtgccggcatgaggaggtggtgcaggtgcttcgcaatgccggcgaagaagtgacactgaccgtgtcctttcttaaaagagcccctgcttttctgaaacttccactgaatgaggactgcgcttgcgccccatccgaccagtcaagtggcacgtcaagtcctctatgtgattccggcttgcacctcaactatcaccccaataatactgatactctgtcctgttcttcttggcctacttccccaggacttcgttgggaaaaaaggtggtgcgacctgcgcctgattccccttttacatagccggttttctcagtatgtgccggggactgacctcagtcggcagaacgcgtttcaggtgatcgctgtggacggcgtctgtacaggcatcatccagtgtttatctgcggaagactgcgtcgactggctgcaagccatcgccactaatatatctaacctcaccaaacataatataaaaaagatcaacagaaatttccctgtgaaccagcaaatcgtctatatgggatggtgcgaggctagagagcaagatcctttacaggacagggtgtattccccaacgttcctcgctctacgagggtcgtgtctctacaagttcttagccccacccgtcaccacctgggactggacccgggctgaaaaaaccttttctgtatatgagattatgtgtaaaatattaaaagattccgacttgcttgacaggaggaaacagtgctttacagtgcagtctgagagcggagaggatctatatttttctgtggagttggaatctgacctggcgcagtgggagcgcgcctttcagacagccaccttcctggaggttgaaagaatccagtgtaagacatatgcttgcgttctcgaatcacaccttatggggctgaccattgactttagcaccggattcatttgttttgacgccgctacaaaggagttagagttctccaatttgtttgccgtcctccattgtatccactcttttttcgcagccaaggttgcatgcctggatccacttttcctgggcaatcaggccactgcatccacggcagcgtcaagcgcgaccacgtctaaggcaaaatacactacctag

SEQ ID NO: 207885 - DNA, 1443 bp, Artificial Sequence
  Description of Artificial Sequence: Synthetic coding sequence
atggacttccggaccgcctgcgaggagaccaagaccggcatctgcctgctacaggatgggaaccaggagccgttcaaggttaggcttcatttggccaaggacatcctgatgattcaggagcaagatgtgatttgtgtctccggagagcccttctattccggcgaacgcactgtaactatccgcaggcagacagtcggggggttcggtctgagcatcaagggtggcgccgagcacaacatccccgttgttgtctctaaaatatctaaggagcagagggcggagctgagcggcctcctgtttatcggtgatgctatactgcagattaatggcatcaatgtgcggaagtgccggcacgaagaagtagtccaggttcttcggaatgcgggggaggaagtcaccctcactgtttcgttcttgaagcgcgcaccggcctttttgaagctgccactaaacgaggactgtgcgtgcgcacccagtgaccagagttccggtaccagttctcctctctgcgactctgggttacacctcaactaccatccaaataatactgatactctgtcatgctccagctggccgacgtctcccggattacgatgggagaagcggtggtgcgaccttcgcctaatcccgcttctacattctcggttttcccagtatgtacctggtaccgatctgtctcggcaaaatgccttccaagtcattgcagtagatggagtgtgcacggggattatccagtgccttagtgcagaagactgtgtggactggctccaggccattgcaacaaatatatccaacctgactaagcataatataaaaaagatcaatcgcaatttccccgtcaaccagcaaatagtttacatgggttggtgtgaggcaagggaacaagatcccctgcaagaccgcgtctactccccaaccttcttggctttgcgcggctcatgtctatacaagttccttgcaccccccgtgactacttgggactggacaagggcagaaaagacattctcagtgtatgaaatcatgtgtaagattttaaaagattcagatttgctggaccgtcgcaaacagtgctttactgtgcagagtgagtctggggaggatctgtactttagcgttgaactggaatcagatctggctcagtgggaacgggccttccagactgccacgttcctcgaggtggagcggattcagtgtaaaacctatgcttgcgtgttggagtctcacctaatggggctgacaatagatttctccacaggattcatttgttttgacgcggccactaaggagctggaattcagtaacctcttcgcagtcctgcattgtatccatagttttttcgctgccaaggtagcttgcctggatccattattcttgggcaatcaggcgaccgcgtcaacagcagcatccagcgccaccactagcaaagccaagtacacaacctag

SEQ ID NO: 207886 - DNA, 1554 bp, Artificial Sequence
  Description of Artificial Sequence: Synthetic coding sequence
atggacttccggaccgcctgcgaggagaccaagaccggcatctgcctcctgcaggacggtaatcaggagccatttaaggtgcggctgcacctagccaaagacatcctgatgatacaggagcaagacgtgatctgcgtgagtggcgagcccttttacagtggtgagcgcacggtcaccatcaggcgacagacagtcggaggctttggtttgtcgattaaagggggggccgaacacaatattcccgtggtggtttcaaaaatcagcaaagaacagagagccgagctatcgggcttactgttcatcggcgacgctatactgcagattaacggcataaatgtgcgcaagtgtcgacatgaggaagtggtgcaggtgctcagaaatgccggtgaggaggtaaccctgaccgttagctttctgaaacgcgcccctgcattcctgaagctgccccttaacgaggactgcgcttgcgcccccagcgaccaatccagtgggacatctagcccgctatgcgattccggtctccacctgaactatcatcctaataatactgatacgctgagttgctctagctggcccactagtcccggactgcgttgggaaaaaaggtggtgcgatctccgcttaattcctcttctgcacagtcggttttcacagtacgtgcctggaactgacctgagcaggcagaatgccttccaagttatcgctgttgacggggtgtgcacaggcataatccagtgcttgagcgccgaggattgcgtggactggcttcaggctatagccacgaacatctcaaacctgaccaagcataacattaagaagatcaaccgcaacttccccgtcaaccagcagattgtgtatatgggatggtgcgaggccagagagcaggaccctctgcaagatcgtgtatactcccccactttcttggcattacgagggtcatgtctctataagtttttggctccacctgtgacgacatgggattggactagggccgaaaaaacgttctctgtgtacgagatcatgtgcaagatactgaaagactccgatctgctcgaccggcgtaagcaatgttttaccgtccagtccgaaagtggagaagacctgtacttctctgtggaacttgagtcagatctggcacagtgggaacgggcattccagacagcaacatttctcgaggtcgagaggatacaatgtaaaacttacgcgtgcgttttagaaagtcacttaatgggacttacgattgatttttcgacagggtttatctgttttgacgctgcgaccaaagccgtgctgtggaggtataagttctcccagctgaagggatcctccgacgatggcaaaagcaagattaagtttctgtttcagaaccctgatacgaagcagatcgaggcaaaagagctggaattcagcaatctcttcgctgtcctgcattgcattcacagcttctttgccgccaaagtggcatgcctagacccactgtttctgggcaatcaggctacggccagtacagccgctagcagcgctaccacctccaaggccaagtataccacctag

SEQ ID NO: 207887 - DNA, 1554 bp, Artificial Sequence
  Description of Artificial Sequence: Synthetic coding sequence
atggacttccggaccgcctgcgaggagaccaagaccggcatctgcttactgcaagacggtaatcaagaaccgttcaaggtccggttgcacctggcaaaggatatactaatgattcaagagcaagatgtcatttgcgtctcaggtgaacccttttatagtggagagagaacagtaactatccgtcggcagaccgtcggaggctttggtctatcgattaaggggggcgctgaacacaacatccccgtggtggtcagcaaaatctcgaaggaacaacgggctgagctttctgggcttctgttcatcggcgatgccatcctgcagattaacggcattaacgtgagaaaatgccggcacgaagaggttgtccaggtgctccgaaacgctggtgaagaagtaaccttaactgtctcatttcttaagcgggctcccgcttttctgaagctaccattaaacgaagattgtgcctgcgccccttccgaccagtcttccggcacaagtagccctctgtgtgatagcgggctacacctgaattaccatcccaataacactgatacgctcagctgctcaagctggcctacttctcccggcctgcggtgggagaagagatggtgcgatctcagactaattccactgctgcacagtagattttcacagtacgtgcctggaaccgatctgagtagacaaaacgctttccaggtgattgccgttgatggcgtctgcacagggataatccagtgtctcagcgccgaggactgcgtggactggctgcaggccattgcaacaaatatctctaatttgactaaacataacattaagaaaattaataggaactttccagtgaaccagcagatcgtatatatggggtggtgcgaagccagggaacaggaccctttacaggatcgagtgtacagccctacctttctagccctccgcgggagctgtctgtacaaatttctggcaccgccggtgacaacctgggattggacccgggccgagaaaaccttctcagtctacgaaatcatgtgcaaaattctgaaagatagtgaccttttagacaggagaaaacagtgctttactgtgcagagtgaaagtggagaggatctctatttcagcgtggaactcgaaagcgacctcgctcaatgggaaagagctttccaaactgcaacctttctcgaggtggagcgtattcagtgcaaaacatatgcctgcgtgcttgaatcacacctgatgggactcacaattgatttcagcactgggttcatatgtttcgacgctgccactaaagccgtgctgtggaggtataagttctcacagctgaagggtagctctgatgatgggaaatcaaagatcaaattcctgttccagaacccagatacaaaacagatcgaggctaaagaactggagttttctaatctttttgccgtcttacactgcatacatagcttctttgctgcaaaggtggcctgcctggatcctctgtttctcggtaatcaggctactgccagcaccgctgcttctagtgccacgacatcaaaggccaaatataccacctag

SEQ ID NO: 207888 - DNA, 279 bp, Artificial Sequence
  Description of Artificial Sequence: Synthetic coding sequence
atggacttccggaccgcctgcgaggagaccaagaccggcatctgcctgttgcaggacggaaaccaggaaccattcaaggtgagactgcaccttgccaaagacatcctgatgattcaggagcaggatgtgatttgcgtgtctggtgagcctttctactctggagaaaggaccgtgactattagaaggcagactgtgggcggattcggcctgagtatcaagggtggtgcagagcacaatatacccgttgtggtctccaaaatcagtaaagagcaaaggtag

SEQ ID NO: 207889 - DNA, 423 bp, Artificial Sequence
  Description of Artificial Sequence: Synthetic coding sequence
atggacgtgttcatgaagggcctgagcaaggccaaggagggcgtggtcgctgccgccgaaaaaaccaaacaaggcgtagccgaagctgccggcaagactaaagaaggcgtgctttatgtcggctccaagaccaaagagggcgtcgtgcacggcgttgcaactgtagccgagaaaaccaaagaacaggtcaccaacgttggcggcgcggttgtcaccggggtaaccgccgttgcgcaaaaaacagttgagggcgcgggctccatagctgctgccacgggatttgtcaagaaagatcagctcggaaagaatgaggagggggctccacaggagggcattcttgaggacatgccagtcgaccctgacaatgaagcttatgagatgcccagtgaggaaggctaccaggactatgaacctgaggcctag

SEQ ID NO: 207890 - DNA, 339 bp, Artificial Sequence
  Description of Artificial Sequence: Synthetic coding sequence
atggacgtgttcatgaagggcctgagcaaggccaaggagggcgtggtggcagctgccgaaaaaaccaagcaaggggtagccgaggctgcaggtaagaccaaggaaggtgtactttacgtgggttctaaaactaaggagggcgtcgtgcatggggttgccaccgtggccgaaaagacaaaggaacaggtgaccaacgtcggaggggcagtggttaccggcgtgacagctgtggcgcagaagacagtagaaggtgctggatctatcgcagctgctactggatttgtgaagaaggatcaactgggtaaggaaggttaccaagactatgagcccgaagcctag

SEQ ID NO: 207891 - DNA, 423 bp, Artificial Sequence
  Description of Artificial Sequence: Synthetic coding sequence
atggacgtgttcatgaagggcctgagcaaggccaaggagggcgtggtggcggccgcagaaaaaacgaaacaaggcgttgccgaggccgcaggtaaaaccaaagagggcgtgctgtatgtgggttcaaaaaccaaggaaggagttgttcatggtgtggcaacagttgcagagaaaactaaggagcaggttacaaacgttgggggggctgtggtgacgggagtaacagcagttgcacaaaaaaccgtagagggtgctggcagtatagctgccgccactggcttcgttaaaaaggatcaactagggaagaatgaggaaggagctccacaagagggtatattagaggatatgccagtcgatcccgataatgaggcttacgaaatgccctctgaggagggataccaagactatgaacctgaggcctag

SEQ ID NO: 207892 - DNA, 381 bp, Artificial Sequence
  Description of Artificial Sequence: Synthetic coding sequence
atggacgtgttcatgaagggcctgagcaaggccaaggagggcgtggtagcagcggccgagaagacaaaacaaggagtcgcagaggctgcaggcaaaaccaaagagggtgttttgtatgtcgtggctgagaaaaccaaggagcaagtgacaaatgtaggcggggccgtggtgacgggggtgacagcagtggcacagaagacagtcgagggagctggcagcattgcggcagccacgggctttgttaaaaaggatcagctaggaaagaatgaggaaggtgcgccccaggagggcattctggaggatatgccagtggatccagacaatgaagcctatgagatgccttcagaggagggttaccaggactacgaacccgaggcatag

SEQ ID NO: 207893 - DNA, 423 bp, Artificial Sequence
  Description of Artificial Sequence: Synthetic coding sequence
atggacgtgttcatgaagggcctgagcaaggccaaggagggcgtggtcgctgccgctgagaaaaccaaacagggagtcgctgaggccgcaggaaagacaaaagagggggtgctgtacgtgggaagcaagaccaaagagggtgtcgtgcacggagtcgccaccgtcgctgagaagacaaaggaacaggtcacaaatgtcggcggtgcggtcgtaaccggggtgaccgccgtcgctcagaagactgtggagggtgcgggatctattgctgccgcaaccggtttcgttaaaaaagatcagctgggaaagaatgaggaaggcgccccacaagagggaattctcgaagatatgccagtcgaccctgacaacgaggcatatgagatgccctccgaggagggttaccaggactacgagccagaagcgtag

SEQ ID NO: 207894 - DNA, 339 bp, Artificial Sequence
  Description of Artificial Sequence: Synthetic coding sequence
atggacgtgttcatgaagggcctgagcaaggccaaggagggcgtggtggccgccgctgagaagaccaagcagggcgttgccgaagccgctggaaagactaaagaaggtgtcctatatgtcgggagcaagaccaaagaaggggtcgtccacggagtcgccacagtcgcagagaaaacaaaggagcaggttacaaacgtgggtggagccgtggtgactggcgtgaccgcagtagcccaaaaaacagtggagggagcaggaagtatcgcggccgctacaggttttgtcaagaaggaccagttaggaaaagaagggtaccaagattatgagcctgaagcttag

SEQ ID NO: 207895 - DNA, 348 bp, Artificial Sequence
  Description of Artificial Sequence: Synthetic coding sequence
atggacgtgttcatgaagggcctgagcaaggccaaggagggcgtggtggctgctgctgaaaaaaccaagcaaggcgtcgcagaggccgctggtaagactaaagagggtgttctgtatgtgggttctaaaacaaaagaaggtgtggtgcatggcgtggcaaccgtcgccgagaagactaaagagcaggtgactaacgttggaggtgcggtagtgaccggagtaacggcggtagcacagaaaaccgttgaaggtgctggcagcatcgcggctgcaaccggcttcgtgaagaaagatcaactgggcaaagtatggctgtgtaccttctgtgtcacctttatttcctggtag

SEQ ID NO: 207896 - DNA, 381 bp, Artificial Sequence
  Description of Artificial Sequence: Synthetic coding sequence
atggacgtgttcatgaagggcctgagcaaggccaaggagggcgtggtcgccgccgcagagaaaacaaagcagggcgtggccgaggcggcggggaaaaccaaagaaggagtgctgtacgtcgttgccgagaaaactaaagagcaggtgactaacgtgggcggtgccgtggttacaggagtgactgccgtggctcagaaaaccgtcgaaggggcagggtccatcgcagcggccaccggcttcgttaagaaagatcagttgggaaaaaacgaggagggggccccccaggagggcatcctggaggacatgcctgtagatcctgacaacgaagcctacgagatgccatccgaggaaggttaccaagactatgagccggaagcgtag

SEQ ID NO: 207897 - DNA, 423 bp, Artificial Sequence
  Description of Artificial Sequence: Synthetic coding sequence
atggacgtgttcatgaagggcctgagcaaggccaaggagggcgtggtggctgcggcagaaaagactaaacagggtgtggccgaggctgcggggaaaaccaaggaaggtgtgctgtacgtgggctcaaaaaccaaagagggggttgttcatggggttgccactgtggccgagaagaccaaagaacaggtgacgaacgttggcggtgccgtagttaccggagtgaccgccgtggcccagaagacagtcgagggagcaggttcaatcgccgctgcaaccggttttgtgaagaaagaccagctggggaagaacgaggagggcgctcctcaggaaggcatcctcgaggatatgccagtggaccctgataatgaggcctatgagatgcccagcgaggagggctatcaggattacgagccggaggcatag

SEQ ID NO: 207898 - DNA, 204 bp, Artificial Sequence
  Description of Artificial Sequence: Synthetic coding sequence
atggacgtgttcatgaagggcctgagcaaggccaaggagggcgtggttgccgcagcagagaagactaagcaaggcgtggctgaggctgctggaaaaactaaagaaggcgtgctgtacgtgggtagtaaaacaaaggaaggtgtcgtccatggggtggctactgtcgctgagaagaccaaggaacaggtgaccaacgtggggtag

SEQ ID NO: 207899 - DNA, 423 bp, Artificial Sequence
  Description of Artificial Sequence: Synthetic coding sequence
atggacgtgttcatgaagggcctgagcaaggccaaggagggcgtggtggcagccgcggaaaaaacaaaacagggagtcgccgaggccgcaggcaaaacaaaggaaggcgtgctgtatgtgggaagtaagaccaaggagggcgtggtgcatggagtcgcaacagtagccgagaaaaccaaggaacaggtgacgaatgtcggcggtgcagtggtgaccggcgtaactgctgttgcacaaaagacggtcgaaggtgccggctcgattgctgccgcgacagggttcgtgaaaaaggaccagctgggtaagaacgaagagggcgcgcctcaggaaggcatccttgaagatatgcctgttgatcctgacaacgaagcctacgagatgccatctgaagaagggtaccaagattacgagcctgaagcttag

SEQ ID NO: 207900 - DNA, 2760 bp, Artificial Sequence
  Description of Artificial Sequence: Synthetic coding sequence
atggaggcccccgagtacctggacctggacgagatcgacttcagcgacgatataagctactctgtaacctctctcaaaacaatccctgaactatgtcggcggtgcgatactcagaatgaggacagaagtgtttccagcagctcatggaattgtgggatttcgaccctgatcacaaacacccaaaagcccacaggtattgcggacgtgtattctaaattccgccccgtgaaacgggtcagtcccctgaagcaccagcccgaaacactggagaacaatgagagcgatgatcaaaaaaatcagaaggttgtggaataccaaaagggaggagaaagcgaccttggtccccagccccaggaactaggacctggcgatggcgtaggggggcctcccggcaagagctctgaacctagcacctctttaggggagcttgagcattacgatttggacatggacgaaattctggacgttccgtacatcaagtctagtcagcagctcgcctctttcaccaaagtcacaagtgagaagagaattctgggattatgcacgaccataaatgggctcagcgggaaagcctgctctaccggtagctccgaaagtagttctagtaatatggctcccttttgcgttttatccccagtgaaatctccccatctacgaaaggcttccgctgttatccacgatcagcataagctctccacggaggagacggaaatttcaccacccctggtaaagtgtggttccgcatacgaacccgagaaccagtcaaaagactttcttaataagacattctcagatcctcacggccggaaggtggagaagacgaccccggactgccagctgcgggcttttcatctgcagagctccgccgctgaaagcaagcctgaggaacaggtgtcaggtctgaaccgaacatcctcacagggaccagaggaaagaagtgagtacctaaaaaaggttaagagtatcctgaatatcgtcaaagaggggcagatttcactactgcctcacttagcggctgataatctggacaagattcatgatgagaacgggaacaatctcctgcatatagccgccagccaaggtcatgctgagtgtcttcagcacctcacttctctaatgggcgaggactgtttgaacgagagaaataccgagaagctgacacctgcgggtctcgccattaagaacggccagctggaatgcgtgaggtggatggtgtctgagacagaggccatagctgagctctcatgttccaaagacttcccctctctcattcactatgccgggtgttacggccaggaaaagatcctcctgtggttactgcagttcatgcaggaacagggtatcagcttggacgaggtggatcaagatggcaactccgctgtgcacgtcgctagccagcatggctatctcggctgtattcagaccctggtcgagtatggtgctaatgttactatgcagaaccacgcgggcgagaagccctcacagagcgcggaacgtcagggccacacactgtgctcacgctatctggttgtggtggaaacttgcatgtctcttgcctcccaagtcgtcaagctaacgaaacagctgaaagagcagacagtggaaagagtgactctacagaaccagctacaacaattccttgaagcgcagaaaagtgaaggtaaatccctccctagctctcctagctctccctccagtccagctagtagaaaaagccagtggaagtctccagacgctgacgacgactcagttgctaaatctaagccaggggtacaagagggtatccaggtcctaggatctctgagcgccagttcgagagctaggccaaaagctaaggacgaagatagcgataaaattctgcgacagctcctgggcaaagagatcagcgagaatgtctgcacacaggaaaagctttcactggagttccaggacgcccaagcctcaagcagaaattctaagaaaattccactcgaaaagcgagagctgaagctggcccgactgcggcaacttatgcagaggagcctgagtgagtctgatactgactcaaataattctgaggaccccaagaccacacctgtaagaaaagcggatcgtccacggcctcagcccatcgttgagtccgtggagagcatggatagcgcagaatccctgcaccttatgattaagaagcacacacttgcctccggcggtagacgttttcccttcagtataaaggcgtctaaaagcttggacggacactcccccagcccaacgagcgaaagcagcgaacctgacttagaatctcagtatcctggctctggatctatccctccaaaccagcctagtggcgatccacaacagcccagcccggatagtaccgccgcacagaaagtggcaacaagcccaaagtccgcacttaagtcccctagtagcaagagacggaccagccaaaatctgaagttgagggtgaccttcgaagaaccagtcgtgcaaatggaacagccgagcctcgaattaaacggcgaaaaggacaaggacaagggcaggacattgcagcggacttcaaccagcaatgagtccggtgaccagcttaaaaggcctttcggagctttccgcagtatcatggagactctgagtggcaatcagaataacaacaacaattatcaggctgccaatcagctgaaaacgagcaccctgcctttgactagtctgggccgaaagacagacgctaaagggaacccagctagttccgcctctaaaggtaagaacaaagcagcatag

SEQ ID NO: 207901 - DNA, 3051 bp, Artificial Sequence
  Description of Artificial Sequence: Synthetic coding sequence
atggaggcccccgagtacctggacctggacgagatcgacttcagcgacgacatatcagacaaccgcagtcagggtaaccggctgcagaaactggggctggaagatactgatcgggaggatgctatgggtttcgggagccatagggccaaattgactgtggttgcagccttaggagcctgtcactgcccggagaacgagtattctgtgacaagtctgaagacaattcctgagttgtgccgccggtgtgatacccagaatgaagaccggtctgttagctcctctagttggaactgtgggatctccactttgatcactaatacacagaagcctactgggatcgccgacgtctattctaaatttcggccggtcaagcgggtgagccccctgaaacaccagcccgagaccttggaaaataatgagagtgatgaccagaaaaaccaaaaagtcgtggagtaccagaagggcggcgaaagtgatctgggccctcagccacaggaacttggacccggtgatggagtggggggcccacctggtaagagcagcgagccttctacttccctcggagaactggagcactatgacctggatatggacgagatattggacgtgccttacattaaatcaagccagcaattagcttcttttacgaaggtaacatctgaaaaaagaattctggggctgtgcacaactattaacgggctgtcaggtaaggcttgcagcaccggaagttcagagagcagtagtagcaacatggctcctttctgtgtactgtctcccgtcaagtcgccccacctccggaaagccagcgccgtcatccatgatcaacacaaactctcgaccgaagagaccgagatctccccacctctggttaaatgtggttccgcctatgaacccgagaaccagagtaaagactttttaaacaagaccttctcagacccgcacggcaggaaggttgagaaaacaacacctgactgtcagctgcgggcctttcatctccagagtagtgcagccgagtccaaacccgaggaacaggtaagcggactcaatcggaccagcagtcaaggacccgaggaacggtccgagtacctcaagaaggtgaaatcgattctgaacatagtaaaagagggccagatctcccttcttccacatcttgctgcggacaatttggataagattcatgatgagaatggaaacaatttgctgcacatagcagcttcccaggggcatgctgaatgtttgcaacacctgacgtcacttatgggtgaggactgtctgaacgaaaggaatacagagaaactgacaccggccggtcttgcaatcaaaaatgggcagctggagtgcgttcggtggatggtctccgagaccgaagccatagccgagctgtcatgttcaaaagacttcccctctctgattcattacgctgggtgttatgggcaggagaagattttactttggctgctgcagtttatgcaagagcagggaatctctctggatgaagtggatcaggatggcaattccgctgtccacgttgcatcccaacacggctacctggggtgcatccagacgctcgttgaatatggtgctaatgtcactatgcaaaatcatgccggagagaaacctagccagagcgccgagaggcagggccacactctgtgcagcaggtacctggttgtggtggaaacctgcatgtcactggccagtcaggtggttaagttgaccaagcaacttaaagagcagactgtcgagagggtgacactgcagaaccaactgcagcagtttttagaagcccaaaaaagtgagggcaagagcctgccatcatcacctagtagtcctagttcccccgctagccgcaagagccaatggaagtcccccgacgccgacgatgactccgtggccaaatcaaaaccgggggtgcaggaagggattcaggtgctcgggtccctgtccgcgagctctagagcgcggcccaaggccaaggatgaagactcggataaaattttaaggcagctactgggtaaggagatttccgagaatgtgtgcacgcaggagaagctgagcctggagtttcaggacgctcaagcctcatcacggaactcgaagaagataccacttgagaaacgcgagctgaagctggcccgcctccgacagttgatgcagcgttctctgtcggagtctgacaccgatagcaacaactccgaggatcctaagacaacacctgtacgtaaggctgaccgccctcgtccacagcccatcgttgaatctgtggaaagtatggactctgctgaatcactgcatctgatgattaaaaagcatacactggcctcaggggggcggagatttccgttctctatcaaggccagtaaatctctggatgggcactccccatctcccaccagcgagagttccgaacccgatcttgaatcacagtatccagggagtggctcaatcccgcctaaccagccctccggcgatccgcagcagccttctccagattccacagcagcccagaaggtagcaacctcccctaaaagcgccctgaagtctcctagctcgaagagaaggaccagccagaatctgaaactacgtgtgacttttgaggaaccagtggtgcaaatggagcaaccttccctggaactcaacggcgaaaaggataaggacaaagggcggaccctacaaaggaccagcacctctaatgaaagcggagatcagctgaagcgcccatttggagcatttagaagcattatggagaccctaagtggaaaccaaaataataacaataactatcaggctgccaatcaactcaaaactagtacattgccattgacgagtctgggcagaaagaccgatgcaaaaggtaatccagcttctagcgcgagcaagggcaagaataaagccgaaatgtatagcagttgcatcaatctcagctcaaatatgcttattgaggagcacctgtgcaatgatacccgccacaacgacattaaccgcaagatgaagaaatcgtactcgataaaacacattgcagagccggaatccaaggaactctttctgtag

SEQ ID NO: 207902 - DNA, 2580 bp, Artificial Sequence
  Description of Artificial Sequence: Synthetic coding sequence
atggaggcccccgagtacctggacctggacgagatcgacttcagcgacgacatctcctactccgttaccagtctgaaaacaattcccgaattatgtagaagatgtgacactcagaacgaggatcgcagcgttagctcatcatcttggaactgtggcatttctactctcataaccaacacacagaaacctacggggatcgctgatgtctattctaagtttcgtcctgtgaagagagtgtctccacttaagcaccaaccggaaaccttggaaaataatgaaagtgacgatcaaaaaaaccagaaagtagtggagtatcagaaaggtggcgagtctgacctcgggcctcagccccaagagctgggtcctggcgacggcgtgggaggtccacccggtaagtctagtgagccctcaacgtcattgggtgagctggagcactatgacctcgatatggacgagattctggacgtgccatatatcaagagcagccagcagctagcctcattcaccaaggtaacctccgagaagagaatcttggggctttgtactaccatcaacggactgagtggcaaagcatgcagtacaggaagttcagagtccagtagcagtaatatggcgcctttttgcgtcctttctccagttaagtctcctcatctgagaaaagcttcagctgttatccacgatcaacacaagctctctacagaggagacagaaatctcccccccgctcgtgaagtgcgggagtgcatacgaacctgagaaccaatccaaagacttcctgaacaaaaccttttcggacccacacggacgcaaagtcgagaagacaacccctgattgtcaactgagagcttttcacctccagtcgtctgctgccgagtccaagcccgaggaacaggtgagcggactcaatcggacaagctctcaaggtcctgaggaaagatccgagtacctaaagaaagtgaagagcatactaaatattgtcaaagagggacaaatctcactgctgaacggacagctcgagtgcgtgaggtggatggtatccgaaaccgaagccatcgctgaattgtcctgctccaaggatttcccatcccttatccactacgcaggatgttatgggcaagagaaaattttgctgtggttactccagttcatgcaggagcaaggaatcagcctggacgaagttgaccaggacggtaacagcgcggtgcacgttgcttcccagcacggctacttaggctgtattcagaccctcgtcgaatatggggcaaacgttaccatgcaaaatcacgcgggcgagaagccctcacagtcggccgaacgacagggacataccctgtgctctagatacctggtcgtggtcgagacatgcatgagccttgcatcgcaagtcgtcaagctcaccaaacaacttaaagagcaaaccgttgaaagagtgacgctacaaaaccagctccagcagtttctggaggcccagaaatctgaaggaaagagcctgcctagtagtccctcttccccatcaagccccgcaagccgcaagagtcagtggaagtcccctgatgccgacgatgactctgtcgctaagtccaaaccaggtgtccaggagggaatccaggtactgggaagcctcagcgcctccagtcgtgcgcgacctaaggctaaagacgaggactccgacaaaatccttaggcaactgctggggaaggagatttcggaaaacgtttgcacacaggaaaaattgtccctggaatttcaagatgcgcaggctagttctaggaactcgaaaaaaataccccttgagaagcgcgagcttaagctggcaagattacgacagctgatgcagagatcccttagcgagtcagatacagactctaataacagcgaggacccaaagactaccccagtgcgtaaagccgatagacctagaccgcagcctattgttgaatcggttgaaagcatggatagcgccgaaagccttcacctgatgatcaaaaaacacacgttggcttcaggcggccggcggttcccatttagcattaaagcaagtaagtccctggatggccattctccgtctccaacttccgagagtagtgagcctgatttggagtctcagtacccagggtctggctctatcccacccaaccagccatctggggatccacagcagccctcaccagactcaaccgcagcacagaaggtcgctaccagccccaagagtgcactcaagtctccatcttctaagagacggactagtcagaacctgaaactccgagtcaccttcgaggagcctgtagtacaaatggagcaaccttctctggaactgaatggagaaaaggacaaggataagggacggaccctccaacgaacctcaactagtaatgaatcaggcgatcagctgaagcgtccctttggggctttcaggtccattatggagaccctatcagggaatcagaacaacaataacaactaccaagccgccaaccagctgaagacgagtaccctccctctgaccagtctgggacgcaagaccgatgcgaaaggaaacccagcatcttctgcttcaaagggcaagaataaagcagcatag

SEQ ID NO: 207903 - DNA, 1812 bp, Artificial Sequence
  Description of Artificial Sequence: Synthetic coding sequence
atgacctacctgatccagagccaccacagccggcggagccagaactgtgcagaggacgtgattcgcaagacaaaaacagaccaaaacggccaattggaatgtgtgcggtggatggtgtcagagactgaagcaatcgcggagcttagctgttccaaagatttcccttctctgattcactatgcagggtgttatgggcaggaaaagatactgctttggctactgcaatttatgcaggaacaggggatttccctggacgaggtcgaccaggatggtaacagcgcggtgcacgttgccagccagcacgggtacctaggttgcatccagactctggtggagtacggggccaacgttaccatgcaaaatcacgccggagaaaaaccctcacagagcgcagaaaggcaagggcatactctctgtagccgatatctggtagtggtggaaacgtgtatgagcctagcttcccaggtcgttaagctgactaagcagctgaaggaacagaccgtggaacgggtgacactgcaaaatcagctgcagcaattcctcgaggcccagaagtccgaagggaagtcactgcccagttcccctagtagcccatccagtccggcttcccgcaagtcccaatggaagagcccagacgccgatgacgattctgtggccaaaagtaaaccaggagtgcaggaaggcatacaggttctggggagtcttagtgcttcatcccgcgcccgcccaaaagcaaaagatgaagacagcgacaagatcctcagacagcttctgggcaaggaaatttctgagaacgtatgcacacaagagaagctaagtctggagttccaggatgctcaggcctcctcacgaaactctaaaaaaatccctttggaaaaacgtgagctgaagctcgcccgcctgcgacagctgatgcaacggagcttgagtgaatccgatactgatagtaataactccgaggatcccaaaaccactcccgttcgcaaggctgatcgcccccgaccgcaaccgattgtggaatctgttgaatctatggacagcgctgaaagtctccatctaatgattaagaaacacacattagccagtgggggacgaagattcccattctcgatcaaagcaagcaagtcactggacgggcattccccctctccaactagcgagtcctcagagccagacctagaaagccagtacccaggaagcggctctatccctccgaaccagccctctggagacccgcagcagcccagccccgattctactgccgctcagaaagtagcaactagcccgaagtccgctctcaaaagccccagctccaaaaggcgcacaagccagaatttgaaacttcgcgtgacttttgaggaacctgtcgtccagatggaacagccttctttggaattaaacggagaaaaggataaagataagggacgcactctccagagaacctctacctctaatgaaagcggcgaccagctcaaacgcccatttggggctttcaggagcattatggaaacactctctggaaatcagaataacaacaataactaccaggctgccaatcaactgaaaacctccaccctacctctgacttcgctgggtaggaaaactgacgccaagggaaaccctgcttctagtgcctccaaaggtaaaaataaggccgaaatgtatagcagctgcatcaatctgagtagtaacatgctcatcgaggagcatctgtgcaacgatactcggcacaatgacattaataggaaaatgaaaaaatcttactctatcaagcatatcgctgaacctgagtccaaagagttgttcctgtag

SEQ ID NO: 207904 - DNA, 1566 bp, Artificial Sequence
  Description of Artificial Sequence: Synthetic coding sequence
atgaagctgaccctggtgatgacctacctgatccagagccaccactcccgtcgctcccagaactgcgcagaggatgtgatccgaaagacaaaaacggatcaggagaaaatcctgttgtggctcctccagtttatgcaggaacaagggatcagcttagacgaggtggatcaggacggcaacagcgctgttcacgtcgcttcccagcatggatatctgggctgtattcagacattagttgaatatggcgctaatgttacaatgcagaaccacgctggagagaagccatcgcagagcgccgaacggcaggggcacactctgtgctctcgttatttagttgtcgtggagacttgcatgagcctcgcgtcccaagtagtgaagttaactaagcagctgaaggaacagacagttgagagggtgaccctgcagaaccagcttcagcaatttctggaagcccagaaatcagaggggaagtccctgccctccagtccgtcatcaccgtcttcccccgcctcccgcaagtcacagtggaaatcccctgatgccgatgatgactccgtggctaaaagcaaaccgggcgtccaagaggggatacaagtgctgggctcgttgagcgcctcgtcacgcgcacggccaaaagcaaaggatgaggactctgataaaatccttcgccagcttttgggaaaggagatcagcgagaacgtgtgtacccaggagaagctgagcctcgagtttcaggatgcacaggcaagtagccggaattccaagaaaattccacttgaaaaaagggaactgaaattggccaggctgaggcaattgatgcagaggagcctttcggagtcagacaccgacagtaataatagcgaggaccctaagacaacaccagtgaggaaagccgatcgccctcgaccccaaccaattgtggagtctgtggaatcaatggacagcgccgagagtttacatttgatgattaagaaacacacactggcttcggggggcagacggttcccgtttagcataaaagcctccaaatccctggatggccattccccgtcacccacaagcgagtctagtgagccagatttagagagccagtacccaggcagcgggtccattcctccgaatcagccctctggtgacccccaacaacccagtccggacagcacagctgcccagaaagtggctacatcccctaaatcagcacttaagtcaccctccagtaagaggcggaccagccagaatcttaaactgagagttaccttcgaagagcctgtcgtacagatggagcaaccaagcttagagctcaatggggagaaggataaagataagggtcgaaccctgcagagaacctccacatcgaacgaaagcggcgatcaacttaaacgaccattcggcgctttcaggtctatcatggaaactttatccggcaaccagaataacaataataattatcaggctgcaaaccagctaaaaacatccaccctgcctctgaccagcctgggtaggaagacagatgcgaagggcaatccagcatcctcggcttccaagggaaaaaataaagcagcatag

SEQ ID NO: 207905 - DNA, 1146 bp, Artificial Sequence
  Description of Artificial Sequence: Synthetic coding sequence
atgaagctgaccctggtgatgacctacctgatccagagccaccacagtcggaggtctcagaattgtgcagaagatgtaatccggaagaccaaaaccgaccagaatggacagctcgagtgtgtgcgctggatggtgtctgagacggaagctatcgctgagttatcgtgtagtaaggactttccgagcctgatccattacgccggatgttacggacaggagaagatattgttatggctgctgcagttcatgcaagaacaagggatatcactcgacgaggtcgaccaagacggaaattctgcagtccatgtggcatcacagcacggttatctgggctgcattcagaccctggtcgaatatggtgctaatgtgactatgcagaaccacgccggtgaaaagcccagccagagcgccgaacgtcaggggcacaccctgtgtagccgttatcttgttgtggtggaaacatgtatgtctctggcatctcaggtggtcaaactgaccaagcagttgaaagagcaaacggtggaacgtgtaacgttgcagaaccaattgcagcagttcctcgaggctcagaaaagtgagggtaagtcgctccctagttctcctagctcgccatcatctccagcatctcgcaagagtcaatggaagtcaccagacgctgacgatgacagcgtggcgaagtccaaacccggcgttcaggagggtatacaggtgctaggctcactctcggccagctcacgcgcgcgacccaaagccaaagatgaggacagcgacaagatccttcgccaacttttaggaaaagaaatctctgagaatgtgtgtacgcaggagaaactcagcctggagttccaggatgctcaggcttcctcgcgtaacagcaaaaaaattcctctggagaagagggaactgaaactcgccagactgcggcaactcatgcagcggtcccttagcgaatctgatacagacagcaacaactccgaagaccctaagactacccccgtccggaaggcggacaggccaaggccacagccaattgtagagagcgttgaaagcatggactccgccggtttcctgtccgcgagtcgtccaccaaatccttggatggcaactgcccatcttccaccgcaaagggccgccaaccaaacctag

SEQ ID NO: 207906 - DNA, 1767 bp, Artificial Sequence
  Description of Artificial Sequence: Synthetic coding sequence
atggaggcccccgagtacctggacctggacgagatcgacttcagcgatgacatcagcgacaatcgatctcagggcaataggcttcagaaacttggactggaagacactgatcgcgaagacgccatgggatttgggagccacagagcgaagttaaccgtggttgctgcactgggtgcttgccactgtcctgagaatgaatattcagtgacttcgctgaagaccattccagaactgtgtagaaggtgcgatactcagaacgaagataggtctgtgtctagcagcagttggaactgcggcatttctaccttgatcacaaatactcagaaaccgacaggtattgcggatgtctactccaagttccgacctgtcaagagggtctcaccgctgaaacatcagccagaaacgctcgagaacaacgaatccgatgatcagaaaaaccagaaagtcgtggagtaccagaaaggcggggaaagcgacttgggtccacagccccaggagctagggcccggggatggagttggtggtcctcccgggaaaagcagcgagccatccacaagcctgggggagctagaacactacgatctcgacatggatgagatactcgacgtaccatacattaaaagcagccagcagttagcctcttttacgaaggtgacctctgagaagagaatcctgggtctgtgcacaacaatcaacggcctgtccggaaaggcttgctctaccggctcttctgaatccagctccagtaacatggctcctttctgtgtactttctcctgtcaagagcccacaccttagaaaagcatccgctgtaatacacgatcaacacaagctgtcgactgaggaaaccgagattagtccccccttggtgaagtgcggcagcgcttacgagccagagaatcaaagcaaagacttcctgaataagaccttctccgacccacatggaagaaaggtggaaaaaactacccccgactgccagctgcgcgcattccatttgcaatccagcgctgctgagtcaaaacctgaggaacaggtgagtggcctgaacaggacatcttcccagggtccagaggaacgctcagagtacttaaagaaagtaaagtccattctgaacattgtgaaggaaggacagatcagccttttgccccatctcgccgctgacaatctggataaaatacacgacgagaatggcaataacctgctgcacatagccgcaagccagggtcacgccgaatgtctgcagcatttaacatcccttatgggtgaagactgtcttaacgagcggaacaccgaaaagcttacccccgccggtttagcaatcaaaaacggccaacttgagtgtgtgcgttggatggtcagcgaaacggaagcaatcgccgaacttagctgttctaaggatttcccctcactgatacactatgctggctgttatggccaggaaaaaatactgctgtggctgcttcagtttatgcaggaacaaggtataagtctggacgaagtggatcaggacggtaattcagcagttcacgtggctagtcagcacgggtatctcggctgcatccaaacgagattgaagattcaaggcacatggaacggcagcgaaacatgcctatttactcaccacttctcttcttacccgcctatcagctcaggactccagtgccagggtcaagaaggagtgttatttataccagaccaggtgggtgcagccacgaacaagcaggtgctgtttcagaaccagctgcctgagacgaagtcgagttactag

SEQ ID NO: 207907 - DNA, 267 bp, Artificial Sequence
  Description of Artificial Sequence: Synthetic coding sequence
atggaggcccccgagtacctggacctggacgagatcgacttcagcgacgatatatcctattcggtgacctcactcaaaacaattccggaactatgccgccggtgcgatacacagaatgaggatagatccgccacacccagctgcaggcagtcccgccagaattctagaagaaaatggaagcagagtattacatactgtggggtcacgggtacaaggagggtgtccacggctccccacttcttcgacggaaggcgcctgccccaatag

SEQ ID NO: 207908 - DNA, 297 bp, Artificial Sequence
  Description of Artificial Sequence: Synthetic coding sequence
atggaggcccccgagtacctggacctggacgagatcgacttcagcgatgatatctcatacagcgtgacttccttgaagactattccagaactgtgccgccgctgcgacacacagaacgaggataggtccgtttcctcttcaagttggaattgcgggatatccactttaatcacaaatacacagaagccaacgggaattgcagacgtttacagcaagttccgcccagttaaaagagtctctcccctcaagcatcaacccgaaactttagagaataacgaaagtgatgaccagaaatag

SEQ ID NO: 207909 - DNA, 45 bp, Artificial Sequence; identical to SEQ ID NO: 101715
  Description of Artificial Sequence: Synthetic coding sequence

SEQ ID NO: 207910 - DNA, 408 bp, Artificial Sequence
  Description of Artificial Sequence: Synthetic coding sequence
atggaggcccccgagtacctggacctggacgagatcgacttcagcgacgatatttcctactccgttacatcactgaaaacaatccccgaattgtgtagacgttgtgatacccagaatgaggatcgaagcgtctcctcatcatcttggaactgtggcattagtaccctgatcacaaacacgcagaagcccactggcattgcagacgtgtatagcaagtttcgtccagtgaaacgtgtcagccctctcaagcaccagcctgaaacgttagagaataacgaatccgatgatcagaaaaaccagaaagttgtcgaataccaaaaagggggcgagtccgatcttggaccccaacctcaggaactcggacccggcgacggcgtgggcggccccccggggaagtccagcgagtag

SEQ ID NO: 207911 - DNA, 1434 bp, Artificial Sequence
  Description of Artificial Sequence: Synthetic coding sequence
atgcaggagcagggcatcagcctggacgaggtggaccaggacggcaacagcgctgtccacgttgcatcccagcatggataccttggctgcattcagacacttgtcgagtacggcgccaatgtcacaatgcagaatcatgccggcgagaaacccagccagagtgcagagcgccaaggacacacgctgtgttcacggtacctggtcgtggttgagacatgcatgtcactggcaagccaggttgtgaagttgactaagcagctgaaagagcaaaccgtggagagggtgacactacagaaccaactacaacagtttctggaggctcagaaaagtgaaggcaaatcactcccgtccagtccttcttcccccagctcacctgcatcccggaagtctcagtggaaatcaccagacgctgacgacgattctgtggccaagagcaaaccgggcgtgcaagagggcatccaagttctaggtagtctgagtgcctcttccagagctcggcccaaggcgaaggatgaagacagcgataagattctaaggcagctccttggaaaagaaatttcggagaacgtatgcacccaagaaaagctctctttggaatttcaggatgcccaggccagtagcaggaacagtaagaagattccattggagaagagagaactaaaactcgcacgtttgcggcagctgatgcagcgcagtttgagcgagtccgacacggacagcaacaattcagaagatcccaaaactaccccagtaaggaaagcggacaggccaagaccacaacctatcgtggaaagcgtggaatctatggactccgcagagagcttacaccttatgatcaaaaagcacaccctagcaagcggcggccggaggttccccttcagtataaaagctagtaaatcattagacgggcatagtccctcacctacctccgaatcgagtgagcccgacctggaaagccaatatcccggaagtggctctatcccacccaatcaacccagtggtgatcctcaacaaccgagtccggacagtaccgcagcccagaaagtggcaacctcaccaaaatctgccttgaaatctccttcgtcaaagcgccgcacaagccagaacctgaagctccgcgtaactttcgaggagccagtggtccagatggaacagccttcgctcgagttgaatggtgagaaagacaaggacaagggacgcacgttacagcgaacctccacaagcaatgagagcggtgaccagctgaaacggccctttggagcattccgcagcataatggagacgctcagcgggaatcagaataataataacaactatcaagccgccaaccaactgaagacgtcaaccttacctctgacttctctgggtagaaaaactgacgctaaagggaaccccgctagcagcgcaagtaaaggtaagaataaggccgcctag

SEQ ID NO: 207912 - DNA, 405 bp, Artificial Sequence
  Description of Artificial Sequence: Synthetic coding sequence
atggacgtgttcatgaagggcctgagcatggccaaggagggcgtggtcgccgctgcagaaaaaaccaagcagggtgtgacagaggcagctgagaagacaaaagagggggtgctctatgtgggcagcaaaactcgcgaaggcgttgtgcagggagttgcttcagtagccgagaaaacgaaggaacaagcttctcatctcgggggggctgtgtttagtggcgcaggaaacatagcggctgcgaccggccttgtgaaacgggaggagttccctactgacctgaagccagaggaagtagcccaggaggcagcagaagagccgttaatcgaacccctcatggagcccgaaggcgaatcctatgaagatcccccccaggaggagtaccaagagtatgaaccagaagcctag

SEQ ID NO: 207913 - DNA, 405 bp, Artificial Sequence
  Description of Artificial Sequence: Synthetic coding sequence
atggacgtgttcatgaagggcctgagcatggccaaggagggcgtggtggccgcagcagagaagacgaaacaaggagtcacagaagccgcggagaaaactaaggaaggggtgttgtacgtgggaagcaaaacccgagaaggcgtggtccaaggagtggccagcgtagctgaaaaaacaaaagaacaagcttcgcacctgggcggagctgtgtttagtggcgcgggaaacatcgcagcagcaaccggccttgtgaagcgggaggaattccccactgatctgaaacccgaagaagtggctcaagaagctgctgaggagccactgatcgagccgttgatggaacctgagggcgaatcatacgaggatccaccccaggaggagtatcaggaatacgaacctgaagcttag

SEQ ID NO: 207914 - DNA, 405 bp, Artificial Sequence
  Description of Artificial Sequence: Synthetic coding sequence
atggacgtgttcatgaagggcctgagcatggccaaggagggcgtggtggccgcagccgaaaaaaccaaacagggagtgacagaagctgccgagaaaacaaaagaaggcgtcctgtatgtgggcagcaagactcgggagggcgtcgtgcagggggtcgcgtccgtggccgagaagactaaggaacaagcgtcccacctgggtggggccgtgttctccggtgcgggcaacatcgccgctgccacagggttggtgaagcgagaggaatttccaacggaccttaaacccgaggaggtggcacaagaggcagcagaagaacccctgatcgaaccgctgatggagcccgaaggcgaaagctacgaggatccacctcaagaggagtatcaggaatacgaaccagaggcctag

SEQ ID NO: 207915 - DNA, 405 bp, Artificial Sequence
  Description of Artificial Sequence: Synthetic coding sequence
atggacgtgttcatgaagggcctgagcatggccaaggagggcgtggtcgcagccgcagagaagacgaagcaaggcgtaacagaggccgcggagaagaccaaagaaggggtgctgtatgtgggatctaaaacgcgggaaggggttgttcagggcgttgcgtctgttgctgagaagactaaggaacaggcctcacacctcggaggagctgtgttcagcggggcaggcaatatcgctgccgcaactggtctcgtgaaacgcgaggagttccccaccgacctcaaaccggaagaagtcgcacaggaagccgccgaagaacctctgatcgagccactgatggagccagagggggagtcgtatgaagacccccctcaggaagagtatcaagagtatgagccagaggcctag

SEQ ID NO: 207916 - DNA, 381 bp, Artificial Sequence
  Description of Artificial Sequence: Synthetic coding sequence
atggacgtgttcaagaagggcttcagcatcgccaaggagggcgtggtgggggcggtagaaaagactaagcagggtgttactgaggccgcagagaaaactaaagagggcgtgatgtacgtgggggccaagaccaaggagaatgttgtgcagtcagtgacctccggtttaccatggggatggggatggggtggagggcaacccgtatcttctcactcaggccgtgaggaccagggcgcagggcaacggcgggagcgcggatgcggcgagcaacgccaacattgtggacatcaggaccgggggggtggaggcgagcatcgcgggcatctgaggggaggcgcacagggaggattggaggccatttgtccacccacgggaggctag

SEQ ID NO: 207917 - DNA, 384 bp, Artificial Sequence
  Description of Artificial Sequence: Synthetic coding sequence
atggacgtgttcaagaagggcttcagcatcgccaaggagggcgtggtgggggcggtggagaaaacaaagcagggcgttacagaagccgccgaaaagacgaaggaaggcgtcatgtatgttggcgcaaaaactaaagaaaacgttgtgcaatccgtcactagcgtggcagaaaaaactaaggagcaggcaaatgcagtctctgaagccgttgtgagcagtgtgaacacagtcgctactaagactgtggaagaggctgaaaacatagctgtcacatcgggagtggtacgcaaggaagatctgaggccatccgctccccagcaggagggcgaagccagcaaggagaaggaggaagtggctgaagaggctcagtccggcggagactag

SEQ ID NO: 207918 - DNA, 471 bp, Artificial Sequence
  Description of Artificial Sequence: Synthetic coding sequence
atggccggccagttccggagctacgtgtgggaccccctgctgatcctgagccaaattgtgttaatgcaaaccgtgtattacgggtctctgggtctctggctggcactggtggatggactcgtcagatcatctccttctctggaccagatgttcgacgccgaaatccttggatttagtacgcctccggggcgcttgtccatgatgtccttcattctgaatgctctgacttgcgctctcggcctgttatatttcattcgtcggggcaagcagtgtctggactttaccgtcacagtgcacttcttccatcttctcggttgttggttctactcatcccgtttcccaagcgctctgacctggtggctggtccaagctgtctgtatcgctttgatggcagtgataggtgaatatctgtgcatgcgtaccgagttgaaagagattccattaaattcagccccaaaaagcaatgtctag

SEQ ID NO: 207919 - DNA, 471 bp, Artificial Sequence
  Description of Artificial Sequence: Synthetic coding sequence
atggccggccagttccggagctacgtgtgggaccccctgctgatcttgagccagatcgtgctgatgcagaccgtctattacggaagtctggggctgtggctggcactggttgatgggcttgtgaggagctctccctcactggatcagatgttcgacgcggaaatccttggatttagtacccctccgggccgcctctccatgatgagttttatcctgaatgccctgacctgcgccctgggtctgctctattttatcaggagaggcaagcagtgcctggattttaccgtgacggtgcatttcttccatttactcggatgctggttctactccagccgatttcctagcgccctgacctggtggcttgtgcaagctgtatgcattgccctaatggccgtgataggtgagtatctgtgtatgcggactgagcttaaggagatcccactgaacagtgcccccaaatctaacgtatag

SEQ ID NO: 207920 - DNA, 357 bp, Artificial Sequence
  Description of Artificial Sequence: Synthetic coding sequence
atggccggccagttccggagctacgtgtgggaccccctgctgatcttgagccaaatcgtgctcatgcagaccgtgtattacgggagtctggggctctggctggcgttagtggacggcctggtccgcagctctccatccctcgaccagatgtttgacgccgagatactcggcttctctactccacctggacggctgtcaatgatgtcgttcatactgaacgctctaacctgcgccctcgggctgctgtactttatacggcgaggcaagcagtgtctggactttaccgtgacagttcatttttttcatctgttgggctgttggttttattctagcaggtttccttcagcccttacatag

SEQ ID NO: 207921 - DNA, 231 bp, Artificial Sequence
  Description of Artificial Sequence: Synthetic coding sequence
atggccggccagttccggagctacgtgtgggaccccctgctgatcctgtcacaaattgttctgatgcagactgtctactacggctccctaggtctctggctggcgctggtggatggactcgttcgctcatccccctccttggaccagatgtttgacgccgagatcctggggttcagcacccctccaggacggctgtctatgatgtcttttatcctgaacgctctcacctag

SEQ ID NO: 207922 - DNA, 1134 bp, Artificial Sequence
  Description of Artificial Sequence: Synthetic coding sequence
atgagcagccccggcaccgagagcgccggcaagagcctgcagtacagagtggaccacttgttgtcggcagtggagaacgagctgcaggctggttcggaaaagggggaccccaccgagcgcgaattgcgagtgggcctagaagaaagcgaactgtggctgcgctttaaagagctaaccaatgagatgatagttactaagaacggtcggcgaatgttccccgtgctcaaagtgaatgtatcggggctcgatccaaatgccatgtactcctttttgcttgattttgtcgcggccgacaatcaccgatggaagtacgtgaacggggaatgggttccgggaggaaaacccgagccgcaggccccgagctgtgtctatatacatcccgactcacccaactttggagcccattggatgaaggctcctgtgagcttctccaaagttaagctgaccaataaactgaacggagggggccagataatgttgaattccctgcacaagtacgaaccacgcatccacattgttcgagtgggcgggccacagcgcatgattacttctcattgttttccagagacccagttcatcgctgtcaccgcttatcagaacgaggagatcaccgctctgaagattaagtacaaccccttcgccaaggccttcctggatgcaaaggagaggtcagaccacaaggagatgatggaggagccgggcgactcccaacagccagggtactctcagtcgtattccgacaatagccccgcttgtttgtcaatgctccaaagccacgacaattggtcttctctgggcatgccagcacacccatccatgttgcccgtgagtcacaacgcttcaccaccgacttctagttcccagtatccctccctgtggagcgtgtctaatggcgccgtcacaccaggatcccaagccgctgcagtcagtaatggtctgggcgctcagttttttcgagggagcccagcccactacacaccgctgacacatcctgtgagtgcccccagcagctccgggtcccctctgtatgagggtgctgctgccgccactgatatcgtggacagccagtacgatgctgcagctcagggtaggctaattgcctcctggactcctgtgagccccccaagcatgtag

SEQ ID NO: 207923 - DNA, 735 bp, Artificial Sequence
  Description of Artificial Sequence: Synthetic coding sequence
atgcggtggtgcctgctgctgatctgggcccagggcctgcggcaggccccacttgcatccggcatgatgaccggcaccattgagacgaccgggaatatctccgctgagaaagggggttcaatcatactgcagtgtcacctctcctcaaccactgctcaggtgacacaggtgaattgggaacagcaagatcagctgttggctatctgtaacgcagacctgggatggcatatctccccatctttcaaagatagagtggctcctggacccggactcgggctcacactccaatctctgacagtcaatgacactggcgagtacttctgtatttaccacacgtatccagatggcacatacacaggccgaatttttctcgaggtgttagagagtagtgtggcagagcatggcgcgagattccagattcccctacttggagccatggcagctacgctggtggtgatctgcaccgccgtaatcgtggtcgtggcgcttaccaggaaaaagaaggccttacgcattcacagtgtggagggggacttgcggcggaaatctgccggccaggaggaatggagccccagtgccccaagtcccccagggtcgtgtgtccaggcagaggctgcacctgccggtctctgtggagagcaaaggggtgaggattgcgccgaactccatgactatttcaatgtgttatcctaccgatctctggggaattgttcttttttcacggagaccggatag

SEQ ID NO: 207924 - DNA, 936 bp, Artificial Sequence
  Description of Artificial Sequence: Synthetic coding sequence
atggccttcctggtggcccaccccatgcagttcgtgtacctgctgacaacactgtgcgtgttcaatatggtctttgccaaattaggattcagcgagacagttttttctcagcgactgtccttcactgtcttaagcgctgtcggctactttcagtggcagaaaaggccacatctactcccggtgggtcccctcggaagatctatgagatggtgccttctgctcatttgggcccagggactccgccaagcacctctggcctcaggaatgatgacaggcacaatcgaaactacgggcaatatctctgctgagaagggtggatcaattatactccaatgccacttaagctcaaccactgcccaggtgactcaggtgaattgggagcagcaggatcagctgcttgcgatatgtaacgcggatctgggatggcacatttctccatccttcaaggatcgagtggctccaggcccaggccttgggctgaccctacagtctctgacagtgaacgacaccggagaatacttctgtatttaccacacctatccggatggtacttacacaggccgaatattcttggaggtgctggaatccagcgtggctgaacacggtgcacggttccaaatcccacttctgggtgctatggcagcaaccttagtcgttatttgtacggctgtcatcgtggtcgtggccctgacccgcaaaaagaaagctctgcgaatccacagtgtggaaggggacttgagacggaagtccgcaggacaggaagagtggtcgcctagcgctccttccccccctggctcatgcgtgcaagccgaggcggcgccagcaggtctttgcggagagcagaggggcgaggactgtgccgaactgcatgactacttcaacgtgctgagctaccggtcccttggaaattgctcattctttaccgaaaccggctag

SEQ ID NO: 207925 - DNA, 735 bp, Artificial Sequence
  Description of Artificial Sequence: Synthetic coding sequence
atgcggtggtgcctgctgctgatctgggcccagggcctgcggcaggcccctctggcctcaggaatgatgacggggaccattgagacaaccgggaacatcagcgcagaaaagggcgggtctattatactgcagtgccacctgtctagtaccacagcccaggttacacaggtgaattgggagcagcaggaccagctgctggcaatttgcaacgccgatctggggtggcatatttccccctctttcaaagatcgggtggcccccggaccgggcttgggactaacacttcagtcgttgacagtgaacgatacaggcgagtatttctgcatctaccacacttacccagacggtacctataccggacgtatctttctcgaagtgctagagagtagcgtagccgagcacggcgcccgcttccagatccctctcctgggcgcgatggctgccaccctggtcgtcatctgcactgccgtaatcgtagttgtcgctcttacgaggaagaagaaagcattgcgaatccatagcgtggaaggtgaccttagacgtaaatcagccgggcaggaagagtggtctccctctgcaccaagccccccaggcagttgcgtccaggccgaagctgcacctgcaggcctttgtggtgaacaacgcggcgaagattgcgcagaactccacgattattttaacgtgctctcatatcgctctctcggtaactgctccttctttacagagactggatag

SEQ ID NO: 207926 - DNA, 561 bp, Artificial Sequence
  Description of Artificial Sequence: Synthetic coding sequence
atgagcggcatcagcggctgccccttcttcctgtggggcctgctggccctgctgggactggccctggttatttcgctcatcttcaacatttctcattatgtcgagaaacagagacaggataaaatgtacagttactccagtgaccatacaagggtggatgaatactacattgaagacacaccaatctatggtaacctggacgacatgataagtgagcccatggacgaaaactgttacgagcagatgaaagctaggccggagaagtccgtaaacaagatgcaggaagccacaccaagtgcacaggccacaaatgagacccagatgtgctacgctagcctggatcattctgtgaaagggaaaaggaggaagccgaggaagcaaaatacacacttctccgacaaggacggtgatgaacagttacatgcgatagacgcgagcgtatccaaaacaaccttagtggactcgttttcaccagagagccaggcagtggaagagaacattcatgatgatcctattcggctctttggactgattcgggccaaaagggagcccatcaattag

SEQ ID NO: 207927 - DNA, 1308 bp, Artificial Sequence
  Description of Artificial Sequence: Synthetic coding sequence
atgagcagccccggcaccgagagcgccggcaagagcctgcagtacagagtcgatcatctgctctcagctgtggagaatgaactacaggcaggctccgagaaaggtgatccaaccgaaagggagctgagagtcgggctggaagaatccgaactttggctgagatttaaggagttaaccaatgaaatgatcgtgactaagaatggacggcgcatgtttcccgtgctgaaggtgaatgtatctggactagacccaaacgctatgtattctttcctgcttgatttcgtggctgctgataaccaccggtggaagtacgttaatggggaatgggtgcccggagggaagcccgagccacaagcaccctcctgcgtctacatacatcccgattcgcccaacttcggtgcccattggatgaaagctccagtctccttttccaaggtgaagcttacgaacaagctaaacggggggggtcagattatgctgaactcgctgcacaaatatgaacccagaattcatatcgtacgtgtgggaggtccgcagcgtatgatcacaagtcactgtttccctgagactcagtttattgccgtcacggcttatcaaaacgaggagattacggctttgaaaatcaagtataacccctttgccaaggcttttctggacgccaaggagaggagcgatcacaaggaaatgatggaggagccaggagactctcaacaacccgggtactcccagtggggatggttgctgcctggaaccagcacattgtgcccccctgccaaccctcacccccagttcggcggcgccttgtctctgccgagtactcactcctgcgacagataccctactctgaggagccacagaagcagtccttatccttctccatatgctcataggaataactctcctacatacagcgacaactcccccgcctgtctcagcatgctacagtctcacgacaattggagttcattaggcatgccagcccatcctagtatgctgccagtcagccacaatgcctctcctcccactagcagtagccagtacccttctctgtggtcagtgagcaacggagccgtcacccctggcagtcaggcagccgcagtctccaatggattaggggcacagttcttcagggggtcgccagcccactacactcctctcacccatcctgtgagcgcgccttcatcttccgggtctcccctgtatgaaggcgctgctgctgctaccgatatcgtggacagccagtacgacgctgctgcacagggtcgtctcattgcatcttggacccccgtctccccaccctctatgtag

SEQ ID NO: 207928 - DNA, 732 bp, Artificial Sequence
  Description of Artificial Sequence: Synthetic coding sequence
atgagcagccccggcaccgagagcgccggcaagagcctgcagtaccgggtggatcaccttttgtccgccgtcgaaaacgaactgcaagccggaagtgagaaaggcgaccctacagagcgtgagctgcgcgtgggattagaagagtccgaactctggctcaggtttaaggagttaacgaacgagatgattgtaacgaaaaatggtagacggatgttcccagttctgaaagtcaatgtctcaggactggatcccaacgccatgtacagcttcctcttagattttgttgccgctgacaaccacagatggaagtatgttaatggagaatgggttcccggcgggaaaccagagccacaggccccgtcatgcgtgtatattcaccctgattcaccgaatttcggggcccactggatgaaagccccagtatcattttctaaggtaaagctgacaaacaaactcaatggaggtggacaaataatgcttaactccctccacaaatacgagcccaggatacacatagtgcgtgttgggggaccccagcgcatgatcacgagtcactgcttcccggaaacccagttcatcgcggtgactgcttatcagaacgaagagatcaccgccctcaaaataaaatacaatccgtttgctaaggcttttttggacgcgaaggaaaggtctgatcacaaagagatgatggaagaaccgggcgatagccaacagccgggctattcgcagtag

SEQ ID NO: 207929 - DNA, 366 bp, Artificial Sequence
  Description of Artificial Sequence: Synthetic coding sequence
atgcggatcatgctgctgttcaccgccatcctggccttcagcctggcccaatcctttggggcagtctgtaaggaacctcaagaagaagtcgtccccggcggggggcgttcgaagcgagatcctgatttatatcagctcctgcaaagactgttcaaaagtcactcatctcttgaagggctcctgaaagcactgtcgcaagcctccactgaccccaaagagagcacgagtcctgagaagcgggacatgcacgacttttttgttggcctcatgggaaagcggtcagtgcagcccgactccccaacagatgtaaaccaagaaaatgtgccctccttcgggatactgaaataccccccccgagccgaatag

SEQ ID NO: 207930 - DNA, 366 bp, Artificial Sequence
  Description of Artificial Sequence: Synthetic coding sequence
atgcggatcatgctgctgttcaccgccatcctggccttcagcctggcccagagcttcggtgcagtgtgcaaggaaccccaagaggaggtggtgcctggaggcggccggtccaaacgggaccccgacctttatcaactactccaaagactttttaagtctcacagttcactcgaaggactgcttaaagcactgtcccaggcgagcacagaccccaaagaatccacatcccccgaaaaaagagacatgcatgactttttcgttggactgatgggcaagcggtccgtacagcctgatagtccaaccgacgttaatcaggaaaacgtcccctcgttcggaatattgaaatatcccccccgggcggaatag

SEQ ID NO: 207931 - DNA, 312 bp, Artificial Sequence
  Description of Artificial Sequence: Synthetic coding sequence
atgcggatcatgctgctgttcaccgccatcctggccttcagcctggctcaatcctttggcgccgtttgcaaagaacctcaggaagaagtcgtccccggcggcggtagatccaaaagggaccccgatctgtaccagttgcttcagagactcttcaaatcccatagtagccttgagggactgctgaaagccctgagccaggcgagcaccgatccaaaagaatccactagtcctgaaaagcacagtcccaccgacgtgaatcaagagaatgttcctagtttcggtatcctgaagtatcccccccgagcggaatag

SEQ ID NO: 207932 - DNA, 366 bp, Artificial Sequence
  Description of Artificial Sequence: Synthetic coding sequence
atgcggatcatgctgctgttcaccgccatcctggccttcagcctggctcagtctttcggtgccgtctgcaaagaaccccaggaagaggttgtccccggaggcggcaggagcaagagggacccggacctgtaccaactgctgcaaagattgtttaagtctcactcatcccttgagggcctcctgaaggctctgagccaggcttccacagacccaaaagagagcaccagcccagagaaaagggacatgcatgatttctttgtgggcttaatgggcaagagatctgtccagccagattcaccaaccgacgtgaaccaagagaacgtaccatccttcggaattctgaaatacccacctcgggcagagtag

SEQ ID NO: 207933 - DNA, 1224 bp, Artificial Sequence
  Description of Artificial Sequence: Synthetic coding sequence
atggacaacgtgctgcccgtggacagcgacctgagccccaacatctctaccaacacaagcgagcccaaccagtttgtgcagcctgcctggcaaattgtgctatgggccgctgcctacacagtcatcgtggtgacctctgtggtcgggaacgttgtggtgatgtggattatattggctcacaaaagaatgagaacagtgaccaactacttccttgttaacctagcgttcgctgaggcttcgatggccgccttcaatacagtcgtgaactttacctacgcagtgcacaatgaatggtactacggcctcttttattgtaagttccacaatttctttcctatcgccgccgtatttgccagcatctattcaatgacagccgtggctttcgatcggtatatggccattattcatcctctgcaaccgaggctatcagctacagcaacaaaggtggtaatttgcgttatctgggtgctggccctcctacttgcattcccccaaggctactacagcaccaccgaaaccatgccatcaagagtcgtgtgcatgattgagtggccggaacaccctaacaagatatacgagaaggtatatcacatttgtgtgacagtcctcatttatttcctgccactcctggtgatcggatacgcctatactgtcgtggggatcaccctctgggcctccgagatacctggcgatagcagcgataggtaccacgaacaagtcagtgcaaagaggaaggtcgtcaagatgatgattgtggtagtttgcacctttgccatctgctggctcccattccatatcttctttctgcttccctatatcaacccggacctatacttaaagaagttcatacagcaggtgtacttggcgattatgtggctggctatgtcctcgacaatgtataacccgatcatttactgttgcttaaacgatcgattcagattgggtttcaagcacgccttcagatgttgtcccttcatctccgctggcgattacgagggcctggaaatgaagtccacgcggtatctgcagactcaggggtctgtctataaagttagcagacttgaaactacgatctccaccgtggtgggcgcccacgaggaggagccggaagacggccctaaggccacaccttcatcgctggatctgacatccaactgctcatctcgctctgactccaaaaccatgacagagtcgttttccttttctagtaatgtactcagctag

SEQ ID NO: 207934 - DNA, 936 bp, Artificial Sequence
  Description of Artificial Sequence: Synthetic coding sequence
atggacaacgtgctgcccgtggacagcgacctgagccccaacatcagtactaataccagtgaaccgaatcagtttgtccaaccagcgtggcagatagtgctctgggccgctgcatataccgtgatcgtggtgacgtccgtggtgggtaatgtcgtggtaatgtggattattctggcacataagcgaatgagaacagtgaccaattacttcctcgtgaaccttgcctttgccgaggccagcatggccgcttttaacaccgtggtgaattttacatatgcagtccacaacgagtggtattatggcctgttttactgtaaatttcataatttctttcctattgccgctgtttttgcttcgatatattcaatgactgccgtggcgttcgatagatacatggcaatcatccacccgttacaaccccgcctgtccgcgaccgccactaaagtggtgatctgtgtcatctgggtgcttgctttactgttggcctttccccaaggctattattccaccacagagacaatgccaagccgagtggtgtgcatgattgagtggcccgaacatcccaacaaaatctacgaaaaagtgtatcacatttgcgtgaccgtgctcatctatttcctgcctctgctggtgatcggctacgcctatacagtcgtgggcattactctgtgggcgagcgaaattcctggggactcctcagaccgataccacgagcaggtcagcgctaagaggaaggttgtgaagatgatgattgtggtggtgtgtactttcgccatttgctggttaccctttcacatcttttttttgcttccctatatcaaccctgacctgtatttgaagaagtttattcagcaagtgtatctggctattatgtggttagcgatgtccagtacgatgtataatccaataatctactgttgcctgaacgaccgctag

SEQ ID NO: 207935 - DNA, 1197 bp, Artificial Sequence
  Description of Artificial Sequence: Synthetic coding sequence
atgggcacctgcgacatcgtgaccgaggccaacatcagcagcggcccggaatccaacacaactggaatcacggccttctccatgccttcttggcagctggccctgtgggctacggcatatcttgccctggtgctggtggcagtgacaggaaacgccatagtgatatggatcattttggcccaccggcgcatgcggaccgtgaccaactattttatagtgaatcttgctcttgccgatttgtgcatggcagccttcaatgcagcctttaactttgtatatgctagccacaatatatggtacttcggcagagcattctgttactttcagaacctatttcccatcacagcaatgttcgtcagcatatattctatgacagcgattgcagccgaccgctacatggcgattgtacatcctttccagccccgcttgtcagctcccagtaccaaggcagttatcgctgggatctggctggtggcccttgcgcttgctagcccacagtgtttttactctactgtgaccatggaccagggtgccaccaaatgtgtcgtggcttggcctgaggattcaggaggcaagacactgcttctttaccacctcgtggtcatcgccctcatctactttctgccactcgcagtgatgttcgtcgcttacagcgttattggtcttacactgtggcggcgggccgttcctggccatcaggcacatggcgctaacctgagacacctgcaggccatgaaaaagttcgtaaagaccatggtgctggttgtgctgaccttcgccatctgttggctcccgtatcatctctacttcatcctaggtagctttcaagaagatatttattgccacaaatttattcagcaggtctatctcgcacttttttggctcgccatgtccagcactatgtataaccccatcatctactgctgtttgaatcatcggtttcgaagtgggtttcgcctcgcattcaggtgttgtccttgggtcacccccactaaggaagataagctcgagctgacccccacaacatctctgtccacacgggtgaaccgctgccatactaaagaaacattatttatggccggagacacagctcccagcgaagccacctccggcgaagccggccgaccacaggatggaagcgggctctggtttgggtatggcctgctggcacctaccaagacacatgtcgagatatag

SEQ ID NO: 207936 - DNA, 561 bp, Artificial Sequence
  Description of Artificial Sequence: Synthetic coding sequence
atgttcgtggcctacagcgtgatcggcctgaccctgtggcggcgggccgtccctggccatcaggctcacggggccaatctccgacacctgcaggctatgaaaaaatttgtcaaaacgatggttctggtagttctgacgtttgctatttgttggctgccataccatctctattttattctggggtcctttcaggaggatatctattgccacaagttcattcaacaagtctacctggccttgttttggctggcaatgtcctccaccatgtacaaccccataatttattgctgcctcaatcataggtttaggagcggcttccggctagcttttcggtgctgcccgtgggtgacccccacgaaggaagataaactagagctcactccgactaccagtctatccacacgcgttaacagatgtcacactaaagaaacacttttcatggctggtgatacagccccgtctgaggcaacctccggggaagcgggacgaccgcaggacgggagcggcttgtggttcggctacgggctgctggctcctacaaagactcatgtggaaatatag

SEQ ID NO: 207937 - DNA, 1398 bp, Artificial Sequence
  Description of Artificial Sequence: Synthetic coding sequence
atggccaccctgcccgccgccgagacctggatcgacggcggcggcggtgttggggcggatgctgtgaatctgactgcaagcctcgccgctggggcagcaactggcgcagtcgaaaccggatggcttcagttgcttgaccaggccggtaatctgtctagttctcccagtgcgttaggacttcccgtcgcatcccccgctccgtcccagccatgggctaatctgacgaaccagttcgttcaacctagctggaggatcgccctctggagtcttgcctatggagtagtggttgcggtggccgtgttgggaaacctgattgttatctggatcattttggcccataagcgcatgcggacggtaacaaattactttctcgtaaacctagccttttctgacgccagcatggcagcttttaacaccctcgtgaattttatctatgccctgcattccgagtggtacttcggcgctaactactgtagattccagaatttcttccctattacggcagtcttcgcctcaatatactcaatgacagccattgcagtggaccgctatatggccattatagatccactgaagccacgccttagcgctacggctactaaaattgtgatcgggtccatttggattctggcctttcttctggcatttccccaatgcctctacagtaagaccaaggtcatgcccggtaggaccctttgtttcgtccagtggcccgagggccccaaacagcatttcacgtaccacatcatcgtgatcatcctcgtttattgcttcccactcctgattatggggatcacatatactattgtgggaattaccctatggggcggcgagatccccggagatacctgtgataagtaccacgaacagctgaaggcgaagagaaaggtcgtgaagatgatgataatcgtagtgatgacattcgcaatctgctggcttccttaccacatctactttatcttaactgccatttatcagcaacttaatagatggaagtacatccagcaggtctatctggcgagcttttggctcgcaatgtcttccactatgtataaccctatcatctactgctgtctgaataagagattccgtgcaggttttaaaagggcctttcggtggtgtccttttattaaagtgtcatcctacgatgagctcgagcttaagacaacccgcttccatccaaacaggcaatctagcatgtatactgtgactcgtatggagtcgatgacagttgtcttcgacccaaacgatgccgacactacacggtcttcccgcaaaaaacgcgccactcctagagacccaagttttaatggatgcagtagacgcaattcaaaatccgcttccgccacctcatcttttatttcttcaccatacacgagcgtagacgaatattcttag

SEQ ID NO: 207938 - DNA, 5682 bp, Artificial Sequence
  Description of Artificial Sequence: Synthetic coding sequence
atgggccccggctgcgacctgctgctgcggaccgccgccaccatcactgcggctgctatcatgagtgacactgacagcgatgaagactccgcagggggaggccctttctccctggccggttttctgttcggcaatatcaatggagccggacagttggagggagaaagtgtacttgacgatgaatgtaagaaacacttggctgggctcggtgcactcgggttggggtccctgatcaccgagctaacggctaacgaagagttgaccggaacagacggcgctctggtcaatgatgagggctgggtccggagcacagaggatgccgtggactactccgacataaatgaggtggccgaggacgagtctaggagatatcagcagaccatgggctcacttcagccgctctgtcatagcgattacgacgaggacgattacgacgcagattgtgaggatatcgactgtaagctgatgcccccgcctccccctccgcctggcccaatgaaaaaagacaaggaccaagatagcatcacgggtgtatccgaaaacggcgaagggatcattttgccctcgattattgcccctagctcacttgcatccgaaaaggtggatttcagcagcagcagcgacagcgagagtgagatgggaccccaggaagccacccaggcggaaagtgaagatggaaagttgacacttcccctggcggggatcatgcaacacgatgcgacaaagttgctaccttccgtgactgaactctttccggagtttcgccctggaaaggttttgaggtttttaaggctgtttgggccgggaaagaacgtgccaagcgtctggagatcagctagacggaaacgaaagaagaaacacagagaactcatccaggaggaacagatccaggaagtcgagtgctccgttgagagtgaggtgagtcaaaagtctctctggaactacgactacgccccacctccgcctcccgaacagtgcctgtctgacgatgaaattaccatgatggcacctgttgagtctaaattttctcaatcgaccggggacatagacaaggtcaccgatacaaagcctcgggtggccgagtggcgttacggacccgcccgcttatggtatgatatgctcggtgttccagaggacggatcaggttttgactacggcttcaagctgcggaagactgagcatgagcctgtgattaagtcccgcatgatagaagagttcagaaagctggaagaaaataacggcacagacctgctcgccgacgaaaattttttaatggtcactcagctacactgggaagatgacatcatttgggacggtgaagacgtgaaacacaaaggaacgaagcctcagcgagcttcactggccggctggctgccctctagtatgacccgcaatgccatggcatataacgtccagcagggatttgcagctactcttgatgacgataagccatggtactccatttttccaatagataacgaggatctggtctacggccgctgggaagacaacatcatctgggatgcacaggcgatgccccgattattagagcctcctgtgctgactctcgaccctaatgacgagaatttgattctggagattcctgatgaaaaggaggaagcaacgagtaactctccttcaaaagaatccaaaaaagagagtagtctgaagaagagccgtatactgttggggaagacgggcgtgattaaggaggagccacagcagaacatgtcccagccagaagtaaaagacccttggaacctgtccaacgacgaatactattatcctaagcagcaaggcctaaggggcaccttcggaggcaacattatccagcatagcatccccgctgtggaactgagacaaccattctttcctactcacatggggccgataaagctgaggcagtttcataggccgcctctcaagaagtattcttttggcgccctgtcccagccaggtcctcactctgttcagccccttcttaagcatatcaagaaaaaggctaaaatgagagaacaggagcgccaggcatccggagggggggagatgttttttatgaggacaccccaagacctaaccgggaaagatggtgacttgatcctcgccgagtactccgaagagaacggaccgctgatgatgcaagttgggatggcgaccaagattaagaactattacaaaagaaagccaggcaaggacccaggcgcaccagactgcaagtatggagaaactgtctactgtcacacgagtccctttttagggagccttcatcctggccagctgctgcaagctttcgaaaataacctgtttcgcgcccctatctatctccataaaatgcccgaaactgactttctcattattagaaccaggcaaggttactatatcagagagcttgtcgacattttcgtggttggccaacagtgcccgctcttcgaggtccctgggccgaactctaagcgggccaatacccacattagagactttctccaggttttcatttatagattgttctggaaatctaaggacagaccaagaaggatcaggatggaggacatcaagaaggcattcccttcccacagtgagtctagcatcagaaagaggctgaagctctgtgccgatttcaaacgaacgggaatggattccaattggtgggtgttgaaatcagacttccgtctgccaacagaggaagagatccgagccatggtgtccccagaacagtgttgtgcctattattccatgatcgccgccgagcagaggttgaaagatgcggggtacggcgagaaatctttcttcgctcctgaggaggagaatgaagaagacttccaaatgaagattgacgacgaggtgcgcactgccccttggaatacaacgcgggccttcattgccgccatgaaaggaaaatgtcttctggaagtcactggagtggccgaccccactgggtgtggagaagggttctcttatgtgaagattccaaataaacctacgcagcagaaagacgacaaagaaccgcagcccgtgaaaaagacagtgaccggcactgacgctgacctgcgaagactcagtctgaagaacgcaaagcagctgctacggaaatttggagtgccagaagaagagatcaagaagctgagtaggtgggaagttattgacgtggtgaggaccatgagcacagaacaggctagaagcggggagggacctatgtctaaattcgcgaggggtagcagatttagtgtcgccgagcatcaggagcgttataaggaagaatgccagaggattttcgatttgcaaaacaaggtgctatcctcaaccgaggtgctctcaaccgatactgattcaagctcggccgaagactcagacttcgaagagatgggtaagaacatcgaaaacatgctgcagaacaagaaaacatcatctcagctgtcacgcgagcgtgaagaacaggaaaggaaggagttacagcgaatgctgttggccgcggggtctgccgcttcagggaataaccacagagatgatgacacagcctctgttacaagtcttaattcaagcgccacaggtaggtgccttaagatttatcggacttttagggacgaagagggaaaggaatatgtccgatgcgagacagtgagaaaacctgctgttatcgatgcctatgttagaatacggacgacgaaagacgaggaattcatcaggaagttcgctctgttcgatgagcagcacagagaggagatgcgaaaagaaagacgacggattcaggaacagctgcgccggctgaagaggaaccaggagaaagagaagctgaagggccccccagaaaagaagcctaagaagatgaaagaacgtccagacctgaaactcaagtgcggcgcgtgcggcgctattggacatatgcggaccaataagttttgccccctttactaccagacgaatgctcccccaagtaacccagtggcgatgactgaagagcaggaggaggaactcgagaaaacagtgattcacaatgataacgaggagctgataaaggtggaaggaaccaaaattgtgctgggaaaacagctgatcgaatcggccgacgaggtccgcaggaaaagccttgtactgaagtttcccaaacagcaactgccgccgaagaagaaacggagggtggggactacggttcactgcgactacctgaaccgccctcataagtccattcacagacgccgaacagacccaatggttactttgtcatccatcctggagtccatcatcaatgacatgcgcgacctgcccaacacttaccccttccacacccccgtcaatgctaaagtggtgaaggactactataagatcataactcgtccaatggatctgcagaccctaagagaaaacgtcagaaagcgcctgtacccctctcgggaggagtttcgtgagcacctcgagctgatcgtgaagaactcggccacttacaacggacctaagcacagcctcacgcaaataagccagtccatgctcgacctgtgcgacgagaaattaaaagagaaggaagacaagctagctcgcctggagaaagccattaatccactgctagacgacgacgaccaggttgcatttagctttattctagataacatcgtgactcagaagatgatggccgtcccggatagctggcctttccatcatcctgtcaacaagaaattcgtgccagactactacaaggtgatcgtcaaccccatggatctggaaacaattcgaaagaatatatctaagcacaaatatcagtcccgggagagcttcctcgatgacgtgaaccttatactggcgaacagcgtgaagtacaatggacctgaatctcagtacacgaagacagcccaggagatagtcaatgtgtgttatcagactctcacagagtacgacgagcatctcacccaactcgaaaaagacatttgtacagcgaaagaggctgccctagaggaggcagaactggagagcctcgacccaatgacccctggcccttacaccccccaacccccggacttatatgacaccaatacgagcctttctatgtctcgtgatgccagcgttttccaggacgagtcaaacatgagtgtcttagacatcccctctgccacgccagagaaacaggttactcaggagggcgaggatggcgatggcgacctcgcagacgaagaggaaggtacagtgcaacagccacaggcctccgtattgtacgaggatctgctgatgtccgagggagaagacgacgaagaggacgccggcagcgatgaagagggggataaccctttttccgccatccaacttagcgagtctgggtcagattccgacgtggggagcggcggcatcaggcccaaacaaccacgcatgctgcaagaaaacaccagaatggatatggaaaatgaggagtccatgatgagttacgagggagacggtggcgaggcgagccacggactggaggatagtaatatctcgtacgggtcttatgaagagccggaccccaagtctaacactcaagacacgtccttctcatcaatcggcggctacgaggtgtctgaagaggaggaggatgaggaggaggaggagcagaggagtggaccatctgtcctgagtcaggtacacctgtccgaagacgaagaggactctgaggatttccacagcattgctggcgatagcgacctggattccgacgagtag

SEQ ID NO: 207939 - DNA, 5619 bp, Artificial Sequence
  Description of Artificial Sequence: Synthetic coding sequence
atgggccccggctgcgacctgctgctgcggaccgccgccaccatcacagccgccgccattatgagcgatactgactctgatgaggatagtgccggcggtgggcccttttcactggccggcttcctcttcgggaatattaatggcgccggtcaattggaaggagagtccgtcctggacgacgaatgtaagaaacatctggccggtctcggagccctgggactggggtccctgatcaccgagctcactgccaatgaggaactgacaggaacggacggcgccttggtcaacgacgagggctgggtgagatctaccgaagatgcggttgattactcggatatcaatgaggtggctgaagacgaatcccggcggtatcagcaaacaatgggtagcttacagcccctgtgccatagtgactacgatgaggacgactacgatgcagattgtgaagatattgactgtaagctgatgcccccacccccacccccgcccgggccaatgaaaaaggacaaagaccaggacagtataacgggtgaaaaagtggacttctcttcttcttccgactccgagtcagaaatgggcccacaggaagccacccaggccgagtctgaagatggtaaactcaccctaccactggccggcatcatgcaacatgacgcaaccaaactgctcccaagcgttacagaactgtttccagagttccgtcccggcaaggtgctgagattcctccgactgttcgggcccggaaaaaacgtgccaagtgtgtggcggagtgcccggagaaagcgcaaaaagaagcacagggagctgatacaggaggagcaaatccaggaggttgagtgcagcgtggagagcgaagtgagccaaaaatctttgtggaattatgattacgccccaccacccccccccgagcagtgcctctccgatgatgaaatcacaatgatggccccagtggagtcgaagttctctcagtccacaggagatattgacaaagttactgatactaaaccaagggtcgcggaatggcggtacggcccagctagactgtggtatgatatgctgggggttccggaagacgggagtggattcgattacggatttaagctcagaaagaccgaacacgaaccagtgataaagagccggatgattgaagagtttagaaaactggaggagaacaatggaactgacctgctcgcagacgaaaactttctgatggtaactcagttgcattgggaagacgatattatttgggacggcgaagacgtgaaacataagggaacaaaaccacagcgcgcctctctggctggctggttgccttcttctatgactagaaatgctatggcctacaatgttcagcagggctttgccgcaacattagacgatgacaaaccatggtactcaatcttccctattgataatgaggacctggtgtatggcagatgggaggacaatattatctgggatgcacaggcaatgcctagactgctggaacctccagttttgactctggaccctaatgatgagaacttaattcttgagatcccagacgagaaagaggaagcgacgtctaactctccgagcaaagaatccaagaaagaatcctcattgaaaaagtccaggattctgctgggaaagaccggtgtgattaaggaggagccacagcaaaacatgtcccagcctgaggtgaaggatccatggaatttgagtaacgatgagtattactatcccaaacaacaggggctcagggggacattcggcggcaatatcattcagcattcaatacctgctgtagaactgcggcagccctttttccctactcacatgggacccattaaactgcgacagttccatagaccaccactaaagaaatatagcttcggagccctcagccagcccggcccccacagcgttcagccgctgctgaaacacattaaaaaaaaggccaagatgcgcgagcaggaaagacaagcctcaggtggtggcgagatgtttttcatgcgcacaccgcaggatctgaccggtaaggacggcgatctgatccttgcggaatatagcgaggaaaacggtcccctgatgatgcaggtgggaatggcaacgaagatcaagaactactacaagcgcaaaccgggcaaagatccaggggcgccagattgtaaatatggggagacagtctactgtcacacctcacccttcctggggagtctgcaccctggccagctcctccaagctttcgaaaataatctgttcagagcccccatctatctgcataaaatgccagagacagatttcttaatcatcagaacgagacaggggtattatatacgcgagctggtggacattttcgtggtgggccagcagtgtccgctgtttgaggttcccggccccaattccaagcgcgcaaatacccacatccgggattttctgcaggtatttatctatagactcttttggaagagcaaggataggcctaggcgcataaggatggaagatattaagaaagcgtttcctagccactcagagtccagcatccgcaaacggttgaaactctgtgcggactttaagcgcacagggatggatagcaattggtgggtcttgaaaagcgacttccgtcttcctacagaggaagaaattcgagccatggtcagtcccgagcaatgttgtgcctactacagcatgatagccgctgagcaaagactcaaagacgcaggctatggcgaaaaaagctttttcgccccagaagaagagaacgaggaggatttccaaatgaagatagatgacgaggtccgcaccgcaccttggaataccacccgagcctttattgctgcaatgaaggggaagtgcctccttgaagttacaggggtggcagacccaacaggctgcggagaaggcttttcctacgtgaagatccccaataagcccactcagcagaaggatgataaggagcctcagcccgtgaagaagactgtcacgggtaccgacgcagatcttagacgcttgtcgctcaagaatgcgaaacagctgcttaggaagtttggtgtccccgaagaggagattaagaaactgtctagatgggaagttatcgatgtcgttaggaccatgagtactgagcaggcaaggtctggcgagggaccaatgtccaaattcgccagggggtctagattttccgttgcagagcaccaggagcggtacaaagaggaatgtcagcggatattcgatctgcaaaacaaagtcctgtctagtacagaagtgttaagcacagatactgattcttcttcggcagaggattcagattttgaagaaatggggaagaacattgagaacatgctacagaacaagaaaacctcgagtcagctgtcacgggagcgtgaggagcaggagagaaaagaactccagaggatgttgctggctgctgggagcgctgcttccggcaataaccacagagacgatgacactgcttccgtcacgtctctaaattcgagcgccaccgggagatgtctcaaaatttacaggacctttagggatgaggaaggcaaagaatatgtacggtgcgagacggtaagaaaacctgcagtgatcgacgcctacgttagaatccgcactacaaaggacgaggagttcatccggaagttcgcgctattcgatgagcagcacagagaggaaatgcgcaaggagcgcaggcgtatccaggaacagctgcggagactgaaacggaatcaggagaaagaaaagctgaaaggcccccccgagaagaaacccaaaaagatgaaggagagaccagacctgaaacttaagtgtggcgcttgtggtgctattgggcacatgcgtaccaataagttttgccccctttactatcaaacaaatgctcccccctccaatcccgtcgcaatgaccgaggaacaagaggaagaattggaaaaaactgtgatccataatgacaacgaagaactgataaaggttgaggggaccaagattgtgctgggtaaacaactgatcgagagcgctgacgaagtgaggagaaagagtctggtgctcaagtttccaaaacaacagctgccaccaaagaaaaaacggcgtgtgggaacaactgttcattgcgactatctgaaccgccctcacaagtccatacaccggcgccgaacagatcccatggtcactctgtcttctatcctcgagagcataattaatgacatgcgagatttaccaaacacgtatcccttccatacacccgtgaatgctaaggtggtgaaagactactacaagattatcactcgacctatggatcttcaaacgttacgcgaaaacgtacggaaacgtctttatccctctcgggaagagttccgcgaacaccttgagttgatcgttaagaacagtgcaacgtataacggtcccaagcactccttgacacagatctctcagtccatgctcgatctgtgtgacgaaaaactaaaggaaaaggaggataaattggcccgtctcgagaaggcaattaatcccctgctcgacgatgacgaccaggtcgctttctcttttatactggataacatcgttactcaaaagatgatggccgtccccgactcctggccgttccaccaccctgtgaataaaaagtttgttcctgactactataaggttatcgtgaaccctatggatctcgaaactatcaggaagaacatcagtaagcacaagtaccagtcgagagagtcttttcttgatgacgtgaatctgatcctggcgaatagcgtgaagtataatgggcccgaatcccagtacacaaaaaccgcccaagagattgtcaacgtgtgctaccagacactaaccgagtacgacgaacatctgactcagctcgagaaagacatttgcactgctaaagaagcagcactggaagaagcagaactggagagcctcgaccccatgacgccagggccttacacgcctcagccacctgacctttatgatacaaatacatcactctcaatgtcgcgggatgcgagcgtcttccaggacgagagtaatatgagcgtgcttgacatcccttctgccacccccgaaaaacaagtgacccaggaaggagaggacggagacggggacctggccgatgaggaggagggtaccgttcagcagccgcaggcctccgtgctgtatgaggatctcctgatgagtgagggtgaggacgatgaggaagatgctggatcagacgaggagggtgataacccgttttccgcaatccagctgtctgagtccggatcggactctgatgtgggatctgggggcatccggccaaagcagcctagaatgctccaggaaaacacacggatggacatggagaacgaggagtccatgatgtcctacgaaggagacggtggcgaagcatcccacggcctggaagatagtaatatttcatatggctcgtacgaggaaccggaccccaagagcaacacacaggacacatccttctcctcaattggcgggtatgaagtctccgaagaggaagaagatgaggaagaggaggagcagagatcaggcccatcggtgctctctcaggtccacctgtcagaggatgaagaggactctgaagatttccatagcattgccggtgattctgacctggacagcgacgaatag

SEQ ID NO: 207940 - DNA, 1632 bp, Artificial Sequence
  Description of Artificial Sequence: Synthetic coding sequence
atgaccgaggagcaggaggaggagctggagaagaccgtgatccacaatgataatgaagagcttattaaggtcgagggaacgaagatcgtgctcggaaagcagctgatagaatccgccgatgaagtccgccggaagtccctggtactcaaatttccaaaacaacaactgccaccaaagaaaaaaaggagagtgggaacaaccgtgcactgcgactatttgaatcgccctcacaagtcaatccacaggcgcaggacagatcccatggtgacgctgtcctccatcttagaatccatcatcaacgacatgagagacctgccaaatacttacccttttcatacaccagtgaacgcgaaggttgtgaaggactactacaagatcatcacccggccgatggatttacagaccctgcgtgaaaatgttcgtaaacggctgtacccttcacgagaagaattcagagaacatcttgaacttatcgttaagaactcggcgacttacaatggcccaaagcattcgcttacccagatcagccagtccatgcttgacctgtgtgatgagaagctcaaagaaaaagaagacaagctggcgcgactggaaaaggctattaaccccttgttagatgatgatgaccaggtggccttcagcttcattctcgataatattgtgactcagaagatgatggccgtgccagactcttggccatttcaccacccagtgaataaaaagttcgtccccgactactataaggtgattgtcaatcctatggatctggagaccattagaaaaaacatatctaaacacaagtatcaatcaagggagagttttctcgacgacgttaaccttatcctcgccaactctgtaaaatataatggccctgaatcccagtacaccaaaacagcccaggaaatcgtcaacgtgtgttaccagacgctgaccgaatatgatgagcacttgacccagctcgagaaggacatctgcacagccaaggaggctgccttggaggaggccgaacttgaaagtctggaccccatgacaccaggcccatacacaccccaagctaaacccccggatctttatgatactaacacctccttgtctatgagccgggatgcatctgtttttcaggacgagtctaacatgagtgtgctcgacataccctccgccacgcccgaaaagcaagtcacgcagatgcggcagggcagagggagactcggagaggaggattctgatgttgatattgaaggctacgatgacgaggaagaggatggcaaacccaagacaccggccccagaaggcgaagatggagatggagaccttgcagatgaggaggaggggacggtacagcagccacaggccagtgtattatacgaagatctattgatgagcgaaggcgaagatgacgaggaagacgccggctccgatgaggagggcgacaacccattctcagcaatccaactgtccgagagtgggtctgactctgacgtcgggtcgggcggaatcaggcccaagcagcctagaatgctgcaagaaaacacccggatggatatggagaatgaggagagcatgatgtcctatgagggcgacgggggggaagcatcccatggactggaagacagtaatattagccatcagtag

SEQ ID NO: 207941 - DNA, 5688 bp, Artificial Sequence
  Description of Artificial Sequence: Synthetic coding sequence
atgggccccggctgcgacctgctgctgcggaccgccgccaccatcaccgcagcagctatcatgtccgacaccgactctgacgaagactccgcaggcgggggcccattctctctggccgggttcctgtttggcaatatcaacggggcaggtcagctcgaaggcgaaagcgtgctggacgatgaatgcaagaagcacctggccggcctgggcgctcttggactgggcagcctgatcacggaactcaccgcgaatgaagagctcaccgggactgatggggctctggtcaatgacgaggggtgggtcaggtcaacagaagacgccgtagactattctgatattaatgaagtggccgaagacgaaagtcggcgataccagcaaacgatgggaagcctgcagccgctttgccactcagattacgatgaggacgactatgacgccgattgtgaggatatagactgcaagctgatgccccctcctcctcctccaccggggcctatgaaaaaggacaaggaccaggactccatcaccggggttagcgaaaacggcgagggtattatcctaccatcaattattgctccctcttcacttgccagcgagaaagttgatttctcatcttcatcagatagcgaaagtgagatgggcccacaggaggcgacccaggcggagagtgaggacggtaaactcacgcttcccctagccggcataatgcaacacgatgctaccaaattgttaccatctgtcactgagctgttccccgaatttcgacccggcaaggtgctgcgctttctcaggctttttgggcctggcaaaaatgtgccttccgtgtggagatcggcacgccgcaaaagaaagaaaaagcaccgagaattgatacaagaagagcagatccaggaggtcgaatgttcagtggagagtgaagttagccaaaagtctctgtggaattacgattatgcgccccccccacctccagagcaatgcctttccgatgacgaaattacgatgatggcgcctgtggaatctaaattctctcaatctaccggcgacattgataaggtgactgacactaaacccagggtggccgagtggcggtacggtcctgctaggctgtggtatgatatgctgggggtcccagaagacggaagtgggttcgactacggcttcaaactgaggaagacagagcatgagcctgttattaagtcgcgcatgatcgaagaatttcggaaacttgaggagaacaatggcactgatctgctggcggacgagaactttctcatggtcactcagctccattgggaggatgacattatttgggatggggaggacgtgaagcacaaaggtaccaaacctcaaagagcatccctggcggggtggctgcccagtagcatgacgagaaacgccatggcttataacgtccagcaaggttttgcagcaacccttgatgacgacaaaccctggtacagcatatttccaattgacaatgaggaccttgtgtacgggaggtgggaagataatataatttgggatgcccaggcaatgccccgactgctagagccccctgtccttacgctagatcctaacgatgagaacctgatcctggagatacctgacgagaaagaggaagctacatcaaattccccaagcaaggaatcaaaaaaagagagctctctcaaaaagtctcgcatacttctggggaaaaccggggtaatcaaagaggagcctcagcaaaatatgtcacagccagaagtgaaggacccttggaacctgtctaacgacgaatattattatcctaagcaacaaggattgagagggactttcggaggaaatatcatccagcattccattccagcagtcgagctgagacaacccttcttccccactcacatgggaccgattaaactccgccagttccatcgaccaccattgaagaagtattcattcggagctctgtcgcagccaggcccacacagcgttcagcccctgctaaagcacatcaagaagaaggcgaaaatgcgagaacaggaaagacaggccagcggtggaggggaaatgttcttcatgcgaactccacaggatttaacagggaaggacggagatctgatcctggcagaatactccgaagagaatgggccactgatgatgcaggtcggtatggctactaagattaagaattattacaaaagaaaacctgggaaagatccgggtgcacctgattgtaaatacggggagacggtatactgccacacatcgccctttttgggcagcctgcaccctggacaactgctgcaggcattcgaaaacaatctatttcgggcccccatctatctccacaagatgcccgaaactgattttctgatcatccggacccggcaaggttactacatcagggaactggttgacatatttgtggtcggacagcagtgtcctctgttcgaggttcctggccctaactcaaaacgagctaatacccacatccgcgacttcttgcaggtattcatttaccgtctcttctggaaatctaaagatcgccctcgacgcattcgaatggaagatataaaaaaggcattcccgagccatagcgagtccagcatacggaagagactcaagctctgcgctgacttcaaacgaacagggatggatagcaattggtgggtgcttaaaagcgactttcgactgcccaccgaggaagagatccgcgcaatggtcagtcctgagcagtgttgtgcttattacagcatgattgctgccgagcagcggttaaaggatgccggttacggagaaaaaagctttttcgcccccgaagaggaaaatgaagaagatttccaaatgaaaatcgacgacgaggtgcgcacagcaccatggaacacgaccagagccttcatcgccgccatgaaagggaagtgcttactcgaagttaccggggtagctgatcctacgggctgcggggaagggttttcctacgtgaaaatcccaaataaacctacccagcagaaagacgataaggagccacaaccggtcaaaaagaccgtcaccggcacggatgccgatctgcgacggctgagcctcaagaatgccaagcagttgttacgaaaattcggtgtcccggaggaggaaattaagaagctgtcacgctgggaggtgatcgatgttgtgcgaaccatgagcaccgagcaggcccgctccggcgaagggcccatgtcaaagttcgcgcgtggatcccgtttttcggtggccgagcatcaggaacggtataaagaagaatgtcagcggatcttcgacctgcaaaataaggtgttatcttcaactgaggttctgtccactgataccgacagtagctcggcagaggattccgacttcgaggagatgggcaaaaacatcgagaatatgttgcaaaacaagaaaacctcgagccagttgtctcgagaaagggaagaacaagagcgtaaggagctgcaacggatgctgctggcagccggctcagctgcatctggaaacaatcatcgggatgacgacactgcctccgtgacctctttgaatagcagtgcaacagggagatgcctgaagatttataggaccttccgtgatgaggagggaaaggagtacgtgaggtgtgaaacagttcggaagccagcagtaattgacgcatatgtacgcatccgtaccacaaaggacgaagagttcatccgtaagtttgccctgttcgacgagcaacatcgagaggagatgcggaaggaacggagacggatccaggaacagttgcgaaggcttaagagaaatcaagagaaggagaaactgaagggccctcctgaaaaaaaacctaaaaagatgaaggaaaggccagaccttaaactgaagtgcggggcctgtggtgccattggccacatgcggaccaacaaattttgtcctttgtattatcagaccaatgcaccgccctccaaccctgtggcgatgactgaggaacaagaggaggaactggaaaaaacagtgatacacaacgataatgaggagctgattaaggtggaagggacaaaaatcgttctgggcaaacagctaattgaatctgctgacgaagttcggcgcaagtcgctggtgctgaaatttccaaagcaacagctcccgcccaaaaagaagaggcgcgtcggaactacagttcattgtgattatctcaatagaccccacaagagcatacacagaaggagaacagatccaatggtaacgctttccagcattcttgagtctattatcaacgacatgcgggacctgccaaacacatatccgtttcacactccggttaacgccaaggtagtcaaagattactacaagattatcacgagacccatggatctacaaaccttgcgggagaatgtccgcaagcgcctctatcccagcagggaagaattccgggagcatctggaattaatcgtgaagaacagtgccacctataacgggccaaaacacagcctaacccagatctcccaaagtatgttggacctgtgtgatgagaagctcaaggagaaggaagataagcttgccaggctcgagaaagcaattaatcccctgctggacgatgacgaccaggtggccttcagcttcatccttgacaacattgtcacccaaaaaatgatggccgtgcctgactcctggccgttccatcaccccgtaaacaagaagtttgttcccgattactacaaggtgatcgttaaccctatggacctcgagacgattcggaagaatatctcaaagcataagtatcagtctcgggagtcttttttggatgatgtgaacctcatactagccaattccgtgaagtacaatggaccggaatcccaatacactaaaaccgcccaggaaattgtgaatgtgtgctaccaaacgctcacagagtacgacgagcacctgactcagctggagaaggacatttgtacggctaaagaggctgctttggaagaggctgaactggagtcactggatcccatgactcctgggccatacaccccacaggctaagccaccagacctgtacgatactaacacctcactgtccatgtccagggatgcgagcgtgttccaggacgaatctaacatgtctgtgttggatattcccagtgcaacgccagagaaacaggtgacccaggagggcgaagatggcgatggcgatttggctgatgaagaggaggggacagttcaacagcctcaggctagtgtactatacgaagacctccttatgtccgagggcgaggacgatgaggaggacgcagggtctgatgaagagggtgacaaccccttttctgctattcagttgtcagagagtggcagtgactcagatgtcggcagcgggggaatccggcctaagcagcctcggatgctgcaggaaaacacccggatggatatggagaacgaagaatccatgatgagctatgagggagatggcggtgaagcctcccatgggctggaagactccaacatctcttatggctcatatgaggagccggatccaaagagcaacacacaggatacatccttcagcagtatcgggggatacgaggtctcagaggaggaggaggatgaggaagaggaggaacagcgcagcggcccatccgtgttgagccaagtccacctcagtgaagacgaagaagattctgaagacttccatagtatcgcaggggacagtgatctggacagtgatgaatag

SEQ ID NO: 207942 - DNA, 5721 bp, Artificial Sequence
  Description of Artificial Sequence: Synthetic coding sequence
atgggccccggctgcgacctgctgctgcggaccgccgccaccatcactgctgccgcaataatgagcgatacggactcggatgaggactccgcagggggagggccatttagtctggccggttttctgttcggcaacattaatggtgccgggcagctggagggggaatccgtcctcgatgatgagtgcaaaaaacatctagccgggttgggcgcactcggccttggctctttgattaccgaattaactgcaaatgaggagctgacgggaacagacggcgcgctggtgaacgacgagggttgggtgcgatcaaccgaggatgctgtcgattattccgatattaatgaggtggcggaagacgagagccgcagatatcagcagacgatgggtagtctccagccgctgtgtcacagtgattatgacgaggatgattatgacgctgactgtgaggatattgactgtaagttgatgcctcctcccccacctccaccggggccaatgaaaaaggataaggaccaggatagtatcacaggagagaaggtcgactttagctcctcatctgacagcgagagcgagatggggccgcaggaagcaactcaagctgaaagcgaggatggtaaactgactctgcccctggctggcatcatgcagcacgacgctacaaaattgctaccgtcagttacagagctgttcccagagttccggcctggtaaggtgctgaggtttctgcgactcttcggtccagggaaaaacgtcccgagtgtgtggagatccgccagacgaaagcgcaagaagaagcacagagaactcattcaggaggaacagatacaggaagtcgaatgtagcgtggagtccgaggtgtcacagaaaagtctatggaactacgattatgccccaccacctccccctgagcagtgcctttccgacgatgagatcacaatgatggctccagtggaatccaagttctctcaatctaccggagacatcgacaaagtcactgataccaagccacgcgtggccgaatggcggtatggtcccgctaggctttggtatgatatgctcggagtgccagaggacggatcagggttcgactacgggtttaaactccgcaagacggaacacgagcctgtgataaaatctcggatgatagaagagtttcggaaactcgaagaaaacaatggaaccgaccttctggctgacgagaacttccttatggtcacacagttacactgggaagacgatatcatttgggacggcgaagacgtcaaacataagggcacaaaaccccagagagctagcctggcaggttggctcccctctagtatgacaaggaacgctatggcttataatgttcagcagggcttcgccgctacattagacgacgacaagccttggtactcaatcttccctatagacaatgaggacctggtgtacggacgctgggaggataacattatttgggacgcccaggcaatgcctcggctcctcgagccacctgtccttacgctggatccaaatgacgaaaacctcatcctagagattcctgacgaaaaagaggaggcaaccagcaactcaccatcaaaggagtccaaaaaggaatcatccttaaagaagtctcggattctgctaggaaaaactggcgttataaaggaggagccacagcagaatatgtcccagcccgaagttaaagacccgtggaatctatcaaatgacgagtactattaccctaaacagcaaggcctcaggggaacatttggaggtaatattatccaacattctatcccggcagtcgagctacggcaacctttctttcctacacacatgggccccatcaaattgcggcagtttcaccggccccctttaaaaaaatacagttttggggccttaagccagcccggcccccatagcgtacagcctctactgaaacatataaagaaaaaggctaaaatgagagaacaggaaagacaggcctctggcggcggggagatgttttttatgcgcaccccccaggatctcacgggaaaggatggggaccttattttggccgagtactcagaagaaaatggcccattgatgatgcaggtaggtatggcgaccaagattaagaactactacaagagaaagcctggcaaggatcctggcgcccctgactgtaagtacggagaaaccgtgtactgtcataccagccctttcttaggcagcttgcatcccggtcaactgcttcaggcatttgagaataacctgtttagggctccgatctacttacacaagatgccagagacagattttttaataatacggactaggcaaggctactacatccgcgagctggtggatatttttgttgtgggccagcagtgtcccctgttcgaggtccccggccctaatagtaagcgggccaacactcacatcagagatttcctccaggtgttcatatatcgcctattctggaagtcaaaagaccgcccaagaagaatccgaatggaggatattaagaaagccttcccatcgcactcagaatcttctatacgaaaacgcctgaaactgtgtgccgattttaaacgcacgggtatggactccaattggtgggtgctcaagtcagacttccgcttgcccaccgaagaggaaattagagccatggtctctcctgagcagtgttgtgcttattacagcatgattgcagccgaacagcgtctgaaggatgcgggttacggagagaagtccttcttcgcccccgaggaggaaaatgaagaggacttccagatgaagatcgatgacgaagttcgcacagctccttggaacaccaccagggcatttatcgcagctatgaagggaaagtgcctgttagaagtgacaggggtggctgacccaactggctgcggagagggattcagctacgtgaaaattcccaacaaacccactcagcaaaaagatgacaaggagccccaacctgtcaaaaagaccgtgaccgggaccgacgcagacttgaggagactgagtctgaagaatgctaagcaactactgcgtaaattcggggttcctgaagaggaaattaagaaactctctcgctgggaggtgatcgatgtggtgcgcaccatgtcaaccgagcaggcccgatcaggagaagggcctatgtcaaaattcgccaggggctcgcgattctctgttgccgagcaccaggaacgctacaaagaagagtgccaacgcatctttgaccttcagaataaggtgctgtcgagcaccgaggtactgtccacagacaccgatagttcttcggcggaagacagtgattttgaggaaatgggcaagaatatcgagaatatgcttcaaaacaagaaaaccagttcacaattgagcagggagagggaagagcaggaacgcaaggaactgcagcgaatgctgcttgccgcaggctcagcggccagcgggaataaccaccgcgacgacgatacagcttcagtgaccagtctgaattcaagcgcgacagggcggtgtctcaaaatctaccgcaccttcagagacgaagagggtaaggagtatgtccgctgcgaaacagtacgaaagccagccgttattgatgcctatgttagaattcgaactacaaaggacgaggagttcatacgaaaatttgccttatttgacgaacaacaccgtgaagaaatgaggaaagaacgcagacggattcaggaacagctccgtcgtttgaagcggaaccaggaaaaggaaaagctcaagggtcctcccgagaaaaagcctaagaaaatgaaagagaggcccgatctgaagctaaagtgtggagcctgtggagcaatcggccacatgcgcacaaataagttctgccctctctattaccaaaccaatgctccacctagcaaccccgtggccatgaccgaagaacaggaggaagagctggagaagaccgtgattcataatgacaacgaggaactgattaaggtcgagggcacaaaaattgtactggggaagcagttgattgagtctgcggatgaggtcaggagaaaatctttggtactgaagtttcctaagcagcaattaccgcccaaaaagaaacgccgagtcggcactacagtccactgtgactatttaaatcggccacacaagagtattcatcggaggaggacagatcccatggtgaccctgtcttccatactggaaagcatcatcaatgacatgcgtgacctgcctaatacatacccttttcacacgcccgtgaacgccaaggtagttaaagactattacaagatcattactaggccgatggatctccagacactgagagaaaacgtcaggaaacggctctatcctagcagggaagagttcagggaacacttggaacttatcgttaagaatagcgcgacctataacggaccaaagcactccttaacacagatctcccagtctatgctggacctttgtgatgaaaagctgaaggagaaagaagacaagctggctaggctggagaaggcaatcaaccctctgctggacgacgatgaccaagtggccttttcttttatattagataatatagtgacacagaagatgatggccgtcccagatagctggcctttccatcaccccgtgaacaaaaagtttgtgccggattactacaaggttattgtgaaccctatggatctggagacaatccgcaagaacatttctaaacacaagtaccagagtagagaaagtttcttagacgacgttaatttgatactggctaacagcgtgaaatacaacggacctgagtcccagtacaccaagaccgcacaggagatagtcaacgtttgttatcagaccttaactgaatacgacgagcaccttacccaacttgaaaaggacatctgcaccgcaaaagaagcagccctggaagaggccgagctggagagtctggaccctatgacacctggaccctatacaccccaaccccccgatctgtacgatactaatactagtctgagcatgtcgagagacgctagcgtgttccaggacgagtccaacatgagcgtgcttgacattccgtctgctactcccgagaaacaggttactcagatgcgccaaggcaggggccgactgggcgaggaggacagtgatgtggacatcgaaggatatgacgatgaggaagaggatgggaagccgaaaaccccagcacccgaaggggaagatggcgatggagacttggctgatgaggaggaaggtactgtacaacagcctcaggcctcagtcctctacgaggacctcctgatgtccgagggtgaagacgatgaggaggacgcgggcagtgatgaggaaggtgataatcctttcagtgcaatccagctcagtgagtcaggctcagattctgacgtaggatcaggaggaatcagacctaaacagccacgaatgctccaagaaaatacaagaatggatatggagaatgaggaatccatgatgtcttatgaaggtgatggaggcgaggcttcccatggtctcgaggacagcaatatatcctatggcagctacgaggaaccagatccgaaatctaacactcaggatacatccttctccagcattggaggctacgaggtgagcgaggaggaagaggacgaggaggaggaggagcagagatctggaccatccgtgctgtcccaggtccacctgagcgaagatgaggaggacagtgaggactttcactcaatcgcaggggacagcgatctcgatagcgacgaatag

SEQ ID NO: 207943 - DNA, 897 bp, Artificial Sequence
  Description of Artificial Sequence: Synthetic coding sequence
atgaccgaggagcaggaggaggagctggagaagaccgtgatccacaatgacaatgaagagctgatcaaagtcgaaggtacaaagattgttttagggaaacagctgatcgagtcagcagatgaggtaagaaggaaaagtctggtactgaagtttccgaagcagcagcttcccccgaagaagaagaggcgcgtgggtacaaccgttcattgcgattatttgaacagacctcacaagtccatccacaggcggcggactgaccctatggtgactttgtcttctatcctggaatccataatcaatgatatgagggatctgccgaacacttatcctttccacacccctgtgaacgcaaaagtggtgaaggattattacaagattatcacacggcccatggacctccagacactgcgagagaacgtgagaaagagactataccctagcagggaggaatttcgagagcatctggagcttatcgtcaaaaattctgcaacctataacggccccaaacactctcttacccagatcagtcaatctatgctggatttgtgtgacgagaaacttaaagagaaagaggataagctggcccggctggagaaggccatcaacccacttttagatgacgacgatcaggtggcttttagttttatcttggataatatcgtgactcagaagatgatggccgtcccggactcatggccattccaccatcccgtgaataaaaagttcgtaccagactattataaggtgatagtcaatccaatggatctggagactattaggaagaacatatccaagcacaaataccagagtagagaaagcttcctcgatgacgtcaacttgatattggccaatagcgtgaagtataatggctacatgtgtaccacctgcagattctag

SEQ ID NO: 207944 - DNA, 657 bp, Artificial Sequence
  Description of Artificial Sequence: Synthetic coding sequence
atgagctgcagcggcagcggcgccgaccccgaggccgcccccgccagcgcagccagcgctcctggtcctgcaccccctgtgtcggccccggccgccctgccaagcagtaccgctgccgagaacaaagcatcacccgcgggcaccgcggggggacctggagctggagcagccgctggggggaccgggcccttagccgccagggcaggggagcccgccgagagacggggggcagctccggtgagcgccggcggtgctgctccccctgaaggggcaatctccaatggtgtgtatgtgctgcccagtgccgccaatggtgacgtgaagcccgtggtaagttccaccccactggttgacttcctgatgcagctggaagactatacccctaccattccggatgctgtgacggggtattatctgaaccgagccgggtttgaggcaagtgatcctcgaattatccggttaatctcactggctgcacaaaagtttatatccgacatcgcaaacgatgctttacagcactgcaagatgaagggaactgctagcggctccagtaggagcaagagtaaggacagaaaatatactctgacaatggaagacctcactcctgctctttcggaatacgggataaatgtcaaaaagcctcattatttcacctag

SEQ ID NO: 207945 - DNA, 636 bp, Artificial Sequence
  Description of Artificial Sequence: Synthetic coding sequence
atggacgacgcccacgagagccccagcgacaagggcggcgagaccggagaatccgatgaaacagcagctgtcccaggagatcctggagctactgacaccgacggaatccccgaggaaaccgacggcgatgctgatgtcgatctcaaggaggccgcagccgaggaaggtgagctggagtcccaagacgtgtcagacctgacaacagtagagagggaagattcgagcctactgaacccagccgctaagaaactgaagattgatacgaaagagaagaaagaaaagaaacagaaggttgacgaggacgaaatccagaagatgcaaattttggtgagctccttcagcgaggagcaactgaaccgatacgaaatgtatcgacgatccgcatttcctaaggcagccatcaagcgactcatacagtctattactggaacatcggtgagccagaacgtggttatcgcgatgagcggcatctcaaaagtttttgtgggtgaagtggtggaagaggccctcgatgtgtgtgagaaatggggtgagatgccacccctgcaaccaaaacacatgagagaggccgtgcgtaggctgaagtcaaaagggcaaattcctaactcgaaacacaagaagatcatattcttctag

SEQ ID NO: 207946 - DNA, 465 bp, Artificial Sequence
  Description of Artificial Sequence: Synthetic coding sequence
atggacgacgcccacgagagccccagcgacaagggcggcgagaccggcgagtccgacgagaccgcagccgtaccaggagatcccggggctacagacacggacggaatccctgaggaaacagatggagacgccgacgtggaccttaaggaggctgctgcagaagagggcgagctggagtcgcaggacgtttcagatcttaccaccgttgagagggaggactctagtctactaaaccccgccgccaagaagctcaaaatcgatacaaaggagaaaaaggaaaagaaacaaaaggtagacgaagacgagattcagaagatgcagatattggtgtcgagcttttcagaagagcagcttaatcgctatgaaatgtaccgtaggagtgccttccctaaggccgcaataaagaggcattggatgtgcgtgaggagcggcgagaaatgccaccattacaaccctaatatctag

SEQ ID NO: 207947 - DNA, 486 bp, Artificial Sequence
  Description of Artificial Sequence: Synthetic coding sequence
atgaaccagttcggccccagcgccctgatcaacctgagcaacttctcgtctatcaagccagagcctgctagtaccccgccacaaggtagtatggccaacagcaccgccgtcgttaagataccaggaacaccgggggccggaggaaggctgagccccgagaacaaccaggttctgaccaagaaaaaactacaggatctcgttcgcgaggtcgaccctaatgaacagctggacgaggatgtagaggaaatgctcctgcagatagctgacgattttattgaatcggtggttacagcagcctgccaactggccaggcaccggaagtcctcaactctggaggtcaaggatgttcaacttcatctagagcgccagtggaacatgtggatcccaggtttcggttccgaagaaatcagaccttacaagaaggcctgcaccactgaggcccacaaacagcgaatggcgctgattagaaaaaccaccaagaaatag

SEQ ID NO: 207948 - DNA, 486 bp, Artificial Sequence
  Description of Artificial Sequence: Synthetic coding sequence
atgaaccagttcggccccagcgccctgatcaacctgagcaacttctcgtcgattaagcctgagcccgcctcaaccccccctcagggtagcatggctaacagtacagccgtagtgaagattccaggaacaccaggcgcgggaggaaggctgagccctgagaacaatcaagtgctgactaaaaagaaactgcaagatctggtgcgcgaggtggacccaaacgagcagctggacgaggatgtagaggagatgctcctccaaatcgccgatgatttcatcgaatcggtggttacagccgcgtgtcagctggcaaggcaccgtaagtcaagtactctggaagtaaaagacgtgcaactgcatctggaaagacagtggaatatgtggattccaggatttggaagcgaggaaattagaccctacaaaaaagcatgcactacagaggcccataagcagcgaatggccctgatccgcaagactactaaaaagtag

SEQ ID NO: 207949 - DNA, 1779 bp, Artificial Sequence
  Description of Artificial Sequence: Synthetic coding sequence
atgagcgacagcggcagctacggccagagcggcggcgagcagcagtcctatagcacttatggcaatcccggcagccagggctacggtcaggcaagccagtcttactccggctatggtcaaaccacggattcatcatacgggcagaattactctggctactcttcgtatggacagagccagagcggatactctcagagttacggaggctatgagaaccagaaacagtcctcctacagccaacagccttacaacaaccaagggcagcagcagaatatggaaagttctgggagtcagggtggtcgagcaccttcgtacgatcagcccgattacggtcagcaagatagctatgaccagcagagtgggtacgatcagcatcaaggctcctacgacgaacagtccaattatgatcaacaacatgattcgtacagtcagaatcagcagagctatcattcacaacgggagaactattcccatcacactcaggacgacaggagagacgttagcagatacggcgaagacaataggggctacggcgggtcccagggtggtggacggggcagggggggctatgacaaagacgggcggggtccaatgaccggaagcagcggcggggaccggggcggcttcaagaactttggcggacatagggactatggaccgaggaccgacgccgacagcgagtcagataactccgacaacaacaccatctttgttcaaggcctcggcgaaggagtcagcacggaccaggttggggaatttttcaagcagatcggcattataaaaacaaataaaaagacggggaaaccaatgataaacctctacacagataaggacactggtaagccaaagggtgaggccacagtctcttttgacgatcctccttcagcaaaagccgcaattgactggtttgacgggaaggagtttcacgggaatattattaaagtgtcattcgccacacggaggcccgagtttatgcgtggagggggtagtggtggcgggaggagggggagaggtgggtacagggggagaggtggctttcagggtcgaggaggggatccaaaatccggcgactgggtttgccccaacccctcgtgcggaaatatgaacttcgccagacgaaactcttgtaatcaatgcaacgaacctcgcccggaggattctcggccttcaggcggggactttcgaggtcggggttacggtggcgagagaggctatcggggaaggggcgggagggggggggaccggggtggctacggaggggacagatcaggaggaggatatggcggtgacaggtcttctggcggcggctattcaggagatcgctcaggaggcggatatgggggagaccgaagcggtggcggttatggcggcgaccggggcggcggatatggcggggaccggggaggaggctacggcggggaccgcggagggggatacggtggggatagaggcggttacggcggggaccgaggcggcggctacgggggtgaccgcgggggatacggcggcgatcgcggtggatacggaggtgacaggggaggttacggtggagaccgcgggggctacggtggagaccgcagcaggggtggctatggcggggatagaggaggcggtagtggttacggaggcgaccgatcagggggctacgggggtgatcgctcagggggaggatatgggggtgaccggggcggcgggtacggtggtgacaggggaggttacggagggaaaatgggcggtaggaacgactaccggaatgatcagagaaacagaccttactag

SEQ ID NO: 207950 - DNA, 1779 bp, Artificial Sequence
  Description of Artificial Sequence: Synthetic coding sequence
atgagcgacagcggcagctacggccagagcggcggcgagcagcagtcgtactctacttacgggaatcctgggagtcaagggtacgggcaagcctcacagagttactccggctacggacaaacaacggactcgagctacggccagaactacagcggttacagttcctatggtcagagtcaatctgggtactcacagtcatacggcggctatgaaaaccagaaacagtcttcctatagccagcagccttataacaaccagggacagcagcagaacatggagtcaagcgggtcacagggcggtcgggccccaagttacgaccagcctgactacgggcagcaggattcttatgatcagcagagcggttatgatcagcaccaggggagctatgacgagcagtccaattacgatcagcagcacgacagttattcgcagaaccagcaatcctatcactcacagagagagaattacagccatcacacgcaggatgaccgcagggacgtttcacgatacggtgaggataaccgcggatacggagggtctcaggggggtggtcgtggcagaggaggttacgacaaagacggccgcgggcccatgacaggatcaagcggcggggacagagggggctttaaaaattttggcggacatcgagactacggtccaagaaccgacgccgactccgagagcgataacagcgacaacaacactatttttgtgcaaggactcggagaaggggtctcaacggaccaagtgggtgagttcttcaagcagattggcataattaagaccaacaaaaagacaggaaagccaatgataaacctgtacactgataaagacacgggaaaacccaagggagaggccaccgtctcatttgacgatcccccatcagccaaagccgctatcgactggttcgatgggaaagagttccacggtaatattattaaggtatcttttgcaacacgcagacccgaattcatgcgaggaggcggaagcggcggaggcaggagaggccggggcggataccgcggtagggggggcttccaaggtcgaggcggagaccccaaatccggcgactgggtgtgtcccaaccctagttgcggcaatatgaactttgcacggcgcaattcttgcaaccaatgtaacgagcctcgcccagaggatagtcgtccctccggcggcgatttccgtgggcgcggatatggcggcgaacgcgggtataggggacggggcggcagaggtggcgatcggggcgggtatgggggggataggtctggagggggctacggaggtgacaggagtagtggaggcgggtactccggcgatcggtccgggggcggatatggtggggatcggtcggggggcggatatggcggtgatcgtggaggcggctatggaggcgacagggggggtgggtacggaggcgatcggggggggggttatggcggtgataggggtggatatggaggcgatagagggggggggtacggcggagaccgcggaggctatggcggggatcgggggggatacggcggagatcggggtggttatggaggcgaccggggcgggtatggtggcgacagaagccgcggcgggtatggaggagaccgcggcggaggttctggatatggaggcgatcgctcaggtgggtacgggggagatcggagcggcgggggctacggaggcgatcgcggagggggttacggtggcgaccggggagggtacggggggaagatggggggcagaaatgattacaggaacgatcagcggaacagaccttattag

SEQ ID NO: 207951 - DNA, 1188 bp, Artificial Sequence
  Description of Artificial Sequence: Synthetic coding sequence
atgaccggcagcagcggcggcgaccggggcggcttcaagaacttcgggggacatcgcgattacggaccgcggacagatgccgactccgaatcagacaacagcgataacaacacgatattcgtccagggattgggtgaaggcgtcagcacagaccaggttggagaattctttaagcagatcggaataattaagacgaacaagaaaaccggaaaacctatgatcaatctctatactgataaggatacaggaaagcctaagggggaggccacagtttccttcgatgaccctccctctgccaaggccgcaatcgactggttcgatggaaaagagttccacggcaacatcatcaaagtgagctttgccaccaggcgaccggagtttatgagaggaggcggtagcggcggggggaggagaggtcggggcggttacaggggacgcggaggcttccagggcagaggcggcgacccaaagagcggggattgggtgtgccccaatcctagttgtgggaacatgaattttgcaaggcggaattcttgtaatcagtgtaacgagcctcgcccagaagactctagaccctcaggcggcgacttcagggggcgagggtacggtggggaacgaggttaccgaggacggggggggcgagggggggacagagggggctatggcggggatcggtcaggcgggggatacggtggggaccggtcatccggaggcggctactcgggtgatagatcaggaggaggctacggaggggatagaagtggcggcggctacggcggcgaccgcgggggagggtacggaggcgatcgaggggggggctatgggggagacagggggggaggatatggaggtgatcgtgggggttatggaggcgaccgggggggcggttacggcggcgatagggggggttatggtggcgaccggggagggtacgggggagaccgcggtggatacggtggagatcgcggaggctacggcggcgaccgatctcgtggcggatacggaggcgatcgcggcgggggctcaggctatggcggcgacaggtcgggaggctatggaggtgatcggtcaggtggagggtatgggggcgaccgagggggagggtacggtggggatagaggcggctacggtgggaaaatgggagggaggaatgactataggaacgatcagagaaaccgaccatattag

SEQ ID NO: 207952 - DNA, 2790 bp, Artificial Sequence
  Description of Artificial Sequence: Synthetic coding sequence
atgtgcgagagctacagccggagcctgctgcgggtgagcgtggcccagatctgccaggcgctggggtgggactccgtgcagctctcagcttgccacctactcaccgatgtcctgcagcgatacctccagcagctaggcagggggtgccatcgatactccgaactgtacggtaggaccgaccctattctggacgatgtgggtgaggcgtttcagctaatgggtgtctccctccacgagctggaggattacatccacaacattgaacccgtgacattcccacatcaaattccatccttccccgtgtctaaaaacaacgtcctacagtttccccaaccaggaagcaaggacgccgaggagagaaaggaatatatccccgattatctgccaccgattgtttcgtcccaagaggaggaagaggaggagcaggtgccgacagatggtggcaccagcgcagaggctatgcaagtacccctcgaggaagacgacgagctggaggaggaggagatcatcaacgacgagaactttttgggaaaaagacccctggatagtccggaggcagaggagcttcctgcgatgaagaggcccagactgctgtctacgaaaggggacaccttggacgtggtgctcctggaggcgcgcgagcccttgagtagtataaacacgcagaaaattccccctatgctgtcccccgtgcacgtacaggacagcaccgacctggcaccgccctctccagaaccccccatgctggccccagtagccaagtctcagatgcccactgcaaagcctcttgaaacaaagtcctttacacctaaaaccaagaccaaaacctcttcgccaggacagaaaacaaagagcccgaaaacagcccagtctccagccatggtcggttcacccattcggtctccgaaaactgtatctaaggagaagaagtctcctggccgctcgaagagccccaaaagcccaaagtccccaaaagttaccacacatatcccacaaaccccggtgcgaccagaaacacccaacaggaccccttccgcgaccctttctgaaaagatttccaaggaaactattcaggtgaaacaaatccagactccaccagacgccgggaaattaaatagcgagaaccagcctaaaaaagccgtggtcgctgacaaaactatagaagctagcatagacgcggtcattgctcgcgcgtgcgctgaacgtgagccggacccttttgagttcagttctgggagcgagtcagaaggcgacatttttacaagcccaaagcgtatatccgggcctgaatgcaccacacccaaagcatctacatcagctaacaacttcacgaaaagcggctcaacacccctaccccttagcggcggaacaagttcgagcgataacagctggaccatggacgcctctattgatgaggtggtgcgaaaggcaaagctcggcacaccaagcaatatgccgcccaattttccatacatctcatctccatccgtcagcccacctactcccgaaccccttcataaggtatacgaggagaagaccaaactccccagctcagtggaagtgaagaaaaagttaaaaaaggaactcaagaccaaaatgaagaagaaggaaaagcagcgagacagggagcgtgagaaggacaagaataaggacaagagcaaagaaaaagacaaagtgaaagagaaagagaaggacaaggagacaggtcgagagacaaagtatccctggaaggagttcctgaaggaggaggaggccgatccttataagttcaagatcaaggagttcgaggatgtggaccctaaggtcaagctgaaagatggtttggtgaggaaagaaaaagagaaacacaaggataaaaagaaggaccgggaaaagggaaaaaaggataaggacaagagggagaaggaaaaagtgaaggataagggtcgagaagacaaaatgaaggccccagcgccccccctagtgctgccacctaaggaattggccttgcccctgttttcacccgccactgcatcgcgagtgcccgccatgctgcctagcctgctccctgtccttcccgaaaaactgttcgaggagaaggagaaggtcaaggagaaggagaagaaaaaagataagaaggaaaagaaaaagaaaaaagaaaaggagaaggaaaaaaaggagaaggaaagggagaaagagaaacgggagcgtgagaagagagagaaggaaaaggagaaacacaaacatgaaaaaattaaagttgagcctgtggctctcgcgccgtcccccgtgatccctcgattaacgctgcgggtcggcgccggtcaggacaagatcgtgatcagcaaggtagtacccgcccctgaggccaagcccgccccatcccagaatcgtccaaaaactcccccacccgcacccgctccagcccctggcccaatgcttgtatcccctgcgcccgttcccctgcctttacttgctcaggctgcagcgggccccgcactcctccccagccccggtcctgccgcatccggcgcttccgcaaaagctcctgtgcgcagcgtggtcaccgagacagtgtctacctacgtcataagggacgaatggggaaatcagatctggatctgtcccggttgtaataagccagacgatggctctcctatgataggatgcgacgactgtgacgattggtaccactggccttgtgtgggtattatgactgcccctcctgaggaaatgcagtggttctgtcccaagtgtgccaacaagaagaaggataaaaaacacaagaagcgcaaacaccgtgcccactag

SEQ ID NO: 207953 - DNA, 852 bp, Artificial Sequence
  Description of Artificial Sequence: Synthetic coding sequence
atgtgcgagagctacagccggagcctgctgcgggtgagcgtggcccagatttgccaggcgttgggttgggatagcgtgcagctaagcgcctgccacctcctcacagacgtcctgcaacgctacctccaacagcttgggcggggatgtcatcgatattccgaactgtacggtagaacagaccctatcctcgatgatgttggtgaggcgtttcagttgatgggggtttcattgcacgaactggaagattacattcataacatcgagccggttactttcccacatcagatcccctcctttccggtcagcaaaaacaacgtgctgcagtttccccagccaggctccaaggatgccgaggaacgcaaagaatatatccccgactatctgccccccattgtctcttctcaagaagaagaagaagaagagcaggttcccaccgacggcgggacaagcgcagaggccatgcaggtcccactggaagaggacgacgaactggaggaagaagagattatcaacgatgagaacttcctcggaaagcgccctctcgatagccccgaagccgaagaactcccagcgatgaagaggcctcgactgttgagcacaaagggagacactctggacgtggtcctgctcgaggccagagagcctttatcttccattaacactcagaagattccgcccatgctctcccccgtgcatgtgcaggattctaccgatcttgccccgccctcacccgaacctccaatgttggctcccgttgctaagtcccaaatgcccacagctaagcctctggagaccaagtcttttacacctaagaccaaaactaaaaaaaagaaaaaaaagaagaagtcttag

SEQ ID NO: 207954 - DNA, 3258 bp, Artificial Sequence
  Description of Artificial Sequence: Synthetic coding sequence
atggccgccggcagcgacctgctggacgaggtgttcttcaacagcgaggtcgatgagaaggtcgtaagcgatctggtgggctcacttgaaagccagctcgcagcctctgccgcccaccaccatcacctcgccccccggaccccagaagtgagggcggcggccgcgggggccctgggcaatcacgtggtatctggttccccggctggtgcagccggtgctgggccagcggcccccgctgaaggagccccgggggccgcccccgagcctccccccgccggcagggccagaccaggagggggaggaccacagcgacctgggccaccttctcctcgtcggcctctcgtgccggcagggcccgcccctcctgctgcgaaactgcggccgcctcccgagggatccgcagggtcgtgtgcccccgtccctgcagcagccgcggtcgcggctggcccggaacccgctcctgcggggcctgctaaacccgcagggcccgccgcactagcagcacgcgcaggcccaggccccggtccgggccctggccccggccccggaccagggcccggtaagcccgccggtcccggcgccgctcagacgctgaatgggtctgcagccttactgaactcacatcacgccgcagcaccagccgtttccctggttaacaatggccctgccgccctgctccctcttccaaagcccgccgccccaggtaccgtcatccaaactcctcctttcgtaggcgccgccgccccgcccgcaccagccgcccctagccctcccgcagcccccgccccagcagcccccgccgccgcaccaccaccacccccacctgctcccgccaccttagcaaggccaccaggacacccagccgggcctcctacagccgcacctgcagtgccacctccagccgccgcccagaatggaggctctgccggggctgctcctgcacccgcaccagctgccggaggccccgccggggtgtctggacagcccggccctggcgcggctgccgctgcaccagcacccggcgttaaggccgagagtcccaagcgggttgtgcaagctgccccccctgccgcacagactctcgcggccagcggaccagcctctaccgcagcttctatggtcatcggaccaacaatgcagggtgctcttccatcacctgctgctgtgccgcctccagctcccggaacgccaactggtttgccaaagggcgctgctggagcagtgacccagagcctgagccggacccccaccgccaccacctccggtattcgggcaacgttgacacccactgtcctggcccccagactgccacagcccccacagaatccgacaaacattcagaatttccaactgcctcctggaatggtgctggtgcgaagtgagaacggacagttactaatgattccccagcaggcattagcacagatgcaggcccaggctcatgcccagcctcagactacgatggctccacgacccgccactccaactagcgcccctccagtccaaataagcactgtccaagcgcccgggacaccgatcattgctcggcaggtgacacccactaccattatcaaacaggtctcacaggcgcaaacaacagttcagcccagcgcgaccctgcagcgctccccgggtgtccaaccgcagctagtgctcgggggcgctgcacaaactgcaagcctcggcacggctactgccgtgcagaccggaacaccccaacggaccgtcccaggagcgaccactacatcttcagccgcgacagagacaatggaaaatgtgaaaaagtgtaagaactttctaagtactctaatcaagctggcgtcctccggcaaacagagtacagaaacagccgccaatgtgaaagaacttgttcagaatcttttagatggcaaaattgaagccgaggacttcacttctagactttacagggaattaaacagtagcccacagccatacttggtccctttcctcaagcgcagtctgcccgccctgcgacaattgactccagacagtgctgcattcatccagcaaagccaacaacagcccccgccgccgacttcacaggccactacggctctgaccgcggtggttctgagttctagtgtgcaacggacagccggaaagactgctgctacagtcacaagcgccctgcaacctcccgtgctatccctcacacagccgactcaggtcggggtgggaaagcagggccaacccacgccactggtcatccagcaacctcccaagcccggtgcgttaatcaggccaccacaggtgacactcacccaaaccccaatggtggccctccgacagcctcataacagaataatgctaacaacacctcagcaaatccaactgaatccgctccagcccgttcccgtagtgaagcccgccgtgctcccaggaacgaaggcactgtcggctgttagcgcacaggcagccgccgcgcagaaaaataagctgaaggagccaggagggggaagctttcgtgacgacgacgatatcaatgacgtcgccagcatggcaggtgttaacctgagcgaggagagtgccaggatcttagccactaatagcgaactcgttgggaccttgacacgttcttgtaaggacgagaccttcctcctgcaggcgccgcttcagcgccgtatcctagagattggaaaaaaacacgggattactgagctccaccccgacgtggtgtcatacgtaagccatgcaacccaacagcggcttcagaatctggtggagaaaatctctgagaccgcccagcagaaaaacttctcttacaaggacgacgataggtacgagcaagcttcggacgtaagagctcaactaaagttctttgaacagcttgaccagatcgaaaaacagagaaaggacgagcaggaaagggagatcctgatgagggctgctaaatccagatctagacaagaagatcccgagcagcttaggttgaaacaaaaagccaaggagatgcagcagcaagagttagcacagatgcggcaaagagatgcgaacctcaccgcgttggccgcgattggcccacgaaagaagcgcaaagtcgactgcccaggccccggctcaggagccgaaggatctggccccggctctgtagtgcccggctcctctggggtcgggacccccagacagtttacacgccagaggatcactcgggtaaatctgagggatctgatcttttgcctcgagaatgaacgggaaacgtcccacagcttgcttctgtacaaggctttcctgaagtag

SEQ ID NO: 207955 - DNA, 2850 bp, Artificial Sequence
  Description of Artificial Sequence: Synthetic coding sequence
ggccggggcctgctgcagcagcggggcggccgggagagcggccccgcgcctcccgccgcaaagcttcggccaccacctgagggtagtgctggctcgtgcgctcccgtgccagctgccgcagctgtcgctgccgggccggagcccgcccctgccgggcccgccaagccggctgggcccgcggcacttgccgccagggccggacctgggccgggtccaggtcctggcccaggcccaggtccaggcccgggcaaacccgccggcccaggcgccgctcagactctcaacggctccgccgcccttttgaatagccaccacgccgccgcccccgctgtcagtctggtcaataatggtcctgccgctttgcttcccttgccaaagccagctgccccagccgcagcccccccgccaccacctcccgctcctgctacactggctagaccccctgggcatccggctggccctccaacggctgccccagccgttcctcctcccgccgccgcacaaaacgggggatctgccggagctgcccccgcccctgcccctgctgctggcgggccagctggcgtgagtgggcagccaggccccggagccgccgccgcagcccctgctcccggcgtgaaggccgagtcccccaaaagggttgtgcaggcggccccccctgcagctcagactcttgcagcaagcggacccgcgtcgacagcggctagcatggtaataggaccaacgatgcagggggccttacctagtcccgccgccgtgccgccgcctgcgcccggcacaccaacaggtctacccaagggagcggctggcgccgttacgcagagcttatccaggactcccactgccaccacttcaggcattagagcgaccctgacacctactgtcttagcgccgcgcctgccgcaacctccccagaaccccacaaacattcagaactttcagctccccccgggcatggtcctggtgaggtccgaaaacggacagttgttgatgatcccccaacaagcattggcacagatgcaagcccaggcgcatgcccagccacaaaccactatggccccccgcccagcaaccccaactagcgccccgccagtgcaaatcagtacagtgcaggccccagggaccccgattattgccaggcaggtgacaccaacgacgattatcaaacaagtgagccaggctcagactacagttcaaccctcagctaccctccaacgatcacccggcgtgcagcctcagctggttctgggaggagctgcccagacagcctcgctcggcacagcaaccgccgtgcagacaggcacgccccagcggacagtgccgggagctaccacaacaagcagtgccgccacagagactatggagaacgtgaagaaatgcaaaaactttttgagtaccttgattaagctggcctcttccgggaagcagtcgacggagacagccgcaaacgttaaggagcttgtgcagaatttgctggacgggaagattgaggctgaggatttcacatcccgtctctaccgggaactgaactcatcccctcaaccttatctggtgccgtttctcaagagaagcctgccagctctccgacagctgactcctgacagcgccgcctttatccagcagagtcagcaacagccccctcctcctacatcacaagcgaccaccgcactaactgcagtggtgctgtcatcctccgttcagaggaccgctgggaaaaccgccgcaaccgtgacatctgctctacaaccgcctgtgttgtctctgacacagcctacgcaggtgggcgtcggaaaacaaggccaacctactcccttagtgattcagcaacccccaaagccgggagccctcatcagaccaccgcaagtcaccttaacacagactcctatggtagccctgagacagccgcacaaccgaatcatgctcaccaccccacagcagatacagttgaatcctctgcagcccgttcctgtggtgaagcctgcagtcctccccggcactaaagcattgtccgcagtctccgcacaggccgccgcagcccagaaaaacaagcttaaggagccaggagggggctcattcagggacgacgatgatatcaatgatgtggcaagtatggccggggtcaatctgtctgaagagtcagcacgaatacttgctacgaactctgaactggtggggacattaacccgttcatgcaaagatgaaactttcctgctccaggccccgctgcagcggcgaatcctggaaattggcaagaaacacgggatcactgagctccaccctgatgtggtctcatacgtgagtcacgccactcagcagcgcctccagaacctggtggaaaagatctccgagacggcccagcagaagaatttctcatataaagatgatgacagatatgaacaggcatctgatgtgagggcccagctcaagttcttcgaacaactggaccagatagagaaacagcgcaaagacgaacaggaacgcgagatcttaatgcgtgccgctaagtcacgaagtcgccaggaagaccccgagcagctgaggcttaagcagaaagccaaggaaatgcagcagcaggaactcgctcagatgcgccaaagagatgccaacttaactgcgctggccgctattggcccacggaaaaagagaaaggtcgactgtcccggacccggctcaggagcggaggggtccggcccaggctctgtggtgcctggtagctcgggagtggggacgccccgccagttcactcgccagcggattacccgagtgaatttgcgagatcttatcttctgcctggagaacgaacgggaaaccagccatagtttacttctctacaaggcttttttaaagtag

SEQ ID NO: 207956 - DNA, 2589 bp, Artificial Sequence
  Description of Artificial Sequence: Synthetic coding sequence
atgcccgccggcctgaccgagcccgccggcgccgccccccccgccgccgtctctgcaagcggaaccgtcaccatggctccagccggggccttaccagttcgcgttgagtcgacccccgtcgccttaggcgctgtgacaaaagctcccgtgtccgtgtgtgtggagcctactgccagccagcctctcagaagtcctgtcggcacactcgtgacaaaagtagcacccgtctccgccccgcccaaagtaagctctgggccgagactgcccgcacctcagatcgtagctgtgaaagctccgaacacaacgacaatacagttccctgccaacctgcagctccccccagggaccgtcctcattaagtcaaactcaggccccctgatgctggtgagtcctcagcagacagtgacacgggcagaaacaacctcaaacatcacttcgcgcccagccgtacccgcgaatccccagacagtgaagatctgcacagtgcctaatagttccagtcagcttatcaagaaggtggctgttacccccgtcaagaaattagctcagattggaaccactgtagtgaccacagtccccaaaccaagctcagtacagagtgtggcagtacctacctccgttgtgacagtgaccccaggtaagccactgaacacagtaactactctcaagcctagctccctcggtgcctcttcaacaccatctaacgaaccgaatttgaaagccgagaactctgccgcagtacagatcaatctgtcaccaaccatgttggaaaatgttaagaaatgcaagaacttcctggctatgctgataaagctggcatgcagcggatcccaatcaccggaaatggggcagaacgtcaagaagctggtagagcagctcctcgacgccaaaattgaggccgaagagtttacgcggaagctgtacgtagagctgaaaagcagtccccagccacaccttgtcccatttcttaaaaagtctgttgtggctctaaggcagctgttgccaaactctcaatcatttattcagcagtgtgtgcagcaaacttccagtgacatggtgatcgcaacttgcacgactactgtcacaacttctccagtcgtcaccactaccgtgtcctcgtcgcagtctgaaaagtccatcatcgtgtccggtgctaccgctccgcggactgtgtccgtacagaccttgaacccacttgccggccctgtaggcgccaaggccggagtggttaccctccacagcgttggtcccactgcagccacaggcggtaccacagccggaacagggctgctgcagacgtctaagcccctggtgacttccgtggcgaatacagttaccaccgtgagtcttcaacccgagaaaccagtcgtgtcaggtacggctgtgacacttagcctcccggccgtgactttcggggagacgagtggggccgcgatatgcttaccctcagtcaagcctgtagtttcctcagcaggcactacttctgataaaccagtgattgggactcctgtgcagattaagctcgctcagcccggccctgtgctgagccagcccgcggggattccacaagctgtgcaggtgaagcagcttgtcgtgcagcaaccctcaggaggaaacgagaagcaggtcaccaccatttcccacagttccactctcaccattcaaaaatgtggtcagaaaacaatgccggtgaatacaatcattcccacctcgcaatttccaccggccagtattctgaaacaaattactctgcccggtaacaaaattctgagcctgcaggcctccccgacgcagaagaatcgcatcaaggaaaatgtgacaagttgctttagggacgaagatgacatcaacgacgtgaccagcatggccggggtgaacctgaacgaagagaatgcctgcattttggccaccaactctgagctggtgggcacacttatccagtcctgtaaggatgagccatttctcttcattggtgccctgcagaagcgcatcctcgatatcggcaagaagcatgatatcaccgagctgaatagcgacgcagtgaacctgatatcacaggcgacccaggagaggctaagagggctgttggagaagctcaccgcaatcgcccagcacagaatgacgacgtacaaagcctcagaaaattacattctgtgttccgacacaagaagtcagctaaagtttttggaaaaactggatcagcttgagaaacagcggaaggacttagaagaacgggaaatgttgctgaaggccgcaaagtcacgatcaaacaaggaagatccagaacagctccggttgaaacaaaaggctaaagaactgcaacagttggaactggctcagatacaacacagagatgcaaacctcacagcattggccgcaattggaccacgtaaaaagagacccctggagtctggtatcgagggactgaaagataacctgctggcatccggcaccagcagccttacagctactaagcagctacaccgtccacgcattaccagaatctgcctcagagatctcattttctgtatggaacaggagcgagaaatgaagtactctcgcgccctgtacctcgccctgctgaaatag

SEQ ID NO: 207957 - DNA, 1857 bp, Artificial Sequence
  Description of Artificial Sequence: Synthetic coding sequence
atgcccgccggcctgaccgagcccgccggcgccgccccccccgccgcagtgtccgctagcggcactgtgactatggctcccgcaggcgctctccctgttcgggtggagagtacaccagtggccctcggggctgtcaccaaagcacccgtgtcagtttgcgtggagcctaccgcctcccagccccttcggtcccccgtgggcaccctggttacaaaagtggcacccgtctcggctcctcctaaggtctctagcgggcctagactgcccgcaccacagattgttgctgttaaagcaccgaacaccacgacaatccagtttccggctaacctgcaactgcctcccggaaccgtccttataaagtccaactccggccctctcatgctggtgtcccctcagcagacagtgacaagggcagagaccaccagcaatatcacctcacggcccgccgtgcccgcaaacccgcagactgtgaagatatgcacagtgcccaactcctcctctcagttgattaagaaagtggccgtcacccccgtgaaaaagctggcccagatagggaccaccgtggtcaccaccgtcccaaagcccagcagtgttcagtccgttgcagtcccaacaagcgtggttacagtaacccctggaaagccacttaacacagtgaccactctcaagccctcaagcctgggcgcgagcagtactccatccaatgagcctaatttgaaggcggagaacagcgccgccgtccagatcaacctttcccccaccatgttagagaatgtgaaaaaatgtaaaaattttctggccatgctcatcaaactcgcgtgctcaggctctcagtctcccgaaatgggccagaacgttaaaaagttggtggaacagcttctcgatgccaaaatcgaggctgaagaatttaccaggaagctctatgtagagctgaagtcgtccccgcagcctcatctcgtcccctttctcaagaagtccgtggtcgctctccgccagcttttgccgaattcacaatctttcatccagcagtgtgtacagcagaccagtagcgatatggtgattgcaacttgtactacaaccgtgacaacatccccagtcgtgacaaccacagtgtcctcctcgcagtcggaaaaatccatcattgtctctggagcaacggccccacggaccgtcagcgtgcaaaccctcaaccccctcgctgggccggtcggagcaaaggctggggtggtgactcttcactcagtgggacccactgccgctaccggtggcactacagccggcacaggcctgctccagacctccaaaccgctcgtgacctccgttgccaacaccgtcacaacagtttcactccagcctgagaagcccgtcgtgtcaggtaccgcagtcacgttatccttacctgctgtaacctttggcgaaacgtccggcgccgcgatctgcctgcccagcgtcaagcctgtggtgagctctgctggaaccacttctgacaagcccgtcattgggacacccgtgcagattaagcttgcacagcctgggccagttctttcccaaccagctggtatcccccaggccgttcaagtgaaacagcttgtggtccagcagccctctggaggaaatgaaaaacaggttaccaccatttctcactcaagtactcttacgattcagaaatgcggacaaaagaccatgccagtgaacacaatcataccgacttcccagtttccccccgcatcaatcctcaagcagataacactacctggaaataagattctgtccctccaggccagccccacccagaagaacaggatcaaagaaaacgtaacgtcctgtttcagaagcactttcatttgcgtgtactag

SEQ ID NO: 207958 - DNA, 2598 bp, Artificial Sequence
  Description of Artificial Sequence: Synthetic coding sequence
atgcccgccggcctgaccgagcccgccggcgccgccccccccgccgccgtgtccgctagcggaactgtcacgatggcaccagcgggcgccctacctgtgagagtagagtccaccccagttgccctaggtgccgtaaccaaggccccagtctcagtgtgcgtggaacccacagcctcccagccactcagatctccagtgggaaccctcgtgacgaaagttgcccctgtcagtgcgcctccgaaagtttcttccggcccgcgcctgcccgccccccaaattgtggcagtcaaggctcccaacacaacgacaattcagttccctgccaacctgcagcttccacctggaaccgtcttgatcaagtcgaacagcggcccactgatgctcgtgtccccccagcaaaccgtcacccgggcagagactacctcaaatatcacaagccggcctgccgttcccgccaaccctcagaccgtcaagatctgcaccgtgccaaactcatcgagccagttaattaaaaaagtggctgtgactcctgtcaagaagctggcccaaatcggcaccactgtggtgacaacggttcccaaaccgagctcagtgcagagcgtggccgtccccacatccgttgtgaccgttacacccggaaaacccctgaacactgtgacgaccttaaagccatccagcctcggcgccagcagtacgccatccaacgaacccaacttaaaagcggagaactctgctgccgtgcagatcaacttgtcacccacaatgctggagaatgtcaagaagtgcaaaaatttccttgccatgttgataaaactggcgtgtagtggcagccagtccccagaaatgggccagaatgtaaagaaactggtggaacagttgttggacgctaagatagaagcagaggaattcactcggaaactctacgtcgagttgaaatcatccccccaacctcacctcgtgccgtttcttaagaaatctgtagtcgcactgcgtcagctacttccgaatagccaaagtttcattcagcaatgtgtacaacagacttcatcagacatggtgattgctacttgtacaaccacagtgactacctcacctgtggttacaactacagtctcttccagccagagcgagaagagtatcatcgtgtccggtgccactgcgcctcgcacagtgtctgtccagacattgaacccacttgcggggccggtaggtgccaaggcaggagtagtcacactgcatagtgtggggcctacagctgccacaggaggcaccacggcaggaacagggttgctccagacaagcaaacctctcgtgacatccgtcgctaatactgtgaccacagtgtccctgcagccagagaaacccgtcgttagcggaaccgccgtcaccttgtccctccctgccgtgactttcggcgaaacctctggcgcagctatatgtcttcctagcgtaaagcctgtcgtcttctgttgggaccatataaaaccagtcataggcacacctgtgcagataaagctcgctcagcctggcccagtcctaagtcagcctgcggggattccgcaagccgttcaggtgaagcaactcttctccctctttcaggtagtccaacagcctagtgggggcaatgagaagcaagtgactacgatttctcattcctccactctgacaattcagaagtgcggccaaaagaccatgcctgttaacacaattatccccaccagccagtttccacctgcctcaatacttaagcagatcacactacctggcaataaaatactgtccttacaagcctcccccacacaaaagaataggatcaaggagaacgtgacaagttgttttcgcgacgaagatgatatcaatgatgtcacgtccatggccggtgtaaatttgaatgaggagaacgcatgcatcctagccactaacagcgaattggtgggcaccctcatccagtcttgcaaagatgaaccatttctgtttatcggcgcccttcagaaacggatccttgacattggcaaaaaacatgacatcacggaactaaactccgacgccgtaaacctcatatcccaggctacacaagaacggcttagaggactcttagagaagctgaccgctatcgcccaacatcggatgacaacatacaaggcctcagagaattacatactgtgcagcgacacccgctcacagttgaaatttttggagaaactcgaccagctcgagaagcaaaggaaagatctggaggagagggagatgctgctcaaggcagctaaaagtaggagcaacaaagaggacccagaacagctgagactcaagcagaaagctaaggagcttcaacagctcgagcttgctcagattcaacaccgcgacgctaatttaactgccctggccgccattggtcctcggaagaagcgccctctggaatccggcattgagggacttaaggataatttacttgcttcgggaacaagctcattaacagctactaagcagcttcacagaccacgaatcacccgtatctgtctgcgggatctgattttttgtatggagcaggagagggagatgaaatacagcagggcgctgtaccttgcactcctgaagtag

SEQ ID NO: 207959 - DNA, 2238 bp, Artificial Sequence
  Description of Artificial Sequence: Synthetic coding sequence
atggccgccctggccgaggagcagaccgaggtggccgtgaagctggagcctgaggggccccctactttgctcccaccccaggccggtgacggtgccggtgaagggtccggaggcactactaataacggacctaacggaggggggggcaacgtggctgctagctcttcaaccgggggtgacggcggtaccccaaagcccacggttgccgttagtgccgccgcaccggccggggccgcaccggtacccgcggcagctcccgatgctggtgccccccatgacagacagacacttttagctgttttacagttcctccgacagtccaaattacgcgaagcggaggaggccctgaggcgcgaagccggcttgctggaagaggcagtggccgggtcaggcgcgcccggggaagtagactccgccggagccgaggtgacgtccgccttgctatccagagtgacagccagtgcaccaggaccagctgctccggacccccccggaaccggagccagcggagcaacagtagtcagcggatccgcttccggccctgcagcacccggcaaagtcgggtctgtggccgtggaagatcagccagatgtgagcgctgtgctgagcgcctacaaccagcagggagatcccaccatgtacgaggagtactattcaggcctcaaacacttcatcgagtgtagcttggactgtcaccgggccgaactaagtcagctcttttatcccctgttcgtgcacatgtatcttgagttggtctacaaccaacatgaaaacgaagccaaatctttctttgagaagttccacggcgatcaagagtgctactatcaggacgaccttcgtgtcctgtcctctctaaccaagaaagagcacatgaaaggtaatgagaccatgcttgacttccgtactagtaagtttgtcctgaggataagtagagattcgtaccagctgctaaaaagacacctgcaagaaaaacagaacaaccagatctggaacatcgtacaggaacacctgtacatcgacattttcgatgggatgcccagatccaaacaacagatcgatgccatggtgggcagtcttgctggtgaagctaagcgagaagccaacaaaagtaaggtcttttttgggcttctgaaggagccagaaatcgaggtccccctagacgacgaggacgaagagggagaaaacgaggaaggcaagcctaagaaaaagaagcccaaaaaagactcaatcggttctaaaagcaaaaaacaggaccctaacgcccctccacagaataggatacctttgcccgagctgaaggactctgataagcttgacaaaatcatgaacatgaaggagacgactaagcgtgtgcgcctgggacctgattgtttgcccagcatctgcttctacacattcctcaatgcttaccagggcctcacagcagtagatgttactgatgactcctcccttattgcaggcggtttcgctgattcgactgtgagggtatggtctgtaacgcccaagaaattgaggtctgtaaagcaggcatcggacctgagcttaattgataaagagtccgatgacgtcctggaaagaatcatggacgagaagaccgcatccgagctcaaaatcctctatggccactctggccctgtgtacggagccagcttttctccagatcggttgtgggctacggatcactaccagccactgagaatttttgctggtcatctagccgacgtgaactgcactcgtttccaccctaatagtaactatgttgctacgggtagcgccgaccgtaccgtaagactgtgggacgtccttaacggcaattgtgtcagaatcttcacaggtcataaaggtccaatccactcacttaccttcagccctaatgggcgatttctcgcgaccggcgccaccgacggacgtgtgttattgtgggatatcggtcacggactgatggttggagagttgaagggccataccgacaccgtctgttccctgcggttctcccgggatggcgaaatcttagccagcggatcaatggataacacagtgcgactctgggacgctatcaaagccttcgaggatttggagacagacgacttcacaaccgccacgggtcatattaacctccccgaaaatagtcaggaactccttctgggaacctacatgacaaaatccacaccggtagtgcatctacacttcacccggagaaatttagtcttggccgccggcgcatattctcctcaatag

SEQ ID NO: 207960 - DNA, 2403 bp, Artificial Sequence
  Description of Artificial Sequence: Synthetic coding sequence
atggccgccctggccgaggagcagaccgaggtggccgtgaagctggaaccagagggccccccgacgctactgccaccacaagccggtgatggcgcaggggaagggagcggaggtacgacaaataatggcccgaacggtggtggcggaaatgtggcggcttcatcttccacagggggcgatggcggcacgcccaaaccaactgttgccgtcagcgctgccgccccagctggggcggcaccagttcccgccgctgctccagatgcaggggcaccacacgaccgacagacactgttggccgtgctccagtttcttaggcagagcaagctccgagaagctgaagaagcgctaagacgagaggctggcctcctggaggaggctgtggccgggtccggggcaccaggagaggtcgatagcgccggcgctgaggttacatcggcgctattatcaagagttaccgccagcgctcccgggccagccgcccctgatccccctggcacaggagcatccggggccacagtggtctcgggttctgccagcgggcccgcagctcccggaaaggtgggatcggtcgccgttgaagatcaaccagatgtgagcgctgtgctgtctgcatacaaccagcaaggcgatccaaccatgtacgaggaatactattccgggcttaagcacttcatcgagtgttcattggattgccaccgggctgagctaagtcaacttttctatcccctgttcgtacatatgtacctggagctcgtctacaaccagcacgaaaacgaagctaagtcattctttgagaagttccatggagaccaggagtgttactaccaagatgacctgcgagtgttgtctagtctcaccaagaaggagcacatgaaaggaaacgagaccatgctagactttagaacttccaaattcgtactgcgcatcagcagagatagctatcaactgctgaagcgccacctccaggagaaacagaacaatcagatatggaatatcgttcaggagcacttgtatatagacattttcgacggaatgccacgctctaaacaacagatcgatgccatggtgggcagtctggccggggaagcgaaaagggaggcaaataagtccaaagtcttctttggattgctgaaggagccagagatcgaggttcccctggatgatgaggacgaagagggcgaaaatgaagaaggcaagcctaagaagaaaaaacccaaaaaggatagtatcggcagcaaaagtaaaaagcaagacccaaacgcaccccctcagaatagaatccctctgcctgagctgaaggatagcgataagctcgacaaaatcatgaacatgaaagagacaacaaaacgggtgcggctggggccggattgcttaccctctatctgcttctacacattcctcaacgcttatcaagggctgactgctgtcgacgttactgatgactccagtctgattgctggaggattcgctgacagcacagtacgcgtatggtctgtcacgccaaaaaagctgcgctccgttaagcaagcttcggaccttagcctgatagacaaggagtctgacgatgttctagagcgtatcatggatgaaaaaacagctagcgaattgaaaatcctgtacggccacagcggccccgtctatggtgcaagcttttccccggaccgtaactatctattgtcttcaagtgaggatggcacagtccggctctggtcattgcagacatttacttgtcttgtgggctacaaggggcataactatcctgtatgggatacccagttcagtccgtatggatattattttgtttcaggtggacatgatcgcgtggccagactgtgggccactgatcactatcagcccctccgcattttcgccggccatctggcggatgtcaactgtactcgtttccaccctaatagtaactatgtggctactggcagtgccgaccgcacagtacggctatgggacgtactaaacggcaactgcgtgagaattttcactggccacaaggggccaatccactctttgacttttagccctaacggacggtttctggccaccggagcaacagacggtcgggtgctcctgtgggacatcgggcacggcctaatggtaggcgagctcaagggacacaccgacaccgtgtgctctctccgtttcagcagggatggcgagatcctggccagcggaagcatggacaataccgttcggctgtgggatgccatcaaggccttcgaggaccttgagacagatgactttacaacagcgaccgggcatataaacttgcccgaaaattcacaagaactgttattgggcacctacatgacaaagtcaacaccggtggtgcacctccacttcacacggcggaatctggtgttggccgccggtgcttatagccctcagtag

SEQ ID NO: 207961 - DNA, 2034 bp, Artificial Sequence
  Description of Artificial Sequence: Synthetic coding sequence
atggccgaggagaagaagctgaagctgagcaacaccgtgctgccctcagagtctatgaaagtcgttgctgaaagcatggggattgcacagattcaggaagagacttgtcagctgttgacagatgaggtgtcttatcgcataaaagaaattgcccaggatgccttgaaattcatgcacatggggaaacgacaaaaactgaccacctcagacatagactatgctctaaagttaaaaaacgttgagcccctgtacggattccacgcacaggaattcatccccttccgtttcgccagtgggggtgggcgcgagctatatttctacgaagagaaggaagtcgatttgtctgatatcatcaacacccctcttccccgcgtgcctctggacgtttgcttaaaggcacactggttaagtatcgaaggatgtcagcccgccatccctgaaaatccaccacctgcaccaaaggagcaacagaaggctgaggctactgaacccctgaagtccgccaaacctgggcaggaggaggacggtcctctgaaggggaagggtcagggggccacaacagctgatggtaagggaaaagagaaaaaagcccccccccttctggaaggagccccactaaggctgaagcctagaagcatccatgagttatccgtagagcagcagctctattacaaggaaatcaccgaggcctgcgtaggcagttgcgaggcgaaacgtgcagaggctctccagtcgatcgccaccgatcccggcttgtatcagatgttgcctagattctctacctttataagcgaaggagttcgggttaacgtggtgcagaataatctcgctctgctgatttacttgatgcgtatggtcaaagctctgatggacaatcccacactgtatctggagaagtatgtgcacgagctgattcccgccgtgatgacatgcatcgttagtcgccagttgtgcttgcggccggacgttgataatcactgggctctaagggactttgccgcacgcttggtcgcccaaatctgtaagcacttttctacgaccacgaacaatattcagagtcgaatcaccaagacatttaccaaatcatgggtagatgaaaaaacaccctggaccacacgctacggctcgatcgcgggcttggcagagctggggcatgacgtgatcaagaccttgattctgccgcgtctgcaacaggagggcgaaagaattcgctctgtactcgacggtcccgtactttccaatattgacagaatcggtgctgatcatgttcagagcttgctcttaaagcattgtgcaccagtcctggccaagctccgtcccccacctgataaccaggacgcttacagggcggagtttggaagtcttggccccctgctgtgttcacaggtagtaaaagcaagagctcaggctgccctgcaggcgcagcaggttaacaggacaactctgaccataacccaaccccgaccaactctcaccctgtcgcaagcaccgcagcctggcccgcgcacaccaggattgttgaaggtccccggatcaattgccttacccgtgcagacgttagtttctgccagggctgcggcgccaccccaaccctcccccccccctactaaattcattgttatgagcagtagttcaagtgcaccgtcaacccagcaggttctctccctcagcacctctgcacctggtagcgggtccactaccacctctcccgtgacaacgacagttccctccgtgcaaccgatcgtcaagctggtctcgacggcaacaaccgctcccccaagcacagctcccagcggccccgggagcgtccagaagtacatcgtggtgtctctgccccccacaggggagggcaagggcggaccgacttcccacccctcgccagtccctccccctgccagctctccgtcaccactctccgggagtgctctctgtggtgggaagcaagaggccggggattcgcctcctccggctccagggaccccaaaggccaatggtagccagcccaactcaggtagcccccagcccgcgccttag

SEQ ID NO: 207962 - DNA, 231 bp, Artificial Sequence
  Description of Artificial Sequence: Synthetic coding sequence
atggccgaggagaagaagctgaagctgagcaacaccgtgctgccctcggaatcaatgaaggtcgtagcggaatctatggggattgcccaaatacaagaagagacctgtcagcttttgacagatgaagtgagctacaggatcaaggagatcgcccaggatgccctgaagttcatgcacatgggcaaaaggcagaagctgaccacatctgacattgactatgccctgaagtag

SEQ ID NO: 207963 - DNA, 1806 bp, Artificial Sequence
  Description of Artificial Sequence: Synthetic coding sequence
atgcacatgggcaagcggcagaagctgaccaccagcgacatcgactacgccctgaaacttaaaaacgtcgaacccctttacggttttcatgctcaggagttcatcccgtttcggtttgccagcgggggcgggagggaactctacttctacgaggagaaagaggtagatctttctgatataatcaatacgcctctgcctcgggtgcccctggatgtctgcctgaaggcacctaaagagcaacagaaagctgaggctaccgaaccgctcaaaagcgcgaagccaggccaggaagaggacggtcctttgaagggaaagggtcaaggagctacaaccgcagatggcaagggcaaagagaagaaggcgcctccgctgctggaaggcgcacccctgcggttaaagcctagaagcattcatgaactgagtgtggagcaacagctttattataaagagatcaccgaggcgtgcgtagggagctgcgaggctaaacgcgctgaagcgctccagagcatagccacagaccccggactctatcaaatgttaccgagattctcaaccttcatttctgaaggcgtgcgtgttaatgtggtccagaataatttggccctgctgatttacctgatgcggatggttaaagccctcatggacaacccgaccctctacctggaaaagtatgtgcacgagcttatcccggccgtgatgacatgcatagtgtctagacaattatgtctgaggcctgatgtcgacaaccattgggcactgcgtgactttgcagctcggctcgttgcccaaatctgcaagcacttctccacaacgaccaacaacatccagtcccgaatcacaaaaacattcaccaagagttgggtcgatgagaaaacaccctggacgaccaggtatggcagcatagctggactggctgagctgggccacgacgtaatcaagaccctaatccttcctcgcttacagcaggaaggtgagcgaatccgttcagtgctggatgggcccgtcctaagtaacattgatcgcatcggggccgaccacgttcagtccctgctgctcaaacactgcgcccccgtgttagctaaactgcggcctccccctgacaatcaggacgcctatcgcgctgagtttggctctcttgggcctttgctgtgcagccaggtggttaaggcccgcgcccaagccgctctccaagcacagcaggtgaacaggactactctcacgatcacccagccaagacctacgctgacattgagccaagccccacagccaggaccacgaacccccggactgctgaaagtacctggcagcatcgctttacctgtacaaacacttgtttccgctagagcggcagcccctccccaaccatctccaccccccaccaaattcatagtaatgtctagtagttcttcggctccaagtacccagcaggtgctgtccctttctacgtccgctcctggctccgggagcacaacgaccagtccggtgacaactaccgtgccttcagtgcagcctattgtgaaactggtcagcacagctactaccgctcccccttccactgcacctagtggccccgggtcagtacagaaatacattgtggtctccctgccgcctactggagaggggaaaggcggtcctactagccacccttctcctgtaccgccaccagccagttctccctccccactctctggaagcgctttgtgcggaggaaagcaggaggccggggatagcccgccccccgctcctggtacaccgaaagccaacggaagccagccaaacagcggctctcctcaacccgccccatag

SEQ ID NO: 207964 - DNA, 45 bp, Artificial Sequence; identical to SEQ ID NO: 101770
  Description of Artificial Sequence: Synthetic coding sequence

SEQ ID NO: 207965 - DNA, 2145 bp, Artificial Sequence
  Description of Artificial Sequence: Synthetic coding sequence
atgaccaagcggcggctgcagaccatcaccgcctgcctgcagctgcgagaaggatcccccagcctgcataggggcctacaccccagccgagaagaaaagagagacagtcgaatggcggaggagaagaaattgaaactgagcaacaccgtcctcccgtctgaatctatgaaagttgtggccgaaagcatgggaatcgcacagatccaggaagaaacatgtcagctcctgactgacgaagtgtcataccggatcaaagaaatagcccaagatgcactcaagtttatgcatatgggcaagaggcagaagttaaccacttctgacatcgactacgctctgaagttgaagaacgtcgaaccattgtatgggttccacgcgcaggaatttatccccttcagatttgcctccggaggagggagagagctgtacttctatgaggagaaggaggtggacttgagcgatataataaatactcctctcccgagggtccccctggatgtttgtctgaaagctcactggttgtccattgagggctgccagcccgccattcctgagaacccccctccagcccctaaggaacaacagaaggcggaagctactgagccattgaagtcagctaagcccggacaggaggaagatggcccactcaaaggcaaaggccaaggggctacaacagccgatgggaaaggcaaagaaaagaaggctccgcccctgcttgaaggcgcaccactcagactaaagccacgctcaatccacgagctcagcgtagaacagcaactgtattataaagagattacagaagcttgtgtgggttcctgcgaagcgaaaagggctgaggcactgcagtcaatcgccacggaccccggcctttatcaaatgcttccacgctttagtacatttatcagtgaaggcgtacgggtgaacgtagtccagaacaatctagccttacttatttatctcatgcgcatggtcaaggccttgatggataatccaacgctatatctggaaaaatacgtgcatgagctcatccccgccgtaatgacctgcatcgtttcacgtcagctgtgtctgcgccccgacgttgataatcattgggcattaagggactttgcagcccggttggtggctcaaatatgtaagcacttttccaccaccactaataacattcagtccagaatcactaaaacttttaccaaatcgtgggtcgacgagaagactccatggactaccaggtacggctctattgctgggctcgcagagcttggtcacgatgtcattaagactcttatactgcctaggctgcaacaagagggcgagcggatccggtctgttttagatggaccagtactcagtaatatcgataggattggggccgaccatgtccagtccctgctgttgaagcactgtgcaccagttctggccaagctccgccctcctccggataatcaggatgcctaccgcgctgagtttggctccctcgggccactgctgtgcagccaagtcgttaaagcgagagctcaggcagccctacaagcccaacaggttaacagaacaacattaactattactcagccacgtcccactctaaccctgagtcaggcacctcagcctggccccaggactcctggcctgctgaaagttccagggtctatagctctcccggtgcagactctcgtctccgcgagggctgctgctcccccccaacccagtccgccacctactaagttcatcgtcatgtcctcgagcagttctgctccctccactcaacaagttctgtcactatccaccagcgcccccggctctggctctaccacaaccagtcccgtgaccaccaccgtccccagcgtccagcctatcgttaagttggtctccactgccacaacagctccaccttcaacagcaccctccggacccgggagcgtccaaaagtatatcgtggtgagtttgcccccaacgggggagggcaaaggtggccctacatcccacccttcacccgttccccccccagcctcaagcccatctcctctctcaggctcagctttgtgcggggggaagcaggaggcaggagactcccctccgcccgcccctggaacacctaaggccaacggctcccagcccaattctggcagccctcagcccgccccgtag

SEQ ID NO: 207966 - DNA, 702 bp, Artificial Sequence
  Description of Artificial Sequence: Synthetic coding sequence
atggccgaggagaagaagctgaagctgagcaacaccgtgctgccctctgaatccatgaaagtggtcgctgagtcaatggggattgcacaaatccaggaagaaacttgccagctcctgacagacgaggtaagttaccgcataaaggaaatcgctcaggatgccctcaagttcatgcatatgggcaagcgacagaaacttacaacatcggacattgattacgctttaaagctcaagaacgtggagccgctgtacggttttcatgcacaggagttcatcccattccgcttcgctagcggcggagggcgtgagctgtatttttacgaagagaaggaagtcgatctgtccgatattattaacactcctctgccgcgagtgccactggatgtctgcttgaaggcccccaaagagcagcaaaaagcggaagcaactgagcccctcaagtccgctaagccaggccaagaagaggatggtccacttaagggcaaaggtcagggagccacaacagccgatggcaagggcaaagagaagaaagcaccgccgctgctcgagggtgctcccttaagattgaagcctagatctatccatgagctcagcgtcgagcaacagctgtattacaaggagattaccgaggcctgtgtggggtcatgcgaagctaaaagggccgaggcgctgcaatccatcgctaccgatcctgggttatag

SEQ ID NO: 207967 - DNA, 405 bp, Artificial Sequence
  Description of Artificial Sequence: Synthetic coding sequence
atggccgaggagaagaagctgaagctgagcaacaccgtgctgccctccgaatccatgaaggtggtggcagaaagtatgggcatcgcccagattcaggaagagacctgccagctgctgaccgatgaggtgtcttatcgcattaaggagattgcccaagacgctcttaaattcatgcacatgggaaaacggcagaaattaactactagcgacatagattacgctctgaagctgaaaaatgtcgagccactgtatggttttcacgcgcaggagttcatacccttccgcttcgcctcaggggggggacgcgaattgtatttttacgaggaaaaagaggtcgacctgtccgacattattaacacccctctcccccgggtgcctctggacgtatgccttaaggcgcattag

SEQ ID NO: 207968 - DNA, 345 bp, Artificial Sequence
  Description of Artificial Sequence: Synthetic coding sequence
atggccgaggagaagaagctgaagctgagcaacaccgtgctgccctccgagagcatgaaggtagtcgccgagtctatgggcatcgcccaaattcaggaggaaacgtgtcagctgttaacagatgaggtgagctataggatcaaagaaatagcccaggacgccctgaagtttatgcatatgggaaaaagacagaaacttaccacttctgatatcgattatgccctgaagctgaagaatgtggaacccctgtacggcttccatgcccaagaattcattccctttcgttttgcgtctggcgggggccgtgagctttatttttatgaagagaaagaagttgatttgtag

SEQ ID NO: 207969 - DNA, 2034 bp, Artificial Sequence
  Description of Artificial Sequence: Synthetic coding sequence
atggccgaggagaagaagctgaagctgagcaacaccgtgctgccctccgaatccatgaaggtggtggccgagagtatgggcatagctcagatccaagaagagacctgccagctgctaactgacgaggtatcataccgaatcaaagaaatcgcccaggatgcattaaagttcatgcatatggggaagcggcagaagctgacaacatctgacatagattacgcactgaagttaaagaacgtcgaaccgctttatgggtttcacgcacaggagtttatccccttcagatttgcctccggaggaggacgtgaactgtatttctatgaggagaaggaggtggatcttagcgacataattaacacgccgctgccccgcgtccccctggatgtgtgcctaaaagcgcattggctctcaatcgaaggctgtcaacctgccatcccagagaatccaccccctgccccaaaagaacaacagaaggcggaggccacagagccactgaagtcagccaaaccaggccaggaagaagacgggccgctgaaaggcaaggggcagggcgcaacgaccgcagatggcaaggggaaagagaagaaagcccccccattgctggagggagcccccttgcggttgaagccgaggtccatccacgagttaagtgtcgagcaacagttgtattataaagaaattaccgaggcttgtgtgggaagttgcgaagcaaagcgggcagaggctttacagagcattgccactgatccaggactgtatcagatgctgccacggttctctacatttatcagcgaaggcgtgcgggtgaacgtcgtccagaataatctggccctattaatataccttatgcgtatggtgaaagctctcatggacaaccctacgttgtacctggagaaatacgtgcacgaactcatcccggctgtcatgacatgcatcgtgagcaggcagctctgcctgcgacctgatgtcgacaaccattgggccctgagagatttcgccgcaagactcgtggcccagatttgcaagcacttttctaccacgacaaacaacatccagtcacgaatcactaaaactttcactaaaagctgggttgacgagaagaccccttggactacacggtacggctctattgcaggtctggctgagctgggccacgacgtgatcaagaccctaatcctgccacgattgcaacaggagggtgagcgcatcagatcggtgttagatgggccagtgctgtcaaacattgatcgaatcggtgctgatcatgtccagtcactgcttcttaagcattgcgcccctgttttggctaagcttcgccccccgccggataaccaggatgcctacagggccgagtttggaagcctaggtcctcttctgtgttcacaggtcgttaaggcacgggcacaggcagccctccaggcccagcaggtaaacaggacaactttgactattactcagcctagacccaccctaacactcagtcaagccccccagcctgggccacggactcctggacttttaaaggtgcccggatctatcgccctcccagtgcagacgctggtttcagcccgtgccgctgcacctccccaaccatcacctccgccgaccaaattcattgtcatgtcttcttcgtcatcagcaccatctacccagcaggtgctgtccctctcaaccagtgctccaggcagtgggagcacaactacctctcccgtaaccaccaccgtccccagtgtgcagccaatcgtgaaattagtgtccactgccacaacagcaccaccaagtactgcaccctcaggccctggcagtgtacagaaatatatcgtggtgtctttaccgccgactggcgagggcaaggggggtcctacctcccacccttcccctgtccctccccctgcctcatccccatcgcctttgtccggcagtgccctatgcggcgggaagcaagaggcgggcgattctccccctcccgcacctggcactcccaaagccaacggttcccaaccaaactccgggtctccacaaccagccccttag

SEQ ID NO: 207970 - DNA, 2034 bp, Artificial Sequence
  Description of Artificial Sequence: Synthetic coding sequence
atggccgaggagaagaagctgaagctgagcaacaccgtgctgcccagcgaaagcatgaaagttgtggcagaatccatgggaatcgcgcagatccaggaggaaacatgtcagctgttgactgacgaagtctcctaccgtattaaagagatcgcccaggacgccctcaagttcatgcatatggggaagcgccagaaacttacgacatcggatatcgactacgcactcaagctgaaaaacgtcgaaccactgtacggctttcacgcacaggaattcatcccattccggtttgcaagtggaggcggccgggagttatatttttatgaggaaaaagaagttgatctgtccgatataattaatactcccctgccacgggttcccctggacgtgtgcttgaaagcccattggcttagcatcgagggctgccaaccagctattcccgagaatcctccacctgctcccaaggagcaacagaaagcggaggcaaccgagcccttgaaaagtgctaaacccggtcaggaagaagatggcccccttaaaggaaaaggtcagggcgccactactgccgatggaaaagggaaggagaaaaaggcaccaccactgttagagggcgcacctctgaggctcaaacctcggtctattcatgagctcagtgtagagcagcagctgtactacaaagaaataacagaggcgtgcgtaggaagctgcgaggcaaagcgagcagaggccctgcagtccattgcaacggatcctggtctctaccagatgcttccgcggtttagtacatttatcagtgaaggcgttcgggtcaacgtcgtgcagaataacctagccctattaatctacctcatgcgtatggtcaaagctctcatggataatcctaccctttatctggagaagtatgtgcatgagcttatcccggcagtcatgacttgcattgttagtcggcagctttgtctgaggccagacgtggacaatcactgggcccttagagatttcgcagcacgtcttgtagcacagatttgtaaacacttttctactactactaacaacatacagtcaaggattaccaaaacctttaccaaaagttgggttgatgaaaagacaccttggacgaccaggtacggttctattgcaggattagcggaacttggtcacgatgtcatcaagacactgattcttcccaggttacagcaggaaggagagcggattaggtctgtgcttgatggccctgtgctgtccaatatcgacagaattggagctgaccacgttcagtctttgctgttaaaacactgtgctcctgtgctggccaaattgcggcctccacccgataaccaggacgcctacagggccgagtttggctccttgggccccctcctttgttcccaggtggttaaggcccgggctcaggccgcccttcaggcgcagcaggtgaaccggacgactcttaccatcacccagccaaggccaactctgacactgtcccaggcacctcaacccggtccacggacaccaggtctgcttaaagtcccagggagtatcgctcttcccgtccagactctcgttagcgcccgcgctgctgcgcctcctcagccgtccccccctcccaccaagttcatagttatgtccagctcctcttccgctcccagcacccagcaggtcctcagtctgtcaacatctgccccgggatcagggtccacaaccacgagtcctgtgacaacaactgtgccttctgtgcagcccatcgtgaagctcgtgagcacagcgactacagcacctccatccactgccccgtctggcccaggatctgtacaaaagtacatcgtggtatcactgccccccactggggagggaaagggagggccaactagccatcccagtccagtgccaccaccagcatcaagccccagcccactttctggcagcgccctctgtgggggaaaacaggaggctggagatagcccaccaccagcgccgggcactcccaaggccaacgggagtcaacctaatagtggctctccccagcctgcaccatag

SEQ ID NO: 207971 - DNA, 30 bp, Artificial Sequence; identical to SEQ ID NO: 101777
  Description of Artificial Sequence: Synthetic coding sequence

SEQ ID NO: 207972 - DNA, 2205 bp, Artificial Sequence
  Description of Artificial Sequence: Synthetic coding sequence
atggacatccggcacagcgagttcctgccctgcctgcactgcccccctttcgttgggcccctgcccgtctcgcatgtcagtttctccagcgcctgtcctgtgcctttgcccggatcaccttcactgcaccgtgggctccaccccagccgtgaagaaaaaagggactctcgaatggctgaggaaaaaaagctgaagctgagtaatacagtgctgcctagcgagagtatgaaagtggtcgccgagtcgatggggatcgcccaaatccaagaggaaacctgccagctgctgacagatgaggtttcctaccgcattaaagagatagcccaggatgcactgaaattcatgcatatgggtaaacgccaaaaactcactacatcagatatcgattatgcgctcaagcttaaaaacgtggaacccctgtatgggtttcacgcccaagaatttataccttttaggtttgcgtctggcggaggccgcgaactgtatttctacgaggaaaaggaggtcgatctgtccgacatcatcaacacccctttaccccgcgtgccccttgacgtgtgcttgaaggcacattggctgtccattgagggttgtcagcccgctatccccgagaaccctcctcccgcacccaaggagcagcagaaagccgaggccaccgagccccttaagtcggctaagccaggccaggaggaggatggtcctttaaaaggcaaaggtcagggagccaccacagcagacggcaaaggcaaggaaaagaaggcaccaccgctgttggaaggcgctcctctgcggttaaaaccccgcagcatccacgagctgagtgtggaacagcagctgtattataaggagatcaccgaggcctgcgtggggtcttgcgaggctaaaagggctgaagctttgcagtccatagctacagatcccggtctttaccagatgctgccccggttttcaacgtttatttctgaaggagttcgcgtcaacgtggtgcaaaacaacctggcactactcatctacttgatgcgtatggtgaaagcactcatggacaatcccacgctttatctggagaagtatgttcatgagcttatccccgctgtaatgacatgtatcgtctcgaggcaactgtgtctgaggcccgatgtggacaaccattgggccctgagggattttgcagcacggcttgtcgcgcagatctgcaagcatttttcaacgacaactaacaacatccagagtaggatcacaaaaaccttcaccaagtcatgggtggatgagaaaacaccttggactactcgatacggttcaatcgctgggcttgctgagttgggccacgacgtgataaaaaccctgatcttaccacgtctgcaacaggagggagaacgtatccgtagcgtgttagatggccctgtgttgtcgaacattgatcggataggagccgatcatgttcagagtctactccttaagcattgtgcccccgttctggcaaaactccgcccgcctccagacaatcaagatgcttaccgcgctgagttcgggagcttaggccccctgttatgtagccaggtcgtaaaagcacgggcccaggccgctctgcaggctcagcaggtcaatcgtacgaccctgactatcacacagcctcgacccacactgacactgtctcaggccccacagccaggcccaaggacccctgggctgttaaaggtgcctggaagcattgctctcccagtgcagacacttgtttcggcccgagccgccgcccccccacagccttccccacccccaaccaaatttatcgtcatgtccagctccagttccgccccttccactcaacaggtgctctcactctccacatccgctcctggtagcggctcaaccactacgagcccagtgacaacgactgtgcctagcgtgcagccaattgtgaaattggtctctacagctaccactgcgccaccctccaccgctccatcaggtccaggttctgttcaaaaatacattgtggtctctctgccccccacaggcgaaggcaagggaggcccgacatctcatccctcgccagtgccacctccagctagtagcccgtctccactgagtggatctgccctatgcgggggcaagcaagaggccggagattcgcctccccccgccccgggtacccctaaagccaacggatcacagcctaattccggatctccacagccagctccatag

SEQ ID NO: 207973 - DNA, 768 bp, Artificial Sequence
  Description of Artificial Sequence: Synthetic coding sequence
atggccgaggagaagaagctgaagctgagcaacaccgtgctgccctcggagtccatgaaagtggtggccgagagcatgggtatcgctcagatccaggaggagacctgccagctgctgacggatgaagtgtcttaccggatcaaagagatcgcccaagatgctctgaaatttatgcatatgggcaagcgacagaagttaacaacctcagatatcgattacgcactgaagctcaaaaatgtcgaacccctgtatggcttccatgcccaggaattcataccctttcgttttgcgtcaggaggcggtagagagctgtatttctacgaagagaaggaggtggacctaagtgatattatcaatacaccattgcccagggtgccccttgatgtatgcctcaaggctcactggctgtctattgaaggctgccaacccgccatcccggagaatccaccaccagctcccaaagaacagcagaaggcagaggctaccgagccactgaaaagtgcgaaaccagggcaggaagaggacggccccctgaagggaaaaggacagggagccacaactgcagatgggaaaggcaaggagaaaaaggctccacctctgctagagggagccccactgaggctcaaaccacgcagcatccacgaactatcggttgaacagcagctctactacaaggagataaccgaggcctgtgtcggatcgtgcgaagccaagcgtgcggaagccctgcaaagtattgcaacagatcccggactgtaccagatgtag

SEQ ID NO: 207974 - DNA, 1050 bp, Artificial Sequence
  Description of Artificial Sequence: Synthetic coding sequence
atgagcaagagcaaggacgacgccccccacgagctggagagccagttcatcctccgtctgcctcctgagtacgcgtccacagtacgcagggccgtgcagtctggccacgtgaatctgaaggatagactcacaatagaactgcatcccgatggaaggcatggtattgtccgagtcgaccgcgtcccattagctagcaagctggtcgacctcccttgcgtaatggaaagccttaagacaatcgacaaaaagacgttttacaagactgcggacatatgccaaatgctcgtttctacagttgacggcgatttatatccacccgtggaggagcccgtggcgtcgactgaccctaaagcatcaaaaaaaaaagacaaggacaaggagaagaagttcatttggaatcacggcattacgcttcccttgaagaacgttcggaagcgaaggtttaggaaaacagcgaagaaaaaatatattgagtctcctgacgtggagaaagaagtcaaaagactgttgagtaccgatgccgaggcggtttccacccgctgggagataattgcagaggatgagacaaaggaggcggaaaaccaagggttggacatatcctctcccggcatgtccggacaccggcaagggcatgattccctcgaacacgatgagctgagagagattttcaacgatttatccagcagcagcgaagacgaagacgagactcagcaccaggacgaagaagacattaacattatcgatacggaagaagatctggaacgccagctccaagataagcttaacgaaagtgacgaacagcatcaggagaatgagggaaccaaccaacttgttatgggcattcagaaacaaattgacaacatgaagggtaagctacaggagacacaggacagagcgaaacgacaggaagatctgattatgaaagttgagaatttggctctgaaaaatcgcttccaggcagtactggacgagctcaagcagaaggaagatcgagagaaagaacagctgtcatctcttcaggaggaactcgaatccctgctagagaaatag

SEQ ID NO: 207975 - DNA, 909 bp, Artificial Sequence
  Description of Artificial Sequence: Synthetic coding sequence
atgagcgagagccaggacgaggtgcccgacgaggtggagaaccagttcattctcagactccctctggaacacgcttgcaccgtacgaaatctggctaggagtcagtcggtgaagatgaaggacaagctgaaaattgatctcctgcctgacggcagacatgccgttgtcgaggtcgaagatgtgcctctggcagcgaaactggttgatctgccctgtgtgattgaaagccttagaaccctcgacaagaagacgttctacaagacagctgatattagccaaatgttggtctgtaccgcagacggtgatatccatctatccccagaagaaccagccgcttccactgaccctaatatagtcagaaagaaagaaaggggccgggaggaaaagtgcgtgtggaagcacggaattaccccccctctaaagaacgttcgcaagaagagattccggaagacgcagaaaaaggtcccagacgtgaaggaaatggagaaatccagcttcaccgagtacattgagtccccggacgtggaaaacgaggtgaagaggcttctgcggtccgacgccgaggccgtatccacccggtgggaggtgattgcagaggacggcacaaaggaaatcgagagtcagggttccatccctggcttcctcatttcgagtggcatgtcttcccacaaacagggccacacatctagtgtgatggagattcaaaagcagattgagaagaaggaaaaaaagctgcacaagattcagaacaaagctcaacggcagaaggaccttataatgaaggtggagaacctgactctcaaaaaccacttccagtctgttctcgaacagctggagctgcaggaaaaacagaaaaacgagaaacttataagtctgcaagagcagctccaaaggtttttgaaaaaatag

SEQ ID NO: 207976 - DNA, 1131 bp, Artificial Sequence
  Description of Artificial Sequence: Synthetic coding sequence
atgagcgagagccaggacgaggtgcccgacgaggtggagaaccagttcattcttcgcctcccactcgagcatgcctgcactgtccgaaatctagcgcggtcacagtccgtgaagatgaaggataaattgaaaattgacctactcccagatggaaggcatgctgtcgttgaagttgaggacgttcctttagcagctaagctcgttgatctcccatgtgttattgagtctttgcgtacactggataagaagactttctataaaaccgccgatataagccagatgctggtgtgtactgccgatggcgacatacatcttagtcccgaggagcccgccgctagtactgatcctaatattgtccggaagaaggaaaggggtagggaagaaaagtgtgtctggaaacacggtatcacaccgcccttaaaaaacgtcaggaagaaacggttcaggaaaacacagaaaaaggtaccagacgtgaaggagatggagaagagcagctttaccgagtatatagagtcccccgacgtcgagaatgaagtgaaaagacttcttcgttcagatgctgaagcagtctccactcgttgggaagtgattgccgaagacggaaccaaggagattgaaagtcaagggagcatcccagggtttctgatctcaagcggaatgtcaagtcacaagcagggacacactagttcggaatatgacatgttgcgagaaatgtttagcgattcacggagcaataatgacgatgatgaggatgaagacgatgaggatgaggacgaggacgaagacgaagatgaagacgaagacaaagaagaagaagaagaagattgctcagaagagtatctggagaggcagctacaggcagagtttattgagtctggccagtaccgggcaaacgaggggacatcttctatcgtaatggaaattcagaagcagatcgagaaaaaagagaagaagctgcacaaaatccagaacaaagcccaacggcagaaggacctgatcatgaaggttgaaaatctgaccctcaaaaaccacttccagtccgtactcgagcagcttgaacttcaggagaaacagaaaaacgaaaagctcattagcctgcaagagcaattgcagcgatttctcaaaaagtag

SEQ ID NO: 207977 - DNA, 909 bp, Artificial Sequence
  Description of Artificial Sequence: Synthetic coding sequence
atgagcgagagccaggacgaggtgcccgacgaggtggagaaccagttcattctccggctgcctctggagcacgcctgcaccgtgcgcaacctagccaggagtcaatctgtcaaaatgaaggacaaattgaagattgacctcttgccagacggcagacatgcggtggtggaggttgaggatgttcccctggcggccaagctcgtggatttaccgtgcgtgattgagtctctgcgtactctggataagaagacattttataaaacggctgatatctcgcagatgctggtgtgtaccgccgacggagacatccacctttcgccggaggagcccgcggcgagtacagatccgaatatcgtccggaagaaggaacgcggccgtgaagagaaatgcgtgtggaagcatggcattacacctcctcttaagaacgtgagaaagaaaagatttcgcaagacccagaagaaggttcccgacgtaaaagagatggagaaaagttcattcacggagtacattgagtcaccggacgtggagaatgaagtcaaacgcctgctgcgaagcgatgctgaggccgtaagcacgcgttgggaggtcatcgcagaggacggtactaaggagatcgagtctcagggcagcattccgggttttttaatctcgtccggaatgagctctcacaaacagggccatacatctagcgttatggaaatccaaaagcagattgaaaaaaaagagaagaagctgcacaagatccaaaataaagcccagcgccaaaaagatttgattatgaaggtggagaatctgacgctaaaaaaccattttcaatctgtgcttgagcagctagaactgcaggagaagcagaagaacgagaaactcatctccctgcaggagcaactccagcgctttcttaagaaatag

SEQ ID NO: 207978 - DNA, 1389 bp, Artificial Sequence
  Description of Artificial Sequence: Synthetic coding sequence
atggagtgccccgagggccagctgcccatcagcagcgagaacgactctactccgacggtgtcaacgtcagaggtgacgtcccagcaggaaccacagatccttgtggataggggttctgagacaacctatgaatcgtcggctgacatagctggggacgaaggaactcagatcccagccgatgaagatactcaaaccgacgccgatagctccgctcaagcagctgctcaagcgccggagaattttcaggagggcaaggatatgtcggagtcccaggacgaggtgccagacgaggtggaaaaccagttcatacttcggctacctctggaacatgcttgtacggtgcgcaacctcgcccgctcccagagcgtcaagatgaaagataaactcaagatcgaccttttgcctgacggccggcacgccgtcgttgaggtcgaggatgtccctctcgctgctaaactagtcgacctgccttgtgtgatcgagtcgttacgcacactggataaaaagaccttctataaaactgccgatatctcacagatgctggtatgtacagctgacggagatattcatctgagcccagaggaacctgcagctagcacagaccctaacatagtgcgtaaaaaggaacgcgggagggaggagaaatgtgtctggaaacacgggatcacaccccccctgaagaacgtgcgcaaaaagcgatttagaaaaacccaaaagaaggtgcccgacgttaaagaaatggaaaaatcttctttcactgaatacatcgagtctcccgacgtggagaacgaagtgaaaagactgcttcggagtgatgccgaagcagtgtcgactcggtgggaggtaatcgcagaggacggtacaaaggaaatagaatcacaaggcagtatacccggctttctcatatccagtggcatgtcctcgcacaaacagggccacacgtcaagcgagtacgacatgctgagggagatgttttcagactctagatctaataatgacgacgatgaggacgaagacgacgaggatgaagacgaggatgaagatgaagatgaggatgaggacaaggaggaggaggaagaggactgttcagaggagtaccttgaacggcagctgcaggctgaatttatcgaatccggtcagtacagagccaatgagggtaccagcagcatcgttatggaaattcaaaagcagatcgaaaaaaaggaaaagaagctgcataagatccaaaacaaggcccaacgacaaaaggacctgatcatgaaagttgagaatttgactctgaagaatcacttccagagtgtgttggagcagctggagctgcaagagaagcaaaaaaacgaaaaattgatcagcctccaggaacagttacagagatttctcaaaaaatag

SEQ ID NO: 207979 - DNA, 1548 bp, Artificial Sequence
  Description of Artificial Sequence: Synthetic coding sequence
atgggcaactgggtggtgaaccactggttcagcgtgctgttcctggtggtatggctgggactgaatgtcttccttttcgtcgatgctttcttgaaatatgagaaagccgataaatactattatacccggaagattctcgggtctacacttgcttgtgcccgggcatctgcattatgcctgaattttaactccacccttatcctgctgcccgtctgccgcaacttgttgagctttctccggggcacttgctccttttgcagcagaacattgaggaaacagttggatcacaatctcacattccacaaactggtggcctacatgatttgtctgcatactgcaatccacataatcgcacatctcttcaattttgactgttattcccgcagtaggcaggctaccgatggcagcttggcatctatcctgagcagtttaagtcatgacgagaagaaaggcggatcctggttgaaccccatccagtcaagaaacacgaccgtcgaatacgtgacattcacgagcatagcagggctgacaggtgtgatcatgaccatcgctttgatactcatggtgaccagcgccacagaattcattagacgctcatacttcgaggtgttctggtacacacatcacctgtttatcttctatatactgggtctcggtatacacgggattggtgggattgtacgtggccagaccgaagagagcatgaacgagtctcatcctcggaaatgcgcggagtcctttgagatgtgggacgatcgtgacagccattgccgccgccccaagtttgaaggacaccctccagaatcctggaaatggattcttgccccggtgatactctacatttgtgagaggatcctgaggttctacagatcccagcagaaagtagtgatcacgaaagtggttatgcatccgtctaaagtgcttgagctgcagatgaataagcggggttttagtatggaggtgggccagtatattttcgtaaactgtccatcgatttctctcctggaatggcacccattcaccttgacatcagcgcccgaagaagattttttctccattcacatccgcgccgcaggcgactggacagaaaacttaatccgtgctttcgagcaacagtattctcccatcccgcgcattgaggttgacggaccgtttgggaccgcaagcgaagacgtgtttcaatacgaagtcgccgtcctggtaggcgccggcattggagttactccttttgcaagcatactcaaaagcatctggtacaagtttcagtgtgccgaccacaatctgaagaccaagaaagtcgggcacgcagccttaaattttgataaggctaccgacatagtgactggcctgaagcagaagacttctttcggtcgaccaatgtgggataacgagttttctaccatcgccactagccaccccaagagcgtggtcggcgtattcctgtgcggcccaaggacactggcaaaaagcttgcgcaaatgctgccaccgctacagcagcctggacccacgaaaggtacaattctatttcaacaaggaaaacttttag

SEQ ID NO: 207980 - DNA, 795 bp, Artificial Sequence
  Description of Artificial Sequence: Synthetic coding sequence
atggagagcggcaagaccgccagccccaagagcatgcccaaggacgcccagatgatggctcagattttaaaggatatgggcatcactgagtacgaaccacgggtgatcaaccagatgcttgagtttgccttccgctacgtgactaccatactggatgatgcaaagatctatagcagccatgccaagaaggccacagtcgatgccgacgatgtgcgccttgccattcagtgtcgagccgaccagagttttacatcacctccaccccgggacttcctgctggacatcgcgcgccagaggaaccaaacccccttgccacttatcaaaccgtattctggaccccgcttaccaccagatcgatattgccttaccgcacccaactaccgcctgaaaagcctccagaaaaaggcctcaactagtgccggccgtataactgtgcctaggctgagtgtcggatcggtcacctctagacctagtacccctaccctaggtactccgacaccacagacgatgagcgtctccaccaaggttgggacaccaatgagcttgactggtcaacggtttacagttcagatgcccacatcacagtcaccagcggtgaaagcatcaatcccagcaacttctgctgtgcagaatgttctgatcaatccttccctgatcggcagtaaaaatattctcattactactaatatgatgtcgtcgcagaacaccgcaaacgaaagctcgaacgctctcaaaagaaagcgcgaggacgacgatgacgacgatgatgatgacgatgattacgataatctgtag

SEQ ID NO: 207981 - DNA, 510 bp, Artificial Sequence
  Description of Artificial Sequence: Synthetic coding sequence
atgtgccaccggaagcccggcacccccggcgtgggcaagaccacccttgggaaggaactggctagcaaatctggcctaaaatatattaacgtcggggacttggctcgggaagagcaactgtatgacggttatgacgaagagtatgattgtcccatattggacgaggatagagttgtcgatgagctcgacaaccaaatgagagaaggaggcgtgatcgttgactatcacggttgcgacttcttccccgagcggtggttccacattgtgtttgtgctcaggaccgatacaaatgtgttgtacgagcgcttagagaccaggggatataacgagaagaagttaacagacaatattcagtgcgagatctttcaagtgctctatgaagaggctacagcaagctacaaagaggagatagtgcaccagctgccctctaataaaccagaggaattggagaataatgttgaccagattcttaaatggatagagcagtggataaaagaccataactcgtag

SEQ ID NO: 207982 - DNA, 519 bp, Artificial Sequence
  Description of Artificial Sequence: Synthetic coding sequence
atgctgctgcccaacatcctgctgaccggcacccccggcgtgggcaagaccaccctgggtaaagagctggcttcgaagtcaggcctaaagtacattaacgtcggcgacctcgccagagaagaacaactttatgacggctacgacgaggagtacgactgccctatcctggacgaagatagagtggtcgacgagttggacaaccaaatgcgggaggggggggtgatcgtagactaccacggttgtgacttcttcccagagaggtggtttcatattgttttcgtcctcaggaccgataccaacgtgctgtacgagcgcttggagaccagaggctacaacgaaaagaaactgacggacaacattcagtgtgaaatttttcaggtgctctatgaggaagccacggcctcttacaaggaagagatcgtacaccagctaccttccaataagcctgaagaactcgagaataacgtggatcagatccttaaatggattgagcagtggatcaaggaccacaactcgtag

SEQ ID NO: 207983 - DNA, 597 bp, Artificial Sequence
  Description of Artificial Sequence: Synthetic coding sequence
atggagagcggcaagaccgccagccccaagagcatgcccaaggacgcacagatgatggcgcagattctaaaggacatgggcattactgagtacgaaccccgcgtgattaatcaaatgcttgagttcgcctttcgctatgtcaccacaattctcgacgacgccaaaatttacagttcccacgcaaaaaaagcgaccgtggacgctgacgacgtgagactggccattcagtgcagggccgatcagtccttcacctcaccacctccgagggactttctgttggatatagccaggcagcgcaatcagacccccctcccactgattaagccatacagcggcccacgtctaccccctgacagatactgtttgaccgctcctaactatagactgaagtctctacagaaaaaggcaagcacatccgccggacggattacagtgcctcggctcagcgtcggctctgtgacaagccggccttcaacacccacactggggacgcctactccacagaccatgtctgtgtccacgaaggtggggacccccatgtcccttaccgggcagcggttcaccgtgcagatgcccacaagccaatcccctgcctag

SEQ ID NO: 207984 - DNA, 411 bp, Artificial Sequence
  Description of Artificial Sequence: Synthetic coding sequence
atggagagcggcaagaccgccagccccaagagcatgcccaaggacgcacagatgatggcgcagatactcaaggacatgggcatcacagaatacgagcctcgagtcattaatcagatgttagagtttgcttttcgttatgtgacaactatcctggatgacgctaaaatttatagcagccacgcgaagaaggccaccgtggatgccgatgacgtgcggctggccattcagtgtcgtgcagaccagtccttcacaagcccacctcctcgggatttcctgcttgatattgcaagacagagaaatcagacaccacttcccctgatcaagccttattctggtccacggctcccccccgaccgatattgtctcaccgctccaaactatcgacttaaaagccttcaaaagaaagcctag

SEQ ID NO: 207985 - DNA, 795 bp, Artificial Sequence
  Description of Artificial Sequence: Synthetic coding sequence
atggagagcggcaagaccgccagccccaagagcatgcccaaggacgcacaaatgatggcgcagatcctgaaggacatgggaatcacagagtacgaaccaagagtcatcaatcaaatgctagagtttgcattcagatacgtgactactattctggatgacgcgaaaatctactcttctcacgcaaagaaagccaccgtcgatgcagacgacgtgcgactcgctatacagtgcagggccgaccagtcctttacaagcccaccacctcgagactttctgctcgatatagctagacagagaaaccaaacaccgctccccctcataaaaccctatagcggacccagactgcccccggacagatattgcctcactgccccaaactacaggcttaagtctcttcagaagaaggcaagcacctctgccggtagaatcacggtcccacgactctccgtgggcagcgttacaagcaggccgtctacccccacacttggtacccccaccccacagaccatgagtgtgtctactaaggtgggcaccccaatgagtctcactggtcaacggttcaccgtccagatgccaacctcacaatcgcctgctgtgaaggctagcatccctgcaacatcagcagtgcagaacgtgcttattaaccctagcctgattgggtccaaaaacatcctcatcacaactaatatgatgagctctcaaaataccgccaacgaatcaagtaacgccttaaaacggaaacgggaggatgacgacgatgacgacgacgatgacgatgactacgataacctgtag

SEQ ID NO: 207986 - DNA, 309 bp, Artificial Sequence
  Description of Artificial Sequence: Synthetic coding sequence
atggagagcggcaagaccgccagccccaagagcatgcccaaggacgcccagatgatggcccagatcttgaaagacatggggattacagagtatgaaccacgtgtgataaaccagatgttagaatttgccttcaggtatgtgaccacaatactggatgacgcaaagatctattcatcgcacgccaaaaaagctacagtggatgctgacgacgttcgccttgctattcagtgccgagcagaccagagcttcaccagccccccaccccgtgacttcctcctagacattgccagacaaagaaatcagacatag

SEQ ID NO: 207987 - DNA, 501 bp, Artificial Sequence
  Description of Artificial Sequence: Synthetic coding sequence
atggagagcggcaagaccgccagccccaagagcatgcccaaggacgcacagatgatggcgcagatccttaaggacatgggtataacagagtatgagccacgcgtcattaatcagatgcttgagtttgcgtttcggtatgtgactactatacttgacgacgccaagatatatagcagccatgctaaaaaggctactgtggacgcagatgacgtccgcctggcgatccagtgcagggctgatcaatcttttacgtcacccccgcccagggatttcctgctcgatatcgcccgccagcggaaccagactcccctgcccctcattaagccttatagcggtccaagactgccccccgacaggtactgcttaaccgctccaaattatcgtctcaagagcttacagaaaaaggccagcacctcagcaggccgcattaccgtgccgagacttagtgtagggagcgtaaccagcaggcccagtacaccaactctggggaccccgacctag

SEQ ID NO: 207988 - DNA, 384 bp, Artificial Sequence
  Description of Artificial Sequence: Synthetic coding sequence
atggagagcggcaagaccgccagccccaagagcatgcccaaggacgcgcagatgatggctcagattttgaaggatatgggcattaccgaatatgagcccagggtgatcaatcagatgctggagtttgcgttccgctacgtgaccaccatcttagacgacgccaagatatatagttctcacgcaaagaaagctacagtcgacgccgacgacgtaagactggcgatccaatgcagggcagatcagagctttacatcacctccaccccgcgattttcttctagatatcgccaggcagaggaaccagactccactccctctgataaagccttactctggcccacgactcccccccgacaggtattgtctcacagctcctaactactag

SEQ ID NO: 207989 - DNA, 756 bp, Artificial Sequence
  Description of Artificial Sequence: Synthetic coding sequence
atggagagcggcaagatggccccccccaagaacgccccccgggacgcattggtgatggctcagattcttaaggatatgggcattacagaatatgaaccccgagttatcaaccagatgttggagttcgcttttcgatacgttacaacaattctggatgacgctaagatctattcaagtcacgcaaagaaacccaacgtagacgcggacgacgtacgcctcgctattcagtgccgagctgaccagtcatttacatcccctcctcctcgcgacttcctcctggacatcgctaggcaaaagaaccaaacccccctgccgttgatcaaaccttacgctggacccaggctgccacctgaccggtattgcttgacagccccaaactacagactaaaatcacttatcaagaaaggtccgaaccagggcagacttgtgccacgccttagcgtgggagcagtgagttccaaacccactactccaacgattgccactccccagactgtgtcagttcctaataaagtggccacacccatgagtgtcacaagtcagaggttcaccgttcaaataccgccaagccagtcaactcccgtcaagccggtaccggcaactactgccgtccagaacgtcttaatcaatccatcgatgatcggtcccaagaacatactcattaccaccaatatggtgtcgtctcagaacactgccaatgaggctaacccgcttaaaagaaaacatgaggatgacgatgacaacgacatcatgtag

SEQ ID NO: 207990 - DNA, 879 bp, Artificial Sequence
  Description of Artificial Sequence: Synthetic coding sequence
atgcccctgcacgtgaagtggcccttccccgccgtgccccccctgacctggactcttgcttcctctgtggtgatgggactcgtgggaacctactcgtgcttctggacaaagtacatgaaccatttaacagtccacaacagggaggttctgtacgagttgattgagaaacgaggtccagcgaccccattaattacagtgtccaatcatcagtcgtgtatggacgacccgcatctatggggaattctaaagttgagacatatatggaatctaaaactaatgaggtggacccctgctgctgccgacatctgtttcacgaaggagctgcacagccactttttcagcctgggcaagtgcgtgccagtctgtaggggcgccgagttcttccaggctgaaaacgaagggaagggtgtgctggacaccgggcgccacatgcctggggccggtaaaagaagggagaagggggatggcgtttaccagaagggaatggactttattctcgagaagttaaaccatggagattgggttcacattttcccagagggcaaggtcaatatgagcagcgagtttctccggtttaagtgggggatcggcaggctgattgccgaatgtcatctcaaccctataattcttccactgtggcatgtgggcatgaatgacgtgctccctaatagccctccctattttccaagattcggtcaaaagataactgtgcttatcggcaagcctttttctgcacttcccgtactggaacgtctacgagccgagaacaaaagcgccgtggaaatgcggaaagccctgacagactttatccaggaggaatttcaacaccttaaaacacaggcggaacagctgcacaaccacctccagccagggcggtag

SEQ ID NO: 207991 - DNA, 789 bp, Artificial Sequence
  Description of Artificial Sequence: Synthetic coding sequence
atgcccctgcacgtgaagtggcccttccccgccgtgccccccctgacatggaccctggccagcagtgtggtcatgggcctcgttgggacatattcctgtttctggacaaagtacatgaaccaccttaccgtacacaatcgagaagttctttacgaactgatcgagaagagaggacctgcaactcctctgatcaccgtgagcaatcaccagtcttgtatggacgatccccatttgtgggggatcttgaaactgcgtcacatttggaatcttaaactgatgcggtggactcccgcagcggccgatatatgtttcaccaaggaactccacagtcacttcttttccctcggtaaatgtgtgcccgtgtgcagaggcgacggagtgtaccagaagggtatggacttcatcctggagaaacttaaccatggcgactgggtgcacattttcccagaagggaaggtcaacatgtcgagtgagttcctgcgttttaaatggggaattggcagactgattgctgaatgtcacctgaatcctatcattcttcccctgtggcacgtcggcatgaatgatgtgctcccaaatagccccccctattttcctaggttcggtcagaagatcaccgtcctgattggcaagcccttctccgccctgcctgtcctcgaacgacttagggccgagaataaatcagccgtcgaaatgagaaaagcattaaccgacttcattcaggaggagttccagcacttgaagacacaagccgaacagctgcacaatcacctgcaacctggcagatag

SEQ ID NO: 207992 - DNA, 837 bp, Artificial Sequence
  Description of Artificial Sequence: Synthetic coding sequence
atgcccctgcacgtgaagtggcccttccccgccgtgccccccctgacatggaccctggcctcttctgttgtgatgggattggtcggaacttattcctgtttctggacaaaatacatgaatcatctcactgtgcacaacagggaggtgctgtacgaattgatagagaaacgtgggcccgcgactcccctgatcactgtctccaaccaccagtcctgcatggacgatccccatctgtggggcattctcaagctccgccacatctggaatttaaagctgatgcgctggacacccgcagccgccgatatctgttttaccaaagaactacactctcattttttctccctcgggaagtgcgtgcctgtgtgcaggggggctgagttcttccaggccgaaaacgaaggtaaaggagtgctggataccggacggcacatgccgggcgctgggaaaagacgagaaaagggcgatggggtctaccaaaagggcatggactttatcctcgagaagctgaaccacggggactgggtgcacattttccccgaaggcattggacgccttattgctgaatgccatctgaaccctatcatcctccctctctggcacgtggggatgaatgatgtcttaccgaattcaccaccctatttccccagattcgggcagaaaatcaccgtgctcattggcaaaccattctccgcgctccctgtgctggagagactgagagctgaaaataaaagcgctgtggagatgcgtaaggcactgacagactttatccaagaagagtttcaacacttgaaaacacaagctgaacagctgcacaaccatctccaacctggcaggtag

SEQ ID NO: 207993 - DNA, 747 bp, Artificial Sequence
  Description of Artificial Sequence: Synthetic coding sequence
atgcccctgcacgtgaagtggcccttccccgccgtgccccccctgacctggactcttgcgtcttctgtggtcatgggcctggtgggtacatactcatgcttttggacaaagtacatgaatcatctgactgtccataacagagaggtcctttacgagcttatcgagaaacgcgggccagcaaccccattaataaccgttagcaaccaccagagttgtatggatgatcctcacctgtggggaatactgaaattgaggcatatttggaatctgaaactgatgagatggacccccgccgccgccgacatctgctttacaaaggagcttcattcacatttttttagtctcggaaagtgtgttccagtgtgcagaggcgacggcgtttaccagaagggcatggattttatactcgagaagcttaaccacggagattgggtgcatatctttccagagggcattggtaggctgatagcagagtgtcacctgaacccaattatcttgcctctctggcacgttggaatgaatgacgtgctgcctaacagtccaccctatttcccacggtttgggcagaagatcacagtgttgatagggaagcccttcagtgccctaccagtattagaacggctccgagccgagaataagagtgcagtggaaatgcgaaaagctcttaccgacttcatacaggaggagttccagcacctcaagacacaggcagaacagctgcacaatcaccttcaaccagggcgctag

SEQ ID NO: 207994 - DNA, 798 bp, Artificial Sequence
  Description of Artificial Sequence: Synthetic coding sequence
atgcccctgcacgtgaagtggcccttccccgccgtgccccccctgacttggactcttgccagttctgtggtcatggggctggtaggaacctactcttgcttctggaccaaatacatgaatcatttaaccgtacacaatcgggaggttttgtacgagctcatcgagaagcggggcccagccactccccttattactgtctctaatcaccagtcctgtatggacgatccccatttgtggggaattctcaaactccgacacatctggaatctgaagctgatgcgttggactccggctgccgccgacatatgctttaccaaagaattgcacagccacttcttctctctgggcaagtgtgttccagtatgtaggggcgcagagtttttccaggcagagaatgagggaaaaggtgtcctagacactggtcgacatatgcccggcgcgggtaaacgcagggaaaaaggcaaagtgaacatgtccagtgagttcctgaggttcaagtggggcatcggccgcctgatagctgagtgccaccttaacccgattattctgcccttatggcacgttggaatgaatgacgtgctccctaatagcccaccgtactttcctcgattcggtcagaagatcacggtccttattggtaagcctttttccgccctaccggtgttggagcgcctgcgggctgaaaacaaaagcgctgtcgaaatgaggaaggccctgaccgatttcattcaagaagagtttcagcaccttaagacacaggccgagcagctgcacaatcatttacaaccaggccgctag

SEQ ID NO: 207995 - DNA, 7629 bp, Artificial Sequence
  Description of Artificial Sequence: Synthetic coding sequence
atggtggccctgagcctgaagatctgcgtgcggcactgcaacgtggtgaagaccatgcagttcgaacccagtaccgccgtgtatgatgcctgcagggtcatccgcgaacgagtacccgaggcacaaactggccaggcatctgattatggactgtttttgagcgatgaagatccacggaaagggatctggctggaggctggccgaacccttgactactatatgctgagaaacggcgatattctagaatacaaaaagaagcagcggccacagaaaatccggatgttggatggatctgtgaagactgtgatggtcgacgacagcaagactgtgggtgagctgctggtgactatttgcagtcgaataggaataactaattacgaagaatattcactgattcaggagactatagaggaaaagaaggaagagggaaccggaacccttaaaaaggaccgtacgttgctcagggatgagagaaagatggaaaaattgaaagctaaactccataccgacgacgatttgaattggcttgatcactcgcgaaccttccgtgaacagggggtcgacgaaaacgaaacactgctgttaagaagaaagtttttctattcagatcagaatgtggattcaagggacccagtccagctaaacctcctttacgttcaggcccgcgatgatatcttaaacggaagccaccctgtttcttttgagaaagcttgcgaatttggaggcttccaagctcagattcagtttggacctcatgtcgagcataaacacaaacccggcttcctggacctgaaggagtttttacccaaagaatatataaagcagcggggagccgagaagagaattttccaagaacacaaaaactgcggggaaatgagcgagatagaggctaaggtcaagtatgtgaaactggcccgttcattgaggacttatggggtgagcttttttctggttaaggagaaaatgaaaggaaaaaataaactcgtcccacgcttgctcggaatcactaaagactctgtcatgcgtgtggacgagaagacaaaagaggtgctgcaagaatggcccctgacaaccgtgaaaaggtgggccgccagccccaagtcgttcaccctagattttggagaatatcaggagtcatattacagcgtacagaccacagagggagagcagatttcccagctgattgctgggtacatcgacattatactcaagaagaaacagtcaaaggaccgttttgggcttgaaggcgacgaggagtccacaatgttagaggagagcgtgtcaccaaagaagagcacaattctgcaacagcaatttaaccgcacagggaaggccgagcatggatctgtggcacttcctgccgtgatgaggtccgggtctagcggtcccgagactttcaacgtgggctcaatgccaagcccacagcagcaggtgatggtcgggcagatgcaccgtggacatatgcccccgctgaccagtgctcaacaagcacttatgggtaccatcaatacaagtatgcatgccgtccaacaggcgcaggacgatctgagcgagctggactccctgccacctctcggccaagacatggcatcaagggtctgggtccaaaacaaggtggacgagtccaagcacgaaattcatagccaggttgatgcaattaccgccgggactgcttctgtggtgaacttaacagctggagaccccgccgataccgattatacagccgttgggtgtgccattaccacaatttcctcaaacttaacagagatgtccaagggtgtaaagctcctggcagcccttatggacgatgaagtcggaagcggcgaagatctcctgagagcagcacgcaccctggccggcgccgtgtctgacttgctgaaagcagttcagcctacctccggagaaccgaggcagaccgtgctgactgcagccggctccattggtcaggcctccggtgatctgctgcgccagattggcgaaaacgaaaccgacgagcggtttcaggacgtgctgatgagtttggcaaaggctgtggccaatgctgccgcaatgctcgtcttgaaggccaagaacgtcgcccaggtggccgaagatacagtccttcagaaccgcgtaatcgcggccgccacccaatgtgctcttagtacttcccagctcgtggcttgcgcaaaagttgttagtccgaccattagttcacccgtatgccaagaacagctgattgaagccggtaagctcgtggataggagcgtggagaactgtgtccgcgcttgtcaagcggccacaactgattcggaacttctgaagcaggtgtctgccgctgcctccgtagtttcccaggccctacatgatctgcttcaacatgtaagacagttcgcctctcgtggcgaacccataggacgatacgaccaggccactgataccattatgtgcgttaccgaatctatcttttcttcaatgggggacgccggcgagatggtgcgccaggctagggtcctggcgcaggcaacctctgacttggtgaacgccatgcggagtgatgccgaagctgagattgacatggagaactcaaagaaactgctcgcagccgccaagcttctcgcagattccaccgcccgaatggtggaggcggctaagggggctgccgcgaacccagagaatgaagaccagcaacagcggctccgcgaggctgcagaaggtctacgggtcgccacgaacgcggccgcccaaaacgctatcaagaagaaaattgtcaatcgacttgaggtggccgcaaagcaggcggcagcagcagctactcagactattgcggcatcccaaaacgccgccgtgtccaacaagaatcccgcagcacagcagcagctggtccagtcctgcaaagccgtggctgatcatatccctcaacttgtgcagggagttagagggagccaggctcaagcagaagatttatcggcacaactcgcccttattatatcttcccagaattttctacaaccgggaagcaaaatggtgtcgagcgcaaaagcagccgtacctaccgtaagtgatcaggcagccgccatgcagttgtcccagtgtgctaagaacttagctacctctctggctgagctgcggacggcaagccaaaaggcgcacgaagcgtgcggtcccatggagattgatagcgcgcttaacaccgtccaaaccctgaagaatgagctccaggatgccaaaatggctgccgtggagagccagttgaagccacttccgggggagacacttgaaaagtgcgcgcaggacttgggttcaacctctaaggccgtgggctccagtatggcgcagttactcacctgcgcagcacagggcaacgaacactatactggagttgcggctagggagacagcccaggctttgaaaacccttgcgcaggccgcccgtggagtggcagcttctaccactgacccagccgccgcacacgctatgttggattcggcccgcgatgtgatggagggctccgccatgctgattcaggaagccaagcaagctttaatcgctcccggggatgccgagcgacagcagcggctcgcgcaagtggccaaagctgtcagccattcacttaataattgcgtgaattgtctgcctggtcagaaggacgtggacgttgcactgaagtccattggagagtcatctaaaaagctgctcgttgatagtttgcctccaagtaccaagcctttccaggaggcacagtcagagttaaaccaggccgccgctgacctaaatcagagcgccggggaagtggtacacgccactcgagggcagagcggagagttggcggccgcctccgggaagttctccgatgatttcgacgaattcttggacgcaggcatagagatggccggtcaggcacagactaaggaagaccagatccaggtgattggtaacctgaagaacatatctatggcctcctctaagttgctcctggcagctaagtcgctgagcgttgatcccggcgctcccaatgctaagaatttgctggccgctgctgcacgcgcagtcaccgaaagtatcaatcaattgattacgttgtgcactcaacaggcaccaggtcagaaggaatgcgacaacgcactgagggagcttgagacagtgaaaggtatgcttgataatcccaacgagcctgtgtccgacttatcatattttgattgtatcgaatccgtgatggagaattcaaaagtgctgggcgagtctatggccggtatttcccaaaacgctaaaactggagatctaccagctttcggagagtgcgtcggaattgcatccaaagcgctgtgcggcttaactgaggccgccgcacaagccgcttacctcgttggaatctcagacccgaattcccaagccggtcaccagggcttagtggatcccatccaattcgctcgtgccaaccaggccatccagatggcatgtcagaatctggtcgatcctggatctagtccctcccaggtgctgagcgctgccacgatcgtggccaagcatacatccgcgctgtgcaacgcttgtcggatcgcttcctctaagaccgcgaacccagtggccaaacgccatttcgtccaaagtgctaaagaagtagctaactcaaccgcaaacctggtcaaaactataaaagctcttgacggcgatttttccgaagataaccggaacaagtgtcggatcgccaccgctccactcatcgaagccgtggagaaccttacagcttttgcctccaaccctgaattcgtgtccataccggctcagatcagttccgaaggaagtcaggctcaggaacccatcctcgtgagcgcaaaaaccatgttggaatcttcctcatacctgattcgaacagcccgatccttggcgatcaacccaaaggatccccctacgtggagtgtgctggctggacacagtcatacggtcagtgactccattaaatcattgataacaagcatccgggacaaagcacccggccagagagagtgcgattatagcatcgacgggattaatcgctgcattcgcgacatagaacaggccagcttagctgctgtgtctcaatctttagcgacacgggacgacatctctgttgaagcactgcaggaacagctgacctccgttgtccaggagattggtcacctcatcgatcccattgctaccgcagccagaggcgaggcagcacaattgggccacaaagtgacacagcttgcttcttactttgaacctctcattctcgcggcagttggtgtcgcaagcaagattctcgaccatcagcaacagatgactgtactggatcagaccaagacccttgcagagtccgctctgcaaatgttgtatgcagcaaaagagggaggaggaaatccgaaggcccaacacacacacgacgctattactgaggccgcacagctgatgaaggaagctgtggatgacatcatggtgacactaaacgaagccgcctctgaagtggggctggtcggagggatggtggatgcaatcgccgaggctatgtctaaattggacgagggaacaccccctgagcccaagggcacgttcgtagattaccagacaaccgtggtcaagtattctaaagcgattgcggtcaccgcccaagagatgatgactaagagcgtgacgaaccctgaagagctgggaggtctggcttcccaaatgacaagcgattacggtcacctggcttttcagggtcagatggctgccgctacagccgaacccgaggagattggttttcaaatccgcacaagagtgcaggatctcggccatggctgtattttcctggtgcaaaaagctggagccctacaggtgtgtcccaccgatagctataccaaacgcgagctaattgagtgtgcacgcgctgtgactgagaaggtgtccctggttctcagcgcactccaggctgggaataaagggacgcaggcctgcattaccgccgccacagcggtgtccgggatcatcgccgacctagatacaacaattatgtttgccacagccggtacactgaatgccgagaatagcgagacctttgcagaccatcgagagaacatcctgaagacggcgaaggctctcgtcgaggacacgaaactcttggtgagtggtgcagcttcaacccctgacaagctcgcccaggcagcccaatcatccgctgctactatcacacagctggctgaggttgttaaattgggagccgccagcctggggtctgatgatcctgaaacccaggttgtgctgatcaacgcaataaaagatgtcgctaaggctctgtccgatcttatctctgctaccaaaggcgccgcgagtaaaccagtcgatgatccctctatgtaccagttgaagggggcggctaaggtgatggtcacaaatgtgacgagtctacttaagacagtgaaggccgtggaggacgaggcaactagggggacccgggcactcgaggcaacgatcgagtgcataaagcaggagttaacagtctttcagagcaaagacgtgcctgagaagacctcgtcaccagaagagtctatcaggatgacgaaggggattaccatggccactgcgaaagctgttgcagccgggaattcatgtcgtcaagaggacgtgatcgcaaccgctaacctctctaggaaggcagtatctgatatgctgacagcttgtaagcaagcctcttttcaccccgatgtttctgatgaggtgcgcaccagggcactcagatttggcaccgagtgcacactgggctatcttgacctgttggagcatgtccttgtgattctgcagaagccaacacccgagttcaagcagcagctggccgccttctccaagagggtcgccggcgcggtgactgagctcattcaagccgccgaggccatgaagggaactgagtgggtcgatccagaggatcctactgtgatcgcagagacagagctactcggagccgctgcctccattgaagctgcagcgaaaaagttggaacagctgaaaccgagggctaagcctaagcaagcggatgagaccttggatttcgaagaacagatcctggaagctgcgaagagcatcgccgccgccactagtgcacttgttaagagtgcgtcagctgcccagcgggagttggtagcgcagggtaaggtgggcagtatccctgccaatgctgccgacgatggacagtggtctcagggtctcatcagcgctgctaggatggtggctgccgcgacttcctccctctgtgaagcagccaacgccagtgtgcaaggtcacgcaagtgaagagaaacttatatccagcgcaaaacaggtggccgcttcaacagcacagttgctggtggcttgcaaggtcaaggccgaccaagacagcgaggccatgcggaggctgcaggccgcaggtaacgccgtgaagcgtgcaagcgacaatcttgtgcgggccgcacagaaagcggctttcggaaaggccgacgacgatgatgtggtagttaagacgaagttcgtgggcggaatagcacagatcatcgctgcccaggaagaaatgttgaagaaagaaagggagctggaggaggcaaggaagaagttggctcagatcaggcaacagcagtataaattcctgcccaccgaactgagagaagacgagggatag

SEQ ID NO: 207996 - DNA, 7629 bp, Artificial Sequence
  Description of Artificial Sequence: Synthetic coding sequence
atggtggccctgagcctgaagatctgcgtgcggcactgcaacgtggtaaagacaatgcagtttgaacccagtaccgcagtttatgacgcgtgccgtgtgattcgcgagcgcgtccctgaggcccagaccggccaggcatccgactacggactcttcctctcagatgaggatcctaggaaaggcatctggcttgaggccggtcgcaccctggattattatatgcttcgcaatggtgacatattggagtacaaaaaaaaacagcgtccacaaaagattcgtatgctggatggctcggtcaaaacagtgatggtcgatgattccaagactgtgggcgagctacttgtgaccatctgtagtcgcatcgggatcacaaactatgaggagtactcgttgatccaggaaacaattgaggaaaaaaaggaggagggcacaggtacactcaagaaagaccgaaccctcttgcgggacgaaaggaaaatggagaagctaaaggctaagctccatactgacgatgatttaaactggctggaccacagtagaacatttagggagcagggtgtggatgaaaatgagactctcctgctgcggcggaaatttttctatagtgaccagaatgttgattccagggacccggtgcagcttaacttgctgtatgtccaggcccgggacgatatcctgaacgggtctcaccctgtaagcttcgagaaggcatgcgagtttggaggcttccaggcgcaaatccagttcggtccacacgtggagcacaaacacaagcccggatttctggatctgaaagaattcctccccaaagagtatattaaacagcgcggggctgagaaacgaatttttcaggaacacaaaaactgcggggaaatgagcgagattgaagcgaaggttaaatatgtgaagctggctaggtccctcagaacatatggcgtgagctttttcctggtgaaagagaaaatgaagggcaaaaataaactggtgccaagactgctgggcatcaccaaggattccgtgatgcgcgtggatgaaaaaacaaaagaggtacttcaggagtggcctctcacaaccgtgaagagatgggcggcctctccgaaaagctttaccttggattttggggagtatcaagagtcttattactccgttcagaccacggagggtgaacagatttctcaactcatagccggttatatagacattattctgaagaagaagcagagtaaggatagatttggcctggaaggagatgaagagtcaaccatgctcgaggagagtgtcagtcctaaaaagtcgactatcctgcaacagcagttcaatagaacggggaaggccgagcacgggagcgtggcgctccctgcagtgatgagatctggcagctccggccctgaaacttttaacgttgggtcaatgccttccccacagcaacaggttatggttggtcagatgcacagaggacacatgccccctctcacgagcgcccaacaggctctgatgggcaccattaacacgtccatgcacgcagtgcagcaggcccaagacgatttgtcggaactcgatagtctcccacctcttgggcaggacatggcgagtcgcgtctgggttcagaataaagttgatgagtctaagcatgaaatccatagccaagtggacgcaatcactgccgggaccgcctcagtagttaatctcaccgctggcgacccagccgacactgactataccgcagtgggatgtgcaattactacaatcagcagtaacctgaccgaaatgtccaaaggagttaagttgctcgctgctctgatggatgacgaagtgggcagtggggaggatctgctgagggccgcacggaccttggccggggccgtgtccgacctgctcaaggccgtgcagcccacttccggagagcccaggcaaacagttctgactgctgccggatcaattgggcaggcatccggtgacttactccgccagattggcgagaacgagaccgatgagcggttccaggacgtactaatgagcctggctaaggctgtggctaacgcagcggcaatgctcgtgttgaaggcaaagaacgtggcacaagtggccgaagatacagtattgcaaaacagagtgattgccgcagccacacagtgcgcactatccacctcccagctcgtggcctgcgcaaaagttgtgtctcccaccatatcgtcgcccgtgtgccaggaacaactgatagaggctgggaaactggtcgaccggtctgtcgagaactgcgttagagcatgtcaggctgctaccacagacagcgagctgcttaaacaagtctcagcagccgcttccgtggtttctcaggcattgcacgatctgttgcaacatgtcaggcaattcgctagccgcggcgagccaatcgggcgctacgatcaagcaaccgataccattatgtgcgtgaccgagagcatcttcagtagcatgggtgacgcgggagagatggtgcgccaagcaagggttctcgctcaggctactagcgaccttgtgaacgcgatgcgctctgacgccgaagctgaaattgacatggagaacagcaaaaagttgctagccgcagcaaagcttttagcagactcaaccgcaagaatggtcgaagccgccaagggagccgccgcaaatccggagaatgaggaccagcaacagcgcctgagagaagctgcagagggacttagggtcgcaacaaatgctgctgcccagaatgctatcaagaagaagattgtgaatagactcgaagttgcagccaagcaggccgccgctgcagccactcagaccattgctgcttctcagaatgcggctgtgagcaacaagaaccccgcagctcagcaacagctggtgcaatcctgtaaggctgtcgcggaccacattccccagctggttcagggagtccgcggatctcaggcccaggctgaagacttgagcgcccagctggcactgatcataagctcccaaaacttccttcagccagggagtaagatggtgtcctcggcaaaagcagcggtccccaccgtctctgatcaggccgctgctatgcagctttcacagtgtgcaaagaaccttgccactagcttggcagaactacggaccgccagtcagaaggcccatgaggcgtgcggccctatggagatagactcagcactcaacacagtccagaccctgaaaaatgagttacaggacgccaaaatggccgcggtcgaatcacaacttaaacctctacctggggaaaccctggaaaaatgtgcccaggatctcggtagcacaagtaaagcagtgggtagctccatggcccagcttttgacatgtgcggcacagggcaacgaacattacactggagtggctgctagggagacagctcaggctctgaaaacactggcacaagcggccaggggggtcgcagcctccactacagatccggccgcagctcacgccatgctggactcggcaagggacgtgatggagggatccgctatgttaattcaggaggctaagcaagccctcatagctccaggagacgccgagcggcagcagcgactcgcccaagttgctaaggctgtgtcacactcacttaacaattgcgtgaattgccttcccggccagaaggacgttgacgtggccctcaagtcgatcggagaaagcagtaagaaattacttgtcgattcacttccccccagtaccaagccctttcaggaggcccagtctgagttgaatcaggctgcagctgacctaaaccaaagcgcaggggaagttgtgcatgccacccgcggtcagtcaggagaactcgcagctgcaagcggtaaattctcagacgatttcgacgaattcctggatgccggaatcgaaatggccgggcaagctcagactaaagaggaccagattcaggtgattggtaacctgaaaaatatctccatggcaagtagcaagcttctccttgcggcaaaatctctgagtgtggatcctggagcccccaacgccaagaacttgttagctgcagctgcccgcgcagtgaccgagagcatcaaccaactgattactctgtgcactcagcaggccccaggtcaaaaggagtgcgataacgctcttagggagcttgagacagttaaggggatgctagacaatcccaatgagcctgtgtcagatttgagctatttcgattgcatcgagtcagtgatggaaaattctaaggtgctgggggaatctatggcagggattagccaaaacgcaaaaaccggagacctcccagcattcggggaatgtgtggggatcgcctcaaaagcgttgtgcggcctgactgaggccgccgctcaggccgcctacctcgtgggcataagcgaccccaacagtcaggctgggcaccaggggctagtggacccaatacagtttgcacgcgcgaaccaggcaatacagatggcttgccaaaaccttgtggatccaggttcctctccaagccaggtactgagcgcagcaaccatcgtcgccaaacacacatctgccctgtgtaacgcgtgtcgtatcgcgtcctctaagacagcgaaccccgtggctaagcgacacttcgtgcagagcgccaaggaagtagctaacagcaccgctaatctggtgaagactatcaaggctctcgacggcgattttagtgaagataatagaaataagtgcaggatcgccacggctccactgattgaagctgtagaaaacctgactgcctttgccagtaaccccgaattcgtgagtatacccgcacagatctctagtgaaggctctcaggcccaggaaccaattctcgtgagtgctaaaaccatgctcgaatcctcttcataccttattcggaccgctcgatcattggcaattaacccaaaagaccctccaacttggtccgtattagccggtcatagtcatacagtgtccgactctatcaagagccttatcaccagcattcgcgacaaagcgccaggccagcgcgagtgcgactattctatcgatggcattaaccgatgtatccgggatattgaacaggcgagtctggccgccgtgagtcagtctctcgcaaccagagatgatatcagtgtggaggctctgcaagagcagctcacaagcgtggtccaagagattggacacctcatcgaccctatagctaccgcggcacgcggcgaggccgcccagttaggtcacaaagtaactcagctcgcctcatacttcgagcctctgattctggctgccgtcggagttgccagcaaaatcctggatcaccaacagcagatgacagtgctggaccaaacgaaaacactggcagaatcagctctccagatgttatatgctgccaaggagggcggcggaaaccctaaggcccagcatacccatgacgctatcacggaggctgcccagctcatgaaagaggctgttgacgacatcatggttaccctcaatgaggccgcaagtgaggtcggcttggtgggtggaatggtcgacgccattgcagaggcgatgagcaagctggacgaagggacaccacctgagcccaagggtacttttgtggattatcagacgacagtggtcaagtacagcaaggcaatcgctgtgacagcacaggagatgatgacaaaatccgttacaaacccagaggagctcggaggcctggcgtcccaaatgactagtgattacgggcacttggcattccagggacagatggctgctgctactgctgagccggaggaaattggctttcagataaggacacgagtacaagatctagggcacggatgcatcttccttgtgcagaaggccggagccttgcaagtgtgcccaaccgacagttacaccaaaagagagcttatcgagtgtgccagagctgtgaccgagaaagtgagtctggtactaagcgcgctccaggccgggaataaggggactcaagcctgtatcaccgcagcgaccgctgtttctggaattattgccgatctggataccaccatcatgttcgccactgccgggaccctgaacgccgagaatagtgaaacctttgcggatcacagagagaatatactgaagaccgccaaggctctagtggaggacactaagttgctggtctccggggctgcttcgacacctgacaaactggcgcaggccgcccagtctagcgctgccacaattacccagctcgcagaggtggtcaaactgggcgccgcttccctgggctcagatgatccagagacccaggttgtcctgattaatgctattaaagatgtagccaaagccctgtctgatctgatctccgccacgaagggagccgcctcaaaacctgtcgacgaccccagcatgtatcagctgaagggggccgccaaagtcatggttacgaacgtcacatcgcttctgaagactgtaaaggcggtcgaagatgaggccacccgggggacacgagccctcgaagctaccatcgaatgcatcaagcaggagctaaccgtgtttcaatccaaagatgtccccgaaaagactagctctccagaagaatctattcgaatgacaaaggggatcacaatggctactgccaaagctgtggcagctggcaacagctgtagacaagaagatgttattgcaacagccaacctgtcaaggaaggctgtctccgatatgctcacggcgtgtaagcaggcctcattccacccggatgtcagcgatgaggtgaggactagagccctgagattcggaacagaatgtaccttgggttatcttgacctgttggaacatgttctcgtgatcctgcagaaacccacacctgaattcaagcagcagctggctgctttcagcaaacgcgtggcgggcgctgtaaccgaactgattcaggccgccgaggctatgaaagggacggagtgggttgaccccgaggatcccacagtcattgcagaaactgaactcctgggagccgcagccagcattgaggcggccgctaagaagctggagcagctgaaaccaagagcgaagccaaaacaagctgatgaaactctggacttcgaagaacaaatcctggaggccgccaagagcatcgctgctgccacaagcgccctggttaagtccgctagcgctgcccaaagggagctggtagcccaaggtaaggtgggatctattccagcaaatgccgctgacgacgggcagtggtcccagggtctaatttccgctgctcggatggtggcagccgcaacctcctccctttgcgaagcagccaacgcctccgtccagggccacgcctcagaagagaagctaatatcttctgccaagcaggtggctgcaagcactgcccaactgttggtggcatgcaaggtgaaggcagaccaggactccgaagccatgcgccgtttgcaggccgccggcaacgcagtgaaacgcgcatcagacaatttagttagagccgcccagaaggccgctttcggtaaagccgacgacgatgatgtggtggtgaagacgaaattcgtgggcggcatcgcacagatcatagctgcgcaagaggagatgctgaagaaggagcgggaactggaagaggcccggaagaaattagcccagattaggcagcagcaatataagtttctgcctactgagctgcgcgaggatgagggttag

SEQ ID NO: 207997 - DNA, 5190 bp, Artificial Sequence
  Description of Artificial Sequence: Synthetic coding sequence
atgaaggtgagcaccctgcgggagagcagcgccatggccagccccctccctagagaaatggaagaagagctggttcccacagggtcggagcctggggatactcgggcaaagccccctgtgaagcctaagccgcgggctctgcctgccaagccagccctccctgcgaaaccctccctgttggtgcccgtcggcccccgaccgccaagagggccactggccgaattaccttccgcccggaagatgaacatgctggccggacctcaaccttacggggggagcaagcgtcctctcccttttgccccccgacccgctgtagaggcctcaaccgggggcgaggctacccaggaaaccggaaaagaggaggccggaaaagaggaaccaccacctctgacccccccagcgagatgcgcagcgcccggaggagtgaggaaagccccagcccccttccggcctgcctcagagcgattcgctgctaccaccgtggaagagatcttagccaaaatggaacagcccagaaaagaagtgttggcatcccctgatcgactctggggtagcagactgaccttcaaccacgacggatcatccaggtacgggccacgaacctatggaaccactacggcaccaagagacgaggatggctcaacactttttagaggatggtcccaagaggggccagtaaaatcacccgcagaatgcagagaagaacattccaagacaccagaagagagaagcctgccatccgacttggctttcaacggtgacctcgcaaaggccgctagttctgaactaccagccgacatttccaagccctggattcccagctccccagctccctcaagcgaaaatggcggccccgcctctcccggactgccagccgaagcatccggtagcggtcctggatccccccatctgcacccacccgacaagtcctcgccctgtcactctcaattgcttgaagctcagacccctgaggcttcacaagctagtccttgtccagcagttacaccctctgccccaagcgcagccctgccagacgaaggctctcgacataccccctcaccgggtctgcccgccgagggggcaccggaggcgcccagaccctcttctcctccgccagaggtactcgagccacatagcctcgaccagccaccggccacttctccccgccctctcatcgaggttggtgagctcttggacctgacacgaaccttcccctcaggtggggaggaggaggccaagggggatgcacacttgcgccctaccagcctagtccaacgccgcttctctgagggagtgttgcagtctccctcccaggaccaggaaaaactcggcggatctctggcggccctgcctcagggacaaggcagccagctggctttggaccgtcccttcggtgcagaatctaactggtccctgagccagagctttgaatggaccttcccgactcgtcccagcggacttggcgtgtggaggttggattcaccccctccatcacctattacggaggcaagcgaggccgccgaagccgcagaagctggcaaccttgccgtcagtagtcgcgaagaaggagtgtcccagcagggccagggcgctggctcagcaccaagcggtagtggctcctcttgggtccagggcgacgatccttcaatgtcacttacgcagaagggcgatggcgagagtcaaccccaattccctgccgtgcccctagaaccactccctactacagagggcacccccggactccctttacagcaggccgaagagcgctatgagtcgcaggagccccttgccgggcaggaatctccactacccctagcaactcgcgaggccgctctgcccatcctcgaaccggtcctgggccaggagcagccggcagcacctgaccagccttgcgtgcttttcgctgacgcccccgaaccgggtcaggccttacccgtcgaagaggaggccgtgactctggcccgcgctgaaaccactcaggctagaacggaagcacaggacttgtgtagggctagccctgagcccccaggccccgaaagttcctctagatggctggatgatctgttggcgagcccaccaccaagcggcggaggagcccgtcgcggcgctggagcagagctgaaagacactcagtctcccagcacctgtagcgaaggcttgttaggctggagtcagaaagacctgcagtcggagtttggcattactggagatccccagccatcatcctttagtccgtctagctggtgccagggcgctagccaggattacggacttggtggggcgtccccccggggagatcctggtctgggcgaacgcgactggacaagcaagtacgggcaaggggcgggcgagggatcaacacgagagtgggcctcacgctgcgggatcgggcaggaagagatggaggctagttccagccaggatcagtctaaagtgtccgcaccaggggtcctcaccgcccaggatagagtggttgggaagcccgcacagctgggaacccagcgcagtcaggaggccgacgtccaggactgggagttcaggaaacgcgatagtcagggcacatactcaagtagggacgctgaattacaggatcaggagtttgggaagcgggactccctgggcacttacagtagtcgtgacgtgtcgctcggggactgggagttcggcaaaagggactccctgggagcttacgccagtcaggatgctaacgagcagggccaggacctggggaaaagagaccaccacggccggtacagtagtcaagacgccgatgaacaggactgggagtttcaaaaaagggatgtgtctctgggaacttacggcagtagagccgcagagccgcaagaacaggaattcggaaaaagtgcctggatacgtgactattctagcgggggtagctctcgcacactcgacgctcaggatagatcctttggcactagacctctgtccagcggctttagcccagaggaggcccagcagcaggacgaggagttcgaaaaaaaaataccgtccgtggaagatagcttaggcgaaggatccagagatgcgggccgccctggggagcggggttcaggaggactgttcagtcctagcaccgcgcacgtcccggacggcgccctgggacagcgggaccagtctagctggcagaattccgacgcatctcaggaagtgggaggccaccaggagaggcagcaggctggagcacagggaccaggttccgccgacctcgaggatggcgaaatgggcaaaaggggatgggttggggaattcagtctgtctgtagggccacagcgtgaggccgccttctctccaggccagcaggactggtctagagatttttgcattgaagcttctgaaagatcttatcagtttggaataatcggcaatgatagagtttccggagctgggtttagccccagcagtaaaatggagggcggacactttgttccacccggtaaaacgaccgcaggttcagtcgactggacggaccagctcgggttgaggaacctggaggtcagtagctgtgtgggtagcgggggaagtagcgaggcccgggaatccgcagtgggccagatgggatggtcaggaggtctctctttgcgtgatatgaatttgaccggctgcctggaaagtggaggtagtgaggagcctgggggaattggcgtcggtgaaaaggactggacaagcgacgtgaacgttaagagtaaggacctggctgaagtgggcgaaggcggcgggcactcacaggctcgtgagtccggagttggacaaactgactggagcggagtggaggccggtgaattcctgaaaagcagagaaaggggggtggggcaggcggattggacacccgacttaggccttcgtaatatggcacccggggcggtgtgcagtcctggagagtcaaaggagttgggagtcgggcagatggactggggtaataacctgggcttgagagatctggaagtgacgtgtgaccctgattctggggggtcacagggtttaagagggtgtggcgtcgggcagatggactggacacaagatctagcccctcaaaatgtcgaactgtttggcgcccccagcgaagcgagggagcatggggtgggcggggtaagccagtgcccggaacctggattgcggcataacgggagcctatccccaggcctggaggcccgtgaccccctggaggcgagggagttaggtgtaggggagacctcaggaccagagactcagggagaagactactctagcagttctctcgagcctcatccagccgatcctggtatggagacaggggaagcactttcctttggggcatcacccggtcgctgtccagcgcgacccccgccatccggatcacagggtttgctggaggagatgctcgccgcttcctcaagtaaggccgtcgcacgcagggaaagcgcagcatccggtctggggggcctgctggaggaggagggggctggagccggcgctgcgcaggaggaggtgctggagcctggccgcgactccccaccttcgtggaggccccagccagatggagaggcctcacaaacagaggatgtcgacggtacctgggggtcttccgccgctcgatggtccgatcaggggcccgcacaaacttcgcgccgaccctcacagggcccaccggctcgttcgccatctcaggacttttcctttatagaagatacagagatcctggatagtgccatgtaccggagtagagctaatttaggtaggaaaagagggcaccgcgcgcctgtgatcaggccaggcggtaccctggggctcagcgaggccgcagatagcgacgcacacctcttccaggacagtaccgagcccagggcaagccgtgtcccttcatctgacgaggaagttgtcgaagaaccccaatctagaagaacccgtatgtccctgggcacaaagggcttgaaggtcaatctatttccaggcctttcaccatctgctttgaaggctaagctacggccccggaacaggtctgcagaggagggtgagttggcggaaagcaaaagtagccagaaggaatcagccgtccaacggtcaaaatcatgtaaggttccaggtctgggcaaacccctgacgttaccgccaaaacctgagaagtcaagcggcagcgaaggttcaagccccaactggctgcaggcgctcaagctcaagaaaaagaaggtttag

SEQ ID NO: 207998 - DNA, 432 bp, Artificial Sequence
  Description of Artificial Sequence: Synthetic coding sequence
atgaaggtgagcaccctgcgggagagcagcgccatggccagccccctgcctagggaaatggaggaggagctcgttccgacgggctcagaaccgggggacacccgtgccaagcctcccgttaaaccgaagccccgcgccttgccagcaaagcctgcactgcccgcgaagccctccctgctggtgcctgttgggcccagacctcctcggggaccgctggccgagctgccttctgcgcggaaaatgaatatgctggcggggccccagccctacggcggctctaaacggcccctccctttcgccccacggcccgccgtggaagcaagcactggcggcgaggcaacacaagaaactggcaaggaggaggcagggaaggaagaaccaccgccacttaccccaccagctcgttgcgcagcaccgggaggtgttagatag

SEQ ID NO: 207999 - DNA, 5190 bp, Artificial Sequence
  Description of Artificial Sequence: Synthetic coding sequence
atgaaggtgagcaccctgcgggagagcagcgccatggccagccccttacctagagaaatggaggaggagcttgtcccaactggcagtgaacctggcgatactcgcgccaaaccccccgtaaaacctaagcctcgggccctacctgctaaaccagcgcttcctgccaagccatctctgctggtgcctgttgggcctcggcccccacgcggtccactcgctgagttacctagtgctcgcaagatgaatatgttggccgggccccagccatacgggggctcgaagcgacctttgccctttgccccgcgacctgcggtggaggccagcacggggggggaggctactcaggagacaggtaaagaggaggcaggaaaggaggaaccacctccactgacccctccggcccggtgtgccgcaccaggcggggtcagaaaagccccagctccctttcggcccgcttctgaaagattcgcggcgactaccgtggaggaaattctggccaagatggaacaaccgagaaaggaggtgctggcatctcctgacagattatggggcagcagacttaccttcaatcatgatggaagcagtaggtacgggccgcggacctatggcaccaccaccgcaccgcgggacgaagacggctccactctgtttcgcggatggagtcaggaaggacccgtgaaatcccccgccgaatgcagagaggagcactcaaaaacccctgaagagcgatcgctgcctagcgatttggccttcaacggagatctggccaaggccgcatcttccgaattaccggccgacatcagcaagccatggatcccctctagccccgccccctccagcgagaatggcggcccagcatctccaggcctgccagctgaggcctctggctccggtcctgggtctcctcatctgcaccctccggataagtcttcgccatgccattcccagttgctcgaagcgcaaaccccagaggcgagccaagccagtccctgccccgccgtcactccatctgcacctagcgccgccctacctgacgagggaagcaggcacacaccaagcccggggctgcccgcggaaggggcccctgaagctcctcgtcctagctcaccgccccccgaagtgctggagccccattccctggatcaacctcctgctacgagccccagacccctcattgaagtcggtgagttgcttgacttgacgaggactttcccttcgggcggcgaagaagaagctaagggcgacgctcacctgcggccgacgtctttggttcagagacggttcagcgagggggtgcttcagtcccccagccaggatcaagaaaagttgggtggctctttagccgcacttcctcagggacagggtagccagctcgctttagacagaccatttggggcggagtccaattggagcctcagtcagtctttcgagtggaccttccctacccgcccttcaggtttaggggtctggaggttggattccccccctccctcccctattaccgaagcgtcagaagctgctgaagcagctgaggccggcaatctggccgtgagctcgcgtgaggaaggcgtaagccaacagggccaaggagcgggctcggcaccatctgggtcaggctcttcttgggtgcagggtgacgaccccagcatgagtctgacccagaagggggatggcgagagtcagcctcagttccctgccgtccccctggagcctctcccaacgactgaaggcacaccaggactgccgttgcagcaggctgaggagagatacgaaagccaggagcccctggctggacaagagagccctttgccattggctacgagagaggcagccctaccgatcctggagcccgttctggggcaagagcaacctgccgcacctgatcagccatgtgttctgttcgccgacgctcccgaaccagggcaggcattgcctgtggaggaagaggccgtcactctcgcgcgtgccgagacaacccaggcaaggacagaggcacaggatctttgtagggcttcgccggagcctccaggacctgagtcatcaagtcgctggttggatgatctcctcgcctcccctccacccagcggcggaggggctaggcgtggcgccggtgctgaactgaaggatacccagtcaccgtctacttgttcagagggccttctggggtggtctcagaaggatctgcaatctgagtttggcataaccggtgaccctcagccgtcaagcttttctccatcctcctggtgtcagggcgcctctcaggactacgggctaggtggtgcgtcgccccggggcgacccgggcctcggcgaacgcgattggaccagcaagtacggccaaggcgctggcgaagggtccacaagggagtgggcgagccggtgtggcatcgggcaggaggagatggaagctagctccagccaggaccagagcaaggtgtcagcacctggtgtcttgactgcccaggatcgcgttgtagggaaaccagctcagcttgggacacagcggtcacaggaagcagatgtgcaggattgggagttccggaagagggattctcaggggacatacagcagcagagacgccgagctccaggatcaggagtttggcaaacgcgactccctgggtacctactcaagccgcgatgtgagtctcggtgattgggaattcggaaaaagggattcactaggagcatacgcatcccaagacgccaatgagcaaggacaggacctgggcaaacgcgatcaccatggacggtactcgtcccaggacgctgatgagcaggactgggaatttcaaaagcgtgacgtttcactggggacctatgggagtcgggccgccgagccccaagagcaggaatttggcaagagtgcctggatacgggattacagtagcggcggcagttcccggactcttgacgctcaggaccgttctttcggaacacgtcctcttagctctgggttttccccagaggaggctcagcagcaggatgaggaattcgagaaaaaaatcccatcagtggaggacagtttgggagagggctcgagggatgccgggagacccggcgaacgcggatctggaggactcttttcccccagcaccgcgcacgtgcccgacggcgctctcggtcaacgtgatcagagcagctggcagaactccgacgctagccaagaagtgggcggacaccaggaacgccagcaggcgggtgcgcaaggaccaggctcagcagacctcgaagatggagagatgggcaagcgcggatgggttggcgagtttagtttatccgtagggcctcaaagggaggcggcgtttagcccaggacagcaggattggtcgagagacttttgcattgaggcatctgagcggtcataccaatttggtattataggtaatgatcgtgtgagtggtgccgggttttccccctcttccaagatggaaggcgggcattttgtgccccctggaaaaacgactgctggatccgtggattggacggaccagctggggctacggaacttagaggtgtcttcctgtgtgggcagtggggggtcatcagaggccagagagagcgcggtcggtcagatggggtggagtggcgggctatctcttagagacatgaatttgacaggctgcctggagtctggcggaagtgaggaaccaggcggtattggagtgggtgagaaagactggacctcagatgtgaacgtgaagtccaaggatttggctgaggtgggagaaggcggcgggcatagccaggctcgggagtcaggtgtcgggcagacggattggtccggcgtggaagctggggaatttctcaagagtcgggagcggggtgtgggtcaggccgattggacacccgatctggggctgagaaacatggcccctggtgctgtctgtagtcctggggagagcaaggagctaggggtcgggcagatggactggggcaataatctgggcctgcgagacctggaggtgacgtgcgacccagacagcgggggcagccagggactgcgcggctgcggtgtgggtcaaatggactggacacaggatctcgccccccagaacgtggaactttttggcgcaccatccgaggcacgagagcacggcgtgggcggcgtgagccagtgtcccgaacctggactgcggcataatggctcattgagtcccgggctggaagcccgtgatcctctggaagccagggagttaggcgtgggagaaacaagtggccctgaaacccagggggaggattattctagcagctcattggagccccatcctgcagaccctggaatggagacaggagaggcgctgtcatttggggctagtccgggaaggtgtccagcccggccgcctccaagcggctctcaaggcctcctcgaagagatgctggcagcctccagctcaaaagcagtggctagacgtgaatctgcagcatcaggtttgggcgggcttctggaggaggaaggtgcaggagcaggggcagcccaagaggaggtattagaacctggccgagatagtcctccctcctggcggccccagcccgatggggaagcctcacaaacagaggatgtggatgggacctggggatcaagcgcggctcgatggagtgatcagggacctgcacagacatccagacgtcctagccaaggaccacctgctcggagtcccagccaggatttcagttttatagaggataccgaaatcctcgattccgccatgtaccgatcccgagccaatctcggtaggaaaaggggtcaccgtgctccggtcattaggcctggaggcaccctcgggctgagcgaagcggcagatagcgacgcacatctcttccaagactcaactgagcctcgtgcttcccgcgtgccctcgagtgatgaggaagtcgtcgaagagccgcagtccagacggacaaggatgtccctgggtacaaaggggctgaaagttaacctctttcccggcctctctccgagcgctcttaaggcaaaattacggcctcgaaatcggtcagccgaggagggagagctagctgaatctaaaagtagccagaaggagtctgccgtccagcgctcaaagagttgtaaggtgccggggctggggaagccactgaccctcccacctaaaccagagaagagctctggctctgagggcagcagccccaattggctacaggcactgaaacttaagaagaaaaaggtgtag

SEQ ID NO: 208000 - DNA, 3006 bp, Artificial Sequence
  Description of Artificial Sequence: Synthetic coding sequence
atgcccagcaccaaccgggccggcagcctgaaggaccccgagatcgcagaattgttcttcaaagaggaccccgagaagctcttcaccgacttgagggagatcggccacggcagctttggagccgtctacttcgctagggacgtcaggactaacgaggtggtggcaatcaaaaagatgtcatactctgggaaacagagcaccgagaaatggcaagacattattaaggaggtgaaatttctgcagcggatcaaacaccccaatagtatcgaatacaagggctgctatctcagggagcataccgcatggctagtgatggagtactgtttgggtagtgcctccgacctgctggaagtccataagaagccactgcaagaagttgagatagccgccatcacacacggcgccctgcaagggttggcatatctccattcccataccatgatccaccgcgatattaaggcaggcaacatcttgctgaccgagcctgggcaggtgaagctcgctgatttcggatccgcctcaatggcgagtcccgctaatagcttcgtggggacgccatactggatggctccagaagtgatcctcgcaatggacgaaggccagtacgatggaaaagttgatgtctggagccttgggatcacctgtatcgagctggccgaaagaaaacccccattattcaacatgaacgccatgagcgcgctgtaccatatagcccaaaacgagtctcctaccctccagagtaacgaatggtcggactacttcagaaacttcgtggacagttgtctacagaaaattccccaggatcggccaacctcagaggaattgctgaagcacatttttgtgctgagagagcgccccgagacagtgctgattgatctgattcagcggacgaaagatgccgttcgggaactggacaatctgcaatatcgcaagatgaagaaacttctcttccaggaggcccataacggtcctgccgtggaggcccaggaggaggaggaggagcaggaccacggcgtgggccgtacagggaccgtaaacagcgtcggatccaaccagtccatcccatcaatgtccataagtgcttcttctcagtctagctccgtgaattctctgcctgacgtatctgacgacaagagcgagctggacatgatggagggcgatcacactgtgatgagtaatagctctgtcattcatctaaaaccggaggaggagaactatcgcgaggagggtgatcctcggacacgggcctctgacccccagagtccaccccaggtgtctcgccataagagccactataggaacagagaacacttcgccaccatccgcacagcctcactggtgacgcggcagatgcaggaacacgagcaggacagtgagctgcgcgaacaaatgtccggctataagcgcatgaggcgccaacatcaaaaacaattgatgacactggagaataaactgaaggccgagatggatgaacaccggctccggttggataaggacctcgaaacccaacggaacaatttcgccgctgagatggagaagttgatcaagaaacaccaagccgcaatggagaaagaagccaaggtgatgtccaacgaagaaaaaaagttccagcaacatatccaggcgcagcaaaagaaagagcttaattcatttctcgaatctcagaaaagagagtataagctgcggaaggagcagcttaaagaggaattaaatgagaatcagtccactcctaaaaaggagaaacaggagtggctgagtaaacagaaggagaacattcagcacttccaagctgaagaggaggctaatcttctcaggcgccagcgtcaatatctcgaacttgaatgccggcgctttaagcggcggatgctgctgggaaggcataaccttgaacaggatttagtgcgcgaggaactgaataagaggcagacgcaaaaagacctcgaacatgctatgctcttacggcagcatgagtctatgcaggagcttgaattcagacacttaaacaccattcagaaaatgcggtgtgagcttatcaggttacagcaccagacggagctcaccaatcagctggaatacaacaaacggagggaacgggagctgcgacggaaacacgtcatggaggtgaggcagcagccaaagtcactaaaatctaaggagttgcagatcaaaaagcagtttcaagacacgtgcaaaatccagaccagacagtataaggcattgcggaaccatttactggagactactccaaagtcagagcataaagcggtgctcaaacgcctcaaggaggaacagacccggaagctcgcgattctcgcggaacaatatgatcatagtattaacgagatgctgtcaacacaggcccttcggctggacgaagctcaggaagcagagtgtcaggtgctcaagatgcagcttcagcaggaactcgagctgctgaacgcttaccagtccaagataaagatgcaggctgaggcgcaacatgatagagagttgagagagctggaacagagagtgtccctgcgtcgagcactcctggagcagaagattgaagaggaaatgctggcactccagaatgagagaaccgaacgtatccggtcgctgctcgagcggcaagcaagagagatcgaggccttcgattctgagtctatgagactgggctttagtaacatggtcctgtccaatctttctccagaagcttttagtcacagctacccaggggctagtggatggtcacataaccccacaggtggtccaggccctcattgggggcacccaatggggggacctccgcaggcatggggccacccaatgcaggggggaccccagccatgggggcacccctcaggcccgatgcaaggcgtgcctagaggaagctccatgggcgtgcgcaacagtccacaagcactcagacggaccgctagtggtgggcgaaccgagcagggcatgtctaggagcacttccgtcacctcacagatctctaatgggtcccacatgtcctatacatag

SEQ ID NO: 208001 - DNA, 2562 bp, Artificial Sequence
  Description of Artificial Sequence: Synthetic coding sequence
atgcccagcaccaaccgggccggcagcctgaaggaccccgagatcgccgaactattctttaaagaagacccggagaagctgttcactgaccttagagagatcggccacggaagcttcggcgcagtctactttgcacgtgacgtaagaactaacgaggtggtggctattaagaagatgtcatactccggaaagcagtccactgagaaatggcaggatattattaaagaggtaaagttcctgcaacgcatcaaacaccccaactctatcgaatacaaaggctgttacctgcgagaacatactgcctggctggtgatggagtactgtctcggctctgcttcagacctcctggaagtgcacaagaaaccactccaggaagttgaaattgctgctatcacccacggggcactgcagggtctcgcctacctccatagccatactatgatccatagggatatcaaggccgggaacatcctgcttactgaacccgggcaggtcaaactggcagacttcggctctgcctctatggcgtctcctgccaactcttttgtcggaaccccctactggatggctcctgaggtgattctggctatggatgaaggacagtatgacggtaaggttgacgtgtggagtctgggcattacatgcatcgaactagccgaaaggaagccgcctctgttcaacatgaatgccatgtccgctctctatcatatcgcccagaatgagagtccgaccctccagagcaacgagtggagcgattacttcagaaatttcgttgattcctgtctacagaaaattccacaggatcgacccactagcgaagagcttctgaaacacattttcgtgctccgcgagcggcccgaaaccgtgctcatcgacttgatccagagaacaaaagatgcagttcgggaactagacaacctccagtataggaagatgaaaaagctgctcttccaggaggcgcacaatgggcctgctgtcgaggctcaggaagaagaagaagagcaagatcacggggttggccggacagggaccgtgaattctgtagggtctaaccaaagcattccatctatgtccatttctgcgtcaagtcagagttcctctgtaaattctttgcctgatgtctccgacgacaaatctgaattggacatgatggagggtgatcacactgttatgtccaattcctcggtcattcatctcaaacctgaggaagagaactatcgggaagagggcgacccccggacacgcgcatccgatccacagtctcctcctcaagtaagccggcacaaatcgcattaccgaaacagagaacattttgccacaatcaggactgcctccctcgtaacaaggcagatgcaggagcacgagcaagattctgaactgcgggagcagatgagtggatacaaacgcatgcgcaggcagcaccaaaagcagttgatgacgctggaaaacaaactgaaggcagagatggatgagcaccggctgagactggacaaggatttggaaactcagagaaacaacttcgccgcagagatggagaaactgatcaaaaagcaccaagcagccatggaaaaggaggcaaaggtgatgagcaatgaggaaaaaaaatttcagcaacacattcaagcacagcagaagaaagagctcaactcgttcctggaaagtcagaaaagggagtacaagctgagaaaggagcaacttaaggaatccaaggagttgcagatcaaaaagcagtttcaggacacttgtaaaatccagacaaggcagtacaaggctctacgtaaccacctgctggagacgacccctaagtcggaacacaaagccgtcctgaagcggctgaaggaggaacagacacggaagctcgctatactcgccgagcagtacgatcacagtattaacgaaatgctgtctacacaggcgcttaggcttgatgaggcccaagaggcggagtgtcaggtactcaagatgcagcttcagcaggagctggaattgctgaacgcatatcagtccaaaataaaaatgcaggccgaggcccaacatgatagagagctgagggagctggaacaacgggtgtctcttagaagggcattgttggagcagaagatcgaagaggagatgctggctcttcagaatgaaagaacggaacgaatccgctcccttctggagcggcaggctcgggaaattgaggcctttgactcagagtctatgcgcttgggattttccaatatggtgttatccaatctcagtccagaggcgttctcccatagttaccctggcgccagcggatggagtcataaccctaccggagggcctgggcctcattgggggcatcccatgggtggccctccacaggcctggggacacccaatgcaggggggaccccagccctggggtcacccttctgggcccatgcaaggggtccctaggggcagctcaatgggagtccgcaactcgcctcaggcattgcgcagaaccgctagcggaggacgaacagagcaaggaatgtcacggtccacttccgtcactagccagatcagtaacggctcccatatgtcttacacgtag

SEQ ID NO: 208002 - DNA, 3150 bp, Artificial Sequence
  Description of Artificial Sequence: Synthetic coding sequence
atgcccgccggcggccgggccggcagcctgaaggaccccgacgtggccgagctgttctttaaagacgaccctgagaagctcttcagtgacctgagagagatcggccacgggtcctttggcgcagtgtatttcgccagggacgttagaaattctgaagtggtggctatcaagaaaatgagttattctgggaaacagtccaacgaaaagtggcaggatattatcaaggaagtcagatttttgcagaaactgaggcatcctaatacaattcagtaccgaggatgctacctgcgggagcacacagcttggctcgtcatggagtactgcctggggtctgcatccgacttgttagaggtccataaaaaacccttacaggaagtcgaaatcgcagccgttactcacggggctctgcaaggattggcctaccttcacagtcataacatgattcaccgggatgtgaaggccggaaacatactgttaagcgagcccggcctggtgaaattaggtgacttcggcagcgcttccatcatggcgccagccaactcatttgtcggcacgccatactggatggccccagaagttattctcgccatggacgaagggcagtacgatggcaaggtggatgtctggtccttggggataacctgtatcgagcttgccgagcgcaagcctcccttatttaacatgaatgctatgtcagccctctaccacatagctcagaacgaaagccctgtgcttcaatccggccattggtctgaatattttcgcaatttcgtcgactcttgcctgcagaaaattcctcaagatcgtcccacaagcgaggttctgctgaagcatcggtttgtgctcagggaacgtccccccaccgtaattatggatctaattcaacggaccaaggatgctgtccgagagctggacaatttacaataccgtaaaatgaaaaagattctcttccaggaagcccctaatggacctggggccgaggcccccgaggaggaagaggaggcggaaccctacatgcaccgtgccggcaccctcacgtcgctggagtcttctcacagtgtacctagcatgtcaatcagcgccagcagccagagcagctcagtcaattcgttagcagacgcatccgataacgaagaggaggaagaagaagaggaggaggaggaagaggaagaggagggaccagaggcacgggaaatggctatgatgcaggagggcgagcacacagttaccagccacagctcgatcatacatcggctcccaggctctgataatctttacgatgacccataccagcctgaaataacaccgagcccattgcaaccaccggccgcccctgcgcccacctctaccacctcctcggctcggagacgcgcttactgccgcaatagagaccattttgcgactattcgcacagcatctctggtctcacgccagatccaagaacacgaacaggacagcgcgctgagagaacaattatcgggatataagagaatgcggcgccagcaccagaaacaactgctggccctcgagtcccgattgagaggtgagcgcgaagagcacagcgcacgcttgcagcgcgaattggaagctcagagggctgggtttggcgctgaagcagagaaactggctcggcgtcaccaggctatcggggagaaagaagcgcgggctgcccaggctgaagagagaaaatttcagcagcacattctgggccagcagaaaaaggagctcgccgccctcctggaagctcagaaaagaacctacaaactgcgcaaggaacagctgaaagaggaacttcaggaaaatccctctactccaaagcgagagaaagcagagtggctgctcaggcagaaagagcaactgcaacagtgtcaggccgaagaggaggctgggttacttcgaagacaacgacagtattttgagctgcaatgcaggcaatacaaaagaaaaatgctcctggccaggcactcacttgaccaggacctgttaagggaggatttgaacaagaaacagacccagaaggatttagaatgcgccctgctgctcagacagcatgaagctactagagagttggaacttagacagctgcaggccgtacaaagaactcgagccgaactgaccagactccagcaccagaccgagctgggcaaccagctcgagtataataagagacgcgagcaggagttgcggcagaaacatgcggctcaggttaggcagcaacccaagtccctgaaatctaaggaactacagattaagaaacaatttcaggaaacctgtaagatccagactagacagtataaagcattacgggcccatttgcttgagactactcccaaggctcagcataagtcactattgaaacgcttgaaggaggaacaaactcgaaaattggccatcctcgctgaacaatatgaccaaagtatcagcgagatgttatcgtcacaggccctccgcctggatgaaacacaggaagctgaatttcaagctctcaggcaacagctacaacaggaactggaactgctcaatgcttatcagagtaagattaagatacgaaccgagtcacagcacgaaagggaactgagggagttggagcagagggtagcactgcgccgggcgctgctggaacagcgggtcgaagaggaactgctagctctgcaaacggggcgcagcgaaagaattcgcagtctgcttgagaggcaggctcgcgagattgaagctttcgacgccgagagcatgcggctgggattctccagcatggctcttggcggtatccccgcggaggccgccgcacaaggttatccagcccccccccctgcaccagcctggccctcccgaccagtgccacgatctggtgcacactggagccacgggcccccgccacccggtatgccaccacctgcgtggaggcagccatctctgctggcgccaccggggccaccaaactggcttggaccccccacccaaagtggtacccctcgggggggcgccttgctgttactgcgcaactctcctcaacctcttaggcgggctgcctcgggcggtagtggatcagaaaacgtggggcccccagcagccgccgtaccaggccctctgagcagaagcactagcgtagcgtctcacatcttgaacggatcatctcacttctatagttag

SEQ ID NO: 208003 - DNA, 3708 bp, Artificial Sequence
  Description of Artificial Sequence: Synthetic coding sequence
atgcccgccggcggccgggccggcagcctgaaggaccccgacgtggctgaactgtttttcaaagacgatccagagaaacttttctcagacctgcgagagattggacatggttcattcggtgccgtttattttgcacgggatgtgcggaattccgaagtcgtcgcgatcaagaagatgagttactctggcaaacagagcaacgaaaagtggcaggatattattaaagaagttcgctttctgcaaaagctgaggcacccgaatacaatccaataccggggatgctatctccgcgagcacaccgcttggttggtaatggagtattgcttgggaagcgcttctgacctcctagaggtccacaaaaagccactgcaggaggtagagatagccgctgtcacacatggagccctccaagggctcgcataccttcatagtcataatatgattcatagagatgtgaaggctggtaacatcctcctctcggagcccggcttggtgaaactgggggactttggaagtgccagcatcatggcccccgctaactcgttcgtggggaccccctactggatggcccccgaagtgatattggcaatggacgaggggcagtacgatggaaaggtggatgtgtggtcccttggaataacctgtatcgaactcgcggaacgaaagccccccctgtttaacatgaatgctatgagcgctctttatcatatcgcccagaatgagtcgcccgtattacaaagcgggcattggagcgagtactttcgtaatttcgtagactcttgcctgcagaagattccccaggatcgccctacttctgaagtgttactcaagcacagattcgtgctgcgggaacgtccccctaccgtaataatggatctgattcagaggaccaaagacgccgtgagggagttggataacctgcagtaccgtaagatgaagaaaatcttgtttcaggaagcaccaaatgggcctggcgctgaagcccccgaggaagaggaagaggctgagccttacatgcacagagcagggaccctgacctcgctggaatccagccattctgttccttcgatgtctatcagcgcgtcctctcagtcctcttcagttaacagcctggctgacgcctctgataatgaagaggaagaggaagaagaggaggaggaggaggaggaggaggagggacccgaagcccgggagatggccatgatgcaggaaggagaacacactgtcacaagccattcaagcatcatccaccggctgcctggctcagataatttgtacgacgatccgtaccagcccgagattacacccagtccactgcagccacctgcagccccagccccaacctcaacaacatcctcagctagaagaagagcctactgtaggaaccgggaccattttgcgaccatcagaaccgccagcctggtgtctagacaaatccaggagcacgagcaggattccgcgcttcgcgagcagctgagcgggtataaaagaatgcgccgacagcaccagaaacagctgctggcactggagagccgcttgcgaggggaaagagaggaacattcggcgcgtctccaaagagagctggaggcgcagagggctggcttcggcgctgaagccgaaaagctggctaggaggcaccaggcaattggagagaaagaggcacgtgctgcgcaggccgaagaaaggaaattccagcagcatatcctcggtcagcagaagaaggaattggctgccctgctggaagctcagaagcgtacctataaattacgcaaagagcagctaaaggaagagcttcaagagaaccctagcactccaaagagagaaaaagcagagtggctcctgcgccaaaaggaacaactgcaacaatgccaggccgaggaggaggccggcctactgcgaaggcagcggcagtactttgaactgcaatgccggcaatacaaacgaaagatgctgttggctagacattccctggaccaggacctgttgcgtgaggacttaaacaagaaacagacccaaaaggatctggaatgtgctctgctgttgagacagcatgaggcgaccagagagctcgaacttagacagcttcaggctgttcagcggactcgtgcagaattaacgcgattgcagcaccagacagaactgggtaaccagctggagtataacaagcgcagggagcaggagttgcgacagaagcatgccgctcaggtccggcaacagcccaagagcttgaaggtaagggctgggcagcgcccacccggtttaccactccctatacccggagccctgggaccacccaacaccgggacacccattgagcagcaaccatgttcaccagggcaggaagccgtgctggatcaacgcatgttgggcgaagaggaggaggccgtgggagaaagaaggattttgggtaaggagggagcaactctggaacctaaacaacagagaatcttaggtgaagaatctggggctcccagcccaagtccacagaagcacggttcattggtggacgaagaagtgtggggcctgccagaggaaatagaggagctccgtgtcccttcgttggttccgcaggagaggagtattgtcggccaggaagaggccggcacgtggtcactgtggggcaaagaagacgagtcattgcttgacgaggagtttgaactgggatgggtgcagggcccagcactgaccccagttcctgaagaggaggaagaggaagaggagggcgcccctatcggaaccccccgcgatcctggagacggctgcccgtccccggacataccccccgaacctcccccaacgcacttgaggccatgtccggccagccaattgcctgggctgcttagccacggtttgctcgcaggcctgagcttcgcagtgggcagtagctcaggcctcttgccattgcttctactcttacttctgcccctgctggcagcccagggcgggggcgggttgcaagccgctttgctggctctcgaagtcggcttggtcgggctgggagcctcctacctgttgctttgtacggctctccacctgcctagttctctttttctgctactggcacagggaaccgcgttgggcgcagtcctgggtctgagctggcgacggggtcttatgggggtgcccctgggactgggcgcagcatggttgttagcttggccaggtctggccttaccgttagtggccatggccgccggtggcagatgggtcaggcagcagggacctcgcgtcaggagggggatttccaggctgtggctgagagtgttgcttcgcctgtcccctatggccttcagagccctgcagggctgcggagccgtgggggatagaggtcttttcgcactgtatcccaaaactaataaggatggattccgctccaggcttccggtacccggtccgcgtaggagaaatcccagaaccacgcagcatccccttgcactcctggcgcgtgtttgggtgctctgtaaaggctggaactggagactggctcgggcctcccagggccttgccagccacctacccccttgggccatacacacattggcatcctggggtctcctgcgcggtgaacgcccaactcgtatacctaggctcctgccccgcagtcaaaggcaactgggaccacctgcctctagacaaccattgcctggaacccttgcaggcagacgttcaaggacaagacagagccgggccctcccaccttggaggtag

SEQ ID NO: 208004 - DNA, 2268 bp, Artificial Sequence
  Description of Artificial Sequence: Synthetic coding sequence
atgcccgccggcggccgggccggcagcctgaaggaccccgacgtggccgagctattttttaaggacgatcccgaaaaactttttagcgacctaagggagattgggcacgggtctttcggtgctgtttatttcgctcgagatgttagaaacagcgaggtggttgccatcaagaaaatgagttattctggcaaacagtccaacgaaaagtggcaggatattataaaagaggttagatttctgcaaaagttgcgtcatccgaatacaatacagtacagaggctgctacctgcgggagcatactgcatggctggtgatggagtattgtttgggctcggctagtgacctgctagaggtgcacaaaaaaccattacaggaagtggaaatcgcagcagttacccatggcgcattgcagggtctggcatatctacactcccacaacatgatccaccgagacgtgaaggccggaaacattttacttagcgaaccgggcctcgtcaaactaggtgacttcggctccgcctcaataatggcccccgccaacagcttcgtgggaacgccctactggatggccccagaagtgatattagccatggacgaaggtcagtatgacggcaaggtcgatgtgtggtcccttggaataacctgcatagaactcgcggagcggaagcctcccctattcaatatgaacgccatgtctgccctttatcacattgcgcagaatgagagcccggtactccagagcgggcattggagcgagtacttccggaacttcgtagatagctgcctccagaagatcccccaggaccggcctacctcggaggtgctcctgaagcacagattcgtcttgagagagcggccacccacagtcatcatggatctaattcagcgtacgaaagacgccgttcgtgaactggataacctccagtatcgaaagatgaaaaaaatactgtttcaggaagctcccaacggccccggcgccgaggccccagaagaagaagaggaggcagaaccatacatgcatcgggccggaacacttaccagcctcgagtcttctcacagtgtgcccagcatgtcaatatctgcctcctcgcagagttcttctgtgaacagcctggccgacgcctcagacaacgaggaagaggaagaagaggaagaggaggaagaggaggaggaggaaggacctgaagcacgtgagatggctatgatgcaggagggggaacatacggtgacttctcactcgagcattatccacaggctgccgggttcagataacctatatgacgatccctatcagcccgaaatcaccccttctcctctccagccgccagccgctcccgcacccacttctaccacatctagtgcacgtcggagagcctattgccgcaatcgcgaccacttcgctaccattcgcaccgcctccctggtgtcacgccaaatacaggagcatgagcaggatagcgcgttacgtgagcaactcagcggttacaagaggatgcgtcggcagcaccagaaacagctgcttgccctggaaagtagactccgaggggagagggaggagcactccgcccggttgcagcgggagctagaagcacagcgcgccggctttggtgcagaagccgaaaaactggcacgccggcaccaagccatcggggagaaggaagcgagggctgcccaggcagaagagcgtaaattccagcagcatattctgggtcaacagaagaaggagcttgctgcattattagaggcccagaagagaacttataagctgaggaaggagcaattaaaggaagaacttcaggagaacccctcaacacctaaacgcgagaaggctgagtggctgctgcgccagaaagagcagctacagcagtgccaagccgaggaagaagcaggcttactccggagacagcggcaatatttcgagctgcagtgcaggcagtataagcgaaagatgctgcttgcacggcattccctcgaccaggatttgctgcgtgaagacctgaacaagaagcagacacagaaggatctcgaatgcgcgctgcttcttcggcagcatgaagcaacgcgggagctggagctccggcagcttcaggctgtgcagaggacccgcgcggaactgacacgcctgcagcaccaaaccgaactgggaaaccaactggaatataataaacgtcgggaacaggagctacgacagaagcacgctgcccaggttaggcaacagcctaagagtttaaagaagaaaaccaatacgaacaaaatctccgagcgatag

SEQ ID NO: 208005 - DNA, 3369 bp, Artificial Sequence
  Description of Artificial Sequence: Synthetic coding sequence
atgcccgccggcggccgggccggcagcctgaaggaccccgacgtggctgaactgttcttcaaggacgatcccgagaagctgttctctgatctgcgagaaattggacacggctcctttggtgcagtgtattttgctagagacgtgcgaaattctgaggtggtggctattaagaagatgtcatatagtggcaagcagtcaaacgagaagtggcaggatataattaaggaagtgagatttctccagaaattgcggcacccgaatacaatccagtaccgcggctgctacctcagggaacacaccgcctggttggtgatggaatattgtctgggttctgcttcggacctgttagaagtgcacaaaaagccactgcaagaggtggagatcgccgcagtgactcatggggctcttcaagggctcgcgtatctgcacagccataacatgatccatcgagacgtgaaggctgggaatatcctgctgtccgaacctggactcgttaaattgggggacttcggaagtgcatcaatcatggcccccgcgaattcctttgtagggaccccttattggatggctccagaggttattctggccatggacgaaggtcagtacgacggaaaggtcgatgtgtggtcattaggaataacatgcattgaactggcagaacggaagccgcctttgttcaatatgaatgccatgagtgctctctaccatatagcccagaacgaaagtcccgtgctacagagcggccattggtctgaatattttaggaatttcgtcgattcttgcctgcaaaagatcccccaggacagaccgacgtccgaggtgctgctcaagcatcgcttcgttctcagggagaggccacctaccgtgataatggacctgatacagcggacaaaggatgcggtgcgtgagctggataatctgcaatacagaaagatgaaaaagattctcttccaggaggctcctaacggcccaggggccgaagcacccgaggaagaggaagaggccgaaccatatatgcaccgggcaggaacactcacttccctggagtcatcccattcagtcccatctatgagtatcagtgccagtagccagagttcttccgtcaactccctggccgacgcaagcgacaatgaagaggaggaagaggaagaagaagaggaagaggaagaggaggaaggccctgaagcccgcgagatggcaatgatgcaagagggcgaacacactgtaacttctcattcctccattatccacaggctgcctgggagtgacaacttgtacgacgatccttatcagccagagattacgccctccccactgcagccacccgctgctcctgcccccacaagcactacaagttcagccagacgacgagcctattgcagaaatagggatcactttgctacaattcgaaccgcctccttagtctccaggcagattcaggaacatgaacaggactccgctcttcgcgagcagctgtctggttacaaaagaatgcggcggcaacatcagaagcagctcttggctctggagtcaaggctccgaggtgagagggaggagcacagcgctaggctgcagcgggaacttgaggcccagcgcgctggtttcggtgcagaggctgaaaagcttgcccggaggcatcaggcgattggcgaaaaggaggcccgcgccgcccaggcagaagagcgaaagtttcagcagcacattctgggacagcagaagaaggaactggctgctctgctggaggcgcagaaacgcacatacaaacttcgcaaagagcaattaaaagaagagcttcaggagaatccatctacaccaaaaagggagaaagcagaatggctgctgagacagaaggagcagttgcagcagtgccaggccgaggaagaagcgggacttctgcggcgccagcgccagtattttgaattgcagtgtcggcagtacaagcgtaagatgttgctggctcgccatagtttggaccaggacctgttgagagaagacctcaacaagaaacagacccagaaagacctggagtgtgccctgttgcttcggcaacatgaagccacacgagaattggagctcaggcaattacaagccgtccagcgaacgcgcgcggaactcacaaggttgcagcaccagacggaactaggaaaccagcttgaatataataaacgccgagagcaggagttgcggcaaaagcatgccgcacaggtgagacagcagcctaaatccctgaaagaacgctcaattgtcgggcaggaagaagcaggaacgtggagcctgtggggaaaggaggacgaatccttgctcgacgaggaatttgagttaggctgggttcaggggcccgctctgaccccagtgcctgaggaggaagaggaggaagaagaaggagcccccatagggaccccaagggatcccggagacggctgcccctcgcccgacatcccacctgagcctccccctacacacctgagaccgtgtcccgcatctcagcttccaggtctcctctcccacggcctgttggccggcttatcattcgccgtgggctccagtagcggcctgctgcccttattgctgttgctccttcttcctcttctcgctgcccaaggcggcggcggtcttcaggccgccttactcgcacttgaagttggactggtagggctaggggcaagctatctcctactctgcacggccctgcaccttccaagttctctcttcctacttctggcacagggcactgctctgggtgccgtgctcgggctgtcttggagacgcggccttatgggtgtccccctggggctaggcgctgcttggctcctggcttggccagggctggcccttccactagtggccatggccgcaggtggccggtgggtgcggcagcaggggcctcgcgtgcgacggggaatcagccgactttggttaagggttttactgaggctgtctcctatggcgttccgggcactgcaagggtgcggagccgtcggggatcgaggactgtttgccctgtatccaaaaacaaacaaggatggtttcaggtcccggttgccggttccgggtccacggcggcgtaatcctagaactacccagcacccgctcgccctcctggccagagtctgggtgctctgcaaaggttggaattggcgcctcgcgagagcttctcaaggtctggcatcacacctgccaccttgggccatccacacgctggcttcctggggcttactgaggggagaacgccctacacgtataccccgcctgctgcctagaagccaaagacaactgggcccccccgccagtcgccaacctttaccgggaacgttagcagggcggcggagtagaaccagacagagtcgcgctctgcccccctggagatag

SEQ ID NO: 208006 - DNA, 1401 bp, Artificial Sequence
  Description of Artificial Sequence: Synthetic coding sequence
atgaagagcctgagcctgctgctggccgtggccctgggcctggccacggcggtgagcgccggacctgccgtgatcgaatgttggtttgtggaggacgcaagcgggaaaggactcgcaaagaggccgggggccctgctcctgcgccaggggccgggcgaaccaccaccaagacccgatctggaccctgagctttatctttctgtacacgaccctgcaggcgcactgcaggccgcttttagacggtaccctagaggagccccagccccgcactgcgaaatgtcgagattcgtcccactgccagcttcagccaagtgggcgagtgggctcacacccgcccaaaattgcccgcgtgccctggatggggcctggctgatggtgagcattagtagtcccgttttatctctgtcctctttgctccgcccgcaacctgagccccaacaggagcccgtgttaatcaccatggcaaccgtggagatgggattccaccacgttgggcaggccgcgttggagcttcttactagcgttgtgctgactgtcctaacccacacgcccgctccaagggtccgcctgggacaggatgccctgcttgatctgagctttgcgtacatgccgcccacttcagaagcagcaagctcactggcccccgggcctcctcctttcggactggaatggagaagacagcacctggggaaggggcacctgcttctggccgctacacctgggcttaatggacagatgcccgccgcacaagagggggccgtcgccttcgcggcatgggatgacgacgagccctggggcccctggactggaaacggcactttttggctgcctcgagttcagccctttcaggaaggaacctacctggcaacgatccaccttccttacctccagggccaggtgactttggagctggccgtctacaagccacccaaagtctctttaatgcccgccacactagccagggccgcccctggggaagcaccacccgaactattgtgtctggtcagtcacttctacccaagcggcggtcttgaggtggaatgggaactcaggggggggccgggaggtagaagccagaaagccgaaggacaacggtggctgagcgctcttcgccaccatagcgatgggtccgtctccctgtccggccatctgcagcctccgcccgtgacaactgaacagcatggagcccgctatgcctgcagaatccatcatccctctctgcctgccagtggaaggtcagcagaagtgacgcttgaagtcgccggcctttctgggccttcgttggaagattccgtgggcttgttccttagcgcctttctgcttctggggctgttcaaggctctgggatgggctgcagtgtacctttccacatgcaaggattctaagaaaaaagccgaatag

SEQ ID NO: 208007 - DNA, 1347 bp, Artificial Sequence
  Description of Artificial Sequence: Synthetic coding sequence
atgaagagcctgagcctgctgctggccgtggccctgggcctggccacagctgtctctgccggaccagccgtgatcgagtgctggtttgtggaggatgccagtggaaaagggctggcgaagaggcctggggccctcctgctgcgtcagggcccgggtgagccccctccccgacctgatctggatccagaattgtacctctcagtgcacgaccccgcaggtgctctgcaggctgccttccgccgataccctcgcggagcaccagctccacattgcgagatgtcaaggtttgttcccctgcctgcctcagccaaatgggcatccggccttacaccagcgcaaaactgtcctagggctctcgacggcgcgtggttaatggtgagcatcagctcaccagttctctctctcagctcactgctgcgcccacagcccgagcctcaacaagaacctgtgctgattaccatggccaccgtagtactcaccgtgctgacccacacccccgccccccgcgtgcgattgggacaggacgccttactggatttaagctttgcctatatgcctccgacctctgaggctgcttcttcattggctcccggaccacctcccttcgggctcgagtggcgccgacagcatctcggcaagggtcacctccttctggccgccacacccggactcaacggtcagatgccagccgcccaggagggtgcagtggcctttgccgcatgggacgacgatgagccttggggtccgtggacaggcaatggaacattttggctgcctcgggtgcagcccttccaggagggtacgtatcttgctaccatccacctgccatatctacaggggcaggtgacgctggagctagcggtttataagcccccgaaggtgtctctcatgcctgctacactggcccgtgccgcgcctggggaagcccctcccgaattgctgtgtcttgtatcccatttctaccctagtggaggtctcgaagtggagtgggaactgcgaggaggtcccggaggccgcagtcagaaagcggaaggccaacgctggctcagcgctctcagacaccactccgacggttccgtctctttgagcgggcacttgcaacccccgccagtgacaacggaacagcatggcgccagatatgcgtgcaggattcaccatccgagtctgccggcctccggtcgcagcgctgaggtgacactggaagtagcaggcctctcgggcccaagtctcgaagactcagtcgggttgttcctatccgcttttctgctactggggctgtttaaggccttaggatgggctgcggtatatctcagtacctgtaaggactcaaaaaaaaaggcagagtag

SEQ ID NO: 208008 - DNA, 1515 bp, Artificial Sequence
  Description of Artificial Sequence: Synthetic coding sequence
atgaagagcctgagcctgctgctggccgtggccctgggcctggccacagctgtgtcagcggggccggcggtgattgagtgctggtttgtcgaggacgcaagtggtaagggattggctaagcggcccggagccctcttgctgcgacaagggcccggggagcccccacctcgcccagatctggatcccgagctgtacctgtcagtccacgaccccgccggagctttacaggcagccttcagaagatatcctaggggcgcccccgcaccgcactgcgaaatgtccaggtttgtcccattacctgcctccgccaagtgggcaagtggactgacccccgcccaaaactgtccccgcgcactggacggggcttggctgatggtgagcattagttcccctgtgctgtcactaagtagcctgctgagaccacagccagaaccgcagcaggagcctgtcctgattaccatggcgactgttgttctgaccgtcctgacgcatacacccgccccccgagtgcgccttggacaagatgccctgttagatctaagttttgcgtatatgccaccaaccagcgaagccgctagctctttagccccaggcccccccccgtttggccttgagtggcgcaggcagcacctcgggaaggggcatctattactcgccgccacgccgggcctgaatggtcaaatgccagctgctcaagagggtgcagtggcctttgcagcctgggacgacgacgaaccatggggaccttggaccggtaacggaaccttctggctcccgactgtacaaccattccaagaggggacatacctcgccactatccacttgccatatctccagggacaagtcaccctggaactcgcagtgtataaaccacccaaagtgtctctaatgcccgctacactcgcacgggctgcaccaggagaggccccccctgaattgctgtgcctcgttagtcacttctacccttcagggggcctggaagtggaatgggaactgaggggcggtccaggggggcgctcccaaaaagccgagggacagcggtggctgtcggctctgaggcaccactcagacggttccgtgagcctgtccggacacctacaaccgccccctgtgaccaccgaacagcatggagctcggtatgcctgtaggatacatcacccatccctccctgccagtggtcgatccgcggaggtgacactcgaggtggcgggtctctctggccccagcctcgaggatagtgtgggattgtttctaagcgcattcctgctactcggcctattcaaagcgctgggatgggccgcggtctatctctcaacttgcaaggactccaaaaaggtgcagtgctccacaagcctctacctgagcctggtgaccttgtccccacatcccatctccaaaccgatggaaggtggctgctggtgcgggagacagaatctgggcctggaattcaccctaatctgggtaaagacttggcactatatactgacagtgggactgttcgaacacgctacttag

SEQ ID NO: 208009 - DNA, 1347 bp, Artificial Sequence
  Description of Artificial Sequence: Synthetic coding sequence
atgaagagcctgagcctgctgctggccgtggccctgggcctggccacagcagtctccgctggccctgccgtaatagagtgttggttcgtggaagacgcatccggtaagggattagcaaaacgaccaggggcactcttgctgagacagggtccaggtgagcctcctccaagacctgacctggatcctgagctgtatctgagcgtgcatgacccagctggcgctctgcaggccgcatttagaaggtatcccagaggagcaccagcaccccattgtgaaatgtctcgctttgtgccactgcctgctagtgcaaagtgggcctctgggctgactcctgcccagaactgtccccgagccctagatggagcctggctgatggtttccatcagctctccagtcttgtctttgtcctcgcttctgaggcctcaaccggaaccacagcaggagcccgtcctgattacaatggcaaccgtggtgttgacagtgttgacacacacccctgctcctcgcgttcgactgggacaggacgctcttctcgatctgagttttgcctatatgccaccgacatcagaagctgctagctcactcgccccaggtccccccccattcgggctggaatggagaaggcagcaccttggaaagggccatctcctgcttgcagctactccaggattgaacggccagatgccagcggcgcaagagggggccgtggctttcgccgcgtgggacgacgacgaaccctggggaccatggactggaaacgggacattttggttgcccaccgtgcagccattccaagaagggacgtatttggctacaatacatctgccatatctgcagggacaagtaacacttgagctggccgtatacaagccaccgaaggtgtccttgatgcccgccacattggccagagccgctccaggagaagcaccgccagagctgctgtgtttggtgtcacacttctatccctctgggggactcgaggtggagtgggagctccgaggagggccaggaggccgaagccaaaaggctgaggggcagaggtggctcagtgccctaagacaccactctgacggtagcgtgagtctgtcgggccaccttcagcccccccctgtcacaacagagcagcacggagcacgttatgcctgccgcattcaccatccttccctacctgccagcgggcgcagtgccgaggtgacgctcgaggtggccggactttctggcccatccctggaagacagtgtgggcctgtttctgagtgctttccttcttttagggcttttcaaagccctgggatgggcagcagtgtacttatcgacctgcaaggattcaaagaagaaagccgaatag

SEQ ID NO: 208010 - DNA, 1401 bp, Artificial Sequence
  Description of Artificial Sequence: Synthetic coding sequence
atgaagagcctgagcctgctgctggccgtggccctgggcctggccaccgctgtgtccgctggtcccgccgtaatcgaatgctggttcgtggaagacgcctccgggaagggccttgcaaagaggccaggagcattattgctgaggcaaggaccaggagagcctcctccaaggcctgacttggacccagaactttacctctctgtccacgaccccgcaggagcattgcaggctgcttttagaaggtacccacgcggggctccggctccacactgtgaaatgtctaggtttgtccccctccccgcatctgccaaatgggccagtgggctgaccccagcacagaactgtccccgcgccctggacggggcctggcttatggtatctatttcctctcccgttctgagcctctcaagtctgcttaggccccagccggagccacagcaggaaccagtcttgattacaatggccaccgttgaaatggggttccatcacgtgggccaggctgcccttgaactgctgacgagcgtagttctgactgttcttactcacacaccagcgcccagggtgaggctgggccaggacgccctcctggacctgagttttgcctatatgccccccacctccgaagccgcctcttccctagctcccggaccccccccattcggtctggaatggcgcagacagcacctgggaaaaggacacttgctgcttgctgccactccaggtttaaatggtcagatgccagctgcccaggagggagccgtagcttttgccgcttgggacgatgatgaaccttggggaccttggactgggaatggaactttctggttgccaaccgttcaaccatttcaggagggcacctacctggcaactattcacctcccatacctccagggtcaggtcaccctcgagcttgcagtctacaaacctcccaaggtgagccttatgcccgccactctggcaagggccgcccccggggaggccccaccggagctattgtgtctggtcagccatttttacccctcaggagggctggaggtggagtgggaactgaggggtggccctggtggacggtctcagaaggcagaagggcagcgctggctatccgctctgcgccatcacagcgacggatcagtgtcactgagcgggcacctgcagccccctccagtgacaaccgagcagcacggggcccgttacgcctgtcgcatacatcacccaagcctacctgctagcggacggtccgctgaggtaacacttgaagttgccggcttgtctggccccagcctggaggattccgtggggctgtttctcagcgccttcctcttactgggtctgtttaaggcgctcggctgggcagcagtttatctgtcgacttgtaaggatagcaagaagaaggccgaatag

SEQ ID NO: 208011 - DNA, 1515 bp, Artificial Sequence
  Description of Artificial Sequence: Synthetic coding sequence
atgaagagcctgagcctgctgctggccgtggccctgggcctggccaccgcagtctctgcaggtcctgcggtcatcgaatgttggtttgtggaggacgccagcggcaagggactggcgaagcgacccggagctttgcttctgaggcaaggtccgggggagccccccccccgccctgacctcgatcctgagctttatttgtccgtccacgatcccgccggcgctctccaggcagcttttcgaagatatcctcggggcgcacccgcacctcattgcgagatgagccgatttgtacccttgccagcttccgccaaatgggctagtggcctgacccccgcgcagaattgtcctcgcgcactggatggcgcatggctgatggtatccatcagctcacccgtactgtctctcagctccctccttcgaccacagcccgaaccccaacaagaacccgtgctgatcacaatggccacggtagtattaactgttctcacgcatacacctgcccccagagtcaggctgggccaggacgcgttgctggacctgagctttgcttatatgccaccaaccagcgaggcagcatctagtctggcaccaggacccccaccctttggactggaatggcggaggcagcacctaggaaaaggtcacttattgttggcggccacacctggcctgaatggacagatgccagcagctcaggagggcgctgtggcttttgcggcctgggacgatgatgagccctgggggccctggaccgggaacggcaccttctggctgccacgtgttcagccctttcaggaaggtacttatctggccaccatacacctcccatatttgcaaggtcaggtcaccctcgaacttgccgtgtacaagccccccaaggtctctttaatgccagccaccctcgctcgggccgctccaggggaagctccccccgaactgctgtgtttggtgtctcatttctatccctccggcggcctggaagttgaatgggaactgaggggaggccctggcggacggtctcaaaaggccgaaggacagaggtggctctctgcgctgcgtcaccattctgacggctcagtgagccttagcgggcacctgcagccccctccagtgactacagaacagcatggtgcgcggtacgcgtgtcgcatccaccacccaagccttcctgcgagcggtcgctcagctgaagttaccctcgaggtggcaggtctgagtggaccatccctcgaagactctgtgggcctgtttctctctgcgtttctgctgctggggctattcaaagctttaggatgggctgccgtgtatctctcgacatgcaaagacagcaagaaggtgcagtgctcaactagtctgtacttgtccctggtgacgctgagtccccaccccatctctaagcccatggaggggggctgctggtgtggccgtcagaatttgggtctggaattcactttgatttgggtcaaaacttggcactatatcttgaccgtgggcttatttgaacacgcaacttag

SEQ ID NO: 208012 - DNA, 1347 bp, Artificial Sequence
  Description of Artificial Sequence: Synthetic coding sequence
atgaagagcctgagcctgctgctggccgtggccctgggcctggccacagctgtgtctgccggacccgcggtgatcgaatgttggtttgtagaagatgcgtctgggaagggcttggccaaacgccccggcgcactgttgctgcgtcagggacctggagagcccccccccaggcctgaccttgacccagagctgtatctctctgtacacgatcctgcaggagccctacaggccgctttccggaggtaccctagaggcgcgcctgccccccattgtgagatgagtcgctttgttccactgcccgcctcagcgaagtgggcatccggtttgacgcctgctcaaaactgtcctagagctctggacggtgcctggctaatggtttccatttctagccctgtcctttcattgtcctccctcttgcgcccccagccagagccacagcaggagcccgtgctgatcacaatggcaactgtggttctgaccgtcctcacacacacccccgctccccgggtccgtctcggccaggacgccctgctggacctgtcattcgcttacatgcccccaacctctgaggctgcctcctctctggcccctggcccaccaccgttcgggttagaatggcgacgccagcacctcggcaaaggccacttgctgttggcggccacccctggactgaacggccagatgccagccgcacaagagggagccgtggcttttgccgcatgggatgatgatgaaccatgggggccatggaccgggaacggaacattttggctgcctcgagtgcaaccgttccaagagggcacttatcttgccacaatacacctcccctacttgcaggggcaggtgacgctggagctggcagtatacaaacctccgaaagtttctttgatgcctgcaacactggctagggctgccccaggagaagcgccccctgagctcctgtgcctggtgtctcatttctatccaagcggtggtctggaagtggagtgggagctgagaggcggcccaggtggccgcagccagaaagcagaaggccagcggtggctgagtgcattaagacatcacagtgacggctcagtttctctgagcgggcatctccagcctccccccgtcacaactgagcagcatggggctcgatatgcttgccgtatacaccacccctctcttcctgccagcggtaggtctgctgaagtgaccttagaggttgccggattgagcgggccttcactggaggactctgtggggcttttcctgtccgcattcttgctcctgggccttttcaaggctttggggtgggcagctgtttacctctctacctgtaaggatagtaaaaaaaaagccgaatag

SEQ ID NO: 208013 - DNA, 1515 bp, Artificial Sequence
  Description of Artificial Sequence: Synthetic coding sequence
atgaagagcctgagcctgctgctggccgtggccctgggcctggccaccgcagtctccgccggtccggcagtgatcgagtgttggttcgtcgaagacgcgtcgggaaaaggattagcgaagagacccggtgcattgttgctccgccaaggacccggcgagccacctccccggcccgacttggacccggagctgtacctgtccgtgcacgacccagcaggagccctgcaggctgccttccggcgctacccaaggggtgcacccgctccacactgtgagatgtcacggttcgtgcctttgccagcctctgctaagtgggctagcggcctgacccccgcccaaaactgccccagggccctcgatggtgcatggcttatggttagtatctcaagcccagtactgagtctgtcgagtctgcttaggccccaacccgaacctcagcaggaacctgtcctgattactatggctacagtggtgctcactgtgctgacccacactcctgctcctcgcgtgagattggggcaggacgccttattagacttgagtttcgcatacatgcctccaacatctgaggcagcctcttctcttgctccaggacctcctccttttggcctagagtggagacggcagcacctgggcaaggggcacctgctcctggccgccactccaggcctgaatggacagatgcccgcagcccaagagggagcagtggcattcgccgcatgggacgacgacgagccttggggaccatggaccggaaatggtactttctggcttccacgggtacagcccttccaagaaggcacatatctagctactatccacctgccttacctacaagggcaggtcacactggaactggccgtttacaaacccccaaaggttagtctcatgcccgctacacttgcccgcgcagcaccaggagaagccccccccgagttgctgtgcctcgtgtcacatttctacccctcaggggggctggaggttgagtgggagctccgcgggggcccaggaggcagatctcagaaagccgagggccagcgatggctgtccgccctgcgccaccactctgacggctctgtctctttgagcggacatcttcagccaccgccagtcacgacggaacaacacggggcccgctacgcctgtaggatacatcatccctcactgcccgccagtgggagatctgcagaagtcactctggaagtcgctggactgtccggacccagcctggaggattcagtaggtctgtttttgagcgcctttctgctgctgggtttgttcaaagcattaggctgggccgcggtgtacctatccacctgcaaagactccaaaaaggttcaatgctccacaagtctgtacctgtcgttggtaacactgtcgccacaccctatctccaagcctatggaaggtggctgttggtgtggccggcagaatctcggtctggagttcacactcatttgggtgaagacatggcactatattcttaccgtgggattgtttgaacatgctacctag

SEQ ID NO: 208014 - DNA, 1401 bp, Artificial Sequence
  Description of Artificial Sequence: Synthetic coding sequence
atgaagagcctgagcctgctgctggccgtggccctgggcctggccaccgcagtgagcgccggccccgctgtgatcgaatgttggttcgtggaggacgcaagtggtaaaggacttgccaaaagaccaggagcgttgctgctgcgccaggggcctggcgagcctcccccccggcccgatctcgaccccgagttatacctgtccgttcacgaccccgccggagccctgcaagccgcgttcaggcgctatccccgcggcgcaccagctccccactgtgaaatgagcaggtttgttccgctcccggccagcgctaagtgggcctccggactgactccagctcaaaattgcccccgggcacttgatggagcatggttgatggtttcaatatcatcccccgtcctgagcctgagctcactcttgagaccacaacccgagccgcagcaggaacctgtgttgataacaatggcaactgtggaaatgggattccaccatgttggacaggcagcactggaactgcttacctctgttgttttgacggttctcacccacacgccagctcccagggtacggctgggccaggatgcgctgttggatctgtcattcgcgtatatgcctccgacctccgaagcagcttccagcctcgcccctggcccacctccattcgggctggaatggcgtagacagcatctgggtaagggtcaccttttactcgcggctacgcctgggttgaatggccaaatgcccgccgcacaggagggcgccgtcgccttcgcagcatgggacgacgatgagccatggggtccttggaccggaaacgggaccttctggctgcctcgcgtgcaacccttccaggagggtacataccttgccactatccacttaccatacctgcaggggcaggtgaccctggaactcgctgtatacaagcctcctaaggtgtctctgatgcctgcaaccctggcgcgcgccgctccaggagaggccccacctgaactgttgtgcctggtttcacatttttaccctagcgggggacttgaggtggaatgggaactacggggagggcccggaggcagatcccagaaggccgaagggcagcgctggctgtccgctttgagacaccatagcgatggctccgtgtccctgtcaggtcacctccaaccccctcctgtaactactgaacagcacggtgcccgctacgcatgtagaatacaccatccatccctgccggcttccggtcgctctgcggaagtgactctagaggtggccggcctgtccggaccgtccctggaagatagcgtgggcctattcctttcagcctttttattgctggggctgtttaaggctctgggatgggccgccgtgtacctctctacctgcaaggactccaagaagaaggctgaatag

SEQ ID NO: 208015 - DNA, 1347 bp, Artificial Sequence
  Description of Artificial Sequence: Synthetic coding sequence
atgaagagcctgagcctgctgctggccgtggccctgggcctggccacagccgtaagcgcaggtccggcagttattgaatgctggttcgtagaggatgcatccgggaagggcctggccaaacggccaggcgcacttctccttagacagggccccggtgagcctccaccaaggcccgacctggacccagaactgtacctgagcgttcacgatccagccggcgctctgcaggccgccttcagacggtatcctagaggagccccagctccccactgcgagatgtctcggttcgtaccactcccggctagcgctaagtgggctagcggcctgacccccgcgcaaaattgtcctagggccctggacggggcctggttaatggtgagtatctctagccccgtcctgtctctctcttctctcttgcgacctcagccagagcctcagcaggaacccgtgctcatcacaatggcgactgtcgtactgaccgtactgacacacaccccggccccccgggtgagacttggccaggatgctctcttggatctgtctttcgcttacatgcccccgacaagcgaagctgcgtcctcgctcgcgcccggcccacctccctttggtctcgagtggagacggcagcatctcggtaaggggcatcttctgctggctgcaacaccgggactcaacgggcagatgcccgctgcacaagaaggcgcagtcgctttcgccgcctgggatgatgacgaaccctggggcccctggacaggaaatgggacattttggcttcctagagtgcaaccctttcaagagggcacctacctcgccacaattcatttaccttatttgcaaggccaagttacattggagttagccgtatataaacctccgaaagtgtctctgatgccagcaacccttgcccgcgctgccccgggcgaggctcctccagagttactttgcctggtgtcccatttctatccttcaggcgggctcgaggtggagtgggagcttcgtggaggacccggcggccggtctcagaaggctgagggtcagagatggcttagcgccctgcgtcaccatagtgatggctctgtcagtttgagcggacatttacaacctccacccgtaactactgagcagcacggggccaggtatgcttgtcgcatccatcaccctagcttacccgcctctgggagatcagcagaagtgaccttggaagtagcggggctttccgggccgtcactggaggattctgtcgggctgtttttgagtgccttcttgctgctcggcctctttaaagccctgggatgggctgcagtctatttgtcaacttgtaaagattccaaaaagaaagcagagtag

SEQ ID NO: 208016 - DNA, 1515 bp, Artificial Sequence
  Description of Artificial Sequence: Synthetic coding sequence
atgaagagcctgagcctgctgctggccgtggccctgggcctggccaccgcagtgtctgctggtccggccgtgatcgaatgttggtttgtcgaggacgcgagtggcaaaggcctggccaaacgacctggggctctcttgcttcgccaaggtcccggagagcctcccccacggcctgatctggacccagaactctacctttcagttcacgatccagccggtgccctacaggccgcgttccgcaggtatccacgtggcgctcccgccccccactgcgaaatgagtcgttttgtgcccctacctgcgagtgccaaatgggccagtggtctcactcccgctcagaactgtccacgcgccctcgacggcgcctggttgatggtgtccataagttcccctgtcctgtcgctgtcatcactgttgagacctcagcctgagccccagcaggagcctgttctcattacaatggccacagtcgtgttaactgttctgacccacacccccgccccacgagtgaggctgggccaggacgcactcctggatcttagcttcgcttacatgccacccacctcagaggccgcgtcctccctggccccgggtcccccaccctttggcctggagtggcgccgacagcacctgggcaaaggacacctgctgctggctgcaacgcctggccttaatgggcagatgcctgccgcccaagaaggcgcagtggctttcgccgcttgggatgatgacgaaccttggggaccttggacgggcaatgggaccttttggctgcctactgtgcagccgttccaggaagggacctacttagccactatccatctgccctacctgcagggtcaggtaactctggaactcgctgtgtataaacccccaaaggtgtctctgatgccagcaaccctggccagggctgccccaggggaggccccccccgagctgctttgtttagtgtcccacttttaccccagtgggggactagaagtcgaatgggagctgaggggaggaccaggaggcaggtcacagaaggccgagggccaacgctggttgtccgccttacgccaccattctgatggtagtgtgtctttgtctggccatctgcagcctccacccgtgacaactgaacaacatggcgcaaggtacgcttgcaggattcatcatcccagcctccctgcctcggggagaagcgccgaagtaacccttgaggtggctggattgtccggccctagcttagaagatagcgtgggcttatttctgagcgcttttcttctgttaggattattcaaggctctgggctgggccgcagtgtatctgtctacctgtaaagactccaaaaaggtgcagtgcagcactagcctctacttgagcttggttaccctgtctcctcacccaatttccaaacctatggagggcggatgttggtgtgggaggcagaacctcggcttggaattcacactgatttgggtgaaaacatggcattacattctgactgtcggcctatttgagcacgcgacatag

SEQ ID NO: 208017 - DNA, 609 bp, Artificial Sequence
  Description of Artificial Sequence: Synthetic coding sequence
atgaagagcctgagcctgctgctggccgtggccctgggcctggccacggcggtttccgcagggccagcagtgatagagtgctggtttgtggaggatgcctcaggtaaaggcctggcaaagcgccctggtgccctgttgctgcgtcaaggtcccggcgagccaccccctcgccctgatctagatcccgaactctacctctctgtgcacgtcgttttgactgttctgacccataccccggccccccgggtgcgtctgggccaggacgctctgcttgatctctcgttcgcttacatgccaccaacgagcgaggccgcatcctctcttgcgcctgggcctccacctttcggactggagtggaggcgacagcatcttggtaaggggcacctgctgctcgccgccaccccaggcctcaacggccaaatgcccgcagctcaggagggcgccgtcgccttcgccgcttgggacgatgacgagccttggggcccctggactggaaacggtaccttttggttgccaagagtccagccctttcaggagggcacttatctggccacaatacacttaccatatctgcagggccaggtcacactggagctggctgtgtattag

SEQ ID NO: 208018 - DNA, 1347 bp, Artificial Sequence
  Description of Artificial Sequence: Synthetic coding sequence
atgaagagcctgagcctgctgctggccgtggccctgggcctggccactgctgtatccgccggaccagccgtcatcgaatgctggttcgtggaggacgctagcggcaaaggcctcgctaaacgaccaggagccctgctgctcagacagggacccggcgagccaccacctcgccccgatctggaccctgagttatacttatccgtgcacgatcccgcaggggcactgcaagcagctttccggcggtaccctcgaggagcacctgccccccactgtgagatgagccgattcgtgccactgcccgcctccgctaaatgggcatctggattgactccagcgcagaattgcccacgagctctggacggcgcttggctgatggtgtcaattagctctcccgtcttgtccctcagcagtctgctgcggccacaaccagagccccagcaggaacccgtgctcatcacaatggccaccgtcgttcttaccgtcttgacgcacacgccagcccctagggtcagactaggacaagacgcattgctggacctgagtttcgcctacatgccacccacttcagaagctgcttcttcactagctcctgggccaccgcctttcggtctggaatggagaaggcagcacttagggaaaggccatcttctgttggctgctacgccgggccttaacggccaaatgcccgcggcgcaagagggagccgtcgcattcgcagcttgggatgacgatgagccatgggggccttggaccggaaatggcactttttggctccctacagtgcaaccttttcaggaaggtacataccttgctacaattcacctgccctatctccagggacaggtgaccctcgagctggctgtttataaacctcccaaggtttccctaatgcctgcaactttagctagggcggccccaggggaggctccacccgagttgctctgtcttgtatcacatttttatccatcgggaggactcgaggttgaatgggaattgcggggcggtccaggaggcagatcccaaaaagctgaaggccaaaggtggttgagtgctctgagacaccattccgatggctcggtctcactaagcggccatttgcagccaccgcctgtgacaactgagcaacacggagctcgttacgcctgccgcatccaccaccctagtttgcccgcgagcggtcggtccgccgaggtgactctcgaagtggctggcctgagtggacccagcctggaagattccgtaggactgttcctcagtgcattcctgctgctaggacttttcaaagccctaggctgggcagctgtgtatctgtctacttgcaaggactccaagaaaaaagccgaatag

SEQ ID NO: 208019 - DNA, 1401 bp, Artificial Sequence
  Description of Artificial Sequence: Synthetic coding sequence
atgaagagcctgagcctgctgctggccgtggccctgggcctggccactgccgtgtcagccggaccagctgtaatcgagtgctggtttgtggaggacgcttcaggaaagggcctcgctaaacggcctggtgcactgctgctgcggcaggggcctggagaaccccctcccaggccggacctcgacccagaactgtatctatctgtccacgatcccgccggggcgttgcaggccgcgttcaggcgctaccccaggggcgcgccagctccacactgcgagatgtctcggttcgtgcctctccccgccagcgcgaagtgggcctcaggtcttacacctgcccagaattgccctcgggcccttgatggcgcctggctcatggtgagtatctcaagtcctgtcttgagtctttcttccctgctgagaccacaacccgagccgcagcaggaacctgtactgattacaatggctacggtcgagatgggcttccaccacgtgggtcaggctgcgttggaactcttaacctccgtcgtgctcaccgtgttaacgcatacaccagcccctcgagttcggctcgggcaggatgccctgcttgacctgtcattcgcgtatatgccacctacctctgaggcggcatccagcttggcgcctggacctccaccgtttggcctggagtggcggagacagcatttaggaaagggacacctgctcttggctgcgacccctggccttaacggacagatgcctgcagcccaagagggtgccgtcgcatttgccgcatgggacgacgacgagccttgggggccatggaccggcaacgggactttttggctgccgagagttcaacccttccaggagggcacatacctggctacaattcacctgccttatcttcagggacaggtcactctagaactggcggtgtacaagccccccaaggtgtccttaatgccagctacattggctcgggctgcccccggcgaagcgcctcccgagcttctgtgcctggtcagtcacttctacccttcaggcggtcttgaggtagaatgggagctgagaggtggaccaggagggagatcccaaaaggcagaggggcagcgctggctgagcgccttaagacaccactctgatgggtccgtctccctgtccggacacctgcagccaccacccgttaccacggagcaacacggcgccagatacgcttgccggatccaccacccaagcctgccagcatccggccgtagtgccgaggttactctcgaggtcgcggggctatctggaccaagcctggaggattctgtcgggctctttctctccgccttcctcctgctgggactcttcaaggccctcggctgggccgccgtgtacctgagcacttgtaaggatagtaaaaagaaggccgaatag

SEQ ID NO: 208020 - DNA, 609 bp, Artificial Sequence
  Description of Artificial Sequence: Synthetic coding sequence
atgaagagcctgagcctgctgctggccgtggccctgggcctggccaccgccgtgtcggccggcccagccgtcatcgaatgttggtttgtggaagatgccagcggaaagggcctcgctaaaaggcctggagcactccttcttcgccagggtccaggagagccaccacctcgccccgaccttgatcctgaactctatcttagtgttcacgtggtcctcacagtgctgactcacactcccgctccccgcgtgaggcttgggcaggacgccttgctggacttgtcttttgcgtacatgccccctacctcagaggccgcgtcaagcctggcacccggtccaccaccatttggcctggagtggaggcggcagcatttaggaaaaggccacctcttactggcagcgacacccggattaaatggtcagatgcctgcagcccaggagggtgcggtcgctttcgccgcttgggacgacgatgaaccctggggtccgtggaccggcaacggcaccttctggctgccgaccgtccaaccttttcaggagggaacttatctggccactatccatctgccatacctccaggggcaagtgacattagagttagccgtttattag

SEQ ID NO: 208021 - DNA, 609 bp, Artificial Sequence
  Description of Artificial Sequence: Synthetic coding sequence
atgaagagcctgagcctgctgctggccgtggccctgggcctggccaccgcagtgagcgctgggcctgcggttattgagtgctggtttgtagaggacgccagcggtaaaggtctggccaagaggccaggtgctctcctgctgcgccagggcccaggagagcctcctcctcgcccagacctggacccagagctgtaccttagcgtgcacgtggtgcttactgtgctaacccatacaccggcaccgagggtccggttagggcaggacgctctactggatctgagctttgcctatatgcctcccacgagtgaagcggcaagttctcttgcccccgggccacctccctttggcctggaatggaggcggcagcacctgggaaaaggacacctgctgctcgctgccacccccggcctgaacggtcagatgcctgcagcgcaggaaggggccgtggcattcgcggcatgggacgatgatgaaccgtgggggccgtggacaggcaacgggacattttggctgccgcgtgtgcaaccatttcaggaggggacgtatttggccacaatacacctcccttaccttcaggggcaggtgacactcgagctcgcagtgtattag

SEQ ID NO: 208022 - DNA, 609 bp, Artificial Sequence
  Description of Artificial Sequence: Synthetic coding sequence
atgaagagcctgagcctgctgctggccgtggccctgggcctggccactgccgtgtccgcgggacctgccgtgatagaatgctggtttgttgaggacgcgtcaggtaaagggctggctaaaaggccaggagcactgcttctgagacagggtcccggggagccacccccacggccagatttagatccagagctctatctgtcggtgcacgtagtgctgactgtcctcactcacacaccagccccacgggtgcggctgggtcaagatgcattgttagacttgtccttcgcctacatgccacccacctccgaagctgcctcttctcttgcccccggcccaccaccttttggcctggagtggaggagacaacatctgggaaaaggccacttactccttgccgctaccccgggactaaatgggcagatgcccgcggcccaggagggcgccgtggccttcgccgcgtgggacgacgacgagccatgggggccttggaccggaaatggcacattttggcttccgagggttcagccctttcaggagggtacctacctggcaactatccacctgccctatcttcagggccaggttactcttgaactcgctgtctactag

SEQ ID NO: 208023 - DNA, 1347 bp, Artificial Sequence
  Description of Artificial Sequence: Synthetic coding sequence
atgaagagcctgagcctgctgctggccgtggccctgggcctggccactgcagtgagcgccggtcctgccgtaattgaatgttggtttgtggaagacgcaagtgggaagggcctggccaaaaggccaggagccctgctcctgcggcaggggcctggcgagcctcccccaaggcctgatttggaccctgagctgtatctgagcgtccacgaccccgccggcgctttacaggcagccttcagaagataccccagaggcgctcccgcaccccattgtgaaatgtctcggtttgtacctctgccggcttcagctaaatgggcaagcggtcttacaccggcgcagaattgtccccgggccttagatggcgcatggttgatggtttctatatcctccccagttttgtccctctcatccctgctgagaccccagccagagccgcagcaagagccagttctgatcactatggccactgtggttcttaccgtgctaacacatactccagcacctcgggtgcgcctgggccaggatgctcttctggatctgtcctttgcatacatgccacctacgagcgaagctgctagtagcctggcccccggcccacctccctttggcctggaatggagaagacaacacctgggcaaagggcatctcctgctggcggccactccagggctgaatggacagatgcccgcggcccaggagggcgcagtcgcctttgctgcttgggatgacgacgagccttggggtccctggacaggcaatggaacattctggcttcccaccgtccagccgttccaggaaggaacatacctggcaacaattcacctaccctacctccaaggtcaggtcacattggagctggcggtctataagcccccaaaagtgagcctcatgcccgccacgttggcacgggccgcccccggcgaggctccacccgagctgctgtgcttagtaagccacttctatcctagtgggggacttgaggtggagtgggagttaagaggcggaccggggggccgatcccagaaagccgaaggtcaacgctggctgagtgcgctgagacaccatagcgacggctctgtttcactcagtggccatctgcagccccctccagtaacaaccgaacagcacggggccaggtatgcttgcagaatccaccacccatctctgcccgcctccggacgctctgcagaggtcacgcttgaggtggctgggctttccggcccttccctcgaggattccgttggactgttcctgtccgcttttttactactgggcttgttcaaagcacttggttgggccgctgtttacctgagtacttgtaaggattctaaaaaacatgcgacctag

SEQ ID NO: 208024 - DNA, 1515 bp, Artificial Sequence
  Description of Artificial Sequence: Synthetic coding sequence
atgaagagcctgagcctgctgctggccgtggccctgggcctggccactgctgtgagtgctggtcccgccgtgattgagtgctggtttgtggaagacgcatccggaaagggtctcgccaagcggccgggcgccctgctgctgaggcagggccctggtgaacctcctccaagacctgatttggaccccgaactctacttgtcagtccacgaccctgctggggctctacaggctgcttttcggaggtatccgcggggcgcaccagcgcctcattgcgagatgtccagatttgtacctctgccggcgagtgcgaagtgggctagcgggttaactcctgcacagaattgtccccgggccctcgatggagcttggctcatggtctcaatctcctctccagttctcagtcttagtagtctgctgcgaccgcagcctgaaccacaacaagaaccagtcttgattaccatggcaaccgtcgtcctgacagttctcacccatactcccgcccctcgcgtgaggttagggcaggatgcgttgttggacctgtccttcgcctacatgccacccacctccgaggcagcatcatccctagcccccggccccccgccttttggcctcgagtggcgcaggcagcatttgggcaaagggcatcttctgctcgcagctacaccaggactcaacggccaaatgcctgctgcacaggagggcgctgtggcttttgcagcatgggatgacgatgagccatggggaccatggaccgggaacggcactttttggctgccccgggtccaaccatttcaagagggcacatatcttgctacgattcatctgccgtacttacagggacaggtgacccttgaactcgctgtttacaagccacctaaggtatccctcatgcctgctacccttgcaagagcagcgcccggggaggcccccccggaactcctgtgcctcgtgtcacacttttacccctcagggggactcgaggtggagtgggagctccgcggcgggccggggggacgctctcaaaaggcagagggacaaagatggctctcggcgctgcggcatcattccgacggatcagtgtctttatccggacatttacagcctccaccagtgacgacggagcagcacggcgcccgctatgcctgcagaattcaccatcctagcttacctgcttcaggacggtctgccgaagtcacgctagaagtcgcgggactcagtgggcccagcctcgaggattcagtaggcctgtttctgtcagcgttcttgttgctggggctgttcaaggcactagggtgggctgccgtttatctgagtacttgtaaagattcaaagaaggtccaatgcagcacttcactgtacctcagcttagttactctgtcaccacacccaatctccaagcccatggaaggcggttgttggtgtggccgacagaacttaggtctggagttcaccctaatttgggtcaagacgtggcactacatcttaaccgtcggactgtttgaacatgccacctag

SEQ ID NO: 208025 - DNA, 471 bp, Artificial Sequence
  Description of Artificial Sequence: Synthetic coding sequence
atgaagagcctgagcctgctgctggccgtggccctgggcctggccaccgctgtgtctgccggacccgctgtgatagaatgctggttcgtggaagacgcaagtggcaaggggctggcaaagcgacccggagccctgctcctgcgccaggggcccggtgagccaccgcccagacccgatttggatcctgaactgtatctgagcgttcatgatccagctggagctctccaggcagccttcaggcgatatcccaggggtgctccagcccctcattgtgagatgagccggttcgttcccctgcctgcctccgccaagtgggccagcggactgacgccagctcagaactgtccaagagcgctggacggggcctggctaatggtctctatctcaagcatgggacatgccatgccagtggagtttaccattcccgcctgcctgcccaggggggcagcgctccgtagtccctggaggtag

SEQ ID NO: 208026 - DNA, 1401 bp, Artificial Sequence
  Description of Artificial Sequence: Synthetic coding sequence
atgaagagcctgagcctgctgctggccgtggccctgggcctggccactgcggtgtctgccggaccagccgttatagaatgctggtttgtagaagacgcttcagggaagggccttgcaaagcgtcccggggccctcctgcttcgccagggtccaggagagccgcccccccgacccgacttggaccctgaactctatctttcagtccatgatcccgctggggctcttcaggctgcttttagaaggtatcctcggggggcgccggcgccacattgtgagatgtcaaggttcgtgccgcttcccgcaagcgctaaatgggcgtccgggttaacgcccgcccagaactgtccacgcgctttggatggtgcttggctgatggtgtccatatcttcgccagtactctctctgtcctctcttctacggcctcaacctgaaccgcaacaggagccagttcttatcaccatggccaccgtggaaatgggtttccatcatgtaggccaggccgctcttgagctgctgactagcgtggtcctgactgtgttgacgcacacaccagcaccacgggtgagactggggcaggacgccttgctggacctgtcatttgcatacatgcctcccacctctgaagccgccagcagcttggcccctggaccgcccccttttggactggaatggaggaggcagcacctgggtaaggggcatctgcttctggccgccacccccggtctgaacggtcagatgccagccgcccaggagggcgctgtggcctttgcagcctgggatgacgatgagccttggggcccgtggaccggaaatggaactttttggctacctacagtgcagccctttcaggagggaacctacctggcaaccatccacctcccttacctgcaaggtcaagttaccttagaattggctgtgtacaagccccctaaggtctcactgatgcccgccacccttgcacgcgccgcgccgggtgaagcaccccccgaattactgtgtctcgtcagccacttctatccctcaggcgggctggaagtcgagtgggagctcagaggcggacctggaggacgctcacagaaagctgaagggcagcgatggctctccgccttgaggcatcactctgacggcagcgtgtccttaagtggtcacctccaacctcctcctgtaacgacggagcaacacggagcccggtatgcttgccgaatccaccatccttctctgccagcctcagggcggagcgccgaggtcacgctggaggttgcaggcttatcaggccctagtttggaggacagtgtgggactgtttctgagtgcgttcctcctgctgggcctttttaaagcccttgggtgggcggcagtgtacttgagcacatgcaaagattccaagaagaaggccgagtag

SEQ ID NO: 208027 - DNA, 1086 bp, Artificial Sequence
  Description of Artificial Sequence: Synthetic coding sequence
atgaagagcctgagcctgctgctggccgtggccctgggcctggccacagccgtctcagccggccctgctgtaatcgagtgttggtttgttgaggacgcctctggtaaaggactggcaaagcggccgggcgcactcttgctacgacaaggaccaggcgagcctcccccccggccagatcttgatccagagctgtatctcagtgtacatgtggtcttaacagtactgactcacactccggccccgagagtccgcctgggacaggacgccttattagatttgtcatttgcttatatgccacccacttccgaggcggcctcttcattggctccggggccccctccattcggactggagtggcggcgacaacatctgggtaaggggcaccttctccttgctgcaacccccggattaaacgggcagatgcccgcggcccaggagggggccgtcgctttcgcggcttgggatgacgatgagccttggggaccctggactggtaacggaaccttttggctgcccacggtgcagccatttcaggaaggtacttatcttgctactatccatcttccttacttgcaggggcaggtcacactggaactggcggtgtacaagccccctaaggtttctctgatgccggccaccctggcacgggcagcaccgggcgaggccccacctgagctgctttgcctagtgtcccatttctacccctcaggggggctggaggttgagtgggaattaagaggtggccccggagggcgatcccagaaagctgaaggccagcgctggctctcggcccttagacatcattccgatggaagtgtcagtttgagcgggcacctgcagccaccgccagtgaccactgagcagcacggcgccagatacgcttgtcggatccaccacccttctttgcccgcgagcggcaggagcgccgaagtgactctggaggtcgcgggtctctccggccccagcctggaagactccgtcggactgttcctgagtgcattccttctcctcggactctttaaagcccttggttgggcagccgtctatttgtctacttgcaaagattctaagaagaaggccgagtag

SEQ ID NO: 208028 - DNA, 1347 bp, Artificial Sequence
  Description of Artificial Sequence: Synthetic coding sequence
atgaagagcctgagcctgctgctggccgtggccctgggcctggccaccgcggtgagcgctggtcccgcagtgatcgaatgttggttcgtcgaagatgcctctggcaagggtctagccaaacgaccaggcgcgcttctcttgaggcagggcccgggtgagcccccgcccaggcctgacctggatcccgagctgtatctgtccgtgcacgaccctgccggggccctgcaggcagccttcaggcggtatcccagaggggctcccgcaccccactgtgaaatgtcacgcttcgtcccacttcccgcctccgctaaatgggccagcgggctgactcccgcgcagaactgcccacgggcacttgacggagcctggctgatggtctcaatcagctcaccagtgctgtcactctcttcgctcttgcggccacagcccgagccccagcaggaacctgtgctcattacgatggccacagtcgtgctcaccgtcttgacacacacccctgcaccaagggtccgcctaggacaggacgcactgctggacctgtctttcgcttacatgccaccaacctcggaagccgcctcatcattggcacctggacccccgcccttcggattagagtggaggaggcagcacttaggtaaggggcatcttttacttgctgccactccagggctgaatggccagatgcctgctgcccaggagggggcagttgcttttgcagcttgggacgacgacgagccttggggcccttggactggaaatggaactttctggctaccaactgtccagccgtttcaagagggtacgtatctggctactattcatctgccatacctgcaaggccaggtgaccctcgagctcgcagtgtacaagccacccaaggttagtctgatgcccgcgacattggctcgcgccgcccccggtgaggcacctcccgaattactatgtctcgtgtctcatttttatccctcaggcggcctggaggttgagtgggagttgagaggaggcccgggagggcgctctcaaaaagccgaaggccagcggtggctaagtgcactgagacatcacagcgacggttccgtgtcattatcaggacacctgcaaccccctccagtgacaactgagcagcatggagcccgctacgcgtgcagaatccaccatcccagcctgcccgcatccggacggagtgcagaagttaccctcgaggtggcaggcttaagtggcccttccttagaggactcagtcgggctgtttctctcagctttcctgctgctgggcctctttaaggccttggggtgggccgctgtgtacctaagtacttgcaaggattcaaaaaaacacgccacctag

SEQ ID NO: 208029 - DNA, 471 bp, Artificial Sequence
  Description of Artificial Sequence: Synthetic coding sequence
atgaagagcctgagcctgctgctggccgtggccctgggcctggccaccgctgtgtcagccggtccagcagttattgagtgttggtttgtcgaagacgcgtctgggaaaggtctggccaagcggccaggcgccttgctgctaaggcagggacccggtgagcctcctcctaggcccgatctggatcctgagctttacctcagtgtgcacgaccccgccggtgccctgcaggccgcttttaggagataccccagaggcgcgccggctccacactgtgaaatgtctcgttttgtgccgctccccgcttccgccaagtgggcgagtggccttaccccggcccagaactgcccgcgggccctggacggcgcatggctgatggtaagtatttcgagcatgggccatgccatgccagtcgaattcacaatacccgcctgcttgccacgcggggccgctcttcgatccccctggagatag

SEQ ID NO: 208030 - DNA, 1086 bp, Artificial Sequence
  Description of Artificial Sequence: Synthetic coding sequence
atgaagagcctgagcctgctgctggccgtggccctgggcctggccacagctgtcagcgctggccccgctgtgatagagtgctggttcgtggaagacgcttccggtaagggacttgccaagcgaccgggcgcactccttttaaggcaaggccccggggaacccccaccacgtcccgatctggatccagaactttatctatccgtgcatgtcgttttgaccgtcttgacacacaccccagcaccacgtgttcggctgggacaggatgctctgctggatttgtcattcgcttatatgccacctactagcgaggccgccagctctctggcgccggggcctcccccgttcgggctggagtggcgcagacagcatttggggaagggtcatcttctgcttgctgcaactccaggcctgaatgggcaaatgcccgccgcgcaggaaggtgccgtcgctttcgcagcttgggatgacgatgagccttggggtccctggactggcaatgggacattttggttgcctagagtgcagcctttccaggaagggacctatctcgcaaccatacaccttccgtacctccagggacaagtgacactcgaattggctgtctacaaaccccccaaagttagcctgatgccagcaaccctggcacgggccgcgcctggagaagctccaccggagttgctgtgtcttgtgagccacttctacccctctgggggcttggaagtggagtgggagctgcgcgggggcccaggaggcagaagtcaaaaggcagagggccagagatggctgagcgccttgagacaccactctgacggaagtgttagtctgagtggccatctgcagcctcctcccgtaactaccgagcagcacggcgcgagatatgcctgccggatacatcatccatctctgcctgcttctggcaggtccgccgaagtcacgttggaggttgcgggactgtctggcccctccctggaggactcagtaggtctcttcctgtctgcttttttactgcttggactttttaaagccctcggctgggcagccgtttacttgtcgacatgcaaggactccaagaagcatgccacctag

SEQ ID NO: 208031 - DNA, 1347 bp, Artificial Sequence
  Description of Artificial Sequence: Synthetic coding sequence
atgaagagcctgagcctgctgctggccgtggccctgggcctggccacggctgtgtccgctgggccagccgtaattgaatgctggtttgtggaagatgcgtctgggaagggccttgcaaagcgtcccggggctctcctgctgcgtcagggaccaggcgagcctcctccgagacctgatctcgatcctgagctgtacctgagcgtgcacgacccagctggtgccttacaagccgcattcaggaggtacccaaggggagcaccggccccccattgtgagatgagcagattcgtccctcttccagcatccgcaaagtgggcctcgggactcacaccggcccagaattgtccccgggctctggatggcgcttggttgatggtgtctatttcctctcccgttttatcactgagcagcttactcagaccgcaaccggagccgcaacaggagcctgtgctgatcactatggcaactgtggtactcaccgtgctcacacatacgcctgcaccacgcgtgaggttgggccaagacgcactgctcgacctctccttcgcatatatgcccccgacgagcgaagcagcttcctctttagctcctggacctccccctttcgggctcgagtggcgcagacaacacctagggaaagggcacctgctcctggcagcgacacctgggcttaacgggcagatgcccgcagctcaggaaggagccgtggccttcgcagcatgggatgacgatgaaccttggggtccctggacaggtaacggtactttctggctgcctcgggtccagccgttccaggaaggaacatatctggccactatacatctgccatatctgcagggtcaggtgactcttgaactggccgtttataagcctccaaaagtgtcgttaatgccagctaccctggcgcgcgctgcccctggtgaagccccacccgaacttctgtgcttggttagccacttttatccctccggcggactcgaggtcgagtgggaattaaggggcggccctggcggaagatctcagaaggctgagggacagcggtggctgtctgcactgcgccatcacagcgacggatctgtctccctctccgggcatcttcagccgccccctgtcaccacagagcagcacggggcgaggtacgcttgcagaattcatcacccatccctaccggccagtggacgctcagctgaagtaacccttgaggtcgctggtctctccggaccatcactcgaagactccgtcggcctctttttaagcgcattcttattactgggactctttaaggcccttggctgggccgctgtgtatctcagcacctgtaaagactccaagaagcatgccacatag

SEQ ID NO: 208032 - DNA, 1086 bp, Artificial Sequence
  Description of Artificial Sequence: Synthetic coding sequence
atgaagagcctgagcctgctgctggccgtggccctgggcctggccactgcagtcagtgccggtcctgctgtgatagagtgttggtttgtggaagacgcctcaggtaagggtctggccaaacgaccaggcgcccttctactgcgccagggcccgggggaacccccccctcgtcctgatttagatcccgaattgtacctttctgtccacgttgtgctcactgtcttgacgcatacgcctgcccccagagtccggctcggccaggatgccctcctggatctcagttttgcatacatgcctcccacctcagaagccgcatcctctctcgcacccggccccccccctttcggattagaatggcgacgacagcatcttgggaaaggtcacctccttctggccgcaactcctggtctgaacgggcagatgccagccgcacaggagggtgctgtggccttcgctgcttgggatgatgatgaaccctgggggccatggactggcaacggtacattttggttgcctcgggtgcagccattccaggagggcacatatctcgctacaatccaccttccatatctccagggccaggtaacactcgaactggccgtgtataagccaccaaaagttagtctgatgccggccacactggcccgagcggcccctggcgaagctccgcccgagctgttatgtctggtgagtcatttttatccaagtgggggcctggaggtggaatgggagctccgaggtggacccggaggccgaagtcaaaaggctgaggggcaacgatggcttagtgccctgaggcaccattccgatggttccgtgagcctatcagggcatttacaaccaccaccggtcaccactgaacagcacggagctaggtacgcgtgccggatccaccacccaagtctgcctgcaagcggaagatcagctgaggtgacgctggaggtcgccggtctaagcggaccatcattggaagactctgtgggcctcttcctgtctgccttccttctcctgggcctgttcaaagccctgggctgggctgcagtctatctgtctacttgcaaggactccaaaaaacacgctacatag

SEQ ID NO: 208033 - DNA, 471 bp, Artificial Sequence
  Description of Artificial Sequence: Synthetic coding sequence
atgaagagcctgagcctgctgctggccgtggccctgggcctggccactgccgtctccgccggacccgcggttatcgaatgttggttcgttgaggacgcctccggaaaaggtttggcaaaaaggcctggagctctgctcctaagacagggtccaggtgagccgcccccccggccagatcttgaccctgaactctacttaagcgtgcatgatcccgccggcgccctgcaggctgcattcagacggtatccccggggggcaccagcccctcactgcgaaatgtctcgtttcgttcccttacccgccagtgctaaatgggcttcagggctgacccccgctcagaactgccccagagctttagatggggcctggctcatggtgtccataagctctatggggcatgctatgcccgtcgagttcacaatcccagcctgtctccctagaggagctgccttgcggagcccctggcgctag

SEQ ID NO: 208034 - DNA, 1347 bp, Artificial Sequence
  Description of Artificial Sequence: Synthetic coding sequence
atgaagagcctgagcctgctgctggccgtggccctgggcctggccacagctgtctccgctggccccgcagtcatcgaatgttggttcgttgaggatgcttctggcaaaggtcttgctaagcgaccaggagccctgcttctccgtcagggacccggcgaaccgcctccgagaccagacctggacccagagctttacttgtctgtacatgaccctgctggtgccctacaagccgctttccggcgctatccgcggggggcacccgcccctcactgtgagatgtctcgatttgtgcctctgcctgcctctgcaaagtgggcctccgggttaacacctgcgcagaactgtccacgagctctcgacggcgcttggctgatggtatcaatctccagccccgtgctcagtctgagttcccttctgcgaccacagcctgagccccagcaggagcccgtcctaatcactatggcaacagtggtcctgaccgtcttgacacatacaccagcaccccgcgtgcgtttgggacaagacgccttactggacctctcttttgcatacatgcctcctaccagtgaggcagcgtcttcgctagcaccaggaccaccgccattcggcctcgaatggcggaggcaacaccttggtaaagggcatctcttgcttgctgccaccccgggtctgaatggccagatgcccgccgcgcaggaaggcgctgtggccttcgcagcctgggacgacgatgagccttggggtccctggactggaaacggtactttctggctcccgagggtccagccatttcaggagggtacctacctggctacaatccatctgccttacttacagggccaggtaacacttgaacttgctgtgtacaagccacccaaagtatctcttatgcctgcaactctggcacgcgccgctcccggggaagcacccccagagctcttgtgtttggtgtcacacttctacccctccggcggccttgaggtagagtgggaactgaggggtggacctggagggaggtcccagaaggccgagggacagcgatggctatctgcattgcgtcatcacagtgacgggtctgttagcctgagcggccatctccagccaccccccgtgacgactgagcagcacggggcccgctacgcctgcaggatccaccatccctcgttacccgcaagtggaagaagcgccgaggtgacactggaagtggcagggttgagtgggcctagcttggaagattcagtgggcctgtttctatccgcgttcctgctcctgggtctctttaaggctctaggatgggccgccgtctacctgtcaacctgcaaggactctaagaagcatgctacttag

SEQ ID NO: 208035 - DNA, 1086 bp, Artificial Sequence
  Description of Artificial Sequence: Synthetic coding sequence
atgaagagcctgagcctgctgctggccgtggccctgggcctggccaccgctgtgtccgccggacccgcggttattgagtgctggttcgtggaggatgccagcgggaaggggcttgccaagcggcccggagcactactacttcgtcaggggccaggagaaccaccccccagaccagatcttgacccagaactgtacttaagcgtgcacgtcgtcttgaccgttctgactcacacaccggctccacgggtgagactcggtcaagatgctttgcttgacctgagtttcgcttacatgccaccaacatcagaagccgcttcgagtttggcacccgggcccccaccatttggattagaatggagacgccaacatttgggaaagggccatcttctgctcgccgcaacccctggtttgaatgggcaaatgcctgcggcacaggaaggggccgtggcgtttgcagcatgggacgatgatgagccctggggaccctggacaggcaacgggacattttggctgcctaccgtgcagccgttccaggagggaacttatttagctaccatccacttgccttatctacaaggacaggttaccttggaattggccgtttacaaacccccaaaggtaagcctgatgcctgccaccttggcccgggcggcccccggcgaggccccccccgagctgctctgcctcgtgagtcatttttacccatcaggagggttagaggtggaatgggagttgagaggtggaccgggcgggcgctcacaaaaggcagagggccagcgctggctgagtgcactgcgccaccattccgatgggtcagtgagcctctcaggccatctgcaacctcccccagtcacaacagagcaacatggcgcacgctacgcctgccggatccaccacccttccctgccagcaagtgggagaagtgctgaagtgacgctggaagttgccgggctgagcggacccagtttagaggattctgttggcctttttctgtcggcttttcttctgctcggcctttttaaagccctcggctgggctgctgtttacctctctacatgcaaggacagtaaaaagaaggcagagtag

SEQ ID NO: 208036 - DNA, 1347 bp, Artificial Sequence
  Description of Artificial Sequence: Synthetic coding sequence
atgaagagcctgagcctgctgctggccgtggccctgggcctggccacagccgtaagtgcgggtcccgcagttattgaatgctggttcgtcgaggacgcttctggcaaaggattggccaaacggccaggcgccctcctgctacgccaaggcccaggggagccacctccgcggcccgacctggacccggagctgtatctgtctgtgcatgaccccgctggcgctctgcaagccgcattccggcggtacccccgaggagcaccagccccacactgtgaaatgtctagattcgtgccattacctgcctccgctaagtgggcaagtgggttaacacctgcgcaaaactgcccccgcgccctggacggcgcttggctgatggtgagcatcagctcacccgtgctctctctctcgtcacttcttaggccacagccggagccacagcaggagccagtgctcattacgatggcaaccgtggtgttgaccgttctcactcacacacccgctccaagagttaggctaggccaggacgctctgctggacctgtcatttgcctacatgcctcccacctccgaagccgccagctcactggctccaggacccccccctttcggcttagaatggcgaagacagcacttaggtaaggggcacctgctgcttgcggcaacccccggactgaatggccaaatgccagctgctcaggagggtgccgttgccttcgccgcatgggatgatgacgagccctggggcccttggacgggaaacggcactttttggctgcctcgggtacagccgttccaagaagggacctacctcgccaccattcaccttccgtatctgcagggacaggtgactctcgaactggccgtctacaagcctcctaaagtgtccttgatgccagccactcttgcccgggccgcaccgggtgaggctcctcctgagctcctgtgcctggtgagccacttctacccttcgggcggactcgaagttgagtgggagctcaggggcggtcccggagggaggagccagaaggccgaaggccagcgatggttgtcagcactccgacaccatagtgatgggagcgtgtccttgtccggccatctccagcccccaccagtaacaactgaacagcacggcgcacggtacgcatgcagaattcatcacccgtcacttcccgcttctggtcgaagcgctgaggtgacactggaagtggctggtttgagcgggccatccctggaggacagcgtcggtcttttcctatctgcatttcttctgctcggcttgttcaaagctttgggatgggccgccgtctacctgtcgacttgcaaagattccaagaagcacgccacctag

SEQ ID NO: 208037 - DNA, 1086 bp, Artificial Sequence
  Description of Artificial Sequence: Synthetic coding sequence
atgaagagcctgagcctgctgctggccgtggccctgggcctggccacagccgtctcagccgggccggccgtaattgagtgttggtttgtggaggacgccagcggtaagggactcgccaagcgtcccggcgccctcctcctgagacagggccctggcgagcctccaccgcgccccgatctggaccctgagctgtacttatccgtgcatgtggtgcttacagtcctgacgcatacgccagccccccgtgtgcgcctcggccaggacgctctgctcgatctgagttttgcctacatgccacccacttcagaggcggcgtcctctctagcacctgggcctccccccttcggtttggagtggcggcgccagcacctgggaaaggggcacctgctgctggccgcaacccctggtctgaatggtcagatgccagccgcgcaggaaggcgcagtcgcctttgctgcctgggacgacgacgaaccctggggaccctggactggcaacggaaccttttggcttccccgcgtgcagccctttcaggagggcacttatttggccaccatccacctgccttacctgcagggccaggtcaccctggagcttgccgtctataagcccccaaaggtctcattgatgcctgccacgctggcccgcgcagcccctggcgaagccccccctgagctgctgtgtctggttagccatttttaccccagcggcggcctggaggtagagtgggagctccggggcggacccgggggccgctcccagaaggcagaagggcaacgatggctctctgcgctgagacatcattctgacggcagcgtgtccctttctggccatctacagcccccgcccgtgaccacggagcagcatggagctaggtacgcatgcaggatccaccacccctctttacctgctagcggccggtccgcggaggtcaccctggaagtcgccggcctgtcggggcctagcctggaagatagcgtgggcttgtttcttagcgcattcctgttgcttggattatttaaggctctcggctgggccgccgtgtacctttctacctgcaaggattccaagaagcacgctacttag

SEQ ID NO: 208038 - DNA, 2037 bp, Artificial Sequence
  Description of Artificial Sequence: Synthetic coding sequence
atgctgctggaggccgagcggcggcggggcggcggcgccgccggcgcaaggctactggaacggtaccgcagagtccctggagttagggccttgagagcggactccgtgctcatcatcgaaaccgtcccagggtttccccccgccccccctgcaccaggtgccgctcagatccgggctgctgaggttctggtgtacggagcccccccaggtcgggtaagcaggctcctggagcgcttcgacccacccgctgcaccccggagaaggggctccccagagcgggctcggcctcctcccccacctcctccccccgcccctcctcgtcccccgccagcagcaccctcccccccggccgcccccggtcctcgtggaggaggggcgtcacctggggcccgcaggagtgactttctgcagaaaactggctcaaattcttttactgtacatccccgtggcctgcatcggggtgccggagctaggctcttatctaacggtcatagtgcccccgagccacgcgcagggccggctaatcgcctagccggatcaccccctggatccggccagtggaaacccaaagtggagtctggcgatcctagcctgcacccacctccgtcgccaggcaccccctctgcaacccccgcatccccacccgcaagcgctacgccttcccagcgccagtgcgtaagcgctgctacgagcacaaacgacagcttcgagatcaggccagcccccaaacctgttatggaaacaattcctctcggagacctacaggcccgcgccctcgcatcactgcgtgctaatagcagaaattcatttatggtcataccaaaatctaaagcctccggggccccccccccagaggggcggcaatccgtggagttacctaagggtgaccttgggcccgcttccccctcccaggaactcggatctcagccagttccgggaggggacggcgcacccgcactcggcaagtcacccctggaagtggaggcccaatgggctgttgaagagggagcctgcccacggacagccaccgccctagctgaccgggctattagatggcaacgcccatcctcgccaccccctttccttcctgcagcctccgaagaggccgagccggccgagggcctgagagtccctggactggccaaaaactctcgcgagtatgtcagacccggacttcctgtgaccttcatcgacgaggtggattcagaggaggccccccaggccgctaagctgccgtatttacctcatccggcccgcccactgcatccggcacgccctggatgtgtcgccgagctccaacccagagggagcaataccttcacggtggtccctaagcggaagccgggtaccctccaggatcagcacttttctcaggcaaatagggaaccaaggccccgggaggccgaagaggaagaagcaagctgtctcctgggacccactctcaagaagagatatccgaccgtccatgagatagaggtaatagggggctacctggcactccagaagtcttgcctgaccaaggccggcagcagccggaaaaagatgaagatatccttcaatgacaagtctctacagacaacttttgagtacccgtccgagtcaagtctggaacaagaggaagaggtggaccaacaggaggaggaagaggaggaggaggaggaggaagaagaggaggaggagggatcaggcagtgaagagaaaccgtttgcactgttccttccaagagccacttttgttagttcagtgaggccagaatcgtcaagactgccggaaggctcctctgggctttcctcttacactcccaaacactccgtggcgttttcaaagtggcaggaacaagccctagagcaggccccacgggaagctgaacctccacctgtggaggcaatggtccgatgcggcggcgtagagcgatggggggaaagcgatacacgagccagcccctgcgttcatatcctcagctctcactttcagctgacacctgcatcacaaaacgacctcagtgactttagaagcgagccggcactctatttctag

SEQ ID NO: 208039 - DNA, 2136 bp, Artificial Sequence
  Description of Artificial Sequence: Synthetic coding sequence
atggccgccctgggccggcccggcagcggcccccgggccgccgtgcccgcttggaagcgggaaattctggagcgaaagcgcgcgaaacttgcggctctgggaggcggcgccggtcctggggccgccgagcccgagcaaagggtgctggctgagtccctcggaccacttagagagaaccccttcatgctgttggaagccgagaggcgcagaggtgggggagccgcaggtgcacgcctactagagagatatcgcagagtgcctggcgtccgcgctctgagagccgactccgtcctcattatcgagactgtgccggggtttcccccagctcccccagctccaggcgctgctcagattagggcggctgaggtactggtttatggagctccacctgggcgcgtgagccggcttctcgaaaggtttgaccctccagccgcacctcggcgcaggggcagccccgagagggctaggcctcctccacctcctcctccacctgctccgcctcgcccgccccctgccgctcccagcccccccgctgctcccggaccccgtggtggtggcgccagtcccggggctcgacggtctgacttcctccagaagaccggcagtaattccttcacagttcatccaagaggacttcataggggggctggagcgagactgctgtctaatggtcattcagccccagagccccgggcagggccagcaaacaggctcgcaggctcccctccagggtcaggccaatggaagccgaaggtagaatccggagatccaagtttgcaccccccaccttctccagggaccccaagcgcaacccctgctagtcctcccgcaagtgccaccccttcacagcgccaatgcgtaagcgccgcaacctcaaccaacgactccttcgaaattagaccagcccccaaacctgtgatggagacaattccgctcggcgatctccaggccagagccctagcgagcctgagagccaacagcagaaacagctttatggtgattcccaaaagcaaagcctcaggtgcccctcctcctgaggggagacagtctgtggaactgcccaagggagatcttggtcccgcctcgcccagtcaggagctggggtcacagcccgttcccggaggagatggagcacctgcgttagggaaatcgccattggaggtggaggcccagtgggcagtcgaggagggcgcctgccccagaacggcgacagctttagctgatagagcaattcgatggcagcgcccgagttctccccccccttttcttcccgccgcctcagaagaggctgagcccgccgaaggactgcgggtgccggggctggccaagaactctagagagtatgtcaggcctggcttacctgtcacctttatcgacgaggtggactctgaagaggccccacaagcggctaagctcccgtacttgccacatcctgccagacctctgcatcctgctcggcccggctgtgttgccgagttgcagcccagaggatccaatacattcactgtggttcccaaacgcaaacctggtacattacaggatcagcatttcagccaggcaaatcgggagcccagacctcgggaggccgaggaagaggaggcatcttgtctgctgggccctacgctgaagaagaggtacccgacagttcacgagattgaggtgattggaggctatttggctctgcagaagtcatgcctcaccaaagctggctccagccggaagaaaatgaagatcagttttaacgacaaaagcctccagaccaccttcgagtacccttccgaatccagtcttgagcaggaagaggaggtggaccagcaagaagaggaagaagaagaggaagaagaggaggaagaggaagaggagggctctggatccgaagaaaagccttttgccctattcctgccaagggcaacgttcgtgagttctgtccgtcccgagagtagtcgcctgcctgaaggatccagcgggctgtctagctatactcccaagcactctgtcgctttcagcaagtggcaggaacaagctcttgagcaggctcctcgtgaagccgagccacctcctgtagaggccatgctgacgcctgcctcccagaatgatctttccgacttccggagtgaacccgccctatacttctag

SEQ ID NO: 208040 - DNA, 4866 bp, Artificial Sequence
  Description of Artificial Sequence: Synthetic coding sequence
atggagtgggtgctggccgaggccctgctgagccagagccgggacccaagggccctgctgggagcactctgtcaaggcgaggcctcagcagagagagtggaaaccctccgcttcctcctgcagcgcctcgaagatgaggaagcacggggtagtggcggagcaggcgctttgcctgaagctgcgcgtgaggtggccgcaggctacctggttcccttgctgaggagtttgcgcggccgcccagcagggggccctgatccatcccttcagcccaggcaccgccgcagggtcttgagggccgctggtgcggctcttaggtcttgtgtccgactggctgggagaccacagctggccgctgccttggccgaggaagccttaagagacctcctcgctggctggcgcgctcctggtgccgaagccgctgtggaggtgctggctgccgtcggtccatgcctgcgaccccgggaggacggaccactactcgaacgggtcgcgggtaccgctgtggccctcgccctgggcggtggaggcgacggagatgaggctgggcccgccgaagatgccgcagctttggtcgcgggacgcctcctgcctgtgttggtccagtgtgggggggctgccttgcgggccgtttggggaggcctggctgccccaggtgcatctcttggaagtggcagggtcgaagagaagctactcgtattgtctgcactggctgagaaactccttcccgaaccaggtggggatagggcccgaggagcaagggaagctggacccgatgcacggcgctgctggagattttggaggacggttcaagcaggtttgggacaagctgatgcgctcacccgaaaaagggctagatatttgctgcaaagagccgtggaggtttccgcagagctgggggctgactgcacgtgtggtccgcaagagggcaatggaccttctctcttttggtggagcgagcgtaaaaaagacgaactcctcaagttctgggagaattacatcctcataatggaaacactcgagggcaaccagatccacgtcattaagccagttctgcccaaactgaataacttgtttgagtacgcggtgtcggaggagaacggctgctggctcttccacccatcgtggcatatgtgtatatacaaaaggatgttcgaaagtgagaacaaaattctcagtaaggagggcgtgatccatttcctagaattgtacgaaacaaaaattttgcctttttcacctgagttctcagagttcatcattggtccgttaatggacgcccttagtgaatcgagcctgtacagccggagccctggacagccaattgggagctgttctccactcggcctgaagctgcagaaatttctagtaacatacatatccctgttgcccgaggagataaagagtagctttttacttaaatttatccggaagatgacatcccgccactggtgcgcagtccccattttgttcctgtcaaaggccctagcgaatgtgcctcgtcacaaggcgctagggatcgacggtctgcttgccctccgcgatgtgatccactgcacaatgatcacccatcagattctgctgaggggagcggctcagtgctatctgctacagacggccatgaatctcctggacgtagaaaaggtgtccctgagtgacgtcagtacgttcctgatgtctctcagacaggaagagagccttgggcgaggtacttcgctgtggacagagctctgtgactggctgcgcgtgaacgagtcctacttcaagccaagcccaacatgcagttcaattgggctccacaagacttcattaaacgcctatgtgaagagtatcgttcaggaatatgttaagagttcagcatgggagacaggggagaattgtttcatgccggactggttcgaagccaaacttgtgtcactcatggtcctgctggccgtagatgttgaaggtatgaagactcagtactccggaaagcagaggacggaaaacgtgttgcgcatctttctggaccccttacttgacgtcctgatgaaattcagtacaaatgcctacatgcccttgctgaagacagacagatgtctccagttattgctgaagctcctgaatacatgccgtctgaaagggagtagtgctcaggatgatgaggtctccacggttctgcaaaactttttcatgtcaacaactgaatctatttctgagttcattctgagacgcctaaccatgaatgaacttaattcagtaagtgacttagacaggtgtcacctgtacttaatggtgctcaccgagctgattaatctacacctgaaggtgggttggaaaaggggcaacccaatctggcgcgtgattagcctcctcaaaaacgcctcaattcagcatctccaggaaatggatagtggacaagagccaactgttggctcccagattcagcgggttgtgtctatggctgccctggctatggtgtgcgaggccatcgatcagaagcctgagctacagttggatagtctccatgcagggcctctcgaatcctttctcagtagcctacagctcaaccagaccctgcagaagcctcatgccgaagagcagtcgtcctacgcccatcctctagagtgctcttccgtgctcgaggagtccagcagctcacaaggctgggggaagatcgtagcccagtacatacacgatcagtgggtgtgtctgtccttcctactgaaaaaatatcatactctaataccaacgacaggaagcgaaattctggagccgttcctcccagcagttcagatgccaattcggacgcttcagagtgcactggaggcattgaccgtgctgtcatcagatcaagtgctgcctgtttttcattgccttaaggtgttggtgcccaaattacttacatcaagcgaatctctgtgcatcgagtctttcgatatggcatggaagattatcagttccctaagcaatacccagttgattttctgggccaaccttaaagccttcgttcagttcgtcttcgacaacaaggttctgaccattgccgccaaaatcaagggacaggcctacttcaaaatcaaagagataatgtataagatcatagaaatgagcgctataaaaaccggcgtatttaatactttaatcagctactgctgtcagagctggatcgtgtccgcgagtaacgtctctcaaggcagtctgtcatcagcaaagaactattccgagttgatactagaagcctgtattttcgggactgttttccggcgcgaccagagacttgtgcaagatgttcagacattcattgaaaatctgggccatgattgcgcagctaacatcgtgatggagaataccaagcgggaagaccactacgtgcgtatctgtgctgttaaatttttgtgcctgctagacggtagtaatatgtctcataaactgttcattgaagaccttgcaatcaaactcctggataaggatgaactggtttcaaagtccaagaaaaggtactatgtgaatagccttcagcacagggtgaaaaacagggtctggcaaacactcctggtcctgttcccacggctcgatcagaactttttgaatggtataatagaccgcatctttcaagcgggctttacaaacaatcaagcaagcatcaagtacttcatcgagtggattattatccttatccttcacaagtttcctcagttcctccctaagttctgggactgcttcagctatggagaagaaaatttgaaaacttccatctgcacttttttagctgtgctgtcccatctggacatcattacccagaatataccggaaaaaaaacttatccttaagcaggctctcatcgtcgtcctccagtggtgtttcaaccacaacttctctgtgcgcctgtatgcactcgtggctcttaagaaactctggacagtgtgcaaggtcctctcagttgaggaattcgacgcgctcaccccagtgatcgagtcttctctgcatcaagtcgagagtatgcatggagccggcaacgcaaagaagaattggcagaggattcaggagcacttcttcttcgctacctttcatcctctaaaggactactgtctggaaaccatcttttatattctgcctcggttgagtggactgattgaagatgagtggataacaatagacaaatttactcggttcaccgatgtgccactggccgctggcttccagtggtacttgtcacagactcagctgagcaaacttaagcccggtgattggagccagcaggatattggaacaaatcttgtagaagccgacaaccaggccgagtggactgatgtgcagaaaaagattatcccctggaactcacgcgtctctgacttggatctggagctgctgttccaagaccgcgccgcacggctaggcaagagcatctctcgtcttatcgtcgtggcttctctgatagacaaacccaccaatttgggcgggctgtgccgcacgtgcgaagtcttcggggcttccgtcttggtggtgggaagtctccagtgcatctctgataaacagttccagcatttatcagttagcgcagagcaatggctacctctagttgaagtgaagccccctcaactgatcgactacctgcaacagaagaaaacggaaggttacacaattatcggagtggaacagactgccaaaagcttggatctgactcagtactgctttccagaaaagagccttttgctgctgggcaacgagcgagagggcataccagccaacctgattcagcagctggatgtctgcgtagaaatcccacagcagggcattattcgctccttgaatgttcatgtgagcggcgccttgcttatatgggaatacacccggcagcagttgctctcccacggggatactaaaccctag

SEQ ID NO: 208041 - DNA, 1101 bp, Artificial Sequence
  Description of Artificial Sequence: Synthetic coding sequence
atgagcgaggaggagcagggcagcggcaccaccaccggctgcggcctcccaagtattgagcagatgctagctgctaatccaggcaagacgcccatatctctcctccaagagtacggaaccagaatcggaaagacccctgtgtatgatttgctgaaagcagaggggcaggcacatcagcccaactttacctttagagttactgttggggacacaagctgtacaggtcagggaccctccaagaaagcagccaagcacaaggctgccgaggtcgccctgaagcacctgaagggcggttccatgctagagcccgctctggaggattctagctcgttctcaccactcgactcctccctgccagaggacatccctgtgtttaccgcggcagcagctgctacaccggtcccctcagtggtgctgactcgcagcccgcctatggagctacaacctccggtgagtccccagcagtcggagtgtaatcccgttggggccctacaggaactcgtggtgcagaaggggtggcgccttcccgaatatacagtaacacaggagagcgggcctgcacaccgaaaagagtttacaatgacctgccgcgtggaacgctttattgagataggctccggtacttccaagaagctggccaaaaggaacgccgcagctaagatgttactcagagtccatactgtccccctcgacgcaagggatggaaacgaagtagaacctgatgatgaccacttctccatcggcgtggggagcagactggatggcttgaggaatcgcggcccggggtgcacttgggacagcttgagaaactccgtcggggagaagattttaagtctgagatcgtgctcactgggtagcctgggtgccctggggccggcatgttgtcgtgtcctctctgagctgtctgaggaacaagcatttcacgtgtcttatctggatatagaggaactttcattgagtggattgtgtcagtgcctcgtagaactatctacacagcccgctaccgtatgtcatggtagcgccaccactagggaagcggccagaggcgaggcggcaagacgagccctccaatatctcaagattatggccggctcaaaatag

SEQ ID NO: 208042 - DNA, 1038 bp, Artificial Sequence
  Description of Artificial Sequence: Synthetic coding sequence
atgctggccgccaaccccggcaagacccccatcagcctgctgcaggagtacggtactcgtattgggaagacacccgtgtacgacttgctgaaggccgagggccaggctcatcaacccaatttcactttccgcgtcaccgttggagatacatcctgcacggggcaaggccccagcaaaaaggctgcgaagcacaaggcggctgaggttgccttgaagcacctgaaagggggttctatgctcgagcccgccctcgaagactcaagtagcttttcccccctcgattcctccctccctgaagacatacctgtgtttaccgcagctgcggcggctacccctgtacccagtgtagtgctgacgaggtccccaccaatggagttacagccccccgttagtccacagcaaagcgagtgtaatcccgtgggagcactgcaggaactggtggtgcagaaaggctggcgcttaccagagtacaccgtcacccaggagtccgggcccgcccatcggaaggaatttactatgacatgccgcgtcgaaaggttcattgagattggcagtggaaccagtaaaaagctggcgaaacgaaacgcggccgcaaagatgctgttgcgggtgcacactgtcccccttgatgcacgcgatgggaacgaggtggaacctgacgatgaccacttctcaatcggcgtcggatctagactcgacggattgagaaatcgagggcccggttgtacctgggattctctgaggaattccgtgggagagaagattctaagcttgagaagctgtagtcttggctctctgggagctctgggccccgcttgttgtagagtcctgtctgaactgagtgaggagcaggccttccacgtcagttacctggacatcgaggaacttagcctcagcggactttgccagtgcttagtggaattgtccacccagccggccaccgtttgccacgggtctgcaactacaagggaggccgctcgtggggaagctgcacggcgagccctccagtacctcaagatcatggcagggtcaaagtag

SEQ ID NO: 208043 - DNA, 1038 bp, Artificial Sequence
  Description of Artificial Sequence: Synthetic coding sequence
atgctggccgccaaccccggcaagacccccatcagcctgctgcaggaatatggaactcggataggaaagacaccggtctatgaccttctaaaggcagaaggccaggcccatcagccaaacttcacattccgagtgaccgtgggggacacatcttgcaccggacaggggccatctaagaaggctgccaaacacaaagcagctgaggtggctctgaagcacctaaaaggaggctcgatgttggaaccagctttagaagactcatcctcattctcgcctctcgactccagtctgcccgaggacatccccgtgttcacagcggcagccgccgccactccggtgccttctgttgttttgaccagatccccccccatggagttgcaaccgccagtctctccgcagcaatccgaatgcaaccctgtgggggctctccaggaactcgtggtccagaaaggctggcgcttgcccgaatacacagtcactcaggagagcggtcctgcccatcgcaaggagtttactatgacctgccgagtcgagcgcttcattgaaatcggctctggtacctccaagaagctggccaaacggaatgccgctgctaaaatgctcttgcgtgtgcatacggtgcccttagatgctagagacggaaacgaagtggagcctgatgacgatcacttcagcatcggagtgggctctcgtctggacggtctaagaaatagggggcctggatgcacctgggacagtctccgaaattcggtgggtgagaaaatcctcagcttgagaagctgtagtttgggttccttgggggcattaggccccgcctgctgcagggtcctgagcgaactcagcgaggaacaggccttccacgtgtcttacttggatattgaggaactgtcactcagcgggttgtgccaatgtctagtcgagctcagcacacagcccgccaccgtgtgccatggctctgccaccacgcgggaggccgcacggggtgaggctgcccgaagggcattgcaatacctgaaaattatggccgggtctaagtag

SEQ ID NO: 208044 - DNA, 1245 bp, Artificial Sequence
  Description of Artificial Sequence: Synthetic coding sequence
atgagcgagtacatccgggtgaccgaggacgagaacgacgagcccattgaaattccctccgaggacgacggcaccgtactcctgtcaaccgttactgctcaattccctggtgcttgtggtttacgctaccgcaaccctgtatcccagtgcatgaggggggttcgtctggttgaaggcattctccatgcccccgacgcaggctgggggaatctggtctatgttgtcaactacccaaaggacaacaagcgaaagatggacgagaccgatgccagcagtgctgtaaaggttaagagagctgtacaaaaaaccagcgatctgattgtgctgggcctgccttggaaaaccactgaacaagatctgaaagagtactttagcacatttggggaggtcttgatggtccaagtaaagaaggatttgaagacagggcactccaaaggattcggattcgtgcgcttcactgaatacgagactcaagtaaaagtaatgagccagaggcatatgattgacgggcggtggtgcgattgcaagctgccaaacagtaagcagtctcaggatgagcctctgagaagccgaaaagtgttcgtgggtcgatgtaccgaggacatgacagaagacgaactccgcgagttcttcagtcaatatggagatgtgatggacgtgttcattcctaaacccttcagagcttttgccttcgtaacctttgctgatgaccagattgctcagagtttgtgtggggaggacttaataatcaaaggcatatctgtgcacatttcaaacgcagaacctaagcacaacagcaatcggcagttggaacggagcggccgctttggagggaatccaggcggtttcggcaatcaaggaggattcgggaactcccgaggcggaggggccggcctaggcaataatcaaggctctaatatgggtggcggcatgaatttcggggcttttagcatcaacccagccatgatggctgccgcccaggctgcactacagagcagttggggtatgatgggcatgctggcctctcagcaaaatcagtccggccccagcggaaataatcagaatcagggaaacatgcaacgcgaacccaatcaggccttcggctcggggaacaattcctattccggcagcaattccggcgcagcgatcggctgggggtcagcgagtaatgccgggtctggctctggatttaatgggggctttgggtcttcaatggactccaagagctccggttgggggatgtag

SEQ ID NO: 208045 - DNA, 888 bp, Artificial Sequence
  Description of Artificial Sequence: Synthetic coding sequence
atgagcgagtacatccgggtgaccgaggacgagaacgacgagcccatcgagattcccagtgaagatgacggtacggtcctgctctccacggtgaccgctcagtttcccggggcctgtgggctgaggtaccgcaatcctgtgtcacagtgtatgcggggggtacggctcgtggaaggcattctccacgcacccgatgctggctggggaaacctcgtgtatgtggtgaactaccctaaggataacaaacgcaagatggatgaaacggacgcatcgtctgccgtgaaggtgaagcgggcagtgcagaaaacatccgacctcatcgtactaggacttccttggaagactaccgagcaagatctgaaagagtatttttccacctttggcgaggtgctgatggtgcaggttaaaaaggacttaaaaactggtcactccaagggcttcggcttcgtccgatttacagagtacgaaacccaggtaaaggtgatgtcccagagacacatgatagacggccggtggtgtgattgcaaactgccaaatagcaaacaatcccaggatgagcctcttagatcgcgtaaggtgttcgtggggcgttgcacagaggatatgaccgaagacgaattgcgtgaattctttagccaatacggtgatgtgatggacgtttttatcccaaagccgtttcgagccttcgcattcgtaaccttcgctgacgaccagatcgctcaatcactctgtggagaagacttaatcatcaagggaatctcagtccacatatcaaatgccgaacccaaacataattctaacaggcaactggagcgaagcggacgctttggggtccacctcatctcaaatgtatacggccggtcaacctctctgaaagtggtgctctag

SEQ ID NO: 208046 - DNA, 897 bp, Artificial Sequence
  Description of Artificial Sequence: Synthetic coding sequence
atgccccagatgctggccggcgagatctggtgcatgctgagcaccattcaaaaggtgaaaaaagatctaaaaactggtcattccaaaggttttggttttgttcggttcacagagtacgaaacccaggtgaaagtaatgagccagagacacatgatcgacgggagatggtgtgattgtaaactgcctaattcgaagcagagccaggatgaacccttacgatcccgaaaagtctttgtgggtaggtgcaccgaagatatgactgaggatgagctgagagaattcttcagccagtacggggacgtcatggacgtgtttatccccaagcccttccgagccttcgccttcgtgaccttcgccgacgatcagattgcccagtctctgtgtggtgaggaccttattataaaaggcatctctgtccacatttctaatgccgaaccaaaacacaattccaaccgtcagctggaacgatccggcaggttcggcgggaaccccggcggctttggcaatcagggcggcttcggcaacagtcggggggggggggccgggttgggtaacaatcaggggagtaatatggggggggggatgaatttcggggctttttcgatcaaccccgccatgatggctgccgcccaagccgcactgcagagtagctggggcatgatggggatgctcgcctcacaacagaatcagtctgggcccagtggcaataaccagaatcaggggaacatgcaacgggagcctaatcaggcgttcggctcgggtaacaactcctatagcgggtccaattccggagcagccatcggatggggttcagcatccaacgcaggatccggctccggctttaacggtgggttcgggtcaagcatggattctaagtcttctgggtggggaatgtag

SEQ ID NO: 208047 - DNA, 1533 bp, Artificial Sequence
  Description of Artificial Sequence: Synthetic coding sequence
atggccgccgacagcgacgacggcgccgtgagcgcccccgccgccagtgacgggggggtcagtaaatcaaccaccagtggggaagagctcgtggtgcaggtgccggtggttgatgtgcaatccaataatttcaaagaaatgtggccgtcattgctcctggctattaagacagccaattttgttgccgtcgatactgagcttagcggcttgggcgaccgcaagtcacttctgaaccagtgtatcgaggagcgatataaggctgtgtgccacgccgctagaactcggtcgattctgtcccttggactggcatgctttaagaggcagccggacaaaggtgagcactcctacttggcgcaggtgttcaatctgaccctgctctgtatggaggaatacgtcatcgagcctaaaagtgtgcagttcctcattcagcatggctttaactttaatcagcagtatgcccaaggaatcccatatcacaaaggcaacgacaagggtgacgagagtcagagccaatccgtcagaacattgtttctcgaacttatcagagccaggagaccgctcgtcttacataatggactgattgaccttgtgtttctgtatcaaaatttttatgcacacctcccagagagcctaggtactttcacagcggatctgtgtgaaatgttccccgctgggatatacgacacaaagtatgccgccgagtttcacgctaggtttgtcgctagctatctggagtacgcgttcagaaagtgcgagagagagaacggcaagcagcgcgcagcaggcagcccgcacctgactttggagttctgtaattatccctcttctatgagagaccatattgattacaggtgctgtctgcctcctgctactcatcgaccccatcctacaagtatctgtgataatttctccgcgtacggttggtgtcctctggggccccagtgcccacaatctcacgatatcgatcttatcatagatacggacgaagccgccgcagaggataaaaggcgccgccggcgtaggcgcgagaaacgaaaaagagcactacttaatctgcctgggacacagaccagtggcgaagccaaggacggcccccctaaaaaacaggtatgcggtgactcaattaagccagaggaaactgaacaggaggtggccgcagacgaaacaaggaatcttcctcatagcaagcagggcaataagaacgacctggagatggggatcaaggctgctagaccggaaattgcggatcgcgccaccagcgaggttccaggcagtcaggcctctccaaaccccgtcccaggtgacggactccaccgtgctgggtttgacgccttcatgacaggctacgtgatggcctatgtggaggttagtcaaggcccacaaccgtgttcaagcgggccctggcttcccgagtgccataacaaagtatacctgtccggaaaggctgtgcccctaactgtggcaaagtcccaattctcgagaagcagcaaagcccacaatcagaaaatgaagttgacatggggctcttcctag

SEQ ID NO: 208048 - DNA, 1293 bp, Artificial Sequence
  Description of Artificial Sequence: Synthetic coding sequence
atggccgccgacagcgacgacggcgccgtgagcgcccccgccgcctccgatggcgctgaatgggcctgggggcaggaagaattcgctgaaccaggcgagcactcatacctagcgcaggtattcaatctaaccctcctgtgcatggaggaatacgtgattgaacccaagtccgtgcagttcctcatccaacacggattcaacttcaatcaacagtacgctcaagggataccttatcataagggaaatgacaaaggcgatgagtctcaatcccagagcgtccggaccctatttttggagctcatccgggcgcggcggccactggtcctacataatgggctgattgacctcgtttttctctaccagaacttttatgcacacctcccggagtccctcgggaccttcactgccgatttgtgcgaaatgtttcctgctggcatctacgacactaagtatgcagcagagttccatgcaagattcgtcgccagctatctggagtacgccttccggaagtgtgaacgagagaatggcaaacagcgggccgctggaagcccccatcttactctggagttctgcaattacccatcctcgatgagagaccatattgactatagatgctgcctccctcccgccacgcatcgtcctcacccgacgtctatctgcgacaacttctctgcatatggctggtgcccccttgggcctcagtgtccacagtcacatgacatcgatctgatcattgatacggatgaggccgctgccgaggacaagcgacggagacggcggcgtcgggagaaacggaaacgagcacttctcaacctccccggcacccagacaagcggtgaagctaaagacgggcctcccaagaagcaggtatgcggtgacagtataaagccagaggaaaccgaacaggaggtcgccgcggatgaaacgaggaacctacctcactccaagcaggggaacaaaaatgacctggaaatgggcattaaagctgctagaccagagatagctgatcgggctaccagtgaggtgcctggctcccaggccagtccaaacccagtgccgggggacgggctgcacagggcgggctttgatgctttcatgacgggctacgtgatggcatatgtggaagtgtcacagggccctcagccatgcagcagcggaccctggcttcctgaatgccataataaggtatatctgtctgggaaagctgtaccgctgacggtcgccaagtcacaatttagccgcagttcgaaagcacacaaccagaaaatgaagctgacatggggaagtagttag

SEQ ID NO: 208049 - DNA, 1263 bp, Artificial Sequence
  Description of Artificial Sequence: Synthetic coding sequence
atgaccatggagaagggcatgagcagcggcgagggcctgcccagccgctctagccaagttagtgcgggcaagattacagctaaggagctcgagacaaaacaatcttacaaggagaaaaggggcggatttgtgctggtgcacgctggcgctggttatcattccgaatccaaggcaaaagagtacaaacacgtgtgcaaacgggcctgccagaaggcaattgaaaagctgcaggcgggggcacttgccacagacgccgtcactgcggcactcgtagagttggaggactctccctttacaaatgctggcatgggctccaatctgaatctgctcggtgaaattgaatgcgacgcatccatcatggacggtaaatcgctcaattttggggcggtgggcgctctgtctggaattaagaatcctgtgtccgtggccaatcgtctgttatgcgaggggcagaaaggtaaactgtctgccggtcgcatccccccatgtttcctcgtaggagagggcgcctaccggtgggcagtagatcacggaatcccgtcttgtcctccaaacattatgacgacaagattttcactcgcagctttcaaaagaaacaaacgcaagctggagctggctgagagggtggacactgactttatgcaactcaaaaagagaagacagagctcagagaaggagaacgactctggaacactggataccgtgggcgcagttgtggttgatcacgagggcaacgttgccgcagcggtttcctccggggggttagcactaaagcaccccggaagggtcggtcaggccgctctgtatggttgtggatgttgggccgagaacactggtgctcacaacccatattccaccgcagtctcaacatcggggtgtggggagcatctagtgcgaacgattctcgcacgtgaatgtagccacgctctgcaggccgaggacgcacatcaagccctcctggagaccatgcagaataagtttatcagttccccttttctcgcttctgaggatggcgtgctcgggggagtgatagtgctgagatcgtgtcggtgttctgcagaacctgacagttctcagaataagcaaaccctgttggttgagttcttgtggagccacaccaccgagtcgatgtgtgtcggatacatgagtgcccaggacgggaaggcaaagacacacatctcgcgattgcctcctggagctgtggccgggcagagtgtcgccattgaggggggggtgtgccgcttggagtctccggtgaactag

SEQ ID NO: 208050 - DNA, 918 bp, Artificial Sequence
  Description of Artificial Sequence: Synthetic coding sequence
atgaccatggagaagggcatgagcagcggcgagggcctgcccagccggtccagtcaagtttccgccggtaagatcactgcgaaggaactggagactaaacagtcctacaaggagaagaggggggggtttgtactcgttcatgccggcgccggatatcacagcgagtccaaggctaaggaatacaagcacgtctgcaagagggcgtgccagaaagattcacctttcaccaacgccggcatgggctcaaacctgaatctcctgggcgagatcgaatgcgacgcgagcatcatggacggaaagagtcttaactttggagcggtcggagccctgagcgggatcaaaaaccccgtcagcgtggccaaccgattactttgcgagggtcaaaaaggcaaactgagtgcaggccgcatcccgccgtgcttcctggtcggagaaggagcctaccggtgggccgtcgatcatggtatcccatcctgcccacccaatattatgaccacccgcttcagcctagctgccttcaagagaaacaagcggaagctcgagttagccgaacgcgtagatactgatttcatgcagctgaagaaaagacgacagagcagtgagaaagagaatgacagtggcacgctggacaccgttggagccgtggtggttgaccacgaagggaacgtcgccgccgccgtgtcatctggtggcctcgcccttaagcaccctggcagggtcggacaagcggcgctgtacggttgtggatgctgggctgaaaacactggagctcacaacccctatagcacagcagtgtccacctctggatgcggggagcaccttgtaaggacaatcctggccagggaatgtagccatgcgctccaggctgaagacgcccatcaggccctgttagagaccatgcagaacaaattcatctag

SEQ ID NO: 208051 - DNA, 333 bp, Artificial Sequence
  Description of Artificial Sequence: Synthetic coding sequence
tgaaagatcaccgccaaggagctggagaccaagcagagctacaaggaaaaaagaggcggatttgtattagtacatgccggcgccgggtaccactctgagtctaaggccaaggaatataaacacgtttgtaaaagggcctgccagaaagctattgaaaaactacaggcgggggccctggccacagatgctgtgactgccgcattggtagagttagagctcatgtggaagggccagttccaggtgctctgtgtccttacgaatctcttcctggatatcatcaaaaatccgaccaaaacaaagtttaagactattagcaatgttaaagtatattag

SEQ ID NO: 208052 - DNA, 918 bp, Artificial Sequence
  Description of Artificial Sequence: Synthetic coding sequence
atgaccatggagaagggcatgagcagcggcgagggcctgcccagcaggagttctcaagtgagtgcgggaaagataaccgcaaaggagttggaaaccaaacagtcttacaaggagaaaagaggaggattcgtgctcgtgcacgctggcgctggatatcattcggaaagtaaagctaaggaatacaagcatgtgtgtaagcgggcctgccaaaaagactcgcccttcaccaacgcaggaatggggagtaaccttaacctgctcggcgaaatcgaatgcgatgcctcgataatggacggcaagagcttaaatttcggagccgtcggagcattaagtggtatcaaaaaccccgttagcgttgcaaatcgactgctgtgtgagggccagaagggaaaattatctgccggcagaatccctccttgtttcttggtaggcgaaggagcttacaggtgggccgttgaccacggaatccccagctgcccccccaatataatgacaacacgcttctcactggctgcctttaagcgcaacaagcgtaaactcgagcttgccgaaagagtagacactgactttatgcagcttaagaaaagacggcagagctcggaaaaagagaacgactccggcacccttgatacggttggagcagtggtggttgaccacgagggcaatgtggcagctgccgtcagcagtggagggctggccttgaagcaccctggcagggtcggccaggcagctctatatgggtgcgggtgctgggctgagaataccggggcccacaacccgtacagtaccgccgtgagcacttccgggtgcggagaacacctggtcaggactatcctagccagggagtgctcccacgcgttgcaggccgaagacgcacaccaggccctgttagagacaatgcagaacaagttcatctag

SEQ ID NO: 208053 - DNA, 438 bp, Artificial Sequence
  Description of Artificial Sequence: Synthetic coding sequence
atgaccatggagaagggcatgagcagcggcgagggcctgcccagcaggtcttctcaggtttcggccggtaagataactgctaaggagctcgagaccaaacaatcatataaagagaagaggggcggctttgtcttggtccacgctggagctggttaccatagcgagtcaaaggctaaagagtacaaacacgtatgcaaacgggcctgtcagaaagcaatcgaaaaactccaggctggagcactggccacggatgcagtgaccgctgccctagttgaactggaagatgttgaatcaatattatgcgcaccctactggctcgaaaacgtgcatatgctctataaactccgcatgctgactaaaccctgttggagactttgtaagacgagtctctccgtccatctgtcattgcctgttaaaatggcttgcctcgcagagtag

SEQ ID NO: 208054 - DNA, 390 bp, Artificial Sequence
  Description of Artificial Sequence: Synthetic coding sequence
atgaccatggagaagggcatgagcagcggcgagggcctgcccagccggtcctctcaggtatcagcagggaaaatcaccgcaaaagagctggagactaaacagtcgtacaaagaaaaacggggagggttcgtcctggtgcacgcaggcgccgggtaccactctgaatccaaagctaaagaatataagcatgtgtgtaagagggcctgccagaaggcaatcgagaaactgcaggccggagcactagccactgatgctgtgactgccgcactggtcgaattggaagtgtacacacacagttacactagctggagttgcattcaaccaagcatccatgtgctccttgtgaaaaggcaaaggaagtccccactgcctaggatctccactttttag

SEQ ID NO: 208055 - DNA, 1443 bp, Artificial Sequence
  Description of Artificial Sequence: Synthetic coding sequence
atgctgctgtgcaccgcccggctggtgggcctgcagctgctgatcagctgttgctgggcgtttgcttgccactcgacggaatcgtctcccgacttcactctccctggcgactatctactggccggtctattcccactccatagcggttgtctccaggtccgccaccgtcccgaggttacgctgtgtgacagaagttgcagctttaatgagcatgggtatcacctgtttcaagccatgcgcctcggtgtggaagaaatcaacaactccactgctctccttcctaacattaccctaggctatcaactctacgatgtgtgctctgactccgcaaacgtgtatgcaaccttgcgagtattaagcctgccaggccaacatcacattgagctgcagggcgacctactgcactatagcccgactgtgctcgccgtgatcggcccggacagcacaaaccgggccgccactactgccgctttactcagtcccttccttgttcccatgatctcctacgctgccagcagcgagaccctgagcgtgaagcgccagtatccttcattcctgaggacaatccctaatgataagtatcaggtcgaaactatggtgctactattgcaaaaatttggatggacgtggatttcactggtcggctcatctgatgactatggacaattaggggttcaggccctggaaaaccaggccacaggacaggggatctgtatagcttttaaggacatcatgccgttcagcgcccaggttggagacgaacgaatgcagtgcctcatgaggcatctggcccaggcaggagcaacagttgttgtggtgttctcctctaggcagctggcgcgggttttctttgaaagcgtcgttctaaccaacctaactggaaaggtatgggtcgcgtccgaagcctgggctctttctcgccatattaccggggtcccagggatccagcggatcgggatggttctaggggttgcgattcagaagagggctgttcccggtctgaaggccttcgaggaggcatatgctagagcagataagaaggctccccgcccatgccacaagggaagctggtgcagtagtaatcagttgtgtagggaatgtcaggcgttcatggctcataccatgccgaagctaaaggctttcagtatgagtagcgcgtataacgcttacagagccgtgtatgctgtggcgcatgggctccaccagcttctcggctgtgcttccggggcctgcagcagaggtcgcgtttatccatggcagacgtctacagacgcttccttagttgggaagaagagcgggcacctgagggaggcacggcccgcatcgcgcgccttatggtgtttttggctgtgcgtgtctactcctttaggttgctgctggcagctgacaagatgttgctgttgttgctgccttggtctgcttgcctgcctgcctggcacctag

SEQ ID NO: 208056 - DNA, 2526 bp, Artificial Sequence
  Description of Artificial Sequence: Synthetic coding sequence
atgctgctgtgcaccgcccggctggtgggcctgcagctgctgatctcatgctgttgggcttttgcatgccattccacggagtctagccccgacttcaccctccctggcgattacctgcttgccggcctgtttcctctccactctgggtgtttgcaggtgcgacacaggccagaggtgactttatgtgacagatcctgtagcttcaatgagcatggttatcacctgtttcaggccatgcggctgggcgtagaggaaatcaataattccaccgccttgctccccaatataaccttgggttatcagttatatgatgtctgcagcgactccgcgaatgtctacgctaccctaagagtgctgagccttccaggacagcaccatattgaactgcagggcgatttgcttcactattccccgacagtgctcgcagtgatcgggcctgactccactaatcgtgctgccactacagccgcactcttgagccccttcctggtgcccatgataagttacgctgctagttctgagaccctcagcgtgaagcgacagtacccgtcatttcttcggaccatccctaacgataagtatcaagtggaaacgatggtgcttctgctgcagaaatttggttggacgtggatttctttggttggatcatccgacgactatggtcaacttggggttcaggccctggagaaccaagcaacaggacaaggcatctgcattgcattcaaggatattatgccattttcagcccaagttggggatgaacgtatgcagtgtttgatgcgacatcttgcccaagcgggcgcgacagtggtggtagtgtttagctcacggcagctggccagagtttttttcgaatcagtggtgctcaccaatctcaccgggaaggtctgggtcgcctccgaggcttgggccttaagccgtcacattaccggggtgcctggcattcagcgcatcggaatggtcttgggcgtggcgattcagaagagggcggtaccgggccttaaagccttcgaggaggcgtatgcccgtgctgacaagaaggctcctaggccctgccacaaagggagctggtgcagctctaatcaactttgcagagagtgtcaggcatttatggcccacaccatgcccaagctaaaggcattctctatgtcgtccgcttacaatgcttatagggccgtctatgcagtagctcacggcctacaccaactgcttgggtgtgcttccggcgcatgcagtcgcggcagagtgtatccctggcagctcctggaacagatccacaaggtgcactttttgttgcataaggataccgtcgccttcaacgacaaccgggaccctctttctagctataatatcattgcttgggattggaacggaccaaagtggacgtttacagtcttggggtcctctacctggtcacccgtgcaactcaatattaatgagaccaagattcagtggcacggaaaagataaccaagtccctaagtcagtatgttccagcgactgcctcgagggacaccagagagttgttacgggattccatcattgctgctttgaatgtgtaccttgtggagccggcacattcctcaacaagagtgatctctatcggtgtcagccctgcggtaaggaggagtgggctccagagggctcccaaacatgtttcccacgaactgtcgtgttccttgccctgagggagcacacctcgtgggtgttgctcgctgcgaatactttgcttcttcttctgcttcttggcactgccggtctattcgcctggcatctggacacaccggtggtaagatcggccggagggcgcttgtgttttcttatgcttggctcccttgccgcaggctccggatctctgtacggcttctttggcgagccaacccgccccgcgtgtcttttgcgccaagctctcttcgcgctgggcttcacaatcttcctttcatgcttgacagtaaggtctttccagctgattataatatttaagttttcaactaaagtccccactttctaccacgcatgggttcagaatcacggcgctgggctgttcgtgatgatttcgagcgccgcccaacttctaatctgcctcacatggctcgttgtgtggacgcctttaccagcccgtgaatatcagcggttccctcacctggtcatgcttgaatgtaccgagaccaatagtctgggcttcatactggccttcctctacaatggattgttgtctatctccgcttttgcatgtagctatctgggaaaggacttgcctgaaaactataatgaagctaagtgcgtgaccttctcccttttgtttaacttcgtatcatggatagctttcttcaccaccgcaagcgtgtatgacggtaagtatctgccggcagcaaatatgatggcagggctgtccagcctcagctccggattcggggggtactttttgcccaaatgttatgtcatcctgtgccgccccgacctcaatagcaccgagcacttccaggcttctatccaggactatactaggcgttgcggttctacatag

SEQ ID NO: 208057 - DNA, 1764 bp, Artificial Sequence
  Description of Artificial Sequence: Synthetic coding sequence
atgctgctgtgcaccgcccggctggtgggcctgcagctgctgatctcgtgctgttgggctttcgcatgtcactctaccgagagctctcctgatttcacattgcctggtgactacctgctcgccggactgttcccccttcactctggatgccttcaggtgcgtcaccgcccggaagtgacactgtgcgatcggtcatgctcttttaatgaacacggctatcatctgtttcaggctatgcgccttggggtcgaggagatcaacaacagtactgccttgctgcctaacatcacactgggatatcagctctacgatgtgtgcagtgactcagctaacgtgtacgccactctccgcgtattgtccctgcctggacaacaccacattgaactacagggcgatttactgcattattcaccaaccgtgctcgcagttataggaccggattccacaaatcgcgccgcaacaaccgccgccctgttgagtccttttctggttccaatgctgttagaacagattcataaagtgcattttttattgcacaaagatactgtcgcatttaatgacaatagggacccgctatcctcgtacaatataatcgcttgggattggaacggacctaaatggacctttactgtgctggggtccagtacgtggagccctgtgcagctgaatataaacgaaacaaagattcagtggcacgggaaggataatcaggttcccaaatccgtgtgctcctctgattgcctggaaggccatcagcgggtggtgacaggatttcaccattgctgcttcgagtgcgtgccctgcggagcgggcaccttcctgaataagtcggacctgtaccggtgtcagccatgtgggaaagaggagtgggcaccagagggttcccaaacatgcttccctaggaccgtggttttcctggcacttcgggagcatacctcatgggtactgcttgcagccaataccttgctactcttgcttctcctcggtacagccggactcttcgcttggcacctggataccccagtcgtgcgttctgccggcggaagattgtgtttcctcatgctggggagcctcgcagcaggatctggttcactctacgggttcttcggtgagcccaccagacccgcctgtctgctcagacaggccctgtttgccctaggatttacaatctttctgagctgccttacggtgagatcctttcagttaatcattatctttaagttctcaaccaaagtaccgacgttttaccacgcttgggtccagaaccatggggccggactctttgttatgattagcagtgcagcccagctcctgatctgcctgacctggcttgtagtctggacgcctctccccgctagagaataccaaaggttccctcacctagtaatgctggagtgtactgaaaccaattcgctcggcttcatattggcatttctttataatggcctgctctcgatttcagcattcgcatgctcctaccttgggaaggatctgcccgagaactataacgaggcaaagtgcgtgactttctccctgctgttcaactttgttagctggatagccttcttcacgactgcatctgtgtacgatggcaagtacctcccggctgcaaatatgatggccggactgtcatctctttcaagcggcttcggcggttactttctgcccaaatgttacgtgatcctgtgcaggcccgacttgaattctacggagcacttccaagcaagcatccaggactacaccagaaggtgcggttccacgtag

SEQ ID NO: 208058 - DNA, 921 bp, Artificial Sequence
  Description of Artificial Sequence: Synthetic coding sequence
atgcggctgggcgtggaggagatcaacaacagcaccgccctgctgcctaatattactcttggctatcagctctacgatgtgtgtagtgattccgcgaacgtatacgccaccctgagggtgttgagtctgccgggtcagcaccatatcgaactgcagggagatttgctgcactattctcccacagtgctggcggtgatcggaccagacagcactaatagagcggctaccaccgcagctctgctctctccctttctcgtgcccatgctgctggaacaaattcacaaggttcactttcttctgcataaggacactgtagcattcaacgacaatagagacccgctgagcagttataatataatcgcatgggactggaacggacctaagtggacatttaccgtgttgggctcttctacctggtcacccgtacaattaaatatcaacgaaactaaaatacagtggcacgggaaggataaccaggtccctaagtcagtctgcagctccgactgcctggaaggacaccaacgcgtggtcacaggatttcaccactgctgctttgagtgcgtgccctgtggagccggcacatttttgaataaaagcgatctgtacagatgtcagccgtgtggcaaagaagagtgggcacccgaggggtcccagacctgcttcccacgaactgttgtttttctcgccctgagagaacacacgagctgggtgttgttggctgctaacacgttgttgctgctgctacttctggggacagctggattgttcgcatggcatctcgacactcctgtagtccgttccgctgggggtagattatgcttcttgatgcttggcagtctggccgcggggagtggctcgctgtacgggttttttggggagccctctctcccactggtgtcccccagcagctgtcctgcttag

SEQ ID NO: 208059 - DNA, 2520 bp, Artificial Sequence
  Description of Artificial Sequence: Synthetic coding sequence
atgggcccccgggccaagaccatcagcagcctgttcttcctgctgtgggttcttgcagaaccagcggaaaactcggacttctatctccccggggactatctgctgggaggcctcttcagcctccacgctaatatgaaaggaattgtgcatttgaattttttgcaggtgcccatgtgcaaggagtatgaggtgaaagtgatcgggtacaatctgatgcaagccatgcgctttgctgtggaggaaattaataatgattcttcgttgctaccaggcgtgctcctggggtacgagattgtggacgtctgctatatcagtaacaacgtgcagccggttctgtacttcctcgctcacgaggacaatttattgccaatccaggaagactacagcaactatatctctcgagttgtggctgtaataggacctgataactccgagagcgtcatgacagtggccaattttctgtcactctttcttttgcctcagatcacctatagtgcaatatccgacgagctgcgggacaaagtgcgttttccagctttacttcggacaactccttctgctgaccatcatatcgaagccatggttcagctgatgcttcattttaggtggaactggattattgtactggttagctccgacacatacggaagggataacgggcagctcctgggcgagcgcgtagcaagaagagacatctgtattgcctttcaggagacccttcctacgctgcaaccaaaccagaacatgactagcgaggaacggcagcggttggtgacaatcgtggataagctccagcagtccaccgctagggtggtagtcgtgttttcgccagaccttactctgtaccacttttttaacgaggtactccggcagaacttcactggcgccgtttggatcgcttctgaatcttgggccattgatcccgtacttcacaacctgactgaacttaggcacttagggacatttctcggcatcacgattcagtccgtgccgattcctggcttctctgaattccgggagtgggggcctcaggccggccctcctcccctatctcgcacctcacaaagctacacatgtaatcaggagtgtgacaattgcctgaacgctacattgtcctttaataccattttaaggctgtccggggaacgtgtggtgtacagcgtttacagcgccgtatacgcggtggcccacgccctccattctctcctagggtgcgacaagagtacttgcactaagcgcgtggtttacccatggcagttgttggaagaaatttggaaagttaatttcacactgctagaccaccaaatctttttcgatccgcagggtgacgttgccctccacctcgagattgtgcagtggcagtgggaccggtcccaaaatccattccagagtgtcgctagttactatcctctgcagaggcagctgaaaaatatacaggatatctcatggcacacaatcaataatacaatccctatgagcatgtgttcaaagaggtgccagtctggacagaagaaaaaacctgtcgggattcacgtgtgttgcttcgagtgcatcgattgcctgcctggtacgttcctgaaccacactgaagacgaatacgaatgccaggcctgtcctaataacgagtggagctaccagagtgaaacctcatgttttaaacgccagctggtgttcctcgaatggcatgaggctcccaccatcgcggtagctctgttagcagccttaggattcctgagcactctcgccatcctggtcatcttttggaggcactttcagactccaattgtgaggtccgccggcggacccatgtgtttcctgatgcttacactcttattggtggcatacatggtggtgccggtctatgttggaccccccaaagtgagcacctgcctttgcaggcaggctctttttccactgtgcttcactatctgcatctcatgtattgcagtgaggtcattccaaattgtctgtgccttcaagatggctagtcggtttccccgggcatactcctattgggtgcgataccagggtccctacgtgagcatggcattcatcacagtgttaaaaatggtgattgtggtgattggcatgcttgctacggggctgagtcctaccactcgaaccgacccggacgaccccaagatcacaatcgtcagttgtaatcccaattaccgaaacagcctgctgtttaacacatccctggacctgcttctctcggtggtggggttttcatttgcctacatgggaaaggagcttcctactaactataacgaagctaaattcattacactatctatgaccttttacttcacatcttccgtgtccctatgcacattcatgtccgcctattccggcgtgcttgtgaccattgtcgacctgctggttacagtgctgaatcttctggcaataagcctgggttattttgggccgaagtgctacatgatactgttttatcctgagcgcaacacacctgcgtacttcaacagcatgatccagggatataccatgaggcgggactag

SEQ ID NO: 208060 - DNA, 2559 bp, Artificial Sequence
  Description of Artificial Sequence: Synthetic coding sequence
atgctgggccccgccgtgctgggcctgagcctgtgggccctgctgcatcccgggacaggagcacctctgtgtctgtcacagcagctgcggatgaagggtgattatgtcttgggggggctgttccctctcggcgaagctgaagaggccggcctgagatctaggactcgccccagtagccctgtatgcactcggttctctagtaatggcctgctgtgggcactcgcaatgaaaatggccgtcgaagaaattaataacaaatccgatctactcccagggctcaggctcggatatgatctgtttgatacctgtagcgagccggtggtggccatgaagcctagccttatgtttctggcaaaagccgggagccgggacattgcagcttattgcaattatacccaatatcagcccagggtcctcgccgtgatcggcccccactcaagcgaactggccatggtgactggaaaattcttttctttttttctaatgcctcaggtttcttacggggcctccatggagcttctgagcgccagggaaacctttcctagctttttccggaccgtgccctccgatagggtgcaactcaccgctgctgccgagcttctccaggaattcggctggaactgggtagcggctctcggaagcgatgatgagtatggccgacaggggctgagcatcttctcggctctcgctgcagccaggggcatctgcatcgcgcatgaaggactggtccctctgcctagagccgacgactcccgacttggcaaggttcaagacgtgctccatcaggtcaaccaatcttcagtgcaagtcgtgctcctcttcgcttctgtccacgccgcccacgccctgttcaattactccatttctagccgtctgtcccccaaagtctgggtggcctccgaagcttggctcacaagtgacctggtcatggggctgccagggatggcacagatgggaaccgtcttaggatttctgcagagaggagcccagcttcacgagttccctcagtacgttaagacccacctcgccctggcaactgaccccgctttttgctcggctctgggagaacgggaacagggactcgaagaggacgtcgtcgggcaacgctgccctcagtgtgattgcattaccttacaaaacgtgagtgcggggctgaaccaccatcaaactttttctgtctatgcagctgtttattccgtggcccaggcgctccacaacactcttcagtgcaacgcctctggttgccctgcgcaagaccccgtgaaaccgtggcagctgcttgaaaacatgtacaatctgacttttcacgttggggggctgcccctcagatttgactcctctggcaacgtcgacatggagtatgacctgaagctgtgggtgtggcagggatctgtaccccgcttgcacgatgtcgggagatttaatggatcactgagaacagaacgcctgaagatcaggtggcacacatcggataatcaaaagcccgtctctcggtgcagccgtcagtgtcaggaagggcaggtgcggcgagtaaagggatttcatagctgttgttatgactgcgtagattgcgaagctgggagttatcgccaaaatccagacgacattgcctgcaccttctgtggccaggacgagtggtccccagagaggtctacccgatgtttcaggaggagatcaaggtttctcgcctggggggaaccagctgttcttctgttactgctgctgttgtctttggccctcgggctggtactcgctgccttgggattgttcgtccaccatcgcgatagccccttggtacaggcctccgggggccctctcgcttgcttcggcctagtgtgcctggggctcgtttgcctgagcgtgctgctctttcctggacagccttcccccgctcggtgtctggctcagcagcccctctctcatctccctctgactgggtgcctttcaaccctcttcctacaggctgcagagatcttcgttgagtcggagctgcctctctcttgggctgataggctaagcggctgcctccgcggaccctgggcctggctagtggttttacttgcaatgcttgtggaggtagctctttgcacctggtatcttgtggctttccctccagaggtcgtgactgattggcatatgctcccaactgaggcgctggtccattgccgaaccagatcatgggtttctttcggacttgctcatgctaccaatgctacattggcattcttgtgttttctgggcacctttctcgtcagatctcagcctggctgttacaatcgtgcccggggcctgaccttcgccatgctcgcttattttatcacatgggtgtctttcgtacccctactagcaaacgtgcaagtggtgctccggccggccgtacagatgggagccctgctgctgtgtgttctcggcatcctggccgcctttcacctgccaaggtgctacctactaatgagacaaccagggttgaatacacccgagttctttttggggggtgggccaggtgacgctcagggtcagaacgacggcaatactggaaaccagggaaaacatgaatag

SEQ ID NO: 208061 - DNA, 876 bp, Artificial Sequence
  Description of Artificial Sequence: Synthetic coding sequence
atgatccccatccagctgaccgtgttcttcatgatcatctacgtgctcgagagcctcacgatcattgtgcagtcctctcttatcgtcgctgtgctgggacgggaatggctacaggtgaggcggctgatgcccgttgacatgattctgatctcactaggcataagccgcttctgtctacagtgggcttccatgttgaataatttctgctcgtacttcaacctgaactatgtgctgtgcaacctgacgatcacatgggagttttttaatattctgaccttctggttaaactccctgctaactgtgttctactgcatcaaggtatcatcgttcacccatcacatttttttgtggttgcgctggagaatacttagactattcccctggatactgttaggctctttgatgataacttgcgtcacaatcattcctagtgcaataggcaactacatccaaattcagctgctgaccatggagcacctgccccggaattctacagttacagataaacttgagaacttccatcagtatcaatttcaggctcacaccgttgctctcgtcattccgtttatcctctttttggcatctactatttttttaatggccagcctcactaagcagattcagcaccacagtacaggacattgtaacccttcaatgaaggcccgctttaccgctttgcggtctctggctgtgcttttcattgtgttcacttcatattttctcacaatcctgatcaccattatagggacacttttcgacaagagatgctggttgtgggtctgggaggccttcgtctatgctttcatcttgatgcactccacctccctaatgctgtccagcccaaccctgaagcgcatacttaaagggaaatgttag

SEQ ID NO: 208062 - DNA, 900 bp, Artificial Sequence
  Description of Artificial Sequence: Synthetic coding sequence
atgatgtgcttcctgctgatcatcagcagcatcctggtggtgttcgctttcgtcctcggtaacgtggccaacggcttcattgctctggtcaacgtaattgattgggtgaatacccggaagatctcctccgccgaacaaatcttgactgctctcgtggtctctagaatcgggcttctctgggtcatgttgtttctgtggtacgccaccgtgtttaactccgctctgtacggcctcgaagtcaggatcgtggccagcaacgcttgggcagtcactaatcactttagcatgtggctcgctgcctccctgagcattttctgtttacttaagatcgctaacttctctaaccttataagcctgcacttgaagaagagaataaagagcgtggttctcgtgattctgctggggccactggtatttttgatatgtaatctggcggtcatcacaatggacgaacgggtctggaccaaggaatacgaaggaaacgtgacgtggaagataaaactccggaatgccattcacctgtcctccttaaccgtgactaccttggcaaacctcatcccattcacactgagcctcatctgcttcctgttactcatctgtagtctgtgtaaacatttaaagaaaatgcgattacacagcaaagggtctcaggacccaagcacaaaagtgcatataaaggctctccagaccgtgactagcttcctgatgttgttcgctatctattttctctgcattataacttccacttggaatctgagaacacagcagagcaagttggtgctcctgctgtgtcagactgtggcgatcatgtatccgtcgtttcactcttttatattaatcatggggagccgaaagctcaaacagactttcctgtctgtattgtggcagatgacccgctag

SEQ ID NO: 208063 - DNA, 930 bp, Artificial Sequence
  Description of Artificial Sequence: Synthetic coding sequence
atgatgagcttcctgcacatcgtgttcagcatcctggtggtggtggcatttattctagggaatttcgctaatggattcatcgccctgattaattttatcgcatgggtcaaacggcagaaaataagcagtgcggaccagatcattgccgccttagccgtgagccgcgttggacttttgtgggtgatcctgctccactggtactctacagtcctcaatccaacctcatctaacctgaaagtcataatttttataagtaacgcctgggctgtgactaaccattttagtatctggctggctacaagtctttccattttttatctgttaaagattgtgaacttcagccgtctgattttccaccatctcaaacgcaaggcaaaaagcgtggtgttggtaattgtgctgggaagcctcttcttcctggtctgccacctagtgatgaagcacacatacattaatgtgtggacggaagagtgcgagggaaacgttacctggaagatcaaactgcgaaatgctatgcacctaagcaatctcacggtggctatgcttgctaacctcatcccctttaccctgaccttaatctcattcctgcttctgatctacagcctctgcaagcatttgaagaagatgcagctccatggcaaaggtagccaggatcccagtactaagattcacatcaaagcactgcagacggtgaccagctttctgatccttctggctatttacttcttgtgtctcataatctcattttggaatttcaaaatgagacctaaggaaattgtgctgatgctctgccaagcatttggtatcatttacccctccttccacagtttcatattgatttggggcaacaagaccctgaagcagacttttctttccgtgctttggcaggtgacctgttgggccaagggacagaatcaatcaacaccatag

SEQ ID NO: 208064 - DNA, 951 bp, Artificial Sequence
  Description of Artificial Sequence: Synthetic coding sequence
atgatgggcctgaccgagggcgtgttcctgatcctgagcggcacccagtttactttgggcattttggtgaactgttttatcgagctagtgaacggcagctcttggtttaagactaagcgcatgagcctctccgactttattattacaactctggcccttctgcgtattattctgctatgcatcatcttgacagatagttttctgatagaattcagccccaacacacacgactctggcatcatcatgcagattatcgacgtttcgtggacattcaccaatcatttaagtatctggcttgctacatgcctgggagtgctctactgccttaaaattgcgtcattcagtcatcctacattcctctggctgaaatggcgggtttctagggttatggtatggatgctgctgggagctttgctgttgtcttgcggatccacggcctccctgataaacgaatttaaactatactccgtctttagaggcattgaagccacaagaaacgtgacggagcatttcagaaaaaagcggagcgagtattatttaattcatgtgctgggaacactgtggtacctgcctcctttgattgtcagcctggctagctattcactgttaattttcagcttagggcggcatacacgccaaatgctgcagaacgggacatcttcgcgggacccaaccaccgaggcacacaagagggcaattaggattattctaagcttttttttcctgtttttgctgtatttcttagctttcctgatcgccagctttggcaatttcttgcctaagactaagatggccaagatgataggggaagtgatgactatgttctacccggccggccattcgttcattctgatcctggggaactcaaagctgaagcagactttcgtggtgatgttgcggtgcgagagtggccacctcaaacctgggagtaagggaccaattttctcttag

SEQ ID NO: 208065 - DNA, 960 bp, Artificial Sequence
  Description of Artificial Sequence: Synthetic coding sequence
atgatcaccttcctgcccatcatcttcagcatcctgatcgtggtgatatttgtcatcggcaatttcgccaatggcttcatcgcgctggttaactcaatcgaatgggtgaagaggcagaaaatttccttcgtggatcagatacttaccgctctcgccgtgagcagggttggactcctgtgggtgctgctcctccattggtatgccactcaactgaatcccgccttttacagcgtcgaggtacgaatcacggcctacaacgtgtgggcggtgaccaaccattttagctcttggctggctacgtccttgagcatgttctacctgctgagaatcgccaactttagcaatctcatattcctacgaatcaagcgtcgcgtgaagagcgtggtactcgtaatcctgctcggaccactgctatttctggtgtgccacctgtttgtgatcaatatggatgaaactgtttggactaaggaatacgaggggaacgtgacctggaaaatcaaattacgaagtgctatgtatcattccaacatgactcttacaatgcttgccaacttcgtccctctgacgctcacgcttatctccttcctgttgctaatctgcagtctctgtaaacacctgaaaaagatgcagctgcatggcaagggaagccaagacccttctacaaaggtacacattaaggctcttcagactgttaccagctttctgcttttgtgcgctatctactttctgagcatgataatctccgtctgcaatttcggaagacttgaaaaacaacctgtcttcatgttttgccaagcaatcatcttcagctacccatccacacatccttttatcctcattctcggcaacaagaagctgaaacagatctttctgtctgtcttacgtcatgtccggtattgggtcaaagatagaagcctcagactacatcgattcacaagaggcgctctgtgtgtgttttag

SEQ ID NO: 208066 - DNA, 930 bp, Artificial Sequence
  Description of Artificial Sequence: Synthetic coding sequence
atgaccaccttcatccccatcatcttcagcagcgtggtggtggtgctatttgtgatcggcaattttgcaaacggatttatcgccctggttaattccattgaaagggttaagagacagaaaatctcttttgcagaccagattttgaccgccctagctgtgtctagggtaggactgctgtgggtgctgctgttgaactggtactccactgtttttaatcccgccttctacagtgtggaagtgagaactacggcttacaatgtgtgggcggtgactggccacttctccaattggctcgccacttccctttccatcttttaccttctgaaaatagctaacttctctaatctcattttcctccacctcaaaagaagagtgaaatcggtcattctcgtaatgctcctcggaccattgctgttcctggcgtgtcagttattcgtgatcaatatgaaggagatcgtgcgcaccaaggaatatgaaggaaacctgacatggaaaattaagctgagatctgccgtctacttgagcgatgcaaccgtgactactctcgggaatcttgtcccatttactttgactctattatgcttcctgttgctgatttgtagcctttgtaagcatcttaaaaaaatgcagctccacggaaaaggaagtcaggatccctcaaccaaagttcatattaaggcacttcagaccgtgatcttttttctccttctttgtgctgtgtactttttgtcgattatgatcagcgtgtggagttttgggtcattagaaaataagcctgtcttcatgttctgcaaggccatacggttctcctatcctagcatccatcccttcattttgatatggggcaataaaaagttgaaacagacctttctgtctgtgctacggcaggttaggtattgggtgaagggtgaaaagccgtccagtccctag

SEQ ID NO: 208067 - DNA, 1002 bp, Artificial Sequence
  Description of Artificial Sequence: Synthetic coding sequence
atgctgaccctgacccggatccggaccgtgagctacgaggtgcggagcacattcctttttatctccgttctggaatttgcagttggcttcctgacaaacgcgtttgtgtttcttgtcaacttttgggatgtcgtgaagcgccaggctctctcaaactccgactgcgtgctactttgcctcagtatttctcgtctctttctccacggcctgctgttcctctctgctatccagctgactcactttcaaaaactgagcgaacccctgaatcattcataccaggccattattatgctctggatgattgccaaccaggctaatctgtggttggccgcgtgtctatccttgctgtactgtagcaagctcatcagattttctcacacgtttcttatttgcttggcctcatgggtgtcccggaagattagccagatgctgcttgggattatcctctgctcttgtatatgtactgtcctttgtgtttggtgttttttctctcgtccccactttacggtgacgaccgtcctgtttatgaacaataatactaggctgaactggcagataaaggacctgaacctcttctactcgtttttgttctgttatctttggagcgttccccctttccttctcttcctggttagttccgggatgctgacagtgtctctgggacgccatatgagaacaatgaaggtatacacacgaaacagcagggatccatcactggaggcgcacatcaaggcactcaaatcactggttagctttttctgcttcttcgttatttcctcatgcgctgctttcatcagtgtccctcttctcatcctgtggagagataagattggagtaatggtctgcgtgggcataatggccgcctgtcctagtgggcacgccgcaattctcatctcagggaacgctaaactgaggcgagcagttatgacaatccttctttgggcccagtccagtctaaaggtgagggccgaccacaaggctgatagtcggaccttatgctag

SEQ ID NO: 208068 - DNA, 900 bp, Artificial Sequence
  Description of Artificial Sequence: Synthetic coding sequence
atgctgcggctgttctacttcagcgccatcatcgccagcgtgatcctaaattttgtcgggatcattatgaacctgttcatcacagtggtgaactgtaagacatgggtaaaaagtcacagaatcagctcatccgaccgcattctgttcagtctagggattactaggttcctcatgctggggctgttcctggtgaataccatttattttgtctcttccaacaccgagcgctccgtgtatctatctgccttttttgtgctttgtttcatgttcctggacagctcttctgtgtggtttgtgaccctgctcaatattctgtactgcgtcaagataaccaacttccagcattcagtgttcctgctactgaaaaggaacattagtccgaagattccaaggcttctgctggcctgcgtgctgatatccgcatttaccacttgcctgtacataacgctcagccaggcgtccccttttcccgaacttgtgacgactcgaaacaacacctcatttaacatctcggagggtattttgagcctggtggtaagtctcgttttgtcctcttcactacaattcataatcaacgtaacatccgcaagcctactgatccacagcctgagacgccatatccagaaaatgcagaagaatgccaccggtttctggaatccacagactgaggctcacgtaggcgccatgaaactgatggtttactttcttattctctacataccgtatagtgtagctactcttgtgcagtacctgccgttttacgctggaatggatatgggtaccaaatcaatctgtcttatcttcgctaccctatactcaccaggccatagcgtgctcattataatcactcatcccaaactcaagaccacagcaaagaagatcctatgtttcaagaaatag

SEQ ID NO: 208069 - DNA, 972 bp, Artificial Sequence
  Description of Artificial Sequence: Synthetic coding sequence
atggccaccgtgaacaccgacgccaccgacaaggacatcagcaagttcaaggtgaccttcacgctggtggtttcaggaatagagtgcatcacaggaatcttagggtcaggctttattacagcaatctatggagccgagtgggctcgcggcaaaaccctacccacgggcgaccggatcatgctcatgcttagcttctcacgactgctcctccagatatggatgatgttggagaacattttcagtcttctgttccgcattgtatacaaccaaaatagtgtttacatactttttaaagtcataaccgtcttccttaaccattcaaacttatggtttgccgcttggctgaaggtattttactgtctcaggatcgcaaatttcaaccaccccttgttcttcctgatgaaacggaagattatcgtcctgatgccgtggctgctcaggctctccgtcctggtatctcttagtttctcttttcccctgagccgggacgtgtttaatgtatacgttaactcctccatcccgattccatcctctaactctacggaaaaaaagtacttttcagaaacaaacatggtgaatctagtgtttttctacaacatgggcatcttcgtccctctgattatgttcattctggcggccactctgcttatcctgtcgttgaaaagacatacactgcatatgggctccaatgctactggctcaagggacccgagtatgaaggctcatattggggccataaaagctacgagctattttctcatactttatattttcaacgctatagccttatttctctcgacctcaaacatcttcgacacctattcaagttggaatattctctgtaaaattattatggcagcctacccggcgggccattcggtccagttgatactcggcaacccgggactgcgccgagcttggaaacggtttcagcaccaggtgccattgtatctcaaaggccagacactgtag

SEQ ID NO: 208070 - DNA, 924 bp, Artificial Sequence
  Description of Artificial Sequence: Synthetic coding sequence
atgcaggccgccctgaccgccttcttcgtgctgctgttcagcctgctgtctctgctgggaatcgcagcgaacgggttcatcgtacttgtgctcggtagagagtggcttcgttatgggcggctgttgccactagatatgattctgatttcactgggggccagtcgtttctgtcttcagcttgtcggaacagtgcataatttctattacagcgcccagaaggtcgagtatagcggtggacttggccgccagttctttcacctgcactggcacttcctcaatagcgcgactttctggttttgctcttggctatcagttctattctgtgtgaagatcgccaatatcacacacagtaccttcctttggctcaaatggagatttccaggatgggtcccatggctgttgttgggttccgtactaatatcttttattattacactgctctttttttgggtcaattatccggtgtatcaagaattcctgatcagaaaattctcggggaacatgacctacaaatggaatacccgaatcgaaacttattactttccttctctcaagctggtgatttggagtatcccattctcagtgttcctggtaagcataatgctgctgatcaattctctgcggcggcatactcagagaatgcaacacaatggtcactctctgcaggatcctagcacgcaggcacacacacgagcgctgaagtctctgatctccttcctgattttgtatgcactttctttcctgagcctaataatcgatgccgctaagtttattagtatgcagaacgatttttactggccgtggcaaatcgccgtgtatctgtgtatcagtgtgcacccctttattctgatctttagcaatctgaagttacgatctgtgttcagtcagctcctgcttcttgcacgcggtttctgggtagcctag

SEQ ID NO: 208071 - DNA, 945 bp, Artificial Sequence
  Description of Artificial Sequence: Synthetic coding sequence
atggccaccgagctggacaagatcttcctgatcctggccatcgccgagtttatcattagtatgttaggcaatgtcttcattggactggtgaactgttccgagggcattaagaaccagaaagtcttctccgctgatttcattcttacttgcctggcaatctcaacgatcggccaactgttagtgatcctgtttgactcttttctcgttggtctggcctctcacctgtacaccacgtataggctgggcaagactgtgatcatgctttggcacatgaccaaccacttaactacttggcttgcgacatgcctgtccatcttttatttctttaaaattgcccatttcccacactcactgttcttatggttgcgctggcggatgaacggcatgattgtgatgctcctcatcctgtcactttttctgctgattttcgactccttagtgttggagatcttcatcgatattagtctgaacattatagacaagtctaatcttactctttacctcgacgagtcaaaaacattgtatgataaactcagcatcctcaagacgctactctctttgactagctttatccccttcagcctttttctgacaagtctcttattccttttcctatcattagtgagacacacacggaatttgaagctaagttcacttggatctcgggatagttctaccgaagcgcacagacgggccatgaagatggttatgtcgttcctatttctcttcatcgtgcacttcttttctctgcaagtggctaacggaattttttttatgctgtggaacaataaatacatcaaatttgtgatgttggctctgaacgctttccccagttgtcactccttcattcttattcttggcaactctaaactaaggcagactgcagttcgtctgctgtggcatctgcgaaattacacaaaaacccctaacgccctgcccctatag

SEQ ID NO: 208072 - DNA, 930 bp, Artificial Sequence
  Description of Artificial Sequence: Synthetic coding sequence
atgatcaccttcctgcccatcatcttcagcagcctggtggtggtgaccttcgtcattggcaactttgccaatggatttatcgctcttgttaatagtattgaatggtttaaaaggcagaaaatctctttcgctgaccagatcttgaccgccctggccgtttcccgggtggggctactgtgggtgctcttattgaactggtactcaacagtacttaatccagctttcaattcggtggaagtgcggacaactgcctacaatatctgggccgtgattaatcatttttctaactggcttgccacgaccctgagcatcttctacctactgaaaatcgctaacttctcaaattttatctttctccatctcaagaggcgtgtgaagtctgtaatcttagtgatgctcctaggcccccttctttttttggcatgccacttgttcgttattaacatgaacgaaatcgtcaggactaaggagttcgaggggaacatgacgtggaaaatcaagctgaaatcggctatgtactttagcaacatgacagtgaccatggtggccaatctggtcccattcacgctgacccttctcagcttcatgttattgatatgcagcttatgtaagcacctgaagaagatgcagctccatggaaaaggcagccaagatccttcgacaaaggtgcacatcaaggccctccagactgtgataagcttcttactactctgtgctatctacttcttatccattatgatcagcgtgtggagcttcgggtctctggaaaataagccagtttttatgttctgtaaggccatccgcttttcctatccatccatccatccgttcattctgatctggggaaacaagaaactgaagcagacgtttctcagcgttttctggcagatgcggtactgggtcaaaggcgaaaagacctccagcccctag

SEQ ID NO: 208073 - DNA, 930 bp, Artificial Sequence
  Description of Artificial Sequence: Synthetic coding sequence
atgatcaccttcctgcccatcatcttcagcatcctgatcgtggtgacgttcgtgattgggaacttcgctaacggatttattgccctcgtgaattcaatcgaatggtttaagcggcagaagatatccttcgctgatcaaatcttgacagcactcgccgtgtctcgagtcggcctgctgtgggtgttggttttgaactggtacgccacagaactgaacccagcatttaactcaatagaagtcaggatcactgcgtacaacgtgtgggcggtgatcaatcacttcagcaactggctggcaacttctctgtcaatcttctatctgcttaaaatcgcaaattttagcaacctaatcttccttcatctcaagagaagagtcaaaagcgtcgtgctcgtgattttgctggggccactgctctttctggtctgtcatctgtttgtcattaatatgaaccaaatcatctggaccaaggagtacgagggaaacatgacctggaagattaagcttagaagcgctatgtatctgtcaaacaccacggtcactattttagccaaccttgttccttttactctaaccctgatatcctttctgctcctcatatgttcgttgtgtaaacatttaaaaaagatgcagctgcatggcaagggttctcaggatccaagcatgaaagttcacattaaagcgctgcagacagtgacgtcatttttactactttgcgccatatatttcctaagtatcatcatgtcagtctggtctttcgagtccttggagaacaaacctgtatttatgttctgcgaggccatcgcgtttagctacccgtccacccacccctttattctgatatggggtaataaaaaactaaaacagacttttttgtcggtattgtggcacgtccgatattgggtgaagggggaaaaaccgagcagctcttag

SEQ ID NO: 208074 - DNA, 900 bp, Artificial Sequence
  Description of Artificial Sequence: Synthetic coding sequence
atgctgagcgccggcctgggcctgctgatgctggtggccgtggtggagtttttaataggcctgatcggcaacggatctctggtcgtgtggagcttccgagagtggatccgtaagtttaactggagctcttacaatttgatcattctgggcctggccggttgtcgcttcctactgcaatggttaattatacttgacctttccttgttccctctgtttcagtctagtaggtggttgcggtacctttcaatcttttgggtcctcgtatcccaagcttccctgtggttcgcaactttcctctcagtcttttattgcaagaagattaccacatttgataggcctgcatacttatggctcaagcagcgggcctataatctttccctgtggtgcctattgggctatttcatcattaaccttctactcactgtccaaatcggattgacattctaccatcctccacagggaaactcctcgatccggtaccctttcgaaagctggcaatatctgtatgcttttcagctgaattctggctcttatctgccccttgtcgtgtttctcgttagctccggaatgcttatcgtttccttgtatacccaccacaagaaaatgaaggtgcacagtgcaggaaggagagacgtgcgagcaaaggcccacatcaccgccctgaagtctcttggatgcttcctgctcctgcacctggtctacatcatggccagtcccttttcgatcactagtaaaacataccctccggaccttaccagtgtctttatatgggaaacacttatggccgcctatccgtccttacacagtctcatcttaatcatgggcatccctagagttaagcaaacatgtcagaaaatcctgtggaagactgtatgcgccagacgctgttgggggccatag

SEQ ID NO: 208075 - DNA, 900 bp, Artificial Sequence
  Description of Artificial Sequence: Synthetic coding sequence
atgatcaccttcctgtacatcttcttcagcatcctgatcatggtgctgttcgtgctgggtaacttcgctaatggatttattgccctagtcaactttattgactgggtgaagcggaagaaaatctctagcgctgaccagattttgacagcgttggccgtatcccgcatcggcttactgtgggcacttctgctaaactggtacctgaccgtattgaatccagccttctactcagtggagctgcgcattacctcctacaatgcctgggttgttaccaaccacttttctatgtggttagccgccaacctgtctatcttttatcttctgaagatcgctaatttttccaatctccttttcttgcacctgaaaagaagggtccggagcgtgattcttgtgatacttctgggtactctgatctttctggtgtgccatctgcttgtggccaacatggacgaaagcatgtgggcggaggagtacgaggggaatatgaccggcaaaatgaaactccgaaatacagtgcacctgagctatcttacagtgaccacactctggtcattcataccctttacgctctccctaattagttttttgatgttgatctgttcactgtgtaagcaccttaagaagatgcagctacatggcgaaggctcccaggacctaagtaccaaggtgcatatcaaagcgttacagaccctgatctccttcctactgctgtgcgccattttcttcctttttttgatcgtgagcgtttggtctcctcgccggctgcggaacgaccccgttgtaatggtttccaaggctgttggcaatatctaccttgccttcgactcgtttatcctaatctggaggacaaagaaactgaaacacacgttcctcctcattctctgtcagattagatgttag

SEQ ID NO: 208076 - DNA, 957 bp, Artificial Sequence
  Description of Artificial Sequence: Synthetic coding sequence
atgaacggcgaccacatggtgctgggcagcagcgtgaccgacaagaaggctatcatcctggtgaccattcttctgctgcttcgtctggtggcgatagccggcaacggttttattaccgccgccttgggggtggaatgggtgttgaggcgcatgctgttgccatgtgacaagcttctcgtctctcttggggctagcaggttttgtctgcaatccgtcgttatgggcaagacgatctacgtctttctgcatcctatggcttttccttacaacccagtgctgcagttcttggcgttccaatgggattttctgaacgccgccacactttggtccagcacctggttgagcgtattctactgtgtcaagatcgccacgttcacacacccagtcttcttttggcttaagcacaaactgtccggttggctcccctggatgctgttttcctcagtcgggctgtcctctttcacgacaatcctttttttcatcgggaaccaccgcatgtatcagaattacctgcggaaccacctccaaccatggaacgtcaccggagatagtatcagatcatactgtgagaaattttatctgtttcctttgaaaatgatcacttggacaatgcctacggcggtcttctttatctgtatgatactcctgatcacctccctggggcgccaccgaaagaaggccctcttgaccacctccggtttccgcgaaccctccgtgcaggctcatatcaaggcactgctggctctcctttcatttgcgatgctgtttatctcttacttcctgtccctggtttttagtgctgctggtatattccctcccttggattttaaattttgggtttgggagagcgtcatctacctctgcgccgccgtgcatccaatcatccttctgtttagcaactgccgcctgagagctgtgctgaaatcccgcagatcatcaaggtgtggaacaccttag

SEQ ID NO: 208077 - DNA, 1314 bp, Artificial Sequence
  Description of Artificial Sequence: Synthetic coding sequence
atgcccaagttcaaggccgcccggggcgtgggcggccaggagaagcatgcacccctcgccgatcagatcctcgccgggaatgccgtgagggcaggagtgagggaaaaacgtagagggaggggtacaggcgaggctgaagaggagtacgtcgggccccgactgtccagaaggattctccagcaggcccgccagcaacaggaagaactggaggcagagcacggaaccggcgacaaacccgctgctccccgcgaacgcacgactcgcttgggtcccaggatgccccaggacggtagcgatgacgaagatgaagaatggcccactctcgaaaaggctgccactatgaccgctgctggacatcacgcagaggtggttgtcgatccagaagatgaaagggcgatcgagatgttcatgaacaagaatccgcctgctaggcgcacgttagctgacattattatggagaagctgactgaaaagcaaacagaagtggagaccgtgatgtccgaggtttccgggtttcctatgccacagttagacccacgcgtgctggaagtatatcgtggagtgagagaggttttgagcaaatacagaagtggaaaacttcccaaggcgttcaaaatcatccctgcgctttcaaactgggaacagattctgtacgtgactgaacccgaggcctggaccgctgccgccatgtatcaagccaccagaatctttgctagcaatcttaaggagaggatggcgcagagattctacaacctggttctactcccacgggtgcgagacgacgtggcagagtataagcgactgaactttcatctctatatggctttgaagaaagcactgtttaagcccggtgcctggttcaaagggattttgatcccactgtgcgagagtggaacatgtacacttagggaggctataatcgttggatctatcatcacaaagtgcagcattcctgttctacacagcagcgccgctatgctgaagatagccgagatggaatattccggcgccaattccatctttcttcgcttgctgctggataagaaatatgcactcccttatagggtgctagacgccctcgtgttccatttcctgggttttcgaactgaaaagagggagctcccagtgctgtggcatcaatgcctgttaaccctggtgcagcgctataaggcggacctcgctactgatcagaaggaggcactgctggagttattgcgcctgcaaccccacccccaacttagcccagagatccgaagagaacttcagagcgccgtccccagagatgttgaagacgttcccattacagtggagtag

SEQ ID NO: 208078 - DNA, 951 bp, Artificial Sequence
  Description of Artificial Sequence: Synthetic coding sequence
atggaccagaacaacagcctgcccccctacgcccagggcctggcctcaccccagggggccatgacacccggcatccctattttcagccctatgatgccctacggaacaggtctgacaccccagcctattcagaatactaactcactctccatactggaagagcaacagcgccagcaacagcagcagcaacagcagcagcagcagcagcagcagcaggccgtcgccgcagcagccgtgcagcagtctacaagccagcaggccacacagggcacttcagggcaagcaccccagctttttcatagccagactcttaccaccgctcctctgcctgggactactccattatacccctcaccaatgacgcccatgacccccatcactcctgccaccccggcctcagaaagctcaggtatcgtcccccagctgcagaacattgtttcaacggtcaatctgggctgtaagctcgacttgaaaacaatcgctcttagggcacgtaacgccgaatataatcccaaacgctttgctgccgtgattatgcgcattcgtgaaccccgaaccacggctctgatcttttcctcagggaagatggtgtgcaccggggctaagagcgaagaacagtctcggcttgccgcccggaagtatgcacgggtcgtgcagaagctgggcttccctgccaaatttctggattttaaaatccaaaacatggtggggagttgtgatgtaaaattccccatccggctcgaggggttggtgctcacacaccagcagttctcaagctatgagcccgaattgtttcccggactgatttatcgcatgattaaaccccgcatcgtgttgctcatttttgtttctggtaaggtagtgctaaccggtgcaaaagtgagggcggaaatttacgaggccttcgagaacatatatcctatcctcaaagggtttaggaaaaccacttag

SEQ ID NO: 208079 - DNA, 1020 bp, Artificial Sequence
  Description of Artificial Sequence: Synthetic coding sequence
atggaccagaacaacagcctgcccccctacgcccagggcctggccagtcctcagggggctatgacccccgggatcccaattttctctcccatgatgccatacgggaccggacttactcctcaaccgatacagaacacaaactctctgagcatccttgaggagcagcagaggcaacaacagcaacagcaacaacagcagcaacagcagcaacagcagcaacagcagcagcagcaacagcagcagcagcagcagcagcaacagcaacagcagcagcagcaacagcaggcggtggccgccgcagctgtgcagcagtcaacctctcagcaagctacccagggcacgtcgggacaagccccacaactgttccattcacagactcttacgacagcccccttgcccggcactactcccctataccctagtccaatgactcccatgacccccattaccccggccaccccagcctccgaaagtagcggcatcgtgccacagctgcaaaatattgtgtccaccgtgaatctgggttgtaaactcgacttgaagaccatagcacttagagccagaaatgctgaatacaaccctaaaaggttcgctgcagttatcatgcgaattagagaaccacgcactaccgcgctgatattttccagcggcaaaatggtgtgtaccggcgccaaaagtgaggagcaatcgagactggcggcacgaaaatatgcccgcgtggtgcagaagcttgggttcccagcaaaatttcttgattttaaaatccaaaacatggtgggcagctgcgacgtaaagttcccaattcggctggaggggctggtccttactcaccagcaattctcaagttatgagcctgagctgtttcccggacttatttaccggatgatcaaacctcgcatcgtgctgcttatattcgtctctgggaaagttgtactgactggcgccaaggtcagggctgagatatatgaggcattcgaaaatatctaccctatcctgaagggtttccgaaaaacaacttag

SEQ ID NO: 208080 - DNA, 627 bp, Artificial Sequence
  Description of Artificial Sequence: Synthetic coding sequence
atggaccagaacaacagcctgcccccctacgcccagggcctggcctcaccgcagggggcaatgacccccggaattcccatcttcagccccatgatgccctacggtaccgggctcacaccccagcctattcagaacaccaatagcctcagtatcctggaagaacagcagcgacaacagcagcagcagcaacagcagcaacagcagcagcagcagcagcagcaacagcagcagcagcagcagcaacaacaacagcagcagcaacaacagcaacaacagcagcagcaggcagtagcagctgccgctgtgcagcaatctacctctcagcaggccacccagggcacgagcgggcaagctccccagctgttccactctcagactctcaccacagcaccactcccagggacgacacctctgtacccatcaccgatgactccaatgaccccaattacgccagcgacgcccgcatcggaatcctccggtatcgttccacagcttcagaacatcgtgagtactgtgaatctgggctgtaaactcgacctgaagaccattgcactgagggctcgaaatgccgagtataaccctaagaggtttgcggccgtaattatgagaatacgcgagccacgatag

SEQ ID NO: 208081 - DNA, 456 bp, Artificial Sequence
  Description of Artificial Sequence: Synthetic coding sequence
atggaccagaacaacagcctgcccccctacgcccagggcctggcctccccccagggcgcaatgactcccggcatccccattttcagccctatgatgccatatggcaccggacttaccccacagccaatacagaacacaaattcgttgtccattttggaggagcagcagcggcaacagcaacagcagcagcaacagcagcagcaacagcagcaacagcagcagcagcagcagcagcagcagcagcagcagcagcaacaacagcagcaacagcaacagcagcagcaagcagttgccgctgcagctgtgcagcaatcgacttctcagcaggcaacacagggaacctccggacaggcgccacagctgtttcactcacaaacgctcacaaccgcgcctctgccgggcaccaccccattatatccctcgcctatgacccctatgacgccaattaccccatag

SEQ ID NO: 208082 - DNA, 306 bp, Artificial Sequence
  Description of Artificial Sequence: Synthetic coding sequence
tgagaggagcagagccggctggccgcccggaagtacgcccgggtggtgcaaaagctgggcttccccgctaagtttctggattttaagattcaaaacatggttggctcttgcgacgtcaagtttccgatttcctacgaacccgagctgttccccggactgatctacagaatgatcaaaccccggatcgtcctgctaatttttgtcagcggcaaggtggtgctgaccggagccaaagttcgcgcggaaatttacgaggccttcgagaacatttaccctattctcaaggggtttaggaagacgacttag

SEQ ID NO: 208083 - DNA, 960 bp, Artificial Sequence
  Description of Artificial Sequence: Synthetic coding sequence
atgacccccggcatccccatcttcagccccatgatgccctacggcacaggcctcacaccacaacctattcagaacactaattccttgagtatcctggaggagcagcagcgccagcagcagcagcagcagcagcagcaacagcagcagcagcagcagcaacagcagcagcagcagcagcaacaacaacagcagcaacagcagcagcaacagcagcagcagcagcaggcagtcgccgccgccgccgtccagcaaagcacatctcaacaggctacacaaggcactagtggccaagctccccagctcttccactcacaaaccctaacaaccgctcccctgccgggcacaacacccttgtatccgtcaccaatgacgcccatgacccccataacacccgccacaccagcatccgaatccagcggtatagttccccagctgcaaaatatcgtttcaactgtgaatcttggctgcaaactggacctgaaaaccattgctcttcgggcacggaacgccgagtataatcctaaacgatttgctgcagtcattatgcgcattagggaacctagaacaactgctctgatcttcagctctggcaagatggtctgtactggcgcgaaatcagaggagcagtcacgcctggccgcacggaagtatgcgcgggtcgtccagaagctgggattcccagcaaaattcctggattttaaaatacagaacatggttgggtcctgcgacgttaaatttcccataaggcttgagggcctggtcttaacgcatcagcagttctctagttacgaaccagagctgttcccagggttgatctatcggatgataaaacccagaattgttctgctcatctttgtgagcggaaaagtggtattgacaggtgctaaagtcagggctgaaatctacgaggctttcgaaaatatctatcctattttgaagggattccgcaaaacaacatag

SEQ ID NO: 208084 - DNA, 2610 bp, Artificial Sequence
  Description of Artificial Sequence: Synthetic coding sequence
atggacttccccagcagcctgcggcccgccctgttcctgaccggccctctcgggcttagcgacgtcccagacttaagcttcatgtgctcatggcgagatgcgctgaccctgcccgaagctcaacctcaaaactccgaaaatggcgctttacacgttaccaaagacttgctctgggagcctgccacccctggccctttaccaatgctgcctcccctaatcgatccatgggaccctggcctgactgctagggacctgctcttcaggggcggatgccgttaccgaaagaggccacgggtcgtactggatgtgacggagcagatctccagatttctgctcgaccatggggacgtggcgtttgctccgctcggtaagctaatgctggaaaactttaaacttgaaggcgccgggtcaagaacgaagaagaagacagtggtgtcggtgaagaagttgctgcaggatcttggcggacaccaaccatggggatgtccatgggcctatctttcaaatcggcagcggaggttttccattctggggggaccaatccttggcacctccgtggcaagtcatttagcagagctcctgcacgaagaactggtcttgaggtgggagcagctactgttggacgaggcatgtactgggggagcgctggcctgggtgccgggaagaaccccccagtttgggcagttagtatatccagcgggtggtgcccaagacaggttgcacttccaggaggtcgtgttgacgcccggcgacaatcctcagttccttggcaaaccaggcaggatacagttacagggccctgtacgccaagtcgtaacatgtaccgtgcagggcgaatcgaaagccctgatttatacgtttctgccacattggctgacttgctacctgacacctgggccattccatccgagcagcgcactgctcgctgtgcggagcgactaccattgtgccgtgtggaaattcgggaaacagtggcagcctacgttactgcaggcaatgcaggtggagaagggagccactggaatcagcctgagcccgcatctgcccggcgaactcgcaatttgcagccgctccggggctgtgtgcctgtggtcccccgaagatggattgcgccagatttaccgtgaccccgagacactggtgtttcgcgactccagcagctggaggtgggcagactttacggcccaccctcgcgtcctgacagtcggcgaccgaacaggcgtgaaaatgctcgacacacaaggaccacccggttgtggtctgttgctattccgactcggtgccgaggcgtcatgtcagaaaggagaacgggtcctgctgactcaatatctaggtcatagtagcccaaagtgcctcccccccacactgcacctggtgtgcacacagttttccctgtacttagttgacgagcggctgcctctggttcctatgctgaagtggaatcatggcctgcctagccctttactcctggctaggctactcccaccaccgagacctagctgtgtgcagcccctcctcctaggcggacaaggcggccaactccaactactgcaccttgctggggagggcgcttctgtaccgcgattggccggccccccacagagtcttcccagccgtatcgattctctcccagctttccccctgctggagccgaaaatccagtggcgattgcaagagcgtcttaaggcccctaccattggtttagctgctgtggttccgcccttgccatcggcacctacccccggactagttcttttccagctctccgccgcaggggatgtattctaccaacagctgcgtccgcaggtggattctagcctcagaagggacgccggccctcccggcgatactcagcctgactgtcacgccccaaccgcgagctggacgtcccaggacacagctggctgctctcagtggctgaaagccttattgaaggttccactcgccccacccgtctggacagcccccaccttcactcacaggcagatgctgggaagtacagagctgaggcgggaggaggaggagggacaacggctcggagtgttgaggaaagcaatggcgaggggacagctgttgctacaaagagatctgggttccttgccagccgctgagccacctccagccccagaaagcggcctggaagataagctgagtgaaagactcggtgaagcatgggccggtcgcggggcagcctggtgggagcggcagcaaggaagaacctcggagcccggaaggcagacacgccggcctaagcggagaactcagctgagttcaagcttctctctcagcggccatgtggatccttccgaggacaccagtagtcctcactctcccgagtggccccccgctgatgctctgccactacctcccaccactcctccttcccaggaacttactccggacgcatgcgcccaaggtgtgccgtccgaacagcgtcagatgctacgtgattatatggcgaaactgcccccccagcgggacacacccggctgtgccactacccctccacactcccaggcaagtagtgtacgggctactaggagtcagcaacacacacccgtcctctccagctctcagcctttaaggaaaaagcctcggatggggttttag

SEQ ID NO: 208085 - DNA, 1353 bp, Artificial Sequence
  Description of Artificial Sequence: Synthetic coding sequence
atgagcgacttcagcgaggagctgaagggccccgtgaccgacgacgaggaggtagagacgtctgtcctgtcgggtgcaggaatgcacttcccctggttgcagacatatgtcgagaccgttgccattggcggtaagagaagaaaggattttgctcaaactacctcagcctgcctgtcctttattcaggaggcattgctgaaacaccagtggcagcaggccgctgaatacatgtatagctacttccaaactctggaggacagcgatagctacaagcgtcaagctgcacccgagataatctggaaactaggatcagagatccttttttatcacccaaaatccaacatggagagttttaacacctttgcgaaccgaatgaagaacattggagtcatgaattacctgaaaatctcattacagcatgcgctctacctcctccaccacggcatgctgaaggacgcgaaaaggaacctgtctgaagcagaaacttggcggcatggcgaaaatacttcaagcagggagattttgattaatctgatccaagcctataagggcttgctgcagtattacacctggagcgagaaaaagatggagctgtctaagctcgataaggacgactatgcatataacgcggtcgctcaggatgtatttaaccactcttggaaaacaagcgccaatataagcgctttgatcaagatcccaggtgtgtgggatccgtttgtaaaatcgtatgttgagatgctagagttctacggagaccgcgacggcgcccaggaagtgttaactaactacgcatacgacgaaaagttcccctccaatcctaacgctcacatttatctatacaactttctgaagcggcagaaagccccacgaagtaagctcatttccgtcctgaagattttgtaccagatagttccgtcccataagctcatgttagagttccacaccttgcttcgaaagtcagagaaagaggagcatcgtaaactgggccttgaggttctgttcggcgtactcgactttgccggatgcacaaaaaatatcacagcatggaaatatctcgctaagtatctcaagaacatcctgatgggcaatcaccttgcatgggtgcaggaagaatggaatagccggaagaactggtggccaggttttcacttctcctacttttgggcaaaaagtgattggaaagaggacaccgctctagcgtgcgagaaagctttcgtggcaggcctgctgctagggaaaggctgtagatattttcgttacatcctgaagcaggatcatcagatcctggggaagaagattaaacgcatgaagcgctcagttaagaaatactctattgtcaaccctcggctgtag

SEQ ID NO: 208086 - DNA, 1353 bp, Artificial Sequence
  Description of Artificial Sequence: Synthetic coding sequence
atgagcgacttcagcgaggagctgaagggccccgtgaccgacgacgaggaagtagagacgtccgtattatccggtgccggcatgcatttcccatggctgcagacctatgtggagacagtggcgattggggggaagcgacggaaggatttcgcacagactacgagcgcctgcttgtcctttattcaggaggcacttctaaaacatcagtggcaacaagctgctgagtatatgtactcctactttcagactcttgaggattcggacagctacaagcgccaggccgcccctgagatcatttggaagcttggctctgaaatcctgttttaccatccaaagagcaacatggagtctttcaatactttcgccaacaggatgaaaaatattggggtaatgaactacctgaagatctctcttcagcacgctctgtacttgctgcatcatgggatgttgaaggacgcaaaacggaacctaagcgaggccgagacttggaggcacggagagaacacatcaagccgggagatccttatcaatctgatccaggcatataagggccttctgcagtactatacctggtctgagaaaaaaatggagctttctaaacttgacaaggatgactatgcatacaatgctgttgcacaggacgtgttcaatcactcatggaaaacatccgcgaacatctccgctcttattaagattcctggggtgtgggaccctttcgttaagagctatgtcgaaatgctggagttctatggtgacagggacggagcccaagaggtgttaactaactacgcttacgacgaaaaattcccgagcaatcctaatgcacacatttatctttacaatttcttaaaacggcagaaggcgccacgctccaaattaatcagtgtgctgaaaattctgtatcagatcgtgccatcgcacaagctgatgctggaattccatactttgctgcgtaaatctgagaaagaggagcataggaaactcggactcgaagtcttgttcggagtgttagattttgctgggtgtaccaagaacattacagcttggaaatacttagctaagtatctcaaaaatatcctgatggggaaccacctcgcctgggtgcaagaggagtggaactcgagaaaaaactggtggccaggcttccacttctcatacttctgggctaagtccgattggaaggaggacaccgcccttgcttgtgaaaaggccttcgtggcgggactgctgttagggaaaggctgcaggtacttcagatatatattaaagcaggaccaccagatactgggcaagaaaatcaaacggatgaaaagaagcgtcaaaaaatattcaattgttaacccacggctctag

SEQ ID NO: 208087 - DNA, 1011 bp, Artificial Sequence
  Description of Artificial Sequence: Synthetic coding sequence
atggagagcttcaacaccttcgccaaccggatgaagaacatcggcgtgatgaactacctgaaaataagtctgcagcacgccctatatctgctgcatcacggaatgctgaaggacgcgaagaggaatttatcagaagctgaaacatggcggcatggagaaaacactagttcaagagaaattctgataaatttgatccaggcctacaaaggcttactccagtactacacatggagtgaaaaaaaaatggagctgtctaagctggacaaagacgattatgcctataacgccgtcgcccaggacgtgttcaaccattcttggaagacaagtgctaatatttccgccctcatcaaaatacctggggtgtgggatccctttgtgaagtcctatgtggagatgttggaattttacggagacagggacggagctcaggaagtgctgacaaactatgcctatgatgagaaatttccctccaaccctaacgctcatatttatttgtacaactttctgaagaggcaaaaggctcccaggtctaagctgattagtgtccttaagattctgtatcagatcgtcccatctcacaagcttatgttggaattccatacactgctgcggaagagcgaaaaagaggaacataggaagttggggctcgaagtcctgttcggggtgttggatttcgctggatgcacgaaaaatataactgcttggaaataccttgcgaagtacctgaagaacattctgatgggcaaccatctggcgtgggtgcaagaagagtggaactcccgaaaaaactggtggccaggattccacttttcatacttctgggccaagtccgactggaaggaggataccgctctcgcatgtgagaaggcattcgtggctggcctgttgctgggcaagggatgcagatacttccgctatatcttaaaacaggaccatcagatcctgggcaagaaaataaagcgtatgaagcggtctgtgaaaaaatactccatcgtcaaccctcgcttgtag

SEQ ID NO: 208088 - DNA, 1011 bp, Artificial Sequence
  Description of Artificial Sequence: Synthetic coding sequence
atggagagcttcaacaccttcgccaaccggatgaagaacatcggcgtcatgaactacctcaaaataagcttacagcacgctctatacctgcttcaccacgggatgctgaaggatgccaaacgcaatctgtctgaggctgagacatggcggcatggcgagaatacttccagcagagagattctgattaatctcatccaggcgtacaaaggcctgttgcaatattacacttggagcgagaagaaaatggaactgtcaaagctggataaggacgattacgcttataacgctgtggcccaggacgtgttcaaccactcatggaaaacgtccgcaaatatatcggcgctgatcaagatcccaggggtatgggacccattcgttaagagctacgtcgaaatgctggagttttacggggacagagatggtgcccaggaggtgctcactaattacgcctacgatgagaaatttccaagtaaccctaatgcccacatctacctgtacaacttcctgaaacggcaaaaagcccctagaagcaaactgatttctgttctgaagatcttatatcagatcgttccatcacacaaattgatgctggagtttcacaccctcctgcggaagagtgagaaggaagagcaccgcaagctggggcttgaagtcctctttggcgtcttggactttgctggctgcacaaagaatattacagcctggaagtacctcgctaagtatttgaagaacatactcatgggtaaccatctggcctgggtgcaggaggaatggaactcacgcaagaactggtggcctggatttcacttctcctatttctgggccaagagcgactggaaggaggacaccgctttggcctgtgagaaggcgtttgttgccggactgctgttggggaagggttgccgatacttccggtacattctgaagcaggaccaccagatccttgggaagaagattaagcgcatgaaacgcagcgtaaagaaatactcaatagtcaaccctcggctatag

SEQ ID NO: 208089 - DNA, 861 bp, Artificial Sequence
  Description of Artificial Sequence: Synthetic coding sequence
atgagcgacttcagcgaggagctgaagggccccgtgaccgacgacgaggaagtcgaaacttcagtcctgtccggtgcaggcatgcattttccttggttacagacatatgtggaaacagtcgcaatcggcggaaagcggaggaaggactttgcacagaccacctcagcttgcctctctttcatccaggaggcactgctgaagcatcagtggcagcaggccgccgagtacatgtattcctatttccaaacattagaggactccgacagctataagcgccaggccgctcccgagattagtctccagcatgcactgtaccttttacatcacgggatgctgaaagacgctaagcgaaatttgagcgaggcagagacttggcgtcatggcgagaatacttcatcacgggagatcttaatcaaccttattcaggcttataaggggctgctgcagtattacacctggtctgaaaagaaaatggaattgtcaaagttagacaaggatgactacgcctataacgctgtagcccaggacgtgttcaatcattcttggaagaccagcgccaatatctcagccctcatcaaaatacccggtgtatgggacccattcgttaagtcttatgtggagatgctggaattttatggcgacagggatggagcccaggaggtgctcacaaattacgcctatgatgagaagttccccagcaatcctaatgcacatatttacctgtacaatttcctcaaacgacagaaggctcctaggtctaaacttatttccgtgctaaaaatcttataccagatcgtgccctcccacaagctgatgctcgaattccacactttgttgagaaagtccgagaaggaagaatag

SEQ ID NO: 208090 - DNA, 849 bp, Artificial Sequence
  Description of Artificial Sequence: Synthetic coding sequence
atgagcgacttcagcgaggagctgaagggccccgtgaccgacgacgaagaggtggagacaagcgtgctgtctggggccggaatgcacttcccctggctgcaaacatatgtcgaaactgtagctatcggtggaaagcggcgcaaggatttcgctcagaccacatccgcttgcctgtccttcatccaagaggctcttttgaaacatcagtggcaacaggcagctgagtatatgtactcttattttcagacactcgaagattctgactcctataaaaggcaggccgcaccagagatttctctgcagcacgctttatacctcctccatcacgggatgctgaaggacgctaagcgcaatctcagcgaggcggagacatggagacatggcgaaaacacaagttcacgggagattctcatcaacctcatccaggcatacaaaggattactgcagtattacacctggtctgaaaagaaaatggagcttagcaaattagataaggatgattatgcctacaatgcggtcgctcaagacgtatttaaccacagctggaagactagcgcaaatattagcgccctgatcaaaattcctggcgtgtgggatccctttgtaaaatcctacgtagaaatgttagaattttatggagacagagatggcgcacaggaagtgcttaccaactatgcatacgacgagaagttcccatctaatcctaacgcccatatctacctctataatttcctgaagcgacagaaagcaccaagatccaagctgatctcggtgctgaagattctgtaccagatcgtgcccagtcacaagctaatgttggagtttcataccctcctgaggaaaagttag

SEQ ID NO: 208091 - DNA, 936 bp, Artificial Sequence
  Description of Artificial Sequence: Synthetic coding sequence
atgagcgacttcagcgaggagctgaagggccccgtgaccgacgacgaagaagtggagaccagcgtcctcagcggagctggaatgcattttccatggctccagacgtatgtggagaccgtggccattggcggaaagcggcgtaaagatttcgcccaaacaacctccgcttgtttgtccttcattcaggaagctctgttaaaacatcaatggcagcaggcagccgaatacatgtattcgtatttccagacactggaggattccgattcctataagcgtcaggccgccccagagatcatttggaagttggggtcagaaatcctgttctatcacccaaagagcaacatggagagctttaatacattcgctaaccggatgaagaacatcggtgtaatgaattacctgaagatatctctccaacatgccctttacttactgcatcacgggatgctcaaagacgccaaacgtaatctcagcgaggcagagacgtggaggcatggagagaatacctccagccgggagatcctgatcaacctgattcaagcctataaagggctgctgcaatattacacctggagcgaaaagaagatggaattgtccaaattagataaggatgattatgcgtacaatgcagtggcccaggacgtgtttaaccatagttggaaaacgagcgctaatataagtgctttaataaaaattccaggtgtgtgggatcccttcgtcaagtcttacgtggagatgctcgagttctatggagaccgcgacggcgcccaagaggtactgacaaactacgcgtacgacgaaaagttcccctcaaatcctaatgcacacatatatttatacaacttcctcaagcggcaaaaagcccctcgttctaagctcatcagcgtgcttaaacacttgcaaaagatctccattatgtactccactctccggtag

SEQ ID NO: 208092 - DNA, 2328 bp, Artificial Sequence
  Description of Artificial Sequence: Synthetic coding sequence
atgctgccccccctgatcgacccctgggaccccggcctgaccgcccgtgacctattattccggggcggctgtagatatcgcaaacgccctagagtcgtgcttgatgtgactgagcaaatatctcgatttctcctcgaccatggtgatgtggcctttgcccctcttggaaagctgatgctcgaaaacttcaagcttgaaggtgccggatctagaacaaagaagaagaccgtagtgtctgtgaaaaagctgctccaggacctaggcggtcatcagccttgggggtgtccttgggcttacctctccaatcgccagcggaggttttctatattaggggggcccatactggggacatcagtggcgtcccacttggccgaattgctgcatgaggagctcgtgttgcggtgggaacaactgctgctagatgaagcctgcaccggaggcgccctggcgtgggtgccaggccggacgccgcagttcggacagctggtctatcccgcgggcggcgctcaggatagactgcacttccaagaagtggtgctgacccctggagacaatccccagtttttggggaagcccggccggatccagctccagggaccagtcagacaggtggttacatgtacagtgcaaggtgagactctactggcagtgcgcagtgactatcactgtgcagtctggaaattcggcaaacagtggcagcctaccctgttgcaggctatgcaggtagaaaagggggccactggtatttcgctttctccccatctccctggagagctggctatctgctctcgctccggagcggtctgtctctggagtcctgaagacggactgcgccagatctatcgtgacccagaaactctcgtttttagggactcttcttcctggcgttgggccgactttactgcccatcctcgcgtgctaacggtgggcgatcgaaccggtgtcaaaatgctcgatactcagggtcctcctggttgcggattgctgcttttccggctcggggccgaggcttcctgccagaagggcgaacgtgtgctgctgacccagtaccttggccattcctcccccaaatgcttaccccccaccctgcatctggtttgcacccaattttctttatatctagtcgatgaacgcctgcctctggtcccgatgctaaagtggaaccacggcttgcccagtccgctcctgctggcccggttgctcccaccacctaggccgtcatgcgtgcagcccctgctcttgggaggacaaggcggtcagctgcagctgctgcacctcgcggagggtgcctctgtgccaaggttggcgggaccccctcagtctttaccatcacgaattgatagcctgcctgcatttcccctcctcgaacccaaaatccaatggagactgcaggagcggctcaaagcgcccaccataggactggccgccgtcgtccccccccttccgagtgcaccaacacccggactggtgctgtttcaactttccgccgcaggggacgttttttaccaacagctgagacctcaagtggacagttctctgagacgagacgccggaccacccggcgatacacaacctgactgtcacgcgcccactgcttcctggacatctcaggacaccgcgggatgttcacagtggcttaaggccttgttgaaagtgccactcgcaccccctgtctggactgcaccgacctttacacatagacagatgctcggctccacggagctgagaagagaagaagaagaaggtcagagacttggagtgctgagaaaagccatggcacgtggccagttattgctccaaagggacctaggaagcctacccgccgcagaacctccgcctgcaccagagtctggactcgaagataagctttctgaacggctaggagaggcctgggctggacgtggggcagcctggtgggaaagacagcaaggtagaacctctgaaccgggcagacagacccgccgccctaaacggcgcacacagttgagtagtagcttttccctgtcaggccacgttgatccctccgaggacacctccagcccccactctcccgaatggcctcctgctgacgctctgcctctgccgccaaccaccccgccgagccaagagctgacgccagacgcctgtgcgcagggcgttccctctgaacagcgccagatgcttagagattacatggccaagctgcctccgcagagagacacccccgggtgtgccacaaccccaccgcactctcaggcctctagcgttagggcaacacgttcccagcagcatacgcccgtcctgtcctcctcacaaccgctcagaaaaaaaccccggatgggattctag

SEQ ID NO: 208093 - DNA, 2610 bp, Artificial Sequence
  Description of Artificial Sequence: Synthetic coding sequence
atggacttccccagcagcctgcggcccgccctgttcctgaccggccccctgggattgtcggatgtgcccgacttgagcttcatgtgctcttggagggatgccctgacattgccggaagctcagccacaaaattcagagaatggcgcattgcacgttacaaaagacttactctgggaaccggctacgcccggtcctttaccaatgctcccccccctcattgacccctgggatccaggactcactgccagagatttgctcttcagaggcggatgcaggtaccggaagcgcccccgtgtggtcctagacgtgacagagcaaatctcacgctttctgcttgaccatggtgacgtggcctttgcaccactgggaaaactcatgttggaaaattttaagctggagggagctggctctcgcacaaaaaagaaaaccgtcgtgagcgtgaagaagctcctgcaggatctgggcggccatcaaccttggggctgtccctgggcttatttgagtaatcgacagaggcgtttttccattctggggggaccaatcttaggcacaagcgtggcttcccacctggcagaactgctgcacgaggaactggtcctgcgctgggaacagctcctgttggatgaggcctgcactggaggcgcattggcatgggttcctggccgaacaccacagtttggccaacttgtgtacccggctggaggggcacaagacaggctgcacttccaggaggtggtgttaacacccggcgacaatcctcagtttctcggtaagcctgggaggattcaactccaagggcccgtgaggcaagtagtgacgtgcacagtgcagggagaatctaaagctctcatttatacattcttaccacactggctaacatgctacctgacgccgggcccctttcatcccagtagcgccctccttgcagtgcggtccgattaccattgtgcagtttggaagtttggaaaacaatggcaacctactcttctccaggccatgcaagtggagaaaggtgccacagggatcagtctctctccccatctccccggcgagctggcaatttgttcacggtctggagccgtatgtctgtggtcacccgaggacggtcttcggcagatatacagagatccagaaactttggtctttcgcgactcaagcagttggagatgggcagacttcactgcccatcccagagttctgacagtgggagatcgcacgggagtgaagatgttggacacccagggtccccccggctgtggactgctcctgttccgactcggagcagaagccagttgtcagaaaggagaaagggtgttgctcacacagtaccttgggcacagctctcctaagtgtctcccccccactttgcatctggtgtgcactcagttcagcctatacctggtagacgagagactccctctggttccaatgctcaagtggaaccatggcctgcctagtcccctgctcctggctcgcctgctgccaccccccagaccttcttgtgttcagcctctgctgttaggcggccagggcgggcaactccaactgctgcaccttgccggtgagggggcttcggttcccagactggccggccccccacagtcccttccctccaggattgactcacttcccgctttcccactgctcgaaccgaaaatccagtggagactgcaggagcgcttgaaggctcccacgattggcctcgctgcagtggtcccacctctgccctccgcccccacacccggacttgttctgtttcagcttagcgccgctggtgatgttttctatcagcaattaagaccacaggtcgactcttctctgaggcgagatgccggccctcctggtgacacacagccagattgccacgcacctacagccagctggacatcccaggacacagcaggttgcagtcagtggttgaaagcactgctcaaagtgccgttggcaccacccgtgtggactgcccccacctttactcatcgccagatgctgggcagtacggaactgcggcgggaagaagaagaaggccagcggcttggagtccttcggaaagccatggcccgcggacagttactcctgcagcgagatctgggatcattgcccgccgctgaacctccgccagctcctgaatccggccttgaggataagctgagtgaaagattaggtgaggcctgggccggccgcggggcagcttggtgggaacgtcaacaagggagaacctcagaacctgggcggcaaactcgccggcctaaaagacgcactcaactgagttcctcattttcactgtccgggcatgttgatccttctgaagatacttcaagtccgcacagcccagagtggccccctgctgacgccttaccccttcccccaaccactcccccttctcaggaactcaccccagatgcgtgtgcccagggtgtacctagcgagcagcggcagatgctgagagattatatggccaaactaccgccccagagggatacacctggctgcgctacgaccccaccacattcccaggcttctagcgtgcgagccacaaggtctcaacagcatacgcccgtactgtcatcatctcagcctctcaggaagaaaccccggatgggattttag

SEQ ID NO: 208094 - DNA, 1047 bp, Artificial Sequence
  Description of Artificial Sequence: Synthetic coding sequence
atggacttccccagcagcctgcggcccgccctgttcctgaccggcccactgggtctgtctgatgtgcctgacctctctttcatgtgcagctggcgcgacgccctaacactccccgaagcccagccccagaatagcgagaatggcgccctgcacgttactaaggatctcctctgggagcctgcaacccctggcccactgcccatgttgcctcccctgattgacccctgggacccaggcctcacggcaagagatctgttattcagaggggggtgcagataccgcaagcggcccagagtcgtcctcgatgttacagagcagatctcccgattcctgctcgatcatggcgatgtcgcttttgcgccgctagggaaattaatgctcgaaaattttaagttggagggagctggatcgcgcaccaagaagaaaaccgtcgtgtctgtgaagaagcttttacaggatcttggtggccaccagccttggggctgcccttgggcctatctgtccaacagacagcgaaggttctccatcctgggcgggccaatccttggtaccagtgtagcctcccatctcgctgagttactgcatgaggagttggtattgagatgggagcagctgttgctggacgaggcttgtaccggcggcgccttggcttgggtgcccggcaggacaccgcagttcggacaactagtgtaccccgccggtggcgctcaagacaggttgcatttccaggaagtcgtcctcacaccaggagataatcctcaatttctcggaaaaccaggcaggattcaattacagggacccgttcgtcaggtcgtgacgtgtacagtccaaggtgagactcttctggctgttcgcagtgactatcactgcgccgtgtggaagtttggaaaacagtggcaacctactctacttcaggcaatgcaggttgaaaaaggcgcaactggtatctcactaagtccccacctgcccggcgaattggccatctgctcaaggtcgggcgcggtgtgtctgtggagccccgaggatggctatcgccgcttcctctag

SEQ ID NO: 208095 - DNA, 2331 bp, Artificial Sequence
  Description of Artificial Sequence: Synthetic coding sequence
atgctgccccccctgatcgacccctgggaccccggcctgaccgcccgcgatctgctcttcagaggcgggtgcagatatagaaaacgccccagggtggtgctcgatgtgacagagcagatctctcggttcctgcttgaccacggtgatgttgctttcgcccctcttggtaaactcatgctagaaaatttcaagctcgagggcgccggatcaagaactaaaaaaaagacggtcgtcagtgtaaagaaacttctccaggacctgggtggccaccagccctggggttgtccttgggcttacttgagtaatagacagagaaggttctcaatattgggcggacctatacttgggacatctgtggcctctcacctggccgaattactccatgaagaacttgtgctcaggtgggagcagctgttgctggatgaagcatgtactggaggcgcactcgcatgggtgcccggcagaactccacagtttgggcagcttgtgtaccctgcgggcggagcacaagaccgactacattttcaggaggtcgtgctgacgcctggcgacaatcctcagttcctcgggaaacccggacgaatccagctccaagggccagtacggcaggtggtgacctgtaccgtgcaaggtgaaacactgctcgctgtcagatctgactaccattgtgctgtttggaagttcggaaagcagtggcaaccaacactgctgcaggcaatgcaggttgagaaaggcgctaccggcatatcactgtcaccccaccttcccggcgagcttgccatctgctctaggtcaggggcagtttgcctctggtctccggaggatggactgcgtcagatatacagggacccagagacactggtttttcgagactcttccagctggcgatgggctgatttcacagctcatccccgcgtgcttaccgtaggcgatcgcacaggggttaagatgctggatacacagggccctccaggatgcggtctcctgttatttcggctgggcgccgaagcatcatgtcaaaagggagagcgtgttctcctcacacagtatcttggtcacagctcccccaagtgtttacccccaacattgcacttagtgtgcactcagtttagtttgtacctggttgatgaacgactcccactggtgcccatgttgaagtggaaccacggactgccctcccccctcctgctggcccgtctgctcccgccccctagacctagttgtgttcagccgctactcctgggcggacagggtggccagcttcaactcctgcacctcgccggggaaggcgccagcgtccccaggctggcgggacctccacagtccttaccttcaagaatcgactctctcccggcgtttcctctgttggaaccgaagatccagtggcggttacaagaacgcctgaaggcccctaccatcggtctcgctgcagtagtgcctccactccctagcgctcctacccccggcttggttctttttcagttgtccgcggcaggagatgtattttaccagcagctgagaccccaagtcgattcttctctccgcagggatgcagggccccctggagatacccagccggactgccacgccccaactgctagttggacttcacaagatactgctggctgcagccagtggttgaaagcactactgaaagtgcctctcgccccgccggtgtggacggcacccactttcacacacagacagatgctggggagcaccgaactgcggcgcgaagaagaggagggccagcggttgggcgtcttacgcaaggccatggcgcgcggccagcttctgctccagagagacctgggctcgctccccgccgccgagcctccaccagcccccgagtcaggtttggaagacaagctctctgagcgcctcggtgaggcctgggcgggacgcggagccgcttggtgggagcgacagcagggccgtacctccgaaccaggacgccaaacccggcgacccaagcgccggactcagctgtctagttccttttccttgtccggacatgtcgatccaagtgaggatacatcctctcctcattcgcccgagtggccgccggctgatgccttaccattacctcccacaaccccgcctagccaagagctgacccccgacgcctgtgcacagggcgtgccttcagagcagagacaaatgttgagagactacatggcaaaattgcccccccagcgcgatacaccaggttgcgccacaacgccaccacacagccaggcatcctccgttcgtgccacaagatcacagcagcacacacctgtcctgagcagctcgcaacccctgcggaaaaagccgagaatggggttctag

SEQ ID NO: 208096 - DNA, 1179 bp, Artificial Sequence
  Description of Artificial Sequence: Synthetic coding sequence
atgctgaagtggaaccacggcctgcccagccccctgctgctggccaggttgcttccccctccgcgcccatcatgcgtccagccccttttattgggcggccaaggagggcagctccagttgctgcacctcgctgaaggggccagtgttccccgactggcgggacctccacagagtctaccgtctagaatcgactcattgcctgcattccctctcctggagccgaagatccagtggcggttgcaggaacgactgaaggcccctactatcggacttgccgcagtggttcctccactcccgagtgctcccacacctggtcttgtcctgtttcagttatccgccgctggagacgtgttctaccaacagctccgtccccaagtcgacagctcgctgcggcgcgacgccggacctcctggtgatacccagcccgattgtcacgcacctaccgcctcttggacgtcccaagatacagctggctgcagtcagtggctgaaagccctactcaaagtaccactcgccccccctgtgtggacagctccaacgtttactcataggcaaatgctgggttccacggaactgagaagagaggaggaggagggacagagattgggcgtgttgcggaaggcaatggctagggggcagcttctcttgcagcgcgatcttggctccttgcccgccgcagagccccccccggcaccagaatctggccttgaggataagctctcagaaaggctgggggaggcctgggctggccgcggggccgcttggtgggaacgacagcagggacggacaagtgagccgggcaggcagactcgccgccccaaacgccggactcagctcagcagctccttttccctcagcgggcatgtggatccctccgaggacacgtcttccccacacagtcccgaatggccgccagcagatgcactcccgctcccacctaccacgcctccctcacaggagctgactcctgacgcgtgcgctcagggcgtcccaagtgagcaaaggcagatgctgcgggactatatggctaagctgccaccacagcgagatacaccaggctgtgccactacaccaccccacagccaggcatcctccgttagggccaccaggtctcagcaacacaccccagtgctgtcatcctctcagccccttagaaagaagccaagaatgggcttttag

SEQ ID NO: 208097 - DNA, 837 bp, Artificial Sequence
  Description of Artificial Sequence: Synthetic coding sequence
atggacaagagcggcatcgacagcctggaccacgtgaccagcgacgccgtggaactggctaatagaagcgacaatagtagtgacagctcgctgtttaaaacccagtgcattccttactccccaaagggagaaaaacggaatccgatcaggaagttcgtgcgaacccccgagagcgttcacgcgtctgacagttcttcggactccagttttgaaccaattcctctcactatcaaggctatctttgaaagatttaaaaaccgaaagaagaggtacaaaaagaaaaaaaagagacggtaccagccaaccggccgcccaagagggagaccagaaggtcgcagaaatcccatctattccctgatcgataagaagaagcagtttcgctcacgggggtccggatttccattcctggagtctgaaaacgagaaaaacgctccctggagaaagatcctgactttcgagcaagccgtggcaagaggattttttaattatatagagaagctgaaatatgagcaccacctgaaagagtccttaaaacagatgaacgtgggcgaggatttggagaatgaggatttcgattccagacgctacaaattcctggacgacgatgggagcatcagcccgattgaggagtctaccgccgaagacgaggacgccactcatctggaggacaacgagtgcgacatcaaactcgctggggattcatttattgtaagttcagaatttcctgtcaggttatcggtgtatctggaggaggaggatataactgaagaagccgccctgtccaaaaagcgcgccacgaaagcaaaaaacacaggccaaaggggcctgaagatgtag

SEQ ID NO: 208098 - DNA, 837 bp, Artificial Sequence
  Description of Artificial Sequence: Synthetic coding sequence
atggacaagagcggcatcgacagcctggaccacgtgaccagcgacgccgttgaattggccaacaggagcgacaattcatccgattcctccctgttcaaaacacagtgcatcccgtatagcccgaaaggcgagaagaggaaccctattcgaaagttcgtcagaacgcccgagagtgtgcacgcatctgattcctcttcagacagttccttcgaacctattcccctcactatcaaagccatttttgagcgatttaagaataggaagaaacgctacaagaagaagaagaagcgtaggtaccagcctacgggaaggcctcgagggcggccagagggacggcgtaaccccatctactcgctcatagataaaaaaaagcagttccgcagtcgcgggagcggattccccttcctggagagtgaaaacgagaaaaacgctccctggcggaagattctgacatttgaacaggcagtcgcgagagggttcttcaattacatagaaaagcttaaatacgagcaccatctgaaagaatctctgaaacagatgaatgtgggagaagatctggagaacgaagatttcgatagccggcgttacaagttcctggacgatgacgggtccatcagccccatagaggaaagtaccgcggaggacgaggatgccacacatttggaagataacgaatgcgatattaagttagccggcgactctttcattgtgtccagtgagttccctgttcggctgagtgtgtatttggaagaggaagacataactgaggaggccgccctctcaaagaaacgtgctacaaaagccaagaacaccggtcagcgcggtctgaagatgtag

SEQ ID NO: 208099 - DNA, 837 bp, Artificial Sequence
  Description of Artificial Sequence: Synthetic coding sequence
atggacaagagcggcatcgacagcctggaccacgtgaccagcgacgccgtggagctggctaaccgaagcgataactcaagtgacagctctctgttcaaaacacagtgcattccatacagcccaaagggcgaaaaacgaaaccccattcgaaaatttgtgcgcacaccagaatccgtacacgcctcggactccagtagtgacagtagcttcgaacccatcccgcttactattaaagccatttttgagaggtttaaaaacaggaaaaaaagatacaaaaaaaaaaagaagaggagatatcagcccaccggacgccctagggggagaccggaaggaagacgtaatccgatatatagcttaatcgacaagaagaaacagttccggtcaagaggaagcggctttccctttctggaatctgaaaatgagaaaaacgcgccatggcgaaagatacttacgttcgaacaggcagtggcacggggtttcttcaattacatcgagaaactgaaatatgagcaccacctgaaagagtctctgaagcagatgaacgtgggagaagaccttgaaaacgaggatttcgattccaggaggtataagtttctagacgatgacggctcgataagccccattgaagaatccactgccgaggatgaagacgcaacacacttagaagataacgaatgcgatatcaagcttgcgggtgacagctttatagtctcaagcgaattccccgtccgcctttccgtgtatcttgaagaggaagacatcaccgaggaggccgcacttagtaagaagagggccacaaaagccaagaatacggggcagagaggactcaaaatgtag

SEQ ID NO: 208100 - DNA, 27 bp, Artificial Sequence
  Description of Artificial Sequence: Synthetic coding sequence
atggacaagagcggcatcgacagctag

SEQ ID NO: 208101 - DNA, 3030 bp, Artificial Sequence
  Description of Artificial Sequence: Synthetic coding sequence
atgagctggttcaacgccagccagctgagcagcttcgccaagcaggctttgtctcaggcccaaaaatccatcgaccgcgttctggatattcaggaggaagagcctagcatctgggcagagaccatcccatatggcgaaccaggaatatcctctcccgtttccggtggatgggacacctccacctgggggttgaagagtaatactgaaccacagtctcctcccattgcgagccctaaggccattaccaagcccgtgagaaggaccgtggtggacgagtccgagaatttcttctctgcttttctatcccccaccgtgtccctcaaggtttccgaatcagtgattgatgtgaaaacaacgatggagtcaatctctaataccagtactcagtctctgactgccgagaccaaggacatagcgctcgaaccaaaggaacaaaaacatgaggaccgtcaaagcaacacaccctcaccgcctgtgtccaccttctcgtcaggcacgtctaccacaagcgatatcgaggttctggatcacgaatctgtcatcagcgagtcctccgcgagcagccggcaggaaacaacggattcaaaaagttcactgcatctgatgcagaccagtttccaacttctgtctgcatctgcctgccccgagtataaccggctcgacgattttcagaaactgactgagtcttgttgttcctcagacgccttcgagcggattgattcctttagcgtgcagagcttggatagccgctccgtgtctgagattaactcagacgacgagctatcaggtaaagggtacgccctggtgcctattattgttaacagcagcaccccgaaatccaagactgtggagtccgcagagggtaagagcgaggaagtaaacgaaacccttgtgattcccacagaggaggcagaaatggaagaatctggacggtccgccacaccagttaattgcgaacagccggatatcttagtttcatcgactccaatcaatgagggtcagaccgtgttagacaaggtggcggagcagtgtgaacccgccgagagccagcctgaagccctctccgaaaaagaggatgtgtgtaaggttactctgacagtcgagtttctgaacgagaagctagaaaaacgggaagcgcagctgctctctctgtccaaggagaaggcattgctggaggaggctttcgacaatttgaaagatgagatgtttcgagtcaaggaagaaagtagtagcatttcctcgctgaaggacgaattcacacagcgcatcgctgaggccgagaaaaaggtccagcttgcctgtaaggagagggatgctgccaagaaggaaatcaaaaacattaaagaggagctggctacccgtctgaactcatccgagaccgcagatcttttaaaagaaaaagacgaacagatccgtggtttgatggaggaaggcgagaaattgtccaaacagcagcttcacaactcaaacatcatcaaaaaactgcgggccaaggataaggaaaatgagaacatggtggccaagttaaataagaaagtcaaagaacttgaagaggagttacagcatctgaagcaggtgctggatggcaaagaggaagtagagaagcagcaccgggagaacatcaagaagcttaattcaatggtcgaacgccaggaaaaggatttgggacgcttgcaggtagacatggacgaattggaggaaaaaaaccggtcaatccaggcggccctggactctgcctacaaggaactaacagacctacataaagcaaatgccgcaaaggactctgaagcacaggaagccgcactctcgcgggagatgaaggccaaggaagagctgtctgccgcacttgaaaaggcacaggaggaagcccgccagcagcaggagaccttagccattcaggtgggggacctgaggctcgccttacagcgcacagaacaggccgcagcaagaaaagaggattacctacgtcacgagattggagagcttcagcagcgccttcaagaggcggaaaacaggaaccaggagctttctcagagcgtgagttctaccacacgccctcttctgcgccagatcgagaacctgcaggccaccctgggaagccaaacttcaagttgggaaaagttggaaaagaacctctctgaccggctgggtgagtcccagacattgttagctgccgccgtggagcgagaaagggcagccacggaggagctgctggccaataagatccagatgagctcgatggaatcccagaattctctcttacgtcaggagaacagtcgcttccaagctcaattggaatccgagaaaaataggttgtgcaaactcgaggatgagaataaccgctaccaggtcgagctcgagaatcttaaagatgaatatgtcagaacgctagaggaaacgcggaaagagaaaacattactgaactctcagctcgaaatggagcgaatgaaggtggagcaggaaaggaaaaaagccatattcacccaggaaacaatcaaggagaaggagagaaagcctttctccgtgagcagtacccctacaatgtcccgcagctcctccatctctggtgttgatatggcaggcctgcaaacttcgtttctaagccaggatgagtctcacgaccattcattcgggcctatgcccattagcgccaacggcagtaatctttacgatgccgtgagaatgggcgctggctcaagcataatcgagaatttgcagtctcaactaaaactgcgcgagggagaaatcacccaccttcagctggaaatcgggaacctcgagaaaacaaggagcatcatggcggaagagctggtcaagcttacaaaccaaaacgacgaactggaagagaaagtcaaagaaattccgaaacttcggacccagctccgtgaccttgatcagcgatacaacactattctgcaaatgtatggagaaaaggccgaggaggccgaggagcttcggttagatctagaggatgtgaagaatatgtataagacacagatcgatgagcttctgcgccagtccctgtcttag

SEQ ID NO: 208102 - DNA, 3282 bp, Artificial Sequence
  Description of Artificial Sequence: Synthetic coding sequence
atgagctggttcaacgccagccagctgagcagcttcgccaagcaggccctatcgcaagcacagaagtccatagaccgcgtcttagacatccaagaagaggagccctctatatgggcagagactattccgtatggagagcccggcataagcagccctgtgagcggtggctgggacacctccacatggggtttgaaaagcaatactgaaccccaatcccccccgattgcatctcctaaagcgatcaccaaacccgtgaggaggaccgtagtggatgaaagcgagaatttcttttctgccttcctgtcccccactgacgtccagaccattcagaaaagccccgtggtcagcaaacctccggcgaagtcccaacgtccagaagaggaggtgaagtcctctctgcacgaaagcctgcacattggacagtcacgaacccccgagactacagaaagccaagttaaggattcttcattatgtgtgtcaggcgaaacgctggccgccggaacatcctcccctaagaccgaagggaagcacgaggagactgttaataaggagagcgatatgaaggtaccaacagtgtcactgaaggtgtccgagagcgtcattgacgtcaagacaaccatggagtccatttccaacactagtactcaatcacttaccgcagagacgaaggacattgcgctggaacccaaggaacagaaacacgaggaccggcagtccaatacacctagccccccagtgtcaactttttcatccggcactagtacaacatctgacatagaggtgctggatcatgagtccgttattagcgagtctagcgcttcctctcgacaggagacaacagacagcaaatccagcttgcacctcatgcagacaagctttcagctcctatcggcgagcgcctgtcccgaatataatcggttggacgattttcagaagctgacagagagttgctgttcctcagatgcgtttgaaaggatagatagcttctccgtacagagcctcgattcccgaagcgtgtctgagatcaattccgacgacgaactttccgggaagggctacgctctggtgcctataatcgtcaacagtagcactcccaagtcaaaaactgtggaatcggctgagggcaaatcggaagaggttaacgagacgctggtgatcccgactgaggaagcagaaatggaggagtccgggagatcggcaacacctgtcaactgcgaacaacctgacatcctggtttcgagcacccccattaacgaaggtcagaccgtacttgataaagtggccgaacagtgtgagcccgctgagagccagcccgaggcactatccgagaaggaggacgtgtgcaagacagtcgagttcttaaacgaaaaactggaaaaaagagaagcccagctgttgtcactctccaaggagaaggcactgctggaagaagcatttgacaacctcaaagatgagatgtttcgtgtgaaagaggaaagctccagcatctctagcctcaaagacgagtttacacaacggatcgccgaggccgaaaagaaagtgcagcttgcctgtaaagaaagggacgccgccaaaaaggagatcaagaatattaaagaggagctcgcaactagactgaactcgagtgagacagcagacttacttaaagagaaagacgagcagatacgcgggcttatggaggaaggggagaagctctccaagcagcagcttcacaactcaaacatcattaagaagttgcgcgccaaggataaagagaatgagaatatggtagcaaagctgaacaagaaagtgaaggagctcgaggaggaactgcaacacctgaagcaggtcctggatgggaaagaggaggtagagaaacagcatcgtgagaacatcaaaaagctcaattcaatggtggagaggcaagagaaagacttggggcgtctgcaagtcgatatggatgaactggaagagaagaataggagtattcaggccgcacttgatagtgcatacaaggagctgaccgatctgcacaaggctaatgccgcaaaagattcggaggcgcaggaagctgctttatctagggagatgaaggcaaaagaagagctctctgcagcactggaaaaagcccaagaggaggcgagacaacagcaagaaacccttgctatacaagtgggagatttgaggctggccttacaaagaacggagcaggccgccgccagaaaggaggactatcttcggcacgagattggcgaactgcaacagcgcctgcaagaagctgaaaatcggaatcaggaactctctcagtcagttagcagcacgacacgacctcttcttaggcagatagagaacctgcaagctacactcggatcccagacgtcttcctgggaaaagctcgaaaagaacttaagcgaccgccttggcgaatcacagacccttctcgctgcagccgtggagagggaaagagctgcgactgaagagttactggcaaataaaatacaaatgagctccatggaatcacaaaacagtttactgcgccaggagaactcccggtttcaggctcaactcgagagcgagaaaaatcgattatgtaaattggaagacgagaataatcgttatcaggtggaactcgagaacctgaaagacgagtatgtcaggactttggaggaaacacgcaaggagaagaccttactaaatagccagctggaaatggaacgcatgaaagtcgaacaagagaggaagaaggccatcttcacccaggagacgattaaggaaaaagagagaaagccctttagtgtatccagcactccaactatgtcccgaagttcttcaatctcaggcgtggacatggccggtctacagacgtctttcctcagccaggatgagtcccacgaccattctttcggtcctatgcctatcagcgccaacggcagcaacctgtatgatgcggtccggatgggcgccggctcatccatcattgagaacctccaaagccagctcaagctgcgggaaggcgagatcacccacttacagctggaaatcggtaatctggagaagacaaggagcattatggctgaagagttggtaaagttgacgaatcagaacgatgaattagaagagaaggtcaaagagatccctaagctaagaacccagctgcgggacctagaccaacgctacaatactattctacagatgtatggggagaaagcagaagaggccgaggaactacggttggacctggaggatgttaaaaacatgtataagacacagatcgacgagctccttcgacagagcctaagctag

SEQ ID NO: 208103 - DNA, 1602 bp, Artificial Sequence
  Description of Artificial Sequence: Synthetic coding sequence
atgagctggttcaacgccagccagctgagcagcttcgccaagcaggccttaagccaagcacaaaagagtattgacagagtgctggatattcaggaggaggaaccctcgatttgggccgagactatcccctatggtgagcctggcatttcaagtcctgtttcggggggctgggacacctctacctgggggcttaagagcaacactgagccacagtccccgcccattgccagcccgaaggcaatcactaaacctgtcaggagaaccgtggttgatgagagtgagaacttcttttctgccttcctgtcccctactgacgttcagacaatccaaaagagtccagtggtgagcaaaccccccgccaaaagccagaggcctgaagaagaggtgaagtcttctctccatgagtctctacacattgggcagagtcgcacgcctgagaccaccgaaagccaagtaaaggacagcagcctgtgcgtatctggagagactttggccgctggtaccagttctcctaaaactgaggggaagcacgaagaaactgtgaataaagaatccgacatgaaggttccaacagtgtcactgaaggtgtctgaatcagtcattgacgtcaagaccaccatggaatctatatcgaatacaagtacccagagtctaacagccgaaaccaaagacatagcacttgagcctaaggagcagaagcacgaggatagacagtccaacacacctagcccccccgtaagcaccttcagttccgggacaagcactacatctgacatcgaagtgttggaccacgaatcagtcataagcgagtcctctgccagctctcgtcaggaaacgaccgattctaaatcttccttacacttaatgcaaacttcttttcagctgctgtccgccagcgcatgcccagagtacaaccgtctggatgacttccagaagctgacagagtcgtgctgcagttccgatgcatttgagcgaatcgacagcttttctgtgcagagcctggactcaaggtcagtcagtgagataaatagtgatgacgagttaagtggcaaagggtacgcactggtgcctataattgttaatagtagtactcccaagtctaagacagttgagagtgctgagggcaaaagtgaggaggtcaatgagaccttggtgatcccaacagaagaagcagaaatggaggagagtggtcgctcagcaaccccagtgaattgtgagcagcctgatatcttggtgtctagcacaccaataaatgaaggacagacggtattggacaaggtggctgagcagtgtgaaccagccgaaagccaaccagaagcgctcagcgaaaaagaggacgtgtgtaaaactgtcgaatttttaaatgaaaaattagagaaacgcgaggcccagctcctgtcactgtcaaaggagaaggccctcctggaggaagccttcgataacttgaaggatgagatgtttcgagttaaagaagagtcatcctccatctcttccctgaaggatgagtttacacagagaattgccgaggcagaaaaaaaggtccagctggcctgcaaggagagagatgctgcaaagaaagaagtgaaaagaaaaaaacggtag

SEQ ID NO: 208104 - DNA, 3291 bp, Artificial Sequence
  Description of Artificial Sequence: Synthetic coding sequence
atgagctggttcaacgccagccagctgagcagcttcgccaagcaggccttgtcacaggctcagaaatccattgatagggtgctcgatattcaggaagaggaaccctctatatgggctgaaacaatcccttacggcgagcctggcatttcctctccggtgagtggggggtgggacactagcacttggggtctgaagtccaacacggaaccccagtccccaccaattgcatcccctaaagcgatcaccaaacccgttcggaggacggtggtggacgagtctgagaacttttttagcgcatttttgagccctactgacgtgcaaaccatacagaagagccccgtggtcagtaaaccccccgccaaaagccaacggcccgaagaggaagtgaaatcatcactccatgagagcctgcacattggccagtctaggactcccgagactactgaaagccaggtgaaagattcttctctgtgcgtgtccggagagaccttggccgccggtacatcaagccccaagactgagggcaagcacgaagaaacagtgaataaggaaagcgatatgaaagtgccaactgtttcacttaaagtatccgaatctgtcatcgatgttaagaccaccatggaatccatctcaaatacctccactcaatctctgacagctgaaactaaagatatcgccctggaacctaaagagcagaagcacgaggacaggcagtcaaacactccctcgcctccggtgtccacattctcttccggcacgtctacaacatcagatattgaggttctagatcatgaatcagttattagcgagtcatcagcttctagccggcaggagacaaccgatagtaaaagtagtctccacctgatgcaaacgagttttcaattactgagcgcatcggcgtgcccggagtataaccgcctggacgatttccagaaactgaccgaaagctgctgtagttctgatgcgttcgaacggatcgacagtttttcggtgcagagtctggatagcaggtctgtgtctgagattaactcagatgacgaactgtctggtaagggctacgcattggtcccaatcatcgtaaattctagcactcctaagtcaaagacagtggaaagtgccgagggcaaaagtgaagaagtgaatgaaacccttgtgatcccaacagaagaggctgagatggaagagagcggacgcagtgcgactcctgtaaattgcgagcagcccgatatcttggtgtcttcgacacccatcaatgaaggtcagacagtgttggacaaggtggccgagcaatgcgaaccggccgagagccagcccgaggcactgagcgagaaagaggatgtgtgcaaggtcactctgaccgtggaattcctgaacgagaagctggagaagcgcgaagcccagctcctgtctctaagtaaggagaaggctctgcttgaggaggcatttgataacctcaaggatgagatgtttcgcgtaaaagaggagagtagctcaattagttctctgaaggacgaattcacgcaacgcatcgctgaggccgagaagaaggtccagcttgcttgcaaagagcgagatgctgcaaaaaaagagattaaaaatataaaagaggagctggctactaggctcaactcaagcgaaacagctgaccttctcaaagagaaggatgagcagattaggggcctgatggaggagggggagaaattaagcaagcagcaactacataattccaacatcataaagaaactgcgggccaaggataaagaaaatgagaacatggttgccaaactgaataaaaaagtcaaagaattagaggaggagcttcagcacttaaagcaggtgctggatggcaaggaggaggttgagaaacaacatagagagaatatcaaaaagttgaacagtatggttgaaagacaggagaaagacctgggacgactgcaggttgacatggatgaactggaggagaaaaatcgatcaatccaggctgccctggactccgcctacaaggagctaaccgacttacacaaggctaacgctgccaaagattctgaggcacaagaagcagcactgagcagggagatgaaagcaaaagaggaactgtccgccgcactggaaaaagcccaagaagaggctaggcagcaacaagaaaccttagcgatacaggtgggagacctaaggctggcattgcagcgaacagagcaggcagcagccagaaaggaggactacctaaggcatgaaattggcgagctgcagcagcgactgcaagaagccgaaaataggaaccaggaactgtcccagagcgttagctctactactcgacctcttctgagacagatcgaaaacctgcaggccaccctgggaagccagacaagctcctgggaaaaactggaaaagaatctcagcgacagacttggagaaagccaaaccttactggcagcagctgtggagagagagagggcggcaactgaagaactgctggccaataagatccagatgtcaagtatggaatcccagaatagcttgcttcggcaggaaaatagtcgcttccaggcccagttggaaagcgagaaaaacagactgtgtaagctagaggatgagaataaccggtaccaggtggaactcgagaacttgaaggacgaatatgtgagaacactggaggagacaagaaaagaaaagactctgctgaacagtcagctggaaatggagcgcatgaaggtggaacaggagaggaagaaggcaattttcacccaggaaacaattaaagagaaggaaagaaaacctttctccgtgagctcaacgccgactatgtcaaggtcatcctcgatctccggcgttgatatggctggtctgcagacatcctttttgagccaggacgagtcgcatgatcattcatttgggccaatgcccatatccgctaatgggagcaacctatatgacgcagtccggatgggcgccggcagttccatcattgagaatctgcaatcacagctgaagctgcgggaaggagaaatcacccatctgcagcttgaaatcggcaatctcgagaaaaccaggagcatcatggccgaggagctggtcaagttaacgaaccaaaacgacgaactcgaggagaaggtaaaggagattccaaaactgcgaactcaactgcgagacttggatcaacgctacaacacaattctgcagatgtatggcgaaaaggctgaagaagcggaagaactgaggctcgatttggaagatgtaaaaaacatgtataagacccaaatcgacgaactcctgcgacaatccctaagctag

SEQ ID NO: 208105 - DNA, 4950 bp, Artificial Sequence
  Description of Artificial Sequence: Synthetic coding sequence
atggagagcgtggagaaggactggggctggggcctgtggcggaaccttcgatgtctgggtcatgcgcaccagggtaagtgctgcacagagggtggcatctccagtacaaccaaaacatcaagtgaaaacgggtcatgttgcttcgagaaggctgcgaggaaggaccacgtttgccggttcatcggctgcgggaggaacgatcgcttcaactacgttgttatgcagttgcaaggtagaaacttggctgacctgcgaagatcacagagcaggggaacctttactattagcaccacactgagattaggcaggcagattctggagtctattgagtccattcactcagtggggtttctgcaccgtgatattaagccaagtaattttgccatgggacggtttccatctacatgcaggaagtgttacatgttggatttcggcctagcccgacagtttaccaattcctgtggtgacgtgcgaccaccccgggccgttgctggtttcaggggcacagttcgctatgcaagcatcaatgctcacaggaatagggaaatgggccggcacgacgacttatggagccttttctatatgctggtcgagtttgtagtaggacaactgccttggagaaagattaaagataaagaacaggtcggctctattaaagaacgatacgatcacaggctcatgctcaaacacctacccccggaattctcaattttcctcgatcacatctccagccttgattacttcaccaagcctgactaccagatgagcattagggttacgagaaagagttataaggtgtctacaagcggcccccaagcgttcaacagcctgagctacacaagcggtcccggagcttgtatatcctcttcgtctttcagtaggatggggtctagttcattccgcggcggcctgggagcaggctacggcggcgcctccggcggcatcactaccatcaccgtcaaccaaagcctgctgtcgccactgaacctcgaggtcgacccaaacattcaggcggtaaggacccaggaggagaagcaaatcaagacacttaataacaaattctttagcttcatcgataaagtgagatttctcgagcagcagaacaaaatgctggaaactaagtggagcctagtacagcaacagaaaatggctagatctaacatggacaatatgttcgagagctatattaataatctgaagtggcagctggaaacgctcggccaagaaaagctgaagctcgaagctgagcttggaaatatgcatggtctggtggaagattttcggaataaatacgaagtggagataagcaaatgtacagagatggagaacgagtttgtcctcatcaaagagtacgtggacgaagcatatatgaataaaatggaacttgaatcatctctgaaagagcttaccgcaaaaataagtttcctgagacagttatatgaagaagaaattggcagttgctccccccgttctcgcattcacttatggtgctgctcctggaccaccgcagcttcgtggacttggacggcttcctcgctccgatcacgacctgagggttttcccggtggatgtcatgctgatacagagcaacgaggggagttggcaatcaaagacgcaaatgccaaactgagcgaactggaggccgccctccagttagccagtcaagatatggcacggcagctgagggagtaccaggagctgatgaatgtgaaactggcactggacatcaagatcgcaacctatcggaaactcctggagggggaggaaagctggctggagtccggaatgcagaatatgtcaatacacatgaagacaactagctcttatgcgggggggcagagcctcgcatacggaggactaacttctcctggtttatcatatggcctgggttcttcttttgggagcggaatgggctcttcgtcattctcacatacctcgagctccagggcagtggtgatgaagaagatcgagaccagggatggcaaactcgtctcagaaagctccaatgtccttcccaacctgcgaattacagccaccctcctcacatcagtattcgacaactctatcaaaacttttggtgttattgagtctgaccctttcgattgggaaaaaactggaaatgatggctccctcaccaccactacaaccagtaccacccctcagctccacacacggctgactcccgccgcaatcggaatagcgaacgctacgccaatcccaggggatctgctgcgcgaaaacacagacgaagtgtttcctgatgagcagttgtccgatggcgaaaatggcatccctgtgggcgtcagtccagacaagctccccggatcccttggccaccctcggccgcaggagaaggatgtatgggaggaaatggatgcaaacaagaacaagatcaaactggggatctgtaaagccgcgacagaagaagaaaattcccacgggcaagctaatggtttgctgaacgcacccagtctcggaagtcctatacgagtcaggtcggagattacccagcccgaccgagatatccccctggtgcgcaaacttaggtctattcatagcttcgagttggaaaagcgcttgacactggaacccaagcccgatacagacaagttcctggagacctgtctcgagaaaatgcagaaagacacttctgctggtaaggagagcatcctgccagcccttctccataaaccatgcgtacctgcagtcagcaggaccgatcatatatggcattatgatgaggaatacctacctgatgcgtctaaaccggccagcgccaacacaccggagcaagctgacgggggtgggagcaacggctttatcgccgtcaacctgagttcctgtaaacaggagatagatagtaaggagtgggttatcgtggacaaggagcaggatctgcaagactttagaactaatgaggccgtcgggcataaaactaccggaagtccctccgacgaggagcctgaggtgctgcaggtgcttgaagcctccccgcaagatgagaaactgcaattaggcccgtgggcggagaacgaccacctcaagaaggagaccagcggcgttgtgctggcactgagcgctgagggacctcccaccgcagcgagcgagcaatacacagatcgcttggaattacaaccaggagccgcaagccagtttattgccgccaccccaacttccctaatggaagcccaggcggagggcccacttacagccatcactataccccggccatccgtggcaagcacccagtctacgtcaggttctttccactgcggacagcagcccgaaaagaaggaccttcagcctatggagcctacagtagagctttactccccgcgagagaatttttccggcctcgtggtgactgaaggcgagccaccctcggggggaagcagaaccgatctaggtttgcagattgatcatattggacatgatatgctcccaaacattcgtgaaagtaataagtcccaagatctcggccccaaggaactaccggatcataatcgcctggtcgtgagagagttcgaaaaccttcccggcgagacagaagaaaagagcatcctgttggagagtgacaacgaagacgagaaactgagtcgcggccagcattgcattgagatcagttcactgcccggcgaccttgttattgtcgagaaagatcactcagccactacagaacctttagatgtgacgaaaacccagacattcagcgtggtgccaaatcaggacaaaaataatgagataatgaagctactcacagtgggtacttctgagatttcctcccgagatatcgatccccatgttgaaggccagatcgggcaggtggccgaaatgcagaaaaacaagataagcaaggacgacgacattatgtcagaagacttgccgggccaccagggcgacttgtcgacgttcctgcaccaagaaggaaaacgcgagaagatcacacctagaaatggtgagttgtttcattgcgtaagcgagaatgagcacggtgctcccactaggaaagatatggttcggtctagtttcgtcaccaggcacagccgaatcccagtcctggctcaggagatcgacagtactttggaatcctcatcccccgtgagcgcgaaagaaaagctgcttcaaaaaaaagcttatcaaccagatctcgtcaagctgttagtggagaagagacaatttaaatcatttctgggcgatctcagcagcgcttctgacaaattgctcgaggagaaactcgctaccgtgcctgccccattctgcgaggaagaggtgttaacacctttctcacggctcacagtggatagtcatctctcccgcagcgccgaggattctttcctttctcctatcatctcacaaagcagaaagtccaaaataccccgccctgtgtcctgggtcaatacagatcaagtaaactcatcgacatctagtcaattctttccaagaccaccacccggcaaaccaccaacaaggcctggcgtcgaggcccgactgcgacgctacaaggttttaggctcgtctaacagtgattcggatttgttctccagacttgcacagattctccagaacggttcccagaaacccagatccaccacccagtgtaagagtccaggaagtcctcacaacccaaagactccccccaaaagtcccgtggtacccagacgatcaccttcagcctcacctcggtcaagcagcctgccacgcacctcctcatcgtcacctagtagggctggtaggccacaccacgatcagcgatcttcgtctccacatctcggcagaagtaaatcaccaccttctcattctgggtcgtccagttctagacgtagttgccagcaggagcattgtaagccgtctaaaaatggccttaaaggcagcggcagtctccatcatcatagtgcgtccaccaaaactccgcagggcaagtccaagccagccagcaaactctctcggtag

SEQ ID NO: 208106 - DNA, 3735 bp, Artificial Sequence
  Description of Artificial Sequence: Synthetic coding sequence
atgagcggcggcggcgagcagctggacatcctgagcgtgggcatccttgtgaaagaaagatggaaagttctgagaaagatcggaggaggaggctttggagagatatacgatgctctggatatgttaaccagagagaatgtggccctcaaggtcgaaagcgctcaacagccaaagcaagttttgaaaatggaagtcgcagtcttgaagaaactccagggaaaggatcacgtttgtcgtttcattggctgcggcaggaacgatcgcttcaattacgttgtaatgcaactgcaggggagaaatctggcggatctccgaagaagccaaagccggggaaccttcacaatctccacaacactaagattgggccgtcagatcctggagtcaatcgagagtattcactccgtggggtttctgcatagagacattaaaccatcgaactttgctatgggtcgctttccaagcacctgtcgcaaatgttacatgctggatttcgggctggctcggcagttcaccaatagctgtggcgatgtccgacctccccgggccgtcgcagggtttcgaggaactgtgcggtacgctagcatcaatgcacacagaaaccgcgaaatgggccgacatgatgacctgtggagtttgttctacatgctagtagaattcgttgtcggccagctgccgtggagaaaaattaaagacaaggagcaggtcggcagcatcaaggagcgatacgatcataggctgatgctcaagcacctgcctcccgagttttctatctttctggaccatatttcctcactcgactatttcacaaaacctgactaccagttgttgactagcgtttttgacaactctatcaagacattcggcgttatagagtcagacccattcgactgggagaagacgggaaatgatggaagcctcacaacaactaccacaagcactacaccccagttgcacactcgcctcacgcccgccgctatcggcatagctaacgctacccccatacctggcgacctgcttagagaaaacactgatgaggtatttcctgacgaacagctgagtgacggcgagaacgggataccggtgggggtcagcccggacaagctgccagggtcacttgggcatcctaggccccaagagaaggacgtttgggaagaaatggacgcaaacaagaataaaatcaagttggggatttgcaaggccgcaactgaagaagaaaacagtcacgggcaggcaaatggcctgctaaacgccccctcactgggctcaccaatacgggtgcgctccgaaattactcagcccgaccgagatatcccacttgtccgtaagctcaggtcaatccattcattcgaactggaaaagcgactgacactcgaacccaagcctgacacggacaagtttctcgagacctgtcttgagaaaatgcagaaggatacctccgcggggaaggaaagcatactgcctgcgctgcttcacaagccctgcgtgcctgccgtaagccgtacagaccacatatggcactacgacgaggaatacctgccagacgcgagcaagcctgcatcagccaacactccagagcaggctgatgggggcggaagtaatggcttcatagccgtaaacttatcctcttgtaagcaggagatcgactcaaaagaatgggtcattgtggataaggagcaggacttgcaggattttcggactaacgaagcggtgggccacaagacaactggttctccctccgacgaagaaccagaggtgttgcaggtgctcgaggcctctccccaggatgagaagctgcagctcggaccatgggcggagaatgaccatctgaaaaaggagacttctggcgtggtgctggcactctcagctgagggaccgcccaccgcggcaagtgagcagtacaccgacagactcgaactccagcctggtgccgcttctcagtttatagccgctactcctacgagtctgatggaggcccaggccgaagggcccctgaccgcaatcaccatcccgcgcccatccgtagcaagtacccagtccaccagcggctctttccattgtggccaacagcccgagaagaaggatctgcagcccatggagccaactgttgaactctactcgcccagggaaaacttctctgggctcgtggtgaccgaaggcgaaccccccagcgggggaagccgcaccgatctagggctgcaaattgatcacattggccacgacatgctacctaacatcagggagagcaataagagtcaggacctgggccctaaagaactgcccgaccataacaggctggtcgtgcgtgaattcgagaatctccctggtgaaacagaggagaagtctattcttctcgagtcagataatgaggacgagaagctgtcccgcggacaacattgcattgagatctcctccctcccaggcgacttagtgatcgttgaaaaagatcacagcgcgacgaccgagccattggacgtgacaaaaacgcaaactttctccgtcgtcccaaatcaggataagaataacgaaattatgaaactgctcacagttggcacttccgagataagttctcgcgacatcgacccgcatgttgagggccagatcgggcaggttgcggagatgcagaaaaacaagatatcaaaggacgatgatatcatgtctgaagacctgcctggccatcagggcgacctgtcaacctttttacatcaagaaggtaagagggagaagatcacaccccgtaacggggaactattccattgcgtgagcgagaatgagcatggagccccaacaaggaaagacatggttcgaagctccttcgtgaccaggcacagccggattcctgtcctagcacaggagattgactccacgctggagagctcaagcccggtgtccgctaaggagaagctgctgcagaagaaggcctaccagcctgatctggtgaaactgttagtagaaaagcgtcagtttaagtcgtttttgggagatctaagttctgcttcggacaagctgctcgaggaaaagcttgccacagttcctgccccattctgcgaagaggaggtgctgacgcccttcagccgtctgaccgtggacagccacctgagcagatcagcagaggatagcttcttgtcaccgatcatctcgcaaagccgcaagagtaaaataccccggcctgtatcatgggttaacacggatcaagttaattcctcaacctcatcacagttcttccccagaccgccgccaggtaagccccctacccgcccaggggttgaggcccgactgcgaagatataaggtcctgggatcttctaactccgactcagacttgttttcacgcctcgcacaaattcttcaaaacggttctcagaaaccccggagtactacacagtgcaagtcccccgggtcaccacataacccgaagacaccacctaaatcccctgtagttccaagacgcagcccaagtgcaagccccaggtcctcatccctcccgcggacatcctcgtcctctccgagccgtgcagggagacctcatcacgatcagcggtccagtagcccccatcttggccggtccaagagcccgcccagtcacagtggttcctcatcctcaaggagaagctgccagcaagaacactgtaagccttccaaaaacggactcaaggggagtggcagtctccaccaccactcagcatcaaccaagacaccacagggcaagagcaagccagcatccaagctgtcaagatag

SEQ ID NO: 208107 - DNA, 3525 bp, Artificial Sequence
  Description of Artificial Sequence: Synthetic coding sequence
gagcccggcaaggaccacgtgtgccggttcatcggctgcggccggaacgacaggttcaattacgtggttatgcagctccagggacgtaacctggcggatctgagaaggagccagtccaggggaactttcacgatttccactaccctgcgtctcgggcggcagattctcgaatccatagagtccattcactcagtcggatttctgcacagggacatcaaaccctccaatttcgcgatgggaagatttccttcgacctgccggaagtgctacatgctcgacttcggcttggccagacagtttaccaattcctgcggcgacgtcaggcccccccgagctgtagcggggtttagaggcacggtgagatacgctagcatcaacgcacatagaaatcgtgagatgggaagacatgatgacttgtggtctctcttttacatgctcgtcgagtttgtggtgggccagctgccttggcggaaaattaaggataaagagcaggtgggatctattaaagagagatacgaccatcgattgatgctgaagcatctcccgcctgaattctcaatttttctggatcacatttcctctctggactattttaccaagcctgactaccagcttctaacttcagtatttgataattctattaagacttttggagtgattgagtcagacccttttgactgggagaagacggggaatgacggaagtctcaccacaactaccacttcaaccacaccccagctacacacgagactgacacccgcggccattggaatagctaacgccacacctattcccggcgatctgctgcgggagaatactgacgaagtgttcccggatgaacagctttccgatggcgagaacgggatacccgtcggggtctcccctgataagctccccggctcactcggtcatccacgccctcaggaaaaggatgtgtgggaggaaatggatgccaataagaataagataaagttagggatatgtaaagctgcaactgaggaagagaactcccacggccaagccaacggcctgttaaatgctccttcactaggatcacccattagggtacgatccgagattactcaacctgatcgtgatattcctttggttcggaaactgaggtcaatacactcttttgagctggaaaagcgccttactctggaacctaagccagataccgacaagtttctggagacatgcctggaaaaaatgcagaaggatacctctgcaggcaaggaaagcattctgcccgccctgctgcacaagccctgcgttccggccgtctccaggactgatcatatctggcattatgacgaagagtacctcccagacgcgagtaagccggccagtgccaatacacctgaacaggcggacggcggtgggagcaacgggttcatagcggtcaaccttagcagctgcaaacaagagatagattccaaagaatgggtgatcgtggataaggagcaagatctgcaagacttccggaccaacgaggctgtcgggcacaagaccacaggaagtccttcggacgaggagcctgaagtgctgcaagttctagaagcaagtccacaggacgagaagcttcaattgggaccctgggctgaaaacgatcatcttaagaaggaaacctccggagttgtgcttgctttgtcggctgagggcccacccactgctgcctcagaacaatacaccgacaggctggaactgcagcccggtgcggcaagtcagtttatagccgccacacctactagcctgatggaagcacaagccgagggaccactcaccgccatcacgattccccgccccagcgttgcaagtacccagagcacctccggaagcttccactgcggtcagcagcccgaaaagaaggatcttcaacctatggagcctacagttgagctgtactcaccacgggagaactttagtgggttagtggtgactgagggagaaccaccatctggtggcagccgcacagatctgggactgcagatcgaccacattgggcacgacatgctcccaaatattcgggagtcgaacaaaagccaagacctgggccccaaagaattaccagaccacaatcggttagtcgtgcgagagtttgagaaccttccaggagagacagaagaaaaatccatcctgctcgaaagcgacaatgaagacgaaaagctctcacggggacagcactgtatcgagatttcatctctgccaggagaccttgttatcgtggaaaaggaccactctgctacgactgaacctttggatgtcacaaaaacacagacgttctctgtcgtacctaatcaagataagaacaatgaaatcatgaaacttctgaccgtggggacctcagagatatcaagtcgcgacatagacccccacgtcgaaggacaaattggtcaggtcgccgagatgcagaagaacaagatctcaaaggacgatgacattatgtccgaagatcttccaggacatcagggggacttgagtacctttctacaccaagagggcaagcgggaaaaaatcactcctaggaatggagaactgttccactgtgttagtgaaaacgagcacggggccccgacccgcaaagatatggtacggagtagcttcgtgacccgccactcccggattcccgtactggcgcaggagatagactccactcttgagagctctagccccgtgagcgctaaggaaaagctgctccaaaagaaggcatatcagcctgatttagtgaagctgctggtcgaaaagcgacagtttaagagtttcctaggggacctgtccagtgcctccgacaagctgctcgaagagaagctagccacagttccagccccattttgtgaagaggaagtcttaacccccttctcacgactgactgtggactcccatcttagtaggagcgcggaggattctttcctgtctccaattatcagccagagcaggaagtccaaaatccccaggcctgtttcttgggttaacaccgaccaggtgaactctagtactagcagtcagttttttccacggcccccccccggcaaaccccccacaaggcccggcgtggaggcccgcctgcgtagatataaggttctgggttcctccaactccgacagcgatcttttttcaagattggcccagattctgcagaacggcagccagaaaccacgaagcaccacacagtgcaagagccctggctctccccataatcctaagactcctcctaaatcgcccgttgtgcctcggcgatcaccgagcgccagccctagatcctccagcctgcctcgcacttcatcctcgtctcccagccgggccggacggccacaccacgatcagaggtcctcatcaccccacttaggcaggtccaaaagccctccatctcacagtgggtcctcatcttctaggcgctcctgccagcaggagcactgtaagccttccaagaatgggctgaaggggagcggctccctgcaccatcatagtgcctccactaaaaccccccagggaaagtctaaacctgcctcaaagctgtcccgttag

SEQ ID NO: 208108 - DNA, 2244 bp, Artificial Sequence
  Description of Artificial Sequence: Synthetic coding sequence
atgaccagcttccaggaggtgcccctgcagaccagcaacttcgcccatgtcatctttcagaacgttgccaagtcgtacttaccaaatgcccatctggagtgccattacacattgacaccgtacatccacccacatccaaaagactgggtaggtatctttaaggtggggtggagcaccgcgagagactactatacattcctctggtctccgatgcccgagcactacgtggagggttcaaccgtcaattgcgtgttagcttttcaaggatactatctacccaatgatgacggggagttttatcagttctgttatgtaactcacaagggcgaaataaggggagcttctaccccattccagttccgggcttcaagcccggttgaagagttgctgaccatggaagatgagggaaattcagatatgcttgtcgtcactacaaaggctggccttctcgaactgaagatagaaaaaaccatgaaagaaaaggaggagttactgaaactgattgcagtgctggagaaagagaccgcacagcttcgcgagcaggtgggtcgcatggagcgtgagctaaaccatgagaaggaaaggtgtgatcagctacaggctgaacagaaaggcctgaccgaggtcactcagtcactaaaaatggagaacgaggaattcaagaaaaggttttccgacgctacaagtaaggcccatcagctggaggaggacattgtcagcgtgacccacaaggccattgagaaggaaaccgaactggactcactgaaagacaaacttaagaaagcccagcacgagagggaacagttagagtgtcagctgaagacagaaaaagatgagaaagaactgtacaaggttcatttgaagaacactgaaattgaaaatacaaaactgatgtccgaagtgcagactttaaagaatctcgatgggaacaaggagagcgtcattacgcattttaaagaggaaatcggacgactgcagttgtgcctggcagagaaggagaacctgcagaggactttccttttgacaacctcgtccaaagaggacacgtgctttctcaaggagcaactccggaaagctgaagagcaggtacaggcgacaagacaggaggtcgttttcctggccaaggaactgtccgacgctgtgaatgtccgcgacagaacaatggcagatcttcacacagcccgtctggagaacgaaaaggttaagaagcaattggcggatgcagtggcagaactcaaactgaatgctatgaagaaggaccaggacaagacagacaccttggagcatgagctgagaagagaagtcgaagatttaaagctgcgccttcagatggccgcagatcactacaaggaaaagtttaaggagtgtcagcggctgcagaaacagatcaataagctttccgatcagtcagccaacaacaataacgtgtttaccaaaaaaaccggcaatcaacaaaaggtgaatgatgcctccgtgaacaccgatcccgcgacttccgcctccaccgtcgatgtgaagccttctccatcagcagctgaagcggatttcgacatcgtaactaagggtcaggtgtgcgaaatgaccaaagagatcgcagacaagaccgaaaagtataataagtgcaagcagctgctgcaggacgagaaggccaaatgtaataagtatgcagacgagctagccaaaatggagctaaaatggaaagagcaggtaaagatcgccgaaaacgtaaaattggagctggctgaggtgcaggataattataaagagcttaaaaggtcccttgagaatcccgcggaaagaaaaatggaagacggagctgatggagctttttaccctgacgagattcaacgaccacccgtgcgagttccgtcatgggggctggaggacaatgtggtgtgtagtcagcctgctcgcaatttttccaggcctgacgggctcgaagactccgaggattctaaggaagatgaaaacgtccctactgcccctgaccccccttcgcagcatttacgtgggcacggcacgggcttctgctttgactcgtcattcgacgtgcacaaaaagtgccctctctgtgagctgatgttcccccctaattatgaccagtctaaatttgaggagcacgtcgagtcccattggaaggtgtgccccatgtgttctgagcagtttcctcctgattacgaccagcaagtatttgagcgccatgtacagactcacttcgatcaaaacgtgcttaacttcgactag

SEQ ID NO: 208109 - DNA, 2370 bp, Artificial Sequence
  Description of Artificial Sequence: Synthetic coding sequence
atgaccagcttccaggaggtgcccctgcagaccagcaacttcgcccacgtaatctttcagaacgttgccaagagttaccttcctaatgctcatctcgagtgccactacaccctgaccccctacattcatccacaccccaaagattgggtgggaatctttaaggtgggctggtcaaccgctagagactattatacctttttatggtcgccgatgcccgaacattacgtggaaggttctaccgtaaattgcgtgcttgccttccagggctattacttgcctaatgacgacggggagttttatcaattttgttacgtgacccacaagggcgagatccgcggggcttctactccattccagttcagggcctccagtccagtcgaagaactcctgaccatggaagatgaggggaactctgacatgttggtagtgaccacaaaggccggcctgctcgagctaaagatcgaaaaaaccatgaaagagaaggaagagctgttaaaactcattgcagtgctggaaaaagaaaccgcccagttgcgggaacaggtcggacggatggaacgggagctaaatcatgaaaaagaacggtgtgaccagctccaagctgagcagaaggggttgaccgaagtgactcagtcactgaaaatggagaatgaagaattcaaaaagcggttttctgacgccacatcaaaggcccatcagcttgaggaagatattgtatctgtaacccacaaggcgatcgagaaggaaactgagcttgactctttgaaagacaagcttaagaaagcgcagcatgaaagagagcaacttgaatgtcagctgaaaaccgaaaaagatgaaaaagagctatacaaagtgcacctgaaaaacactgagatcgaaaataccaaactaatgagcgaggtccagacacttaaaaatttggatgggaataaggagagcgttattacacacttcaaggaagagattgggaggctgcagctgtgcctagccgaaaaggaaaatctccagagaacctttctgcttacgacttcctctaaagaggatacttgttttcttaaggagcagttgcgcaaagccgaggaacaggtgcaggccacacgtcaagaagtcgtcttcctggctaaagaactgtcagacgcagtaaatgtgcgtgacaggaccatggcagatttacacacagcccgcttggagaatgagaaggtgaagaaacagctggcagacgcagtagccgaactgaagctgaatgccatgaagaaagatcaggacaagaccgatactttggagcacgagctccggagagaggtggaggacctaaagttacgactgcagatggcagcggatcactacaaggagaaatttaaggagtgtcagcggttacaaaagcagattaataaactgtcagaccaatcggctaacaacaacaatgttttcaccaagaaaacaggcaaccagcagaaggtgaacgacgccagtgtgaatactgatcctgctacttcagctagtactgtcgacgtaaagccttcacctagtgcggcagaagcggactttgacattgtcaccaaggggcaagtttgcgaaatgaccaaagagattgcggacaagacagagaaatacaacaagtgcaagcagttgcttcaggacgagaaggctaaatgcaacaaatatgccgacgagttggccaagatggaactcaagtggaaggagcaggtaaaaatagctgagaacgtcaagctggagctcgctgaagtgcaggataactacaaagagctgaagcgtagtctggagaacccggcagaaaggaagatggagggtcagaactcccagtcacctcagtgctttaagacatgtagtgaacagaatggctatgtcttgacattaagcaatgctcagccagtgctgcaatacgggaatccttacgcatcccaagaaaccagagacggtgccgacggggccttctacccagacgaaattcaacgacctccagtaagggttccctcctgggggctcgaggataacgttgtgtgcagccagccggcccggaacttcagccgaccagacggcctggaggacagcgaagatagcaaggaagatgaaaatgtgccaactgcccccgaccctccgtctcagcatttgcgagggcacggaaccggattctgttttgatagctcttttgatgtgcacaagaagtgcccactatgcgagcttatgtttccacccaactacgatcaatccaaatttgaagaacacgtggaaagccactggaaggtttgtccaatgtgctccgaacagtttcctcctgattacgatcagcaggtgtttgagcgacatgtacagacgcattttgatcagaacgtgctaaatttcgattag

SEQ ID NO: 208110 - DNA, 417 bp, Artificial Sequence
  Description of Artificial Sequence: Synthetic coding sequence
atgaccagcttccaggaggtgcccctgcagaccagcaacttcgcccatgtgatcttccaaaacgtggccaagagctacctcccaaacgcgcacttagagtgccactatactctgactccttacattcatccgcaccctaaagattgggtgggcatcttcaaagtgggctggtcaacggcacgggattactacacgttcctgtggagtccaatgccagaacattacgtggagggctctactgtgaattgtgtgctcgcgtttcaggggtattacttgccaaacgatgatggcgagttctaccagttttgctatgtaactcacaagggcgaaatccgaggagcatccaccccatttcaatttagggcctcctcccccgtggaggagctgcttaccatggaggatgagggtaactcctag

SEQ ID NO: 208111 - DNA, 297 bp, Artificial Sequence
  Description of Artificial Sequence: Synthetic coding sequence
atgaccagcttccaggaggtgcccctgcagaccagcaacttcgcccatgtgatattccagaatgtagccaagagctatttgcccaacgcacatctggagtgccactacactctcaccccctacatccatccccatccaaaggactgggtgggcatttttaaagtcggatggtcaactgcgcgggactattacacgttcctgtggtctcccatgccagagcattatgtggagggtagcacggtgaattgcgtgttagctttccagggatattatttgccaaacgacgacggcgaatag

SEQ ID NO: 208112 - DNA, 1773 bp, Artificial Sequence
  Description of Artificial Sequence: Synthetic coding sequence
atgaaggagaaggaggagctgctgaagctgatcgccgtgctggagaaggaaactgcccagctgagagagcaggtcggcagaatggagagggaactgaatcatgagaaagagcgttgcgaccagttgcaggcagagcagaaagggctgacagaagtcacacaatctttgaagatggagaacgaagagttcaaaaagagattttccgatgctacttccaaggctcaccaactggaggaggatattgtcagtgtaactcataaggccattgagaaggaaacagagctggatagccttaaagataagctgaagaaagcccagcacgaacgggagcaattggaatgtcaactgaaaactgagaaggacgagaaggagctgtataaggttcaccttaagaatacagagatcgaaaacaccaagcttatgtctgaggtacagaccctcaaaaatctggacggtaacaaggagagcgtaatcactcactttaaagaagaaatcgggcgtctgcaactctgcctggcagaaaaagagaacttacagagaacatttctcctgaccacttcttccaaggaggatacctgtttccttaaagagcagctgaggaaagccgaggagcaggtgcaggccactaggcaggaagtggtgtttctggcgaaagagcttagcgatgccgtgaacgtgagagatagaacaatggcagacctgcacactgcccgcctcgaaaatgaaaaggtgaagaaacaacttgccgacgccgtggctgaactgaaactgaacgccatgaaaaaagatcaagacaagaccgacacactggaacatgagttgcggcgcgaagtggaggatttgaaactaagactgcagatggccgctgaccactacaaggagaagttcaaagagtgccagcgactacagaagcaaattaataaactgtctgaccagtctgcgaacaataacaatgtgttcacaaaaaagaccgggaaccaacagaaggtaaacgatgctagcgtgaatacagacccggcaactagcgctagcacggttgatgtcaagccatctcccagcgcggccgaagccgatttcgatatcgtcactaagggtcaggtgtgtgagatgacgaaggagattgccgataaaacagagaaatacaataagtgtaagcagctcctgcaggacgagaaagcgaagtgcaataaatacgctgacgaactcgccaagatggagttaaagtggaaagagcaagtgaagatcgccgagaatgtcaagctcgaactcgcagaagttcaggataattataaagagctgaagaggtcgctcgaaaaccccgccgagcggaagatggaggacggcgccgatggtgccttttatcccgacgaaattcaacgccccccagtgagagtcccctcttggggtttagaggataatgtagtttgcagtcagccagcaaggaacttcagtcgccctgatgggttggaagactctgaggacagtaaggaggacgagaatgtgccgactgccccggaccctccaagtcagcatctgcgtggccacggtacaggcttttgttttgattccagctttgatgttcataagaaatgcccactgtgtgagctgatgtttccacccaattatgatcaatcgaagttcgaggagcacgtggagtctcattggaaggtctgccccatgtgtagtgaacaattccctcctgactatgaccagcaagtgttcgagcgtcatgttcagacccattttgaccagaacgtactcaatttcgactag

SEQ ID NO: 208113 - DNA, 2244 bp, Artificial Sequence
  Description of Artificial Sequence: Synthetic coding sequence
atgaccagcttccaggaggtgcccctgcagaccagcaacttcgcccatgtgatttttcagaacgtggcaaagagctatctccctaatgcgcaccttgagtgtcattacaccctgacgccctatatccatccacaccccaaggactgggtcggcattttcaaggtgggctggtctacggcgcgagactattataccttcttatggtccccaatgccggagcattatgtggaggggagcactgttaattgtgttcttgcattccaggggtattacctgccaaacgatgatggcgagttttaccaattctgttacgtgactcataagggcgaaattaggggggcatctaccccctttcaattccgggcctccagccccgtcgaggagctgcttaccatggaggatgaaggcaacagcgacatgctagttgtgaccacaaaggccggcttactcgaactcaagattgaaaagactatgaaagagaaagaggaactgctgaagctcatcgccgtcctagagaaagagacggcgcagctacgggaacaggtgggtagaatggagcgagagttgaatcatgaaaaggagagatgcgatcagctacaggctgagcagaaaggcctcactgaggtaacgcagtcactaaagatggaaaacgaggaatttaaaaagcgatttagcgacgccacaagcaaggcccaccagttagaagaggacatagtcagtgttactcataaggctatcgagaaggaaacggagctggacagcctcaaggacaaactgaaaaaagcacaacacgaacgagagcagctggaatgtcagttgaaaaccgaaaaagacgagaaagagctgtataaagtccacctgaaaaacacagaaatcgagaacactaaactgatgagcgaagtgcagaccctgaagaacctggatggcaacaaggaatctgtcattactcatttcaaagaagaaatcgggaggctgcaactatgcctggctgagaaggaaaatcttcagaggactttcttacttacaacttcatcaaaagaggatacatgctttctcaaagaacagctgaggaaagccgaggagcaggtgcaggctactcggcaggaggtggtttttctggccaaggagctatcagacgccgtgaacgttagagaccgcacaatggctgacctccatactgcaaggctggagaatgaaaaggtgaaaaagcaactggcagacgcagttgccgagctcaaacttaacgccatgaagaaggatcaggacaagacggacacacttgagcacgaactgcgccgtgaggttgaggatttgaagctccgactccagatggctgcagaccactacaaagagaaatttaaagaatgccagcggctgcagaaacagattaataaactgagcgatcaatccgctaataataataatgttttcactaagaaaactggcaaccaacagaaggtaaatgatgcgagcgtgaataccgaccccgccacctctgcttcgaccgttgacgtcaagccctctccgtccgccgctgaagccgatttcgatatcgtgaccaagggccaggtgtgcgagatgacgaaagaaattgctgacaagactgagaagtacaataaatgcaaacagctgctgcaggacgagaaagcaaagtgcaacaaatacgccgacgagttagctaaaatggagttaaaatggaaagagcaggtgaagattgccgagaacgtgaagctagaactggccgaagttcaggacaattacaaggagcttaagcggagcttagagaaccccgcagagaggaagatggaagacggggccgacggagccttctatcccgacgaaatacaaaggccacccgtcagggtcccctcttgggggttggaagacaacgtagtgtgctcacaacctgcccggaatttttctcggcctgacggcctagaggacagcgaggatagcaaagaagacgaaaatgtccccacggcccctgatcctccatcacaacatctgagaggacatgggacaggattctgtttcgactcaagcttcgacgtgcacaagaaatgtccgctgtgcgagttgatgttccctcccaactacgatcaatcgaaatttgaggaacacgtagaatcacattggaaagtttgccccatgtgctcggaacagttccccccagattatgaccaacaggtgtttgaacgacacgtgcaaacacattttgatcagaatgtcctgaattttgactag

SEQ ID NO: 208114 - DNA, 3480 bp, Artificial Sequence
  Description of Artificial Sequence: Synthetic coding sequence
atggagcccatcaccttcaccgcccggaagcacctgctgagcaacgaagtgagtgttgacttcggactgcaactggtggggtcattgccggttcactcacttactaccatgccgatgctcccttgggttgtggccgaggtgcggaggctgagtagacaatcaacccgtaaggaaccagttacaaaacaagtgcggttgtgtgtcagccccagtgggttaagatgtgagccagagccgggtcgtagccaacagtgggacccactgatttactcttccatttttgaatgcaaacctcaacgggtgcacaagctaatacataattcccatgatccctcctatttcgcttgcctcattaaagaggacgccgtgcatcgacagtctatttgctatgtgtttaaggcagacgaccagacaaaagttcccgagattataagcagtattcggcaggcaggtaagatagcccggcaggaggagcttcattgcccaagcgagttcgacgatacattttcgaagaagtttgaggtgttgttttgcgggcgcgtgactgttgctcacaagaaagcaccacctgcacttattgatgaatgtattgaaaaattcaatcacgttagcggatctcgcggctccgagagcccccggcctaatccgccacacgccgccccaaccgggtctcaggagcccgtgagacgaccgatgagaaaatcgttctcccagccaggacttcggagcctggcgttccgtaaggagctgcaagacggcggcttgcggagcagtggctttttctccagttttgaggagagcgacatcgagaaccatctgattagcgggcacaatatagttcagcccacagacatagaggagaacagaaccatgctatttaccattgggcagagtgaagtttatctgatctccccagacaccaagaaaattgctctcgagaagaactttaaggagatatcattttgtagccagggcatccgacacgtagaccacttcggctttatctgtagagagagcagcggcggcgggggattccattttgtgtgctacgtgttccagtgcaccaatgaggcactcgtggacgaaataatgatgactttgaaacaggcttttactgttgccgccgtgcagcagacagccaaggcacccgctcagctgtgtgaaggatgtccccttcagagcctgcataagctgtgtgaaagaattgagggtatgaattccagcaagaccaagctggagctccaaaagcatcttacaacacttaccaatcaagaacaggctactatctttgaggaagtgcagaagctgagaccccgaaatgaacagcgggaaaatgagctgatcatctcattcctcaggtgcttgtacgaggagaagcagaaggagcacattcatatcggtgaaatgaaacagacatcacaaatggccgccgaaaacattggaagcgagctccctcccagcgcaacacgcttcagattggacatgttgaaaaataaagccaaaagaagcctaaccgagagtttagagtccatcctgagtcgtggaaacaaagctagggggctacaggaacacagcatatcagttgacttggacagctccctgtcttctacgttaagtaatacgtcaaaagagcccagtgtatgcgaaaaagaagctctgccaatctcagaaagctcctttaagctgctgggcagctctgaggacctgtcatctgactccgaaagtcacttgcctgaggagccagccccacttagcccacagcaagcctttcggcggagggctaatacgctgtcccattttcccatcgaatgccaagaaccccctcagcctgcaaggggaagcccaggtgtaagtcagcggaaacttatgaggtatcatagcgtctcaaccgagactccccacgagcggaacgtggacccttcgccggtgggcgaaagcaaacacagacccgggcagtcctcagctcccgctcccccccccaggctaaaccctagcgcaagctctcccaacttttttaaatatctgaagcataattcttctggtgaacagtccgggaatgctgttccaaagagtatttcatatcgaaatgcactgcgtaagaaattgcactcatcttcgagtgtgccgaattttctcaagtttctcgccccagtggacgaaaataacacatctgatttcatgaacaccaagagagactttgagtccaaagcaaaccacttgggagactctggcgggactcctgtaaagacccgcaggcactcttggaggcaacagatattcctgcgggtcgccacacctcaaaaggcttgcgacagttcttctcgctatgaagattattcggagctgggagaactgccccccaggagtccattggaacccgtttgcgaagatggccccttcggtccgccacctgaagagaaaaagcgaacatctcgcgaactacgcgagttatggcagaaggcgatcctccaacagatcttgcttttgaggatggaaaaagaaaatcagaagctacaggcctctgagaacgacctgctgaataagcgactgaagctggattatgaggagattacaccatgcttgaaggaggtcacgaccgtctgggagaagatgttatcgacacctggaagatctaagatcaagttcgacatggagaagatgcactcagccgtggggcagggagtgcctcgtcatcatcgcggggaaatttggaagtttctggcagagcagtttcacttaaagcatcagtttcctagtaaacagcagcctaaggatgtaccttacaaagagctgctcaagcagttgacgagtcagcagcacgcaattctgattgacctgggcaggacctttcccacccacccctacttttccgctcagctcggcgccgggcagctatcactgtacaatattcttaaggcttactcactgttggaccaggaggtggggtactgtcaggggctgtccttcgtggccggcattctcctgctgcatatgagtgaagaggaggctttcaaaatgctgaagtttttgatgttcgacatgggcctgcggaaacagtatcgtccagacatgataattctacagatggagaagacaatcaaccaggttttcgagatggatattgctaagcagctccaggcctacgaagtagagtaccatgtgctgcaggaggagctcatcgactcttcacccctgtcagataaccaacggatggataagctcgagaagacgaattcctccttacgcaagcagaatcttgatctcctcgagcagttgcaggtagcaaatggtaggatccaatcactcgaggccactatcgaaaaactgctgtcctccgaatccaagctcaagcaggcaatgctgacgctggaattggagcggtccgctctgctgcaaacggttgaggagttgcgcaggcggagtgccgagcctagcgaccgcgaaccagaatgcacacagccagagccgactggggattag

SEQ ID NO: 208115 - DNA, 3507 bp, Artificial Sequence
  Description of Artificial Sequence: Synthetic coding sequence
atggagcccatcaccttcaccgcccggaagcacctgctgagcaacgaggtgtccgtcgattttggattgcagctggttggcagtctgccagtgcacagcctgactaccatgccaatgctcccctgggtggtggccgaggtacgacggctgtcgagacaaagtaccagaaaggagccggtgacaaaacaggtcagactctgtgtatctcctagcggcttaagatgtgaacccgagccgggccggtcacagcaatgggaccctctgatttacagctccatctttgagtgcaagcctcagagagttcacaagttgatacacaactcccacgatcctagttacttcgcatgtctgatcaaagaagatgcagttcaccgccagagtatctgctatgtgtttaaagcagatgatcagaccaaagtgccagagataatttcatccatacggcaggctgggaagattgcaaggcaagaggaactgcactgccctagcgagttcgatgacacgtttagcaagaagtttgaggtgctcttttgcggtagagtcaccgtcgcccacaaaaaggccccccctgcactaatagatgagtgcattgagaagtttaaccacgtgtctggttcacgaggttccgagtcacctagaccgaatcccccccacgctgcacctacgggcagccaagagccagtcagacgtccgatgcgcaagtccttctcccaacctgggctgaggtccctggccttcagaaaggagctgcaagatggaggcctacgctcaagcggattcttcagtagcttcgaagagtctgacatcgagaaccatttgatttcaggccacaatattgtgcagccgaccgacattgaggagaacagaactatgctattcactattggccagtcagaggtatatctgatttcgccggacaccaaaaaaattgccctagagaaaaacttcaaagagatctctttttgcagccagggcatcaggcatgttgatcatttcggattcatatgtcgggagagcagcggcggaggcggatttcacttcgtgtgctacgtcttccagtgtacaaatgaagccctcgtggatgaaattatgatgacgcttaaacaggcgtttacagtcgccgcagtgcaacagactgccaaggcacccgcccagctgtgtgagggatgccccttgcaatcacttcacaagttgtgtgaacgcatcgagggtatgaacagttccaagacaaaactcgaactgcagaagcacttgactactttaacaaaccaagagcaggctacaatatttgaggaagtgcagaagctaaggccgcggaatgaacagagggagaatgaactcattataagtttcttacgatgcctatatgaggagaaacagaaggaacacatacacattggcgagatgaaacagacaagtcaaatggcagccgaaaacatcggctctgagctaccacccagcgccaccaggtttaggctggatatgctcaagaataaagccaagcggtccttgactgagtccctcgaatctatactgagtaggggtaacaaggctcgcggtctgcaggagcatagcatctccgtggacttggattcttccttgagcagcaccctttcaaatactagtaaggagccgtccgtttgtgaaaaagaagcccttcccatatcagagtcttccttcaagctgcttggcagctccgaggatctcagctccgatagcgagagccatttgccagaggagcccgccccgctgtcacctcagcaggcttttcgccggagggccaataccctctcacattttccaatcgagtgtcaggagccgcctcagccggccagaggaagtcccggagtgagccagcgaaagctgatgaggtatcacagcgtttccacagaaaccccacacgagcgaaaggatttcgagtctaaagcaaaccacctgggcgattcaggcggcacacctgtgaaaaccagacggcacagttggagacagcagatcttcctccgtgtcgccacccctcagaaggcctgcgactcctcttcccggtacgaggactacagcgaactgggcgagcttcctcccagatctcctctggaacccgtgtgcgaggacggacccttcggtccgcccccagaagagaagaagcggactagccgggagctcagagagctatggcagaaagctattctccagcaaattctgttgctgagaatggaaaaggagaaccagaaacttcaagccagtgagaacgatctattgaacaagcgccttaagctagactacgaagagattactccctgtcttaaggaagtgactaccgtgtgggaaaagatgctgtccactcctggaagaagtaagatcaaatttgacatggagaaaatgcacagcgcagttggccaaggggtacctcgccaccaccgcggcgaaatctggaaatttctggccgagcaatttcacctgaaacatcagtttcctagcaaacagcagcccaaggacgtaccctacaaagagcttcttaagcagctcacgtctcaacagcacgctattctcatcgatctgggcagaacctttccaactcacccatatttttccgcccagttaggcgccggtcagctgtctctttataacatcctaaaagcatactcccttctcgatcaggaggtgggatactgtcaggggttaagcttcgttgccggaatcctattgctacatatgtccgaggaggaggcattcaagatgctgaagttccttatgtttgacatggggctgcgcaagcaatacagaccagatatgatcatcctgcagatccagatgtaccagctcagtcggcttctgcacgactaccaccgcgacctgtacaaccacctcgaagagcacgagatcggtcccagcctgtatgcagccccgtggtttctcaccatgtttgcctcccagttcccgcttggttttgtggctagagtttttgatatgatcttcctgcaaggtacagaagtgatatttaaagttgcactctccttgctgggatcgcacaaacccctgatactgcaacacgagaacctagagaccatcgtcgattttatcaagagcacactgccaaatctcggcctggtacagatggagaagaccatcaaccaggtgttcgaaatggatattgcaaagcaattgcaggcctacgaggtggagtatcacgtcttacaggaagagcttatcgattccagccctctcagcgataaccagagaatggacaaactggaaaagaccaattcctcccttcgaaaacagaaccttgatttgctggaacagttgcaggtggctaatggacgtatccagagcctggaggctacaatagagaagctgttaagctctgagagcaagctgaaacaggccatgttaactctggagctggagcggagtgccctcttacagactgtcgaagagctacgccggcgatccgctgagccctcggatcgggagccggaatgcacccagcccgaacccacaggagattag

SEQ ID NO: 208116 - DNA, 1299 bp, Artificial Sequence
  Description of Artificial Sequence: Synthetic coding sequence
atggagaaggagaaccagaagctgcaggccagcgagaacgacctgctcaataaacggctcaagctagattacgaagagatcacgccatgtctcaaggaagtgaccactgtctgggagaaaatgctatccaccccgggtaggtctaagattaaattcgacatggagaaaatgcattcagctgtgggacagggagtgccaaggcaccaccgtggcgagatctggaaatttctggccgagcagttccatctaaaacatcagtttcctagcaagcagcagccgaaggatgtgccctacaaggaactgctgaagcagttaaccagccagcagcacgctatcttgatcgacctgggccgtacatttcccacacacccctacttctctgcgcaactgggtgccggacagctcagcctgtacaatattctgaaggcatatagtctgctggaccaagaagttggctattgtcagggtctgtcctttgtggcagggatcctgttacttcacatgagcgaggaggaagctttcaaaatgttgaagtttttgatgtttgatatgggactgcgcaaacaatatcgacctgacatgatcatacttcaaattcagatgtaccagctttcgcgcctgcttcacgactatcaccgtgatctgtataatcaccttgaggaacacgagatcggcccctctctgtacgctgccccttggttcttaaccatgttcgccagccaatttccgttggggttcgtagcccgggtgtttgacatgatcttcttgcagggaaccgaggtcatcttcaaagttgctctttctcttctaggttcccacaagccgctgatactacagcatgaaaacctagaaacgatcgtggacttcattaagtccaccctgcccaatctcggcctcgttcagatggagaagaccatcaaccaggtgttcgagatggacatagccaaacagctccaggcatatgaagtcgaataccacgtcttgcaggaggaactgatcgattccagtccgttgagcgacaaccagagaatggataagttggaaaagacaaatagtagccttcggaaacaaaatttggaccttctagagcaactgcaggtcgccaatggccgaatccagtcgctcgaggcaacaattgaaaaactgctcagctcggaatctaagttgaagcaggctatgctgactttggagctggagaggagcgctctcctgcagacagtggaagaactgcgccggcggtccgctgagccttcagaccgggaacctgagtgtacccaacccgaacccaccggggattag

SEQ ID NO: 208117 - DNA, 933 bp, Artificial Sequence
  Description of Artificial Sequence: Synthetic coding sequence
atggcccaggccctgggcgaggacctggtgcagccccccgagctgcaggacgacagcagcagtctgggatcagattcggagttatcagggccagggccttacaggcaggcggatcgatatggctttattgggggtagcagcgctgagcccggcccaggccacccaccagcagacctcattagacaacgcgagatgaaatgggtggaaatgacctcacactgggagaaaacaatgtcacgccggtataagaaggtaaaaatgcaatgccgcaaaggcataccctcggcactgcgagcacggtgctggccgctcttgtgtggtgcgcatgtatgccaaaagaacagccctggtacctaccaggaactggctgaggctccgggcgatcctcagtggatggagaccattggacgagacttgcaccgccagtttcctcttcacgaaatgttcgtatccccgcagggccatggaaggggctcatgtcgctgttcgcgccccaccccttgcatagaccgctctagagcaaccgcgcgcccgcggggtccttggttattatgttgctcgtgcacctgtccacagaggagacccagtggtgcatggtgccgatcagtgcgcagcacttctctgggtacaactggccccacatggtgtcaaagtacagtgccttgcggggcggatactggagccccaggcgccggccattgccgggcagccagggggctaccttggccacctggggataccggctcgccctcgtcccacccccccagggctgctgctgggggcggattgcatgtgacaggggcccagaggggagccgtccgggccggtccggctgcaggggatcaaggtcctgcgggacccgcagcaagattccgagctggcacacccgcaccagctactggtcctcctagacgaggccccagccatctctag

SEQ ID NO: 208118 - DNA, 1662 bp, Artificial Sequence
  Description of Artificial Sequence: Synthetic coding sequence
atggacagccccggctacaactgcttcgtggacaaggacaagatggatgccgccattcaggacttggggcctaaagaactctcctgtaccgagctgcaagaactgaaacagctcgcccggcaggggtactgggcccaaagccacgctttgcgtggaaaagtttatcagcggctaattagagacatcccctgcagaaccgtgactcctgacgctagtgtctactctgacatcgtgggcaaaatagtgggcaagcactcatctagctgcctgccactgccggagttcgtggacaatacccaggttcccagctactgcttgaatgccagaggagaaggagcagtccgaaagatacttttgtgtcttgcaaaccagttccctgatatatctttctgtccggccctccctgccgttgtcgccctcctgcttcactattccatcgacgaagctgagtgttttgagaaagcatgtcggatccttgcatgtaatgatcctggacggaggctcatcgaccagtcatttcttgccttcgaatcctcatgtatgacgttcggtgacttggtgaacaaatattgccaggctgcacacaaactgatggtagctgtctccgaagacgtgctgcaggtgtatgcggactggcagcgctggctgttcggcgagttaccactgtgctactttgcaagagtgttcgacgttttcctggtggaaggatataaggtcttatatcgtgtagccctcgctattctcaagttctttcacaaggtgcgcgccggtcagccacttgagtccgacagtgtgaaacaggacatcaggacctttgtgagagatatcgctaaaacggtgagtccagagaaactgctcgagaaggctttcgcgatccggcttttttctcgtaaagaaatccagctcctacagatggctaatgagaaagccctgaagcagaaggggatcactgttaagcagaaacgacagttcgtccatctggccgtgcacgccgaaaacttccgcagcgaaatcgtctccgttcgcgaaatgagggatatctggtcctgggtcccagaacggttcgctctgtgccaacccctgttgttgttcagctcactgcagcacgggtactctttggcacggttctactttcagtgcgaaggacacgaacctacacttttactgatcaaaacaacccagaaagaagtgtgcggcgcatacttaagcaccgactggtctgagaggaacaaattcggcggaaagttggggtttttcggcacgggtgaatgttttgtttttaggctacagccggaggtccagcggtatgagtgggtggtgatcaagcatccagagttgacaaaacctccgccattaatggccgctgagcctaccgcaccattgagccacagtgcctcaagcgaccctgccgaccggctcagccctttcctcgccgctagacattttaatttaccttcaaagactgagtcgatgtttatggcagggggatctgattgccttatcgtcggaggggggggggggcaagccctgtacatagacggtgacctgaacaggggcagaacatcccattgcgacacattcaacaaccagccgttgtgctcggaaaattttctgatcgcagctgtggaggcttgggggtttcaggaccccgacactcagtag

SEQ ID NO: 208119 - DNA, 759 bp, Artificial Sequence
  Description of Artificial Sequence: Synthetic coding sequence
atgggcgtgctgctgacccagcggaccctgctgagcctggtgctggcactcttatttccttccatggcctctatggcagccatcgggagctgtagcaaagaatacagagttttactggggcagctgcaaaaacaaacagatctcatgcaagacacttcccgcctgctagatccgtatattcggatccagggcctcgatgtacctaagctacgggagcactgccgggagaggcccggcgcatttccaagtgaagagaccctccgaggattgggcagacgcggcttcctgcagacactaaacgcgaccttggggtgtgtgcttcaccggttagctgatctggagcagcgcctcccaaaggctcaggatcttgagaggtctggcctcaatattgaagacttggaaaagctccagatggcccgcccaaacatcctcggtctacgaaataatatctactgtatggcacaattacttgacaacagcgacaccgccgagcctaccaaggctggtcggggggctagccaacctccaactcctacacccgcctcagacgcatttcagagaaaactagaagggtgccgctttctccacgggtaccatcgcttcatgcactctgtgggtagagtttttagcaagtggggcgagagtcccaaccgatctagacggcattcaccccaccaagccttgcgcaaaggtgtccgccgcactagaccctctaggaaaggtaaaagactcatgactcgcggacaactgccaagatag

SEQ ID NO: 208120 - DNA, 1263 bp, Artificial Sequence
  Description of Artificial Sequence: Synthetic coding sequence
atgctgaacaactgggacaagtggatggccaagaagcacaagaagatacgtctccgctgtcagaaaggcatacccccaagccttaggggcagagcatggcagtatttgtccggggggaaagtaaaattacagcagaacccggggaaatttgatgaactagacatgtccccgggcgacccaaaatggctcgatgtcatcgagcgggatctccacaggcagttccctttccacgagatgttcgtgtccaggggcgggcatgggcagcaagacctgttccgggtactgaaggcctatactctgtacagaccagaggagggctattgccaggctcaggccccaatagcagctgtgcttcttatgcacatgcctgcagaacaggctttctggtgtttggtacagatttgtgaaaagtacttgccgggttattactccgaaaaacttgaagctatccagctggacggagaaatcttgttctctctgctccagaaggtgtcccccgtggcccacaagcacctctctaggcaaaagattgacccactgctgtacatgaccgaatggtttatgtgcgcgttttccagaactctcccctggagtagcgtgctgagggtttgggacatgttcttctgcgagggcgtaaagattatatttcgcgtcggattggttctcctgaaacatgcactggggagcccggagaaagtgaaggcctgtcaaggccagtatgaaacgatagagcggctgaggtccctgtctccaaaaatcatgcaggaagcatttttggtgcaggaggtggttgaactgccagtgaccgaacggcagatcgagagagagcatttaatccaattgaggcgatggcaggagaccaggggggagcttcaatgtagatcccccccaaggctgcacggtgccaaggctatccttgatgctgagcctggccctcgacccgccctccagccttcacccagtatccgcctccccctcgatgccccgctgccaggaagcaaagcgaaacctaaaccacctaagcaggctcagaaagagcagaggaagcaaatgaagggccgcgggcagctggagaaaccacccgccccaaatcaggctatggtggtggccgccgcaggagacgcctgtcccccacagcatgtgcctccaaaagactctgcacctaaagacagcgcaccccaggatcttgctccccaggtcagcgctcatcatagatcgcaggaaagtctaacatcacaggaatcagaggatacctatctgtag

SEQ ID NO: 208121 - DNA, 1548 bp, Artificial Sequence
  Description of Artificial Sequence: Synthetic coding sequence
atggccaagagcaacggcgagaacggcccccgggcccccgccgccggcgaaagtctttctgggaccagggagtccttagctcaaggacccgacgctgccacaaccgacgaactaagttccctggggagtgacagcgaagcaaacggctttgctgagcggagaatagacaagtttggctttattgtgggctcacagggcgccgagggtgcaccatgtcctctgctgcatagactggaggaagtgccgttagaagtcctccgtcagagggagtccaagtggctggacatgttgaataactgggacaagtggatggctaagaaacacaaaaaaataaggctgagatgccagaagggtatacctccgtccctcaggggccgggcttggcaatatttgagtggcggaaaagtcaagctgcagcagaatccaggcaagtttgacgaactcgacatgtcccctggggatccaaagtggctggatgtgatcgaaagagatctccatagacaatttccgtttcatgagatgttcgtgagtagaggcggtcacgggcaacaggatcttttccgcgtcttaaaagcgtacaccttgtatcgcccagaagaagggtattgccaagcccaagctccaattgcggcagtcctcctgatgcacatgccggcagagcaagcattctggtgcttggttcagatttgtgaaaagtacctgccaggatactactctgagaagctggaagccattcaactggatggtgaaatactgttctccttgcttcagaaagtaagccccgtcgctcataagcatttgagccggcagaagatcgatccgcttctgtatatgaccgagtggttcatgtgcgcgtttagtcggactctcccatggagcagtgtgctcagagtgtgggatatgtttttttgcgaaggagtcaaaatcatcttccgggtgggtctagtgcttctgaaacacgctttagggtcacccgagaaagtcaaagcatgccaggggcagtacgagacaatagagagactaagatcactttctcctaaaatcatgcaagaggcttttctggtgcaggaggtggtagagctgcctgtgaccgaacgacagatcgaacgcgagcacctgatccagctccgcagatggcaggaaactcgaggggagctgcaatgtcggtcaccgcctcggctgcacggggctaaggctattctggacgccgagccaggtcctcggcctgccctgcagccttctccttcaataagattaccccttgacgcacctttgccaggttccaaggcgaagcctaagccgccaaagcaagcacagaaagaacaaaggaaacagatgaagggacgtggtcaattagagaaaccccccgcacccaatcaggcaatggtggtcgccgctgccggagatgcatgtccaccgcagcacgtcccacccaaggactctgcacctaaagattctgcgccacaggacctcgctcctcaagtctccgcccaccatagatcacaggagtcgctaacctctcaagaatccgaggacacctacctgtag

SEQ ID NO: 208122 - DNA, 2427 bp, Artificial Sequence
  Description of Artificial Sequence: Synthetic coding sequence
atggagaccggcaccgcccccctggtggcccccccccggcggcacggagcgcccgctgcaccatcccccccccctcgaggaagccgcgctggaccagtggtagtggtcgcccccggaccacctgttactactgctacatccgccccagtcacactagtggccccaggagaagcaagacctgcctgggtccccggtagtgcggagactagtgctcccgcccctgcccccgctccggcacctgctcccgctgtgaccggatccactgtcgtggtcctgactctggaggcctcccccgaagcacccaagcctcagttacctagtggtcctgaaagccctgaaccagccgctgtggctggcgttgaaacgtcaagggccctggctgcaggggctgactcccctaagaccgaggaagcacgccccagtcccgcccccggccccggcacgccgactggaaccccaactcgaacccccagtcgaacagccccgggcgctctcacagcgaagcctccactagcccccaaaccagggacaactgtcgccagcggggtgaccgctaggagcgcctcaggccaagtgacagggggacacggagctgccgcagccactagcgcttccgcaggtcaagctccagaagacccgtcagggccaggtacaggaccgtccgggacctgtgaggcccccgtggctgtggtgacggtgacaccagcaccagagcctgccgagaacagccaggatctgggctccacttcgagccttgggcccgggatttcaggacctcgcggacaggcaccagacaccctcagctacctcgactcagtgagcctgatgtcaggaaccttggagagcctagctgacgacgtgtcttctatgggaagcgacagcgaaatcaatggactcgcgctccggaagacggacaagtacggcttcctgggtggcagccagtatagcggatcactggagtcgtccataccagtggatgtagctaggcagcgtgaactcaagtggctggatatgttctccaactgggacaaatggctctctcgtaggttccagaaagtcaaactcaggtgtaggaaaggcattcctagctcattaagggccaaagcttggcagtacctatcaaatagcaaggagttgctcgaacaaaaccctggcaaattcgaggagctcgaaagagcgcctggcgatcctaagtggttagacgttatcgagaaagaccttcatcggcaatttccatttcacgaaatgttcgcggcccggggagggcacgggcagcaggacctgtaccggatcctgaaagcttacaccatttataggcccgacgaaggctattgccaggcccaggcccctgttgctgcggtgctgctgatgcatatgcctgccgagcaagccttctggtgtctggtccagatttgtgacaagtacctgcccggctattactccgccggccttgaggccattcagttggatggagagatttttttcgctctgttgaggagggcctcacccctcgcacacaggcatctccgaagacagagaatcgatcccgtcctttacatgacagagtggtttatgtgcattttcgccaggaccctgccttgggcctcagtgctccgggtctgggatatgtttttctgtgagggcgtcaagatcattttcagggtggcactcgtgctgctgcgccacaccctgggcagcgtggaaaaactccgaagctgtcagggcatgtatgagactatggaacagttgcgcaatttgccgcagcaatgcatgcaggaagatttccttgtgcacgaagtgaccaacttacctgtaacagaggcactgattgaaagggagaatgccgctcagctcaaaaaatggagagaaactcgaggcgagctgcagtatcggccttctcggcgacttcatgggtctagagctatccacgaggaaaggagacggcagcagcctccgctgggaccctcaagttccttactgtctcttcctggcctgaagagcagaggttctagagctgcaggaggggccccatcaccaccgccccctgtccggcgagcctcagcaggcccggcccccggccctgtggttaccgccgaaggcttacatccttccctgccaagcccaaccgggaatagtactcccctgggctcgagcaaggagacgaggaaacaggagaaggagcggcaaaagcaggaaaaagagcggcaaaagcaggagaaagagcgagaaaaagaacgccagaagcaggaaaaagaacgcgaaaaacaagagaaagagagagaaaagcaagagaaagaaaggcagaagcaagagaagaaggcccagggtaggaagctgtccctgagacgcaaggccgacgggccacccggacctcacgacggtggcgatcgtcccagtgcagaggcaagacaggacgcctatttctag

SEQ ID NO: 208123 - DNA, 1341 bp, Artificial Sequence
  Description of Artificial Sequence: Synthetic coding sequence
atggcccaggccctgggcgaggacctggtgcagccccccgagctgcaggacgactcgagctctcttggttccgatagtgaactgtcaggccccggaccatatcgccaggctgatcggtatggcttcattggagggagctcagccgagccaggacctgggcaccccccagctgatttgattagacaacgtgagatgaaatgggtggagatgacttcccactgggaaaaaacaatgtcacggagatacaaaaaggtaaagatgcagtgtaggaagggaataccctctgctctgcgggcccgctgctggcctctcctgtgcggggcccacgtgtgccaaaagaatagccccggcacgtaccaggagctggccgaagctcctggagacccgcaatggatggagactatcggacgtgatttgcatcgccagttccccttgcacgaaatgtttgtgagtccacaagggcacggacagcagggactgctgcaggtcctgaaggcctatacactttaccgtccagagcagggttattgtcaagctcagggcccggttgccgcggtgctgctgatgcatcttccacccgaagaggccttttggtgtcttgtacagatttgcgaggtgtacctgccaggatattatgggcctcacatggaagccgtgaggctggacgccgaggtgtttatggctcttctccgaagactgctgccacatgtgcacaaacacctgcagcaagtcggggttggtcctctactttatctacccgagtggttcttgtgcctgtttgctcgcagtctgccgttcccaacggtcctcagggtctgggacgcttttctgagcgagggcgcccgggtgttgtttcgggttggcctaactttagtccgcctggccctgggcactgccgagcaacgtggtgcatgccccgggttgcttgaaactttgggcgccctgagagctataccgcccgcccaactccaggaggaagctttcatgtcacaagtgcactctgtggtgttaagcgagagggacctgcagagagagatcaaggcgcagcttgctcagctgcccgatagcgctccaggtccccctcctaggccccaggttcgcctggcaggggcccaggctatctttgaggcccaacagctcgcaggggtgaggcgaggcgccaagcccgaggtgcctcgcatcgtggtgcagccccctgaggaaccaaggccccctcgtcgtaagccccagacacgcggaaagacctttcatggccttctgactcgtgctcggggtcccccaatcgagggcccaccacgcccccagcgcggttctaccagttttctcgacacacgattctag

SEQ ID NO: 208124 - DNA, 1341 bp, Artificial Sequence
  Description of Artificial Sequence: Synthetic coding sequence
atggcccaggccctgggcgaggacctggtgcagccccccgagctgcaagatgactcttcttccctgggatccgacagcgagctcagtggtcctggtccttatcgacaggcagatcgttacggatttatcgggggcagctctgcagaacctggcccagggcatccgcccgccgacttgatcagacagagggaaatgaagtgggtggaaatgacctctcactgggagaagactatgtctcgccgatacaaaaaggtaaagatgcagtgccgaaaagggattccttcagcactgagggccagatgttggccactgctttgcggcgcgcatgtctgtcagaaaaattctccgggcacctatcaagaactggcggaagctccgggggacccacagtggatggagactattggaagggaccttcatcggcagttccccctgcacgagatgttcgtgtcgccacaaggccatggccagcaaggtctgctccaagtcctgaaagcatatactttgtaccggccagagcaggggtactgtcaggcccagggcccagttgcggcggttttacttatgcatcttccccccgaggaggcgttttggtgcttagtccaaatctgcgaggtgtatttgcccggctactatgggccacatatggaggcggtgagattagacgccgaggtgtttatggctttactgcgacggctgctgccgcacgtacacaaacatcttcagcaggtcggagtggggcctctgttgtacctgccagaatggtttctctgcctcttcgctaggtcgctgcctttcccaaccgtgctgcgggtctgggacgcttttctgtctgagggggccagggtgttgtttagggttggcttaacccttgtacggctggccctcggcacggccgagcagcgcggcgcctgcccaggactcctagaaaccctcggggcccttagagccatcccccctgcccagttgcaggaagaagcttttatgtcacaggtgcactctgtggtcctgagcgaacgcgaccttcagagggagataaaggcacagttggcccagcttcctgacagtgcacccgggccgccacctaggcctcaggtccgcctggctggagcccaggccattttcgaggcccagcagctggctggggtcagaaggggtgccaagcctgaggtgccccgtatcgttgtacagcccccagaagagccccgaccaccaagaaggaaacctcagaccagaggcaagactttccacggactcctgacgcgtgctagagggccccccatcgaagggccccctcggccgcagcgcggatctacctcctttcttgataccagattttag

SEQ ID NO: 208125 - DNA, 2049 bp, Artificial Sequence
  Description of Artificial Sequence: Synthetic coding sequence
atgtgccccggcctgtacccctacagcagcctgctggagtacggccgaagtatgatcatctatgagcaggagggcgtgtacattcattcttcgtgtgggaaaactaacgatcaggatggcctgattagtggaattttgagggtactggagaaagacgccgaagtcatcgtggattggaggcctttggacgacgctttagactcgagtagtattctgtatgctaggaaggacagctcaagtgtagtggaatggacccaagcacccaaggaaaggggccaccggggttccgagcacctgaacagctacgaagctgaatgggatatggtgaatacagtctcctttaaacgaaaaccccacactaatggtgatgccccgtcccaccgtaatggcaaaagtaagtggtcgttcctcttcagcctgacagatttaaaaagtataaagcagaacaaggagggtatgggttggagctatttagttttctgcctcaaagacgatgtagtgctgccggccttacacttccaccagggggacagcaaactactgatcgaatccttggagaagtacgttgtcctgtgcgagtccccccaggataagcgcactctgctcgtgaactgtcagaacaaatcattgtcacagtcgtttgagaacttgctcgatgagccagcctacgggcttatccagaagattaaaaaagacccctacaccgcaaccatgatcggctttagtaaggtaaccaattacatatttgatagtctgaggggctcagacccaagtacccaccagcggcctcctagcgagatggcagacttcttgtctgatgctattccaggattgaaaattaatcagcaagaggagccgggttttgaggtgataacgagaatcgatctaggtgagagaccagtggtgcagcggcgcgaacctgtatctctggaggaatggaccaaaaacatcgattccgagggtagaatcctaaatgtcgataacatgaagcagatgatatttagaggcggcctgagtcacgccctgagaaagcaggcttggaaattcttgctgggctattttccctgggacagcaccaaggaagaaagaactcagctgcagaaacagaagacagatgaatacttccgaatgaagctccagtggaaatcaattagccaagaacaggagaaaagaaactcacgtttgcgcgattaccgaagccttattgaaaaggacgtgaatcgtaccgaccgaacaaacaagttttatgaggggcaggataacccggggttgatcctgttgcacgacatcctgatgacttattgtatgtatgacttcgacctcggatatgtccaagggatgagcgaccttctctctccccttctatacgtgatggaaaatgaagtcgatgccttctggtgcttcgcctcctacatggatcagatgcaccagaactttgaggagcagatgcaaggaatgaagacccaattaattcagctctcgacgctgctgaggctcctcgatagtggcttctgttcttacctcgagagccaggatagtggatatctgtacttctgcttccgatggttgctgatcagatttaagagggagtttagcttcctggacatcttgcgtctctgggaggtgatgtggactgagttgccttgcacaaattttcatctcctactgtgttgcgcaattctggaatccgaaaaacagcagatcatggagaaacattatggctttaatgagatcctgaagcacattaatgagctgtctatgaagatcgatgtggaggacatcttgtgcaaagccgaagccatctcgctgcagatggtcaagtgtaaggagctgccccaggccgtgtgtgaaatccttggcttacagggctccgaagtgaccacgccggatagtgacgtgggagaggacgaaaatgtcgtcatgacaccatgccctacaagtgcattccagtcaaatgcccttcccactcttagcgcatccggggcgaggaatgacagtccgacccagattcctgtttcgagcgatgtgtgccgtctgacaccagcctag

SEQ ID NO: 208126 - DNA, 1338 bp, Artificial Sequence
  Description of Artificial Sequence: Synthetic coding sequence
atgatcggcttcagcaaggtgaccaactacatcttcgacagcctgagagggagcgacccaagtacccatcagagacccccctctgaaatggccgacttcctgagcgacgcaatcccaggtctgaagattaaccaacaggaagaacccggtttcgaagtgatcacgagaattgatctgggcgaacgccccgtagtgcagcgccgggagcccgtgagtctggaagaatggacgaagaacatcgactcagaaggacggattttaaatgtggataatatgaaacagatgatttttcgtggcggcctgagccacgcacttcgcaagcaggcctggaagttcctgctcgggtatttcccctgggactctactaaggaggagaggacgcagctccaaaaacagaaaaccgatgaatactttaggatgaagctgcaatggaagagcatatcccaggagcaggagaagaggaatagtaggctgagagattacaggagtttgatcgagaaagacgtaaacagaacagaccggacaaataagttctatgaagggcaggacaaccccggcctgatcctgctgcacgatatcctaatgacctattgcatgtatgatttcgaccttggttacgtgcaggggatgagcgacctcctaagtccgctactatacgtgatggaaaacgaagtggatgctttttggtgcttcgcttcttacatggatcagatgcaccagaacttcgaggaacagatgcagggaatgaaaacacagctgatccagctgagtacacttttgagactacttgacagcgggttctgttcctatttggagagtcaggattctggttacttgtacttttgtttcaggtggctcctgatacgctttaaacgcgagttttctttcctagatatcctcagactgtgggaggtaatgtggacggaacttccctgcactaacttccacctgctgttatgttgcgccatacttgagtcggaaaaacagcagattatggagaagcattatgggtttaacgaaatcctgaaacacatcaatgaattgtcaatgaagattgacgtcgaggatatcctctgcaaagcagaagcgattagcctgcaaatggtgaagtgtaaggagctgccccaggcagtttgcgaaattctgggattgcagggctcggaagtaacaacccccgactccgacgtgggggaggatgaaaacgtagtgatgaccccctgcccaacctccgcatttcagtcgaacgcccttcctacactgagcgcaagcggcgccaggaacgattctccaacacagatccctgtatccagtgacgtgtgccggttaacgcctgcatag

SEQ ID NO: 208127 - DNA, 2025 bp, Artificial Sequence
  Description of Artificial Sequence: Synthetic coding sequence
atggccgccgccggcgtggtgagcggcaagatcatctacgagcaggagggagtgtacattcacagctcttgcggaaagaccaacgaccaagacggactgattagcggtatactccgggttctggagaaggacgccgaagtgatagttgactggcgtccattggatgatgcattggacagttcaagcatattatacgcgcgaaaagattccagtagcgtggtcgagtggactcaggcccctaaggagaggggtcaccgcgggagcgagcacctcaattcgtacgaagccgaatgggatatggtaaacacagtgagctttaaaagaaaacctcataccaatggtgacgcaccgagtcaccgaaatgggaagtctaagtggtcattcctgttttctttgaccgacctcaagtctatcaagcagaacaaggaaggcatgggttggagctatcttgttttctgtctgaaggacgacgttgtcttgcctgctttgcatttccaccagggagactcgaagttgctaatcgaatctctggagaaatacgtcgtgctctgtgaaagccctcaagataaaagaacactgctggtgaactgccagaacaagtcactgtcgcagtcgttcgaaaatcttctggacgaacctgcttacggcttaatccagaagatcaagaaagacccttatacagccacgatgatcggcttctcaaaggtcacaaactatatttttgatagcctgagggggtctgacccaagcacccatcagcggcctcccagtgaaatggctgacttcttgtctgatgcaattcccggcctcaaaattaatcaacaagaggaaccaggcttcgaagttatcacccgtatagatctcggggagcggcctgtggtccaacgccgtgaacctgtgagccttgaggagtggaccaagaatatcgactctgagggcaggatcctgaatgttgacaatatgaaacagatgatattccgtggtggtctcagtcatgctctgcgcaaacaggcgtggaaatttctcttaggctactttccctgggactccacaaaggaagaaaggacgcagctgcagaagcagaaaacagatgagtactttcgcatgaagctgcaatggaaatcgattagccaggagcaggaaaagaggaactcacggttgcgcgattatcgctcactgatcgagaaagacgtaaacaggactgatcgtacaaataagttttacgagggtcaggacaatcctggtctcatcttgttacacgacattcttatgacttattgcatgtatgactttgacctaggctatgtccaggggatgagcgacctgctttcccctctactttatgtcatggaaaacgaggtggacgctttctggtgttttgctagctatatggaccagatgcatcagaactttgaagaacagatgcagggtatgaaaacccagttaattcagctctctacattgctgcggctcctggactcaggtttttgttcttacctggaaagccaagacagcggttacctatatttttgctttaggtggttgctcattagattcaagagggagtttagcttcctcgacattctgcggctgtgggaggtcatgtggacagagctgccatgcactaacttccatctgctgctatgctgtgctatcttggagtctgagaagcagcaaattatggaaaagcattatgggtttaacgaaatcctgaagcatatcaatgagttgagcatgaagatagacgtggaggatatcctatgcaaagcggaggcaatttcccttcagatggtgaagtgtaaagaattaccccaggccgtgtgtgaaatcttggggcttcagggatctgaagttacaacaccagactccgatgtcggtgaggacgaaaacgtcgtcatgacgccctgtccaacctccgcctttcagtctaacgccctgccaactctctctgccagcggcgccagaaatgattcacctacgcagattccggttagcagtgacgtgtgccggctgacacctgcatag

SEQ ID NO: 208128 - DNA, 2076 bp, Artificial Sequence
  Description of Artificial Sequence: Synthetic coding sequence
atggccgccgccggcgtggtgagcggcaagatcatctacgagcaggagggcgtgtacatacactcgagttgcggcaagaccaacgaccaggacggcctcatatccgggattcttcgcgtcctcgagaaagatgctgaggttatcgtggattggagaccattggacgatgcactcgacagcagttcaatcctctacgctagaaaggattctagctcagtcgtagagtggacccaggcacctaaggaaagaggccatagaggatctgaacatctcaacagttacgaggcggagtgggacatggtgaacaccgtgtcatttaagagaaaaccacacacgaacggagacgccccctcgcataggaatggtaaatctaagtggtccttcttgttctcactgacggatctcaagtctatcaagcagaacaaggaggggatggggtggagttacctggtattttgtttgaaggatgatgtagtgctaccagccctgcattttcaccaaggggattccaagctactgatcgagtctcttgaaaagtacgtagtattgtgcgagtccccacaggataaaaggacactcttagtcaactgtcagaacaagtcgctaagccaatcttttgagaatctattggacgagcccgcgtacggactgattcaggccggattactggatcgacggaaactactctgggcgattcaccactggaagaaaataaaaaaggatccctacacagccactatgatcgggttcagcaaggtgaccaactatatattcgatagtttaaggggctctgatccctctactcatcagcgtcccccgagcgagatggcagattttctgtctgatgcaatccccggtctgaaaataaaccagcaagaggagcctggcttcgaggtcattaccaggatcgacctgggagagcgaccagtggtgcagcgcagggagcctgttagtctggaggagtggactaaaaatatagactcagagggtagaattctgaacgtggacaacatgaagcagatgattttccgcggaggccttagccatgccctgaggaaacaagcctggaagtttctgctgggctatttcccctgggattccacaaaggaagagagaactcagcttcagaagcagaagaccgatgagtactttcgaatgaaactgcagtggaagagcatctcccaagagcaggaaaaaagaaattctcgcctacgggactatcggtcccttattgagaaagacgtaaaccgtactgaccggacaaataagttttatgaaggacaggataatcctggactcatactgttacacgacattctgatgacctattgcatgtacgactttgacttgggatacgtgcagggcatgtccgatttgctcagtccactgctgtacgtgatggagaacgaagtggacgcgttttggtgtttcgcttcctacatggatcagatgcaccagaatttcgaggagcagatgcaaggaatgaaaactcagctaatccagctgagcaccttgctgaggcttctggacagcggcttctgctcgtatctggaaagtcaagactcaggatatctctacttttgcttccgctggttgttgattcggttcaaacgcgaattttcatttcttgacattctgagactttgggaggtgatgtggaccgagttgccttgcactaactttcatctgctactgtgttgcgccatactggagtctgagaaacagcagatcatggaaaagcactacggttttaatgaaatactgaaacacatcaatgaactgtcaatgaagatcgacgtggaagatatcctgtgtaaggctgaggcaatttccttacaaatggttaagtgtaaggagctgccccaagctgtctgcgaaattttaggactgcaggggtctgaagtcaccaccccagacagcgatgtaggagaggacgagaacgtggttatgactccctgccctacgtccgctttccagtctaatgccctgcccaccttatcagcttcaggtgctcgaaatgattctcccacccagatccccgtgagtagcgacgtttgtaggctgacccctgcctag

SEQ ID NO: 208129 - DNA, 2133 bp, Artificial Sequence
  Description of Artificial Sequence: Synthetic coding sequence
atgcacaacatccggggcaacaagcaggcccagggcaccggccacgaacctccaggagaagattctccccaatccggggaaccccagcgggaagaacagccattggcttccgatgcaagtaccccaggaagggagcccgaggactcacctaaacctgcaccaaagcccagccttactatatcctttgcgcagaaggccaagcgacagaacaacaccttcccattcttctccgaaggtatcacacgtaatagaactgctcaggaaaaggtagcggcccttgagcagcaggttttaatgctgaccaaggagctaaaaagtcaaaaagaactggtgaagatactgcacaaagcgttggaagcagcccagcaggaaaagagagcctcttcagcataccttgctgcagccgaggataaagatcgcctcgagctggtccggcataaggtgagacaaatagccgaactgggaaggcgggttgaggctctggaacaagaacgtgaaagcctggcccatacagcaagtctcagagaacagcaggtgcaggaacttcagcaacatgtgcagttactgatggacaagaaccatgccaaacagcaggtgatctgcaaactatctgagaaagtaacccaggacttcacccaccctcccgatcagtctccactgcgccccgatgcagcaaaccgagatttcttatcccagcagggcaagatcgaacacttgaaagacgacatggaggcatacaggacacaaaattgtttcctgaattcagagatccaccaggtgacaaaaatctggcgcaaggtggctgagaaggaaaaggctctcttgaccaaatgtgcatatcttcaggcccggaactgccaggtggagtcgaagtatctggccggactccgccgtttgcaagaagccctgggagatgaggcatcagaatgttcagagctgttgcgccagttagtgcaggaagcattacagtgggaagccggcgaagcctcatccgacagcatcgagttgtcccccatcagtaagtatgacgagtacgggtttctgacagtccctgactatgaggttgaagaccttaaactcctggccaaaatacaggcccttgagagccggtcacatcacttgttgggactggaggccgttgatagacctctgagggaaagatgggctgccctcggcgacctcgttccgtctgccgagctgaagcagcttctgagggccggagttcctcgggagcaccggccccgtgtatggcgctggctagttcatcttcgcgtacaacacttacacactcctggctgctatcaggagctgttaagccgtggacaggcaagggagcatccagccgcacgccagatcgagttagatctgaataggacgttcccaaataacaagcatttcacttgtccgacatcctccttccctgacaagctgcgacgggtgctgttggccttctcctggcagaaccccacaattggatactgtcaaggtctgaatcggctggccgcgatcgcactgctggtgctcgaagaggaagaatctgcattctggtgtttggtcgcgatcgtggaaacaatcatgcctgctgattactactgtaatacgttgacagcctcccaggtcgaccaaagagtgctgcaagacctcctgtcagaaaagctgcctagacttatggcccacctggggcagcaccatgtcgacttgagtctggttaccttcaactggttcttggtcgtgtttgcagattctcttatttcaaacatcctactacgggtgtgggacgccttcttatacgaaggaaccaaggtagtgtttcggtacgccctggccatctttaaatacaacgagaaagagatcttaaggctgcagaatggcctagaaatctatcagtacctgcgcttcttcactaaaacaatttctaacagtagaaagctcatgaatatcgccttcaatgatatgaatccatttcggatgaagcagcttagacagctgcgaatggtccacagggaacgtttggaagcggagctgcgcgaactcgagcagctaaaggcggaatatttggagcgcagggcctcacgcagacgcgccgtgtccgaaggatgtgcttccgaggatgaagtcgaaggagaggcatag

SEQ ID NO: 208130 - DNA, 1407 bp, Artificial Sequence
  Description of Artificial Sequence: Synthetic coding sequence
atggaggcctaccggacccagaactgcttcctgaacagcgagatccatcaggtcacgaagatctggagaaaagtagctgagaaggagaaagcccttctgacaaagtgcgcttacctgcaggcacgcaattgtcaggttgagagcaagtaccttgccggattgcgaaggctgcaggaagcattgggagacgaggcttctgaatgttccgaattacttcgccagcttgtacaggaagctctgcagtgggaggctggggaagcatcttcagactccattgagttgtcacccataagcaaatatgatgaatacggatttcttaccgttcctgactacgaggtggaagatcttaagctgctggccaaaatccaagcactcgagtcaaggtcacatcatctgctgggtctcgaggccgtggataggccacttagggagagatgggccgccctgggtgacctggtgccatctgccgagctgaagcagttgctccgcgccggcgtgcctcgggaacaccgtccccgggtgtggaggtggctcgtccaccttcgggtgcagcacttgcataccccagggtgttatcaagagttgctgagtcgcggccaggctcgggagcatccagccgcccgccagatcgagctcgacctgaacagaacctttccgaacaataagcacttcacatgcccgaccagctcatttccggacaaattgcgtcgggttttgctcgcctttagttggcagaatcctacaattgggtactgtcaaggcctcaacaggctggccgctatagctctgttggtccttgaagaggaggaatctgctttctggtgccttgtggcgattgtggaaactattatgccggccgattactattgtaacacacttacagcctctcaggtggatcaaagagtactgcaggaccttctgtccgaaaagctcccccggcttatggcacatctgggtcagcaccatgttgacttgtccttggttacttttaactggttcctggtggtgttcgctgactctctaatttcgaacatccttttgcgcgtttgggatgccttcctctatgagggtaccaaggtcgtcttccgttatgcactagccattttcaaatacaacgagaaagagatcctgagattgcaaaatgggctggagatttaccagtatctccggtttttcacgaaaaccattagtaactcacgaaagctgatgaacatagcattcaatgacatgaatccgttcaggatgaagcagcttcgccagttacgaatggtgcatagggagcgcctagaagccgaactacgggagttagagcaactcaaagcagagtatcttgagcgccgggccagtcgcaggagagcagtatctgaaggttgcgcctccgaggatgaggttgagggagaggcttag

SEQ ID NO: 208131 - DNA, 2583 bp, Artificial Sequence
  Description of Artificial Sequence: Synthetic coding sequence
atggagggcgccggcgagaacgcccccgagagcagcagcagcgcccccggcagcgaggagtctgcccgtgacccccaagtgccacccccggaagaggaaagcggggactgcgcccgtagccttgaggccgtgcctaagaaactctgcggttacctgagcaaattcggcgggaaggggcctattcgggggtggaagagtagatggttcttctacgatgaaagaaagtgccagctgtactattcacggactgcacaggatgccaatcccttggactcaattgacttgtctagcgccgtattcgactgcaaggcagacgcggaggagggcatattcgagattaaaacccccagcagggtcatcacactcaaagccgccactaagcaagcgatgctgtactggttgcaacagttacagatgaaaagatgggagttccataactctccaccagctcctccagcgacacctgacgccgcactcgctgggaacgggcccgtgctgcatctggaacttggtcaagaagaagcggagctggaggagttcctatgtccagtgaaaaccccgccgggccttgtgggcgtggctgctgccttacaaccattcccagctctacaaaacatctccctgaagcatctagggacagagatacagaataccatgcataacattagaggaaacaagcaagctcaaggcaccgggcacgaacccccaggggaggactcgcctcagtcaggagagccacagagggaggagcagcctctcgcttccgatgcgtccaccccaggccgggagccagaagactccccaaagcctgctccaaaaccaagtctcacaatctcctttgcccaaaaagccaagcgccagaacaacactttccccttcttttccgaaggcatcacccgtaaccggactgcgcaggaaaaggtggcggccctagagcagcaggtgctgatgctgaccaaagaattgaagagccagaaagaactggtcaaaatcctgcataaggcattagaggccgcccagcaggagaaaagagcctccagtgcctatcttgcagccgcagaagacaaggaccggctggagctggttagacacaaggtccggcaaatcgccgaactggggagacgagttgaggccttagagcaggagagggagagcttggcgcacacggccagcctcagggagcagcaagttcaggagctccagcagcatgttcagctgttgatggataagaaccacgctaagcagcaggtgatctgcaagctgtcagagaaagtgacacaagactttacccacccgccagatcagtcacccctccggccggatgcagctaacagagactttttaagccagcagggtaagatcgagcacctgaaggatgatatggaagcctaccgtactcagaattgctttctcaacagcgaaatccatcaagtgacaaagatttggagaaaagtggccgaaaaagagaaagccctcttgaccaaatgcgcttatctacaggcacggaattgccaggtggagtctaagtacctcgccggtctccggagacttcaagaggccctgggcgatgaagcttctgagtgtagcgaactgctacggcagcttgtacaggaagccttgcaatgggaagcaggggaagctagcagcgattccattgagctgtctcccattagtaagtacgacgagtacgggttcttgacagtcccagattacgaggtggaggacttaaagctactggccaaaatccaggcacttgaatcacgatcacaccacttgctgggcttagaagctgtcgacagacccctgcgcgaaaggtgggctgccctgggcgatttagttccatctgccgagttaaagcagctgctgagagccggggtaccgagggaacaccgcccgcgggtctggcgctggctggtgcatttgcgggtgcagcacctgcacacgcccgggtgctaccaggagctgttgagcaggggccaggccagagaacacccagccgctagacaaatcgaattagacttgaacagaacgtttccaaacaacaagcactttacatgccctaccagttcatttcccgataagctgaggcgtgttttactcgccttttcttggcagaaccccaccattggctattgccaggggctgaataggctagccgcgatagccctgctggtgctcgaggaggaggagagcgcattctggtgcttagtggctatcgtagagacaatcatgccagctgactattactgcaatacactgactgctagccaggtcgatcagcgggtcctgcaggacttgctctcagagaagttgccccgtttaatggcgcatctaggacaacatcatgtggaccttagcctcgtgacatttaactggttcctggttgtgttcgcggatagtctgattagcaacatcctgttacgggtatgggatgccttcctgtacgagggtaccaaggtcgtctttagatatgcactggccatcttcaagtataatgagaaagaaatcctgcggctgcagaacggtctggagatttaccaatatctgcgcttctttactaaaaccatctccaactcaaggtag

SEQ ID NO: 208132 - DNA, 2754 bp, Artificial Sequence
  Description of Artificial Sequence: Synthetic coding sequence
atggagggcgccggcgagaacgcccccgagagcagcagcagcgcccctggctctgaagaatccgcaagggacccacaagtacctcctcccgaggaagaaagcggtgattgtgctcgcagtttagaggcagtgccaaagaagctgtgcgggtacctttctaaattcggagggaaaggtccaatccgcggctggaagtcgcgctggttcttttacgacgaacgcaagtgccaactgtactatagccggaccgcccaggacgcaaaccctctcgattctatcgatctctctagtgccgtctttgattgtaaggcagatgccgaggaggggatcttcgagattaagaccccatccagagtgataacccttaaggccgctactaaacaggctatgctgtactggcttcagcagttacagatgaaacgatgggaatttcacaattcccccccagctccacctgctactcccgatgcagcactcgctggcaacggaccagttctgcacctcgagttgggccaggaggaagccgagctggaggagttcctctgccctgtcaagaccccacccgggttggtgggcgtcgcagcggctcttcagccatttccagcactccagaacatttccttaaaacacctgggcacagagatccagaacacaatgcacaatattcggggcaacaaacaggcccagggtaccggacatgaaccaccaggtgaagactccccacaatcaggggagcctcagcgggaggagcaacccctggctagcgatgccagcacacccggcagagagcccgaagatagccctaagcctgcacccaagccatctttaaccatctcctttgcccagaaagcaaaacggcaaaataataccttccccttcttcagtgaggggataactcggaatcggacagcccaggaaaaagtggccgcccttgagcagcaggtgctcatgctcacaaaggagctgaaaagccagaaggagctagtcaaaatactgcataaggccctagaggccgcgcagcaggagaaacgggcgtcgtccgcttaccttgcagctgcagaggacaaggaccggttggaattggtgcgccataaggtgaggcagatcgctgaactcggaaggcgcgtcgaggcactggaacaggagcgcgaatcccttgctcacacggcttccttacgggagcagcaggtccaagaattacagcagcatgtccaacttcttatggacaaaaatcatgcaaagcagcaggtgatttgcaagctcagcgagaaggttacacaggattttacacaccctcctgatcagtctcccctgcgcccagatgctgcaaatcgcgactttctgagtcagcaaggaaagatagagcatttgaaagacgatatggaagcttaccgcactcagaattgttttcttaatagcgaaattcaccaggtcacaaaaatctggcggaaagttgccgaaaaggagaaggcattgctgaccaaatgcgcttatctccaggcccgaaactgccaggttgagagcaagtacttagcgggattgcgacgcttacaggaagctctgggcgacgaagcctctgaatgttcagaattgcttcgccagctcgtacaggaggctctccaatgggaagccggggaggcaagtagtgactccatcgagctgtcccctatttccaagtacgatgagtatggcttcctgaccgtgcctgattacgaggtggaagatctgaagctcctggccaagatccaggctttggagtctcggagccatcatctcctaggcttagaagccgtcgatcggccacttagggagaggtgggcggcgctgggagatttggtccctagcgctgagctaaaacagcttctccgagcgggagtgccccgcgaacatagaccacgcgtgtggaggtggttggtacacctacgggtccagcatttgcacacaccaggttgttatcaggagttgcttagccggggtcaggcccgcgagcatccagcagctaggcagattgagctggacttaaatcggacatttccgaacaataagcattttacctgtccaacctcatcgtttcctgataaattgcgcagggtgcttctcgccttctcctggcagaatcctaccatcggctattgccagggactaaaccgcctcgctgcaatcgccctacttgtcctcgaagaagaagagagcgcgttctggtgcctggtagccatcgtggagaccatcatgcctgctgactattattgtaatactctgaccgcctcacaggtagaccagagggtgctgcaagacctcctctctgaaaagctgcccagactgatggcccaccttggccagcaccacgtggacctgtccttggtgaccttcaattggtttctggtggtgtttgccgatagcctcatttccaatatcttactgagagtctgggatgcttttttatatgaaggaacaaagtacaatgagaaagaaatactgcgcctgcaaaacgggcttgaaatctatcagtatctgcggttcttcactaaaaccatcagcaattcacgaaagctgatgaacattgcgttcaacgatatgaatcccttcaggatgaagcagctgcggcagctccgaatggtgcaccgggaacggcttgaagccgaactgcgggagctcgagcagcttaaggcggagtacctagaacgtcgagcttctaggaggcgggctgtctcggagggttgtgcctctgaagacgaggttgaaggagaagcatag

SEQ ID NO: 208133 - DNA, 1287 bp, Artificial Sequence
  Description of Artificial Sequence: Synthetic coding sequence
atgcccagcggctgctacgtgccccggagcgagccccggctgctgcccgccccccccccggctggcgcacgcgtgggcgccctccggagtgcgcagggtgacgggcccacaagcggacattgggacggcggcgcagagaaggccgattttaatgccaagcgcaaaaagaaggtggccgaaatccaccaggcacttaattctgaccctaccgatgtggccgctctgaggcgaatggcgatcagtgaaggcggacttcttacagacgagattagaagaaaggtctggccaaaattgttgaatgtcaatgcgaatgaccctccacctattagcggcaagaacctaaggcagatgtctaaggattatcagcaggtcttgctcgacgtccgccgaagcctgaggagattccctcctggtatgccggaggaacagagggagggcctccaggaagagctgatcgatataatcttgttgatcctggaacggaacccacaacttcattactaccagggctaccacgacatcgtggtgaccttcctactggtagttggagagcgtctggccacatctttggttgagaagctgtcaactcaccacttacgagacttcatggacccaacaatggataataccaaacacatcttaaattaccttatgcctataatagatcaggttaatcccgaattacacgatttcatgcagtccgctgaagtcggtactatatttgcattaagctggctgatcacatggttcgggcatgttctctctgacttcagacacgttgtgcggctttatgattttttcttggcgtgccaccctctgatgcccatctactttgccgctgtcattgttctgtacagggagcaggaagtcctggattgcgactgcgatatggcttccgttcaccaccttctgtcccagataccacaagatcttccctatgaaaccttgattagccgggcgggcgacctatttgttcaatttcctcccagcgagctggcacgggaggccgctgcccagcaacaggctgagcgcaccgccgcgagcactttcaaggacttcgaattggcctccgcccagcagcgacctgacatggtgctcagacagcgctttagaggtctgctacgccccgaggatagaactaaggacgtcttaaccaagccacgaaccaataggttcgtgaagctcgccgtgatgggactaaccgtggctttgggtgccgctgcactagctgtcgtgaagtcggctctagagtgggcgcccaagttccaactacagctctttccctag

SEQ ID NO: 208134 - DNA, 1212 bp, Artificial Sequence
  Description of Artificial Sequence: Synthetic coding sequence
atggccctgcggagcgcccagggcgacggccccaccagcggccactgggacggaggcgctgaaaaagcagattttaatgctaaacggaagaagaaggtggccgagatccaccaagctctcaattccgatcccaccgatgtggctgcactccgtcggatggcgattagcgaagggggtttacttacagatgagataaggcgaaaggtatggccgaaacttttaaacgtgaacgccaacgatccgcctcccatttctggcaaaaatttgcgccagatgtcaaaggactaccagcaggtgttgcttgatgttcggcgttcgctccggaggtttccccctggaatgccagaggagcagagagagggtcttcaggaagaactgatcgacatcattttactgattctcgagaggaaccctcaactacactactaccagggctatcacgacattgttgtgactttcctcctggtggttggcgagaggctggcgacaagccttgttgaaaaactgagcacccatcacctgagggattttatggaccccaccatggacaacactaaacacatcctcaattaccttatgccgattatagatcaggtcaaccccgaattacatgatttcatgcagagcgctgaagtagggactatattcgcccttagttggttaatcacttggttcggacacgttctgagcgatttccggcatgtggtgcgcctgtacgatttttttctggcatgccatccattaatgccgatatacttcgcagccgtgattgtgttgtatcgcgagcaggaagttctggactgcgactgcgacatggcgtccgttcaccatctgctaagccagataccacaggacttgccatatgagaccctgatctctcgggcgggagacctatttgttcagttccccccatctgagctcgcgagggaggccgctgcccaacaacaggccgagcggactgcagcgagcacgtttaaagacttcgagctggcctcggcacagcagcggcctgatatggtgcttcggcaacgttttagggggctacttcgccctgaggatcggacaaaggacgtgcttacaaaaccacgaacgaaccgatttgtgaaattagctgtgatgggcctgacggtagccttaggcgcggctgccctggcagtggtcaagagtgccctggaatgggcaccgaaattccagcttcagctgtttccatag

SEQ ID NO: 208135 - DNA, 1212 bp, Artificial Sequence
  Description of Artificial Sequence: Synthetic coding sequence
atggccctgcggagcgcccagggcgacggccccaccagcggccactgggacgggggtgcagagaaagcggacttcaacgcgaagcggaaaaaaaaggtcgccgagattcaccaggccctcaatagcgaccccacagatgttgccgctcttagacgaatggctatctccgaggggggactgttgactgacgaaataagacgcaaggtgtggcccaaactcctgaacgtgaatgcaaatgacccacctccaatatccggtaaaaatctgcgacagatgagcaaggactaccagcaagtgctgttagatgttagacgaagtctgaggagatttccccccgggatgcccgaagaacaacgtgagggcctacaggaggagcttatcgatattattcttctgatactcgaacgaaacccccaactgcactattatcaaggctaccatgatattgtcgtcaccttcctgctggttgtgggcgaacggctcgcaacgtctttagtcgagaagttaagtacccaccacctgcgggatttcatggatccgaccatggacaataccaaacatatcttgaactacctaatgcctattatcgaccaggtgaaccccgagctgcacgactttatgcagagcgcagaggttggaacaatcttcgccttgtcctggcttatcacctggtttggccacgtgctctctgactttaggcatgtggtgcgactttatgacttctttttggcatgtcatccactgatgcccatatacttcgccgccgtgattgtcctttatagagagcaagaagtcctggattgcgactgcgacatggccagtgtccatcacctcttaagtcagattcctcaagatttgccctacgaaacgctgatcagcagagcaggtgatctgtttgtccagtttccccctagcgagctggcaagggaagcggccgcacagcagcaggctgagagaacagcagccagcacttttaaagactttgagctggccagcgcacaacagcgcccagacatggtccttcggcagagattcagagggctgctcaggccagaggaccgaacaaaagatgtgctgaccaaacctagaacgaaccgctttgtcaaactggccgtcatgggactgaccgtcgcactcggagcggccgccctggccgtggtgaaatccgcgctggagtgggccccaaaattccagctccagttattcccctag

SEQ ID NO: 208136 - DNA, 1662 bp, Artificial Sequence
  Description of Artificial Sequence: Synthetic coding sequence
atggacagccccggctacaactgcttcgtggacaaggacaagatggatgccgccattcaagacctgggacccaaagagctaagctgtacagagctgcaggaactgaagcagctggcgcgccaaggatattgggcacaaagccacgccctgcgcggtaaggtataccagagattaattagggacattccctgtaggacggtgacgccagacgcctcggtgtatagtgatattgtgggaaaaattgtcggaaagcacagcagctcttgcctaccactgcccgagttcgtcgacaatacccaggtcccctcgtactgcttgaacgccagaggggagggagccgtgaggaagatccttctgtgtcttgctaatcaatttccagatatcagcttttgtccagccctccctgccgtggtggcactgttactgcattactcaattgacgaagccgaatgcttcgagaaggcatgcagaatcctggcatgtaatgatcctggccggcgactcatcgaccaatcatttttggcattcgagtcctcatgtatgacctttggagacctggtgaataaatattgccaggccgcgcacaagctgatggtagccgtgtccgaagacgttctccaggtctacgcagactggcagcgatggttgttcggagaacttcctctgtgttacttcgcccgcgttttcgatgtttttctggttgaggggtataaagtgttgtaccgcgtggccttggccattcttaagttttttcacaaagtgagggccggccagcctctggaaagcgattccgttaagcaagatattcgtacctttgtacgagatattgccaaaacggttagtccagaaaagctcctcgaaaaagccttcgccattaggctgttctctaggaaagaaatccagctactgcaaatggcaaacgagaaagctttgaaacagaagggcataaccgtgaagcagaaaaggcagttcgtgcatttggccgtgcatgccgaaaatttccgtagcgagattgtttctgtgcgagaaatgcgtgatatttggtcttgggtccctgagcgtttcgcgctctgtcaaccactcctcctgtttagtagcctacaacatggctatagtcttgcccggttttactttcagtgcgagggacatgaaccgacccttctcttgattaaaaccactcagaaggaggtctgcggcgcttacctgtctaccgattggagcgagcgcaacaagttcggcggcaagctgggctttttcggaacaggagaatgctttgtgttcaggcttcaacctgaggtacagagatacgagtgggtggtgatcaaacatcccgagctgaccaagcctccaccactgatggccgcggagccaactgctcctctgagtcactcagcttcgtctgacccagcagaccggctgtccccatttctggcagctcgccacttcaacttgcctagcaagactgagtccatgttcatggctgggggatcggactgtctgatagtaggcggcgggggcgggcaggctctctacatagacggggatcttaatcgcggccgcacctcacattgcgacaccttcaacaaccagcccctgtgttctgaaaatttcctgatcgccgccgtggaagcttggggttttcaagaccctgatacccagtag

SEQ ID NO: 208137 - DNA, 1680 bp, Artificial Sequence
  Description of Artificial Sequence: Synthetic coding sequence
atggacagccccggctacaactgcttcgtggacaaggacaagatggacgctgccatacaggatctgggccccaaggagctgtcgtgtactgagctgcaggaactgaagcaacttgccaggcagggatactgggcccagtcgcacgcgttacgaggtaaagtctaccagaggctcattcgagatatcccttgccgcactgtaaccccagatgcaagcgtgtacagtgatatcgtgggaaaaatcgttggtaagcactcaagtagttgtcttccgctgcccgagttcgtggacaacactcaagtgcccagctactgcctcaacgcaaggggcgagggtgctgtgcggaagatcctgctatgcctggccaatcagttccctgacataagcttctgtcccgcgctcccggccgttgtcgcactactcttgcactactctatcgacgaggccgagtgttttgagaaagcctgtcggattctggcctgcaatgatccaggacggaggctcatcgaccagagcttcctggcattcgagtcttcatgtatgaccttcggcgacttggtgaataaatactgccaggccgcgcataaactaatggtagcagtatccgaagacgtcttacaggtatacgccgattggcagagatggttatttggggaattaccgctttgctacttcgctcgggtctttgacgtctttctggttgagggctataaagtgctctatcgagttgccctcgcaattctcaagttctttcataaagtgcgcgcaggccagcccctagagtctgacagcgttaagcaagatataagaacctttgttagggacatcgccaagaccgtttcccccgaaaagcttctcgaaaaagctttcgcaattagactcttttctcgtaaagagattcagctcctccaaatggcaaatgaaaaggcgctgaaacagaaaggaattaccgtcaagcaaaaatccgtgtccctgtcgaagaggcagttcgtgcacttggcagtccatgccgagaatttccgaagtgagatcgtctccgtgagggaaatgagagacatatggtcttgggtccccgagcgcttcgctctctgtcaaccgctacttctctttagctctctccaacacggctatagcctcgcccgattctacttccagtgcgaggggcatgagcctactctgctactaatcaagacgacgcagaaggaagtgtgcggggcttacttatccacagactggtctgaacggaataagttcggagggaagcttggttttttcgggactggtgagtgctttgtatttcgtctgcagccggaggtacaaagatacgagtgggttgtgatcaaacacccggagctgacaaagcctcccccattgatggcagcggaacctaccgcacccctatcgcactcagcctccagcgacccagcggatagactgagcccctttctcgcggcccgccattttaacctgccatccaaaaccgagtcaatgtttatggcaggtgggagcgattgcctcattgtggggggcggggggggtcaggcgctctacattgacggggatttaaatcggggccgaacctctcattgtgatacgtttaacaatcagcccttgtgcagcgaaaacttcctcattgccgcagttgaggcctggggattccaagaccccgatacacagtag

SEQ ID NO: 208138 - DNA, 2067 bp, Artificial Sequence
  Description of Artificial Sequence: Synthetic coding sequence
atggccaccgccagcggcgccagcgacctgagcggcagcggcgcccctccccccggcgttggcgcccaggctgccgccgctgccgaggaagaggagcgggaggtggtgcgtgtacgggttaagaagtgtgaatcattcttgccccctgaatttcgctcctttgccgtggacccgcagattacatccctcgatgtcttacaacacatcttgattcgcgctttcgacttaagcggcaagaaaaatttcggaataagttacctcgggcgcgataggctgggccaggaagtgtacctgagcctcctttctgactgggacctatcaacagcctttgccactgcgtcaaaaccctatctccagctgagggttgacatcagacctagtgaagattcccccctcttggaggactgggatataatcagcccaaaagacgtgattgggtcagacgtgctcctggccgaaaagagatcatccctcacaaccgcagccttgccttttacacagtcaatcctgacacaggttggccgtaccctttccaaagtgcagcaagttctgagctggtcatacggtgaggacgtgaagccttttaagccccctctctccgacgcagagtttcacacttatctgaaccatgagggacagcttagcagacctgaggagttgagacttcgcatttatcacggcggcgtcgaacctagcctgcggaaggtggtgtggaggtacctgctaaacgtttaccctgacgggcttacgggaagagagaggatggattatatgaaacgcaaaagccgtgagtatgagcaactgaaatctgaatgggcccaaagagctaatccagaggacttggaatttattaggtccaccgtgttgaaggatgtgctgagaaccgatcgcgctcacccctattacgccgggcctgaggatggaccccatctacgggcactgcacgatctgttaactacgtacgctgtgactcacccccaggtgagttattgccagggaatgtcagacctggccagcccaatactggccgtgatggaccacgagggacacgcgtttgtctgcttttgcggcataatgaagcgactggccgccaattttcaccctgacggacgcgcaatggccaccaagttcgctcacctgaaattactactccgccacgctgaccctgatttttatcagtacctgcaggaagcgggagccgatgatcttttcttttgttaccgatggctgttgttggagctaaagcgggaatttgctttcgacgatgctctccgaatgctggaggtcacttggagctccctgccacccgaccctcccgaacacgaagtggagttggtgggtccaccttcccaagtggctgacgcgggctttggaggccatcgtgggtggccagtacgccagcgccacatgctgcggcctgcgggcggcgggggttccactttcgaagatgctgttgaccacttggccacagcctcgcaggggcccggaggcggtgggaggcttctgagacaagctagcctcgatggtctacagcagcttcgggataacatgggctctcggagagacccactggtgcagttaccacatcctgccgcccttatcagctcaaaatcactgtctgagcccctgcttaactctccggacccactgctctctagtttctctcatccggattcccctagttcttccagccccccgtctacacaggaagcgtcacccacaggagacatggctgtcgggtccccactgatgcaggaggtgggatctccgaaggaccccggtaaaagtctgccccctgttcctccaatgggacttccaccacctcaggaatttggacgcgggaacccattcatgttatttctgtgcctcgccattttgctcgagcacagagatcatattatgcggaatggattggactataacgagctggcaatgcattttgaccgtctcgtgagaaaacaccatctcggccgcgtcctccggcgggctagggctctcttcgctgattacctccagtcagaggtatgggattcagaggagggcgcagaggccaccgccgcttcctag

SEQ ID NO: 208139 - DNA, 693 bp, Artificial Sequence
  Description of Artificial Sequence: Synthetic coding sequence
atggccaccgccagcggcgccagcgacctgagcggcagcggcgccccaccccccggcgtaggcgcacaagcagccgcagctgccgaggaagaagagagggaagttgtgagagtgagagttaagcacggtgacggagcgcctggaggattgccacatgtgttcagcccccaaaaatgcgaatccttcttgcctcctgaatttagaagtttcgctgttgaccctcaaatcacatcccttgacgttcttcagcacattctaatccgcgcatttgatttgagcggaaaaaagaattttggaatctcatatcttggccgggatcgactgggacaagaagtgtacctctctctcctgagcgactgggacctaagcacagccttcgctaccgcaagcaagccttaccttcagttgcgggtcgatattcgtccttccgaagattccccattgctggaggattgggatattattagccccaaagacgtgatcggctctgatgtgcttctcgctgaaaaaagaagctctctgacgaccgcagcactgcccttcacccagtcgatactgacacaagtgggcaggactctgtctaaagtgcagcaggtgctgtcctggtcttacggcgaggacgttaagccctttaagccccccttgagcgatgccgaattccacacttacctcaatcacgagggacagctttag

SEQ ID NO: 208140 - DNA, 303 bp, Artificial Sequence
  Description of Artificial Sequence: Synthetic coding sequence
atggccaccgccagcggcgccagcgacctgagcggcagcggcgcccccccaccaggcgttggcgcgcaggctgccgcggctgccgaggaagaggaacgagaagtagtgagagtgagggtaaaaaagtgtgagagcttcctgccgcccgagtttcgaagctttgcagttgatccgcagattacttctctggacgtgctgcagcatatccttatacgcgcgttcgacttgtcagggcccatcgcccgccggctcggccacaaccagcctcagcgctgtcattggcttcggcgtgtggcaggatag

SEQ ID NO: 208141 - DNA, 1305 bp, Artificial Sequence
  Description of Artificial Sequence: Synthetic coding sequence
atggactacatgaagcggaagagccgggagtacgagcagctgaagagtgagtgggcacagagagccaaccctgaggacctcgaatttatccggtcaactgtcttgaaggatgtgttaagaacagatcgggctcacccttactacgcaggcccagaggacggaccacacctgagggcccttcacgatctcctgacaacatatgctgtgacccatccccaggtttcatattgtcagggcatgtctgacctggcgagtccaatccttgcggtgatggatcatgaaggacacgcgttcgtctgcttttgtgggatcatgaagcgcttggccgccaacttccaccctgacgggagagcgatggccacaaaattcgcccacctgaaacttctgctgcgccatgccgacccagatttttatcagtatctgcaggaggctggtgctgacgatctgttcttttgttaccgctggctattactagagttgaagcgcgaattcgcttttgatgatgccctgcggatgctagaggtgacctggtcttctctgccgcctgaccccccagaacacgaggtggaactggtcggccccccctcacaggtggccgatgctggattcggtggtcataggggctggcctgtgcggcaacgtcacatgctgaggcctgctggtgggggcggatccacatttgaggacgccgtggatcacttggccacggccagccaaggtccaggtggggggggcaggctgctcaggcaggcctctctggacggcctacagcagctgcgagacaacatgggcagccggcgcgaccccttggtgcagctccctcatccagccgctttgataagttccaagtctctcagcgaacccctcctcaactcacccgaccccttgctgtcgagcttcagccatcccgatagccccagttcatccagcccccctagcacgcaagaagccagcccaacaggcgatatggctgtgggctctcccctgatgcaagaggtggggtccccgaaggacccaggtaaatcactgccacctgtgcccccaatgggtctgccacctccacaagagttcggaagggggaatccttttatgctgttcttgtgccttgctatccttttggagcatagagaccatattatgcgcaacgggttggactacaacgaacttgcgatgcactttgacagacttgttcggaaacaccacctcggtcgcgttctccgaagagcccgagccctctttgccgactacctgcagagtgaagtttgggactccgaagaaggcgccgaagccaccgctgcctcatag

SEQ ID NO: 208142 - DNA, 876 bp, Artificial Sequence
  Description of Artificial Sequence: Synthetic coding sequence
atggacgtggtggaggtggccggcagctggtgggcccaggagcgggaggacatcatcatgaagtacgagaaaggccatcgggcaggtctgccagaagataaaggtcctaagcccttccggagttataataacaacgtagatcacctcgggatcgtacatgagacagagttaccaccattgaccgcacgcgaagcgaagcagattagacgcgagatttctcggaaatcgaagtgggtagacatgcttggtgattgggagaagtataagagttccaggaagctgatcgaccgcgcctataagggtatgcccatgaacattcggggtccgatgtggagcgtgttgcttaatatagaagagatgaagttgaagaacccaggacgataccaaatcatgaaggaaaaaggaaagcggtccagcgagcatatacagcgcatcgatcgcgacgttagcgggactctgagaaaacatatcttttttcgggataggtacggtacaaagcagagagagcttctccatatcctgctggcctacgaagagtacaaccccgaggtgggttattgtcgcgatctgtctcacatagccgccctcttcctcttatatcttccagaggaggacgccttctgggcccttgtgcagctcctggcgtctgaaaggcacagcctccagggctttcatagtcccaacggaggtacagtgcagggcctgcaggaccagcaggaacatgtggtcgctacttcacagccgaaaacaatggggcaccagagcgcctcccgccggagacccggagttgcacgaggacacgttttcgcgaccggtagcctgatccccggacctggaatgcggacactgtgttctagcatcctgggacctctgtag

SEQ ID NO: 208143 - DNA, 1650 bp, Artificial Sequence
  Description of Artificial Sequence: Synthetic coding sequence
atggacgtggtggaggtggccggcagctggtgggcccaggagcgggaagacatcatcatgaaatacgagaaaggacatcgcgccgggctccccgaagataaaggccctaagcccttcagatcttacaacaacaacgtggaccacctagggatcgttcacgagaccgaactcccccctctcacagcaagagaagccaagcaaatccgacgcgaaatctcgcgaaagagcaagtgggttgatatgctcggagattgggagaagtataagtcgagccgcaaattaattgaccgggcttataagggcatgcccatgaacattcggggacccatgtggagcgtcctgctcaatattgaggaaatgaagctgaaaaatcccggccgataccagatcatgaaggaaaaggggaaaaggtcgtctgagcacatacaaaggatcgaccgcgatgtgtctggaactttgaggaaacacatcttttttcgggacaggtacggaacaaagcagcgcgaactgttgcatattcttctggcttatgaggagtacaatccagaagtgggatactgcagagatctctcccacatcgccgcgctgtttctgctgtatctgccggaagaggatgccttttgggcactagttcagctattggccagcgagcgtcactccttgcaggggtttcatagtccgaatggggggacagtccagggcctccaggaccaacaggagcacgttgtggcgactagtcagcccaaaaccatgggtcatcaggacaagaaagatttgtgtggacagtgtagcccccttggctgtctgatccgcattttgattgatggcatctcacttggactcactctaagactctgggatgtctatctggtggagggagaacaggctttgatgccaattacacggatcgcgtttaaggtccagcagaagaggctgacaaagaccagcaggtgtgggccgtgggcacgattctgcaacagatttgttgatacttgggccagggacgaagacaccgtgctcaagcacctgcgagcgtcgatgaagaaacttacgcgtaagcagggagacctcccaccccccgctaagccggagcaaggtagttcggcttcccgcccggtgccggcaagccgtggcggaaagactctatgtaagggtgacaggcaggctccccccggaccaccagcccgatttccacgacctatctggtcagcatcccctccaagggccccccgaagcagtaccccatgtcctggcggagcggtccgggaggatacctatcccgtgggaactcagggtgttccgtctcccgccctggcccaaggtggccctcagggatcttggcggttcctgcaatggaactcaatgccaaggcttcctacagacctggacgtcgagggcccatggtttaggcattatgactttcggcaaagctgctgggttcgggctatatcccaggaggatcaactggcaccttgttggcaggcggaacatccagcagaacgcgtgcggtccgcattcgcggccccatccacagacagcgaccagggcacacctttcagggcaagagatgagcagccttgtgcacctacctctgggccatgtctgtgtggccttcacctggagagctcgcaattcccgcctggcttttag

SEQ ID NO: 208144 - DNA, 900 bp, Artificial Sequence
  Description of Artificial Sequence: Synthetic coding sequence
atgggccaccaggacaagaaggacctgtgcggccagtgcagccccttgggatgtctgattaggatcctgatcgacggtatatcactggggctgacccttagactgtgggacgtgtaccttgttgaaggagaacaggccctgatgccaattaccaggatcgccttcaaggtgcagcaaaaacggctcaccaaaacatcgcgttgtggaccttgggcccggttctgtaatagattcgttgatacgtgggcgcgcgacgaggatacagtcttgaaacacttaagggcatcgatgaagaagctgacacgaaaacaaggtgatctgcccccccctgctaagccagagcaagggagctctgccagtcggccggtacccgcctcaaggggaggaaagacactgtgtaaaggggaccgccaggcaccacccggacctcccgccaggtttccaagaccaatttggtctgccagtccaccgagggctccaagaagttcgaccccttgccccggcggggccgtgagagaggatacgtacccagtaggcactcagggggttccatccccagcgctagcacagggtgggccccaaggcagttggaggtttctccagtggaattccatgccacggctgcccacagacctcgatgtcgagggcccctggtttcgacactacgacttccgccagtcgtgttgggtgcgggcgatttcacaggaggaccaactggccccgtgctggcaagcggaacacccggccgaacgcgtgcgctcagccttcgcagctccgagtaccgattccgaccaaggcacgccctttagggcgagggatgaacagccctgcgctccaacgtcgggcccctgcctctgtggattgcacttagaaagcagccagttcccacctggattttag

SEQ ID NO: 208145 - DNA, 1584 bp, Artificial Sequence
  Description of Artificial Sequence: Synthetic coding sequence
atggacgtggtggaggtggccggcagctggtgggcccaggagcgggaggacataatcatgaagtatgagaaaggacatcgcgcaggactgcccgaagacaaaggccccaaaccttttcggtcttacaacaacaacgtcgatcatctgggaattgttcatgagacagaacttccaccgctgacggctcgggaagccaagcagattcgccgggaaatttctagaaagtccaagtgggtagacatgttgggagactgggaaaagtacaagagttctaggaagctgatcgacagggcgtacaagggaatgccaatgaatatccgcggacctatgtggtctgtgctgctcaacatcgaggaaatgaaactgaaaaaccccggacggtatcagatcatgaaagagaagggaaagagatcatcagagcatattcagagaattgatagagacgttagcggtactcttcgtaaacatattttctttcgcgatcggtatgggacaaagcaacgtgagctcctgcatattctgctcgcgtacgaggaatacaatcctgaagtgggatactgtcgtgacttgagccacatcgcagccctgtttctcctctatctcccagaggaggatgccttctgggccctggtccagttactcgccagcgaaaggcattctctacaggggttccattcacctaatgggggcacggttcagggactacaagatcagcaggagcacgtggtagctactagccagccaaagacaatgggacaccaaatctccctcggactcacgttgcgtctgtgggacgtgtatctggtggaaggggaacaggccttgatgcccatcacacgcatcgcctttaaagtccagcaaaaacggctcacaaagacctcacggtgtggcccctgggcaagattttgcaataggtttgtggacacctgggcccgagatgaggataccgttctcaaacacttaagagcttccatgaagaagctcacgcggaagcagggcgacttacctccaccagccaagccagaacagggctcttctgcgtcgaggccagtgcctgcgagtaggggggggaagaccctctgcaagggtgaccgccaggctccccccgggcctccagcccgctttcctcggccgatttggtcagcttccccacccagggcgccacgtagttctactccttgtcccggaggtgctgtcagagaggatacatacccggtagggactcagggggtacccagtccggccctggcccagggagggccgcagggatcatggagattcttacagtggaactccatgccaaggctgcccactgacctagacgttgagggcccttggttccgccactacgactttcgccagtcatgctgggtaagagcgattagccaggaagaccagttagccccctgttggcaagccgagcatccggcagaacgggtgcgttctgcgtttgctgcgcctagtacagacagtgatcagggaactccctttagggcgagagatgagcagccatgtgcgcctacctcgggaccttgcctgtgtggcctccacctcgagtctagccagttcccaccgggcttctag

SEQ ID NO: 208146 - DNA, 1650 bp, Artificial Sequence
  Description of Artificial Sequence: Synthetic coding sequence
atggacgtggtggaggtggccggcagctggtgggcccaggagcgggaagacataatcatgaagtacgaaaagggacatagggcaggactgcccgaggataaggggcctaagccttttcggtcatacaacaataacgtggaccaccttggaatcgtgcatgagactgaattgccccctctgacggcccgggaagctaagcagatccggagggagatttcacggaagtctaaatgggttgatatgctgggagattgggagaaatataaaagcagtcgtaagctgatagaccgagcgtataaggggatgcctatgaatatccggggccctatgtggtccgtcttgctgaacatcgaggagatgaaactaaagaaccccggaaggtaccagatcatgaaagagaaaggcaagagatctagtgaacacattcagcgcatcgatagagatgtcagtggaacgctgcgtaagcatatattcttccgcgaccgctacggtacaaagcaacgggagctgttgcatatcctgctagcatacgaagaatacaaccccgaagtcggttattgccgagatctgagccacatagctgctctgttcctgctgtatttgcccgaggaggacgccttctgggcacttgttcagctcctggcttccgaaagacatagtctgcagggcttccacagccccaacggcggcaccgtgcaaggccttcaagaccaacaggaacacgtcgtagcaacatcccaacctaagactatgggacaccaggataaaaaggacctatgtggccaatgctccccattaggttgtttgataagaatcctgatcgatgggatttccctggggctgaccctccgcctgtgggacgtgtatctcgtcgaaggcgagcaagctctcatgccaatcacgaggatcgctttcaaagttcagcagaaaaggcttaccaagacctcacgctgtggaccatgggcacgcttctgcaacaggtttgtggacacatgggcccgcgatgaggatactgtactaaagcacctgcgcgcttccatgaagaaattaacccggaaacagggggatcttccgccacccgccaaaccagaacagggtagtagcgcttctcgccctgtccccgcttccagggggggaaagaccctctgtaagggagacaggcaggctccccccggcccaccagctagattccctcgaccaatctggtcagctagccccccaagggcacccaggagcagcaccccttgtccaggcggagctgtcagagaagacacctatccagtagggactcagggcgtcccttcccctgctctggcacaaggggggccacaggggtcgtggcggtttctgcaatggaattccatgcccaggctgcctacagatctggatgtggaagggccatggttccgacactacgactttcgacagagctgctgggtgagggcaatctctcaggaagatcagctggccccttgttggcaggcggaacaccctgccgagcgggtccgttcagctttcgccgctccaagcactgactctgaccagggaactcctttccgtgcacgagatgagcaaccgtgtgcccctactagcggcccatgtctgtgcggattgcaccttgaatcatcccagttccccccagggttttag

SEQ ID NO: 208147 - DNA, 1584 bp, Artificial Sequence
  Description of Artificial Sequence: Synthetic coding sequence
atggacgtggtggaggtggccggcagctggtgggcccaggagcgggaagacatcatcatgaagtacgaaaaaggccacagggcaggactgccagaggataaggggccgaagccctttaggtcctacaacaataatgtggatcacctaggtattgttcacgagactgaactgcccccactaaccgcccgcgaagcgaaacaaatccggagagaaatttcaagaaaatctaagtgggtcgacatgctaggagactgggagaaatataagagttctcgcaagctgatcgatcgcgcctataagggcatgccaatgaatatcagaggacctatgtggagtgtgttgctcaacatagaagagatgaagctcaagaacccagggcgatatcagattatgaaagaaaagggaaaaaggtcctctgaacatattcaacgtatcgaccgggacatctctggaaccctgcgaaagcatatgttttttcgagatagatatggtactaaacagcgcgagctgctgcacattttgctcgcctatgaggaatacaaccccgaagttggttactgccgcgacttgtctcatatcgccgccctgtttttgctgtactttccggaagaagatgctttctgggctctcgttcaacttctggcgtccgagagacatagcctgcaaggctttcactcacccaatggcggcacagtgcaaggcctccaggaccagcaggaacatgttgttgcgacaagccagagtaagacgatgggccaccagatcagcctgggcctcaccctgcgcctgtgggacgtttaccttgtggaaggagagcaagcactgatgcctattacacgcatagccttcaaagtccagcagaaacgactcacaaagactagcaggtgtggtccatgggctcggttttgcaaccgcttcgtagatacatgggcccgtgacgaggatacggtgctgaaacaccttcgggcctccatgaagaaattgacgcggaaacagggggacctgcctccgccagcaaagccagagcagggctcctcggcgagcaggcccgtgcctgcatctaggggaggaaagaccctgtgtaagggtgatcgccaggcacctcccgggcctccagctaggtttccccggccgatctggtctgcaagcccaccacgcgcccccaggtcgtctactccttgcccaggcggcgcagtccgagaagacacctatcctgttggcacgcagggtgttccaagtccagccctggctcagggtgggccgcagggtagctggaggtttcttcagtggaactcaatgcctaggctgcccacggatctcgatgttgagggtccctggttccggcactacgattttcgccagtcatgctgggtacgcgcaatctctcaagaagaccagctggctccctgttggcaggctgagcaccccgcagagcgcgtgcgcagtgccttcgccgctcccagtaccgactctgaccaagggactccttttagggccagggatgaacagcaatatgcccccacctcaggcccctgcctttgtgggctgcatctcgagtcttctcagtttcctcctggcttctag

SEQ ID NO: 208148 - DNA, 1650 bp, Artificial Sequence
  Description of Artificial Sequence: Synthetic coding sequence
atggacgtggtggaggtggccggcagctggtgggcccaggagcgggaggacattatcatgaagtacgagaagggacacagggctggccttcccgaggacaagggccctaaacccttcagatcttataacaacaacgtggaccacttgggtattgtacacgaaacggaactgccaccgctgacagcccgcgaggctaaacaaattcgccgggagatatccaggaagtccaagtgggttgatatgctcggagactgggagaagtataagagttctaggaagctgattgatagagcatacaaaggaatgcctatgaatattaggggccccatgtggagcgtgcttctgaacatcgaggagatgaagctcaagaaccccggtagataccagataatgaaggagaagggcaaaaggagcagtgagcacatccagcggattgaccgcgatatttcggggacattgcgcaaacacatgttcttcagagatcgttacgggacaaagcagcgagaattattgcatatcctcctcgcctacgaggagtacaaccccgaagtgggttactgccgggatctctcacatatagcagcacttttcctcttgtattttccagaagaggacgccttctgggccttggtgcagttattggccagcgagagacatagcctgcagggcttccactcgcctaacggcggaacagttcagggattgcaagatcaacaggagcacgtggtcgcaacttcacagagcaagacgatggggcatcaggataagaaagatctgtgcgggcaatgttccccactcgggtgcctgatcaggattctcatcgacggaataagcctgggcttaaccctgagactgtgggatgtctatttggtggaaggagagcaagcccttatgcctatcactaggattgcatttaaggttcaacagaagaggctgaccaaaacgtctcgctgcggcccatgggcgcggttctgcaaccgcttcgtcgatacctgggctagagatgaggataccgtattgaaacacctgcgggcttctatgaaaaagttgaccagaaaacagggcgatctgcctccccccgcaaaaccagagcaaggaagtagcgcatcccgtccggtccctgcaagcagaggtggcaagactttgtgtaaaggagatcgccaggccccgcccggcccgcccgcgcgctttcctcgtcctatttggtctgccagtccacctagggcccccagatcttccactccatgtcctgggggtgccgtccgggaggatacatatcccgtggggacccagggtgttccttctcccgcactcgcccaaggtgggccccagggctcttggcgcttcctgcagtggaactctatgcccagactgccaaccgacctggatgtcgagggaccctggtttaggcactatgatttccggcaaagctgttgggtccgcgccatctcacaggaggaccagctggctccatgctggcaggccgaacaccctgcagaacgcgttcgcagcgcttttgcagccccgtccactgactctgaccagggaactcctttccgcgccagggacgagcaacagtacgcacctaccagcggaccatgtctgtgtggacttcacttggagagcagtcaattccctcccggattctag

SEQ ID NO: 208149 - DNA, 1650 bp, Artificial Sequence
  Description of Artificial Sequence: Synthetic coding sequence
atggacgtggtggaggtggccggcagctggtgggcccaggagcgggaggatatcatcatgaagtacgaaaaaggtcaccgggctggcttgcccgaagacaaaggaccaaaaccatttagaagttacaataacaacgtagaccatcttgggatcgttcacgaaacagagctgccaccactgacagcaagggaagcgaagcaaatccggcgtgaaatctcaaggaagtcaaagtgggtcgacatgctgggcgactgggagaagtacaaatctagccgtaagctgatcgacagagcctataagggcatgcctatgaacattagggggcctatgtggtcagtgctcttgaacatcgaagaaatgaagctcaaaaacccagggcgctatcagattatgaaggagaagggaaaaaggtcttcagagcacattcaacggatcgatagagacatctcaggcacgctgcgtaaacacatgttctttcgagatcgttatggcaccaaacagagggagttgctgcatatattacttgcgtatgaagagtataaccccgaggtaggctattgtcgggacctaagccatatcgcagccctgtttctgctatatttccccgaggaagatgccttttgggctcttgtgcagctgctggcttccgaaaggcactctctccagggctttcactcgcctaatggtggaactgtacagggcctccaggaccagcaggaacacgtggtggctaccagccagtcaaagactatggggcatcaagataagaaggatctgtgcgggcagtgctctccattggggtgtcttattcggattctcattgatggcatatccctaggacttacgctgcgactctgggacgtgtacctcgtggagggtgagcaggcactgatgcccatcacacggatcgcctttaaagtccaacagaagcggcttactaaaacctccagatgcggaccgtgggcgaggttctgtaatcgattcgtagacacttgggctcgggacgaagatacagtccttaaacatctcagagcttctatgaaaaagctcaccaggaagcaaggcgacttgcctccacccgctaagcccgagcaggggtctagtgcgtctagaccagtcccagctagcagaggaggcaagaccctttgcaagggcgaccgccaggccccgcccggaccacccgccaggtttcctcggcctatttggtctgcctcccctccacgcgctcctcggtcaagcacaccttgtcctggtggagccgtccgagaagatacctatcctgtcggcacccagggagtgcccagccctgcactggctcagggaggccctcagggctcctggcgctttctgcagtggaattccatgcccagactgccaacagacttggatgttgaaggtccttggtttcgccactatgacttccgccagtcatgttgggtcagggccatctcccaggaggaccagctcgctccttgttggcaggcagaacatccagcagagagggtccgttccgctttcgctgccccgagtacagatagcgaccagggaacgcctttccgggcccgagacgaacaacagtatgctcctacctccggaccatgtttatgcggtctgcatctggagtcctcacagttcccccctgggttttag

SEQ ID NO: 208150 - DNA, 1650 bp, Artificial Sequence
  Description of Artificial Sequence: Synthetic coding sequence
atggacgtggtggaggtggccggcagctggtgggcccaggagcgggaggacataattatgaagtatgagaaaggacatcgagccggactgccagaagataaaggtcccaaaccatttaggtcttataataacaacgtcgatcatttgggtatcgtccacgaaacggagctcccgcccctgacggcccgcgaagctaaacagataagacgagagatatcgcgcaagagtaaatgggtggacatgttgggagactgggagaagtacaaatcgagtcgcaagctgatcgaccgagcctacaagggaatgcccatgaacattcggggccctatgtggagtgttctgcttaatatagaagaaatgaaactgaaaaacccaggccgttaccagatcatgaaggagaaagggaaacgaagctccgaacatatccagcgcattgatagggacatctccggaactttacgtaaacacatgttctttcgcgacagatacggaacgaagcaaagagaactactgcacatcctgctagcatatgaggaatataatcctgaagtggggtactgtagggacctctcacacattgcggcactcttcctcctatacctgcccgaagaggatgcattttgggcactggtccaactgctcgcatctgaacggcactcactccagggtttccactcaccaaacggagggactgtccagggcctccaggaccaacaggaacacgtggtggctacaagccagagcaaaacaatgggtcatcaagacaaaaaagacctctgtggccagtgttctccactcgggtgtcttatccgcatcctgattgacggtataagcctgggcctgactctcagattgtgggacgtctacttggtcgaaggagaacaggcactgatgccaatcacacggatcgcctttaaagtccagcagaaacggctgacaaagacctccagatgtggcccctgggccaggttttgcaatagattcgtagatacatgggcccgagacgaagacacggttctgaaacacctgcgtgccagcatgaagaagcttaccagaaaacaaggcgacctccctccgcctgcaaaaccagagcagggctcctccgcctcgcgtccagtgccagcatcacgaggggggaaaaccctgtgcaagggcgacagacaggctccacccggacccccagcctggttcccccggcctatctggtccgcttccccgcccagggccccaagatcctccactccttgccctgggggcgcagttcgagaagacacctacccggtgggtactcagggagttcctagtcccgcattggcccaaggaggcccacaaggcagctggcgatttctgcaatggaactccatgccaaggttgcctaccgatctggatgtggagggtccctggttcaggcactacgatttccggcagagctgttgggtccgcgccatttcccaagaagatcaactggctccctgctggcaggccgagcatcctgctgagcgagtacggtctgctttcgccgccccatctaccgactcagatcaaggcaccccttttagagccagggatgaacagcaatgcgcacccacctccgggccctgtttgtgtggtctgcaccttgagtcgtctcaatttccaccaggcttttag

SEQ ID NO: 208151 - DNA, 1584 bp, Artificial Sequence
  Description of Artificial Sequence: Synthetic coding sequence
atggacgtggtggaggtggccggcagctggtgggcccaggagcgggaagatatcattatgaagtacgagaagggtcaccgcgccggactgccagaagacaaagggcccaagccttttaggtcctacaacaataatgtggaccacttgggaattgtgcatgagaccgaacttccacccctaacggcccgggaggcgaagcagataagaagagagattagcagaaagtctaaatgggtggatatgctgggagattgggagaagtataagagttccagaaagcttatcgatcgcgcctacaaaggcatgccaatgaatataaggggacctatgtggagcgtgctccttaacattgaagaaatgaagcttaaaaatcctggccgctaccagatcatgaaggaaaagggcaagcggagtagtgaacatatccagcgaattgaccgcgatatcagtggcactctgagaaagcatatgtttttccgcgataggtatggcactaaacaacgagaactgctgcatattctgctcgcgtacgaagagtacaaccctgaggttggatattgtcgagatttatcgcacatcgccgcattgttcctcctgtaccttcctgaagaagacgccttttgggccctcgtgcagctgctagcctcagagaggcactcattgcagggatttcatagccccaacggcggaacagtccagggactgcaggatcaacaagagcacgtcgtagcaacgagccagagtaaaacgatgggccaccagatttcactcggcctgaccctgaggctgtgggatgtctatttggtagaaggtgagcaggccttgatgcccatcacccggatagcattcaaagtgcaacagaaaaggctgactaagacgtctcgttgtggaccctgggcacggttctgcaatagattcgtagacacgtgggctcgagacgaggacaccgtcctgaagcatttgagggccagcatgaaaaagttaactcggaagcagggggatctgccaccacccgccaagccggagcaggggtcttcggcttccagaccggttcctgcatcacggggaggcaagacactctgtaagggtgatcgccaggccccccctggtccgcccgcatggttcccccgccccatatggagcgccagtccaccgcgggccccgcgctcatctacaccatgtccaggcggtgctgtcagagaggacacatatcccgtgggcacgcagggagtgcccagccctgcactagctcagggaggcccacaagggtcctggcggtttctgcagtggaacagtatgcccagactcccaaccgatctggatgtagagggtccttggtttagacactatgatttcagacagtcttgttgggtccgcgcgatctcacaggaggatcagctggccccatgctggcaagcagagcaccccgcagaacgcgtgaggtccgcattcgccgccccttcaactgatagcgatcagggaacaccatttagagcaagggacgaacagcagtgcgcacccacgagcgggccatgcctgtgtggcctccacctggaatcatcccaatttccacccggattctag

SEQ ID NO: 208152 - DNA, 1650 bp, Artificial Sequence
  Description of Artificial Sequence: Synthetic coding sequence
atggacgtggtggaggtggccggcagctggtgggcccaggagcgggaggacatcattatgaagtacgagaagggccaccgagccggcctgcctgaggacaaaggccccaaaccattcaggagctacaacaacaacgttgaccacctgggcatagtgcatgagacggaactgccccccctgacagcgcgggaggctaagcagatccgcagagagatatcacgtaaaagcaagtgggtggacatgctcggggattgggagaagtacaagagcagtcgaaagctgatcgatagagcctacaagggcatgcctatgaatatcaggggccctatgtggtctgttctcctgaatatcgaggagatgaagctgaaaaacccgggccgatatcagatcatgaaagagaaggggaaaaggtcaagcgagcacattcagcgaattgaccgcgacatctctggtacactgcgaaaacacatgttcttcagagatcgctatggcaccaagcagcgggagctgttgcacattctgcttgcctacgaggagtataatccagaggttggctactgcagggatttgtcccacatagcagccttgttcttattgtaccttcccgaggaggacgccttttgggctctggtgcagctgctggcctcggaacggcatagcctgcagggattccattccccaaacggcggaacagtgcagggtctccaggatcaacaggagcacgtcgttgcaaccagccaatctaagaccatgggtcatcaggacaaaaaggatctgtgtggccaatgcagccccctgggttgcctgataaggatcctcattgatggcatttctttaggccttaccctcagattatgggacgtgtatctggtcgagggtgagcaggccttgatgcctattacccgcatcgcctttaaggtgcagcagaaacggctcaccaaaactagcagatgtgggccctgggctagattctgtaatcgattcgtggatacttgggcaagggacgaggataccgttctgaagcacttgcgcgcctccatgaagaagctgactcggaagcagggtgatcttccccctcccgccaagcccgagcagggtagctctgcctcgcgcccagttccagcatcccgcggagggaaaaccctctgtaaaggggatcggcaagccccgcctgggccacccgcgtggtttcctagaccgatttggagcgcctccccgccacgagctcctcggtcctctaccccatgcccggggggagctgtgcgagaggacacctaccctgttggtacacagggggttccctcaccggctctggcccaaggcggtcctcagggatcatggagattcctgcaatggaatagtatgccccggctgccaactgacctggatgtggaggggccatggtttaggcactacgacttccgccagtcatgctgggtgagggcgatctcgcaagaggatcagctggccccctgctggcaggctgagcaccccgccgagagggtgcgcagcgccttcgctgcaccgtccaccgattctgaccaagggacacctttccgggctcgtgatgagcagcaatgcgcacctaccagtggaccctgcctgtgtgggctgcatctggaaagttcgcagttcccccccggattttag

SEQ ID NO: 208153 - DNA, 1650 bp, Artificial Sequence
  Description of Artificial Sequence: Synthetic coding sequence
atggacgtggtggaggtggccggcagctggtgggcccaggagcgggaagatattattatgaaatacgagaagggccaccgcgccggcctgccggaggataagggccccaagcctttccgttcatacaataataatgttgaccacctcggcatagtgcacgagacggaactgccccctctgaccgccagggaggccaagcaaattcggcgcgagatctctagaaagtctaaatgggtcgacatgctgggtgattgggagaaatataagtcaagccggaagcttattgatagggcctacaagggaatgcccatgaacatacggggcccaatgtggagtgtgctcctcaataccgaggaaatgaagctgaaaaatcctggtcggtaccaaattatgaaggagaaaggtaaacgatccagcgagcacatccagcggattgaccgcgacgtgagtggcacgctccggaaacacatttttttcagagaccgctacggcaccaagcagagggagctgctgcatatactgttggcatacgaggagtacaatccagaagtggggtactgtcgagatctctcgcatattgccgctttatttttgctgtatttgcccgaggaggatgctttctgggcgctggtccagctcttggcatctgagcgtcacagccttcaaggctttcacagccctaatggcggcacagtccaggggctccaggaccagcaggaacacgttgtggccacctcccagcccaaaaccatgggccatcaggacaagaaagatctttgcggtcagtgcagcccactgggatgccttataaggatcctgatagatggtatctccctcggtctgacgttgagactgtgggacgtgtacctggtcgaaggggagcaggcgctgatgcctattaccagaattgcctttaaagtgcagcagaaaaggcttaccaaaacatccaggtgcggtccttgggcccgcttttgcaaccgctttgtggacacttgggccagagacgaggacactgtcctcaagcacctccgcgcttctatgaaaaagctgacacggaagcagggagacctgccgcctcctgccaaaccagaacaaggctctagtgctagcaggccggtgccagcctcccggggcggcaagaccctctgtaagggcgaccggcaggcccctcccggacctcctgctcgctttcctcgtccaatctggtctgcaagtccaccccgcgctccccgatcaagcaccccttgccctggtggcgccgtgcgcgaagatacataccctgtagggacacagggagtccctagccctgctctggcccaaggcgggccccagggctcttggcggttcttacaatggaattctatgcctcggcttcccactgacttggacgtggaggggccatggttcagacactacgacttccggcaatcatgttgggtacgggctataagtcaagaggaccagctggcaccatgctggcaagccgaacaccctgcagaaagagtccgctccgctttcgctgctccaagcacggactccgatcagggtaccccgttccgcgcgcgggacgagcaaccatgtgctccaactagcggaccctgtctttgtggcctccatctggaatcttctcagttcccacccggcttctag

SEQ ID NO: 208154 - DNA, 876 bp, Artificial Sequence
  Description of Artificial Sequence: Synthetic coding sequence
atggacgtggtggaggtggccggcagctggtgggcccaggagcgggaggatataataatgaagtacgagaaggggcatcgggctggtcttcccgaagataaaggccccaagccctttagatcgtataataacaacgttgatcatctaggcattgtacatgagaccgagcttcctccattgaccgctcgggaagctaagcagatcaggcgggaaatcagcaggaaaagcaaatgggttgatatgctgggggattgggaaaaatataagtcgagccgtaaactgatcgacagagcttataaggggatgcccatgaatattaggggacctatgtggtccgtcttgttgaatactgaagaaatgaaattgaaaaaccctggccgctaccagataatgaaagaaaagggtaagagatcaagtgagcacatccagaggatcgatagggacgttagcggcacattgcggaagcatatattttttagagatagatacggcacaaaacagcgcgaacttctgcacattttactcgcgtatgaggaatacaacccggaggtaggttattgccgcgacctgtcccacatcgcagctctcttcctgttatacctacctgaggaggatgctttttgggcgctcgtgcaactgcttgcaagcgagcggcattctcttcagggcttccacagccccaacgggggcactgtacaaggtttgcaggaccaacaggaacacgtggtagccacgtcacagccgaagaccatggggcatcagagcgccagtaggaggcgccccggggtcgctcgcggccacgtgttcgccacaggctccctgatccccggacccggaatgagaaccttgtgctcctccatcttggggcccctatag

SEQ ID NO: 208155 - DNA, 900 bp, Artificial Sequence
  Description of Artificial Sequence: Synthetic coding sequence
atgggccaccaggacaagaaggacctgtgcggccagtgcagccccctgggatgcttaattcgaatcctcatcgacggcattagcttaggcctaacgttgcgactttgggatgtgtacctggtggaaggagagcaggcattaatgcccatcacaaggattgcctttaaagtacaacaaaaacggttgaccaaaactagccgatgcggcccttgggcacggttctgcaaccgattcgtggacacgtgggcacgcgacgaggacaccgttcttaagcatttgagggcaagcatgaagaaacttacacgtaaacaaggcgacttgcccccgcctgcaaaaccggaacaaggatcttctgcaagtcgaccagtgcccgcctccagaggtggtaaaacactctgcaagggagacagacaggccccgcctgggccaccagcaaggttccctagacctatttggagcgcttccccacctagggcccctagaagctctaccccttgcccagggggggccgtcagggaagatacataccctgtgggcacacaaggcgtgccatcccccgccctcgcccagggcgggccccaggggagctggcggtttttgcagtggaacagcatgcctcgactgcctacagatctcgacgtggagggaccctggtttagacactatgattttagacaatcgtgctgggtgagggctatatctcaagaggaccagttggctccatgctggcaagcagaacaccctgccgagcgcgtcaggagtgcctttgcagctccctccaccgattcagaccagggtaccccttttcgcgctcgggacgaacaaccatgcgcacctacttccggtccgtgtctgtgcggtctccatctggagtcctctcaattccctccaggcttttag

SEQ ID NO: 208156 - DNA, 1410 bp, Artificial Sequence
  Description of Artificial Sequence: Synthetic coding sequence
atgctgggcgactgggagaagtacaagagcagccggaagctgatcgacagagcatataaaggaatgcctatgaatatcagaggaccaatgtggagcgttctgctgaacacagaggaaatgaaactgaagaaccccggacgataccagataatgaaggaaaagggaaaacgcagttccgaacacatccagcggatcgaccgcgacgtctccggaactctgcgcaaacatattttcttccgggatagatacggcaccaagcagagagaactcttgcatatcctcctagcatacgaagagtacaatcccgaagtgggatactgtcgggatctctctcacatcgctgccctgttccttctatacctccctgaagaagatgctttctgggccctcgtgcagttactcgccagtgaacgacactccctgcaaggcttccattctcctaacggaggaaccgtgcagggactgcaggaccagcaggaacacgtggtggccacatcccagccgaaaaccatggggcaccaggacaagaaggacctatgcgggcagtgcagtcccctcggatgtttaatccgcatcctgatcgacggaattagcctcgggcttactctgcggctctgggatgtctatctggttgaaggtgagcaggccctgatgcccataaccaggatagcctttaaggtgcagcagaagcggctcaccaagacgagccgctgtggtccctgggccagattttgtaatagattcgtggatacatgggcacgtgacgaggacacggtgctgaagcatttacgggcatccatgaaaaagctcaccaggaagcagggagatctgcctccacccgccaagccagagcagggctcatccgcttcacggcccgtgcctgcgagtaggggcgggaaaacgttgtgtaaaggggaccgccaggcaccccccgggccccctgctcgattcccgcggcccatttggtctgcatctcctccccgagctcctcgcagcagcaccccttgtccaggcggcgctgtccgggaagacacctaccctgtgggtacacagggcgtgccgtcccctgcattagcccagggcggaccccagggttcctggcgattcctgcaatggaacagcatgccgaggttacctacggatctggatgtggagggtccatggttcaggcactacgacttccggcaaagctgctgggtccgggcaattagccaagaggatcagttggccccgtgctggcaggccgaacatcctgcggagcgcgtccgaagcgccttcgctgcccccagcaccgactcagatcaggggaccccatttagggctcgggacgagcaaccctgtgccccaacaagcgggccatgtctatgtggcctgcacctcgaatcctcacagtttccaccaggtttctag

SEQ ID NO: 208157 - DNA, 1650 bp, Artificial Sequence
  Description of Artificial Sequence: Synthetic coding sequence
atggacgtggtggaggtggccggcagctggtgggcccaggagcgggaagacatcattatgaaatacgaaaaaggccacagagccggattgcctgaggacaaaggaccgaagccctttagaagctataataacaatgtcgatcacctcggaatcgttcacgaaaccgagctcccaccattaaccgcgcgtgaagcaaagcagataaggcgggagatttctcgcaagagcaagtgggtagacatgctgggggactgggagaaatataaaagttcccgtaaattgattgaccgggcgtacaagggaatgcctatgaacatccgaggacccatgtggtccgtattgctgaacatagaggagatgaaattgaagaaccctggaagataccaaatcatgaaagagaaaggcaagaggtcttcagaacacatccagagaatagacagggacatctctgggacattgagaaagcacatgttctttagagatcgatacggtaccaagcagagagagctcctacatattctccttgcctatgaagagtacaatcctgaggtgggatattgcagagacctgtcacacattgcagctttattcctgctgtacttgccagaagaggatgcgttttgggccttagtgcagcttttggcctccgagcgtcacagcctccaaggattccattctccaaacgggggaactgtgcagggcttacaggatcagcaagagcatgttgtggccaccagccagcccaaaacgatgggacaccaagataagaaggatctctgcggccagtgtagccctctgggctgcctgattcgaatactcatcgatggcatttccctgggtctcacccttagactatgggatgtttacttggtcgagggagaacaggccttaatgcccatcacacgaatcgcattcaaagtccaacagaaacgactgactaagactagccggtgtggaccttgggccagattctgtaatcgattcgtagacacctgggcccgggacgaggacacggttctcaagcatctgcgcgcctccatgaagaaacttacacggaaacagggtgacctgccaccaccggcgaaacctgaacaggggagttctgctagccgcccggtgcccgcaagtcgagggggcaagacactgtgtaaaggggaccgacaggcacctcctggcccgccggcccggttccccaggcccatctggtctgcctcccctcctcgcgcacctcgtagttctaccccgtgcccaggcggcgctgttagggaagacacgtatcccgtgggcacccagggggtccccagccccgctttggcgcagggcggccctcagggaagctggagattcctgcagtggaattctatgcctcgcctgccaacagacctcgacgtggagggtccctggtttagacactacgactttaggcaatcttgttgggtgagagcaatctctcaggaggaccaactcgctccatgctggcaggccgagcacccggccgagagagtacgcagcgcttttgctgctcccagcaccgactcggaccagggtacgccattcagggccagagatgagcagcagtgcgctcctaccagtggcccatgtctgtgcggcctgcacttggaatcgtcccagttcccaccaggtttctag

SEQ ID NO: 208158 - DNA, 1650 bp, Artificial Sequence
  Description of Artificial Sequence: Synthetic coding sequence
atggacgtggtggaggtggccggcagctggtgggcccaggagcgggaggatatcatcatgaaatatgaaaagggacacagagccggactgccggaggataaggggcctaaacccttccgttcttacaacaataacgtggaccacttaggcattgtgcacgagacggagctgccccctctcacagccagggaagctaaacagataaggagggaaattagccgcaaatccaagtgggttgacatgctgggggactgggaaaagtataaaagctctcgaaagctgattgatcgggcatataaggggatgccaatgaacatacgcggccccatgtggagcgtgttgcttaacatcgaggagatgaagctcaaaaacccagggagatatcagataatgaaagagaagggaaagcggtcatctgaacatattcagcggatcgacagggacattagcggcacccttaggaagcacatgtttttcagggatcggtatggtactaaacagcgggagctcctgcacatcttactcgcctatgaggaatataaccctgaggtggggtattgccgtgacctcagtcacatcgctgctctgtttcttctgtatcttcccgaagaagacgccttctgggcactcgtgcaactgctcgcttcagaacgacacagccttcagggatttcattcccctaatggcggcacagtacagggcctgcaggatcagcaagagcacgtcgttgctactagtcagcctaagaccatgggtcaccaggacaagaaggatctgtgcgggcaatgttcacctctcggatgcctgattcgtatcttgattgacggaatatcgctgggtttgaccctgagactgtgggacgtttacctggttgagggtgagcaagctctcatgcctatcactcgtatcgctttcaaggtgcaacaaaaacgtctgacgaaaacatctcgatgtggcccttgggctagattctgtaatcgattcgtagatacatgggcgcgggatgaagacactgttctgaagcacttgagggcctcaatgaagaagctgacccgcaaacagggcgatttacctcctcctgccaagcctgaacagggctcctccgccagtagaccggtccccgcttcccggggcgggaagacgctgtgcaagggcgatcgccaagcacccccaggccctccagccagattcccgcgccccatctggagtgcatcacctccccgggcacccagatcctcaaccccatgccccgggggagccgtgagagaggacacctaccccgtggggacgcagggagtaccttctccagcattagcccagggaggaccacagggtagctggcggttcttgcagtggaattctatgccgcggcttccaacagacttggatgttgaaggtccttggttcagacactacgacttccgccaatcctgttgggtgcgcgctatctcacaggaggaccaactcgccccatgctggcaggctgaacatcctgcggagcgcgtgagaagtgcctttgccgccccatctactgattccgaccagggtacaccgtttagggctagagatgagcagcaatgcgcgcccactagcggtccttgcctctgcgggctgcatctggagagtagtcaatttcccccgggattttag

SEQ ID NO: 208159 - DNA, 1584 bp, Artificial Sequence
  Description of Artificial Sequence: Synthetic coding sequence
atggacgtggtggaggtggccggcagctggtgggcccaggagcgggaagacatcataatgaagtacgagaaaggccatcgcgctggactgccagaggacaagggtccgaagccgtttaggtcatacaataataatgtggatcacttgggcatcgtgcatgaaacagagctgcctccactcactgcccgcgaggcgaaacagattcgccgggagattagccgcaagtcaaaatgggtggatatgctgggcgactgggagaaatataaatcgtcacgaaaactcattgaccgggcctacaagggcatgcccatgaacatccgtggcccgatgtggtcggtcttactgaacattgaggaaatgaagctcaagaaccctggaaggtaccagatcatgaaagaaaagggaaagagatcctcggagcatatacagagaatcgatagagatatctccggaactttaagaaagcacatgttcttccgggatcgctatggcaccaaacaacgcgaactgcttcacatactgctggcctacgaggagtacaatccggaggtcggctattgtagagacttgagccacatcgctgctctttttctgctgtacctgccagaggaggatgcattttgggccctggtgcagctcctggcctctgaacgccactcactgcaaggctttcactcccccaacgggggaactgttcagggattgcaggaccagcaggaacacgtagtagctactagccaacccaagactatgggccatcaaatctctcttggacttactctccgtctgtgggatgtgtacctcgtcgagggagaacaggcccttatgcctataacgaggatcgcctttaaagtccaacagaagagactgacaaaaacttcgcggtgcggaccatgggcccgcttttgcaataggttcgtcgacacctgggccagagacgaggatactgttttaaaacatctccgcgcttctatgaagaagctgaccaggaagcagggcgacctgcctccacctgccaaacctgagcaggggtcctcggctagccggcctgtccctgccagtaggggagggaaaaccctctgcaaaggtgaccgccaagctcctccaggtccaccagcccgttttccccggcccatttggtccgcttctcccccccgcgccccaaggagctccaccccatgccctggcggcgctgtgagagaagatacctatcctgtgggtacacaaggcgtgccctctccagccctagcgcaaggtgggccacaggggtcctggaggttcttacaatggaattctatgccacggctgcccactgacttagacgtcgaaggtccttggtttcgacactacgatttccgacaaagttgttgggtgcgagccatcagccaggaagatcaacttgcaccgtgctggcaagctgagcaccctgctgagagggtgagatcggcattcgccgctcctagcacggacagcgaccaggggacaccctttagagctcgcgatgagcagcagtgcgctcccacctccggcccttgtctatgtggacttcacttggaatcctcacagttcccacccggcttttag

SEQ ID NO: 208160 - DNA, 1584 bp, Artificial Sequence
  Description of Artificial Sequence: Synthetic coding sequence
atggacgtggtggaggtggccggcagctggtgggcccaggagcgggaagatatcattatgaaatatgaaaaaggccacagagctggcctgccagaagacaagggaccaaagcccttcaggagttacaacaataatgttgatcatctaggcattgtccatgagaccgaacttcccccgctgaccgcacgggaagccaagcagatcagacgcgagatctcacgcaagtccaaatgggtggacatgttgggcgattgggagaaatacaagagcagccgtaagctcattgatcgcgcatataaaggaatgcccatgaacattcgggggcctatgtggagcgtccttctgaatatcgaggaaatgaaactcaaaaaccccggacggtatcaaatcatgaaagagaagggtaagaggtcttccgagcatattcagaggattgacagggacatctctggtacactccgaaaacatatgttcttccgtgatagatatggtactaaacagagagagcttctacacatactactggcatacgaggaatacaatcccgaggtggggtactgtagggatctgtcacacatcgctgctttatttcttttatatctccccgaagaagatgctttctgggcccttgtgcagctactggcctcagaaagacattctttgcaggggttccactcaccaaacgggggcacagtacagggactccaggaccaacaggaacacgtcgtggcgacctcgcagcctaaaactatgggccatcagataagtctaggactgacgttgcggctgtgggatgtttatttggttgagggcgagcaagccctcatgcccattactcgtatagcttttaaagtgcagcagaaaagacttaccaagaccagtcgctgcgggccttgggcccgcttctgtaatcggtttgtagatacatgggctcgtgacgaagacactgtgctgaagcatttgagggcaagtatgaagaaactcactagaaaacagggcgatctgccacctccagcgaagcccgagcaggggtcaagcgctagccgaccggtgcccgcgtcacgcggaggcaagacactctgtaagggggaccggcaggcacctccaggacccccagctaggttcccacgaccaatctggtcagccagcccccctcgtgccccaagatcatccacaccctgcccaggtggagccgtgagagaagacacttatcccgtaggcacacagggtgtcccttctcctgcccttgcgcaaggcgggcctcagggctcctggcggttcctgcaatggaattctatgcctaggctcccaaccgatctggacgtcgagggaccatggtttcggcattacgatttccgtcaaagttgctgggttagagctatttctcaagaagaccagctcgcaccatgctggcaagctgagcatccagctgaacgcgtcaggtcagcatttgccgcgcctagtacagactcggaccagggcacaccattccgggcgagagatgaacagcagtgcgcccctacatctggtccatgcttatgtggcctgcaccttgagtcctctcagtttccacctggcttctag

SEQ ID NO: 208161 - DNA, 1410 bp, Artificial Sequence
  Description of Artificial Sequence: Synthetic coding sequence
atgctgggcgactgggagaagtacaagagcagccggaagctgatcgaccgggcctataaagggatgccaatgaacatcagggggcccatgtggtcggtgctgttgaatatcgaagagatgaagctcaagaacccagggcggtaccagattatgaaggagaagggaaagagatctagtgagcatatccagcgtatcgatagagatatctctggcacattgcggaagcatatgttctttcgggaccgatatggcaccaagcagcgcgaactgctgcacatcttgctcgcctacgaggaatataaccctgaagtggggtattgtcgagacctctcccacatcgcggcactgttcttattgtatctgcctgaggaagacgccttctgggccctggtgcagctgctcgcatctgaacgccacagtctacagggatttcattctcctaatggagggacggtgcaagggctacaggatcaacaggaacacgtggtggccaccagtcaaccgaagaccatgggacaccaggataagaaggatctgtgcggccagtgctcccccttgggatgtctaataaggattcttatcgatgggatatctctgggtttgaccctgcgactatgggacgtgtatttggtggagggtgagcaggctctgatgcccattaccagaatcgcattcaaggtccagcagaagaggctgacaaaaaccagcaggtgtggaccctgggctagattctgcaatcgcttcgtcgatacctgggcccgcgatgaggatacggtgctaaagcacctgcgagcatccatgaaaaaactgacaagaaagcaaggtgatctgccgcctcccgctaagcccgagcagggctcctcagcatcacggcctgtgccagcctcgcgcggtggcaagacgctctgtaagggggataggcaggccccacctggccccccagcccgcttccctcgacccatatggagcgcctctccaccaagagcacctcgctcgtctaccccatgccctggtggcgcggtgcgcgaagatacatatcccgtgggaactcaaggtgtgccctcccctgccctagcacaggggggtccccaaggctcatggcggttcctgcagtggaatagcatgccccggctgccgacagacctcgatgtcgaggggccctggttccgccactatgattttaggcagtcttgttgggtgagggccatttcacaggaagatcagctggccccctgttggcaggcagagcacccagctgagagggtgaggtccgcattcgctgccccctccacagactccgaccagggaacaccttttcgcgcgcgagatgaacaacagtgcgcccctacaagcgggccgtgtctgtgtgggctgcaccttgaaagctctcaattcccccctgggttttag

SEQ ID NO: 208162 - DNA, 1410 bp, Artificial Sequence
  Description of Artificial Sequence: Synthetic coding sequence
atgctgggcgactgggagaagtacaagagcagccggaagctgatcgatcgggcctataagggaatgccgatgaatattcgcggacccatgtggagtgtgttgctgaacattgaggaaatgaaactcaagaaccccgggaggtaccagatcatgaaagagaaaggaaaacggagctcagagcacatacaaagaatcgaccgagacattagtggcactctgaggaagcatatgttctttagagataggtacggcaccaaacagcgcgaacttctccatatccttctagcatacgaggagtataaccccgaggtcggttactgccgagatctcagccacattgcggctttgtttctgctgtatctgcccgaagaggatgcgttctgggccctcgtacagctgcttgccagtgagaggcacagtctacagggattccattcccctaatggaggaactgtgcaggggcttcaggatcagcaggagcacgtggtggccacgtcccagcccaagacaatgggacatcaggacaagaaagatctgtgcggccagtgcagccccctcggctgcctaattcgaatcctcattgacggcattagcctggggctgaccctgcgcctgtgggacgtatatttagtcgagggcgagcaggctcttatgcccatcaccagaatcgcgttcaaagtgcagcagaaacggcttacaaaaacgagccgctgcggcccatgggcccggttctgcaataggtttgtcgacacatgggcgcgggatgaagatacagtcctcaagcatttgagagcaagcatgaagaaactgaccagaaaacagggagatctgccacccccggccaagccagaacagggatccagtgcgtcacggcccgttcctgccagccgcgggggcaagacactttgtaagggagatcggcaggccccaccaggacccccggcttggtttcctaggcccatttggtcggcaagtcctccgcgagccccgagatcgagtactccatgtcctggaggagcagttagagaagacacttatccagtaggcacccagggcgtcccatcaccggccctggctcaggggggaccacagggatcttggcgatttcttcagtggaattccatgccacgcttaccgaccgatctagatgtggagggaccctggtttcgtcactacgatttccggcagtcctgctgggtgcgcgctatctcacaggaagatcagctcgctccttgttggcaggctgagcatcccgcggaacgcgtccggtccgcattcgctgcccctagcactgattcagaccagggtactcctttccgcgctcgtgatgaacagcaatgcgcacctaccagcggaccatgcctgtgtggtttgcacctggagtcaagtcaattcccaccagggttctag

SEQ ID NO: 208163 - DNA, 1650 bp, Artificial Sequence
  Description of Artificial Sequence: Synthetic coding sequence
atggacgtggtggaggtggccggcagctggtgggcccaggagcgggaagatatcattatgaagtatgagaaaggacaccaggctgggctgccagaagataagggaccaaaaccattccggagctacaacaataatgtggatcatctgggcatcgtccacgagaccgagctgcccccgctgactgccagggaagccaagcaaatccggagggaaatttctcggaaatccaagtgggtggatatgttgggggattgggagaaatacaagagctccagaaaactgatagatagggcttacaaaggcatgcccatgaacattagaggcccaatgtggtcagtcctcctgaatattgaggagatgaaactgaaaaaccccggacgctatcagataatgaaggagaaagggaagagatcgagcgagcacatacaacggatcgacagagacatatccggtacgctgcgcaagcatatgttctttcgggataggtatggtacaaaacagcgcgaattgctgcacattctgttggcctacgaagagtataacccggaggttggttactgccgcgatctgtcccacattgccgctttgttcctcctctatttgccagaggaagatgctttctgggcactcgtgcaactgctggccagcgagcggcattctttacaaggctttcattcaccaaatgggggcacagttcagggcctccaagaccagcaggagcacgtggtcgccacctcccaacctaaaaccatgggacaccaagacaagaaagacctgtgtggacagtgctctccccttggctgcttaatccgcattcttatcgacggcatctctttaggcctcacactcagactgtgggacgtctaccttgtcgagggcgagcaagcactgatgcctattacacgcatcgcgtttaaagtgcagcagaagagattaacgaagacctctaggtgcggcccttgggcgaggttctgtaataggtttgtcgacacctgggcccgcgacgaggacacagtgctgaagcatctacgcgccagtatgaagaaattgaccagaaagcagggcgatttgccaccacccgcaaagcctgagcaggggtcttccgcaagccgcccagtgcccgcatctcgcggcgggaagaccctgtgcaagggcgataggcaggccccgccaggccctccggccaggtttccacgtccgatttggagtgcctccccaccaagagctcctcggtcatccacaccttgccccggaggggcggtgcgcgaggatacatatccggtagggactcaaggagtcccatctcccgcgctcgcccaaggagggccgcagggctcatggaggttccttcaatggaactccatgccaaggctccccacagatctggacgtcgagggcccctggtttaggcattacgactttaggcaaagctgctgggtgcgggctatttctcaggaggaccagctggcgccgtgttggcaggctgaacatcctgccgaaagagtacggtcagcctttgcggcccccagcaccgatagcgatcaggggacgcccttccgggcccgggacgagcagcagtgtgccccaacctccggcccgtgcttatgcgggctacacctggagtcctctcagttccctccgggattttag

SEQ ID NO: 208164 - DNA, 1410 bp, Artificial Sequence
  Description of Artificial Sequence: Synthetic coding sequence
atgctgggcgactgggagaagtacaagagcagccggaagctgatcgatagggcgtacaagggcatgcccatgaatatccgtgggccgatgtggtccgtcctgttgaatatagaagagatgaagctcaagaatccaggcaggtaccagatcatgaaggagaagggtaagagatcgtcagagcatattcagcgaattgaccgggatatcagtggcactttgcgcaaacacatgtttttccgggatagatacgggacaaagcaacgggagctgttgcatattctgctggcgtacgaggagtataatccagaggtgggatattgcagggatctcagccacatagcagctctgtttctgctgtacttgccagaagaggatgccttctgggcgctagtgcaactcctcgcatcagagcgccactcattacaggggttccatagcccgaatggaggaaccgtacaggggctgcaagatcagcaggaacatgtcgttgccacttcacagcccaaaaccatgggacatcaagacaaaaaagacctgtgcggtcagtgttctcctctcgggtgcctaatccggattctgattgacggtatatccctggggcttactctgagactctgggatgtctatctcgtggaaggggaacaggccctgatgcccatcacccgtatcgcgtttaaggtacagcagaaacgtttgacgaagacatcacgctgcgggccctgggctcggttctgcaatcggtttgtcgacacctgggcccgcgatgaggacaccgtgcttaaacatctgcgggcgtcaatgaagaaactgacacgaaagcaaggggacctcccaccccctgccaagccagagcagggatcaagtgccagccgccctgtccccgcctcgagaggcggcaagaccctgtgcaagggagataggcaggcaccgcccggcccgcccgcctggttccctaggccaatctggtccgcaagcccgcctagagcccccagatcctctaccccatgtcccggaggggctgtgcgggaagacacctacccagtgggtacccagggggtgccgtccccggcgttggctcagggcggaccacagggctcttggcggttcctgcagtggaactctatgccacggctgcccaccgatctggatgtggaaggtccctggttcagacactatgactttcggcagtcatgttgggtgcgcgccatatctcaggaggaccaactggccccttgttggcaggcggaacacccggccgaaagagtgcgcagcgcctttgccgctccctcaaccgactccgatcagggtacaccttttcgggccagggatgagcaacagtgcgcgccaacgagtggtccatgcttatgtggacttcatctcgaatcctcgcagtttcccccagggttctag

SEQ ID NO: 208165 - DNA, 3708 bp, Artificial Sequence
  Description of Artificial Sequence: Synthetic coding sequence
atggagccccccagctgcatccaggacgagcccttcccccaccccttggagccagaaccaggcgtatcagcccagcctggacccggcaaaccatcggataagcgctttcgattgtggtatgtcggcgggagttgtctagaccataggactacgctccccatgctgccatggctcatggcagagatccggcgtagatctcaaaagccagaggccggtggatgcggcgctccagccgctagagaggtcatcctggtactgtctgccccattccttagatgcgtgcccgctccaggtgcaggcgcatctggaggtacgtcaccatccgcgactcaacccaaccctgccgtgttcatattcgaacacaaagcccagcatatttccaggttcatacacaactctcacgatctgacctatttcgcgtatctcataaaggcccaaccagacgatccagaatcgcagatggcctgccacgtctttagagctactgatccaagtcaggtgcccgatgtaatcagtagcatcaggcagttaagtaaggccgctatgaaagaagacgccaaacccagcaaggataacgaggatgccttttacaattcccagaagtttgaggttttgtactgcggcaaggtaacagtaactcacaagaaagcgcctagttcactgatcgacgactgcatggagaaattttctctccatgagcagcaaaggctcaaaattcagggagaacagcggggacccgatcccggcgaggatctcgctgacctcgaagttgtcgtacccggctctcccggcgactgcctcccagaggaagcagatggtacggacactcatctgggactgcctgctggcgcatcccagccagccctcacctcatcaagagtatgtttcccagagcgaatcctcgaagatagtggattcgatgagcagcaggaattccgctcacgatgctcatctgtgacgggcgttcagaggcgagtgcacgagggcagtcagaaaagccagccacgccgtagacacgctagcgccccgtcccacgtacaaccaagcgactccgaaaagaatcgcacaatgctgtttcaggtcggaagattcgagattaatctgatttcccccgacactaagagcgtagtgttggagaagaacttcaaggacatctcctcttgcagccagggcattaagcacgtagaccattttggcttcatctgccgggaaagccctgaacccgggctcagccagtacatctgctacgtgttccagtgcgcctctgagtccctcgtggatgaggtgatgctgaccttgaagcaggccttttcaaccgccgcagccctgcaatccgcaaagacccaaatcaagctctgtgaggcctgcccgatgcactccctgcataagctgtgtgaaagaatcgaaggtctgtatcccccacgggccaaactggtaatacagcggcacctttcgtcactgaccgacaatgaacaagccgatatctttgagagagttcagaaaatgaagccagtctcagatcaggaggaaaatgaactcgttattctgcacctgaggcagctctgcgaggccaagcagaagacacacgtgcacattggcgaaggcccgtctactatctcaaactccaccataccagaaaacgctacgtccagcggtaggttcaagctggatattttaaaaaacaaggccaaacgttctctgacctcaagccttgaaaatattttcagccgaggcgccaaccgcatgcggggccggcttggcagcgtagactcgtttgagcggtccaactcactggccagcgaaaaagattactcccccggcgactctcccccgggcacaccacccgcatccccccccagtagcgcctggcaaaccttcccagaggaagatagtgattcgcctcagtttagaagaagagcccatactttttcccaccctccctcctccacaaaacgcaaacttaatctacaggacggcagggcccagggcgtcaggagtccgctcctgcgacagagtagcagcgagcagtgctctgacggcgaaggtcgcaagaggaccagctccacctgcagcaacgaatccctctcagtgggcgggacaagtgtgactcctcgcagaattagctggcggcaacgtatattcttgcgggttgcatctcctatgaacaagagtccatctgctatgcagcaacaggatggcctagataggaacgagcttcttccgctgtcacctttgagccccacgatggaagaagagccacttgttgtgtttctctccggcgaagatgacccagaaaagatcgaggagcgcaagaagtcaaaagaactgcgtagtctgtggcgtaaggccatacatcagcagatcctcctcctgagaatggaaaaggagaaccagaaattagaggcaagtcgcgatgaactgcaatcccgtaaagtgaaactcgattacgaagaagtgggggcttgccagaaggaggtgctgatcacctgggataaaaaactccttaattgtcgcgctaagattcgctgcgatatggaagacattcacacgctgctgaaggagggtgtccctaaaagcaggaggggcgagatttggcagtttttggccctgcagtaccgtctgcgccaccgactccctaataaacagcaacccccagatattagttacaaggagctcttgaagcagctgactgcccaacagcatgcaattcttgtggacctgggtagaacttttcctacacacccatattttagcgtgcagctgggcccgggtcagttgtccctctttaacttgctgaaggcctatagccttctggataaagaggttgggtactgccaaggcatttcgtttgttgccggggtcctccttctgcatatgtcggaggagcaggcttttgagatgctgaaatttttgatgtatgatctgggctttcgcaagcagtacaggcctgacatgatgtcactccagatacagatgtaccagttgtctcgattattgcacgactaccacagagatctttataaccatctagaagagaacgagatctccccgagcctatacgctgcgccatggttcctaacccttttcgcgtctcaattctcgctgggctttgtggctcgagtcttcgatatcatctttctccaaggaacagaggtgatatttaaagtggccctgtcactgctttctagccaggaaaccctcatcatggagtgtgaatccttcgaaaacattgtggagttcttaaagaatacactgcctgatatgaacaccagcgaaatggaaaagatcatcacacaggttttcgaaatggatatcagcaaacagctgcacgcttatgaggtcgagtatcatgtgttgcaggatgagctgcaggagtccagttattcttgtgaggactccgagacattggagaaactcgagcgggccaactcccagctaaagcggcagaacatggacctgctcgaaaagttgcaggtggcacatactaagatccaggctttagaaagtaatctcgagaatttactgacccgagaaaccaagatgaaatcactgattcgcaccttggagcaggagaaaatggcctaccagaaaactgtcgagcagctcagaaagctcctccccgcagacgcgctggtgaactgtgatctcttgctgcgagatctgaactgcaacccaaacaacaaggccaagatcggcaacaaaccttag

SEQ ID NO: 208166 - DNA, 3897 bp, Artificial Sequence
  Description of Artificial Sequence: Synthetic coding sequence
atggagccccccagctgcatccaggacgagcccttcccccaccccctggagccagagccaggggtctcagcacagccaggccctggtaaaccgtcagacaagaggtttcgcctgtggtacgttggagggtcttgcttggaccacagaaccactttgccgatgctcccttggttaatggcagagattcggaggagaagccagaagcccgaggctggcgggtgtggtgctcctgcggctcgcgaggtcatcctcgtgttatctgcacccttcctgcggtgtgtgcccgcaccaggcgccggtgctagcgggggtacaagtcctagcgctacccagcccaatccagccgttttcattttcgagcacaaggctcagcacatcagccgcttcattcacaatagtcacgacctgacatacttcgcttacctgatcaaggctcaacccgatgatccagaatctcaaatggcctgtcatgtgtttcgtgccactgacccctcccaagtacccgatgttattagctctatcagacagttgtcgaaggcagccatgaaggaggatgccaagcccagtaaagacaacgaagacgccttctacaattcccagaaattcgaagttctgtactgtggcaaagtcacagtgacgcacaaaaaggcccctagctcacttattgatgattgcatggaaaagttcagtctgcacgaacagcagcgattaaaaattcagggagagcaacggggtccagaccctggtgaggacctggcagatttggaagtggttgttcccggatctccaggtgattgtctgcctgaagaggcagacgggactgatacccatcttggcttgccggctggtgcatctcaacctgcactgacttcctcgcgtgtgtgtttccctgaacgcatcctggaggactctggatttgatgaacagcaggaattccggtccaggtgcagttcagtgacaggcgtgcagaggcgggtgcacgagggctcacagaaaagtcaaccacgacggagacacgcgagtgccccttcccatgtccagcccagcgacagcgagaaaaaccggacaatgctatttcaggtggggcgtttcgaaattaacctgataagtccggacactaaatctgtggttttggagaaaaatttcaaggacatttccagctgttcacaaggaatcaagcatgtggatcacttcggattcatttgtcgtgagtcacctgagcccggcttgagtcagtacatttgctatgtattccagtgcgctagcgaaagcttggtggacgaggtgatgctgacgctgaagcaagcattctccactgcagctgccctgcagagtgccaagactcagattaaactttgtgaagcgtgcccaatgcactccctacataagctgtgtgagcgcatcgagggactctatccacctagagcaaagctcgtgattcagagacacctgagttcactaactgacaatgaacaggcagatatttttgagagagtgcaaaaaatgaagccagtttcggaccaggaggagaacgaattggtcatcttgcacctgaggcagctgtgtgaggcaaaacagaagacgcacgtccacattggcgagggccctagtacaatcagcaatagcacaatccctgaaaacgccacatcatctggacgtttcaaactggatatcttgaagaataaggccaaaagaagcctgacttcttcacttgaaaacatttttagtcggggagctaacagaatgcgtggtcgcctgggcagcgtggacagttttgaacgctcaaattctctggcgtctgagaaagattattcccctggggactcaccccccggaacaccaccagcaagcccacctagttcagcctggcagacgtttcctgaggaagattctgattcaccacagttccggcggagagcacacaccttcagccacccgccgtccagtacaaagaggaagttgaatcttcaggatggacgtgcccagggggtgcgcagccctctcctacgtcagagctcgagcgagcagtgtagtaacttgtccagcgtgcgccgcatgtataaagagtccaattccagcagctccttacccagcttacacacttccttcagcgcccccagctttacagcccctagtttcctgaagagtttttatcaaaacagcggcaggctttcccctcagtacgaaaacgagatcagacaagacaccgcctctgaaagcagtgatggagaagggcgcaagagaacctcctccacctgcagcaacgagtctcttagcgtgggtggcacaagcgtgacaccacgtcgcatctcttggcgccagagaatcttcctcagggtggcctctcccatgaacaagtccccgtccgccatgcagcagcaggatggcctggataggaacgagttgctcccactgtctcctctaagcccaactatggaggaggagcccctggtggtgtttctgagcggagaagatgatcctgaaaagatcgaggagcgcaagaaatcaaaagaactccggagcctttggagaaaggccatccaccaacagattctactgcttaggatggaaaaggagaaccaaaaactggaagcaagtcgtgatgagctacagtctaggaaggtgaagctcgactatgaagaggtcggcgcctgtcagaaggaggtgctgattacctgggacaagaagctgttaaactgccgcgctaagatcagatgcgacatggaggacattcataccttactgaaggagggagtgcctaagagtcgcagaggagagatctggcagtttctcgctttgcagtacaggctcaggcacagacttccaaataaacagcaaccgcctgacatcagctacaaggaactgctgaagcagctgacggcacagcaacatgcgattctggtggacctggggaggaccttccccacacatccatactttagcgtccagctcggccctgggcagctgagcttgttcaacttgctgaaagcctactcgttactggacaaagaggtcgggtattgccaagggatctcctttgtcgccggggtactgctgctgcacatgagcgaggaacaagcattcgagatgctgaagttcttaatgtatgaccttggctttcgaaaacagtatagacccgacatgatgagcttgcagatacaaatgtatcagctctcaagacttttacacgattaccatcgggacctctacaaccacctggaggaaaacgagatttcaccctccctctatgctgctccttggttccttactctttttgccagtcagttttcgctcggcttcgtggccagagtttttgacatcatcttcctacaggggaccgaggtgatattcaaagtcgctctgagccttctgagtagccaggaaacacttataatggaatgtgaatcttttgagaatatcgtggaattcctgaagaacaccttgcctgatatgaacacttccgaaatggaaaagattatcactcaggttttcgaaatggacattagcaaacagttacacgcgtacgaggtggagtaccacgtcttacaggatgagctgcaagagagctcttactcatgtgaagactcagagactctggaaaaactggaacgcgccaattcacagctgaagagacaaaatatggacctgctggagaaactccaagtagcccacactaagattcaggccctggaatccaacctcgaaaacctgcttacccgcgagacaaagatgaaaagtctgatccgcacactggaacaggaaaaaatggcgtaccaaaaaacagttgaacagctgcggaagctccttcccgcggacgcccttgtgaattgcgatctcttactgcgcgacctcaattgtaatcccaacaataaagctaaaatcggaaataaaccgtag

SEQ ID NO: 208167 - DNA, 849 bp, Artificial Sequence
  Description of Artificial Sequence: Synthetic coding sequence
gacaacgagcaggccgacatcttcgagcgggtgcagaagatgaagcccgtctctgatcaagaagaaaatgagcttgtgatcctacacctgcggcagctgtgcgaggctaagcagaagacacatgtgcatattggggaaggcccatccactatctcaaatagtaccatacctgaaaatgcgacctcctcaggacgctttaagctggatattttaaaaaataaggcgaagcgttccctgacctcttcactggagaatatattcagtcggggggctaatcgtatgcggggtcgactgggtagcgtcgattcatttgaacgaagcaattcgctggcctctgaaaaggattactcacctggtgatagtccccccgggacacctcctgccagcccccctagcagcgcttggcagacctttcccgaagaagactctgatagtccgcagttcaggcgccgggcccatacgttctcccatccaccatcttctacaaagcggaagttgaaccttcaggacgggagagcgcagggagtgagatccccactgcttcgccagtcctcaagtgagcagtgctcagatggtgaaggcaggaagaggacttctagtacatgctccaacgagagcctttctgtgggtgggacctccgttacccccagacgtatatcatggcggcaacggattttcctgcgcgttgcaagtcccatgaacaagagcccttctgctatgcaacagcaggacggcctggaccgaaacgagcttctaccactgtcccccttgtccccgactatggaggaggagccactggtggtattcttgagtggcgaggatgaccccgagaaaattgaggagcgatag

SEQ ID NO: 208168 - DNA, 1389 bp, Artificial Sequence
  Description of Artificial Sequence: Synthetic coding sequence
atgaacaagagccccagcgccatgcagcagcaggacggcctggacagaaatgagctgcttcccttgtcacctctcagccctaccatggaagaggaaccccttgtggtgttcctttcaggggaagacgaccccgagaaaattgaggaacgcaagaaatctaaggagttgcggagtctgtggcggaaggctattcaccagcagatcctgttactccggatggagaaagagaatcagaagctggaaggagtgccaaagtcccgaagaggtgaaatctggcagttcctcgcgctccaatatcgcttaaggcaccggttacccaataagcagcaacctccggatatctcctataaggagttgctgaagcagctgacagcacagcagcacgccatcctcgtcgacttgggacgcacatttcccactcacccgtatttttccgtgcagctcggacccgggcaactgagtcttttcaacctgctgaaggcgtactcactcctggacaaagaagtcggctactgtcagggaattagtttcgtcgccggagtgctgctccttcacatgtctgaggagcaggcatttgaaatgcttaaatttctgatgtacgatctagggttccggaagcagtatcgccccgacatgatgagcctccagatccaaatgtatcagttaagtagactgctgcacgattaccaccgagacctatacaatcacttggaggagaatgagatatcgccctcactatatgctgccccttggtttctgacactatttgcctcgcagttctcactgggattcgtcgccagggttttcgatatcatcttccttcagggaacagaagtgatttttaaagttgcgctgtcactgctgagcagccaggagactctaatcatggagtgtgaatcattcgaaaacatcgtggagttcctgaagaacacgctccctgacatgaatacatccgagatggaaaaaatcatcacccaggtgttcgagatggatatctctaagcagctgcacgcctacgaggtggaataccacgtgctgcaggacgaacttcaggagtccagctacagctgcgaggattctgagactctcgaaaaactggaacgagctaacagccagctgaaacggcagaatatggatctgctagagaaacttcaggtagcccacaccaaaattcaggccttggaatcaaatctggagaacctattaacaagggaaacgaagatgaagtctctgattcgcactctcgagcaggagaaaatggcctaccaaaaaactgttgaacagctgagaaagctactgcccgccgacgcacttgttaactgcgacctcctgctcagagatttgaattgcaaccccaataacaaggcaaaaattggcaacaagccttag

SEQ ID NO: 208169 - DNA, 3873 bp, Artificial Sequence
  Description of Artificial Sequence: Synthetic coding sequence
atggagccccccagctgcatccaggacgagcccttcccccaccccttagagccagagccgggagtatccgcccagcctgggcccggcaagccctctgacaaacgatttcgtctgtggtacgttggcgggtcctgtctggaccacagaaccaccttgccaatgctgccatggctaatggccgagattagaaggcgctcacagaagccggaggccggaggatgcggagcccccgcagctcgcgaggtcatcttggtgctgtcagcaccctttctgcgctgcgtgccagctcccggtgccggcgcaagtggcggcacaagccctagtgccacccagcccaatccagccgtgtttatctttgagcataaggcgcaacacatctcccgtttcattcacaactctcacgacctcacctactttgcctatctaattaaagcacagcctgacgacccggagtcgcagatggcttgccacgtctttcgcgcgacagatccctcccaggttccggatgtgatttcaagtatccggcagctgagcaaggcggctatgaaagaagacgccaagccttccaaagataacgaagatgccttctataactctcagaagttcgaagttctgtattgtgggaaagtcaccgtaactcataaaaaagcgccgtcctcgctgatagacgactgcatggaaaagttctcccttcatgaacagcaacgactaaaaattcagggggaacagcgcggaccagatccaggggaggacctggccgacctcgaggtagtggtgccggggtctcctggagactgcttgcctgaggaagctgatgggactgacacacacctagggctgcccgcaggtgcatcacagcctgctttaacctcctctcgtgtgtgttttccagagaggattctggaggatagcggtttcgacgaacagcaggaatttcgaagcaggtgttcctcagttactggtgtacagagaagggtgcatgaaggcagtcagaagagtcagcccaggagacgtcacgctagtgcacctagccacgtacaaccaagcgactcagagaagaataggactatgctgttccaggtcggacgcttcgaaatcaatctgatatcccctgacactaagagcgtggtactggagaaaaactttaaggatatatcttcatgttcacagggtatcaaacacgtcgaccactttggttttatatgcagagaaagtcctgagcctggcctgtcccaatatatctgttacgtgtttcagtgtgcaagcgaaagtctcgtggatgaggtgatgctcaccctcaagcaggccttttcgaccgctgcagctttacaatcagctaagactcagatcaagctgtgcgaggcctgtcccatgcatagcctccacaaactctgcgaaagaatagagggattgtacccgccacgcgctaaacttgtgatccagaggcatctatctagcttaacagacaatgaacaggctgacatttttgaacgagtgcagaagatgaaacccgtctcagatcaggaggaaaacgaattggtaatattgcacctacgccaattatgcgaagctaaacagaaaacccatgttcacatcggagagggaccaagcaccattagcaacagcacaattcctgagaacgccacctcgtcaggtcgctttaaactggacattctcaaaaataaagccaaacgcagcttaactagtagcctggaaaacatcttctcgcgtggtgccaatcgtatgcgcggccgactgggctcggtggattctttcgaaagatccaactctctggcttcagaaaaagattattcaccgggagactcacccccagggaccccgcccgcttctccgcctagctcggcctggcagacctttcctgaagaggactcggactccccacagtttcggcgccgggcccatacctttagccatccacccagcagcaccaagcgcaagctcaatctccaagatgggcgcgctcagggcgttcgctccccacttcttagacagtcatcatcagagcaatgctctaacctctcttccgtccggcgaatgtataaagaatcaaatagttcttcatccctgccatccttgcacacttctttctcagctccttcatttacagccccgtcctttttgaagagcttctaccagaattctgggcggttatctcctcagtacgagaatgaaatctctgatggcgaaggaagaaaacgcactagttctacatgctccaatgagagcctgagtgtggggggaacctcagttaccccgaggcggataagctggcgacagagaatctttttgagggtggcgagcccgatgaataagtcaccctctgctatgcaacaacaggatgggctcgatcggaacgagcttctgcccctatcccccctgagtcctaccatggaagaagagccattggttgtcttcctgtcaggcgaggatgaccctgaaaaaatcgaggaacggaaaaagagcaaagaactgcggtcactatggagaaaggctattcatcagcagatactcctgctgaggatggagaaagagaaccagaaactcgaagcgagccgggacgagctgcagagccgcaaggtcaagttagactacgaagaggtgggagcgtgtcaaaaagaggtcctcatcacatgggataagaagcttctaaactgcagagcgaaaattcgatgtgatatggaggatatccacacactactaaaagagggcgtgcctaagagccggaggggagaaatttggcagtttttagcccttcaatatcggcttcgccacaggctgccaaacaagcaacaacctcccgatattagctacaaagaactcctcaaacagctgacggcccagcagcacgccatcctagtggatttgggtagaacctttccaacacacccatacttttctgtacagctgggccccggccaactaagcctgttcaatttacttaaagcatactctctgctggataaagaggtgggctactgtcagggtatctccttcgtcgcgggagtccttttacttcacatgtccgaagaacaagccttcgagatgctgaagtttctgatgtatgacctgggctttagaaagcagtaccggcctgatatgatgagcctccagattcaaatgtaccagcttagtcgcctgcttcacgattaccaccgggacctttataaccacctagaagaaaacgagatctcaccaagcctgtatgccgctccatggtttctgacattgttcgcatctcagttcagccttggatttgtggctcgggtgttcgacatcatctttctgcagggaacagaagtaatattcaaagtggcattatctttattaagtagccaggagaccctcatcatggaatgtgagagcttcgagaacatcgtcgagttcttgaagaacacgctccccgacatgaacacatcggagatggagaagatcatcactcaggtattcgagatggacatttctaaacagttgcatgcttacgaggtggaatatcacgtcctgcaagacgagcttcaagaatcttcctacagctgcgaagatagcgagacgctagaaaaactggaacgggctaatagccagttgaagcgccagaatatggacctgctggaaaaacttcaggtagctcacactaaaattcaagctctggagagcaaccttgagaatcttctgacaagggagacaaagatgaaatcgctaattagaactctggagcaggaaaaaatggcttaccagaagacagtggaacagctgcgaaagctgctgcccgctgacgctctcgtgaattgcgacctccttcttagggatctgaattgcaaccctaacaataaggctaagattggaaataaaccatag

SEQ ID NO: 208170 - DNA, 1197 bp, Artificial Sequence
  Description of Artificial Sequence: Synthetic coding sequence
atgcacttcagcaccgtgacccgggacatggaggccttcaccgcctccagcctatcctcccttggggctgccgggggctttcccggggcggccagccctggcgcggacccgtatggaccccgcgaaccgcctcctcctccgcctcggtacgacccttgtgcggccgcagctccaggcgccccaggtccccctcctcccccccatgcatatccattcgcaccagctgccggcgcagccacgtccgcggctgcagaacccgagggacctggggcaagttgcgcagccgctgccaaagccccagttaaaaagaatgctaaggtcgccggcgtgtcggtgcaactggagatgaaggctttatgggacgagtttaaccagctcgggacggaaatgattgttacaaaagcgggcagacgtatgtttcctacatttcaagttaagctctttggaatggacccgatggctgactatatgctactaatggattttgtccctgtagatgacaagcgataccggtatgccttccacagctcttcctggcttgtagccggaaaggcagatccagcaacccccggtcgcgttcattatcaccccgatagtccggcaaagggtgcgcagtggatgaagcaaatagtttcctttgataagcttaagttgacgaataacctgctggatgacaacggccacattatcctgaacagcatgcatcgctaccagccgcgcttccacgtggtctacgttgacccaagaaaggattcagagaaatacgcggaggagaactttaagactttcgtgttcgaggaaacaagatttaccgccgtaacggcgtaccagaatcaccggataacgcagctcaaaatcgctagcaatccgttcgccaaaggttttcgggattgtgacccggaagattggcctaggaatcacagacccggcgccctgccactcatgtctgctttcgcaagaagtcggaaccctgttgcttcacctacacagccctcgggtacagaaaagggcggccatgtgctgaaagataaagaagttaaagcagagacaagtcgaaacacacccgaacgagaggttgagctgctgcgggacgcaggcggctgcgtgaatctggggctgccgtgtccagccgaatgccaaccctttaacacacagggcctagtcgccgggaggaccgccggcgatcgtctgtgttag

SEQ ID NO: 208171 - DNA, 1488 bp, Artificial Sequence
  Description of Artificial Sequence: Synthetic coding sequence
atgcacttcagcaccgtgacccgggacatggaggccttcaccgcctcaagcctgagctctctgggcgccgcaggtggatttccaggcgcggcctctccaggcgcagacccctacgggccaagagagccgcctccgcctccgcccagatatgatccatgcgccgcagccgctcccggagcccctggaccaccaccgcccccccatgcgtacccctttgccccagccgccggagctgccacttctgcagccgccgagcctgagggccctggggcatcatgtgccgccgctgcaaaagctcccgttaaaaaaaatgctaaggtggcaggagtttccgtgcaattggagatgaaggccctttgggatgagttcaaccagctgggaaccgagatgatcgtgacgaaagcgggacggcgtatgttcccgacattccaggtgaagctgtttggaatggaccccatggcagattacatgttattaatggatttcgtgccagtcgatgacaagagatatcggtatgcattccactcatcaagctggctggttgctggtaaagcggaccccgccacaccaggtcgggttcattaccacccagactccccagctaagggggcacagtggatgaagcagattgtatcttttgataagctgaagctcacgaataacctcctggacgacaatggccacatcatcctcaactccatgcataggtaccaacctcgttttcacgtcgtctatgtagaccccagaaaggactctgagaaatatgctgaggaaaacttcaaaacatttgtgttcgaggagacaaggtttacagctgtcactgcgtatcagaaccatcgcatcacacagttgaagattgcgtcgaaccctttcgctaaagggttccgagactgcgaccctgaagactggccccgaaatcaccgccccggagcgctccccctgatgagcgcatttgcacgctcccgcaatccggttgcgtctcctactcagccatctggcactgagaaagacgctgcagaggccaggcgggagtttcagcgtgatgctggcggtccagctgtcttaggagacccagctcatccgccccagctgctggcacgcgtgctgtcgcctagtttgccaggagcaggcggcgccggcgggttagtgcccctccctggagcccctggaggccggcccagccctccaaaccccgagctaagacttgaggctccaggcgcctcagaaccactacaccaccatccgtacaagtatccagcagccgcttacgatcactacttaggagccaaatcgaggcccgccccttaccctctccctgggctgcgggggcacggttatcacccgcatgcccacccccaccatcatcaccaccctgttagtcctgccgcagccgctgcagctgccgctgccgccgctgcagcagcagcaaacatgtatagtagcgctggagctgccccgcccggatcctatgactactgtccacgctag

SEQ ID NO: 208172 - DNA, 1119 bp, Artificial Sequence
  Description of Artificial Sequence: Synthetic coding sequence
atgcacttcagcaccgtgacccgggacatggaggccttcaccgccagtagcttgagctcacttggagccgccggaggattccctggagcagcgagtccaggcgcagatccatacggaccccgtgagcctccacccccgccgccccgctacgacccatgtgcagccgcagcgcccggggcacccgggccacctcccccgcctcatgcctatcccttcgcaccagcagctggggcagctacatcagctgccgcagagccggaaggaccaggagcaagctgtgctgccgccgcaaaggcccccgtcaagaagaacgccaaagtcgcgggcgtcagcgtgcaactggagatgaaggctctgtgggacgagttcaaccagctaggaaccgaaatgatcgtaaccaaggcaggaagaagaatgttccctaccttccaagtgaaactgtttggaatggatcccatggcagattatatgcttttaatggactttgtgccagttgatgataaacgctaccggtatgcctttcactccagctcttggttagtcgcaggtaaagccgaccccgcaactccgggccgtgtccactatcaccccgactcacccgctaagggagcccagtggatgaaacagattgtatccttcgataaattgaaactgactaataatttgctggatgacaacggccacataatcttgaattctatgcaccgataccagcctcgctttcatgtcgtttacgtggacccacggaaagatagcgagaagtatgccgaggagaactttaagaccttcgtgtttgaggaaacacgttttacggcagtaaccgcatatcaaaaccacaggattacacagcttaagatcgccagtaaccctttcgctaagggtttcagagactgcgaccctgaagattggccacggaaccaccggccaggagccctgcccctcatgagtgccttcgcacgctctaggaatccagtagcatccccaacacagccctcaggcactgaaaagggcctggttacagaaggatctggtcttcagccaggactgctggatgtgctattgaagccaccctctaaaaaaagcgagagtttaagacctccgcactgtaaagacacgtag

SEQ ID NO: 208173 - DNA, 1158 bp, Artificial Sequence
  Description of Artificial Sequence: Synthetic coding sequence
atggccgccttcctgagcgccggcctgggcatcctggcccccagcgaaacttaccctctgcctacaacgtcttctgggtgggagcccaggttgggtagcccgttccccagcggcccctgtacctcttccaccggggctcaggctgtcgctgaacccactggtcagggtcctaagaacccccgggtcagccgggtgacggtccagctagaaatgaaaccgctgtgggaagaattcaaccagctgggcaccgaaatgatcgtgaccaaagctggaagacgaatgttccctccttttcaggtcaaaattctgggcatggactctcttgctgattatgcccttctgatggatttcatcccccttgatgataaaagataccgatatgcctttcattcttctgcctggcttgtggccggcaaagctgatcccgccacaccaggtcgagtgcattttcatcccgatagtccagccaaaggagctcagtggatgcgacagattgtctctttcgataagttaaagctgacgaataatttgttagacgacaatggacacatcatcctgaattccatgcaccggtatcagcctagatttcacgttgtgttcgtggatcctcgcaaagactcagaacggtatgcccaagagaactttaaatcgttcatcttcacagagactcagtttaccgctgtcacagcctaccagaaccaccgtatcacgcagctgaagattgcgagtaacccttttgccaaaggtttccgagaaagcgatctggactcatggccagttgccccccgccccctgctgtccgtgcccgcccgctcccacagttccctgtcaccttgcgtgctgaagggcgccaccgacagggaaaaggatcctaacaaggcctcagcatctacctctaaaaccccagcttggctgcatcatcagctgttgccacctcctgaggtgctcctggcccccgccacatacagacccgttacgtatcagtctttgtactccggggctccttcccatctgggaatacctcgcacacggcctgccccgtaccctctgcctaacatcagggctgatcgggatcagggagggttaccgctgcctgctgggctgggattgctgagccctacggtagtctgtctgggtccaggccaggactcacagtag

SEQ ID NO: 208174 - DNA, 2454 bp, Artificial Sequence
  Description of Artificial Sequence: Synthetic coding sequence
atgatggacggcccccggagcgacgtgggccggtggggcggcaaccccttacagcctcccacaactccctcccctgagcctgagcccgagcctgacgggcggtcacgtcgcggaggcggcaggtccttttgggctcgctgttgtggctgctgttcgtgccggaatgccgccgacgatgattggggcccagaaccttccgacagtaggggaaggggctcgtcaagcggaactcgacgtccagggagtagaggctcagattcgcggagacctgtgtcacggggcagcggcgttaatgctgccggcgatggaacaatcagagagggcatgttggtggtgaacggcgtggacttactttcctccagatccgaccaaaatcggcgtgagcaccacacggatgagtacgagtacgatgaactgatcgtgagacgcgggcagcctttccatatgttgcttcttctgtcccgaacctacgaatcttccgacagaattactcttgaattgctgattggcaacaaccccgaagtcggcaagggtacccacgtgatcatcccggttggcaagggaggatcaggcggctggaaagcgcaagtagtaaaagcaagtgggcagaatctgaacctgcgggtccatacctcacctaacgctataatcggcaagtttcaatttacggtccgcacccaaagtgacgctggggagtttcagctcccttttgaccccagaaatgaaatttatatactttttaacccttggtgccctgaggacatcgtgtacgtggaccacgaggattggcgacaggagtatgtgctaaacgagagcggccgcatctattatggaaccgaagcccagatcggcgagaggacctggaattatggacagttcgatcatggcgtgcttgacgcatgcctctatatcctggacagaaggggtatgccctatggtggacggggggatccagttaatgtgagccgtgtaatctcagcaatggttaactccctggatgataatggcgtgctgatagggaattggagtggcgattatagtcgcggaacaaacccttcggcttgggtaggaagcgtcgagatactgctctcttatctgcggaccggttatagtgttccttacggtcagtgctgggtcttcgctggagtaaccactaccgtgctgcggtgtttaggactggccacgagaacagtcacgaactttaactcagcacacgatacagatacaagcctcaccatggatatttatttcgatgagaacatgaagcccctcgagcatctgaatcacgattccgtctggaactttcacgtgtggaacgactgttggatgaaaagacccgacctcccgtcggggttcgatggatggcaggttgtcgacgcaactccgcaggaaacctcctctggtattttttgctgcggaccttgcagtgttgaaagcatcaagaacggcctcgtctacatgaaatacgataccccatttatctttgccgaagtgaatagtgacaaggtgtactggcagagacaggacgatggcagcttcaagattgtgtatgtcgaagagaaggcgataggaaccctcatagtaactaaggcgattagtagcaacatgcgggaggacatcacttatctctacaaacacccggaaggatctgacgccgagaggaaagccgtggaaaccgctgctgctcatggatccaagcccaacgtgtatgcaaacagagggagtgcagaggatgtcgctatgcaggtggaggcgcaggatgccgttatggggcaggacttgatggtttctgtgatgctcatcaaccacagcagcagccgccgaactgttaagcttcacctttacctgtccgtgacattctatacaggagtatccggcacaatatttaaagagacgaaaaaagaggttgagcttgcaccaggcgccagtgatagagtgacaatgcccgtagcatataaggagtaccgccctcaccttgttgaccaaggagcaatgttactcaacgtctccggccatgtgaaagaaagcggacaagtcttggcaaagcagcatacatttagacttagaacaccagacctgagtctgacgctgctgggcgcagcagtggtcggtcaggagtgtgaggtgcagattgtgttcaagaatcctcttccggttacgctcacgaacgtggtgtttagactggaagggtcagggctgcaaaggcctaaaattttaaacgtgggcgacatagggggaaacgaaactgtcacattgagacagtcctttgtgccagtgaggcccggccctcgacagctgatagcaagcctggactcgccccagctatcacaggtgcatggtgtcatccaggtggacgtggcacccgcccccggggacgggggattctttagtgacgccggaggagacagccatctaggggagacaattcctatggcatctaggggcggggcctag

SEQ ID NO: 208175 - DNA, 1200 bp, Artificial Sequence
  Description of Artificial Sequence: Synthetic coding sequence
atgcacaagtaccagccccgggtgcacgtgatccggaaggacttctccagtgatttaagtcctactaaacctgtgccggtaggtgatggcgtgaagacctttaatttcccggagaccgtcttcactaccgtgacagcgtatcaaaatcaacagattactaggctaaaaatcgatagaaaccctttcgccaagggttttagggacagtggaagaaataggaccggcttagaagcaattatggagacctacgcgttctggcggcctcctgtgcggactttgaccttcgaagactttaccaccatgcagaaacaacaagcgtccaagaagactagtcagggttacaccgttaatcagcacagttccgagacagacgctatcgagctctatgaacggcgcgtgtggcttatggagcggagaggcagcactggcacctcaccaaccacctcatcaacagggaccccatcaccgagcgccagctcccacctgctcagcccatcatgttctccccccacgttccatttggcccctaatactttcaacgtcggttgccgggagtctcagctctgtaatctgaatttgtccgactatccaccttgcgctaggtctaacatggctgccttacagagttaccctggcctatctgattccggctataacagattacagtctgggactactagtgctactcagccatcagagacattcatgccccagagaactcctagcctgatcagcggcattccgactccgccctcacttcctggcaactcaaagatggaagcttatggcggccagctcggaagctttcctacatctcagtttcagtatgtgatgcaggccggcaatgcagcaagctcctcttcgtcgccgcacatgttcggcggaagccacatgcagcagagtagctacaacgccttctcactgcataatccctacaatctgtatgggtacaactttcctacaagccctcggctggccgcgtcccctgagaagctttccgcttctcagtctactctgttgtgttctagtccttccaacggggccttcggggagcggcagtatctcccatccggaatggaacatagtatgcatatgatttccccatcccccaataaccagcaagctacgaacacctgcgacgggagacagtatggcgcagtgcccggttcttcctctcagatgtctgtgcatatggtttag

SEQ ID NO: 208176 - DNA, 1809 bp, Artificial Sequence
  Description of Artificial Sequence: Synthetic coding sequence
atgagcgagcggcggcggagcgccgtggccctgagcagccgggcccatgccttcagcgtcgaagctttgatcggcagcaataaaaaaaggaagctccgtgactgggaggaaaaagggctagacctctcaatggaagccttgagcccagctggacctctgggcgacacagaggacgctgctgctcacggccttgagccccaccctgatagcgagcagtctacaggctcggactctgaggtcctgactgagagaacctcctgttccttctccacacacaccgacctcgcctctggagcagcaggaccagttccagccgccatgtccagcatggaggagattcaagtagagctgcagtgtgccgacctgtggaaacggttccacgacatagggacagagatgatcataactaaggctggtcgcaggatgtttcctgcaatgagagttaagatcaccggactggatcctcatcaacagtactatatcgccatggatatcgtgccagttgataacaaaagataccgatatgtctatcactctagcaagtggatggtggctggcaacgctgatagcccagtgccccccagagtatatatccatcctgactccctggcgtctggggatacatggatgcgtcaggtggtctcctttgataagctgaagttgacgaataatgagctagatgatcaaggacatatcattctgcattccatgcacaagtatcagccgagggttcacgtcattagaaaggactttagctcagacttgagtcccacaaaacccgtgcctgttggagatggtgttaagacattcaattttcctgagacagtgtttacaacagtgactgcgtaccagaatcagcagattacccggctcaaaatcgaccgcaaccccttcgctaaagggttccgcgacagcggaaggaacaggacgggactggaagcgattatggagacttatgctttctggagaccccccgtaagaactctgactttcgaagacttcaccacaatgcaaaaacagcagggaggcagtaccgggacgtctccaaccacatcctccacagggactccaagtccatccgcctcatctcatctgctgagtccctcttgtagcccccccacgtttcatctggcccccaacacctttaatgtaggctgtagagagtcccaactttgcaatctgaacctctccgattaccctccctgtgccaggtcaaacatggcggcactgcaatcataccctggcctaagtgacagcggatataacagactgcaaagtggaacaacaagcgcaactcagccgagtgaaacgttcatgcctcagcgaacccctagtttgatctccgggattccgacaccccccagcttgcctggaaattccaaaatggaagcctacggcggacaactcggttcatttcccacctctcagtttcagtatgttatgcaggccggaaatgccgcatctagttccagttctcctcatatgttcggcgggtcccacatgcaacagtcgtcttacaatgctttctcacttcacaacccttataacctgtatggatacaacttcccaacgagcccgagacttgcagcgagccctgagaagctcagcgcctcccaaagtacactcttgtgctcttccccatccaatggggcttttggagagagacagtatttgccctcaggcatggagcacagtatgcacatgatatccccaagccccaacaaccaacaagccacgaacacctgcgatgggcgtcagtacggtgctgtcccagggagctccagtcagatgagtgttcacatggtgtag

SEQ ID NO: 208177 - DNA, 762 bp, Artificial Sequence
  Description of Artificial Sequence: Synthetic coding sequence
cgggtgcggaccggcctggaggccatcatggagacctacgccttctggagacccccagtgcggactcttacatttgaggacttcaccaccatgcagaaacaacaggccagtaaaaagacctctcagggttacaccgtgaaccagcattctagtgagacagacgccattgagttgtacgagaggcgcgtgtggttaatggaacggcgagggagtactggtacttcccctacaactagttctactggcacaccttctcctagcgcatctagccacttactttctccaagctgcagtcctccaacatttcacctggcaccaaatacatttaacgtgggctgccgagaaagtcagctgtgcaatctaaatcttagtgattatcccccctgcgcaaggagtaatatggccgccttgcagtcttatccaggcctgagcgactcgggttacaatcgactgcagagtggaacaacaagcgcgacgcaaccctctgaaacgttcatgccccagcgcactccctcccttataagcggcattcctactcctcccagcctccctacagctcggtggaagccgaccgtcgctagctggggaccctttccactcccaagtttttcgatgtcctgtcgccaggctatgctcccgcccgctccccaccatcacacctgctcgggcgccgctacgtgttctcgggcccctacaatgccatccccttttactaccttgactacctgcatggacaccataagccccctacccctaggttag

SEQ ID NO: 208178 - DNA, 993 bp, Artificial Sequence
  Description of Artificial Sequence: Synthetic coding sequence
ggccggaaccggaccggcctggaggccatcatggagacctacgccttctggcgtcctccagtgcgtacattgacttttgaagattttaccaccatgcagaaacagcaggcaagcaagaagacatcacagggctacacagtgaaccaacactcatccgagacagacgcaatcgagctttacgagagacgggtttggctcatggaaagacgtggcagcacaggaacttcgcctaccacctcctctactggaactcctagcccttccgcctcctctcaccttctcagccctagctgcagcccaccaactttccatctggcacctaacacctttaatgttgggtgtcgagaaagccaactgtgcaacctcaacctcagcgactatcctccctgcgcgcggtctaacatggccgccctccagtcctatcccggactcagcgacagtggctacaacagactccagtccggtaccacaagcgctacgcagccttccgaaaccttcatgccacagaggacccctagccttatctcaggaatccctacccccccttcactgcctggcaactccaagatggaagcttatggcggccagctgggcagtttccccacatctcagttccaatatgtcatgcaagctggtaatgccgcatccagcagctcatccccccatatgttcggcggaagccacatgcagcagtcttcctataacgcattctcattacacaatccttataacctatacggttacaactttccgacttcgccgcgcctagccgcgtcccctgagaaactatccgccagccagagtaccttactctgcagttcacccagtaatggcgcatttggagagagacagtatttgccttccgggatggagcacagcatgcatatgatatccccttcccccaataatcagcaggctaccaacacgtgcgacggaaggcaatacggggccgtgccaggctcaagttcacagatgtccgtccatatggtctag

SEQ ID NO: 208179 - DNA, 1347 bp, Artificial Sequence
  Description of Artificial Sequence: Synthetic coding sequence
atggccatgagcgagctgggcacccggaagcccagcgacggcaccgtcagccatctgctaaatgtcgttgaatcagaattgcaggccggccgagaaaaaggagaccccaccgaaaagcagttacaaatcattctcgaggatgctccgctgtggcagcgttttaaggaagtcaccaatgaaatgatcgtgactaagaacggccgtaggatgtttccagtgctgaaaataagcgtaacggggctggaccccaacgcaatgtattctctgctcctggacttcgtacccactgactcacatagatggaaatatgtgaatggagaatgggtccctgctggcaaacctgaagttagctcccattcatgcgtgtatatccaccccgactcgcccaattttggagctcactggatgaaagccccgatctccttttcaaaagttaagttgaccaataaactgaatggtggtggtcagatcatgctgaactccctgcacaagtatgaaccacaggtgcacatcgtaagggttggcagcgctcacagaatggtgacaaactgctcgtttcctgaaacacagtttatagctgtgaccgcttatcagaatgaggagattacagcactcaaaataaaatacaatcctttcgcaaaagccttcctcgatgcaaaagagcggaaccaccttagggacgtgccagaagcaatctcagagtcccaacatgtgacatatagtcacctggggggctggattttttccaacccagacggggtgtgtaccgccggtaactctaattaccagtacgccgctccactgccacttccggccccacatactcaccatggctgcgaacattactccggcctgcgggggcatcggcaggccccctacccttcagcttacatgcaccggaatcatagcccttcggttaatttaatagaatcctctagcaataatttgcaggtgttttctggtcctgattcttggacatccctgtcgtccacacctcatgccagcatcctgtctgtgccacataccaacgggcccatcaacccgggaccttccccgtacccttgtctgtggactatctctaatggcgcgggtggcccatccggacccggaccagaggtacatgcctcaacccccggcgcctttcttctggggaatcctgcggtcaccagcccaccatccgttctgtcaacgcaggccccaacatcagccggtgtggaagtgcttggtgagccgagcttgactagtatcgctgtgtccacctggacagctgtagcatctcacccctttgctggatgggggggtcctggtgctggcgggcatcatagtccttctagcctggacggttag

SEQ ID NO: 208180 - DNA, 978 bp, Artificial Sequence
  Description of Artificial Sequence: Synthetic coding sequence
atgatcgtgaccaagaacggccggcggatgttccccgtgctgaagatctccgtaaccggactggacccaaatgcaatgtatagcttattgctggactttgtcccaactgactctcaccgctggaagtatgttaatggggaatgggtgccagccggaaaacccgaggttagcagtcatagctgcgtgtacatacatcccgattcgcccaacttcggagcacattggatgaaggcacccatttccttctctaaggtgaagttgacgaataagttgaacggtgggggacagatcatgctgaacagtttgcacaaatatgaaccgcaggtacatatagtacgtgtgggctccgctcataggatggtcactaactgttcttttcccgaaacccagtttatagccgtaaccgcttatcagaacgaagagattaccgctctgaagatcaagtataatcccttcgccaaggcattcctggacgccaaagagcgcaatcacttgagggacgtgccagaagccatcagtgagagccagcacgtaacgtattcccatcttaatttgatcgaaagctctagtaacaatcttcaggtgttcagcggccctgattcttggacttctctgtcctcaaccccacacgcctcaatccttagcgtccctcacaccaacggcccaattaaccccggccctagtccctatccatgtctgtggacgataagcaacggagccggcggtccgtctgggccgggacctgaggtccatgccagtacgccaggagcctttctcttgggcaacccagctgtgacaagccccccatctgtcttgagcacccaagcaccaacttcagctggtgtggaagtgctaggcgagccatcgctgacaagtatcgcagtgtccacctggactgctgtcgcatctcatccatttgctggctggggtggtcctggagctggcggacatcacagcccctccagcctggacgggtag

SEQ ID NO: 208181 - DNA, 957 bp, Artificial Sequence
  Description of Artificial Sequence: Synthetic coding sequence
tgacggatgttccccgtgctgaagatcagcgtgaccggcctggacccaaacgcgatgtactctcttctgttggacttcgtgcccaccgactcccacagatggaagtacgtgaatggtgaatgggtccccgcggggaagcccgaggtctcatctcacagttgcgtgtacatacatccagattcccccaacttcggcgctcactggatgaaggcaccaatttctttctctaaggtcaagctgacaaacaaactgaatggaggtgggcagataatgctgaatagtttgcataagtatgagccccaggtgcacatcgtgcgggttggttccgcgcatcgcatggtgactaattgtagctttcctgaaacccagtttatcgctgtcactgcataccaaaacgaagagattaccgcactgaaaataaagtataaccccttcgccaaagcgttcctcgacgccaaggagcgaaaccatctgcgtgatgtgcctgaagctataagcgagtctcagcacgtgacatatagtcacctgaacttgatcgagtcatccagtaacaacttacaggtgttctcgggaccagattcatggaccagcctcagttcaaccccccacgcaagtattctgagtgtcccacacactaatgggccaatcaatcctgggccttccccttacccatgtctttggaccatatccaacggtgctggtggaccgagcgggccggggcctgaagtgcacgctagtactcccggtgctttcctccttgggaatcccgcagtaacctctccaccgtctgtgctgtccacccaggctccaacgtcggctggcgtcgaagttctgggtgagccatccctgacatctattgccgtatccacatggacagctgtggcctcacaccccttcgccggatggggaggccctggtgctggtggacaccactcaccatcttccctggatggatag

SEQ ID NO: 208182 - DNA, 846 bp, Artificial Sequence
  Description of Artificial Sequence: Synthetic coding sequence
tgaaaggagcgggagctgaactggttctaccggcggcagcgggtgctgttcgcgcacgtgtacccgacatttactaacacatcctgcctctgtaagtgcaagattaccgccctcaagatcaaatacaaccccttcgctaaggctttcctggacgctaaagagcggaatcatttgcgtgatgtacccgaggccatctcagaatcacagcatgtgacttatagccatctgggggggtggatcttctctaacccagatggcgtatgcaccgccgggaacagcaactatcagtatgctgccccgttaccacttcctgctcctcacacacaccacggctgcgaacattactctgggcttaggggccaccggcaggcgccctacccgtccgcgtatatgcataggaatcacagcccttcggttaaccttatagagagctcctctaataacttgcaggtttttagtgggcctgactcctggacgtcgctctcctctacaccccacgctagtatattgtctgtgccacacaccaacggacctatcaacccggggccttctccctatccatgtttatggacaattagtaacggagctggcgggccctcagggccaggacccgaagtgcatgccagtacgccaggggcctttctattgggtaaccctgccgtcacaagtcccccgtcagttctcagcacacaggcccccacctctgcgggcgtggaagtcttgggtgagcccagcttaacttcaattgccgttagcacctggaccgccgtggcctcgcacccttttgccggatggggggggccaggggcaggaggccatcattcccccagttctctggatggctag

SEQ ID NO: 208183 - DNA, 1344 bp, Artificial Sequence
  Description of Artificial Sequence: Synthetic coding sequence
atggagttcaccgccagccccaagccccagctgagcagccgggccaacgccttctccattgccgccctcatgtcatctggaggctccaaagagaaagaggccaccgaaaacactattaagcctctggaacagttcgtagagaaatcctcttgtgcacagccccttggtgagttgacctccctagacgcacacggggagtttggaggtggttcaggtagttccccaagttcctctagcttgtgcactgagccactcattcctacaactcccattatcccaagcgaggagatggctaagatagcatgtagcctcgagaccaaagagctgtgggataaattccatgagctgggcactgagatgatcattaccaaaagcggcagaagaatgtttcctacgatcagggtgtcattctccggcgtggacccagaagcaaaatatatcgtactgatggatatcgtcccagtcgataacaagaggtaccgttatgcctaccatcgcagctcatggcttgtggctggcaaggccgacccgccgctgcctgccaggttatacgtccacccggatagtcccttcaccggagagcagttactcaaacagatggtttcatttgagaaggtcaagcttaccaataacgaactggaccagcacggtcacattatcctcaatagcatgcacaaataccagccccgggtccacataatcaaaaagaaggaccatactgccagcctgctaaacctcaagtctgaggagttccgaactttcatcttccctgagactgtgtttaccgccgtgacggcctatcagaaccagttgataaccaagttgaaaatcgattccaatccatttgctaagggattccgggattccagccgccttaccgacatcgaacgggagagcgttgaatcccttatccagaagcacagctatgccagatcccctataagaacttacggaggtgaggaagacgtccttggcgacgaatcccagactacaccgaacagaggtagtgcttttacaactagtgataacctttcactgagttcttgggtgagctccagcagtagcttccccggctttcagcacccacagagccttactgctctgggcaccagcactgcttccatcgcgacacctataccacatcccattcaggggtctttgcctccatattcccgcctaggaatgccactcactccttctgccatcgccagttcaatgcagggcagtggtcctacattcccctccttccatatgcctcgatatcaccattatttccagcaagggccttacgcggccattcaaggtctaagacattcgtctgcagtgatgacccccttcgtgtag

SEQ ID NO: 208184 - DNA, 1608 bp, Artificial Sequence
  Description of Artificial Sequence: Synthetic coding sequence
atgggcatcgtggagcccggctgcggcgacatgctgaccggcaccgagccgatgcccgggtcggacgaaggaagggcaccaggcgctgatcctcagcaccgctacttctaccccgagccaggggcccaggatgcagatgagcggagaggcggaggctccctcggatccccctaccctgggggagccctggttcctgcaccaccctcgagattcctaggagcatacgcttatccacctcgaccacaggccgcagggttccctggcgcgggcgaatcttttccaccccccgcagacgcggaggggtatcagcctggtgaagggtacgccgcccctgacccccgcgccgggctgtatcccggccccagagaagactatgctctgcctgccggtcttgaagttagtggcaagctgcgagttgccttgaacaaccacctactctggtcgaagttcaatcagcaccagaccgaaatgattattacaaaacaaggccgcagaatgttccctttcctaagttttactgttgccggacttgagcccacaagtcattatcggatgtttgtggatgtagtgctggtcgatcagcatcactggcggtaccagagtggtaagtgggtccagtgtgggaaggcagaaggctctatgcctgggaaccgcctctatgtgcatccagacagtccaaacacgggggcacactggatgaggcaggaagtctcattcggcaaactgaagctgaccaataacaagggagcctccaacaatgttacacagatgatagtgctgcagtccttgcataagtaccagccaagactgcatattgtggaggtaaacgacggcgaacccgaagctgcttgcaatgcgagtaatacacacatcttcacctttcaagagactcagtttattgctgtgacggcctatcagaacgccgagatcacccagctaaaaatcgataacaacccctttgccaaagggttccgggaaaattttgaatccatgtatacaagcgtggacacgagcatcccctcaccgcccggacccaattgtcagtttctagggggagatcactattcgccgctcctgccaaatcagtacccggtcccatctcgattttaccccgatctgccaggacaggctaaggacgtcgttccccaggcctattggttaggcgccccaagagatcactcctatgaagctgaatttcgagccgtttctatgaaaccggccttccttcctagcgcccccggacctactatgtcgtactaccgtggccaggaggtactggcccctggtgcgggctggcccgtggccccacaatatccccctaagatggggcccgctagctggttccggcccatgcgaaccctccccatggagcctggtccgggaggaagcgagggacgcgggcctgaggatcagggcccccccctggtttggaccgaaatcgcccccatcagacccgaatccagcgatagtggtttaggggaaggtgattcaaaaagacgccgggtctccccatacccttcatcgggggacagctctagtcctgccggagcaccttcacctttcgacaaagaggccgaaggccagttctacaattactttccaaactag

SEQ ID NO: 208185 - DNA, 1203 bp, Artificial Sequence
  Description of Artificial Sequence: Synthetic coding sequence
atgttccccagcgtgcgggtgaaggtgaagggcctggaccccggcaaacagtaccacgttgctatcgacgtagtgcccgtggatagtaagcgctacaggtatgtgtatcactcgtctcagtggatggtcgcaggaaacaccgatcatttgtgcattatacctaggttctacgttcaccccgatagtccctgttctggagaaacatggatgcggcagattatcagttttgatcgcatgaagctaactaataacgaaatggacgacaagggccatatcatcctgcaatctatgcataaatacaaacctcgggtgcacgtgatcgaacagggctcatccgtggatttaagccaaatacagagtttgccgaccgagggcgtaaagacatttagctttaaagagactgaatttacaaccgtgacggcctaccagaatcagcaaatcacgaagctgaagatcgaaagaaatcccttcgccaagggctttcgcgacacagggcgcaacaggggcgtgctcgatggattgctcgagacctatccctggcggcctagcttcactctggactttaagacttttggggcagacactcaatctggctcaagcggatcaagcccagtaaccagttccgggggtgccccatctccactaaattcgcttctgtctccactgtgcttcagccccatgttccatcttccaaccagctcactgggaatgccctgcccagaagcctatctcccaaacgtgaacttacctctgtgctataagatttgcccgacgaatttctggcaacaacaacccctcgtcctcccggcccccgagagactggcttcttccaattcgagccagtccctagcacctctaatgatggaagtgcccatgcttagctccctgggtgttacgaatagtaaatctggctcatcagaagactccagcgaccagtacctacaggccccaaattcgacaaatcagatgctctatggcttgcagagtcctgggaatatctttttacccaactcaatcacacctgaagccctttcctgtagttttcatccttcatacgatttctatcgctataatttttccatgccttcccgcttgatatctggatctaatcatctcaaagtcaatgatgatagccaagtcagttttggagaaggaaagtgcaatcacgttcactggtaccctgccatcaatcattacctatag

SEQ ID NO: 208186 - DNA, 1563 bp, Artificial Sequence
  Description of Artificial Sequence: Synthetic coding sequence
atggccctgagcagccgggcccgggccttcagcgtggaggccctggtcggacgacccagcaagcgtaagcttcaagaccctatacaggcggagcaaccagagctgagggaaaagaaaggaggggaagaagaagaggagcgtcgctctagcgctgcaggaaagagcgagcctttagaaaagcagcccaagacagagcctagcacctctgcatccagtggttgtggcagtgactcgggctacggcaactcttctgaatctctggaagagaaagatattcagatggagcttcaggggtccgagctgtggaagaggtttcacgatataggcactgaaatgattatcaccaaagccggacgacgcatgtttcctagcgtgcgagtaaaagttaagggcttagatccaggcaaacagtaccacgttgccattgacgtggtgccagtggatagcaaacggtaccgttacgtgtatcacagctctcaatggatggtcgctggcaacaccgaccatctgtgtataatcccacgtttttacgttcatccagatagcccgtgttcaggcgagacttggatgcgccagataatttctttcgacagaatgaagttgactaacaatgaaatggacgataaggggcacattattctgcagagcatgcacaagtacaagccgcgtgtgcacgtgatagaacagggcagcagcgtggatttatcacagatccaatctctccctacggaaggggttaaaacattctcttttaaggaaaccgaattcacaactgtgactgcttatcagaaccagcagataacaaagctgaagatcgaaagaaaccccttcgcaaaggggtttagagacaccggacgaaataggggagtgcttgatggcctgctggaaacctacccatggcggccttcttttaccttagatttcaaaacgttcggcgctgatacccagagcggcagctccggatcttctcccgtgacgtcttccggcggggccccatcccctctcaacagcttactcagcccattgtgcttcagcccaatgtttcacttgcctacgtccagtctcggtatgccctgtcccgaggcctacttgcccaatgtcaaccttcctctgtgttataaaatttgtcctactaacttttggcaacagcagcccctcgtgctacctgcacctgagagactggcatcatccaattccagtcaaagcctggctccgctgatgatggaagttcctatgcttagcagcctaggcgtcactaatagcaaatccgggtcgtcagaggattctagcgaccagtacttgcaggctcctaactcaacaaatcagatgttatacggactgcagtcgcctgggaatatctttctgcctaactccattacgccagaggcactctcttgctccttccacccctcttacgatttttatcgctacaatttcagtatgccatctagacttatcagcggcagtaaccatctgaaggtcaatgatgattcccaagtttctttcggtgaagggaaatgcaatcacgttcactggtaccctgctatcaaccactacttgtag

SEQ ID NO: 208187 - DNA, 1563 bp, Artificial Sequence
  Description of Artificial Sequence: Synthetic coding sequence
atggccctgagcagccgggcccgggccttcagcgtggaggccctggtgggacgtccctctaagaggaaactgcaggaccccatccaggctgaacagcccgaactgcgagagaagaaaggcggggaggaggaagaggagcggcgcagtagcgctgcaggaaagtcagaacccctggaaaagcagcccaaaacagagccaagcacaagcgcgagctctgggtgtgggtccgatagcggttatggaaattctagcgagtccttggaggaaaaagatatccagatggagttacaaggttccgaactgtggaaaagattccacgatatcggaactgaaatgatcataactaaggcaggccgaaggatgttcccttcagtgcgcgtgaaagttaaaggcctcgacccgggaaagcagtatcacgtggcaatcgacgtggtcccagtggatagcaagagatatcgctatgtctatcactcaagccagtggatggtggctggaaacacagatcatctttgcatcattccacgattctatgttcaccctgacagtccatgctccggagagacgtggatgcgccagataatctctttcgaccgtatgaagttgactaacaacgagatggatgacaaaggtcacattatcctccagagcatgcataaatacaaacccagagtgcacgtcatcgagcagggctcgtctgtggatcttagtcagatccaatcactccccaccgagggggttaagactttcagtttcaaagaaacagaatttactacagtgactgcctaccagaaccagcagattacaaaattgaagatcgagcgaaaccccttcgctaaagggttcagggatacaggtagaaatcgcggtgtgctagacgggctgcttgaaacctacccctggcggccttcatttaccttggacttcaagacgtttggggcggacacccagtccgggagctctggttcttcccctgtgacaagcagtggtggtgcgccctcacctcttaattctctgctgagcccgttgtgcttttcacctatgtttcatctgcccaccagtagcctcgggatgccatgtccagaggcctaccttcctaacgtaaacctgccgttatgttataaaatttgccctaccaatttctggcagcaacagcccctggtcctacctgcacctgagagacttgccagttcaaacagctcacagtccctggcaccattgatgatggaggtgcctatgctgtcctccctgggcgtcacaaattcgaagagtggcagctccgaagacagcagtgaccagtatctgcaggcacccaactccaccaaccagatgctctacggactccaatcccccggtaatatttttctgcccaacagcatcacccctgaagccttgtcttgcagcttccatccatcatacgacttctataggtacaactttagcatgccaagtaggctgattagcggcagcaaccatttaaaggtcaacgacgacagccaggtgtccttcggcgaagggaaatgtaaccacgtccactggtaccccgccattaaccactatctctag

SEQ ID NO: 208188 - DNA, 1203 bp, Artificial Sequence
  Description of Artificial Sequence: Synthetic coding sequence
atgttccccagcgtgcgggtgaaggtgaagggcctggaccccggcaagcagtatcacgtggccatcgacgtggtgccagtggattcaaaaagatataggtatgtctatcactctagccagtggatggtagccggaaacaccgaccatctgtgtatcattccacgtttctacgtccaccctgactccccttgtagcggggagacatggatgagacagatcatcagctttgataggatgaaactgaccaacaacgaaatggacgacaaagggcacatcatactgcagagcatgcataagtataagcctcgggtccacgtgattgagcagggctcaagcgttgacctgtcgcagattcagtcccttccaacagagggggtgaaaaccttcagcttcaaggagaccgaattcactacagtgaccgcgtatcaaaaccagcagatcaccaagttaaagatcgaacggaatccctttgccaaaggattcagagacacgggcaggaaccgaggggtgttagacggcctcttggaaacttatccctggcgccctagcttcacccttgattttaagacctttggcgcggatacacaatccggaagctcaggctcaagccctgtcacatcctcaggtggggcgccatcacctctaaattcactgcttagtcctctgtgcttttccccgatgtttcacctgcccacgagcagtcttggcatgccttgtccagaagcctacctgcccaatgtgaatctacccctctgctacaaaatctgtcctaccaacttttggcagcagcagccacttgtgcttccagcacccgagagactcgccagttccaatagtagccaatccctggccccactaatgatggaggttcccatgcttagcagtcttggggtaactaattcaaaatccgggtcgagtgaggactcatcagaccagtatctccaggcgcctaattccacgaatcagatgctgtatgggcttcagtcacccgggaacatttttcttccaaactcaattaccccggaggctctcagttgttcattccatccctcctacgatttttataggtataacttctccatgccttcccggctgattagcgggagtaaccacctgaaggttaacgacgattcacaggtcagctttggagaaggtaaatgcaatcacgtgcactggtaccctgcaattaaccactatctatag

SEQ ID NO: 208189 - DNA, 2232 bp, Artificial Sequence
  Description of Artificial Sequence: Synthetic coding sequence
atgagcctgagcatgcgggaccccgtgatccccggcaccagcatggcctaccatccgtttctgccccatcgcgcaccagacttcgcgatgagcgccgttctgggccaccagcctcccttctttccagcactcaccctcccgcctaatggggcagccgcattgagcttgcctggcgcccttgctaagcccattatggatcaactggtgggcgcagcggagacaggcattccattttccagtctgggtccacaggctcacctgcgccctttgaagactatggagcccgaagaggaggtggaggatgaccctaaagtacaccttgaggcaaaggagctttgggatcagttccacaaaaggggcaccgaaatggtgattactaaatcagggcgacgcatgttccccccgtttaaagtccgctgctctggattggataagaaggccaaatatatactgctgatggatatcatcgctgccgatgactgtagatacaaatttcacaactctcgttggatggtggctggaaaggctgatcccgagatgcccaaacgaatgtacatccatcccgacagcccggcaacgggagagcagtggatgagtaaggtcgtcacttttcacaagctgaagctcacaaataacatctcagacaagcacggattcaccttggccttcccttctgatcacgctacttggcagggaaattacagcttcggaactcagactattctcaactccatgcacaagtatcaacccagatttcacatcgtgcgtgctaatgacattctcaagctcccctatagcaccttccggacatacctgtttccagagaccgaattcatcgcagtcacagcctaccaaaacgacaaaatcacacagctgaaaatagacaacaacccctttgcaaagggtttccgggacaccggaaatgggcgccgcgaaaagcggaagcagttaactctgcagtctatgagggtcttcgacgaaaggcataaaaaggagaacgggacttctgacgaaagcagttccgaacaggcagccttcaattgcttcgcacaggcgagctctcctgcagcctcaaccgtgggaaccagtaatctgaaagatctgtgtcccagcgagggcgagtctgatgccgaggccgaatcaaaggaggagcatggcccagaggcttgtgacgctgccaaaatcagcactacaacgagcgaggagccttgtcgggataaaggctcacccgcagtgaaggcacaccttttcgcggcagaacgacctagagatagtggccgcctggacaaggcttcacctgactctcgccacagccctgcaacaatctcttcctctaccagagggctgggcgcagaggagaggaggtcacccgtgagggaggggaccgctcccgcaaaagtggaggaggcacgggcattaccggggaaagaggcctttgcacccctgaccgtacagacagatgctgctgcagcccacctcgcccagggacccttgccagggctcggattcgccccaggtctggccggacagcagttcttcaatgggcatcctctgttcctgcatcccagccaattcgccatgggaggagcattcagctcaatggctgccgccggtatgggacccctactcgccacagtcagtggggcctccaccggtgttagcggcctcgactcaactgcaatggcctctgctgcagccgctcagggtttgtccggtgcctcagccgctaccctgccgtttcacctgcagcaacacgttctcgcgagtcaaggcctggcgatgtccccctttggaagccttttcccatacccctacacctatatggccgcagccgcagcagcatcgagtgctgccgcctcttcgtcagtgcacagacacccttttctgaacttaaataccatgaggccgagacttagatactccccgtattctattcctgtgccggtgcctgacggcagttcattgttgaccacagctctcccgtcaatggccgccgcagcaggaccccttgatgggaaagtcgccgccctggccgcttcacccgcctccgtggccgtggacagcgggtctgagcttaatagtaggtcctcgaccttatccagcagttccatgagcctcagtccgaagttatgcgcggagaaggaagcggcaacgtctgagcttcagagtatccagaggctggtgtcgggactggaagcaaaacctgatcgttctcgatctgccagtccctag

SEQ ID NO: 208190 - DNA, 2172 bp, Artificial Sequence
  Description of Artificial Sequence: Synthetic coding sequence
atgagcctgagcatgcgggaccccgtgatccccggcaccagcatggcttatcacccattccttcctcatcgcgcgcctgactttgccatgtcagccgtgctagggcaccagccccccttttttcccgccctaactttacccccaaacggggcggctgctctttctctgccaggagcactggcaaaaccaatcatggaccagctggtcggtgcggccgaaaccggaatcccattttccagcctcggaccccaggctcacttgcgcccactgaaaaccatggaacctgaggaggaggtggaggatgatcccaaagtgcacctggaagctaaggaactctgggatcagttccataagcggggcacagagatggttattacaaagtccggcaggcggatgttcccacccttcaaggtcagatgctcgggcctggataagaaagccaagtacatccttttaatggacatcatcgccgctgatgattgtcgctataagttccataatagccgttggatggttgccggtaaggcagatcccgagatgccaaaacggatgtatattcaccctgacagtcctgcaaccggggagcagtggatgtctaaagtggtcacctttcataaactaaaactaactaacaacatcagcgacaagcacggctttaccatactgaattctatgcataaatatcaaccacgcttccacattgtaagagccaatgatattcttaagcttccatacagcaccttccgaacttatctgttccccgaaaccgagtttatcgccgttacggcttatcaaaatgataaaatcactcaactaaaaattgacaacaacccctttgctaagggtttcagggacacaggtaacggaaggagggagaaaaggaagcagctcacactgcagtccatgcgtgtgttcgacgagaggcacaagaaggagaatggcacatcagatgaatcctcttcagagcaggctgccttcaattgcttcgcccaggccagttctccggccgcctctactgtaggcacaagcaacctgaaagatctgtgcccctccgagggtgaatctgatgcggaagcagagagcaaagaagagcatggtccagaagcatgcgatgcagcgaagatcagcaccacaacttctgaagaaccatgccgggacaagggatccccggccgtcaaagcccacctgttcgcagcggagaggccacgggatagtggacgattggacaaagcaagtccagactctagacactctcctgcaacgatcagcagctcgactaggggcctgggtgctgaggaacgccgttcccccgtgagggagggtacagcccccgcgaaagtggaagaggctagggccctgcctggaaaggaagcattcgctcctttgacagtgcagaccgatgcagcggcggctcacctcgcacagggtcccctgcccggtctggggttcgccccaggcctggccggtcaacagtttttcaacggccacccgctgttcctgcacccctcacagttcgccatgggaggtgccttttctagtatggcagccgctggtatggggcctttgctggcgaccgtctctggcgctagcacgggagtttccggtctcgactctaccgcaatggctagtgctgccgccgcacaggggctctctggagcttccgccgctacattaccattccatctacaacagcacgtgctggccagtcagggactagccatgtctccctttggatctctcttcccctatccatacacctatatggcagcggccgcggcagcctccagcgctgccgcaagttcgagcgttcacaggcacccttttctgaatctgaataccatgaggcccaggttaagatattctccatattcaattccggtgccggtgccagatggctcctccctcctgacaacagcacttccatccatggccgccgctgcaggacccctggatggcaaggttgcggccctggcagcttcgcctgcttccgtggcagtggattccggctcagagctcaacagtagatcatccaccctgtccagcagcagcatgtcattgagcccaaagttatgcgccgagaaggaggcggccacgtccgagctgcagtcaatccagcggctggtctccggccttgaggcaaaacctgaccgctctaggtccgccagcccctag

SEQ ID NO: 208191 - DNA, 1803 bp, Artificial Sequence
  Description of Artificial Sequence: Synthetic coding sequence
atgagcctgagcatgcgggaccccgtgatccccggcaccagcatggcctatcacccctttctgcctcacagggcccccgatttcgcaatgtccgctgtgctgggccaccaaccaccgtttttccccgccttgacacttcccccaaacggggctgccgcactgtccctgccgggtgcgttggcgaagccaattatggaccagctggtgggtgccgccgagaccggaatccctttctccagcctcggccctcaggcccacttgcgacccttaaagaccatggagccagaggaggaagtggaggacgaccctaaagtacacctggaagccaaagaactatgggatcagttccacaaacgaggcacagagatggtgattactaaatccggtcgaagaatgttccccccttttaaagtgcgctgttccgggctagacaagaaggctaaatacattctgctaatggacataatcgctgctgatgactgccgttacaaattccacaactcacgttggatggtcgctggaaaggccgacccagagatgccgaaacggatgtacatccacccagacagcccggccactggagaacagtggatgagcaaggtcgtgacctttcataagcttaagcttacaaataacatcagtgataaacacggctttaccctggcatttccttccgaccacgctacttggcaggggaactactccttcggaactcagacaattttgaactccatgcacaaataccagccccggttccatatcgtgagggccaatgacatccttaagctgccatattcaacctttcgaacctaccttttcccagaaacagagtttatcgcagttacagcttaccagaatgataagatcactcagttgaagattgataacaacccttttgccaagggtttccgcgatactggcaacgggcggcgcgaaaagcgaaagcaattaactctgcagagcatgcgagtcttcgacgagcggcacaagaaagagaacggaacctccgacgaaagcagctccgagcaggccgccttcaattgtttcgctcaagcatccagccctgcagctagcacagtcggcacatcaaacctgaaggatttatgtccaagcgaaggggagagcgatgcagaagccgaaagtaaggaggagcatgggcccgaagcctgtgacgctgccaagattagcacgaccacatcggaagaaccttgccgggacaagggctcacccgccgtgaaagctcacctatttgctgcagaaaggccaagggactcaggaagactggacaaggcttcacccgacagtaggcattccccggctacaatctcatcgagcactcggggattgggcgcggaggaacgtaggtcccccgtccgagagggcactgcgccggctaaagtcgaggaggcgagagccctccccggcaaagaagccttcgcacccctgacagtccaaacggatgcggctgcggctgcagcttcatcttctgtgcacaggcatccgttccttaacctgaataccatgcggccccggcttcggtattcaccttattctattcccgtacccgtgccagacggctccagcctgcttaccacagcccttgccgcttcaccggcctccgtggctgtcgatagcggaagtgaactcaactccagatcctctacactgagcagctcatccatgagcctgtctcccaagttgtgcgcagagaaagaagcagccacaagcgaattacagagtattcagcgcctagtgtctgggctggaagctaagcctgatcgcagtcggtccgcatctccttag

SEQ ID NO: 208192 - DNA, 1638 bp, Artificial Sequence
  Description of Artificial Sequence: Synthetic coding sequence
atgctgcaggacaagggcctgagcgagagcgaggaggccttccgggcacctgggcccgccctcggagaagccagtgctgcgaacgcaccagagcccgctctagctgcaccaggcctgagtggggccgccctgggatcccccccaggacctggtgccgacgtggtggccgcagccgccgcagagcagacgattgaaaacatcaaggtgggtttacatgagaaggagctttggaaaaagtttcacgaggcaggcacagagatgatcattacgaaagccggcagacggatgtttccaagttataaagtgaaagttacaggtatgaatccaaaaacaaaatacatcctgctcatagatatcgttcctgctgatgatcatcgatataaattctgtgacaataagtggatggtcgctggcaaggccgagcccgcaatgccaggaaggttgtacgtgcatcccgattccccggccaccggggctcactggatgcgacagcttgtctcctttcagaaattaaaattgaccaataaccacttagatcccttcggacacatcattctaaacagcatgcacaagtaccagccaagattgcacattgtcaaggcagacgagaataatgcatttggttcgaagaatactgcattttgcacacatgttttccccgagacctcctttatctcggtgacttcatatcagaaccataagattacacagctgaagattgaaaacaatccattcgccaagggcttcaggggctctgacgattccgaccttagggttgctcgcttacagtctaaggaatatcccgtgattagcaagagtatcatgagacaaaggctgatctcccctcagcttagcgccaccccggatgttgggcctctgcttggcacccatcaggccctgcagcactaccagcacgaaaatggtgcacactctcagttagccgagccccaagatctgccactgtccacgtttccaacgcagcgcgacagcagcctcttctaccattgccttaaaaggcgagatggcacccggcacctggatctgccatgtaaacgaagttacctggaagccccttccagcgttggcgaagatcattacttcagatccccccctccctacgaccagcagatgctatcaccaagctattgctcggaagtaacccctcgggaagcttgcatgtactctggcagcggacctgaaattgcaggagtgtctggagttgacgatctgccgccaccgccactttcatgcaacatgtggacctccgtatctccatacacgtcctatagtgtgcagacgatggagacggtgccctatcagcctttcccaacacatttcactgccaccaccatgatgccccggcttcccacactgagcgctcagtccagccagcccccaggtaatgcccactttagcgtgtacaaccaactttctcaaagccaggtccgcgaaagaggtccatcagcgagctttcctcgcgaacgcgggcttccacagggatgcgagcgaaagccaccctcgcctcatctgaacgctgcaaacgagttcctgtacagtcagaccttttctttgtcccgggagagctctttgcagtatcattctggcatgggcaccgtggaaaattggaccgacggttag

SEQ ID NO: 208193 - DNA, 1641 bp, Artificial Sequence
  Description of Artificial Sequence: Synthetic coding sequence
atgctgcaggacaagggcctgagcgagagcgaggaggccttccgggcacccgggcccgcgttaggtgaggccagtgcagctaacgccccagagcccgccttagccgcacccggcttaagcggcgctgcactgggctcccccccaggtcctggggccgatgtggttgcagcggctgccgcagaacaaaccatcgagaacattaaggttggccttcatgaaaaagagctctggaagaagttccatgaagctgggacagagatgattattacaaaagcaggccgccggatgttccctagttacaaagtcaaggttacaggtatgaatcctaagactaaatacatcctactgatcgacatcgtccctgccgacgaccaccggtacaaattctgtgacaacaagtggatggtggctgggaaagctgagcctgcgatgccgggacgcttgtacgtgcaccctgacagcccagccactggagcacattggatgcgtcagctcgtgagtttccagaaacttaagttgactaacaatcaccttgatccctttggtcatatcatactaaatagcatgcacaagtatcaacccagacttcacatcgtgaaggcagatgagaacaacgcctttggttctaaaaacactgccttttgcactcacgttttccccgagacttcattcatatccgtgacttcctatcaaaatcataaaataacccagctcaagattgagaataatcctttcgccaagggattccgaggatcagatgactccgatttgagagtggcccggttacagtctaaggaatacccggtcattagcaaatctatcatgaggcagcgtcttatttcgccgcagctgagtgcaacccccgatgtaggacccctgctgggcacccatcaggcactccaacattatcagcatgagaatggggcacactcacagctggcagagccgcaggatcttcccctcagcacgttccctacccagagagattcttccctcttttaccattgcttgaagagacgtgcagacggaacacgccacctggacctaccatgcaagcggagctacctagaggcaccgtcaagcgttggtgaggaccattactttaggtcaccaccaccgtacgatcaacagatgctgagcccgtcgtattgtagcgaagttactcctcgcgaggcctgcatgtattccgggtcagggcccgagatcgcaggagtgtctggggtagatgacttgcctcctccgcccctctcatgcaatatgtggacgtctgtttctccctacactagctattccgtacagactatggagactgtaccctatcagcctttcccgacacactttaccgccaccacgatgatgccaagactcccaaccctaagcgcgcagagctctcagcccccaggtaacgcccactttagcgtgtacaatcagctctctcagagtcaggtgcgggagaggggcccaagcgctagtttccccagagagaggggcctgcctcaggggtgtgagaggaagcccccatccccccaccttaacgccgccaacgagtttctgtactcccaaaccttttctttgtctcgggagtccagtctgcaatatcatagcggcatgggcacagtcgagaactggacggacggttag

SEQ ID NO: 208194 - DNA, 1557 bp, Artificial Sequence
  Description of Artificial Sequence: Synthetic coding sequence
atggccgacgccgacgagggcttcggcctggcccacacccccctggaaccggatgccaaggacctgccttgcgacagcaagccagaaagcgcccttggtgccccgtcgaagtctccctccagcccccaggcagccttcacacaacaaggcatggagggtatcaaggtgttcctgcatgagcgggaactctggctaaagtttcacgaggtcggaacagagatgattataacaaaagccggtagacgtatgtttccttcatataaagtgaaggtgaccggcctaaatcccaagactaagtatatattgctaatggacatagtgccagccgacgatcaccggtataagttcgccgacaataagtggtccgtgacaggaaaagctgagcctgcgatgccaggcaggttgtacgtgcacccggattctccagccactggagcacattggatgaggcaacttgtgagctttcaaaaattaaaactgactaataatcacctagacccattcgggcacattatcctgaacagcatgcacaagtaccagccaagattacacattgtgaaagctgatgagaacaatgggttcgggtctaaaaacaccgccttctgtacccatgtctttcctgagacagcgttcattgccgtgaccagctaccaaaaccacaagattacacaacttaagatcgagaacaacccgtttgccaaaggattccggggatcagacgacatggaacttcatcgcatgagccgtatgcagtctaaggagtatcccgtcgttcccagatctaccgtaagacagaaagttgcatcaaaccatagtccatttagcagtgaaagccgcgccttgtctacttctagtaatctgggaagtcagtaccaatgcgagaatggcgtgtcaggcccttctcaggaccttttacctccgccaaacccttaccctctgccccaggaacactcccaaatctaccactgtacaaagaggaaggaagaggaatgctctactaccgatcacccttacaaaaaaccctacatggagacctccccatcagaggaggatagtttttatcgatccagttatcctcagcagcaaggattaggcgctagctacaggaccgagtccgcccaacgccaggcgtgcatgtacgcctcctcggctcctcctagtgagccagtgccctccctggaagacatttcatgtaacacctggccttctatgccttcatattcatcatgcactgtaaccacagttcagcccatggaccgactgccctaccaacacttctctgcccactttacatctggccctctggtaccacggcttgccggcatggcgaaccacgggtcaccccagcttggagagggcatgtttcagcatcagacgtccgtggctcaccaacctgtggtgcgccagtgcggtccccagaccggactgcaaagtcccggaacacttcaaccaccggaattcctctacagccacggagtccctagaaccctttcacctcaccagtaccattcagtccatggggtgggaatggtgcccgagtggagcgacaactcttag

SEQ ID NO: 208195 - DNA, 1407 bp, Artificial Sequence
  Description of Artificial Sequence: Synthetic coding sequence
atggagggcatcaaggtgttcctgcacgagcgggagctgtggctgaagtttcatgaagtagggaccgagatgataattacaaaggccggcaggaggatgtttcctagttacaaagttaaggtgaccggtctgaaccctaagactaagtacatccttcttatggacattgtgccggctgacgatcacagatataaattcgccgataacaaatggtctgtgactggcaaagctgaaccagcaatgcccggccggttatatgtacatcccgattcccctgccaccggggcccactggatgcgccagctggttagttttcagaagctaaagcttactaacaatcaccttgacccctttgggcatattattttgaacagtatgcacaaataccaaccccgccttcacatcgtgaaggctgacgagaacaacggatttggttctaaaaacaccgccttctgtacgcacgtcttccctgagactgctttcatagccgtcacctcttatcaaaatcacaagatcacacagctgaaaatcgagaacaaccctttcgccaaaggttttcgtgggagcgatgatatggaattacaccgcatgtcacgtatgcagagtaaagagtatcctgtcgtgcctcggagcacagtcaggcagaaagttgcttctaatcatagcccattttcgagtgaatcgcgtgccttgtccacatcttctaatttggggtcccagtaccagtgcgagaacggcgtgtccggccccagtcaggacttactaccgccacccaacccgtatccattgccccaggaacacagccaaatctaccactgtactaagagaaaggaggaagaatgcagcaccacagatcacccgtacaagaagccctacatggagaccagcccttcagaagaggactcgttttaccgcagctcctacccgcagcagcagggtcttggcgcctcttaccggacggaaagcgcacaacgccaggcatgcatgtacgcttcaagcgcccccccctccgagccagtgccttctctggaagatatcagctgtaatacttggccgagcatgccatcttattctagttgcacagtgactaccgttcaaccgatggacagattaccatatcagcatttctcagctcacttcacctccggtcccttggtgccgcggcttgcaggcatggccaatcacggatcgcctcagctgggggaagggatgtttcagcatcaaaccagcgtggcgcatcagcctgtcgttcgacagtgtgggccccagaccggactgcagagtcctggcaccctgcagcctcccgagtttttgtattctcacggagtgcctaggaccctctccccccaccagtaccattcagttcatggtgtgggtatggtgcctgagtggtccgacaattcttag

SEQ ID NO: 208196 - DNA, 1557 bp, Artificial Sequence
  Description of Artificial Sequence: Synthetic coding sequence
atggccgacgccgacgagggcttcggcctggcccacacccccctggagccggacgccaaagacttgccatgtgactctaagcctgaaagcgcgcttggcgctccctcgaagtcaccaagtagcccacaagccgcctttacgcaacagggtatggaaggcataaaggtgttcttacatgaaagggagctctggctgaaattccacgaagtgggaactgagatgattataactaaagccgggaggagaatgttcccctcctacaaagttaaggtgaccgggctgaacccaaagaccaagtacatcctcctaatggatatcgtgcctgctgatgaccacagatacaaatttgctgataataaatggagcgtgacgggtaaggcagaacctgccatgcccgggcgtttgtacgtgcacccagattcaccagctaccggggcacattggatgagacagctggttagtttccaaaagctgaagctaactaataatcatctggatccattcggacacatcatcctcaattccatgcataagtaccagcctaggctgcacatcgtgaaagccgatgaaaataacggctttggcagtaagaatacagctttctgcacacacgttttcccagaaacggcttttatcgctgtgacatcgtatcagaatcacaaaatcacacagcttaagatcgagaataaccccttcgcaaaaggcttcaggggctccgacgacatggagctccacaggatgtctcgaatgcaatccaaggaatacccagtggtcccaagaagcactgtgcggcagaaggttgcctccaaccatagtccattttctagtgagtcccgggccctgagtacatcatcgaatctcggcagccagtaccagtgcgagaatggtgtgagcgggccatcacaggacttgttgccaccccccaacccatatccacttccacaggaacactctcagatctaccattgtacaaagcgaaaggaggaggagtgctccaccacagaccacccttataagaagccatacatggagacttcaccatctgaagaagatagcttttatagatcctcctacccacagcagcagggattgggcgcctcatataggactgaaagcgcacagaggcaggcatgtatgtatgccagtagcgcgcccccatcggaaccggttccatcacttgaagacatttcctgtaacacttggcccagcatgcccagttacagttcctgcaccgtaaccactgtgcaaccaatggatcgactgccgtaccagcacttcagtgcacactttactagcggtccgctcgtcccccgcttagccggtatggcaaatcacggtagcccacaactgggagagggtatgttccagcaccagacctcagtcgcccatcaacctgtcgttcgacagtgcggaccccaaactggcctacagtcccccggcactctccagccccccgaatttctgtattctcatggcgttccccgcaccctgagccctcaccagtatcattcagttcacggagtgggtatggtacctgaatggtccgataattcatag

SEQ ID NO: 208197 - DNA, 1269 bp, Artificial Sequence
  Description of Artificial Sequence: Synthetic coding sequence
atggacatcgtgcccgccgacgaccaccggtacaagttcgccgacaacaaatggtcagtaaccggaaaagccgagccagctatgcctggacgtctgtacgtacatccagacagccctgcgacgggagcccactggatgcgacagctggtgagctttcagaagctcaaacttaccaacaaccacttggatcctttcggccacatcattctgaactccatgcataaatatcagccccgcctgcacatagtgaaggccgatgagaataatggttttggctccaagaataccgcattctgtacgcacgtgttcccagaaactgccttcattgccgtgacatcatatcagaatcataagatcactcagcttaagattgagaacaatccctttgccaaggggtttcgcgggtcagacgatatggagttgcaccggatgtcccggatgcagagcaaagaatatcccgtggtgccgcgtagtaccgtgagacagaaggtggcctctaaccattcaccgttctcctcagaatcaagggcgctctctacaagtagcaacttaggcagtcagtaccaatgcgaaaacggcgttagcgggccatcacaggatctgttgcccccgccaaacccctatccactcccccaagaacatagccagatttaccactgcacaaagcgcaaagaagaggaatgttctacaactgatcacccgtacaaaaaaccatacatggagacgagccctagtgaagaagatagcttctacaggtctagttacccacagcagcagggactgggcgccagttatcgaactgaatccgctcaacgccaggcatgtatgtatgcttctagcgcccccccttctgaaccagttccaagtctggaggatatcagctgcaatacctggccctcaatgcccagctactcctcgtgcacagtcactacagttcaacccatggaccggctcccctatcagcacttttctgcccactttacaagtggacctctcgtgcctagattggcaggcatggctaaccacggaagcccacaactgggcgagggtatgttccagcaccagaccagtgtcgcacatcagcctgtggtacggcagtgcggccctcagactggactgctccacaataggcatttcctcgaaaaggaacgggaacggggagagagagagaggcgccgggaaacagtagccaaaagaaccccacgcacacgctttttcatctcaccaaatgtacacatctgtacacaggggcggtggatgcttatttag

SEQ ID NO: 208198 - DNA, 1050 bp, Artificial Sequence
  Description of Artificial Sequence: Synthetic coding sequence
atggccgacgccgacgagggcttcggcctggcccacacccccctggagccagatgctaaggatctgccatgcgactcaaaacctgaatcagcactcggcgcccctagcaagtcaccttccagcccgcaggctgcctttacccagcagggaatggagggtatcaaggtttttctgcacgagcgtgaactctggctgaaatttcatgaggtgggcaccgaaatgatcattaccaaggctggccgaagaatgtttccaagctataaagtgaaggtgacaggtctcaaccctaagacaaagtacatcttgctcatggacattgtccctgcagacgaccaccgttacaaattcgctgataacaagtggagcgttacaggtaaggctgagccagccatgccgggtcgcctgtacgttcacccggacagtcctgccaccggcgcccactggatgaggcaactggttagtttccaaaaactgaaacttactaataaccatcttgacccgttcggtcacatcatcctcaattctatgcacaaatatcagccgaggctgcacatcgttaaggctgacgagaataatgggtttggttcaaagaatactgccttctgcacgcatgtgttcccagaaaccgcatttatcgcagtgacctcctaccagaaccacaagattacccaactgaagatcgaaaataatcccttcgcgaaaggctttagggggagtgacgatatggaattgcaccggatgagcaggatgcagagcaaagagtatccagtggtgcctcgcagtactgtcagacagaaagtggcgagtaaccattccccattctcctctgagtctcgagctctcagcacctcctctaatctgggtagtcagtatcagtgtgagaatggggtttctggcccctcacaggaccttcttccaccacccaatccctacccccttccacaggagcacagccaaatctatcactgcacaaagagaaagggggaatgtgaccatccctggagcatctgctttctttcctacctgttcctgtctctcgggtggggctag

SEQ ID NO: 208199 - DNA, 1311 bp, Artificial Sequence
  Description of Artificial Sequence: Synthetic coding sequence
atgtaccacccccgggagctgtaccccagcctgggcgccggctacagactggggcccgcccagcccggggccgacagttccttcccacccgccctggccgagggataccgataccccgagttagacactcccaaacttgactgttttttatccggaatggaggcagcccccagaacgctggctgcgcacccaccgttgccactcctgcctcctgccatgggcacggagccagctccatctgcccctgaagctctgcattctctgccaggtgtgagcctgtccctggaaaaccgggaattgtggaaggagttctcttccgtcgggaccgagatgataatcacaaaagccgggagacggatgtttccggcatgcagagtctccgtcaccggactggatccagaagccagatacctgttcctactggatgtgataccggttgacggcgcaagatatcgttggcagggccgcagatgggaaccgtctggaaaagcagagccgcgtctgccagacagggtgtatattcaccccgactccccagccactggggcacactggatgagacaaccggtctctttccaccgcgttaaactaacaaactccacgctggacccccatggacacctgatcctgcattccatgcataagtaccagccccgtatccatctcgtgagggcggcccaactgtgttcacagcactggggaggcatggcgagctttcggtttccagagacaacgtttatttccgtgactgcctatcaaaatccccaaatcacccagctgaagatcgcggcaaacccatttgccaagggttttcgcgagaatggtcgaaactgcaagcgcgaacgcgacgcgcgggttaaaaggaagttgcgaggccctgaaccagctgccaccgaagcctacggctcgggcgataccccaggcggtccttgcgattctactctcggtggggatataagggagtcagacccagagcaagccccggcccctggggaagctacagccgctccagcccctctgtgcggcggacccagtgctgaagcttatcttctccatccagccgctttccacggagctccttctcatttgcctacaaggagcccatcattcccagaggcccctgactctgggagatcggcaccctattccgccgcctttctggagctgccacacggctctggaggaagtggataccctgccgccccgcccgccgtgccttttgctccacactttctccaagggggtccctttccactcccatacactgctcccggtggatacctggatgttggaagcaaaccaatgtactag

SEQ ID NO: 208200 - DNA, 1311 bp, Artificial Sequence
  Description of Artificial Sequence: Synthetic coding sequence
atgtaccacccccgggagctgtaccccagcctgggcgccggctaccgtcttggtcctgcccagccaggcgctgatagcagctttcctccggctttggccgaggggtaccggtaccctgagctcgacacccccaaactggactgttttctttccggaatggaggctgcccctagaacacttgcagcccacccccctctaccactcctgcctcctgccatgggcacagagccggcacctagtgcccccgaggcccttcatagtctaccaggcgtgtcgctcagtctagagaatcgcgaactgtggaaggagttcagcagcgtgggcaccgagatgatcatcaccaaggccggcaggagaatgttcccagcctgcagagtcagcgtgaccggcctggacccagaagctagatatttgtttctgcttgacgtgattccagttgacggagcacggtatcgatggcagggcaggagatgggagccaagcggaaaagccgagccacgcctgccggatcgcgtatatatacatcccgactcgccagctacgggagcccactggatgcggcagcccgtgtcttttcaccgggttaagcttacaaattccactctggatccgcatgggcatttaattttgcattctatgcacaagtaccagcctagaattcacctggttagagccgcccagttatgttcacagcattggggggggatggccagcttcagattcccagaaacgacgtttatctccgtcaccgcctaccagaatccgcagatcacccagttaaagattgccgccaacccctttgcaaaggggttccgtgaaaacggccggaactgtaagagagagagagatgcgagagtaaagcgtaaactgcgaggacccgaaccggctgctactgaagcctacgggtctggggacacaccaggcggaccatgcgactccactctcggtggagacattagggagagtgaccccgaacaagcaccggcccctggagaggccacggccgcaccagcaccgctgtgtggaggcccatctgctgaagcgtacctactgcacccagctgcatttcacggtgccccctcccacctgccaacaagatctccaagcttccccgaggcaccggactcagggcgaagcgctccttactcagccgcctttcttgagcttcctcacgggtccgggggatcagggtaccccgccgcccctcctgcagtgcccttcgcgccacacttcctgcaaggcggaccattccccctgccctataccgctcccgggggttacctggacgtgggatcgaaacctatgtattag

SEQ ID NO: 208201 - DNA, 888 bp, Artificial Sequence
  Description of Artificial Sequence: Synthetic coding sequence
atgtaccacccccgggagctgtaccccagcctgggcgccggctaccggttgggtccggcacagcccggcgccgatagctcttttccccctgcgctagcggaagggtaccgctaccccgagttagacactcctaagctggattgctttttgagcgggatggaggccgccccaaggactttagccgcgcaccccccactgccactgctgcctcccgctatgggcacggagcctgctccttccgcccccgaggcactacacagccttccgggcgtgagtctgtcacttgaaaaccgggaattgtggaaagagttcagctcagtggggaccgaaatgatcataaccaaagctggccggcgtatgtttccagcttgccgcgtgagcgttaccggactcgatcccgaggcacgatatctgtttctgttggacgtgattccagtagatggggcaaggtaccgttggcagggccgaagatgggaaccctctgggaaggcagagccaagactgcctgatagagtgtacatccacccagattcccctgccaccggggcgcactggatgaggcaaccagtttccttccatagggtcaaactgacgaatagtaccctagacccgcatggtcacctaatcctgcatagtatgcacaaataccagcctcggatccacctggtgagggcagctcagctctgcagccagcattggggggggatggcctcttttcgctttccagagacaacttttatctcagttacggcgtatcagaacccacagatcacccagttaaagatcgctgctaacccatttgcaaaaggattccgggagaacggcaggaattgtaagcggtgggagctgttcatccacttattcatgcatagcacgaatgtttattag

SEQ ID NO: 208202 - DNA, 1974 bp, Artificial Sequence
  Description of Artificial Sequence: Synthetic coding sequence
atggagatggagaccaccgagcccgagcccgactgcgtggtgcagccacctagtcccccggacgacttctcctgccagatgagattgagcgagaaaattacacctctgaaaacttgctttaagaagaaggatcagaagaggctaggaaccggaaccttgcgctcgttacgtcctattttgaatacactcctggagagtggaagtctggacggggtgtttcgctcacggaaccagtccaccgacgagaatagtttgcacgagccaatgatgaagaaggccatggaaatcaacagctcatgtcccccagcggaaaataatatgagtgtgctcatccccgatcgcacgaacgtgggcgaccaaatcccagaggctcatccgtctacagaggctcccgaacgggtggttcctattcaagatcatagcttcccttccgaaactctgtcggggactgtggccgacagcaccccagctcattttcagacagacctattgcatcccgtctcctcagacgttccgacaagtcctgattgcctggataaagtgatcgactacgttccgggcatctttcaggagaatagttttacaatccaatacattctcgacacgagcgataaattatccactgaactcttccaagacaagtccgaggaggcctctctggatctggtgttcgagctcgtgaatcagctccagtaccatacccaccaggaaaatggaatcgaaatatgcatggacttcttacaaggaacctgtatctacggtcgagactgtctgaagcatcacactgtgctgccctaccactggcagatcaaacgcacaaccacacagaaatggcagtctgtcttcaatgactcccaggaacacctagaaagattttattgcaaccctgaaaatgacagaatgcgcatgaagtatggcggacaggaattttgggccgatctcaacgccatgaacgtctacgaaaccacagagttcgaccagctcaggcgactttccaccccaccatcctcaaatgtgaacagtatctaccacacagtctggaagttcttctgtcgcgaccatttcggctggcgcgagtatccagaaagcgttatccggctcattgaagaagccaatagtcgcgggctgaaagaggtgaggtttatgatgtggaacaaccattatatcctacacaactcattctttaggcgcgagatcaaacggagacccctgtttcgatcctgctttatcctgctcccatatctgcaaaccttaggaggggtccccacccaagctcccccacccctagaagcaacaagttccagtcaaatcatttgtcccgacggagtcacttccgcaaatttctaccccgaaacttgggtctacatgcatccatctcaggatttcatacaggtcccagtttcagctgaggataaaagttacagaatcatctataacctgtttcataaaactgttcctgaatttaagtaccgcatacttcagatcttgagagtccagaatcagtttctgtgggaaaagtataaacgcaagaaagagtacatgaaccgcaagatgtttgggcgggataggattatcaatgagcgccacctgtttcacggcaccagtcaagatgttgtcgacggaatttgtaagcataactttgacccccgcgtctgtggaaagcacgcaaccatgtttggacaaggttcttacttcgctaaaaaagcctcctacagtcacaacttttcaaaaaaatcaagcaagggcgtgcactttatgttcctggctaaggtgctgacagggcgatacacaatgggcagtcacggcatgagacgccctcccccagtgaaccccggatctgttacgtcagacctctacgacagctgtgtagataattttttcgaaccccagatctttgtgatttttaatgacgaccaatcttacccctattttgtcattcagtacgaagaggtatccaacaccgtgtcaatttag

SEQ ID NO: 208203 - DNA, 1974 bp, Artificial Sequence
  Description of Artificial Sequence: Synthetic coding sequence
atggagatggagaccaccgagcccgagcccgactgcgtggtgcagcctccgagccctcctgacgacttttcgtgtcaaatgcggttgtctgagaagattactcccctgaaaacctgctttaagaagaaggatcagaagaggctgggaaccgggactctgaggtccttgagaccaatcctgaatacactgttagagagtggttccctggatggcgtgttcaggagtcggaatcaaagcacagacgaaaactctttgcacgaacccatgatgaaaaaggctatggagatcaacagttcctgtccccccgctgagaataatatgtccgtgttgatacccgacaggaccaatgtgggcgaccagatccctgaggctcatccttctaccgaagctccagagcgggttgtacctatccaggaccactccttcccttccgagacactatccgggacagtggccgacagtaccccagcacacttccagactgacctgctccacccagtttctagcgatgtgcccaccagtcccgattgcttggataaagtgatcgactacgtgcccggtatcttccaggagaacagcttcacgatccagtatatcctagatacatcggataagctcagtacggaactcttccaggataagtccgaagaagccagcctggatttggtgtttgagctcgtgaatcagttgcaatatcacacacaccaagagaacggcatcgaaatttgcatggacttcctgcagggaacttgtatctacgggagagattgcctgaagcatcacaccgtcctgccgtatcactggcaaattaagcggaccactacccagaaatggcagagcgtctttaacgacagtcaggaacatctcgagcgcttttattgcaatcccgagaacgacagaatgcgaatgaagtacggtggacaggagttctgggctgacttgaatgctatgaacgtgtacgaaacaaccgagtttgatcagctgcgacgcctcagtacacccccttctagcaatgtgaactccatctaccatacggtctggaagtttttctgcagagaccacttcggctggagggagtaccctgagtcagtgatacggctgatagaagaggccaattctcgggggctgaaagaggtgcggtttatgatgtggaataatcattacatcctgcacaattccttcttccgtagggaaatcaaaaggcggcccctcttccgttcctgttttattctgttgccttacctccagaccctgggcggggtgcccacccaggcccctcctccactggaagccacgtcgtcctcccaaatcatttgccctgacggggtgacaagcgccaacttttatccagaaacctgggtatatatgcatcccagccaggattttatccaggtgccggtatccgctgaagacaaatcctaccgcatcatctataatctgtttcacaagaccgtgcccgaatttaaataccgaatcttgcaaattctgcgggtgcaaaatcaattcctctgggagaaatataagcgcaagaaggagtacatgaaccgaaagatgttcggccgcgatcgcatcatcaacgagaggcaccttttccacggtacgtctcaggacgtggtggacgggatttgtaaacacaacttcgacccccgggtgtgcggtaaacatgccacgatgtttgggcaaggctcttatttcgcgaagaaagcctcctactctcataactttagtaagaagtcatcaaagggggttcattttatgtttctggctaaggttttaaccgggcgctacactatgggcagtcacggaatgcgacgcccaccacctgttaaccctgggagtgttacgtctgatctctacgactcctgtgtggataatttcttcgagcctcagattttcgtgatttttaacgatgaccagtcatatccttacttcgtcatccaatacgaggaggtgagcaacacagtgtctatatag

SEQ ID NO: 208204 - DNA, 1521 bp, Artificial Sequence
  Description of Artificial Sequence: Synthetic coding sequence
atggagatggagaccaccgagcccgagcccgactgcgtggtgcagcccccaagccctcctgacgacttctcctgtcagatgagacttagcgagaagattaccccgttgaaaacatgttttaagaaaaaggatcaaaaaagactagggaccggaactctgaggagtctgaggcccattctgaataccctgctggaaagtggatccctggatggggtgttccgatcaagaaatcagagcactgatgagaacagccttcacgagccaatgatgaaaaaggccatggagatcaatagcagctgtcctccagccgagaacaacatgagtgttctcattcccgaccggactaacgtgggcgaccaaatccccgaggctcatcccagcactgaagccccagagcgcgtggtgcctatccaagaccactcattccccagcgagaccctgtcaggtaccgtcgcagactcaaccccagcccacttccagaccgatctactgcacccggtaagctcagatgtcccgaccagccctgactgtcttgacaaagtgattgactacgtcccaggcatctttcaggagaactcattcacgattcaatacatactggacaccagcgataagctttccaccgaattgttccaggataaatctgaggaagcgagcttggatctggtgttcgaactggtcaaccagctgcagtatcacacacatcaggagaatgggattgaaatctgcatggacttcctccagggaacctgcatatacggccgggattgtcttaagcaccacacagtgctgccttatcattggcagataaagcggactacaactcagaagtggcagagtgtcttcaatgatagccaggagcacctggagcgcttttactgcaatcccgagaacgataggatgagaatgaagtacggcggacaggaattttgggcagacctaaatgccatgaatgtctacgagaccactgagtttgaccaattacggcgtctgtcaacgccgccatcttctaatgtgaattcaatataccacaccgtctggaagttcttctgccgtgaccactttggctggcgcgaataccctgaaagcgtgattcgcctgattgaagaggcaaattctcgcggactgaaagaagttcgctttatgatgtggaataaccattacatcctgcataattcgttctttcggcgggagattaaacgtcgcccgcttttccgctcgtgtttcattctgttgccctacctacagaccctgggcggggttcccacccaggctcctccgcctctggaagccactagctcaagtcagattatctgtcccgacggggtcacatccgccaacttttatcccgaaacatgggtgtatatgcacccctcccaagacttcatacaggttcccgtaagtgcggaggacaaatcatacagaattatatacaatcttttccataaaactgttcccgaattcaaatatcgtatcttgcagatcctgcgggtgcagaaccagtttctgtgggagaaatag

SEQ ID NO: 208205 - DNA, 1965 bp, Artificial Sequence
  Description of Artificial Sequence: Synthetic coding sequence
atggagatggagaccaccgagcccgagcccgactgcgtggtgcagccgccatccccccctgacgatttctcctgccagatgagactgtcagagaagatcacccctctgaagacatgcttcaagaaaaaggatcagaagcgtttgggtaccggcactctgcgcagcctcaggcccatcctgaacacgctcttggagtccggctccctggacggggtgttccgatctagaaatcaatcaaccgatgagaactccctgcacgagcctatgatgaagaaggcaatggaaataaatagtagctgtcccccagcagagaataacatgtctgtgttaattcctgatcgtaccaacgtaggcgaccagattcccgaggcccacccttctactgaggctcccgagagagtcgtacccatccaagaccatagctttcctagcgaaactctgagcggcaccgtggcagattcaaccccagctcatttccaaaccgacctcctccaccctgttagttccgatgtccccacgtctcctgactgtttggacaaagtgatcgattatgtgcctggcatcttccaggagaattcattcacgatccagtatatcctagacacttcggataaactgagcactgaactctttcaggataagtccgaggaggccagtctggacctggtcttcgagctggtgaatcagctacaatatcatacccaccaagaaaacgggattgaaatttgcatggacttcctccagggcacatgcatttacggccgagactgcctcaagcaccataccgtgctgccttaccattggcagatcaagcgcaccacaacacaaaagtggcaatccgtcttcaacgatagtcaggaacacctggagcgcttttattgtaaccctgaaaatgacagaatgcggatgaagtacgggggacaggaattctgggcagatttgaacgccatgaacgtatacgagaccacagagttcgaccagctgaggcggttaagcactccacctagttctaacgtaaactcaatatatcacacagtctggaaatttttctgccgagaccactttggctggagagaatatcctgaatcagtgattcggctaattgaagaagccaatagtagaggcctgaaggaggttaggtttatgatgtggaataatcattacattttacataatagcttcttcaggcgggagattaaacgccgccccctgttccggtcctgcttcattttgctcccatatctccagacattagggggagtcccaacccaggctcctcctccgctagaagcaacatccagctcacagattatttgcccagatggtgtcacatcagcaaacttctatcctgagacttgggtatatatgcacccttcacaggatttcatccaggttcctgttagcgcggaagataagtcgtaccgcataatttataatctgttccacaagaccgtgccagaatttaagtacaggatactgcaaatcctgagggtgcagaaccagttcctttgggaaaaatacaaaagaaaaaaggaatacatgaataggaagatgttcggacgcgatcgcatcatcaacgagagacatttatttcacggaacctctcaggatgtggtggatgggatatgtaaacacaactttgacccccgagtgtgtggcaagcacgcaaccatgttcggccagggcagttatttcgccaaaaaagcttcatactcacataacttcagcaaaaagagcagtaagggggtgcatttcatgttcctggctaaggtgctgaccggccgctacactatggggtcccatggaatgcggcgccccccaccagtcaaccctgggagcgtaacaagcgatttgtacgactcttgtgtcgataacttctttgagcctcaaatctttgttatctttaatgacgaccagtcatacccatactttgttattcagtacgaggaggtatcaaatacttag

SEQ ID NO: 208206 - DNA, 1974 bp, Artificial Sequence
  Description of Artificial Sequence: Synthetic coding sequence
atggagatggagaccaccgagcccgagcccgactgcgtggtgcagcctccttcacctcccgatgacttctcctgtcagatgcgcctctccgagaaaatcaccccacttaagacctgtttcaagaagaaagaccagaaacgattaggaacagggacgttacgcagccttcgcccgatactcaacactctgctggagtcaggctcgctggatggagtgtttcgatccagaaatcaatccactgacgaaaacagccttcacgaaccaatgatgaagaaagccatggagataaactccagttgcccccccgcagagaataatatgagtgttctcatcccagacagaacaaatgttggcgaccaaatcccagaagcccacccgagtacggaggctcctgagcgagtagtaccaattcaggaccactcgtttccttctgaaacactgtctggcaccgtggcagatagcacccccgcacatttccagaccgatctactgcaccctgtctcgagtgatgtgcccacttctccggactgcctcgacaaggtgatagattacgttcctggtattttccaggagaactccttcactatccaatacattttggacacttctgacaagctctctacagagttgttccaggacaaatcagaagaggctagtttggacctcgtgtttgaactcgtgaatcagctccaataccatactcatcaggagaatgggatagaaatctgtatggactttctgcaggggacatgtatttacgggagagactgcctcaagcatcacaccgtgcttccataccattggcaaatcaagcgaacgactacgcagaagtggcagagtgtgttcaatgacagccaggagcatctcgaacgtttctattgcaatccagaaaacgatcggatgaggatgaagtacggcggacaggagttctgggccgatcttaatgccatgaatgtctacgagacgaccgaattcgaccagctgaggcgcctgtccactcctccctcttccaatgtgaacagtatctatcatactgtttggaagttcttctgtagagaccattttgggtggagggagtaccctgaaagcgttattagacttattgaagaagcaaactctcgcggtctgaaagaagtgcgcttcatgatgtggaataaccactatatactgcataactccttttttcggcgagagatcaaaagaaggccactctttcgtagctgtttcatcctcctgccatacctccaaactttaggcggcgtgccgactcaggcacctccacctctggaggccacaagcagcagccagatcatttgtcctgatggcgtgacaagcgcaaacttctatccagagacctgggtgtatatgcacccctcgcaggatttcattcaagtgcccgtttctgctgaggataagtcgtacagaatcatctacaatctgttccataaaactgtcccagaatttaagtatcgcatcctccaaatcttaagggttcaaaaccagtttctttgggagaaatacaaacgaaagaaggaatatatgaatcgaaaaatgtttggcagggacaggatcataaacgagcggcatctctttcacggtacatcccaggatgtagttgatgggatatgcaagcacaacttcgacccacgcgtttgcggcaagcatgcaaccatgtttggccaggggtcttacttcgcgaagaaggcgtcatactcccacaactttagcaagaaaagctcgaagggcgtacactttatgttcttggcgaaagtattaacagggaggtatacaatgggctctcacggcatgcgaaggccaccacccgtcaacccagggtctgtaactagtgacttgtacgattcatgcgttgataacttcttcgagccccagattttcgtgatttttaatgacgatcagagttacccatacttcgttatccagtacgaggaagtatcaaacacggttagcatttag

SEQ ID NO: 208207 - DNA, 1974 bp, Artificial Sequence
  Description of Artificial Sequence: Synthetic coding sequence
atggagatggagaccaccgagcccgagcccgactgcgtggtgcagcccccatctccaccagatgatttcagttgtcagatgaggctttctgagaagataacgccgctgaagacctgcttcaaaaagaaggaccagaaaagattgggcaccggcactcttagatccctgaggccgatactgaacactttgctggaatccggaagcctggacggcgtgtttagatccagaaaccaatctactgatgagaattccctgcatgaaccaatgatgaagaaggccatggaaattaattcgtcatgtcctccggctgaaaacaacatgtctgtcttgataccggatcggacaaacgttggagaccagatcccggaggcccacccctccactgaggcgcctgagcgtgttgtgcccatccaggatcattctttccctagcgagacactttctggcaccgtggcggacagcacaccagcgcacttccagaccgacctactgcaccctgtttcgtccgacgtgccgacaagccctgactgtcttgacaaggtaattgattacgtgcctgggatctttcaagagaacagcttcacaattcaatacatcttggatactagcgacaaactatctactgagctctttcaggataagtcagaggaggcctcactggatctggtttttgagttggtgaaccagctgcagtaccatacccatcaagagaatgggatcgaaatctgtatggacttcctgcagggaacatgcatctacggcagggactgcctgaaacaccatacagtgctgccataccactggcaaataaagcgaaccacgacacagaagtggcaaagtgtattcaacgactcacaggagcacctggaaagattctattgtaatcctgagaatgatcgcatgcggatgaaatacggcgggcaggagttctgggctgacctgaatgcaatgaacgtgtatgaaacaaccgagtttgaccagctcagacgactctctacacccccttcttctaacgtgaattctatctaccataccgtttggaagtttttttgcagggaccacttcggctggcgtgaatatccggagagcgtgattaggctcattgaggaggccaacagccgagggctgaaagaggtgagattcatgatgtggaacaaccactacatactgcacaacagcttctttagacgcgagatcaagaggcggcctctgttccgctcctgtttcatcctgctaccgtacttacagaccttggggggagtgcccactcaagcacccccccctcttgaagctacatcttctagtcagatcatttgccccgatggagttacaagcgccaacttttacccagagacctgggtctacatgcatccctcacaggacttcatccaagttccagtgtccgcggaagacaagtcttaccgaataatctacaacctctttcataaaaccgtgccggaatttaagtatagaattttgcagatattgcgtgtgcagaaccagttcctctgggagaaatataaaaggaagaaagagtacatgaaccgcaagatgttcgggcgcgataggattatcaacgagagacatctgtttcacggcacctcacaggacgtcgtagatggtatttgcaaacacaacttcgatccccgggtgtgcgggaaacacgcaactatgttcggccagggaagctactttgccaagaaggcgtcatacagtcataacttttcgaagaaaagctctaagggcgtgcacttcatgtttctcgcaaaggtgttgaccggcagatacacgatgggcagtcatggaatgaggaggccccctccggtgaaccccggttccgtaacctccgatttatatgacagttgtgtggataacttttttgaaccacagatctttgtgatcttcaacgatgaccagtcctacccatacttcgtgattcagtacgaggaggtatcaaacactgtttctatctag

SEQ ID NO: 208208 - DNA, 1662 bp, Artificial Sequence
  Description of Artificial Sequence: Synthetic coding sequence
atgggcgccctggagatgcaggacgaggaggaccggatcgaggccctcaaacaggttgctgacaagcttcctagacctaatctattgctgctgaagcaccttgtgtacgtcctgcacctcatttcaaagaacagcgaagtcaatcgcatggactcatctaatctggcaatctgtattggtcctaacatgctgacactggaaaacgaccagagcttgtcatttgaggcacagaaggatctgaataacaaggtgaaaaccctagtggagttcctgatcgacaattgctttgaaatctttggtgagaatatcccggtacatagctctatcacctctgatgactccctcgagcataccgatagcagcgacgtgagcactctgcagaatgatagcgcttatgacagcaacgaccccgacgtagagagtaatagttctagtggcatctcttcaccctccagacaaccccaggtgcccatggccacagctgccggccttgattcagctggaccccaggatgccagagaagtgtctcccgaacctatagtttctacggtggcccggttgaaatcctccctggcgcaacccgatcggcggtattcagaaccaagcatgccttccagtcaggaatgcctggagtccagagtgaccaaccagactctcactaagtctgaaggcgactttccagtgccccgggtcgggtctcgactggagtccgaagaggccgaagatcccttccctgaggaggtatttccagccgtgcagggtaagacaaaacgacctgtggacctgaagattaagaatctggcccccgggtcggtgttgcccagggcactggttttaaaagcattcagtagttccagccttgacgccagttctgattcttcccccgtcgcctccccctcctccccaaagaggaactttttttcccggcatcagagctttacaacgaaaaccgagaaggggaaacctagcagggagattaagaagcactcgatgtcctttacctttgcgccccataaaaaggtcctgaccaaaaacttgtccgcagggagcggcaaatctcaggactttactcgggatcatgtgcccaggggcgtgcggaaggagtctcagttggcaggtagaattgtccaggagaatgggtgtgaaacccataaccagaccgccagggggttctgcctgcgcccacatgcactcagcgtagatgatgtttttcagggcgcggactgggagcgccccggatcccctccttcttacgaggaggccatgcagggcccagctgctaggctagtggcgtcagagagccagaccgtcgggtccatgactgtgggcagcatgcgggctcgcatgctcgaggcacattgtcttctgccacctctgccaccggctcaccacgtcgaagattcccgccataggggtagcaaagagccactgccggggcacggactcagcccgctgcccgaacgctggaagcaatcgaggaccgtgcatgccagcggggactctctcggccacgtgtccgggccagggcgtcccgaattgctaccattgaggactgttagcgagtccgtccagagaaataaacgagactgcctggttcggcgatgttcccagcccgtgtttgaggccgaccagttccaatatgctaaagagtcctacatctag

SEQ ID NO: 208209 - DNA, 801 bp, Artificial Sequence
  Description of Artificial Sequence: Synthetic coding sequence
atgaagctgcggagcagccacaacgccagcaagaccctgaacgccaacaatatggaaacactgatcgaatgccagtctgagggagatatcaaggagcatcccctcttagctagttgtgagtccgaggattcaatttgtcagttgattgaagtgaaaaagcgcaagaaagttctttcctggccattcctcatgcgtaggctgagtccagcctcagatttcagcggcgcactcgaaacagacttaaaggcttcactctttgatcagcctttgtctattatctgtggcgattccgatacgctccctaggccaatacaggacattcttacaatcctctgcctcaaggggccttccactgagggtattttcagaagggccgccaacgagaaagcccgaaaagagctcaaggaagaactgaacagcggggacgccgtcgacctggaacgcctgccagtccacctcctggcggtggtgtttaaggacttcctgaggagcatcccccgcaagctgctgagttccgacctgtttgaagaatggatgggcgcgctggaaatgcaggacgaggaagatcgtatagaggctttaaaacaggtagccgacaagcttccgcgccctaatctgttgctactgaaacaccttgtttatgtcctacatctgattagcaaaaacagcgaagtgaacaggatggattcttccaatttagctatctgcatcggccccaacatgctgacattggaaaatgaccagtctctgagttttgaagcacagaaagaccttaacaacaaagtgtgctctgcctattag

SEQ ID NO: 208210 - DNA, 2196 bp, Artificial Sequence
  Description of Artificial Sequence: Synthetic coding sequence
atgaagctgcggagcagccacaacgccagcaagaccctgaacgccaataacatggaaacactgatcgagtgccagtccgaaggcgacattaaagagcatcctctgctcgcttcttgtgagtcggaagacagcatatgccagctgatcgaggtcaagaagcggaaaaaagtgctatcctggcctttccttatgcgaagactgtcccctgcaagcgattttagtggcgccctcgaaacagacctcaaggctagcctgtttgatcaaccgctgagcataatatgcggggattcagacacactgcccaggcctattcaggatattctgactatcttgtgcctgaagggcccatccactgaggggattttccgccgcgctgccaatgaaaaggccagaaaggaactcaaagaggagttaaatagtggtgatgctgtggacctggagaggctgcccgtgcacctcctggccgtcgtctttaaagatttcctgcggagtatccccaggaaactgctatctagtgatctgtttgaagagtggatgggagctttggagatgcaggatgaagaagaccgcatagaagccctgaagcaggtcgccgacaagctgccgcgccccaatctcttacttctgaagcaccttgtttacgtgctgcatctgatcagcaagaactccgaggttaatcgaatggactcaagtaacttggctatatgtataggtcccaatatgcttaccctcgagaatgaccagagcttaagcttcgaggcccagaaggatctgaacaataaagttaagactctggttgaatttctgatcgataactgcttcgagatcttcggcgagaacatacccgttcatagctctattacaagcgatgactcccttgaacacaccgattccagcgacgtttccactttgcagaacgattccgcgtatgatagcaacgatcctgacgtggaaagtaattctagttcgggcatcagtagcccttcgaggcaaccacaggtgccgatggccaccgctgccggactggattctgccggaccacaagatgcacgggaggtgtcacccgagccaattgtcagtactgttgctcgcctgaaatcttccttggctcaaccagaccggcggtacagtgagccatccatgccgagttcccaggagtgtctggaatcaagagtgaccaaccaaaccctgactaaatctgagggggattttcctgtaccgagggtgggatcgagactggaaagtgaggaagccgaagacccatttccagaagaagtgtttcccgcagtccaaggtaagaccaaacggcctgtggaccttaagattaaaaatctagctcctgggtctgtgttgcctcgtgcccttgtgcttaaggctttcagcagtagctcactggatgctagctcagacagctctcccgtggcttctccctcaagtcccaagcgcaacttcttctctcggcaccagtcctttacgacaaaaacagagaaggggaagcctagtagggagatcaaaaagcattccatgagctttaccttcgccccccacaagaaggtgctcaccaagaacctctccgccggatcaggaaagtcccaggattttacacgagaccatgtgccacgcggagtgcgcaaagagtcacagctggcgggaaggattgtgcaggagaacggctgcgaaacccacaaccagacagccagaggcttttgcctccggccccatgccctgtcagtggatgacgtgttccaaggtgccgattgggagagacccggctcaccgccttcttatgaggaggccatgcagggtcccgcagcacgtctggtggcaagcgagtcccaaacagtcgggtcaatgaccgtaggctccatgagggccaggatgcttgaggcacactgcctgctgccaccacttcctcctgcacatcatgtggaagactcgcgccacagggggtctaaggaacctcttcctggacacggtctgtctccacttcccgaaagatggaagcagagcaggaccgtgcacgctagtggcgactccttaggccacgtgagtgggccggggcgtcctgagttactgcctctgcggacagtgtcagagagcgtacagaggaacaaacgggactgcctagttagacgctgcagccagcctgttttcgaggccgaccagtttcagtatgccaaggaatcctatatctag

SEQ ID NO: 208211 - DNA, 828 bp, Artificial Sequence
  Description of Artificial Sequence: Synthetic coding sequence
atggccaccgccgccggcctggacagcgccggcccccaggacgcccgggaagtttctcccgagcctattgtgagcacagtggccagattgaaaagctccctggcccagccagataggaggtatagtgagcctagtatgccttcctctcaggagtgcctagagtcccgagttaccaatcaaacattaacaaagtcagaaggagactttcccgtccccagagtgggttctcggctagagagcgaggaagccgaagacccattccccgaggaagtttttcccgctgtacagggcaaaacgaagcgacctgtcgatctgaagatcaaaaatctggcgcccggtagtgtactgcctagagcactggtcctgaaagcttttagctcgtcgtccttggatgcctcatccgactcatcacccgtggcctcacccagtagcccaaaaagaaacttcttcagcagacatcaatccttcactaccaaaaccgagaaggggaagcccagcagagagatcaagaagcactccatgtcctttacattcgccccccacaagaaggtgctcacaaaaaacctctctgctgggtcaggcaagtcccaagacttcacacgggaccatgtgccacgaggggtgcgaaaggaaagtcagctggctggtaggattgtgcaggagaatggttgcgaaacacacaatcagaccgctcggggtttttgtcttcgacctcatgcactgagtgtggatgatgtcttccaaggggccgactgggagaggccggggtcccccccctcttatgaggaggccatgcaggggccagccgctagaccttggggggcttag

SEQ ID NO: 208212 - DNA, 327 bp, Artificial Sequence
  Description of Artificial Sequence: Synthetic coding sequence
atgacccggaagatcttcaccaacacccgggagcggtggcggcagcaaaacgtgaactccgcctttgcgaaactgcgtaagctcatccctacccacccaccagacaaaaagttaagcaagaacgagactctaaggcttgctatgcgctatatcaattttctcgtaaaagttctgggcgagcagtctctgcagcagacaggcgttgccgcacagggcaatattcttggactgtttccccagggccctcatcttcctggtctcgaggatagaaccctgctggagaactaccaagtgccgagtccaggcccctcccatcacattccatag

SEQ ID NO: 208213 - DNA, 780 bp, Artificial Sequence
  Description of Artificial Sequence: Synthetic coding sequence
atggccagcccccagggcggccagatcgccatcgccatgcggctgaggaaccagcttcagtcagtttataagatggatcccctgcggaatgaagaggaggtgcgtgtgaaaattaaggatctgaacgagcacatcgtctgctgcctctgcgccggctactttgtggacgccacgacgatcactgagtgtctgcacactttttgcaagtcatgcatcgtgaagtatctgcagaccagcaagtattgccctatgtgcaatataaagatccatgaaacgcagccactgctgaatttaaaactcgaccgagtaatgcaggatattgtgtacaaactcgtacccggcctgcaggacagcgaagagaaaaggatccgggagttttaccaaagccgaggcctggatagagttacgcagcctacaggggaggaaccagccttatccaatcttggcctccctttcagtagttttgaccattctaaggcacactactatcgctacgacgaacagctgaatctgtgcctggaaagactgagctctggtaaggataagaataagagcgtgctccagaataaatatgtgagatgctcggtacgggccgaggtgcgtcacctgaggagggttctctgtcataggctaatgctaaatcctcagcacgtgcaactcctcttcgacaacgaggtcttgccggaccacatgaccatgaagcagatttggctatccaggtggtttgggaaacccagcccactgctgctgcaatactccgtgaaagagaaacggcggtag

SEQ ID NO: 208214 - DNA, 876 bp, Artificial Sequence
  Description of Artificial Sequence: Synthetic coding sequence
atggaggcccccgccagcgcccagaccccccacccccacgagcccatatcgtttggaatcgatcagattctgaactcacctgaccaggatagcgcccctgccccccgtgggccagacggcgcctcctaccttgggggacccccagggggtcggcccggggccacctacccctcacttcccgcaagtttcgccggattaggagcaccattcgaggacgcaggcagctacagcgtcaatctgagcctcgctccagctggcgtgatccgggtgccagcacatcgcccactgcccggcgccgtcccgcccccgttaccctcagctttgcctgccatgccaagcgtgccgaccgtgagttcattggggggactcaactttccttggatggaatcctctcgacgtttcgtgaaggacagattcaccgctgccgcagcgctgacaccttttactgtgacccggcggatcggtcacccctaccaaaatagaaccccccccaagcggaaaaagcctagaaccagcttttcccgggtgcagatctgcgagctggagaaacgcttccatcggcagaagtacctggcctcagccgaacgtgccgccctggctaagagcctcaagatgacggacgctcaggtcaaaacttggttccagaacaggcgaacaaagtggcgtagacaaaccgctgaggaaagagaagccgaacggcagcaggctagccgcctcatgttacagttgcagcatgacgctttccagaaaagtctgaatgactcaatacagccggaccccctttgtttgcacaactcttccttgttcgcattgcagaacttgcaaccatgggaagaggactcctccaaggtgccagcggtgacaagcttggtgtag

SEQ ID NO: 208215 - DNA, 312 bp, Artificial Sequence
  Description of Artificial Sequence: Synthetic coding sequence
atggccgagagctggagcggccaggccctgcaggccctgcccgccaccgtgctgggcgccctgggcagcgaatttctgagagagtgggaagcccaggatatgagagtgacactgttcaagctcctgttgctgtggttagtgctctccctgctgggtatccagttggcttggggcttttacggtaataccgttacaggactgtatcatcgcccaggattgggcggacagaacggctctaccccagacggatccacccacttcccaagttgggaaatggccgccaatgagcctctaaagactcaccgcgagtag

SEQ ID NO: 208216 - DNA, 387 bp, Artificial Sequence
  Description of Artificial Sequence: Synthetic coding sequence
atggccagcgaggccagcgtgcggctgggcgtgccccccggccggctgtggattcaacggcccggcatttacgaggatgaagaaggacgcacgtgggtaaccgtggttgtaagatttaacccttcacgacgggaatgggcacgagcctctcagggaagccgatatgagccgagcattacagtgcacttatggcagatggctgtgcacacccgggaactattgtcatccggacagatgcccttctcacagctgccagcagtctggcagctgtacccgggcaggaagtaccgggctgcggattcttcattctgggaaatcgctgaccatggccaaattgacagcatggagcagctggttctgacgtatcagcctgaacgtaaagattag

SEQ ID NO: 208217 - DNA, 387 bp, Artificial Sequence
  Description of Artificial Sequence: Synthetic coding sequence
atggccagcgaggccagcgtgcggctgggcgtgccccccggccggctgtggattcagaggcccgggatatacgaggacgaagaaggaaggacttgggtgacagtcgtggtgcggttcaaccccagtcgtcgagagtgggccagagcttcccaggggagtcgatacgagcctagcattaccgtgcacttatggcagatggcggtgcacacacgggaattactgtccagtggtcaaatgcctttcagccagctgcccgctgtgtggcaactctacccgggaaggaagtatagggccgccgattcatcattttgggaaatcgccgaccacgggcagatcgattccatggaacagctggtgttgacgtaccaacctgaaagaaaagactag

SEQ ID NO: 208218 - DNA, 4776 bp, Artificial Sequence
  Description of Artificial Sequence: Synthetic coding sequence
atgggcaacgccgagagccagcacgtggagcacgagttctacggcgagaagcatgcttcgctgggcagaaaacacacatcccgatctctgcgtttgtcgcacaagaccaggcggactagacatgcatcctctggaaaggtcatacacagaaatagtgaagtcagtacccgctcaagcagcacacccagcatcccccagagtctggcagagaatgggctcgagcctttctcacaggatggcacgctggaagactttggatcccctatctgggtagacagagtggatatggggctccgtccggtgagttacaccgactcttctgtgacaccttccgtagatagttcaatcgtgctcaccgcagcgagtgtccagtccatgcctgacactgaggagtctagattatacggcgatgatgctacctacctggccgaaggcggccgcagacagcactcttacacctctaacgggcctacctttatggaaaccgcatccttcaaaaagaaaagaagtaagtcggcggacatctggcgggaagattctctggaattctccttaagcgacctgtctcaggagcacctaacaagcaatgaagagattttgggttccgctgaagaaaaagattgtgaggaggcccgtggcatggaaacaagagccagccccagacagctgtccacttgtcaaagagctaatagtctaggcgacttatacgcccagaagaactctggtgtcaccgccaacggcgggccagggtccaaatttgcagggtactgccgaaaccttgtgtccgatattccgaacctggctaatcacaagatgccccctgcagccgcagaggaaacgcctccttatagcaactataataccctgccctgtcgcaaaagccattgcctctcagaaggagccaccaacccccagatttctcactcaaactcgatgcaaggccgacgcgcaaaaactacccaggatgtgaatgctggcgagggtagtgaattcgccgacagtggcatagagggagcaaccacagacaccgacctgctcagtcggcgaagcaacgcaaccaatagctcctactcaccaactactggaagggcgtttgtgggatctgatagtggttctagttctaccggcgacgctgcgagacaaggagtgtatgaaaacttccgccgggagctggaaatgtccaccactaactccgaatcactcgaagaggctgggagcgcacactccgatgaacaatcatccggtacgctgtcatccccaggccaatcagacatcctcctgaccgctgcacaggggaccgtgcgcaaggcgggggcgctggccgttaagaatttcctggtgcataagaaaaacaagaaagtcgaaagcgccaccagacgaaaatggaagcattattgggtaagcctcaagggatgtaccttattcttctacgagagtgacggaaggagtgggattgatcacaattccatcccgaagcatgccgtgtgggtcgagaactccatcgtccaggctgtgccagaacaccctaagaaggatttcgtgttttgtctgtcaaacagtcttggagatgcatttttgtttcaaaccacatcgcagaccgagttggaaaactggatcaccgccattcactccgcgtgcgccactgccgtcgcgcgtcatcaccacaaggaggacacgcttaggctgctgaaatcagagatcaagaaactcgagcaaaaaatcgatatggacgagaagatgaagaagatgggggagatgcagctttcgtccgtaaccgatagtaagaagaagaagacgattttagatcagatctttgtgtgggagcagaacctggagcagttccaaatggacctgtttcgcttcaggtgttatctagcctccctgcaaggcggcgagttgccgaaccctaagcgcctcttagcattcgcctctcgtccgaccaaggtggcgatgggcagactcggcatcttttctgtttctagctttcacgctctggtggcagcacgcaccggcgagaccggggtacggagacgaacccaggccatgagtagatccgcatctaagagacgtagcaggttctcatcactctggggccttgataccacatcgaagaaaaaacaggggaggccgagtattaaccaagtattcggggaaggaactgaggccgttaagaagtccttggagggcatctttgatgatatcgttcccgatggcaaaagagaaaaagaggtggtgttgccaaatgtgcaccaacacaatccagactgcgatatctgggtgcatgagtattttacacccagttggttctgtttgccaaacaaccaacccgctttgaccgtagtgcggcccggcgacaccgctcgcgatacactcgaactgatatgcaaaacccaccagttggaccactccgcacattatttgcgtctgaagttcttaatcgaaaacaagatgcagctgtatgtgcctcagccagaggaagatatttacgaactattgtataaagagatcgagatttgcccaaaagtgactcagtcaattcacatagagaaatctgacaccgcggctgatacctacggcttttcgctcagtagcgtggaggaagatggcatcagacgtctctacgtaaactccgttaaggagacaggattagccagcaaaaagggtctgaaggcgggggacgaaatcctggagatcaataaccgggccgcggatgctctgaactcttccatgctgaaggactttttatcgcagcccagtctaggactgctggtcaggacttaccctgaactagaggagggagttgagctgctcgagtcacctccgcatcgcgtggatggtccagccgacctcggagaatctcccctggcatttctgacaagtaatccaggccatagtctatgctcagagcaaggatctagcgcagagacggctccggaggagactgaaggccccgacctggaaagctcagatgaaacagatcacagctctaaatcaactgagcaggtggccgcgttctgccgatcattacatgaaatgaatcccagtgaccagagtccgtcgccccaggatagcaccggcccccagttggccacaatgaggcagctgtccgacgctgacaaactaaggaaagtcatctgcgagctactggaaacggagagaacatacgtgaaagatttgaactgtctgatggaacgctacctgaagccgcttcagaaagaaacatttctcacacaggatgagctagatgtgctcttcggcaatctaactgagatggtggaatttcaggttgagttcttaaagacactggaggacggagtgcggctagtgccagatcttgagaaattggagaaggtggaccaatttaagaaagtactgttctcactcgggggaagcttcctctactatgcagatagattcaagttgtatagtgctttttgcgcctctcatacgaaggtgcccaaggtactggtgaaggctaagaccgataccgcttttaaagcctttctcgacgcccagaaccccaaacagcagcatagttctaccctcgagagttacttaattaagcccatccagcggatcctgaaatatccccttctgctgcgagagctgtttgccctgacggacgctgaatccgaggagcattaccatttggatgtggccattaaaaccatgaataaggtcgcctcacacattaacgaaatgcagaagatccacgaggagtttggcgccgttttcgaccaactgatcgcagagcagactggagaaaaaaaggaggttgccgatctctctatgggcgacctcctcttgcacaccaccgtaatttggctcaacccgcccgcatccctaggaaagtggaagaaagaacctgagctggcagcgttcgtgttcaaaacagcagttgtgttggtctataaagatggttccaagcagaagaaaaaattggtgggatcccatcgtctgtccatctacgaggactgggatccatttcggtttagacatatgatacctacagaagccttacaggtacgggctctcgctagcgccgatgccgaagctaatgctgtctgcgaaatcgtgcatgtgaaatccgaatctgaggggcgccctgaacgggtatttcacttatgttgttcatcacccgaaagtcgcaaagactttcttaaggctgtacattctatcctgagggataagcacaggagacagctgttgaagaccgagtcattacccagctctcagcaatatgtcccgtttgggggtaagcgactgtgtgctctcaagggggcccggccagccatgagcagagccgtgtcagctccaagtaaatccctgggcaggaggcgacgtagactggcacggaaccgcttcacgattgattccgatgcggtcagcgcctctagccctgaaaaggagtctcagcaaccgcccggtgggggagatacagaccgctgggtcgaggagcagttcgacctggcccagtacgaggaacaggacgatattaaggagaccgatatcctctcagacgacgacgaattttgtgaatcagtcaaaggtgcctcggttgaccgggatttgcaggagcgcctgcaggcaactagtatctcccagagagagcgcgggcgcaagacactcgacagccacgcttctaggatggctcaacttaagaaacaggctgctctgtctggaatcaacgggggcttggaaagtgcttcagaagaggtgatttgggtgcggcgagaagatttcgcccccagtaggaaactgaacacggaaatttag

SEQ ID NO: 208219 - DNA, 3216 bp, Artificial Sequence
  Description of Artificial Sequence: Synthetic coding sequence
atggagaccgccagcttcaagaagaagcggagcaagagcgccgacatttggcgtgaagactccctcgagttctcactgtcagatctgagccaggagcatcttacgtcaaatgaagagattttgggtagtgctgaagaaaaagactgcgaggaagcaagagggatggagacacgtgcatcaccgagacagctgtcgacttgtcagcgcgctaacagcctgggagatctgtacgctcaaaaaaattccggagtaactgctaacggaggcccaggaagtaagtttgccggttactgcaggaacttggtaagcgacatccctaatctggctaaccacaagatgcctcccgccgcagctgaggagacacccccatactctaactataataccctcccgtgtagaaagagtcactgtctgagcgagggggctacaaacccccagattagccactccaactcgatgcaaggacggcgggccaagacgacacaggacgtcaacgctggggaaggtagtgagttcgccgattccggcattgaaggcgctaccacagacacagatctgctctcacgaagatctaacgccaccaattcttcctatagtcctaccacaggccgcgccttcgtggggtccgatagcggcagcagctcgaccggcgacgcagcccgccagggtgtctatgagaactttcggcgggagctcgagatgtcaaccacaaattctgagagtcttgaagaagccggctctgcgcacagcgacgagcagagctctggcactctttccagccctggacagagcgatattcttttgacggcagcccaaggcacggttagaaaagctggagcgctggcggtgaagaattttttagtgcataagaaaaataagaaggtggagtctgccaccagaaggaagtggaagcactattgggtgagtcttaagggctgtacactcttcttttatgagtccgacggacggagtggaatagaccataacagtattcccaagcatgcagtgtgggtggagaacagtatcgtacaggccgtaccagagcatcccaagaaggacttcgtattttgcctgtcaaattcactgggagacgcatttctgttccaaaccacttcacaaaccgagctggagaattggatcacggccattcactccgcatgtgctacagcagtcgcccgacatcaccataaagaggacacgttgagactgctgaagagtgaaataaaaaagctagagcagaaaattgacatggacgaaaaaatgaagaaaatgggagaaatgcagttatcctctgtcactgactcaaaaaagaagaagacaatactggaccagatctttgtatgggagcagaatctggaacaattccagatggacctgttccgttttaggtgctacctggcgagtctgcagggcggagagctgcccaatcctaaacggttactggccttcgcctcccggcctacaaaagtggctatggggcggttaggaattttctctgtgtctagctttcacgccctagtggccgctcgcactggggagactggggtgagaaggaggacgcaagccatgagtcgctcagctagcaagcgtcggagtagatttagcagtctgtggggccttgacacaacaagcaagaagaagcaaggacggccttcaattaatcaggtgtttggcgaggggacagaggctgtgaagaagtccctcgagggaatcttcgacgacattgtgcccgacggcaaacgagagaaggaagtcgtgctgcctaatgtacaccagcacaaccccgactgcgatatctgggtccatgagtacttcacgccttcctggttttgtctgccaaataaccagcctgcactgacagtggtgcgtcctggagatacggcgagggatacactggaactgatttgtaaaactcatcagctggatcatagcgctcactatctgcgcctgaaattcttgattgagaacaagatgcaactgtatgtgccacagcccgaagaggacatatacgaactgctctacaaggaaattgagatatgccctaaggtgacccagtctatccatatcgaaaaaagcgacacagctgccgatacatatggcttttccctctccagtgtggaggaagatgggataaggagattatatgtgaacagcgtgaaggaaacgggtctggctagcaagaaaggtctgaaagctggagatgagatcctcgagattaacaaccgggctgctgacgctttaaacagctccatgctcaaagacttcctttctcaacctagtctcggcctgctcgttcgaacttatccagaactggaggaaggtgtggagctgttggaatcccccccccatagggtcgacggacctgctgatctgggagagagcccgcttgccttcttaacatcaaatcccggccactccctctgctccgagcagggctccagcgctgagacagccccagaagagactgagggccctgatctggagtctagcgacgaaaccgatcatagcagcaagtctaccgagcaggtagctgcgttttgtaggagcctccatgaaatgaatccatcggaccagtcaccgtctccccaagattctaccggcccacagttggccaccatgcggcagctttctgatgctgacaagttgagaaaagtgatctgcgagttactagagaccgagcgtacttatgtgaaagatctcaactgtctcatggagcggtacctaaagcctctccagaaggaaacctttctgacacaggatgagctcgacgtcctgttcggaaatctaactgaaatggtggaattccaggtggaatttctcaagactcttgaggatggtgtccgactggtacctgatctcgaaaagctggagaaggtggatcagttcaaaaaggtcctttttagtctgggtggctcattcctgtactacgccgatcgattcaaactatatagcgctttctgtgcgcataaaagctctcagggtccaggtgagtcccaggaccggcatggctttcagggtatacttggctgtcctgagcccgaggccgctgccttgatccatgcaggcgtagtgcctcatcaggctcacccagaggatccacaagtgccaacatccgcacagggagcagtgcgccctgataggtgcggtgagcgtggtgcattaccccccggacgaggtcaccaagaccacgaacagggatgccagtcgcaccagtag

SEQ ID NO: 208220 - DNA, 678 bp, Artificial Sequence
  Description of Artificial Sequence: Synthetic coding sequence
atgggcaacgccgagagccagcacgtggagcacgagttctacggcgagaaacacgccagcctggggagaaagcatacctcgcgatccttgcgtcttagtcacaagacaaggagaacacggcatgcgtcctctggcaaggttattcatagaaattccgaggtcagcactaggtctagttccacacccagcatcccacagtcgttggccgagaatgggctcgaacctttcagccaggatggtaccctggaagactttggcagcccaatctgggtggacagggtggacatgggactcaggcccgtgagttacacagactccagtgtgaccccttcagtggatagctctatcgtgcttacagctgctagtgtgcagtccatgcccgacaccgaggagtcgcgtctttacggtgatgatgcaacctacctggctgaaggcgggcgcagacaacacagctacacatctaatggccccactttcatggagacagcttcttttaaaaagaaaaggagcaagagcgccgatatttggcgggaagattcactcgagttctccctgagcgatctgtcacaggagcacctgaccagtaatgaagaaatcctcggctctgcggaggaaaaggactgcgaggaagcccgcggcatggagactcgtgcctccccacggcaactctctacttag

SEQ ID NO: 208221 - DNA, 4596 bp, Artificial Sequence
  Description of Artificial Sequence: Synthetic coding sequence
atgggcaacgccgagagccagcacgtggagcacgagttctacggcgaaaagcacgcctcactggggaggaagcacacttctaggagtttgagattgagccataaaaccaggaggacacgacatgcctcctcaggcaaagtcattcacaggaattctgaagtgagcacccgcagtagttcaaccccatccattccacaatcacttgcggagaatgggcttgaaccattttcccaagatggcaccctggaggacttcgggtcacctatttgggtggatagggtggatatgggactacgccccgtgtcttataccgattcttccgtcacccccagcgttgactcatcaattgtcctgacggcagcctctgtccagagcatgccagatacagaggagtcccgcctgtacggagatgacgccacttacctggccgaagggggaaggaggcaacactcttacacgtcaaatggaccaacctttatggaaaccgcgagtttcaaaaaaaagagaagcaagagtgcagacatctggagggaggactctctcgaattctcactttcagatctctcacaagaacacctgactagcaatgaagagatcctgggaagcgccgaggaaaaggactgcgaggaggcgagaggaatggagactcgggcctcgcctagacagctctccacgtgtcagcgggctaatagcttaggcgatctgtatgcacaaaagaactccggagttactgccaacggtggccccggcagtaagtttgctgggtactgtcgtaatcttgtgtcagacatcccaaacctggccaaccacaaaatgccacccgctgccgccgaggagacacccccttacagcaactacaatacactgccctgtcgcaagtcccattgcttgagcgaaggtgccacgaacccccagataagccacagcaactctatgcaggggaggcgcgccaaaacaacacaggatgttaacgccggcgaaggctctgaatttgcagattccgggattgagggcgcaactacggacacagatctcctgtctcggcggtcaaacgctactaacagttcctacagtcccacaacaggcagagcatttgtaggctcagactctgggtctagctccaccggtgatgctgcaagacagggtgtgtacgagaacttccggcgagaactagagatgtcaactactaactcggagagcctggaggaagccgggagcgctcacagtgacgaacagagttcgggtaccttgtctagtcccggacagtctgacatccttctgaccgcagcccagggaacagtgcgtaaggccggagctctggccgtgaaaaacttcctagtccacaagaaaaacaaaaaggtcgagtctgccaccaggaggaagtggaaacactattgggtttctctcaagggttgcactctattcttctatgagtccgacggtagatccggtattgatcacaacagtatccctaagcatgccgtgtgggtagagaattccatcgtgcaagccgtgcctgagcaccctaaaaaagatttcgtcttttgcctctccaacagcctgggcgatgctttcttatttcagactacttcccagacggagctggaaaattggattaccgcgatccacagcgcatgcgctacagctgtcgcacgccaccaccacaaggaggacactctgcggttgctgaagtcagagatcaaaaagttggaacagaagatagacatggacgaaaaaatgaagaaaatgggagaaatgcaactctccagcgtgaccgactcaaaaaaaaaaaagacgatactcgatcaaatattcgtttgggaacaaaatctggaacagtttcaaatggacctgtttcgattccgttgctatctagccagtctgcagggcggagagttgcccaaccccaaacggctcctagcatttgcatcccgcccaaccaaggtggccatgggacggctgggcatattttccgtgtcctcatttcacgcgctcgttgcagcgcgtacaggagagaccggcgtaagacgcagaactcaggcaatgagtcgttccgctagcaaacggcggagccgcttttcatccctgtggggcctagatacaacttccaagaaaaagcagggccgtcccagtattaaccaacgtgagaaagaggttgttctgcctaacgtacatcaacacaatccagactgcgacatttgggtgcacgagtactttaccccgagctggttttgtctccccaataatcagcctgcactcactgtggttagacctggcgatacagccagggacacactggagcttatatgcaagctgtataaggagattgaaatttgccctaaggttacccaatccatccacattgaaaaaagtgatactgctgccgatacttacgggtttagtctgagcagtgtggaagaagatggcatacgacgcctgtatgtcaattcagttaaggaaaccggtctggcctccaagaaaggcctaaaggctggcgacgaaattctggagataaataatcgcgccgccgacgccctaaattcctccatgttgaaagacttcctgagccagcctagcctggggctgctcgtcaggacctatcccgagcttgaggaaggagtggaactgcttgaatctcccccgcatagagtggacggcccagccgacctgggcgaatccccactggcttttcttacctctaaccctggccatagtctgtgttccgagcaaggcagctcagccgagactgcgcctgaagagaccgagggcccggatttggagtcaagcgacgagactgatcacagttcaaagtctactgagcaggtagccgccttttgtagaagcctccacgagatgaacccctccgaccagtcaccttccccacaggacagcaccgggcctcagctggctaccatgagacagcttagcgatgcagataaactgcgcaaggtgatttgtgaacttcttgaaacagaaagaacctacgttaaggacctcaactgcctcatggagcgctatctgaaacccctgcagaaagaaactttcttgacacaagacgagctggacgtcctgttcggtaacttgacagagatggtcgaatttcaagttgagtttctgaaaaccctagaggatggcgtgcggctcgtcccagatctggagaagttggagaaagtggaccagttcaagaaggtgctcttcagcctaggaggatcctttctgtactacgctgacagattcaagttatatagcgccttctgtgctagtcacactaaggtgccaaaggttctcgtcaaggctaagactgatactgcgttcaaggcatttctcgatgcacaaaaccccaaacagcagcacagtagtactctcgagtcttacctcatcaagccaattcagcggattttaaaatatcccttgctgctgcgggaactttttgcgctgaccgacgctgagtctgaggaacactatcatcttgacgtggcaattaaaaccatgaacaaggtcgccagtcatatcaacgagatgcagaagatccacgaggaattcggagctgtgttcgatcagctgatcgccgagcaaactggggagaaaaaagaagtggcagacctaagtatgggcgacctactcctccacaccacggtcatctggctgaacccacccgcgtcactgggaaaatggaaaaaggagcctgaactcgctgccttcgttttcaaaactgcagtggtgttggtctataaggacggaagcaaacaaaaaaagaagttggtggggtcccacagactgagcatctacgaggattgggatccttttcggttcagacacatgatccccacggaggctctgcaggtgagagccctggctagcgcagacgctgaggccaatgcagtctgtgagattgtgcacgtgaaaagtgagtctgagggtcgccccgagcgtgtgtttcatctgtgttgttcaagccctgagtcccgaaaagactttctcaaagccgtgcatagtattctgcgggacaagcacaggagacagcttttaaagacagagtcccttccctctagccagcaatacgtcccattcggcggcaagaggctatgtgcgctaaagggagctcggcccgctatgtcacgtgccgtaagcgctccctcgaaaagtctaggcaggagacgcagacgactggctcgaaacagattcaccattgactccgatgcggtatcagccagttctcctgaaaaggaaagccagcagccgcctggcgggggcgacactgatcggtgggtagaagagcagttcgatctggctcagtacgaggagcaggatgatatcaaggaaacagatattctgtccgacgacgacgaattctgcgagagcgtgaagggcgcttctgtggaccgggatcttcaggaacgcttgcaggcaactagcatctctcagcgggaaagaggcaggaaaaccctggatagtcacgcctcacggatggcgcagctgaagaagcaggccgccctgtcgggcataaatggaggtctcgagtccgcctcggaagaggtgatctgggtgagacgcgaggatttcgctccatcccggaagctgaatactgagatatag

SEQ ID NO: 208222 - DNA, 2493 bp, Artificial Sequence
  Description of Artificial Sequence: Synthetic coding sequence
atgggcagcatgttccggagcgaggaggtggccctggtgcagctgtttcttcccacagcggctgcttatacctgtgtcagccggctgggggagctcggacttgtcgagtttcgcgatctaaatgcgtctgtctccgctttccaaagaaggtttgtggtcgacgtgagacgctgcgaggagttggaaaaaacgttcaccttcctgcaagaagaagtgcggcgtgccgggctggttctgcctcctcctaagggcagattgccagctccacctccaagggacttgctgcggatacaggaagaaacagagcggctggcccaagaactgcgcgacgttagagggaaccagcaagccctgagagctcagctgcatcagctacagcttcatgccgcggtgctgcgccagggccatgagccccagctggccgcggcacacactgacggcgcgtctgagcgaacacccctactgcaggcccccggagggccacatcaggacctcagagttaatttcgtggcaggggctgttgagcctcacaaagctccagcgctggaaaggctcctctggagggcctgtagaggattcctgatcgccagctttcgtgaattggaacagccgctggagcacccggtcactggagaacctgcaacctggatgactttcctaatctcgtattggggtgagcaaattggccagaagatccggaaaataacagattgttttcactgtcacgtcttcccgttccttcaacaggaagaagcgcgcctgggtgctctacagcaactgcaacagcagagccaggaactgcaggaggtgctaggcgaaactgagagatttctgtcccaggtgcttggacgcgtgttacagctgctgcctcccggccaggtccaagtgcataaaatgaaggctgtgtacctggcactgaaccagtgctctgtgtcgactactcacaagtgcctgattgccgaagcttggtgctcagtaagagacctgcccgctcttcaagaggctctccgggactcctcaatggaggagggagtgagcgctgtggcccatcggataccctgtcgcgacatgcctccaacgttaatcagaactaaccgctttaccgcctcctttcaggggatagttgacgcttatggagttggcaggtatcaggaggttaatccagcaccatatactatcatcactttccctttcctgtttgccgttatgttcggcgatgtgggacacggattactgatgtttttattcgctctggccatggtgctggccgaaaatcggcctgcagtgaaggctgcacagaatgaaatttggcaaaccttcttcagggggcgctatctgctgcttctgatgggactgttttctatatacacagggtttatctataacgagtgtttcagtcgagctacaagcatttttccttctggatggtctgtggcggccatggcaaatcagtctggatggtctgatgcctttctggcccagcacaccatgcttaccctcgatcctaatgtaacgggagtttttctggggccttaccccttcggcattgatcccatttggtccctggcggcgaaccacctctcattcctgaattcattcaaaatgaaaatgtcggtgattctgggggtggtgcatatggcttttggggtggtgttgggagtatttaaccacgtccactttgggcagaggcatcgactgcttctggaaactctccccgagttgaccttccttctggggctgttcgggtacttagtgttcctcgtaatttacaaatggctgtgcgtctgggccgcccgtgcagcttccgccccatctattttaatccactttatcaacatgtttcttttctctcattcaccgagcaacagactactctaccccagacaagaagtcgtccaggccacactggtggttctggctcttgcaatggtccccattctcctgcttggtactcccctgcatcttctgcacagacacaggcggcggttaagacgtcgaccagcagataggcaggaggagaataaggcaggactcctggacttgccagatgccagtgtgaatggatggagctcggacgaggagaaggctggcggccttgacgacgaggaggaggcggagctcgtgccgagcgaggtcctgatgcaccaggccatccacaccattgaattttgtttagggtgcgtcagtaataccgctagttacctacggctgtgggcgctgagtctggctcacgcccaattgtcagaagtgctgtgggcaatggtgatgcgcataggcctgggcctgggacgcgaagtcggagtggcagccgtggttctggtgccaatttttgccgcttttgccgttatgactgtggctattctcctagtcatggagggattgtcagcctttcttcacgcccttagattgcattgggtggagttccaaaacaagttttatagcggtacgggatacaagctgtctccctttacctttgcggcaacagacgactag

SEQ ID NO: 208223 - DNA, 657 bp, Artificial Sequence
  Description of Artificial Sequence: Synthetic coding sequence
atgggcagcatgttccggagcgaggaggtggccctggtgcagctgttcctgccgacagcagctgcctacacttgcgtgtcccgccttggcgaactcggcctggtggagttccgggacctcaacgctagtgtgtcagcttttcagcgtcgcttcgtagtagacgtgagaagatgcgaggaactagagaaaacctttaccttcctgcaggaggaagtgcggagagccgggctggtgttaccgcctcccaaaggaagactgccggcacccccccctcgtgacctcctccggatccaggaggagacagaaaggctcgcccaggagctcagggatgttcgggggaaccagcaggccttaagagcgcagctgcatcaactacaactgcatgcagccgtccttagacaggggcacgagcctcaactggctgcggcccatactgacggcgcatcagagagaactcctctcttgcaggcacccggcggacctcatcaggatcttagggtgaattttgtagcgggggctgtggaaccccacaaagcccccgcactagaaaggctgctgtggagagcctgcagaggcttcctcatagcttcctttagagagctagagcaaccgctcgagcatccagttaccggcgagcctgccacctggatgacctag

SEQ ID NO: 208224 - DNA, 186 bp, Artificial Sequence
  Description of Artificial Sequence: Synthetic coding sequence
gacgacgaggaggaggccgagctggtgcccagcgaggtgctgatgcatcaagcaattcatactattgaattttgcctgggatgtgtgtccaacaccgcttcgtatcttcgcctctgggcgctgtctctcgctcatgccaggtggaattccaggaccagttctactcaggccagggccacctcttag

SEQ ID NO: 208225 - DNA, 1845 bp, Artificial Sequence
  Description of Artificial Sequence: Synthetic coding sequence
atgaccttcctgatcagctactggggcgagcagatcggccagaagattcgcaagatcacagactgcttccactgtcacgtcttccccttcctccagcaggaggaggccagacttggagccctgcagcaacttcagcagcagtcacaggaactccaggaagttctgggagagactgaacggtttctctcccaggtattaggccgcgttctgcagctgctcccacccggtcaggtgcaggttcataaaatgaaagcagtgtacctagcactgaaccagtgcagcgttagcacgacccataagtgtcttattgccgaggcatggtgctctgtgcgggacttacccgccctccaggaagctcttcgtgatagcagtatggaagaaggggtatctgcagttgcccaccggattccgtgcagggatatgcccccaacactgatccgaacaaatagatttaccgccagtttccaaggcatcgtggacgcatacggcgtagggagataccaggaggtcaatccagctccgtacacgatcatcaccttccctttcttgtttgcagtcatgttcggagatgtgggacacggcctgctgatgtttctattcgccttagccatggtgcttgcggaaaatcgaccggcagtgaaggccgcgcaaaacgagatttggcagacctttttcaggggcaggtatctacttctgctgatgggacttttcagtatttataccggtttcatctataatgagtgttttagtcgggctacaagcatcttcccctccgggtggtctgttgccgccatggccaaccagagtggatggagcgacgcatttctggctcagcataccatgctgactttagaccccaatgtaaccggcgtgttcttaggcccatatccgttcggaatagatcctatctggagtctcgcggcaaatcatctttcttttctcaattcctttaagatgaaaatgagtgtgattcttggggtggtgcacatggccttcggcgttgtccttggtgttttcaaccatgtccacttcggccagagacacagactgctccttgagacacttcccgagctaaccttcctccttggactgttcggttacttagtgtttttggttatatataagtggctttgcgtgtgggcagccagagccgcctctgcccctagcatcctgatccattttattaatatgtttctgttctctcattcacctagtaatagactgttatatcctcggcaagaggtggtgcaagccacactcgtagtgcttgctctggctatggtgcctatattgctactcggcacacctctgcacctgcttcacagacatcgcaggagattgcgaagacggcctgcagataggcaggaggaaaacaaggccggattgctcgacttgcctgatgcaagcgtgaacggttggagctcagacgaagagaaggctggcggtcttgacgatgaggaggaagctgagctggtgccctctgaagttctgatgcaccaggccatacacaccatcgagttctgccttgggtgcgttagtaataccgccagctatctgagactgtgggcgctttctttggcccacgcccagctttccgaagtgctgtgggccatggtgatgcggataggccttgggctgggcagggaggtgggcgtagccgccgtggtgttagtacctattttcgccgcctttgccgtcatgactgttgccatcctcttggtgatggagggcctgagcgctttcctgcatgccttgcgcctgcactgggtggagtttcaaaacaaattttacagtggaacaggctataaactgtccccgttcaccttcgccgcgacggacgattag

SEQ ID NO: 208226 - DNA, 357 bp, Artificial Sequence
  Description of Artificial Sequence: Synthetic coding sequence
atggtgcccatcctgctgctgggcacccccctgcacctgctgcaccgccacagacgcaggctccggcgacggcccgcagaccgtcaggaggaaaataaagcgggactgttggacctgcctgacgcgtctgtaaatgggtggtcatccgacgaggagaaggcggggggcctggatgacgaggaggaggctgagctggtaccaagtgaggtactcatgcaccaggccattcacacaattgagttttgtctgggatgtgtgagtaatacagcatcttatctgcgcctgtgggctctctctctcgcacatgcccgatggaactctcgcacctcctccactcaagcccgcgctacgagctag

SEQ ID NO: 208227 - DNA, 1671 bp, Artificial Sequence
  Description of Artificial Sequence: Synthetic coding sequence
atggagggccccctgagcgtgttcggcgaccggagcaccggcgagaccatccggtcccagaacgtgatggcagcggcatcaattgccaacatcgtcaagtcctctctgggacccgtgggcttggataaaatgctggtggatgatattggagacgtcacaattacgaatgacggagccacaattctgaagctgctggaagtcgaacaccccgccgcaaaagtgctatgcgaactggctgacctgcaagataaagaagtcggggacggtacaacaagcgtggtgatcatcgcagcagagctactgaagaacgctgacgaacttgttaagcagaagatccatcctacctcagtgatttccggctacagactggcttgtaaggaagccgttcgctatataaacgagaaccttatagtgaatacggacgagctcggcagagattgcctcattaacgcagccaagacgagtatgagctcaaaaataatcgggattaacggcgactttttcgctaacatggtagtggacgctgtgctggctattaagtataccgatattcgcggccagcccaggtacccagttaattctgtaaacatactaaaagcccacggtcgctcccagatggaatctatgctgatcagtggctacgcattgaattgtgttgtgggatcacagggcatgccaaaacgaatcgtgaatgccaagattgcttgcctcgactttagcctgcaaaaaacaaagatgaagttaggtgtgcaggtagtaatcacagaccctgaaaaactcgatcagataagacagagagagtccgatattaccaaagaaagaattcagaagattctggccactggggcaaacgtcatcctgacaacaggcgggatcgacgatatgtgcctgaagtactttgtggaagcaggtgctatggctgttaggagagtgctgaaacgtgacctgaagcgcatcgcaaaggcatccggagcaacaattctgagcacattggccaatctggaaggcgaggagacatttgaggctgctatgctgggacaggctgaggaagtggtgcaggagcggatttgtgacgacgagttaatcctgatcaaaaatacaaaggcccggacatcagcctccattattttgaggggggccaatgatttcatgtgtgacgagatggagcgatcgctccacgatgcactgtgtgtcgtcaagagagtgctggaaagcaagagcgtggttccaggcggcggggcagtcgaagctgctttgtcgatttacctagaaaactacgcgacttccatgggatcgcgtgagcagctggcaatcgcggaattcgcccgttccttactcgtgatccctaacaccttagccgtgaacgccgcccaggacagtacggacctggtcgctaagctaagagccttccacaacgaggcccaggttaatcctgagcgcaagaatctcaagtggatcgggctggatctcagtaatgggaagcctcgcgacaataaacaggcgggtgtgttcgaacccactattgtcaaggtgaaatctttgaaattcgccaccgaagccgccatcactattctaaggattgacgacttgatcaagctccacccagagtccaaagatgataagcacgggagctatgaagacgctgtgcattcaggagccctgaatgactag

SEQ ID NO: 208228 - DNA, 1206 bp, Artificial Sequence
  Description of Artificial Sequence: Synthetic coding sequence
atgagcagcaagatcatcggcatcaacggcgacttcttcgccaacatggtcgttgatgcagtgctcgcaattaagtatactgacattagagggcaaccccgctatccggtaaacagtgttaatattctcaaggcacacggaaggagccagatggagtctatgctcatctccgggtatgcgctgaattgcgtggtcggctcacaggggatgcccaagcgaatcgttaacgctaagattgcctgcttggatttctctctacagaagaccaaaatgaagctcggcgtgcaggtggtaatcacagaccccgagaagctcgaccagatacgacagcgcgaatctgacattaccaaggagcggatacaaaaaatcctcgccaccggagccaacgtcattttgacaacagggggaatcgacgacatgtgcttgaaatattttgtggaggcaggggccatggccgtgcggagggtgctcaagcgggatcttaaacggattgccaaagccagcggtgccacaatccttagtacactcgccaatctcgagggagaggaaacgttcgaggctgcaatgcttggccaggcggaggaggtcgtgcaggaaagaatctgtgatgatgaactgatactgatcaaaaacactaaggccagaaccagcgccagcatcattttgaggggcgccaatgacttcatgtgtgacgaaatggaaagatcacttcacgatgctttgtgtgtggttaagcgggtcctcgagtccaaatctgtggtgccagggggcggagccgtggaggcagcacttagtatttacctggaaaactacgctacttcgatggggtcaagagaacagctggccatcgcagaatttgctcgatcccttctcgtcatccccaataccctcgcagtgaacgctgcacaggactccaccgatctggtggcaaagttgcgagcctttcacaacgaagcccaggttaatcctgagcgtaagaatctgaaatggatcggacttgacctttcaaacggcaaacccagggataataaacaggcaggtgtatttgagccaactattgtgaaagttaagagcctgaaatttgccacagaagccgcgataacgatcctgaggatcgatgacttaattaaattacaccccgagtcaaaagatgacaaacacgggtcctacgaagacgctgtgcacagtggggctctgaacgattag

SEQ ID NO: 208229 - DNA, 1302 bp, Artificial Sequence
  Description of Artificial Sequence: Synthetic coding sequence
atggagggccccctgagcgtgttcggcgaccggagcaccggcgagacgattaggtcccaaaatgtcatggctgctgccagtattgccaatattgtcaaatcctctctgggccccgtaggcttagacaagatgctggtagacgacattggcgacgtgacaataacgaatgacggggccactattttaaagttactcgaagtcgaacacccagctgccaaggtactttgtgaactagcggacctgcaagataaggaagtcggtgatggcaccacttctgtggtgataatcgccgctgagttactgaaaaacgcagacgaattggtaaagcaaaagattcacccaacgtctgttatcagtggctacaggctggcatgcaaagaggccgtccggtacatcaatgagaatctaatagtgaacactgatgaactgggccgggactgccttattaacgccgccaaaacatctatgagcagcaaaattatcggcatcaatggggatttttttgcgaatatggtagttgatgctgttcttgccattaagtatactgacattcgcggacagcctcgttacccggtgaacagtgtgaacatcctcaaagcccacggccgctctcagatggagagtatgcttataagcggctacgccttgaattgtgtagtgggttctcagggaatgcctaaaagaatagttaacgcaaagatagcttgtctggacttctccctccagaagacgaaaatgaagctcggggtacaggttgtaatcacagaccccgaaaagcttgaccaaataagacagcgtgagtccgacattaccaaagaaagaatacagaagatcttagccacaggcgccaatgtgatactgaccaccgggggcatcgatgatatgtgccttaagtatttcgtcgaagctggagccatggccgtgagacgggtgctgaagagggacttgaaacggatagccaaagctagcggcgcgacgatcctgtccaccttggctaatctcgagggggaagagactttcgaagccgcaatgctcggtcaggctgaagaggtcgtgcaagagagaatctgcgacgatgagttgatactgatcaaaaatacaaaagctcggacatcagcgagcatcattctgcggggagcaaacgatttcatgtgcgacgagatggagcgctctcttcacgacgctctctgcgtggtgaagcgcgtgcttgagtctaagagcgtggttccaggggggggagcagtggaagctgctctcagcatctacctcgaaaattatgccacatcgatggactggagttag

SEQ ID NO: 208230 - DNA, 648 bp, Artificial Sequence
  Description of Artificial Sequence: Synthetic coding sequence
atgctggccggccagctggaggcccgggaccccaaggagggcacccacccagaagatccttgccccggagcaggagcagtcatggagaagactgcagtagcggcggaagttttaacagaggattgtaacactggtgaaatgcctccattgcaacagcagatcattcggttgcaccaggagttgggcaggcagaaatccctgtgggctgacgtgcatggaaaactcagaagccatatcgacgctctgagagagcagaatatggagctacgcgaaaaactcagggctctgcagctgcagcgatggaaagcgcgtaaaaagagcgctgccagccctcacgccggccaagaaagccataccctggcccttgagcctgctttcggtaagatctcgccactcagcgccgatgaggaaacaattcccaaatacgccggtcacaagaaccagtctgcgaccttgcttggacagcgtagctcatccaataacagtgccccaccaaaaccaatgtcattgaagatagagagaatttcaagctggaaaacgcctccccaggagaatcgagataagaacctgtcaaggaggcgccaggatcgccgtgccacgcctactgggagacccacaccttgcgctgagcgtcgtgggggggtgtag

SEQ ID NO: 208231 - DNA, 981 bp, Artificial Sequence
  Description of Artificial Sequence: Synthetic coding sequence
atggagaagacccccgccgccgccgaggtgccccgggaggacagcaatgctggcgagatgccaagtctgcaacaacagattaccagtctccaccaggagttgggtcgccaacagtccctttgggccgacattcaccggaaactgcagtcacatatggatgcactgagaaaacaaaaccgcgaacttcgagaagagctccgagggctgcaacggcagcaatgggaggccggcaagaagcctgccgcaagtccccacgcaggtcgagagagccacactctcgctctagaaccggcctttggaaagatttctcatctgtctgccgatgaagacactacacccaagtacgccggacgaaaatctcaatccgccacactactcggccagagatggtcctccaaccatcttgctcctccaaagccgatgtccctgaaaaccgaacgcatcaacagtggaaaaacccccccccaggaggaccgcgagaagtcgccgcctgggaggagacaggatcgcagccctgcaccaacgggtaggcctaccccgggggcagagaggaggggcgtttccgaggacggaaagattatgcacccgtcctcccgcagcccccagaactccggagggaggaagtcgcccgtgcaagctagccaagctacaacattgcaggaacagacggcagcagcccgaggcgccgaccggtcatcatctgttctcggttcctcggagggcggcttcctctcccgagtccaagcggatgagttcgcgtccagcgcacctgactccgctgagcggcagaatctgccagttaacccaccatcctctctggagattgcacaggctatggatacaaagatgaaaaaagaagaggtgcaggaggagaaacgccatcctaaggggaaggccgacgactgtcgccggagtggtttcccatcagaattccccggagctctacatgctgctccttcaaggcaggacatgggtccttag

SEQ ID NO: 208232 - DNA, 1326 bp, Artificial Sequence
  Description of Artificial Sequence: Synthetic coding sequence
atggcccccaagggcatcctgggcagcttccccaccgccatgaacttgtccctcgaaggaaaagtgaaagaaacagtgcataacgccttttgggatcatctcaaagaacagctgtccgccacacctccggatttcagctgcgctctagagttgctgaaggaaatcaaggagatcctcttgagcctgctgctgcctcgccaaaaccgcctaagaattgagatcgaagaagccctcgatatggacctgctgaagcaggaagccgagcatggggcactgaaggtcctgtatctctcaaaatatgtgctgaatatgatggcactgctctgcgccccagtgcgggacgaagcagtgcagaaattagagaacataactgatccggtctggctgctgcgcgggatattccaagtcctgggccgaatgaaaatggatatggttaactataccattcagtccctgcagccacatttgcaggaacacagtatacagtatgagcgcgccaagtttcaagagctcctgaacaagcaacctagcctgcttaaccataccacgaagtggcttacccaagctgccggcgacttaacaatgtctcctcccacctgtcccgacacatccgactcatcatccgtggcaggccctagcccaaatgaagccgccaataaccccgagcctttgagccctacaatggtcctatgccaagggttcttaaacctgttgctgtgggacctggaaaacgaggaatttcccgaaaccctgctgatggaccgtacccgactgcaggaacttaagagtcaattgcaccagttgacagtcatggcctctgtgctgctggtggccagttccttttctggatctgtattgtttgggagtccccagtttgtcgataaactgaaaaggattaccaaatctctgttagaagacttccatagccggcctgaggaggcgatactgaccgtgagtgagcaggtgagccaggagatacaccagtctctgaaaaatatgggcctcgtggccctgtcctctgacaacacagcttcactaatggggcagctgcagaacattgcaaagaaagaaaattgtgtttgcagcgtgattgaccagaggattcatctgtttctgaagtgctgcctggtgctgggcgtgcagcgcagcctccttgatctgcccggaggtctcactttgatcgaagccgagctcgctgagcttggccagaaatttgtcaatttaacacatcacaaccagcaagtgtttggaccctattatacagaaatcctcaaaacactgatctcccctgctcaagcccttgaaacaaaagtagaaagcgtgtag

SEQ ID NO: 208233 - DNA, 1551 bp, Artificial Sequence
  Description of Artificial Sequence: Synthetic coding sequence
atgacccggggcggcggcggcggcgacaccatcagcaagatgcccgatgtgaaagaaagcgtgccacccaagtacccaggtgatagcgagggtaggagctgcaaaccggaaacttcaggacccccacaggaagataagtcagggtccgaggacccacccccgttcctctctgtgactggtctgaccgaaaccgttaacgaagtgtctaagttgagtaacaagatcggtatgaactgtgattactacatggaggagaaagtcctgccacccagttcgctggagggtaaagtgaaggagacagttcacaacgccttctgggaccaccttaaggagcagctgtctgccaccccacctgatttttcttgcgccctggaactcctgaaagagattaaagagattttgctgtcacttttgctccctcggcagaatcgcttgcgcattgagattgaagaggctctcgacatggaccttcttaagcaggaggccgagcacggtgccctcaaggtgctgtatctgtccaagtatgtgctcaacatgatggccctactctgtgcaccagtcagggacgaagccgtgcagaagctcgaaaatattacagacccagtgtggttgctccgcggaatcttccaagtactcggtcggatgaagatggacatggttaactataccatccaaagccttcagcctcacttgcaggagcatagtatccagtatgagagggccaaattccaagaactgctaaacaagcagccctctctcctgaatcataccaccaagtggctgacgcaagcagcaggcgatctgacaatgagcccacctacgtgtcctgacacctctgactcctctagtgtcgctggacccagcccaaacgaggcggccaataaccccgaacctctgagcccaacaatggtcctttgccaaggatttttaaatctactgctgtgggatctcgagaacgaggaattcccagagacattgcttatggaccggacacgcctccaggagcttaaatcccagctgcatcagctgacagttatggcaagtgtgcttctggtggcttctagcttttctggcagcgtgctgttcggatccccacagtttgtcgataaactcaagcggatcacgaagagtctcttagaggactttcactccaggccagaggaggccattctgacggtaagcgagcaggtgtctcaggagatccaccaatccttaaaaaatatggggctggttgccctctctagtgacaataccgcctcactaatggggcagctgcagaatatagccaagaaagaaaattgcgtgtgttccgtcatagatcaacgcatccacctgtttctgaagtgctgccttgtattgggtgtgcaacgatcactgctagatctaccaggcgggttaacactcatcgaggccgaacttgcagaactgggacagaagttcgtgaaccttacccaccataaccagcaagtgttcggaccttactatacagagatccttaaaacgctcatcagcccagcacaggctctcgagactaaagttgaatccgtttag

SEQ ID NO: 208234 - DNA, 822 bp, Artificial Sequence
  Description of Artificial Sequence: Synthetic coding sequence
ggcctgagccaccgggccaccccccagcccgccgcccccccccggtggtacgcccccggacgacaagccgcccgaccaaccgaaagaacccccgtggacgacccccgccggggcaggcgctctctggaaggcaaggtgaaagaaactgttcataatgctttttgggaccatctaaaagaacagctctcagcgaccccacctgactttagttgcgccctggagttgctgaaggaaatcaaagagattcttctgtcgttacttctgcccagacaaaatagactgcgcatcgagattgaagaggctcttgacatggacttgctgaagcaggaggctgaacacggcgctctgaaggtgctctatttgtctaagtatgtactgaacatgatggcacttttatgcgccccagtcagggacgaagcagttcagaagctcgagaacattactgatcccgtgtggcttctccggggaatctttcaggttctgggcagaatgaagatggacatggtgaactacacaatccagtctcttcagcctcacctgcaagagcattccatccagtacgagcgcgctaagttccaggagttacttaacaaacagccatctcttttgaatcacactacaaagtggttgacgcaggcggctggggacttaacaatgtccccccccacctgccctgacacatctgactcctcgtcagtggcgggccccagtccgaatgaggctgcaaataacccagagccgctctctcctactatggtactgtgtcagggttttctgaaccttctgctgtgggacctggagaacgaggaatttcccgagtag

SEQ ID NO: 208235 - DNA, 1326 bp, Artificial Sequence
  Description of Artificial Sequence: Synthetic coding sequence
atggcccccaagggcatcctgggcagcttccccaccgccatgaacttatccctggaaggcaaagtcaaggaaacggtgcacaacgccttctgggaccacttgaaggaacagctgtctgctacgccacctgacttctcttgtgcattagagcttctcaaggaaatcaaagaaattttattatcactgctgctacctcgacagaatcggctccgcatagaaattgaggaggccctcgacatggacttattgaagcaagaagctgagcacggcgccctgaaggtgctctacctctcaaagtatgtccttaacatgatggcattgctatgcgctcctgtaagggacgaggccgtgcaaaagttggagaacatcacagaccccgtgtggctgctgcgggggattttccaggtgctgggaaggatgaagatggacatggtgaactacaccatccagtcacttcaaccacacctgcaggagcactcgatacagtacgaacgcgccaaattccaggagctgcttaacaagcagccatctctcctaaatcacaccacaaagtggctgacacaggccgctggggatctgactatgagcccgcccacttgtcccgacactagtgatagttcttctgtggcgggcccttctccaaacgaggccgcaaacaatcctgagcctctatcgcctaccatggtgctttgtcaaggctttctaaacctgctgctctgggacctggagaacgaagagttccctgaaacccttctgatggaccgaaccaggctgcaggagctgaagtctcagctccaccagctaactgtgatggcttcagtgctgttagtcgcctcctcctttagcggctcagtcttgtttgggagcccccagttcgtggacaagctgaagcgaatcaccaagtctctgctcgaggatttccacagcaggcctgaggaagccatcttgaccgtgagcgaacaggtgagccaggagatccaccagagtctgaagaacatgggtctcgtcgccctcagttccgacaacacagcctcacttatgggacagctgcagaacatcgcaaagaaggagaactgcgtctgttccgttattgaccagcgcatccacttgttcctcaaatgctgcctggtcctgggcgttcaaaggtccctgctggacctaccaggggggcttaccctcattgaagccgaactcgccgagctaggccagaaatttgtgaacctcactcaccataaccaacaggtcttcggtccatactacacagagatccttaagaccctgatttcccctgcccaggcgcttgaaaccaaggttgaaagtgtgtag

SEQ ID NO: 208236 - DNA, 312 bp, Artificial Sequence
  Description of Artificial Sequence: Synthetic coding sequence
atggcccccaagggcatcctgggcagcttccccaccgccatgaacttatcgttagaggggaaagtaaaagaaaccgtccacaatgctttctgggaccacctcaaggaacagcttagcgcaacccctccggatttttcttgtgccctagagttattgaaagaaataaaggaaatcctgctctctctgctgctgcctcggcagaacaggctgcgaatcgagatcgaggaggcattggatatggaccttctgaagcaggaagcagagcatggggccctgaaggtcctgtacctctctaagtatgttctcaattag

SEQ ID NO: 208237 - DNA, 1512 bp, Artificial Sequence
  Description of Artificial Sequence: Synthetic coding sequence
atgcccgacgtgaaggagagcgtgccccccaagtaccccggcgactcagagggccggtcctgcaagccagagacaagtggcccaccccaagaagacaagtctggaagtgaggatccccctcctttcctgtcggtgaccggattgactgagacagtgaacgaagtgagcaaactctccaacaagattggaatgaactgtgactactatatggaggagaaggtactgcccccctcctcattggagggcaaggtgaaagaaacggtccacaatgccttttgggaccacttgaaggaacagctctccgccactccgccagacttctcctgcgcacttgaactgctaaaagaaatcaaagaaattctcctttccctgctgctcccaagacagaaccgactccgcattgaaattgaggaggccctggatatggacctgttgaaacaggaggcggaacatggcgccctgaaagtcttgtatttgagcaaatatgtcctaaacatgatggcacttttgtgcgcacctgtaagagatgaagcagtccaaaagctggaaaatatcactgacccggtgtggttactacggggaatctttcaggtgctaggcaggatgaagatggatatggtgaactacacgattcaaagcctgcaacctcatctgcaagagcactcgattcagtacgaaagagctaagttccaggaactcttaaataagcagcctagtcttttaaaccacacgacaaaatggctaacccaggccgctggggacctcacaatgtccccccctacatgcccagatacaagcgactcttctagtgttgctggaccgtctcccaacgaggccgctaataatccagaaccgctctcaccgaccatggtactctgccagggatttctaaacctgctcctgtgggatctggagaacgaagaattcccggaaaccttacttatggacaggaccaggttacaggaattgaagtcccagttacaccaattgactgtcatggcgtctgtgcttctagttgccagctcatttagtggctcggttctgttcgggtctcctcagtttgtggacaaactgaagagaatcaccaagtctctgctggaggacttccatagcaggcccgaggaggcaattctcactgtgtcagagcaggtctcacaggaaatccaccagtccttgaagaacatgggactggtagccctgagcagtgataacacagcatcactgatgggtcaacttcaaaacatagccaagaaggaaaattgcgtgtgtagtgtgatcgatcagcgaatacatctgtttttgaaatgctgtttggtactcggtgtgcaaaggtccctgctggatctgcccggaggactcactctcatcgaggccgaactcgcagaattggggcagaaattcgtgaacttaactcatcacaatcagcaggtgttcgggccttactataccgagatcctgaagaccctgatatctccagcacaggctctggagaccaaggtggaatcagtatag

SEQ ID NO: 208238 - DNA, 1413 bp, Artificial Sequence
  Description of Artificial Sequence: Synthetic coding sequence
atgacccggggcggcggcggcggcgtgctgagcgtgaccggcctgacagagaccgttaatgaggtctctaagctctccaacaagatcggaatgaactgcgactactacatggaagaaaaagtcctcccgccaagcagcctggaaggcaaggtgaaagaaacggtacacaacgctttttgggaccatctgaaggagcagttgtcagctacccccccagatttctcatgcgccctggaacttctgaaggaaattaaggaaatcctgctctcactcctgctgccacgacagaatagactgaggatagagattgaggaggctttggatatggacctgttgaaacaggaggctgaacacggtgccttaaaagtgctctacctgagtaaatacgtattgaatatgatggcactgctgtgtgcgcctgttcgcgacgaggccgttcagaagctcgaaaacatcacagaccccgtctggcttctacgagggatctttcaggtgctggggaggatgaagatggacatggtcaactatactatccagtccctccaaccccatctgcaagagcacagcatccagtacgaacgggccaaattccaggagctcctcaacaagcagcccagtctccttaatcacacaaccaaatggctgacacaggctgccggcgatcttaccatgagcccacccacttgcccggataccagcgactcctcctcagtggcaggaccatcacccaatgaagccgcaaataacccagagccactaagtcccaccatggttctgtgtcagggcttcctgaatctgctgctctgggaccttgagaacgaggagttccctgagacactactgatggacaggacccgattgcaagagttaaagagtcagcttcaccagctgaccgtgatggcgtccgttctgttggtcgcctcttctttttctgggagcgtgctgtttggatcaccacagttcgtcgacaagctcaagcgtatcactaagtcgttgcttgaagacttccactctcgtcccgaagaggcgattttaactgtgtctgagcaggtgagtcaggagattcaccaaagcctcaagaacatgggcttggttgcacttagctccgataacacagcttctctgatgggacagctccagaacatagctaagaaggaaaattgcgtgtgcagcgtcatcgaccagcgcatacacctattcttgaaatgctgtcttgtgttaggggtgcagcgttctctgctcgatctgccaggggggcttacactcatagaggcagaacttgctgaactgggtcagaagtttgtaaatctcacccaccataatcagcaggtatttggaccgtactataccgagatacttaagaccctcatatcgccagcacaggctctagagacaaaagtagaaagcgtgtag

SEQ ID NO: 208239 - DNA, 1398 bp, Artificial Sequence
  Description of Artificial Sequence: Synthetic coding sequence
atgacccggggcggcggcggcggcggcctgaccgagaccgtgaacgaggtgtcaaaactttccaataaaatcgggatgaactgcgattactacatggaggagaaggtgttaccaccctcgtctctcgagggaaaggtcaaggagacagtgcacaacgcgttctgggaccacttgaaagagcaactgtccgccacaccacctgattttagctgcgccctggagctgctaaaggaaataaaagagattcttctgtctctgctcttgccacgacagaacaggttaagaatagagatcgaggaagctctcgatatggatctattgaaacaggaggccgaacacggcgccctgaaggtgctgtatttgtccaagtatgtcctgaatatgatggcgttgctctgtgcacctgtcagagatgaagcagtccagaaactggagaacattaccgatcctgtctggctactaagagggattttccaggtgctcgggaggatgaagatggatatggtcaattatacaatccaatccctgcagccacacctccaggagcactcaatccagtatgagagggctaaattccaggaactactgaacaaacaaccatccttgctgaaccacacgactaaatggctaacacaggctgctggtgacctaactatgagtcctcctacatgccccgatacctcagatagctcatcagttgcggggccatccccaaacgaagcagcgaacaatcctgaacctctgtcaccaacaatggtcctgtgccagggtttcttgaacttgttgctttgggatctcgaaaacgaggagttccccgagaccctactcatggatcggacccgcctccaggagttgaaaagccagctacaccagttgacggtgatggcctctgtgttgctcgtggcgagtagcttctctggaagcgtattgtttggatccccacagttcgtcgataagttgaagcggatcacgaaaagcctcctggaggacttccactcgaggcctgaggaagcgatactgaccgtctcggagcaggtgtctcaagagatacaccagagtttgaagaatatgggcctggtcgctctgtctagtgacaataccgcgagcctcatggggcagctgcagaatattgccaagaaggagaattgtgtttgtagcgttattgatcagcggattcatctgttcctgaaatgctgtcttgtgcttggcgtgcaacgaagtctgctggatctgccggggggattgactcttatcgaggctgaactcgcggaacttggccagaagttcgtgaatctcacccaccacaatcagcaagtttttggcccatactacaccgagattctgaaaactctgatttcgccggcccaagccctggagactaaggtcgaatctgtatag

SEQ ID NO: 208240 - DNA, 165 bp, Artificial Sequence
  Description of Artificial Sequence: Synthetic coding sequence
atgacccggggcggcggcggcggcgacaccatcagcaagatgcccgacgtgaaggagtctgtgcccccaaagtacccaggagacagcgagggccggtcatgtaagccggagactagtgggcctccacaggaagacaaatccggtagcgaggaccccccaccatag

SEQ ID NO: 208241 - DNA, 165 bp, Artificial Sequence
  Description of Artificial Sequence: Synthetic coding sequence
atgacccggggcggcggcggcggcgacaccatcagcaagatgcccgatgtcaaagaatctgtgccaccaaaatatcctggggacagcgaaggtcggagctgtaagcctgaaacgtcaggccctcctcaggaagataagagtggtagcgaggatccccccccctag

SEQ ID NO: 208242 - DNA, 597 bp, Artificial Sequence
  Description of Artificial Sequence: Synthetic coding sequence
atgttcttcgagcggcacctggagaacctgctgaagcacttcatccctggaacgaccgatccagcggtcatcctggacctattgccgctgtgtcgcaactatgtgagacgggttcacgttgaccagtttttaccacccgtgcagctacccgctcagttgcgacccggcgaccagtccgacagcgggagcgagggcgagatggaagaaccgacggtagatcattaccaactgggtgaccttgtggccggcttaagccacctggaagaattggaccttgtgtatgatgttaaggattgtggaatgaatttcgaatggaatttattcctgtttacctaccgggactgtttgagcctggccgcagcaataaaggcttgccacaccctcaaggacggggggaagcagctactggagggaatgtcagacaacaagaccctactggaattcgatctgcgtctttcggatgtggcacaagagtctgagtacctaattgggcaagcactgtacgccaatagggaggccgcccgccaaagggctctgaatcctagccactttatgtctacaattaccgcaaatggccccgagaactctgtggggtag

SEQ ID NO: 208243 - DNA, 597 bp, Artificial Sequence
  Description of Artificial Sequence: Synthetic coding sequence
atgttcttcgagcggcacctggagaacctgctgaagcacttcatccctggtacaactgatcccgccgtgattctggatcttctcccactatgtcgcaactacgtgaggcgtgtgcacgtggaccagttcctgcccccagtgcaactgccagcacagctgagacctggagatcaatctgactctggcagcgagggggagatggaagaaccaacggtggatcactaccagttaggggacttagtggcggggttgtcacacctggaagaactggacctagtatatgatgtcaaggactgcgggatgaacttcgagtggaacctgtttttgtttacttacagagattgcctgtcactggccgcagccatcaaggcatgccacaccctgaaggatggtggcaagcagctcctggagggaatgtccgacaacaagacattgctcgaatttgatctgaggctcagcgatgtggcccaggagtctgagtaccttatcggacaagcactgtatgctaatagagaggcagcccgacagcgggcactcaacccgagtcacttcatgagtacgattacggccaacggacccgaaaactcagtaggttag

SEQ ID NO: 208244 - DNA, 1506 bp, Artificial Sequence
  Description of Artificial Sequence: Synthetic coding sequence
atgcaggacaccgtgaccaccagcgccctgctggaccccagccactcaagcgtgagtacacaggacaatagctcgacaggggggcacacctcctcgacaagcccccagctaagcaagccgtcaattaccccagtgcctgctaaaagcaggaacccacaccctagggctaatatcaggaggatgaggcgtattatagccgaggacccagagtggtcgttagccattgtacccctgctgacagagctgtgcatacagcacatcatcaggaacttccagaaaaacccaatccttaaacagatgctgccagaacaccagcagaaggtccttaaccacctgagcccagatctgccccttgctgtcaccgcaaacctcattgactccgaaaattactggcttagatgttgcatgcacagatggcctgtgtgccacgttgcacaccatggcggatcgtggaagaggatgttcttcgagagacatcttgaaaatctgctcaaacactttatccccgggaccaccgaccctgctgtcattctggatctgctccccctgtgcaggaactacgttcgccgcgttcatgttgatcaattcctgccaccagtgcagctcccagcccagctgcggcccggcgatcaatctgacagtggatcagagggcgaaatggaagaacccaccgttgaccactatcagctgggcgatttggtggctggcctctcacacctggaggagctggatttagtctacgatgtgaaagactgtggtatgaattttgaatggaacctctttctgttcacataccgcgactgtttatccctggctgccgctattaaagcttgccataccttgaagattttcaagctaacacgaagcaaagtggatgacgacaaagccaggattattattagatctcttcttgatcaccccgtgctggaagagctggatctgtcccagaatctgattggggataggggcgcgaggggagctgcaaagcttctgagccattcccggctccgcgtgctcaatctcgccaacaaccaggttcgggcccctggcgcacagtctctagctcatgccctcgcacataacactaaccttatctcattaaacctcagacttaactgtatcgaggacgaagggggtcaggccctagctcacgctttacaaacaaataaatgtctgaccactttgcatttaggcgggaatgagctctccgaacctacggcgactctgctgtcccaggtcctcgcaatcaacacaactcttaccagtataaatcttagctgcaaccacatcgggctggacggcggaaagcagctcctggaaggcatgtctgataacaaaaccctgctcgaattcgatttacgcctgagcgatgtcgctcaagagtccgaatacttaatcgggcaggccttgtacgccaacagggaggctgcacggcagcgcgccttaaacccttcccattttatgtcaaccatcacagcgaatggtccggagaattccgtgggttag

SEQ ID NO: 208245 - DNA, 597 bp, Artificial Sequence
  Description of Artificial Sequence: Synthetic coding sequence
atggagaagcggggccggggcgtgaagagcagccccatccagacccccaaccagaccccacagcaggcccctgtcaccccaaggaaggaacggaggccttctatgttcgaaaaagaggcctacacccagatactacgtgaaaggctgcgggagtcaattcacaatgtccagtatgtggaaccacccttcgatgatagcattgcagatatcgggaaggagtggaaatccgccctcgccaagttaaaatttgcaaactcttacagaatggagccacttaaaaagtttcaggcccacagtgtggagacaaaggtacagcagattttaaccgagtccctgaaagatgtgaagtacgatgataaggttttttctcatttatctctggagctggccgaccggattctgctcgccgtaaaggaattcgggtatcaccggtacaagtttataataaaagtcctgtttattcaaaagacaggccaggccattaatatagcctctcgatggatatgggacattgcctgggattcatgggtggcagcgaagcatgaagctgaaagttatgtggccctggtccttgtttttgcattatactatgaatag

SEQ ID NO: 208246 - DNA, 666 bp, Artificial Sequence
  Description of Artificial Sequence: Synthetic coding sequence
atggccagccggcccctgccccccggccggcaggaggaggagaacgccaaggactctgggaggaaaccgtcacccgttcgcccgagaggctgtctgccatccatcgatgaggcccgtcccgctggaccaggtcccgctcctgcctctcgacggggttcaatgttagggcttgcggcgtctttttctaggaggaactccctggtgggacctggggccgggccaggcggccagagacccagcttgggaccagtacccccgctgggtagcagagtaagtttcagcggcctacccttagctccagcaaggtgggtggctcccagttacagaactgagcccgtacccggcgaacgctgggaggccgcccgcgcacagcgcgctctggaggctgctctagctgcaggtctacacgatgcatgctactcatcggacgaagccgcgagactggtgcgcgagctatgcgagcaggtccacgtcaggctgcgggaactatccccgccgcggtacaagctggtgtgctccgtcgttttaggccccagagccggccagggcgtgcatgtggtatctagagctctgtgggacgtggccagggacgggcttgcaagtgttagttacaccaataccagcctgtttgcagtagctaccgtgcatggcttgtattgtgaatag

SEQ ID NO: 208247 - DNA, 666 bp, Artificial Sequence
  Description of Artificial Sequence: Synthetic coding sequence
atggccagccggcccctgccccccggccggcaggaggaggagaacgcaaaggattccggacggaaacctagtcctgtgcgccctcgcgggtgcctgcctagtatcgatgaagcccgcccagctggccctggtccagcaccggcatctagaagaggctcaatgctgggcctggctgccagtttcagccggagaaattccctggtgggacccggagcggggcctggaggtcagcgccccagcttgggaccagtccctccactcggaagccgcgtttctttttccggcctaccactggctcccgcgcgctgggttgctcccagctatcgcacagaacccgttcctggtgagcgatgggaggccgcccgagctcaaagagccctcgaggccgccttggctgcggggctccatgacgcgtgctacagctccgatgaggccgcaagactagtgagggagttgtgcgagcaggtgcacgtgcgattgcgagaactctcacccccaaggtacaaactggtctgttctgtagtgcttggcccaagagcaggacaaggtgtgcacgtggtgtcccgagccctctgggatgtggccagagacggactcgcttccgttagttataccaacaccagcctgtttgctgtggccactgtccacggactatattgtgaatag

SEQ ID NO: 208248 - DNA, 1074 bp, Artificial Sequence
  Description of Artificial Sequence: Synthetic coding sequence
atggagcggatgagcgacagcgccgacaagcccatcgacaacgacgcagagggggtgtggtctcccgatatcgagcagagttttcaggaggctttggcaatttaccccccctgcggacggagaaagatcatattgagcgacgagggcaagatgtacggacgaaatgaactgatcgctaggtatataaagctccgcaccgggaagactagaacgcgcaagcaggtgtccagccacatacaggtcttggcgcggaggaagtctagagacttccactctaaactgaaggtgactagtatggatcagacggccaaggacaaggcgctacagcatatggcagccatgtccagtgcccaaatagtgtccgccacagccatccataacaaactgggcctgcccggtatcccccgccctaccttccccggtgccccaggcttctggcccggtatgattcagacgggccagccaggtagctcacaagatgtgaagccattcgtgcagcaggcgtatcctatccagcccgctgttaccgcaccaatcccaggcttcgagcccgctagtgctcctgctccatctgtacccgcttggcaggggcgtagcattgggaccacaaaactgcggctggtagaattctccgcctttctggagcagcagcgggaccccgacagcgccgacctcaattgtaatattcaggacgatgccggcgccttctatggagtgacaagccagtacgagtcctctgaaaacatgactgttacttgcagcacaaaagtgtgtagcttcggtaagcaggtagtggagaaggtggagactgagtacgccagatttgagaacggtaggttcgtgtatcgtataaatcgctctcccatgtgcgagtacatgataaatttcatccataaacttaagcatctgcctgaaaaatatatgatgaactcagtccttgaaaacttcaccattttactcgtcgttacaaatagagacacacaggagaccttactgtgcatggcctgtgtgttcgaagtctctaattcggagcacggcgcccagcaccacatttatcgtctggttaaggattag

SEQ ID NO: 208249 - DNA, 1236 bp, Artificial Sequence
  Description of Artificial Sequence: Synthetic coding sequence
atggagcggatgagcgacagcgccgacaagcccatcgacaacgacgccgagggcgtgtggagccctgatattgagcagagctttcaggaggccctggcgatctaccccccctgcggcaggagaaagattattctgtccgatgagggtaaaatgtatggaagaaacgaactgatcgcccggtatattaagctgcgcacgggcaaaacgaggactcgaaagcaggtgagttcccatatccaggtcctggctcgcaggaagtcacgggacttccatagcaagttaaaggatcaaacagccaaggacaaggcgctccagcacatggccgccatgtcaagtgcccagatcgtgtccgctactgccatacacaacaagctgggccttccaggcatccctcgacccaccttccctggggcacccgggttttggccaggaatgatccagaccggccaacccggctcttcccaggacgttaagccctttgtccagcaggcatacccaatacagcctgccgtgaccgccccaatccccgggttcgaaccagccagtgctcctgcaccaagcgtgcccgcctggcaggggaggtcaatagggacaaccaaattgagactagtcgaattttctgcattcctggagcagcaaagagaccccgatagttataataagcacttattcgttcacattggacacgccaatcattcgtactcagacccactgctggaatccgttgacattcggcaaatctacgataagttccctgaaaagaagggcggacttaaagaactattcggaaaggggccccagaacgcattctttcttgtgaagttttgggctgatctgaattgcaatattcaggacgacgccggagctttttacggcgttacctcacagtacgagtcctcagagaacatgactgttacatgttccaccaaagtttgcagcttcgggaagcaagtggtggagaaggttgaaactgagtacgcccggtttgaaaacgggagatttgtctatcggatcaataggtcgcccatgtgcgagtatatgatcaattttatccacaaacttaaacacctgcccgagaagtacatgatgaactccgtactcgagaattttactatcctgcttgtagttaccaacagggatacccaagaaacactgctgtgtatggcatgcgtctttgaagtctctaactctgagcacggggcgcagcatcacatataccgcctggtaaaagattag

SEQ ID NO: 208250 - DNA, 1281 bp, Artificial Sequence
  Description of Artificial Sequence: Synthetic coding sequence
atcgagcccagcagctggagcggcagcgagagccccgccgagaacatggaacggatgtcagattcggctgataagcccattgacaacgatgcagagggagtctggtcccctgatatcgagcagtcttttcaggaagctttagctatttaccccccctgcggccgtaggaagatcatcttatccgatgaaggaaagatgtacggccgcaatgagctgatcgcacgctatataaagctgcgcactgggaagaccagaacacgcaagcaggtctcaagtcatattcaggttctggctaggcgcaagtctcgcgattttcacagcaagctgaaggatcagacagccaaagacaaggcgttacaacacatggccgcaatgagctccgcgcagatagtctcggctactgctatccacaacaagctcgggttgcccgggattccaaggccaacatttcccggggctccgggcttctggcccggcatgattcaaacaggtcagccaggcagcagtcaggacgtgaagccattcgttcaacaagcttatccaatccagcctgcggttacagcaccaatacctggcttcgagccagcttccgcccctgctccttccgttcccgcctggcaagggagaagcatcggaacaactaagctccggctggttgaatttagcgctttcctggaacagcaacgggaccctgactcatataataagcatctgtttgtgcacataggacatgccaatcactcatactcagatcctttattggaaagcgtcgatatccgccagatttacgataaattccccgagaagaaagggggtctgaaggagttatttggcaagggccctcagaacgccttctttcttgtcaagttttgggctgatttgaattgtaacatccaggatgatgccggagccttctatggcgtcacttcgcagtacgagtcatctgaaaatatgactgtcacctgtagtactaaagtgtgttcttttgggaagcaggtggtggagaaggtggagaccgagtatgcacgcttcgagaatggcagattcgtgtatcgcatcaatcgcagcccaatgtgcgagtatatgattaattttatccataaattgaagcacctgccggaaaaatacatgatgaattctgtgcttgaaaatttcacaatcctcctcgtggtgactaatcgggacactcaggaaactctgctgtgtatggcctgtgtgttcgaggtgtctaattctgaacacggtgcacagcatcacatctacaggctcgtgaaagactag

SEQ ID NO: 208251 - DNA, 993 bp, Artificial Sequence
  Description of Artificial Sequence: Synthetic coding sequence
atgcggtacgtgctgagctggtgcgtgaccgtgaccttcaaggaccagacagccaaggataaagccctccagcacatggctgctatgtcctctgcccaaattgtctccgctactgccatccacaacaagttaggcctgcctggcatcccaagaccaacatttccaggcgccccaggattctggccgggcatgattcagactggacagccaggcagtagccaggatgtgaaacccttcgtgcagcaggcctatcctatccaacctgccgtcacggcacccatacccggcttcgagccagcaagcgctccggcaccatccgtacctgcgtggcaggggcgatcaatcggtacaaccaagctgcggcttgtagaattctccgcctttttggagcagcagcgggaccccgacagctacaacaagcatctattcgtgcatatcggccacgcaaatcactcctacagcgaccctctgcttgagagcgtagacatacggcagatctacgataagttcccagaaaagaagggaggactgaaagaactttttggaaaaggcccccagaacgcctttttcttggtgaaattctgggccgacttgaattgtaacattcaggacgatgctggagctttttacggcgtgacttcccagtatgaatcaagcgaaaacatgaccgtaacttgctcaaccaaggtgtgctcctttggtaaacaggtggttgagaaggttgagactgagtatgccagatttgaaaatggccgattcgtgtaccggatcaatcgctcacctatgtgcgaatacatgataaacttcatacacaagctcaagcatctcccggagaagtatatgatgaacagtgtcctggaaaatttcacaatcctcttggtcgttaccaatcgggacacacaggagactcttttatgcatggcgtgcgtgtttgaggtgagcaactcggagcatggagctcagcaccacatctataggcttgtgaaggactag

SEQ ID NO: 208252 - DNA, 207 bp, Artificial Sequence
  Description of Artificial Sequence: Synthetic coding sequence
atcgagcccagcagctggagcggcagcgagagccccgccgagaacatggagagaatgtccgattccgccgacaaaccgattgataacgatgcagagggcgtatggtcgccggatatagaacagagcttccaagaagccctggccatctatcccccgtgcggaaggcgaaaaatcatcctttcagatgaaggaaagatgtacggatag

SEQ ID NO: 208253 - DNA, 1281 bp, Artificial Sequence
  Description of Artificial Sequence: Synthetic coding sequence
atcgagcccagcagctggagcggcagcgagagccccgccgagaacatggagcgcatgtcagactctgcggacaagcccatcgataacgacgcagagggcgtgtggagccccgatattgagcagtccttccaggaagctctggcgatctatccaccatgcggtagaagaaaaattattctttcggacgaaggaaaaatgtatgggcgcaacgagcttattgcgcgatacatcaaattaagaactggaaaaactaggactcgaaaacaggtgtcttcgcatatccaagttctagcacgccgtaaatctcgagattttcactcaaaactgaaagatcaaaccgccaaagataaggccttacaacatatggctgcaatgagctcagctcagatcgtgtccgcaaccgctatccataacaagctcggcctcccagggatccctcggcccacatttcccggggcacctggattctggcccgggatgatccaaacaggtcagcccggctcttcccaagacgtcaagccctttgtgcagcaggcataccccatccagccagccgtcactgcacctattcctggttttgagcctgcatcagctccggccccatccgtgccagcgtggcaaggacgtagtatcggcaccactaaactaagactggtggagtttagcgctttccttgagcagcagagagatcccgactcttataataagcatctttttgtgcacatcggacacgccaatcattcctactccgaccctctgctcgaatctgtcgatataaggcagatctacgacaaatttcctgaaaaaaaaggtggtctcaaagagctgttcggcaaggggccccagaacgccttttttctagttaaattctgggctgacctcaattgtaatattcaagacgacgccggggctttttatggggtcacaagccagtatgagtcctccgagaatatgaccgtcacctgctccacaaaagtgtgctcttttggcaagcaggtggtggaaaaggtggagacagagtatgcccgatttgaaaatggcaggtttgtttatcggattaacagaagtccgatgtgtgagtacatgattaatttcatccataagttgaaacatttacctgaaaagtatatgatgaactcagtccttgagaactttacaatcctgcttgtcgtgaccaatcgggatactcaggagacattgttgtgcatggcctgcgtgtttgaggtgtccaatagcgagcacggagctcagcaccacatctaccggctcgttaaggattag

SEQ ID NO: 208254 - DNA, 1344 bp, Artificial Sequence
  Description of Artificial Sequence: Synthetic coding sequence
atgggcgagccccgggccggcgccgccctggacgacggcagcggctggaccggctccgaggaagggagcgaggaaggcacaggtggctctgaaggggctggcggagacggcggaccagacgccgaaggcgtatggtctccggacattgaacagtcattccaggaagcattagctatataccctccctgtggcagacgtaaaataattctgtctgatgaggggaaaatgtacggcaggaatgagctgatagccagatacatcaaacttaggacaggcaaaactcgaacgaggaaacaggtgtcatcccacatacaagttctggccaggcggaagtctagggagatacagtccaagctgaaagatcaagtgtcaaaagataaagccttccaaaccatggcaaccatgagctccgcgcagttaataagtgccccttctttgcaagccaagctgggacccaccggcccacaggcttctgaactcttccaattctggtccggagggagcggccccccatggaacgtgcccgacgtcaagcctttttctcaaactccattcaccctgtctctgacacctccgtccacagacttacccggatacgaaccccctcaggccctgagccccctgcctcctcccacaccgtcccctccagcctggcaagctcgaggattgggaaccgctcgcctccaactggtggaattttctgcttttgttgagccccccgacgccgtagactcctatcagcggcatctgttcgtgcacatctctcaacattgcccctcccccggcgcgcctccccttgaatcagtcgacgtcaggcagatttacgacaaattcccagaaaaaaaaggcggcctgagggaactttacgaccgcggccccccacacgccttcttcctggtaaaattctgggccgacctcaactgggggccctccggagaggaggccggggccggcggctctattagtagcggcggcttctatggtgtgagctctcagtacgagagccttgagcacatgaccctgacctgttcttccaaggtctgtagcttcggcaaacaagttgttgagaaggtcgaaaccgagcgagctcagcttgaagacggaaggttcgtgtaccggctcctgagatcccctatgtgtgagtaccttgtgaactttctgcacaagctccgtcagcttcccgagagatatatgatgaactccgtgcttgagaatttcacaatcctgcaggttgttacaaatcgtgacacacaggagttgctgctgtgtactgcctatgtgttcgaggtttctacctctgagcgcggcgcacagcatcacatctatcgtctggttagggattag

SEQ ID NO: 208255 - DNA, 1353 bp, Artificial Sequence
  Description of Artificial Sequence: Synthetic coding sequence
atgggcgagccccgggccggcgccgccctggacgacggcagcggctggaccgggtccgaggaaggctccgaggaaggaactggagggagcgaaggggcaggaggtgacgggggacccgatgccgagggtgtatggtccccagatatcgaacaatctttccaggaagccctggcgatttatcccccttgcgggcgcagaaagattattctgagcgacgagggcaagatgtacggacgtaatgagctgatcgcacgctatattaagcttcgaacaggaaagacacgaactaggaagcaggtgagcagccacatccaggtccttgctagacgcaaatcacgcgagatccagtccaaactcaaagaccaagtgtcgaaggataaagcattccaaactatggctacaatgtctagcgcacaactaattagtgctcctagtcttcaggcaaagctggggcctacgggccctcaggtcgtacaagcttctgaacttttccagttctggagcggcggctctggccctccctggaacgtccctgatgtgaagcccttttctcagacaccttttacattgtcactgactccgccttccacggacttacccggctatgagcctccccaggccttatcccctcttcctcccccaactccatccccgccggcttggcaagcccgaggcctaggcaccgccagattacagctagttgagttttccgctttcgtggagccacctgatgctgttgatagttatcagcggcacctgttcgttcacatttcccagcactgcccgagcccaggggcacccccactggagtccgtcgacgtgagacagatttacgacaaatttcccgaaaagaagggcggtctgagggaactgtatgaccgcggccctccacacgccttttttctagtcaagttttgggcagacctgaattggggtccaagcggcgaagaagcaggggctggcggttcgatttcctcaggcggattctatggagtgtcctcgcagtacgagtcgctggaacacatgactttgacgtgttctagcaaagtatgtagtttcggaaagcaggttgtggagaaagtggagactgagagagcccagcttgaagatggccggtttgtatatagactattaagaagtcccatgtgcgagtacctggtaaactttttgcacaagttacggcagttgccggaacgatatatgatgaactccgtgctggaaaacttcaccatactccaggttgttacgaatcgtgatacccaggaactccttctctgcaccgcctacgtttttgaggtgtcgactagcgaacgtggcgctcaacatcatatatatcggttagtccgggattag

SEQ ID NO: 208256 - DNA, 960 bp, Artificial Sequence
  Description of Artificial Sequence: Synthetic coding sequence
atggccaccatgagcagcgcccagctgatcagcgcccccagcctgcaggcaaagttggggccaacggggccccaagtcgtgcaggcctctgagctctttcagttctggtccggtggcagtggtccgccttggaacgtgccggatgtaaagcctttttcccaaacaccctttacgctcagtctcacacctcctagcacagatctgcccggatatgagcccccccaggcccttagtcctctacccccaccgacaccttcccccccggcctggcaggctcgggggttgggcactgcgcgactacagctggtggagttttcggccttcgtggagcctccagacgccgtcgattcctaccaaagacatctgttcgtacacattagccaacattgtccctctcctggagcgcccccactcgaaagcgtggatgtgcgtcaaatttacgataaattcccagaaaagaaggggggcctcagagaactgtacgataggggcccccctcatgcatttttcttagtcaagttctgggcagatttgaactggggcccctcaggagaagaggccggcgcaggcgggtctatcagttctgggggtttctatggagtgtcgagccagtatgaatccctggagcatatgacactgacgtgttcaagcaaggtttgctcgttcggaaaacaggttgttgagaaagttgagactgagagggcacagctggaggatggccggtttgtgtaccggctcctccggagtcctatgtgcgaatatctggtgaactttctgcataagctcaggcagcttccggagaggtacatgatgaactccgtattggaaaattttaccatattgcaggttgtgaccaatcgcgacactcaggaactgcttctgtgcactgcctatgttttcgaggtgtccacttctgaacgtggtgcccagcatcatatttacagacttgtcagggattag

SEQ ID NO: 208257 - DNA, 1356 bp, Artificial Sequence
  Description of Artificial Sequence: Synthetic coding sequence
atgggcgagccccgggccggcgccgccctggacgacggcagcggctggactgggtccgaggaaggatctgaagaagggaccggcggttccgaaggcgcgggcggcgacggcggacctgatgcagaaggtgtgtggtcaccagacattgagcagtcattccaggaggcgctggccatctacccaccatgtggtcgcaggaagatcatcctctctgatgaaggtaagatgtatggtcgtaacgaattaatcgctcggtatatcaagctgcgcaccggcaaaacacggaccagaaagcaggtgtcatcccatatccaagtgcttgctcggcgaaaatcccgggagatccagagcaagttaaaggctctgaacgtggatcaggtgagtaaggacaaagcctttcagactatggcgacgatgtcttccgcacagcttatttccgcccctagcctgcaggcaaagctgggcccgacaggccctcaggcctccgagctctttcagttttggagcggggggagcgggccaccatggaatgttcccgatgtaaaaccctttagtcagactccttttactctgtcgcttaccccgcctagtacagacctgcctggctatgagccgccacaggccctctcaccattgccaccccctacaccctccccacccgcttggcaagctcgggggctggggaccgcacgattgcaactggtggagttctccgcctttgtggagcctcccgacgccgtggattcataccagcgccatttgttcgtgcatataagtcagcattgtcctagccccggtgctccacccctggagagcgtggacgtaaggcagatctatgacaaattccctgagaaaaagggcggcctgagagagttgtatgatcgtgggcccccccatgcatttttcctcgtcaaattctgggctgaccttaattggggaccgtctggagaggaggcaggggctggtggttctatctccagcgggggattctatggcgtcagctcacagtacgagtccttggagcatatgactctcacatgcagttcaaaggtctgttcatttggtaagcaggtggtggaaaaagttgagacagagcgggcacagcttgaagatggacggtttgtataccgattgctgagatcaccaatgtgcgagtatctggtaaactttttgcataagttacgtcagctgccagaaaggtacatgatgaactctgtgctggagaactttacaattttacaagtggtgaccaatcgcgacacccaggaactgttgttatgtaccgcttatgtttttgaagtgagcacttcggagagaggggcccagcaccacatatatagacttgtccgagactag

SEQ ID NO: 208258 - DNA, 1356 bp, Artificial Sequence
  Description of Artificial Sequence: Synthetic coding sequence
atgggcgagccccgggccggcgccgccctggacgacggcagcggctggacaggatctgaagagggcagtgaggaagggaccggtggaagtgagggagcgggaggggacggcggaccagacgccgagggcgtatggtcgccggacattgaacaaagttttcaggaggccctggcaatctatcccccctgtggccggcgcaagatcatcctttcggacgaggggaagatgtacggccggaacgagcttattgcaaggtacattaagttgagaacaggaaaaacccgaactcgtaagcaggtaagctctcatattcaagttctggctcgaagaaaatctagagagatccagtcaaagctgaaggcattaaacgtcgaccaggtcagtaaagacaaggctttccaaactatggcgacgatgtccagtgcccagcttatttctgctcctagcctgcaggctaagctgggacccaccggcccacaggcatctgaacttttccagttctggtctggggggtcaggcccaccatggaatgtgcccgacgtaaagccctttagtcagactccattcaccttatccctgacaccaccatctactgacttgccaggctacgaaccaccacaggccctgtcaccattgcctcctccgaccccaagccctcctgcctggcaggcccgaggactgggaactgctcgtctacaacttgtggaattctctgcctttgtcgagccccctgacgcggtggattcttatcagaggcatttgtttgtccacatctcccagcactgtccctcgcccggtgctcctccactagaaagtgtggacgtgcgacaaatctatgacaaatttcccgagaagaagggagggctgcgagagctgtatgatagaggcccaccccacgctttcttcctggtgaagttttgggctgatttgaactggggcccctcgggggaagaagccggagccgggggctctatatcctcaggagggttctacggcgtatcaagccagtacgaatctctggaacacatgaccctgacatgtagctctaaggtgtgcagctttgggaagcaagtggttgaaaaggtcgagactgaacgcgctcaattggaggatggtcgcttcgtctaccggctgttgagatccccgatgtgtgagtacttggtcaatttcctgcacaagctgcgccagcttcccgagaggtatatgatgaattcagttctcgaaaattttacaatattgcaggtcgttactaatcgcgatactcaagaactactactgtgtactgcctacgtgttcgaggtgtccacctccgaaaggggggcacagcaccacatttatcgactcgtcagggactag

SEQ ID NO: 208259 - DNA, 1353 bp, Artificial Sequence
  Description of Artificial Sequence: Synthetic coding sequence
atgggcgagccccgggccggcgccgccctggacgacggcagcggctggacagggtccgaggaaggcagtgaggaggggactggcggctcagaaggcgccgggggagatggcggacctgatgccgagggcgtatggagccccgacatagaacagtcctttcaagaggctctggcaatttaccccccatgtggtcgtcgcaaaatcatactttctgacgaaggaaagatgtacggccgcaatgagcttattgcacgatatatcaagttgagaactggcaagaccagaactcgcaaacaggtttcttctcatatccaggtcctggcccggcggaaatctagggagattcagtccaaattgaaagaccaggtatccaaggacaaggccttccagacgatggcaacgatgagctcagctcaactcatatccgctcccagcctacaggcaaagttgggccctacaggaccacaggtggtccaggccagtgagctcttccagttctggtccggtggcagtgggcctccctggaacgtccccgatgtgaagcctttctctcagactcccttcactctctcactgacacctccatccaccgatcttcctggatacgagccccctcaggctctgagcccattgccaccccccactccttctcctcctgcctggcaggctcggggcctgggaactgcccggctgcaactcgtcgagttttcagccttcgtggagccgcccgatgcagtggacagctatcagagacatctcttcgtgcatatctcgcagcattgcccttctccaggcgcacctcctctcgaatcggtggacgtgcggcagatttacgacaaattcccggagaaaaaagggggattaagagaattatatgaccggggccctccacacgcgttcttcctggtgaagttttgggcagaccttaattggggcccatctggagaggaggccggagccggaggcagtatcagcagtggaggattctacggagtgtcctctcagtacgagagtttggaacatatgacacttacctgcagttctaaggtctgttctttcggtaagcaagttgttgaaaaggtggaaacagaaagggctcagctagaagacgggcggttcgtgtatagactactgcggtcaccaatgtgcgaataccttgttaacttcctgcacaaactcagacagctacccgagcgttacatgatgaactctgtattagagaattttactattctccaagtcgtgactaatcgggacacgcaggagctcctcctttgcactgcctacgtgttcgaggtctccactagcgagcgcggcgcccaacatcacatttatagactcgtgcgtgattag

SEQ ID NO: 208260 - DNA, 1308 bp, Artificial Sequence
  Description of Artificial Sequence: Synthetic coding sequence
atcgccagcaacagctggaacgccagcagcagccccggcgaggcccgcgaggacgggcctgagggtctcgacaagggattggacaacgatgccgaaggcgtctggagccctgacatcgagcagagtttccaggaggccctggcgatatatcccccttgcgggcgaaggaagattattttgtctgatgaaggtaaaatgtacggacgaaatgagttaatagcccgatatatcaaattgcgaaccggaaagacccgcactcgtaagcaggtctcctcccatatacaggttctggctcgtaagaaagtgagggagtaccaagtcggcattaaagccatgaatcttgatcaggtgtccaaggacaaagccttgcagtccatggcatcaatgtcaagcgcacagatcgtcagcgccagcgtactgcagaacaagttttcccctccgtcaccactgccacaggcagttttctctacatcatctaggttctggtctagccctcccctgctgggccagcaacccggacccagtcaggacattaagccattcgcccagccagcctacccaatccaacctccactaccacccactctctccagctatgaacccctcgccccactgccaagcgccgccgcaagtgtccctgtgtggcaggaccgaacgatcgcatctagtcgcctccgtcttctcgagtactcggcctttatggaagtgcagagagatcctgatacctactccaaacacctgttcgttcacattggtcagaccaatcctgcattttcagatcccccactggaggccgtggacgtgagacagatctacgacaagttccccgaaaagaagggtggactcaaggagctctatgagaaggggccccccaatgccttctttctggtcaagttttgggctgatctgaacagcacaatccaggagggacccggcgcgttttacggcgtcagttcccaatactctagcgcagacagcatgaccattagcgtttctacaaaggtgtgctcttttggcaaacaggtggtcgagaaggttgaaacggagtatgcccgcctggagaacggaagattcgtataccggatccataggtcccctatgtgtgagtacatgattaacttcatccacaagctgaagcatctcccggaaaagtacatgatgaattctgtgctggagaactttaccattcttcaggtggtgactagcagagattcgcaggaaactctgctggttattgcattcgtgttcgaggtcagcacgagtgagcatggagcccagcatcacgtttacaaactggtgaaagactag

SEQ ID NO: 208261 - DNA, 1356 bp, Artificial Sequence
  Description of Artificial Sequence: Synthetic coding sequence
ctgagccggcccgtgggcagcggccccgagccccgggccaccagcaccatagcctctaatagctggaatgcgagcagttcccccggcgaagctcgggaggatggtcctgaggggttggataagggactagacaatgacgctgagggggtttggagcccggatatagagcaaagctttcaggaggcactggccatttaccccccttgtggccgacgaaaaattatcttgagcgacgagggtaagatgtacggcagaaatgagcttattgcccggtatattaaactgcgcacagggaagactaggacgcgtaaacaggtgagttctcatctccaggtactcgcccgtcgcaagagtagagagatccagtcgaaactcaaaagctcacctcaggaccaggtgtccaaggacaaagcgttgcaatccatggcaagcatgtccagcgctcagattgtttccgcttctgtgttacagaataaatttagcccgcccagccccttgcctcaggctgtgttttccaccagtagcaggttctggtcctcacctcccctcctcgggcaacagcctggtccttcccaggacatcaagcctttcgctcagccagcttatccaatacagccacccctgccgcctactctgtctagctacgaacctctagcccctttgccctcggctgccgcctcagtacctgtttggcaggatcggaccatcgcatcctcccgcctgaggctactcgagtacagcgcttttatggaagttcagcgggacccagatacatacagcaagcatctgtttgtgcacataggccagaccaaccccgctttcagtgacccgcccctagaagcggtggatgtcagacagatttatgataagttccccgagaagaagggaggcctgaaggagctctatgaaaagggccctccaaacgctttctttctggtcaagttctgggctgatctcaattcaacaatccaggaaggtcccggagcattctatggcgtcagctcccagtactcaagcgcagacagcatgacaattagtgttagcacaaaagtttgtagttttggcaagcaggtcgtcgaaaaggtggagactgagtatgctcgtctggagaatggtcggttcgtttacaggatccacaggagccccatgtgcgagtatatgattaattttatccacaagctcaagcacctgccagagaagtacatgatgaactctgtcctggaaaactttacaatcctgcaagtggtcacctctcgcgactctcaggagactctgctcgtgatcgcctttgtgttcgaagtttcaacgtcagagcacggcgcgcaacaccacgtgtacaaactcgtgaaggactag

SEQ ID NO: 208262 - DNA, 1176 bp, Artificial Sequence
  Description of Artificial Sequence: Synthetic coding sequence
ctggagggcaccgccggcaccatcaccagcaacgagtggagcagccccacgtcgccagagggctccaccgcttctggcggctctcaggccttggataaaccaattgacaatgatgcagagggggtgtggtcccccgacattgaacagtcattccaagaggcactggcgatctatcccccttgcggaagaagaaagatcatactgtcagacgagggcaaaatgtacgggaggaacgaactgatagcccgctatatcaagcttaggacagggaaaacaagaacgcgaaaacaagtgtcaagccacatccaggtactggcccggaggaaagcgcgtgagatccaagctaagctcaaattttggcaaggggccctgcccggacaggccggaacttcgcatgatgtgaagcccttcagccagcagacatatgctgtgcagcctcctctgccattacctggctttgaaagtccggctggtcctgctcctagcccctccgcccctccggccccgccgtggcaaggccgctctgtcgcgagttcaaagttatggatgctggagttttctgccttcctggagcagcaacaggaccccgatacttataacaagcatttgttcgttcacataggtcaatcttctcccagttacagtgatccctacctggaggctgtagatatcaggcagatctacgataaattcccagagaagaagggcggattaaaagacctcttcgaaagaggtccatctaatgcttttttcctggtgaaattttgggctgacttaaacacaaatatcgaagatgaaggatctagcttctatggagtctctagtcagtacgaatcccctgaaaacatgatcatcacctgcagtaccaaggtttgttccttcggcaaacaggtcgtagagaaagtggagactgaatatgcacggtatgaaaatggtcactatagctacaggatccacaggagtccactgtgtgaatatatgataaatttcattcataagcttaagcacctgccggagaagtacatgatgaattccgtgctcgagaacttcacaattcttcaggtggtgaccaatagagacacacaggagaccttgctttgtatagcttatgtgttcgaagtgtcggccagcgagcatggcgcccagcatcacatatacagactcgtgaaggagtag

SEQ ID NO: 208263 - DNA, 1305 bp, Artificial Sequence
  Description of Artificial Sequence: Synthetic coding sequence
ctggagggcaccgccggcaccatcaccagcaacgagtggagcagcccgacctccccagagggttccacggccagtggcggatctcaggccctggataaaccaattgacaatgacgctgagggggtgtggtcaccagacatcgagcagagttttcaagaagcactggcaatctacccaccgtgtggcagacgtaaaataatactgtccgatgagggaaaaatgtatgggaggaatgagctcatcgcaagatacatcaaactgcggaccggcaagacaaggactcgtaagcaggtctcgtcacatatccaggtgctcgctcgaagaaaagctagggagatccaggcaaaactgaaagatcaggcagcaaaagacaaagccctacaatctatggcggcaatgtcaagtgcacaaatcattagtgccactgctttccatagttccatggctctggcacgtggaccgggtcggcctgctgtgagcggcttctggcaaggcgccctgccgggtcaggctggtacctcacacgacgtgaaacctttttctcaacagacatacgccgtgcagccccccctgccactcccagggttcgagagcccagctggaccagcgccctctccctcggctcccccagcccccccctggcagggaaggtctgtcgcctcctccaagctgtggatgctggagtttagtgcctttctagaacaacagcaggaccccgacacgtataacaaacatttattcgtgcacattgggcagtcctcaccctcctactccgacccttacctcgaggcagtggatatccggcagatatatgacaagtttccagaaaaaaaaggaggcttgaaggatctattcgagcggggccccagcaatgccttcttcctggtgaaattctgggccgaccttaataccaacattgaagatgagggctcttcattttatggggtgtccagtcagtacgagtcaccggaaaacatgataattacatgtagtacgaaagtctgctcctttggaaagcaggtggtagaaaaagtggagactgaatacgcccggtacgagaatggacattactcatataggatccacaggtctcccctttgtgaatacatgatcaacttcatccacaagcttaagcacctgcctgaaaaatacatgatgaattcagttcttgagaatttcacaattctgcaggtcgttactaaccgggacactcaggagactctcctttgtattgcctacgtgtttgaggttagtgcttccgagcacggcgcgcaacaccatatctacagattagtaaaagaatag

SEQ ID NO: 208264 - DNA, 918 bp, Artificial Sequence
  Description of Artificial Sequence: Synthetic coding sequence
atggccgccatgagcagcgcccagatcatcagcgccaccgccttccactcatctatggctctggcacgaggacccggccgacctgctgtttccggcttttggcaaggtgccctgcctgggcaagcaggtaccagtcacgatgttaagcccttctcacagcaaacctacgccgtgcagcctcccctacccctgcctggattcgaatcccccgctgggcccgcaccatccccctccgctcctcctgccccaccgtggcaagggaggagtgtggccagttcaaagctttggatgttggagttcagcgctttcttggagcaacagcaggaccctgacacctacaataagcacctgtttgttcatatcgggcaaagttctccctcctacagcgacccttatttggaggcagtggatatcaggcaaatctacgataagtttccagaaaaaaagggaggtttaaaagaccttttcgaaagaggaccgtccaacgctttcttcttggtcaaattctgggctgacctcaatactaatatcgaagatgaagggtcttcattctacggcgtttcatcccagtatgaatcacccgagaacatgatcataacttgcagtaccaaggtgtgcagctttggcaagcaggtggtggaaaaagttgaaaccgaatacgcccggtacgaaaatggacattattcctatcgtatccatcgatctcctctgtgcgaatatatgattaattttatccataaactgaagcatctcccggagaaatatatgatgaactctgtcctcgagaacttcaccatcctgcaggtggtcaccaaccgggatactcaggagactctcctttgtatcgcatacgtgtttgaagtgtccgcttccgagcacggggctcagcaccacatttatcgcctggtcaaggagtag

SEQ ID NO: 208265 - DNA, 219 bp, Artificial Sequence
  Description of Artificial Sequence: Synthetic coding sequence
ctggagggcaccgccggcaccatcaccagcaacgagtggagcagccctacatctcctgagggaagcacggcttcgggtgggtcacaggccctcgacaagccaatcgacaatgacgccgagggcgtgtggagcccagatattgagcagagctttcaagaggccttggcaatctatccaccttgtggccgacgcaagatcattcttagcgatgaggggtag

SEQ ID NO: 208266 - DNA, 69 bp, Artificial Sequence
  Description of Artificial Sequence: Synthetic coding sequence
ctggagggcaccgccggcaccatcaccagcaacgagtggagcagcccaacttcaccagaagggtcctag

SEQ ID NO: 208267 - DNA, 528 bp, Artificial Sequence
  Description of Artificial Sequence: Synthetic coding sequence
ctggagggcaccgccggcaccatcaccagcaacgagtggagcagccccactagcccagaggggagtaccgcttccggtggctcccaagccctcgataaaccaatagataacgatgccgaaggagtttggtcaccggatattgaacagtcctttcaagaagcccttgccatctacccaccttgtggcaggcgcaagatcatcctgtcagacgaggggaagatgtatggtagaaatgaactgatcgccagatacattaaactgcggaccgggaaaactcgtactagaaagcaggtcagttcacatatacaggtattggcccggcgcaaggcgagagagattcaggctaagctgaaggaccaggcagctaaggacaaagccctgcaatctatggcagcgatgtcctcagcacagattatttcagcaacagctttccattcatctatggccctagcccggggacccggcaggccagccgtttctggtttctggcagggcgctctgcctggccaagccggcacaagccactag

SEQ ID NO: 208268 - DNA, 3099 bp, Artificial Sequence
  Description of Artificial Sequence: Synthetic coding sequence
atgtgcaacgaggagaccgagatcaaggaggcccagagctaccagaattctccagttagctccgctaccaatcaagacgcagggtatggttcaccttttagcgaaagcagcgaccagctggcacactttaagggttcaagcagccgagaggagaaagaggaccctcagtgccctgatagcgtttcataccctcaggattctttggcccagattaaagccgtctacgccaatttgttttctgaatcatgttggtcatcccttgcgctggatcttaaaaagtctggaagcactacatccaccaacgatgcttcccaaaaggagtcttccgcccccacccccacgcccccaacctgcccagttagcaccaccgggcctacaacgagtaccccaagtacaagctgctcatcctcaacttcgcactcctcaactacgtccacatcatcttcatccggctacgactggcaccaagcagcccttgctaagaccctgcagcagacaagttcgtatggattactgccagagccctcgcttttctccacagtccagctgtatagacagaataacaagctatacggcagtgtatttactggggcaagtaaatttcgttgcaaggactgttccgcagcatacgataccttggttgagctgacggtgcatatgaacgagacaggccactaccgtgacgataatcgggataaagactctgagaagactaaacgctggagtaagccccggaaacgctcgctaatggaaatggagggcaaggaagacgctcagaaggtgctgaagtgcatgtattgcgggcacagtttcgagagcctacaagatcttagcgtccatatgattaagacaaagcactatcagaaagtgcctctgaaggaacccgtgcccgccattactaaactcgttccatccacgaaaaagcgggccctccaggatctggccccgccctgctccccggagccagccggcatggcagcagaggttgccctgtcggagtccgccaaagatcagaaggcagccaatccatacgtaacgcctaataaccgttatggttaccaaaatggtgcaagctacacatggcaatttgaggcacggaaagctcagatcctgaagtgcatggagtgtgggagttctcacgacaccctccagcagcttacagctcacatgatggtcacaggtcatttcctgaaagtgacaacctccgccagtaaaaaaggcaaacaactggttctcgacccagttgtggaagagaagattcagtcgattccgctgcccccgaccacccacacgcgactgcctgcttcatccattaagaagcaaccagacagtccagctggcagtactacttcagaggagaagaaggagcctgaaaaggaaaagccccccgtggcgggcgacgctgagaaaataaaggaagagtcagaagacagcctcgaaaagtttgagccatctacactgtacccgtacctgcgagaagaggatctcgatgactctccaaaggggggcttggacatcctcaaaagtttggagaacaccgtaagcactgctatatcaaaggcacagaatggtgctcctagttggggcggatacccttctatccacgccgcgtaccagctgcctggcaccgttaagcccttgccagctgctgttcagtccgttcaggttcagccctcctatgctgggggcgtgaaatctctcagctctgccgaacacaatgctctgcttcacagtcccggcagcctgaccccccccccccacaagtctaacgtgtcggccatggaagagctggtggagaaggtcacgggtaaagttaatatcaagaaagaggagcggccgcctgagaaggagaagagttctctggcaaaggcagctagtcccatagctaaggagaacaaggactttcccaagaccgaggaggtttctgggaagccacagaaaaaaggccctgaggccgagactggaaaggccaaaaaggaagggcctctcgacgtgcacacaccaaacggaacagagcctttaaaggcaaaggtgacaaacggctgcaataacttgggaatcatcatggaccattccccggagccgtccttcattaatccactaagcgctttgcagtcaatcatgaatacccatcttggcaaagtgtcaaaacccgtgtcgccatccctggacccgcttgcaatgctgtacaaaatctcaaattcaatgctggacaagcctgtgtaccctgccactcccgttaaacaggccgacgccatagatagatactattatgagaatagtgaccagcctattgacctgactaagtctaagaacaagccactcgtgagcagtgttgccgactctgtggcttcccccctgcgagagagcgccctcatggatatctcagacatggtgaaaaacttgactggccgtttaacaccgaaatcctcgacgccttctactgtctctgagaaaagcgacgctgacggttctagctttgaggaggctttagatgagctgtcgccagtgcacaagagaaaaggaaggcagagcaactggaatccccagcacctgctgatcctgcaggcccagtttgcttcgtctttacgtgaaacaactgagggcaaatacattatgagcgaccttggccctcaggaaagggtgcacatttcaaaattcaccgggctgtctatgactacgatctcccattggcttgcaaatgtgaaatatcaactgcgccgcaccggcggaacaaagtttctcaagaatctcgatactggccaccccgtgttcttctgcaatgactgtgcttctcagtttcgaactgccagcacttatattagccacctggagactcatctgggcttctccttgaaggatctcagcaaattgcccttaaatcagatccaagaacagcagaacgttagtaaggtgctcaccaacaagacgctgggaccacttggggccaccgaagaggatctcgggtccacttttcagtgtaagctgtgcaatcggacttttgcatccaagcacgcagttaagctccatctgagcaagacgcacggcaaaagccctgaagatcacctgatatatgtcaccgagttggaaaaacagtag

SEQ ID NO: 208269 - DNA, 237 bp, Artificial Sequence
  Description of Artificial Sequence: Synthetic coding sequence
atgtgcaacgaggagaccgagatcaaggaggcccagagctaccagaactctcccgttagctcagctacaaatcaagatgccggctacgggagcccattctctgagtcgtccgatcaactggcacatttcaagggatcttcttccagggaggagaaggaagacccacagtgtccggattccgttagttatccacaggacagcttggctcagatcaaggccgtatacgcgaatctatag

SEQ ID NO: 208270 - DNA, 321 bp, Artificial Sequence
  Description of Artificial Sequence: Synthetic coding sequence
atgtgcaacgaggagaccgagatcaaggaggcccagagctaccagaacagccccgtgtcgtctgccacaaaccaggatgccggttatgggtcccctttcagcgaatcttctgatcagttggcccactttaagggcagttcatcacgggaggaaaaagaagatccacagtgccctgacagtgtctcttatccacaagattccctcgcacagataaaagctgtgtacgctaacttgttctctgagtcttgctggagctctctggcacttgatcttaagaaatcaggctctaccacaagtactaatgatgccagccagaaatag

SEQ ID NO: 208271 - DNA, 3096 bp, Artificial Sequence
  Description of Artificial Sequence: Synthetic coding sequence
atgatggccgccgccctgctgcactacaccggctacgcccaggaggaacagctcaaggaggaagaggagatcaaggaggaagaagaggaagaggactctggttccgtggcgcagctgcaaggcggtaacgacactggcaccgatgaggagctggaaaccggccccgagcagaagggttgcttctcctaccagaacagccctggttcgcacctctccaatcaggatgccgagaatgagtcccttctctctgatgcatcggatcaagtgtcggacataaaatccgtctgcggacgagacgccagcgataaaaaggcccacactcacgtgaggctacctaacgaagcacataactgcatggataagatgactgccgtgtacgctaatatactttcagactcttactggtccgggttgggactgggctttaaattgtcaaattctgagaggaggaattgtgacaccagaaacggcagcaacaagtccgatttcgactggcatcaggacgccctgagcaaaagcctgcagcaaaacctgcctagccgctccgtatccaagccctccctgttctcaagcgtacagctctacaggcaatctagcaagatgtgcgggacagtgtttacaggcgcttctcgttttcggtgtcgtcagtgctctgctgcatacgatacactggtcgagctcacagtgcacatgaacgagacaggacactaccaggacgataatcggaaaaaggacaagctgagacccacatcttacagtaagcctaggaagcgcgcctttcaggacatggacaaggaggatgctcagaaagtgcttaaatgcatgttttgtggcgacagttttgactccttacaagatctttctgtgcatatgatcaaaactaaacactaccagaaggtgccactgaaggaacccgtgccaacaatctccagtaaaatggtgaccccagccaaaaaacgcgtgtttgacgtcaataggccgtgtagccccgattcgaccacgggatcattcgccgattcctttagctcacagaagaatgcaaaccttcagttgtccagcaacaatcgctacgggtatcagaatggagcctcttacacatggcaatttgaggcatgcaaatctcagattctgaagtgcatggaatgcggaagtagtcacgacactctccagcaattgacgacacacatgatggtcaccgggcactttctgaaagttacctcttccgcctccaaaaaaggaaagcagttagtgctggatcccctcgcagtcgagaaaatgcagtccttgagcgaagcaccaaattcggatagccttgccccaaaacccagctccaattccgcctctgactgcaccgcctccactacggaacttaagaaagaatctaaaaaagaaaggcctgaagagacatcaaaggatgagaaagtggtcaaatccgaagattacgaagatcctctgcagaaacctcttgacccaacaatcaaatatcaatatctgcgcgaggaagatctggaggacggatctaaaggtggcggagatattcttaagtcactcgaaaataccgttaccacagcgattaataaggcccagaatggcgccccatcatggtcggcctacccttctatacatgccgcctatcagctgtctgagggcactaaaccgcctctcccgatggggtcccaagtcctgcagattagacccaatctgacaaacaaactgcgacccattgcccccaagtggaaggtcatgcccctggtttccatgcctacccatttggctccatacacacaggtgaaaaaggaaagcgaagacaaggacgaagccgtgaaggagtgcgggaaggagtccccccacgaagaggctagctcattttcacattcagagggcgacagttttcggaagagtgaaaccccaccagaggcaaagaaaactgagctgggccctctgaaggaagaggagaagctgatgaaggaaggcagcgaaaaggaaaaaccccagcctctcgaaccaacctctgccctgtccaatggatgcgctctggccaatcacgctcccgctttaccttgcatcaacccactctccgccttgcagtccgtgctgaacaaccacctcggaaaagccacggagccactgcgtagtcccagctgtagtagccctagttcatctacaatctctatgtttcataagtctaacctgaatgtgatggacaaacctgtcttaagccccgcttcaactaggtcagccagtgtttcacggaggtacctgttcgagaactccgatcagcccatcgacctaacaaagtccaagtctaagaaggcagaaagttcccaggctcagtcatgtatgagtcctccgcagaagcacgccctgtccgacatcgccgacatggtaaaggtgctccctaaggctacaacacccaagcctgcctctagttcccgggtgcctcccatgaagctcgagatggatgtgcggaggttcgaagatgtttctagcgaagtgagcacactgcacaagcgtaaagggcggcagagcaactggaaccctcagcaccttcttatacttcaagcccagttcgcgtcgagtctctttcagacctcagaggggaagtacctgctctctgaccttggaccccaggagcgcatgcagataagtaagtttacgggccttagtatgaccactattagtcactggttagccaatgtgaaataccagctccggaaaacaggggggaccaagttcctgaagaatatggacaaaggtcaccccattttttattgtagcgactgcgcatcccagtttcgtaccccaagcacatatatttcacacctcgaaagccatctagggtttcagatgaaggacatgacgcggctgtctgtcgaccagcagtccaaggtggagcaagaaatcagccgcgtgtcctccgcccagaggtctccagagacgatagctgccgaggaggataccgatagtaaattcaaatgtaagctgtgttgccgcaccttcgtttcgaagcacgcagttaagctccacctcagcaagacccattctaaatcaccagagcatcatagtcagttcgtcaccgacgttgacgaagaatag

SEQ ID NO: 208272 - DNA, 3105 bp, Artificial Sequence
  Description of Artificial Sequence: Synthetic coding sequence
atgccccggcggaagcagcaggcccccaagcgggccgccggctacgcacaggaagaacagcttaaagaggaggaagagataaaagaggaagaggaagaagaggattctggaagtgtggctcagcttcagggagggaacgatactgggactgacgaagaactggaaactggtcctgaacaaaagggatgcttttcatatcagaatagtccggggtcccatctctccaatcaggacgcagaaaacgagtcactgctgagcgatgcatccgaccaggtcagcgacatcaagtccgtctgcgggagggatgcgagcgataagaaagctcacacccacgttcgcctccccaatgaggcgcataactgcatggataaaatgacggcggtgtatgccaacatcctctccgattcctattggtcagggctgggtctgggcttcaagttatcaaattccgagagaaggaactgtgataccagaaatggctccaacaagagcgactttgattggcatcaggatgcgctgtccaaaagtctccagcaaaacctcccttcccgaagcgtgtcaaaaccctctctcttctcctcagtccagctgtataggcaatccagtaaaatgtgcggcacagtttttacaggcgccagccgcttccggtgccgacagtgctccgcagcttatgacaccctcgtggaattaacggttcacatgaacgaaacaggtcactaccaggatgacaaccgtaagaaagacaaattgcgacccaccagctatagcaagccgcgtaagagagcttttcaagatatggacaaagaggatgcccagaaggttctgaagtgtatgttttgcggggatagtttcgacagcctccaggacttgtcggtgcatatgattaaaactaaacactaccagaaagtgccattaaaggagccagtacctactattagttccaaaatggtgacccccgccaagaaaagggtttttgatgtcaatcgcccatgcagtccagactccacgacagggagttttgccgactctttttcttcacagaagaatgccaacctgcaactgtccagcaataaccgctatggctaccagaacggagccagctatacttggcagtttgaggcttgtaaatctcaaatcctaaaatgtatggagtgcggatcaagccacgatactttgcagcagctgacgactcatatgatggttaccggacatttcttgaaggttacttctagtgcctccaagaaaggcaaacagctggtgctggatcctctcgccgttgagaagatgcagagcctttccgaagcccccaattccgacagcctcgccccgaagccaagcagcaattccgcctccgattgcacggcttccacaaccgagcttaagaaggagtctaagaaagaaagaccagaagaaacatctaaagatgaaaaggttgtgaaatccgaagactacgaggaccctctgcagaaacccctggatcccacaataaagtatcaatatctgagagaggaggacctcgaggatggcagcaagggaggaggagatattcttaaaagtcttgagaatactgtgactactgccatcaataaagcccagaatggagccccctcttggtccgcctatccaagtatccatgctgcgtatcagctctctgaaggaacaaagcctccgctgccaatgggcagccaagtgctacaaattcgcccaaatctcaccaataaattgcgtccaatcgccccgaagtggaaagtgatgccactcgtgagcatgcccacccacctggcgccatacacccaggtcaaaaaagaatccgaagacaaagatgaagcggtgaaagagtgcggaaaggagtccccacatgaagaggcgtcctcctttagtcactctgagggcgacagttttagaaaatctgaaaccccccctgaagcgaagaagaccgagcttggacctctcaaggaggaggaaaagctgatgaaagagggttctgagaaagagaaacctcaaccgctggaaccgacttcagctctgagtaacggctgcgccctagctaatcacgctccagctctgccctgcataaaccccctgtctgcactgcagtccgttctcaacaaccatctcggaaaagcaacagagccgctgcgctctccctcttgttcctccccttcttcatctacgatcagcatgtttcataagtccaatctcaatgttatggataaacctgtgctgagcccagcaagcaccagatcagcttccgtcagccggaggtacctgttcgaaaattccgaccagcctattgacttaactaaatctaaatccaaaaaggccgaatctagccaggcccagtcatgcatgtcaccacctcaaaaacacgctctctccgacatcgccgacatggtgaaagttctccccaaagccacgactcctaagcccgctagctccagccgggtgccaccgatgaaactcgagatggacgtacgcaggtttgaagatgtgagttctgaagtgagtaccctgcacaagcgaaaagggcgccagtcaaactggaacccacagcatctgctaatcttgcaggcccaattcgccagttcccttttccagacatccgaagggaaatacctgttgtccgatcttggcccacaggagcgtatgcagatcagcaaatttacagggctctctatgactactatctcccactggcttgctaacgtgaaatatcagctccgcaagacaggtgggacgaagttcctgaagaacatggacaaagggcatcctattttctattgttccgactgtgccagccagtttcgaacccctagtacatatatatctcatctggaatcccaccttggtttccagatgaaggatatgacccggctctctgtagaccagcagagtaaagtcgaacaagaaatctccagggtgtcatctgcccagaggtctccagaaactatagcggcggaggaggacaccgactcaaaattcaagtgcaaactatgctgcagaactttcgtgtctaaacacgcagtgaagctacatctcagcaaaactcactctaaaagcccagagcaccactcacaatttgtgactgatgtcgacgaggagtag

SEQ ID NO: 208273 - DNA, 3246 bp, Artificial Sequence
  Description of Artificial Sequence: Synthetic coding sequence
atgccccggcggaagcagcaggccccccggcgggccgccgcctacgtatctgaggaacttaaagccgctgccctggtggatgaaggtctagacccagaggagcacacggcagacggagagcctagtgctaaatacatgtgtcctgagaaggaactcgcccgggcctgtccatcataccaaaactctccagccgcagaattctcctgtcacgagatggattcagagtcacacatcagtgagactagcgataggatggcggattttgagtctggctcaattaaaaacgaggaggaaaccaaagaagtaaccgttcctctcgaggacaccaccgtctcagatagcctggaacagatgaaggcggtatataataacttcctatcaaattcatactggtccaaccttaatctgaacttgcaccagccctccagtgaaaaaaataatggaagctcctcttcttcatcaagctcaagcagcagttgcggctccgggagcttcgactggcaccagtcagccatggcaaagaccctgcagcaagttagccaatccaggatgttgcccgagccctcactgtttagcaccgtgcagctttaccggcagtcaagcaagctgtatgggtcgatatttactggtgccagtaaattcaggtgtaaagactgctctgcagcttacgataccctggtcgaattgactgtgcatatgaatgaaactgggcattatagggatgataaccacgagaccgataataataaccctaagcgctggagcaagccgaggaagaggtcactccttgagatggagggcaaggaggatgcccaaaaagttctaaagtgcatgtactgcggtcactcctttgaatccttgcaagacttgagtgttcacatgattaagaccaagcactaccagaaagtccccttgaaagaaccggtcacacctgtcgctgctaagatcatccctgccacacggaagaaggcctcactggaactggagctcccatcatctccagactcaacaggcggaacacctaaagctacgataagcgatactaacgatgccctgcagaagaactccaacccttacatcactcccaataaccggtatggccaccagaatggggcctcttatgcatggcactttgaggcccggaaatcacaaatcctgaagtgtatggagtgtggctctagccacgacaccctgcaagaattgacagcccacatgatggtcacaggccactttattaaagtcactaattcggctatgaagaaagggaaaccaatcgtcgaaactcccgtgacacccacaattaccaccttacttgatgaaaaagtgcagtcagtgccactggcagccacaacatttacttcccccagcaacaccccagccagtatcagtccaaagttgaacgtcgaagtgaagaaggaagtcgacaaggaaaaagcagtcacagacgaaaaacctaaacagaaggacaagcccggcgaggaagaagaaaagtgcgatatcagtagtaagtatcattacctgactgagaatgacctggaggaatctcccaaaggaggattagatatcctgaaatctctggaaaatacagtcacatctgccatcaataaagcccaaaacggcacaccctcatggggtggctatccctcgatccatgccgcgtatcagctgcctaatatgatgaaactgagcctgggctccagtggcaagtcaacaccgctgaagcctatgtttggcaactcggagattgttagccccaccaagaaccagactctggtctcacccccgagtagtcagacttcccccatgccaaagacaaattttcatgccatggaggagctcgtcaagaaagttactgaaaaagtggccaaggtggaagaaaaaatgaaagagccagacggtaagttgtcgccaccgaaaagagccacacccagtccatgttctagcgaggtgggagagccaatcaagatggaagctagttccgacggaggcttcaggagtcaggaaaactcccctagtccccctcgcgacggctgcaaggacgggtcccctctggcagaacctgtggagaacggcaaggaactggttaagcccctggcttcttctctctccggatcgacagcaatcatcaccgaccatcccccagagcagcctttcgtcaaccctctcagcgccctccagagtgtaatgaatattcatctgggaaaagcggcaaagccttctctacctgcactggatcccatgtccatgctgtttaagatgagcaattctctcgccgaaaaagcagcagttgctacaccccctcccctccagtcaaagaaagcggatcatctcgatagatacttttaccatgtcaataatgatcaacccattgacttaaccaaaggcaagtccgacaagggatgcagtctcgggagcgtactgctatctccaacaagcacagctccagcaaccagctccagtaccgttactactgcaaagacaagtgctgtggtgtcatttatgtcaaatagcccgttgcgggagaatgccttgtccgacatctctgacatgctgaagaatctaaccgagtctcacacatccaaaagctctaccccgagcagcattagcgagaaatcggatatagacggggccaccttagaggaggccgaggaatctacaccagctcagaaacggaagggacgccagtcaaactggaaccctcagcatttgctcatccttcaggcacagtttgcagcctctttgcggcagacatcagaggggaagtacattatgtcagatctgagcccccaggaacgcatgcacatcagtaggttcacagggttgtcaatgactactataagtcactggctggctaacgtgaagtatcagcttcgtcgaaccgggggcacaaaattcctgaagaaccttgacaccgggcaccctgtattcttttgcaacgactgtgcttcccagattaggacaccttcaacatacatttcccacttagagtcccatttaggcttccgtctgcgggacctgtcaaagttatccacggagcagattaattcccaaatcgcccagacaaagtccccttctgagaagatggtgactagctccccggaagaggatctgggtactagctatcagtgcaaattgtgcaaccgcaccttcgcttcgaaacatgctgtcaagcttcatctatcaaaaacgcatggaaagagtcccgaagaccacctactatacgtctctgagctagagaagcagtag

SEQ ID NO: 208274 - DNA, 1896 bp, Artificial Sequence
  Description of Artificial Sequence: Synthetic coding sequence
atgaacttcaacaccatcctggaggagatcctgatcaagcggagccagcaaaaaaagaagacgagtcctctgaattacaaggaacgactatttgttctcactaagtcaatgctgacgtactatgaagggcgtgcagagaagaagtataggaagggattcatcgatgtctcaaagatcaagtgcgttgagatagtaaagaatgacgacggtgtcattccctgccagaacaagtaccccttccaggtagtgcatgacgctaatactctgtatatcttcgcaccgagcccccagagcagagatttatgggtgaaaaaactaaaagaggagattaagaacaataataacattatgatcaagtaccatcccaagttctggaccgacgggagttaccagtgctgccgtcagactgagaagctggcacctggttgcgagaagtataatcttttcgagtctagcattcggaaggccctccctcccgcacctgaaaccaaaaaaagacgccccccgcctccaatccctctcgaagaagaggataactccgaggaaatcgtcgtcgctatgtatgactttcaggccgccgagggccacgatctgcgcttggagcgcggtcaagaatatctgatcctggaaaagaatgacgttcactggtggagggcccgtgataagtacggaaatgagggatacataccctcgaattacgtcactgggaaaaaatccaataatcttgatcaatacgaatggtactgccgcaatatgaataggagcaaagctgagcagctcctgagatctgaagataaggagggtggtttcatggtgagggattcctcccagcctgggttgtacaccgtttctctctacacaaaatttggaggggaggggtcctcaggattcagacattaccatatcaaggagacaaccacatcacccaaaaagtattacctcgctgaaaaacacgcgttcggatcaattcctgaaatcattgagtaccacaaacacaacgcagctggattggtcactcggctgcggtatcccgtgagcgttaagggaaaaaacgcccccaccacagctggattctcgtatgagaagtgggagattaacccaagcgaactgacatttatgagagagctcggctccggactctttggagttgtgcgactgggcaaatggagagctcagtacaaggtggcaattaaggcaataagagaaggggccatgtgcgaagaggatttcattgaggaggccaaagtcatgatgaaacttacccacccaaaactggtccagttgtacggtgtgtgcacacaacagaagcctatctacatcgtgacggagtttatggaacgggggtgtcttttgaactttcttcgacagaggcaaggacatttttcccgggacgttctgctaagtatgtgccaggatgtctgtgaggggatggaatatttggagcgtaacagtttcattcatcgcgatctcgcagcgagaaactgcttggtgtcagaggcgggtgtggtcaaggtgagcgacttcggcatggctaggtatgttctggacgatcaatacacatcatccagcggagccaagttccccgtcaagtggtgtcctccagaggttttcaactacagcaggttttcatctaagtcggacgtctggtcctttggggtgctcatgtgggaggtatttacggaggggcgcatgcccttcgaaaaatatactaattacgaggtggtgacgatggttacccggggtcatcggctgtaccagccaaagctggcatcgaattatgtgtatgaagtaatgcttcgatgttggcaggaaaagcccgaagggagaccctcattcgaggacctcttgcggacaattgacgaactcgtcgagtgcgaagaaactttcggacgatag

SEQ ID NO: 208275 - DNA, 2094 bp, Artificial Sequence
  Description of Artificial Sequence: Synthetic coding sequence
atgggcttccagccccccgccgccctgctgctgcggctgttcctgcttcaagggatactgcgcctgctgtggggggacttggctttcataccacctttcataaggatgtctgggccagccgtctccgccagtctggtgggagatacagagggtgtcactgtttcccttgcagtcctgcaggacgaggcaggtattctgcctatcccaacctgtggagtcctgaacaacgagaccgaggactggtccgtcacggtcataccgggagccaaagtacttgaggtcaccgttcggtggaagagagggttggactggtgctctagtaatgagaccgactcttttagtgaatccccttgcatcctccaaacactgcttgtatcagcttcccataatagttcatgttcagctcaccttcttattcaagtcgaaatctatgcaaacagctcacttacacacaatgcctccgaaaacgtcaccgtcatccctaaccaggtctaccagcctctgggcccatgtccgtgtaatctgaccgcgggtgcatgtgatgtgcgttgctgttgcgaccaggaatgctcttccaacctgactacactttttcggaggagctgctttaccggcgtgttcggaggcgatgtaaaccctccattcgaccagctgtgttccgcagggactaccacaagaggggtcccagattggttccctttcctttgtgttcagtcaccactggctaatacgccttttctcgggtacttctatcacggtgccgtgtcccccaaacaggatagctcttttgaagtctatgtggataccgacgccaaagactttgcggacttcggctacaaacagggcgaccccatcatgacggtaaaaaaggcctactttaccatcccacaggtgagcttagccggccagtgtatgcagaatgcaccagtcgccttcctccataacttcgacgttaaatgcgttaccaatctggaactatatcaggaaagggatgggattatcaatgccaagattaaaaatgttgccctcggcgggatagtgacacccaaagttatatacgaggaggcaactgacctcgataaatttatcaccaacaccgagaccccccttaacaacgggtctaccccccgcatcgtaaacgtggaggagcattatattttcaagtggaataacaacactataagcgaaatcaatgtgaagattttccgagctgagattaacgcgcaccagaaaggtatcatgacacagcgcttcgttgtgaagtttttgtcttacaatagtggtaacgaagaggagctgagcggcaatccgggataccagctcggtaagcccgtgcgcgcactgaatataaataggatgaataacgttactaccttgcacttgtggcagtccgcaggtcgcggcctatgcacatccgccactttcaaaccaatccttttcggcgaaaatgtgctgagcggttgcctgcttgaggtcggtatcaatgagaattgcacccagctacgcgagaacgccgtggagagattggactctctaatccaagccacacatgtcgctatgaggggaaatagcgattatgccgacctgagtgacgggtggctggagatcattcgtgtggacgcgcctgatccaggcgcagacccccttgctagcagtgtcaacgggatgtgcttggatatcccggcacacctgtcaattcgtatactgatctctgacgccggcgccgtggaggggatcacgcagcaggaaattttgggtgtggagactaggttctcctctgttaattggcaataccaatgcggactgacttgtgaacataaggctgacctccttccgatatccgccagcgtgcagtttattaagattccagcacagctgccacaccctttgactcggttccaaattaattacactgaatacgattgcaacagaaacgaggtctgctggccacagttactgtatccatggacacagtactaccagggcgaacttcattcacaatgcgtggcaaagggcctgcttttgctgctgtttcttacactggccctgttcttgtccaatccatggacgcggatctgtaaagcctacagttag

SEQ ID NO: 208276 - DNA, 2091 bp, Artificial Sequence
  Description of Artificial Sequence: Synthetic coding sequence
atgggcttccagccccccgccgccctgctgctgcggctgttcctgctccagggcatcctcagattactgtggggtgacctcgcctttatcccccctttcatccgaatgtcgggacctgccgttagcgcttctctcgtgggcgacaccgagggagtaaccgtttccctcgccgtcctccaggacgaagcaggaatcttacccatcccgacatgcggtgtacttaacaatgagacggaggactggagtgttaccgtgatccccggggcggtcctggaggtcacagtaaggtggaaacgaggcttagattggtgtagctctaacgagaccgacagcttctccgaatccccatgcatcctccagaccctgctggtgagtgcatcacataattcctcttgctccgcgcatctattgatccaggtggagatctatgcaaactccagcttaacacacaacgcttccgagaacgtcaccgttattcccaaccaggtttatcagcccctgggaccctgcccctgcaatctgaccgcgggcgcatgtgacgtgcgctgctgttgcgaccaggaatgctcctctaacctaaccactctttttaggagatcatgtttcacaggtgtttttggaggagacgtcaaccccccatttgatcagctctgttcagccggtactacaaccagaggcgttccagactggtttcctttcttatgtgtccaatccccactggccaacactccattccttgggtacttctaccacggagctgtttctcccaaacaggactcttcgtttgaagtgtacgtcgacacggatgcgaaggacttcgctgacttcgggtacaagcagggtgaccctattatgacggtgaaaaaggcctactttactattcctcaggtgagtctggccggccagtgcatgcagaacgcaccagtggcctttctgcataattttgacgtcaaatgcgtgaccaatctggagctgtatcaagaacgagacggaatcattaatgcaaaaatcaagaacgtcgcgctcgggggcatcgtcactcccaaagtgatctatgaagaggcgactgacttggacaagttcatcactaacaccgaaactcccctgaacaacggcagtacgccgcgcattgttaacgtcgaagaacactatattttcaagtggaataataacactattagtgaaatcaatgttaaaatcttccgggccgagatcaatgcacatcaaaagggcatcatgacccaacggttcgtggtgaagtttctctcatataactccggcaacgaggaagagctgagtggcaacccagggtaccagctaggaaagcccgtccgtgccctaaacatcaatagaatgaataacgtgactacgctgcatctctggcaatccgccggccgcggactatgtaccagcgcaacattcaaacctattctattcggagaaaatgttttatctggatgtctgcttgaggtgggtattaatgaaaactgtacccagctgagggagaacgctgtggagcgcctggactcactcattcaggccacccacgtagcaatgcgggggaatagtgactatgccgacctgagcgatggatggttggagattattagggtggacgctccggacccgggcgcagacccattggcttcttcggttaacgggatgtgtctggacatccctgcacatctctcaatccgcatcctcatttctgatgcgggagccgttgaaggaatcacgcaacaagaaatcctcggcgtggaaacacggttcagttccgtgaactggcagtatcaatgcggtcttacttgcgaacacaaagccgacctgttacccatctcagcctccgtccagtttattaaaattcccgcccagctgccacacccactgaccaggttccagatcaactacacagagtacgactgcaaccggaatgaggtctgctggccccagcttttgtacccatggacgcagtactaccagggggagctgcactcccagtgcgtggctaaagggctgctgcttttgctgttcctgaccctggccctgtttctgtccaacccatggacacgcatctgtaaggcttattcatag

SEQ ID NO: 208277 - DNA, 1824 bp, Artificial Sequence
  Description of Artificial Sequence: Synthetic coding sequence
atgcggaccccccagctggccctgctgcaggtgttcttcctggtgtttcccgatggcgtgcggccgcagccttcatctagcccctcgggcgcagtccccacatctctcgaacttcagcgtggaacagacggcggaacacttcaaagccctagtgaagccactgccacccggccagccgtgccggggctgccgacagttgtgcccactctggtgacaccgtccgcccccggcaataggaccgtcgacctgtttccagtcttacctatttgcgtgtgtgacttaacacccggcgcctgtgacatcaattgctgttgcgacagagactgttacctactgcacccaagaacggtgtttagcttttgtctgcctggcagcgttaggtcgtcctcatgggtgtgcgtggataattcagtaatatttcgtagcaacagcccgtttccaagccgcgtcttcatggactccaacggcattagacagttttgtgtgcatgtcaacaattccaaccttaactatttccaaaaactgcagaaagtaaacgctacaaacttccaggccttagcagccgagttcggtggcgaaagcttcacgtccacattccagacacagtcacccccttccttttacagggctggcgaccccatccttacctactttccgaaatggtcagttatcagtctcctccggcagccagccggcgtgggggccgggggcctttgtgcagagtctaatccagcgggcttcctggaaagtaagtcaactacctgcacccgtttcttcaaaaatctcgcttcttcatgcactctggatagtgccctgaacgctgcatcttattataacttcacagtgcttaaggtccctcgctctatgacagatccacaaaatatggagtttcaagtcccagtgatcttgacgtctcaggccaatgctccattgcttgccggaaatacctgtcaaaatgtggtctctcaagtgacctatgaaatcgaaacaaatggaacattcggtattcagaaagttagtgtctccctggggcagacaaaccttactgttgaaccaggagcttccctgcagcagcattttattctccggtttagggcttttcagcaatcaaccgccgcgagtttgactagtcctagatcgggaaatcccggctatattgtgggaaagcctctgctcgctttgacagacgatatcagctatagcatgacactcctccagagtcagggtaatggttcgtgcagcgttaagcggcatgaggttcagttcggcgtaaacgccatttccggatgtaagctgcgactgaaaaaagccgactgcagccacttgcagcaagagatttaccaaacgctgcacggcagaccacgccctgagtacgtagccatttttgggaatgccgatcctgctcaaaaaggcggatggacaaggattctcaaccggcattgctctatttccgccatcaactgcacctcctgctgtctgattccagtgtctttagagatacaggtgttgtgggcgtatgtcggcctgctgagcaatcctcaggcacacgtgtccggtgtccgtttcttgtatcagtgtcaatccatacaggattcccaacaggtgaccgaggtgagcttgacaactctcgtgaacttcgttgacatcacacagaagcctcagccacccagagggcagcccaaaatggactggaagtggccatttgatttctttccgtttaaagtcgccttttccagaggagtgtttagtcagaaatgttccgtgagccccatcctgatcttgtgcctcctgcttctgggcgtcctgaatctcgagacaatgtag

SEQ ID NO: 208278 - DNA, 1290 bp, Artificial Sequence
  Description of Artificial Sequence: Synthetic coding sequence
atggacagcaacggcatccggcagttctgcgtgcacgtgaacaactcgaatctgaattattttcaaaaactacaaaaggttaacgccacaaattttcaggccttggccgccgagttcgggggagaaagcttcacaagtaccttccagacacagagcccacccagcttttatagagcaggggatcccattctgacttacttccccaagtggagtgtgatcagtttactccgccagcccgcaggtgttggcgctggcgggctttgcgcagaatccaaccctgccgggtttttagagagcaaatcaaccacgtgtactcgattttttaaaaatctggcaagttcttgcacgcttgacagtgccttgaatgccgccagctactataattttacagtgctgaaggtgccgagatctatgacggaccctcagaatatggaggttacgtacgaaatagagactaatggtacatttgggattcagaaggtttccgtttcactcggccagaccaacttaaccgtggagcccggagcgtctttgcaacagcatttcatacttagatttcgcgcgtttcagcaatcaaccgccgcctcgctgacctcaccccggagcggcaaccccggctatattgtaggtaagccgctgctggctttgacagacgatatctcttattctatgacgctgttgcagtcccagggtaacggaagctgtagtgtgaaaaggcacgaggtgcaattcggagtgaatgcaatttccggctgtaaactgagactgaagaaagctgattgtagtcacctacagcaggaaatttaccagaccctccacgggcgccctaggcctgagtatgttgccattttcggtaatgcggaccccgctcagaagggaggatggacgcgaattttgaacaggcactgttctatctctgctataaactgtactagctgttgtttaatcccagtgtcactggaaattcaggtcctgtgggcttacgtaggactgctctcaaatcctcaggcgcacgtgagtggcgtccgttttttgtaccaatgccagtccatccaagattcacagcaggttacagaagtgtcgcttaccaccctggttaattttgtcgatatcacacaaaaaccacaacctcctagaggacaaccaaaaatggactggaagtggccttttgacttcttccctttcaaagtcgctttcagcagaggcgtgttcagtcagaaatgcagtgtgtcacccatcctcatcctgtgtttattgctcctgggggtgctgaacctcgagactatgtag

SEQ ID NO: 208279 - DNA, 1332 bp, Artificial Sequence
  Description of Artificial Sequence: Synthetic coding sequence
atgcggaccccccagctggccctgctgcaggtgttcttcctggtgttccccgatggagtgcggccacagccgagtagtagtccatctggggcagtcccaacatctctagaactgcagagaggtaccgacggtggtaccttgcagagcccatcagaagcaaccgcaacccggcctgctgtaccaggcctgcctaccgttgtccccaccctggtgacaccctccgcacccggaaatagaaccgtggacctcttccccgtgttgcccatctgtgtgtgtgaccttactccaggcgcatgcgatataaactgctgttgcgatcgtgattgttacctgctgcatccacggacggtgttttccttttgcctgcctggctctgtcaggtcttcttcttgggtgtgcgtggacaacagcgtcatcttcagaagtaattcccccttcccatcgagagttttcatggacagcaatggcatccgccagttctgtgtccacgtgaataattctaacctcaattattttcagaagctacaaaaggtgaatgctactaatttccaggcactggccgccgagttcggtggagagagtttcacaagcaccttccagacccagtctccgccctccttttatcgggctggcgaccccatcctcacctatttccccaagtggagcgtgatatcgttgctacggcagccggccggtgtcggggcgggaggcctctgcgccgagagcaaccccgctgggttcctggagagcaagtcaacaacatgcacccgctttttcaagaacctcgcttcgagctgcaccttggactcggccctgaatgccgcctcttattataactttactgtgctaaaggtaccccgaagcatgacggacccccagaatatggaatttcaggtccccgttatcctgacatcacaggccaacgctccactgcttgcgggcaacacctgtcagaacgttgtcagccaggtgacatatgagattgaaacaaatggcactttcggtatccagaaggtctcggtaagtctcggccagacaaacttgacagtggaacccggggcctctctccaacagcatttcattctgcggtttcgggcctttcaacagtccaccgcagcctctctgacatcaccgcgatcagggaacccaggatacattgttggaaagccccttcttgcgcttaccgatgacatttcgtacagcgtgtcctttctggagttggggggcctgttgcagcctaatgagaagagctgtaagggctttcagacttacgtgaggctggctaagggcgaggagttcttcgtgcactacaatgaagtgttaatttactag

SEQ ID NO: 208280 - DNA, 1878 bp, Artificial Sequence
  Description of Artificial Sequence: Synthetic coding sequence
atgcggctggagaccgccgaggcctacgtgggccccggcggccccgaatgcccaatgagaaccccacagctggcactcctgcaggtgttcttcctcgtatttcctgacggagtacggccacagccttccagcagcccgagcggagctgttcctaccagcttggagctgcagagagggaccgacggagggaccttgcagagcccctccgaggcaaccgcaacgcgccccgcagtccccgggctaccgaccgtggtgcccactctggtgacgccctcagccccaggaaacaggacagtggatctgttccctgtgttgcctatatgtgtatgcgatcttactcccggggcctgtgacatcaattgctgctgcgaccgcgactgctaccttcttcacccacggacggtgttctctttttgccttccaggatcagtgcgatcctccagttgggtgtgcgttgacaacagcgtgatatttcgctccaactcaccttttccatctcgagtttttatggactccaacggcattcgacagttctgcgtgcacgtgaataattcgaacctaaactattttcagaagcttcagaaagtgaatgcgactaacttccaagctctcgcagccgaatttggtggtgagtcctttacctcaacctttcagactcagagtcctccatcattttacagagctggcgacccaatactgacgtactttcctaaatggagtgtcatatctctgctgagacagcctgcgggagtgggtgcaggcgggttatgcgcggaatctaatccagccggattcctagagtccaaatcaacaacctgtacaaggtttttcaagaatttagccagtagttgcactctggactccgctcttaatgctgcctcatattacaattttaccgtgctcaaagttcccagatccatgactgatccacaaaacatggagttccaggttccagtcattctgaccagccaggcaaatgcccctctgctcgccggaaatacatgtcagaacgtagtaagccaagttacttatgaaatagagaccaacggcactttcgggatccagaaggtgagcgtttctcttggccagaccaatctcaccgttgaaccaggggcttcactgcagcagcacttcatattgcggttccgggcttttcagcagagcacggccgcaagccttacaagtcctcgatcgggcaatcccggctacatagtgggcaaaccactgctggcattgaccgatgacataagctatagtatgactttgctgcagtcccagggtaatggatcctgctccgtaaaacgccatgaggttcaatttggggtaaatgcaatctcaggttgtaagcttagattgaagaaggcagattgttcccatctccagcaagaaatataccagacactgcacgggcgtccccggccggaatacgtggctattttcggaaacgccgatccggcccagaaaggcggctggactagaatcttaaacaggcattgctcaatttccgcgattaattgcacttcttgttgcctgattcccgtttctctggaaatccaggtgctgtgggcatatgtgggcttgctctccaacccccaagctcatgtgagcggtgtgagatttctgtaccaatgtcaaagcatacaggattcccagcaggtcacagaagtgagtttgaccactctggtgaactttgttgacatcacccagaaacctcaacccccacgtgggcagcctaaaatggactggaaatggccgttcgacttcttcccatttaaagtagctttctctcgcggtgtcttctctcagaaatgctccgtgagcccaatactcattctgtgcttgctgttacttggcgtgctgaatcttgagactatgtag

SEQ ID NO: 208281 - DNA, 1380 bp, Artificial Sequence
  Description of Artificial Sequence: Synthetic coding sequence
atgcggaccccccagctggccctgctgcaggtgttcttcctggtgtttccggatggcgttcgaccccagcctagttccagtccttcaggggccgtccccactagtttagaactgcagcgggggacggatgggggcacgttgcagtcaccatctgaagccaccgctaccagacccgccgtccccggtcttccaaccgtggtcccaacactcgtcactccgagcgctcctgggaaccggaccgttgatttgtttccagttctccccatttgcgtgtgtgatctcacccctggtgcttgcgatattaactgctgctgcgacagagattgctatctactccatccaaggactgtgttttcattctgtttgcctggaagtgtccggtcatccagttgggtctgcgtcgacaactctgtcatctttcgaagtaattcaccctttccgtcacgtgtgtttatggattccaatgggatcaggcagttttgcgttcacgtcaacaactgctttctggaatccaagagcacaacctgtactcggttcttcaaaaatctggcaagctcctgtacccttgatagcgcactgaacgctgctagttattacaacttcacagttctgaaggtgcctcgctccatgacagacccacagaacatggaagccttccaacagtcaactgccgcctccctgacctcccctcgttccggaaaccccgggtatatcgtgggaaaaccgctcctcgcactgacagatgatataagttactccatgaccctgctgcagagtcagggaaacggcagctgctctgtcaagagacatgaagtacagtttggggttaacgctatatctggctgtaaactccgcctaaagaaagccgattgctcgcatcttcaacaggagatctaccagactctgcatgggaggccccggcctgaatatgtcgctatcttcggtaatgcggatccagctcagaagggtgggtggactaggatcctgaacaggcactgctccatctctgcaatcaactgtacatcctgctgcctaattcctgtcagcctagagatacaggtgctctgggcctacgtaggccttctttcaaaccctcaggcccacgtgtccggagtgaggttcctctaccaatgccagtctatacaggatagccagcaggtgactgaggtctccctcaccaccctggttaattttgtggatataacgcagaagccacagccgcctaggggtcagccaaaaatggactggaagtggcctttcgactttttcccatttaaggtcgcattctcaaggggagtgtttagccaaaaatgcagcgtcagtccaatcttaattctgtgcctgctcctgctgggtgtcctgaaccttgagacaatgtag

SEQ ID NO: 208282 - DNA, 6468 bp, Artificial Sequence
  Description of Artificial Sequence: Synthetic coding sequence
atgaactacagcagcttcctgcggatctgggtgagcttcatcttcgccttggtgcagcaccaggcgcagccacgggagcttatgtatcccttctggcaaaacgacaccaagacaccgaaggttgacgatgggtcctcctctgagataaaactggccatccctgtcttctttttcggagtaccctacagaacagtctacgtaaacaacaacggcgtggtgagttttaatgtgctcgtttcccaattcactcctgagagctttcctcttacagacgggcgggcatttgtggccccattctgggctgacgtgcacaatggtattagaggagaaatatactatcgcgaaactatggagccggcgatattgaaacgcgcaaccaaggatattcgtaagtacttcaaagacatggcaaccttttccgccacatgggttttcatcgtgacctgggaggaggttactttctatggaggcagttccaccactcccgtgaacacgttccaggcagttttagtcagcgatggcagttacactttcacacttttcaactattatgaaatcaactggaccactggcactgccagcggcggtgaccccctcaccgggctgggtggagttatggcacaggcaggcttcaacggaggcaatctgactaacttcttcagtctgcctgggagccggacccccgagatcgtgaacatacaggagactacaaatgttaatgtgcccggacgctgggcttttaaggtggacggaaaagaaatcgatcctgctaacggctgcacaagcaggggccagttcctgcgacgcggcgaagtgttctgggatgatctcaactgtaccgtgaaatgcagatgcctcgacttcaacaacgaaatttattgccaggaggccagctgcagcccatacgaggtgtgtgaaccaaaaggaaagtttttctattgctctgctgtggagaccagcacctgtgttgtttttggtgaaccacattaccacaccttcgacggcttcctgtttcacttccaaggatcctgtgcttacctcctggcgagacagtgtttgcaaacctctagtctgccctttttcagcgttgaggcgaagaacgagcatcggcgcgggagcgctgtgtcatgggtaaaagagctgagtgtagaggtgaacggctataaaatcctaatccccaagggatcgtatggcagagttaaggttaatgatcttgtcacatcccttcctgtgactcttgatttgggaactgtaaagatataccagagcggtatctcaactgccgtggagaccgactttggcctactggtaactttcgatggacaacattatgccagtatctctgtgccgggttcctatattaacagtacgtgtggcctttgtggtaattataataagaaccctctggacgattttctgcgccccgatggtagacccgcaatgtcagtactcgatctgggagaatcatggagagtctatcacgcggactggaaatgcgacagtgggtgcgtggataactgtacacagtgcgacgcagccaccgaggcactgtattttggcagcgattactgtggctttctgaacaagacggacggccctctctgggaatgtggtacagttgtggatcccacagcctttgtccactcttgtgtgtatgacctgtgcagtgtacgggataacggtactttgctgtgccaggccatccaggcatatgcattggtgtgtcaggcattaggcataccaatcggtgactggcggactcagactggttgtgttagtacggttcaatgcccatccttctctcattactcggtgtgcacaagctcctgccctgatacctgctctgatcttactgcaagccgcaattgtgctaccccgtgtaccgaagggtgcgagtgtaaccaggggttcgtgctgagtacaagccaatgcgttcccttgcacaagtgcggctgtgattttgacggacactactacaccatgggcgagttcttttgggccacagcaaattgtaccgtgcagtgtctgtgcgaggagggaggggacgtgtattgctttaataagacatgtggatctggcgaggtgtgtgctgtggaggatggctaccagggctgtttccccaagcgagagacggtctgcttactgagccagaatcaagtcctgcatacatttgatggggcttcgtacgcattcccttctgaattctcttacaccttgctcaagacctgccctgaaagacccgaatacctggagattgatattaacaagaagaagccagatgcgggccctgcgtggctcagagggcttcgtattctagtggccgaccaggaagtgaagatcggaggaatcggggccagcgaagtgaaactgaatggtcaagaggtcgaacttccctttttccacccatccggcaaactcgagatctaccggaataagaacagtacaactgtggagagcaaaggagtagtcactgtgcaatatagtgatattggactcctctacatcagactctctacgacctatttcaactgtacaggcggattgtgcggtttttacaatgcaaacgcatccgatgagttctgcctgccaaacggcaaatgcaccgacaatctcgctgtcttcctcgagagttggacaaccttcgaggaaatttgcaacggagagtgcggcgacctcttgaaggcctgtaacaatgactccgaactgcttaaattctatcggagccgcagccggtgcggcattatcaacgatccatctaattcaagctttcttgaatgtcacggtgtggtaaatgtgaccgcatattatcggacatgcctgtttaggctgtgtcagagtggggggaatgagtccgagctgtgcgacagcgtggccagatatgccagcgcctgtaaaaatgctgatgtggaggtgggcccgtggaggacctatgatttttgtcctctcgagtgtcccgaaaactctcactttgaggagtgcatcacgtgtactgagacctgcgagacccttactctgggcccaatctgtgtggatagttgctcagaaggctgccaatgcgatgaggggtacgccctcctggggtcccaatgcgtgacccgatctgaatgcggatgcaatttcgaaggtcatcagctggccaccaatgaaactttctgggtcgatcttgattgccagattttctgttattgctctggaactgacaatagggttcattgtgagacaatcccctgcaaggatgacgaatactgcatggaagaggggggtttgtactattgccaggccagaacagacgccagctgtatcgtgtccgggtacggacattatctgacctttgacgggttccccttcgattttcagacaagctgtcctctgattctttgcaccacaggcagccgaccctccagtgatagctttccaaaattcgttgtcacggcaaaaaacgaggacagagatccatcgctggcactttgggtcaaacaggtcgatgtaaccgtgttcggctatagcatcgtaattcatagggcatataaacatacagtgttagtcaactccgaaaggctttatctgccactgaagttgggtcaaggtaagattaacattttttcctttgggttccatgttgtcgtcgaaactgacttcggcctgaaggtggtgtacgattggaagaccttcttaagcattacggtgccgcggtctatgcaaaattcaacttatggtctttgtggccgatacaatggcaatcctgacgatgatttggaaatgccgatgggcctgttggcctcttctgtcaatgagttcggacaaagttgggtcaagcgtgacaccttctgtcaggtggggtgcggggaccgttgtccctcatgcgccaaggtggagggcttttctaaagtccagcagctgtgctctctgataccaaaccagaacgctgcattcagcaagtgtcacagcaaagtgaatccaacctttttctacaaaaactgtctgttcgactcttgtatcgatggaggcgcagtccaaaccgcttgtagctggctacagaattatgccagtacctgtcagacccagggcatcactgtgacgggctggcgcaactatacgtcctgcacagtgacctgcccccccaactcccactatgagtcatgtgttagtgtctgccagccccgctgcgccgccattagattgaagtctgattgctcccattactgcgtcgaaggctgtcactgtgacgccgggtacgtcctcaacggtaagtcttgtatcctgccacacagctgcggatgctactccgacgggaagtactatgagccaaagcagttgttttggaatagcgactgtactagaagatgtcgttgtttccggcgcaatgtgatacaatgcgacccgcggcagtgtaaatcagatgaagagtgcgcactaagaaacggggtgcgcggttgtttctccaccaaaacatcatactgcctggcagccggcggaggtgttttccggactttcgatggtgctttcctgaggttcccagccaactgtgcctttgtcctctccaccatctgccagaagttgcctgatatctcctttcagctcatcatcaactttgataagtggagtgctccaaatctcacaatcatctcccctgtttatttctacataaatgaggagcagattctgataaacgaccggaacacggtgaaagtcaatggcactcaggtcaacgtgccattcatcacaggcctggctaccaaaatatattcatccgagggcttccttgtaatcgatacaagccctgatatccagatatactataatggctttaatgttatcaagatatccataagcgagcgtttgcagaacaaggtttgcggtttgtgtggcaacttcaatggggaccttaccgatgactacgtgactctacgtggaaaacctgtggtgagtagcgttgtgctggcccagagttggaaaaccaatggtatgcagaagcggcctcttgcacctagctgtaacgaactccagtttagccagtacgccgcgatgtgtgataatgtgcacatccagaagatgcagggggacggctactgcctgaagttaactgatatgaaggggttcttccaaccctgttacggactgcttgatcctttacccttctatgaatcttgttatctagacgggtgttacagtcacaaaaaatttcagctctgcggttccctagctgcctatggagaagcctgtaggagctttggcattctgtctactgaatggattgagaaagagaattgtagcggagtcgtggaagacccttgcgtgggggccgactgccccaatcggacatgcgaactcggcaacggaagagaactgtgcggatgcatagaaccgccaccttacggcaataacagccatgatatcattgatgcagaagttacctgcaaagcggcacagatggaggtctccatcagtaaatgcaaactttttcagcttggttttgaacgtgagggagtgcgcattaatgacagacaatgcacagggatcgaaggtgaggactttatttcttttcagatcaataatacaaagggcaactgcggaaatatcgttcaatccaatggaacgcacattatgtacaagaacaccctctggatcgagagtgccaataacaccggaaacatcattacccgagatcgaacaataaatgttgaattctcttgcgcctacgagctggacattaaaatttcgcttgatagcgtcgttaagcccatgctgagcgtcatcaacttaaccgttcctacccaggaaggcagttttatcacaaaaatggccctgtataagaacgcaagttataaacatccataccgtcagggagaggtcgtattgacaactcgggacgtgctatatgtcggagtgtttgtcgtaggggctgacgccacgcacctcatactcacacttaataaatgctacgctaccccaacacgtgattccaacgacaaactgcgttattttataattgaaggcggctgtcagaacttgaaagataatacaatcggaattgaagagaatgcggtcagcttgacatgtaggtttcacgtgaccgttttcaaattcattggggactatgacgaggtccacctccactgcgccgtgagcttatgtgattccgaaaaatactcctgcaaaatcacgtgtccacataatagtcggattgcaaccgattacactaaagaacccaaagagcagatcattagcgtaggaccgattcggagaaaacgccttgactggtgcgaggacaacggcggatgcgaacagatttgtacatctcgcgttgatggacccttatgcagctgtgtgacaggaacactgcaggaagacggcaaaagctgccgcgctagtaacagctcgatggaacttcaggtatggaccctgctcctcatcatgatccaaatctctctctggcacttcgtttataaaagtgggacgacgtcctag

SEQ ID NO: 208283 - DNA, 6468 bp, Artificial Sequence
  Description of Artificial Sequence: Synthetic coding sequence
atgaactacagcagcttcctgcggatctgggtgagcttcatcttcgcattggtccagcaccaggctcagcctagagagcttatgtatccgttttggcagaatgacactaaaaccccaaaagtggacgatgggagttcgtccgaaatcaaacttgctatccccgtgtttttcttcggtgtgccttatagaactgtgtatgtcaacaacaatggagttgtgtcttttaacgtgctggtatcgcagttcactccagagtcttttcctctgactgatggacgcgcgtttgtcgctcccttctgggctgacgtccacaacgggatccggggtgagatctactacagagagaccatggaacctgctattctgaagagagccaccaaagacatacgcaagtattttaaagatatggctaccttctccgcaacctgggtgttcatcgtgacatgggaggaagtcaccttctacggcgggtctagcaccactcctgtgaatacgtttcaggccgtgttggttagcgacggatcctacacattcactctgttcaactactatgaaataaattggacgacaggcaccgcctctggcggggacccactgactggcctcggcggagtgatggcacaggcaggttttaacggagggaaccttactaacttcttcagtctcccgggatccaggacacccgagattgttaacattcaggaaactacaaatgtgaacgtccccggtaggtgggcgtttaaggtggacgggaaagaaattgacccggccaatggctgtacctcccgcgggcagtttctccggcgcggagaggttttctgggacgatcttaattgtaccgtgaagtgtagatgtctggactttaataacgagatttactgccaggaggccagctgttctccatacgaggtgtgtgaaccaaagggaaagttcttctactgctctgctgtcgaaacgagtacctgcgtagtgttcggagaaccacactaccacaccttcgacggatttttgttccattttcagggcagctgcgcatatctattagccagacaatgccttcagacaagctctctgcccttcttctctgtggaggccaaaaacgaacaccgccgagggtctgcagtgtcatgggtgaaggaactttccgtggaagtgaatggctacaagatccttatcccgaaagggagctatgggcgcgtgaaggtaaacgacctggtgactagcctgcccgttaccctggatctgggcactgtgaagatataccaatccggtatctcgactgctgtagagacagatttcgggctcctggttacttttgacggacagcactacgcatctatatccgtcccagggagttatataaacagcacctgcggcttgtgcggtaactacaataaaaatcctctggatgactttcttcgaccggatggacgaccggccatgtccgtgctggacctgggggaaagctggcgggtttatcacgcagactggaagtgcgactctggttgtgtggacaactgcacccagtgcgacgcagcaactgaggctttgtattttggttccgattactgtggtttcttgaataagactgatgggcccctttgggagtgcggaaccgtggttgaccctactgcctttgtgcattcctgcgtgtacgatctgtgttccgtgagagataacgggactctgctttgccaagctattcaagcatacgcacttgtctgccaggccctagggatccctatcggtgactggagaacccagaccgggtgtgttagtactgtgcagtgtccgtcgttctctcactacagcgtgtgtacctctagttgccctgacacctgctcagatttaaccgcttcacggaactgtgccaccccatgcaccgagggttgcgagtgtaatcagggatttgtcctgagcaccagccagtgtgttcccctgcataaatgcggatgtgactttgacggccattattacaccatgggcgagttcttttgggctacagctaactgtacagtgcagtgtctttgcgaagagggaggggatgtttactgttttaataagacatgcggctccggggaagtctgcgctgtggaagacggctatcaggggtgcttccccaagagagaaacagtatgcctcttgagccagaatcaagtcctgcacactttcgatggggcgtcttatgccttcccatcagaattctcctacaccctccttaaaacttgtccagagcgacccgagtacctcgagatagacattaacaagaaaaagcccgacgccgggccagcttggcttcggggcctgaggatcttggtggccgaccaggaagtcaaaatcgggggcatcggtgcgtcagaagtcaagctgaacgggcaggaagtcgagctgcctttctttcatcccagcggcaagcttgagatatacagaaataagaactccacaacagtggagagcaaaggcgtagtcactgtacaatattctgatatcgggctgttatatataagattatccaccacatactttaattgcacgggaggcctctgcgggttctacaatgccaacgcgtccgatgagttttgcctgcccaatggaaaatgcacggataacctcgctgtgttcctggagagctggaccacctttgaagaaatctgtaatggagaatgtggcgacctccttaaagcgtgcaacaatgacagcgagctcctgaaattctaccgttcccgatctcgctgtgggatcatcaatgacccaagtaacagctcatttcttgaatgccatggagtcgtgaatgttacggcctattaccgcacttgcctgttcagactctgccagagcggtggcaacgaatcggaactgtgtgattccgtagccaggtacgcgtccgcctgtaaaaatgcggacgttgaagtaggcccttggcgaacttacgacttctgtcccttagagtgtcctgagaatagccacttcgaggaatgtatcacttgcactgaaacgtgcgagacattaaccctcggtcccatttgcgtagatagctgtagcgaaggttgccaatgtgatgaggggtatgcactcttggggtcacagtgcgtcacacgtagcgagtgtgggtgtaactttgagggtcaccagttggccacaaacgagacattctgggtcgacctggattgccagatcttttgctattgttcggggaccgataaccgcgtccactgcgagacaatcccatgtaaggacgatgagtactgcatggaggaaggcggcctgtattattgtcaggcgcgtaccgacgcttcctgcatcgtttccggatacggtcactacttgacttttgacgggttcccgttcgacttccaaaccagctgtccgctgatcctgtgcaccacaggaagccgtccctcctcggatagttttcctaagtttgtcgttaccgcaaagaatgaggatcgggacccatccttggccctttgggtgaagcaggtggacgttactgtgtttggttattctatcgttatccacagagcctacaaacacacggttcttgtgaactctgaaagattgtaccttcccttgaaactggggcaggggaaaattaatatcttcagttttggattccatgtcgtggtagagacagatttcgggctgaaagtcgtgtacgactggaaaacattcttatctattacggtgccacgatccatgcagaacagcacttacggactttgtggtagatacaatgggaatcccgatgacgacctcgagatgcctatgggactcctggcttcctcagttaatgaattcgggcagtcttgggtgaagcgggacacattttgccaggtcggctgtggcgatcgatgcccgtcgtgcgccaaagtcgaaggcttctcaaaggtacagcaactgtgttccctgattccgaaccaaaatgccgcgttttctaagtgtcatagcaaagtgaatccaacttttttttataagaattgtctgttcgactcttgtatcgacggcggagccgtgcaaactgcctgcagctggctacaaaactatgccagtacatgtcagacacaaggcatcacagtcacgggatggcggaactataccagctgcactgtgacttgtccgcccaacagccattacgagtcttgtgtctcagtctgtcagcctcggtgtgccgcgattaggctgaagtcggactgtagccactactgcgtggaagggtgtcattgtgatgcgggatacgtgttgaacggaaaaagctgcattcttcctcactcctgtggatgttactctgatggtaaatactatgagcctaagcaactgttttggaacagtgattgtacgcggcggtgtcggtgtttccgtagaaacgtgattcagtgcgatcctagacagtgcaaatcggacgaggaatgtgctctacgcaatggtgtgagaggctgtttctccaccaagacgtcatattgcttggccgccggtggcggggtctttcggaccttcgatggagcattcttacgttttcccgcgaactgcgcatttgtcctgagtacaatttgtcaaaaactgcctgatatatccttccagctgatcatcaatttcgacaagtggtccgcccccaatctgaccatcataagccccgtatacttctatatcaacgaggagcagatcctcatcaacgatcggaacaccgttaaagtgaacggcactcaggtgaacgtgcccttcatcaccgggttggccaccaagatctacagctccgaaggcttcctcgtgatcgatacgtcacccgacatccaaatatattacaacggattcaacgtgatcaaaatcagtatctctgagcgcctgcaaaataaggtgtgcggcctgtgtggcaatttcaatggagacttaaccgacgactatgttaccctgaggggaaaacccgtggtgtcaagcgtggtactggctcagtcttggaaaaccaacgggatgcaaaaaagacccctcgctccttcttgcaacgagctgcaattttctcaatacgctgcgatgtgtgataacgtccatatccaaaagatgcaaggcgatggatactgcctgaaactgaccgatatgaagggctttttccagccctgttatggtcttctggacccactgcccttttacgagtcctgttatctcgacggttgctattcccataaaaagtttcagctgtgtggctcactagcggcctacggagaggcctgtaggtcttttggcattctgtcaacagaatggatcgagaaggaaaattgttccggcgttgttgaggacccttgtgtcggtgcggattgcccaaatcgcacgtgcgagctggggaatggacgcgagctatgcgggtgcatagagcctccgccatacggcaacaacagccacgacattatcgatgcggaagtcacttgcaaggccgctcaaatggaggtatccatcagcaaatgcaaactatttcaacttggcttcgaacgcgagggcgtgcgcattaacgaccgtcaatgcaccggtatagaaggcgaggatttcatttcttttcagatcaataacaccaaaggtaactgcgggaacatcgtccagtccaatgggacgcacattatgtacaagaacaccctgtggatcgaaagtgcgaataatacgggtaacatcatcacgcgggatcggaccatcaatgtagagtttagctgcgcctacgagctcgacattaaaatctccttggacagcgtggtgaaacctatgttgtctgttatcaacttgaccgttccaacccaggagggttcctttatcactaaaatggccctgtacaagaacgccagttacaagcatccataccgccagggggaggtcgtactaacgactagagatgttttgtacgtgggcgtcttcgtcgtgggcgctgacgcaacccatctgatattaacactgaataagtgttatgcaacccctactcgggacagtaacgataaattgaggtactttataatcgagggtggatgtcagaacttaaaagacaatactatcgggatcgaagagaatgcagtgagtcttacttgtcgctttcacgtgacagtctttaagttcattggggactacgacgaggtgcatctgcattgcgcagtctccctctgtgatagcgagaagtactcatgtaaaataacgtgcccacacaactcccgaattgcaacagactacaccaaggagcccaaggagcaaatcataagtgtggggcctattagacggaaaagactggattggtgtgaggataacggggggtgcgagcaaatttgtacctcaagggttgatggaccgctctgctcttgcgtaacagggactctccaggaggatggcaaatcgtgtcgcgctagtaacagcagtatggagctccaagtctggactttactcttaatcatgatccagatctccctctggcatttcgtgtacaaaagtggcaccacatcctag

SEQ ID NO: 208284 - DNA, 1257 bp, Artificial Sequence
  Description of Artificial Sequence: Synthetic coding sequence
atggccaagctgctgcagcccccccccaagttcctgcccagcgagtggcatatagctaacaagaatcagtatcatagggccgatgcccagcgctcacgtagcgagagattggtcgccgaatcccagcgcttagtcgacgaaattgaaaaaactactaggaagagccagtccgacgtgaataaaaagcttgagcagcgcctggaagaagtccaattctggaaaaaggagctcgacgacaaacttgagcagctcgtgaacgttacagatgacttactcatttacaaaatccgcctagagaaggcgctggagacactgaaggagcccctgcacatcacagagacgtgcctggcataccgggagaagagaattggcatcgaccttgtgcacgatactgtagaacacgagttaatcaaagaagccgaaattatacaagggatcatggctttgttgacgaggacgctggaagaggccagtgagcagattcgtatgaacagatcagccaagtacaacctcgagaaggacttgaaagacaagttcgtggcgctcacaatagacgatatctgcttttcattaaacaacaactcacccaatatccgctacagcgagaacgccgtgcgcatcgagccaaattccgtgagcttggaagattggctcgacttttctagcacaaatgtcgaaaaagcagacaagcagcgcaacaattccctgatgctgaaggcattagtggacagaattctctcgcagactgccaacgaccttcgcaagcagtgtgacgtggtggatacggcctttaagaacggccttaaggataccaaggatgcccgcgacaaactggcagatcacttggccaaggtcatggaggaaatcgcctctcaagagaagaatattacagccctggaaaaggctatcctggatcaggaggggcccgctaaggtcgctcatacacgcttggagacacgtactcaccggcccaatgtcgagctatgcagagatgtcgcacagtatcgcctgatgaaggaagtgcaggagattacgcataacgtggctaggctgaaggaaaccctggcccaagctcaggcagagctgaaaggactgcaccgccggcagctcgcacttcaggaggagattcaggtaaaggagaatacaatctatatcgacgaggttctctgcatgcaaatgagaaagtccatcccgcttcgcgatggagaagatcatggggtgtgggccgggggattgagaccagacgccgtgtgttag

SEQ ID NO: 208285 - DNA, 819 bp, Artificial Sequence
  Description of Artificial Sequence: Synthetic coding sequence
atggccctgctgacccggaccctggaggaggccagcgagcagatcaggatgaacagatccgcaaaatacaatctggagaaggatctcaaggacaagttcgtggcactcacaatcgacgatatttgcttctccctcaacaataattccccgaacatcagatatagtgagaacgccgtgagaatcgagccaaatagcgtttcactagaagattggcttgacttttctagcaccaacgttgagaaagccgataagcaaaggaataatagcctgatgctgaaggcccttgtcgaccgcatactgtcccagaccgccaatgatctccgcaagcaatgcgacgtggtggacactgcgttcaagaacggtcttaaggatacgaaggacgcgagagataagctggccgatcacctggcgaaagtcatggaagagattgcctcacaggagaaaaacatcaccgccctcgaaaaggccatactcgatcaggagggtccagccaaagttgcacataccaggctggagaccaggacccacagaccaaacgtcgagttatgcagggacgtagcccaatatcgactcatgaaagaggttcaggaaataactcacaacgtggctcgtctgaaggaaactctagcccaggcccaggccgaacttaagggacttcatcggaggcagctggctttacaggaggagatccaggttaaagagaacacaatttatatcgatgaagtcctctgcatgcaaatgcggaaatcgatcccattaagggatggcgaggaccacggcgtctgggccggtgggctaagacccgacgcagtgtgttag

SEQ ID NO: 208286 - DNA, 1473 bp, Artificial Sequence
  Description of Artificial Sequence: Synthetic coding sequence
atggagcgggtgggctgcaccctgaccaccacctacgcccaccccaggcctacacccactaattttctccccgcgatctcaactatggcttcaagctacagagataggttcccacactctaatctgacacacagcctctccctgccttggcggccctcaacatactataaggtcgcctcaaactcgccaagtgtggccccttactgcacacggtcccagagagtcagcgaaaacacgatgttgccattcgtgtctaatcggaccacttttttcacccgctatacacctgatgactggtacaggagcaatctcacaaattaccaagagagcaacacaagtcgccataatagtgagaagctgcgcgtggatacatcgcgcttgattcaggacaaatatcagcagacgagaaagacacaggccgacactactcaaaatttgggcgaacgggtgaatgatatcggattctggaagtcagaaattattcacgagctcgatgaaatgataggcgagacaaacgcccttacggacgttaagaaaagactagaaagagctctgatggagactgaggcacctttacaggtggccagggagtgccttttccaccgcgaaaagagaatgggtattgacctggtacacgatgaagtggaggctcagctgctgaccgaggtggacacaattctatgctgccaggagcgtatgaaattgcacctggacaaagccatcgcccaactggctgccaaccgcgcctcacagcacgaactcgaaaaagacctttcagacaagcagaccgcctatcgcattgacgataaatgtcaccatctgagaaacacatccgatggagtgggatattttaggggggtggagagagtggatgccaccgtgagcgttccggagtcctgggctaaattcaccgatgacaacatccttaggtctcagtcagaacgtgctgcctccgcaaagctgcgtgacgacattgaaaatctgctggtcgtgacagcgaacgagatgtggaaccaattcaataaagtaaatctgagcttcactaatcgtatcgccgagacagcggacgccaaaaataaaattcagacccacttagctaagacgcttcaggaaatcttccagaccgaaatgacaatcgaatccattaaaaaagctattaaggataaaacggcattcctgaaggtggcccagactaggttggacgagcgcactaggcggcccaacattgagttgtgcagagacatggcccaactgaggttggttaatgaagtgcacgaagtggacgacaccattcaaacattacagcaaagattgcgcgacgcggaggacacgctgcagtctctcgtgcatattaaagcaacgcttgaatacgacttggcggtcaaggccaactctctatatattgaccaggaaaaatgcatgagtatgcgaaagtcatatccaaatacactccggctggttgggttttgctag

SEQ ID NO: 208287 - DNA, 1473 bp, Artificial Sequence
  Description of Artificial Sequence: Synthetic coding sequence
atggagcgggtgggctgcaccctgaccaccacctacgcccaccccaggccaaccccgacaaatttcttgcccgcgatcagtacaatggcaagctcctatcgagataggttcccacacagcaatttaacccattcattgtctcttccatggagaccatcgacatactacaaagtggccagtaattcaccgagcgtggcaccttactgtacaagatcccaaagagtgtcagaaaacactatgctgccttttgtgagtaaccgaacgacattctttaccaggtacacacctgatgattggtataggtctaacctgaccaactatcaggagagcaacacgagccgccacaactcagaaaagcttcgggttgacactagccgactgatacaggacaaatatcagcagacccggaaaacacaggccgataccacccagaacctgggcgagcgcgtgaacgacattggcttctggaagtcggagatcattcacgaactggacgagatgatcggagaaactaacgccctcaccgacgtaaagaaacggctagagagggccctgatggagacggaggcccctctgcaggttgcgagagagtgtttattccaccgcgagaagagaatggggattgacctggtgcatgacgaagtcgaagcccaactcttgaccgaagtggacacaattctgtgctgccaggagcggatgaagctgcacttagataaggcaatcgctcagctggctgctaatcgagctagccagcacgaactcgagaaagatctgtctgacaaacaaaccgcttataggatcgatgacaagtgccaccacctacgcaacacttcagacggcgttgggtattttcggggggtcgaacgggtggatgctacagtctcagtccctgaatcatgggcaaagttcaccgacgataacatcctgaggtcccagagcgaaagggccgcgagcgccaaactccgggatgacatcgaaaaccttctggtggtgactgctaacgagatgtggaaccaattcaacaaggtaaatctgagctttaccaaccggattgcggaaacagccgacgcgaaaaataaaatccagacccatctcgccaaaacattgcaggagatcttccaaactgagatgaccatcgaaagtataaagaaggcaataaaagataagaccgcattccttaaggtagcccagacaagactggatgagcgcacacgcagacccaacattgagctgtgtagggacatggcccagcttagactggttaatgaggtgcacgaagttgatgatacaatacagacactacagcagcgcttgcgtgacgccgaggatacgctacaatctctcgtgcacatcaaagcaactctggaatacgacttagcagtaaaggccaactccctatatatcgaccaagagaagtgtatgagcatgagaaagtcatacccaaataccctccgcttagtcggattctgttag

SEQ ID NO: 208288 - DNA, 444 bp, Artificial Sequence
  Description of Artificial Sequence: Synthetic coding sequence
atggagcgggtgggctgcaccctgaccaccacctacgcccaccccaggccaactccgacaaatttcctccccgcaataagcacaatggcttcttcttatcgggacaggtttccccatagcaatctgactcactccctgtccctgccatggagaccgtctacttattacaaagttgcctccaacagtccctccgttgcaccatactgcacccgtagccagagggtctctgagaataccatgctgccctttgtttcaaatagaaccacctttttcacccgttataccccagacgattggtacagatcgaacctgactaactaccaggagtcgaatactagcagacacaattccgaaaaactgcgagtggatacaagccgtctcatccaggataaatatcagcagacgcgtaaaacccaggcagataccactcagaaccttggttag

SEQ ID NO: 208289 - DNA, 423 bp, Artificial Sequence
  Description of Artificial Sequence: Synthetic coding sequence
atggagcgggtgggctgcaccctgaccaccacctacgcccacccccgcccaacccctactaattttctcccggcaatatccacaatggctagtagttaccgcgacagattcccccactccaatctcacacactccctgtcccttccatggcgcccttcaacatattacaaggtggccagcaacagcccaagcgtcgccccatattgtacgcggagccagagagtctctgaaaatacgatgttaccatttgtctctaaccgcaccacattcttcaccagatatacacctgatgactggtacaggagtaatttgaccaattaccaggaatctaacactagtcggcacaatagcgagaagttacgcgtggatacctcacgactaatacaggacaagtatcagcaaacccgaaagacacaagcatag

SEQ ID NO: 208290 - DNA, 249 bp, Artificial Sequence
  Description of Artificial Sequence: Synthetic coding sequence
atggagcgggtgggctgcaccctgaccaccacctacgcccaccccagaccaacacccactaatttcctgcccgccatatctactatggccagttcttacagagacagattccctcatagtaatctgacccactccctcagtttgccctggcgacccagtacatattacaaagtcgctagtaatagcccgtccgtggctccttactgtactaggagccaacgggtttctgaaaatacaatgctgccatag

SEQ ID NO: 208291 - DNA, 2514 bp, Artificial Sequence
  Description of Artificial Sequence: Synthetic coding sequence
atggagcccgcccccagcgaggtgcggctggccgtgcgggaggccattcacgctctcagcagcagcgaagacggaggtcacattttctgcaccctcgagagtctgaagcgatacctcggagaaatggagcctcctgctcttcctagggaaaaggaggagttcgcttcagcacatttctccccagtgttaaggtgcctcgctagcaggctgtcaccggcctggctcgagctactgccgcatgggcgactagaggagttgtgggcaagcttttttctcgaggggcctgcagaccaggccttcctggtactgatggagacaatcgaaggcgcggcgggaccatcattcaggttgatgaagatggcgcggctactggcaagattcctgagagaaggcagattagcagtcttgatggaagcgcagtgtaggcagcaaactcagcctggattcatcttactgagggagacattgcttgggaaggtggttgcccttcccgaccacctgggaaacagactgcaacaagaaaaccttgctgagttctttccgcagaattattttcgcctcctgggcgaggaggtagttcgtgtactgcaggctgttgtagacagtctgcagggtggcctcgacagttccgtgagttttgttagccaggttctgggaaaagcctgtgtacatgggcgccaacaggagatcctgggcgtactggtgcctcgtctggcagcactgacacagggatcctacttacaccagcgcgtttgttggcgactggtggagcaggtgccggaccgggctatggaggccgttttgacagggctggttgaggcagccctgggaccagaggtgctcagccggctgctcggcaatcttgtcgtgaagaacaagaaggcccagttcgtgatgacgcagaagttgctgtttttgcagtccagacttactaccccaatgttacaatccctactgggacatctggccatggactctcagcgcagacccctgttgttacaagtgttgaaagagctcttggagacctggggaagctcttctgcaatccggcatacccctctccctcaacagaggcacgtgtcaaaagccgtcctcatctgtctggcacaactaggcgagcctgagctgagagacagtcgggatgagctcctcgcatcgatgatggcgggggtgaagtgcagactcgactccagcctgccccctgttcgacgactgggcatgattgtggctgaggtggttagcgctcgaattcatcctgaagggccccctctcaagtttcagtacgaggaagatgaacttagcctggagctgttggctctggcatcacctcagcccgctggagacggcgctagcgaggccggaaccagcttagtgcccgcaacagccgaaccccctgccgagacccccgccgagatcgtggacgggggcgtcccccaggctcagttagccggatctgactctgatctcgactcggacgacgagtttgtgccgtacgatatgagcggcgacagggagctgaagagttcgaaggcacccgcgtacgtccgagactgcgtggaagccttgactacatcagaagacatagagcgctgggaagcagcattgagagctctggaaggcctggtctataggtcaccgacagctacgagggaggtttccgtggagctggctaaggtgctgctccacctggaggagaagacttgcgtagtaggattcgctgggcttcggcagcgtgcgctagttgccgtgaccgtgacggaccctgctccggttgcggactatcttacctcccaattctatgctctgaattacagtcttcggcagcgaatggacattctcgatgttctgactctagccgcccaggagctgtctaggcctggatgcctgggccggaccccccagcccggctccccgagcccgaataccccctgtcttccagaggccgccgtgagtcaaccagggagtgccgtggcatcagattggagggtggtggtggaagaaagaatccgatcaaaaacacagagactctccaaggggggcccccggcaggggccggcaggcagtccatccaggtttaattcagtggccggtcatttcttttttcccctgctacaaagattcgacaggcctctagtcacattcgacctgctaggcgaagatcagctggtccttggaagacttgcacataccctgggggcactgatgtgtctggccgtcaataccactgttgcggttgccatggggaaggccctgctggagtttgtgtgggctctgcggtttcacattgacgcttatgtacgtcagggcctgctttcagcagtaagctcagttctgctctcactgccagccgcaagacttcttgaagatctcatggatgaactgttggaggccaggtcttggctcgcagatgtggccgaaaaggatcctgacgaggactgcaggacattagcccttcgggccctgctccttttgcaaagactgaaaaatcgactactgcctccagcctccccctag

SEQ ID NO: 208292 - DNA, 1083 bp, Artificial Sequence
  Description of Artificial Sequence: Synthetic coding sequence
atgatggccggcgtgaagtgccggctggacagcagcctgccccccgttcgacggcttggaatgattgttgcggaagttgtgtctgccaggatccatccagaagggcccccactcaagttccagtatgaggaggacgaactttcacttgagctattagctttggccagcccccaaccagctggcgacggagcctctgaagctggtacctccctcgtccctgcaactgctgaacctccagcggagacacccgccgagatagtggatggtggtgtgccccaggcacagcttgccggctccgactccgacctcgatagcgacgatgagtttgtgccctatgatatgtctggtgaccgagagctgaagagctcgaaggctcctgcatacgttagggattgtgttgaggtgcttgatgttcttacactcgccgcacaagagcttagcagacccggctgtttgggacgaaccccacagcctggctcgccatccccaaataccccatgccttcctgaagccgccgtgtcacagccaggcagcgctgtcgcttctgattggcgcgttgtggtggaggagaggatcagatcgaaaacacaacgactctcaaagggtggccctcggcagggaccagccgggagtcctagtagatttaattctgtagcggggcactttttttttccactgctccagagatttgataggcctcttgtgacttttgatctattgggcgaagaccagctcgttctggggcgactggctcatacgctgggagcattaatgtgtctagccgtgaataccacagtcgctgtggcaatgggaaaggctctgttagagttcgtgtgggcactcaggtttcatatagacgcttacgtgaggcagggtcttttgagcgctgtgagctcagtgctgctttccttgcccgctgctcggcttcttgaggatctgatggacgaactgctggaggcccggagttggctggcagacgtcgctgagaaggatcccgatgaggactgcaggaccttagcactgcgtgcacttctgctgctgcagagactcaaaaatcgcttgctgccaccggcatcgccctag

SEQ ID NO: 208293 - DNA, 3270 bp, Artificial Sequence
  Description of Artificial Sequence: Synthetic coding sequence
atggccgtgttcgacacccccgaggaggccttcggcgtgctgcggccagtgtgtgttcagctcacaaagactcagacagtggagaatgtcgagcatcttcagacaaggctgcaggctgtgtcggatagtgccttgcaagagcttcaacaatacatcctttttccgctgagattcacacttaagacccccgggcccaagcgcgagcggctgatccagagtgtagtcgagtgtctgacgtttgtgctcagttcaacgtgcgtcaaggagcaagaactgctccaggaactgtttagtgagctgagtgcgtgtctgtattctccttccagccagaaacccgctgcagtgtctgaggagctgaaactcgccgtgattcaggggttgtccactttgatgcatagcgcctatggagacattatactaaccttttatgagccctcaattctgcccaggttaggcttcgcagtcagtctactcctgggccttgctgaacaggagaaatccaagcagatcaaaatagccgccctgaaatgcctgcaggtactattgctccaatgcgattgccaggatcatcctaggagcttggatgaactcgaacagaaacagctcggcgacctcttcgccagtttcctgccaggcatttctacggctctcaccagactcatcacaggtgatttcaagcaaggacatagcatcgtcgttagctcattgaagatcttttataaaaccgtcagctttattatggcggatgagcagctgaagcgcatatccaaagtacaggcgaagcccgctgttgagcatagggtggcagagctgatggtctaccgcgaggcagactgggtcaagaaaaccggggataagctgaccattttaataaagaagataatcgaatgcgtttctgtgcaccctcactggaaagtgcggctggaactggtggagctcgttgaagatttgctcctaaaatgcagtcaatccctggttgagtgcgccgggcctctcctgaaggctctggtcgggctggtgaatgatgaaagcccagagatccaggctcagtgtaacaaggtgcttcgacacttcgcagatcagaaagtggttgtgggaaacaaagctctggccgacatcctgtcggagtccttacatagtctggctacgagcctgccacgccttatgaacagccaggacgatcagggcaaattttccaccctgtcacttctcctcggctatctgaagctcctcggtccaaagatcaattttgtattgaattcggtggcacacttacagagactctctaaagctctaatccaggtgctagaactagacgtcgcagacattaaaatagtcgaggagcgccggtggaatagtgacgatctgaatgcctcccccaagacgagcgccacccagccctggaaccggattcaaagacgttattttcggttcttcaccgatgagaggatctttatgttgctgcggcaggtatgtcaactcctagggtactacggcaatttgtacctgctggttgatcacttcatggaactgtatcaccagtcagttgtctaccgcaaacaggccgcaatgatcctgaatgaactggtgacaggggcggccggactagaggtcgaggatcttcacgagaagcatattaaaactaatccagaagagctgcgtgaaatcgtgacctcaatcctggaagagtacacatcccaggaaaattggtatctcgtgacttgcctggagaccgaggagatgggagaggagttaatgatggagcaccctggacttcaggcaatcactagcggcgagcacacgtgccaggtcaccagcttccttgcgtttagcaaaccctcacccaccatatgcagtatgaacagtaatatctggcagatttgtatccagctggaggggatcggtcagttcgcgtatgctctgggtaaagatttctgtctcctcttgatgtccgctctgtatcccgtgctcgaaaaagcgggagaccagacgctcttgatttcacaggtcgccacttctacaatgatggatgtatgcagggcatgcggatatgactctctacagcacctgattaaccagaacagcgactatcttgttaacggaatttcgctgaatcttcggcatttggccttacatccccataccccaaaggtgctcgaggtgatgttgcgcaatagcgatgctaacctcctaccattggtagctgacgtggtgcaggatgtgttggcaacactggatcagttctatgataagagggcagccagtttcgtgtcagtgctgcacgcactgatggcagcactagctcaatggttccctgatactggcaatttgggacatctccaggagcagagcttgggagaggaaggctcacacctcaatcagaggcctgccgcgctggaaaagtccaccaccactgcggaggatattgagcagttccttctgaattatctcaaagaaaaagatgtggctgatggaaatgtttctgacttcgataacgaggaggaggaacagtccgtgccccccaaagtggatgagaacgacacccgtcctgatgtagagccacctttaccactccagatccaaatcgccatggacgtgatggagcgctgcattcacctcctgtcagacaaaaacttgcaaattcgattgaaggtcctggacgtgctcgatctgtgtgtcgttgtgctgcaaagccataaaaaccagcttctgcctctggcgcatcaggcctggccaagtctggtccacagactgactagggatgcccccttggctgtattgagggcttttaaggtcctgcggacactgggatccaagtgtggcgactttttgcgaagtcggttttgtaaagacgtgctcccaaagctcgcggggtctctcgtcacgcaggcgcctattagcgctcgggcagggccagtttactcacatacactcgcattcaaattgcagctggctgtcctccagggattaggtcccttgtgtgagcggctcgatttgggcgagggtgatctgaacaaagtggctgacgcatgcttgatttatctgagtgtaaagcagcccgtgaaactgcaggaagcagcccgttccgtgtttttgcacttgatgaaagtagatccggactccacttggttcctgctcaacgagttatactgtcccgtccagttcaccccaccacacccctcactccatcccgtgcagctgcacggggcgagcggccagcagaacccgtacaccacaaacgtgctccagttattgaaagagctccagtag

SEQ ID NO: 208294 - DNA, 3270 bp, Artificial Sequence
  Description of Artificial Sequence: Synthetic coding sequence
atggccgtgttcgacacccccgaggaggccttcggcgtgctgcggccagtgtgcgtccagcttactaagacgcagacagtggagaacgtggaacacctgcaaaccaggctccaggccgtgtccgactccgctctccaggagttgcaacagtacatcctctttcccctcagattcacactaaagacccccggcccaaagcgcgagcgtcttatccaatccgtggtggagtgccttacatttgtattgtcctccacatgcgttaaggaacaggaactgctgcaggaactgttttctgaactgtccgcttgtctctactccccctcaagccagaagcctgcggcagtttcagaggaactgaaactagctgtgatccagggtctgagcacactcatgcacagcgcctacggtgacatcatcctgactttctatgaaccatctatcctgccaaggctgggatttgccgtcagtttgcttttgggacttgctgaacaggagaaatccaagcagatcaagattgccgccctgaagtgcctccaggttttgctcctgcagtgcgactgtcaggaccatcccaggtcactggacgagttggaacaaaaacagctgggcgatctatttgcttctttcctgccgggcatcagcacggccctgacccgtctgatcactggtgatttcaaacagggccattcaatcgtagtgtcaagcttgaagatcttctataagaccgtaagctttataatggcggatgaacagctcaagcgcattagcaaggtgcaggctaaaccagccgttgaacaccgcgtggcagagctcatggtctaccgggaggcagactgggtgaagaagacaggtgataaacttaccattttgatcaaaaaaataattgaatgcgtcagtgtgcatccccactggaaagtgcggctcgaactggttgagctggtagaagatctcctgctgaaatgcagccagagtcttgtggaatgcgctggacccctgttgaaggccctcgttggtctggtaaacgacgagtcgccagaaattcaggcacaatgtaataaggtgctccgccacttcgctgatcagaaggttgtggtggggaataaggcattggctgacattctgagcgaatcacttcattctctggcaacctctcttcctaggttaatgaactcgcaggatgaccaaggtaagttctccacgctcagtctgctgctgggatacctgaaactcctgggcccaaagataaattttgttctgaacagtgtggcacatttacagagacttagtaaagctctgattcaggtgctagaactggacgttgccgatatcaaaatcgttgaagaaaggcggtggaatagtgacgaccttaatgcttccccaaagacctcggccacgcagccttggaacagaatccagagacggtactttcgctttttcaccgatgagaggatttttatgttactgcgccaagtatgccagcttcttggatactatgggaacctgtatttgttagtggaccacttcatggagctctaccaccagtctgtggtgtaccgaaagcaggccgccatgatcctgaacgagctggttacaggggctgcaggtctggaagtggaggacctgcatgaaaagcacattaagacaaacccggaagaacttagagagatcgtgacaagcatcttggaagagtacacctcccaagagaactggtaccttgtcacatgtctggagaccgaggagatgggggaagaattgatgatggagcaccccggcttgcaggctattacttccggtgaacatacatgccaggtgaccagcttcctggccttctcaaaaccttcacccactatttgctccatgaactccaacatctggcagatttgcatccagctggaaggcatcgggcagtttgcctacgcacttggcaaagatttttgcctgctgctgatgagcgcattgtatcctgtgctcgagaaggccggggaccaaacgttgctcatttcccaggttgctacaagtacaatgatggacgtgtgcagagcttgcggctacgattctctgcaacatttgattaaccagaacagcgactatttggtaaacggaatcagcctaaacctgcgccacctggcactgcatccgcatactcctaaggtactggaagtcatgcttcggaacagcgatgctaacctcttgcctctggtcgccgacgttgtacaggacgtgctggctactctggaccaattctacgataaacgcgcggcctccttcgtctctgtgctccacgcgctcatggctgcgcttgcacagtggtttcctgatacagggaacttaggacatcttcaagagcagtcgttgggcgaagaaggcagccacctgaatcagcggcctgctgccctagagaaatctacgacaacagccgaggacatcgaacagttcctgctgaactatctcaaggagaaagacgtagcagacggaaatgtaagtgattttgataacgaggaggaggagcagagcgtcccacccaaggtcgacgagaacgacaccaggccagatgtcgaaccccctctcccattgcagattcagatcgctatggacgtgatggaaaggtgtatccaccttcttagtgacaagaacctccagatccgtcttaaagtgttggatgtgctggatctatgcgtcgttgttttacagtcacataagaaccagctgttgccactagcgcatcaggcctggcccagcctggtgcacagactgaccagagacgcgcccctggccgtgctcagggcgtttaaagtgttgagaaccctcgggagcaaatgtggggatttcctgcgttcccggttttgcaaggacgtgttaccaaaactggccgggtcactcgtcacacaagctcctatctcggcccgagccggccccgtgtattctcacaccctcgcctttaaactgcaactggccgtccttcaggggctggggcccctgtgcgagcgcctcgatctgggcgaaggggacctgaacaaagtcgctgatgcctgtctaatatatctttcggtgaaacaaccggtgaaactgcaggaggctgcacgaagtgtctttttacatctcatgaaagttgatcctgactcaacatggtttcttttgaacgagctatattgccctgtgcaattcactccacctcaccccagcttgcacccagtgcaactgcacggcgcgagtggccagcagaatccatataccacgaacgtcctgcagctcctgaaagagctgcagtag

SEQ ID NO: 208295 - DNA, 3270 bp, Artificial Sequence
  Description of Artificial Sequence: Synthetic coding sequence
atggccgtgttcgacacccccgaggaggccttcggcgtgctgcggcccgtgtgcgttcaacttacaaaaacccagactgtggagaatgtggagcatttacagacacggctgcaggcggtctccgattctgctctgcaggaactccaacagtacattctttttccgctgcgcttcaccttgaaaactccaggtccaaagcgagagcgtctgatccagtctgtggtagaatgcctgaccttcgtccttagctccacgtgtgtgaaagaacaggaactgctgcaggagctgttttcagagctgagcgcatgtctttattctccttcatcacaaaaacccgcagcagtgtccgaagagctgaaactcgccgtgattcagggtctgagtactctcatgcattctgcttacggagacatcattctgaccttttacgagcccagtatcctgcctagactaggctttgccgtgtctcttctgctcggactagccgagcaggaaaagagtaaacaaattaaaattgccgccttgaagtgtttacaggtgttgctgctacagtgtgattgtcaggatcacccccgatctttggatgagttagagcaaaaacagctcggcgatttgtttgcgagcttcctgcctggaatcagtacagcgctcacacggctgattacgggtgactttaagcagggacacagcattgtggtcagctccctgaaaattttttacaaaactgtgagtttcattatggcggacgaacagctgaaaaggatctccaaagtgcaggccaaaccagctgtagaacacagggttgctgagttgatggtctacagagaagctgattgggtgaagaagaccggagacaagctgactatcttgatcaaaaaaatcattgaatgcgtatccgtgcatccccattggaaggtcaggctggagttagtggagctggttgaggatttactgctgaagtgcagccaaagtttggttgaatgtgccggtccattgcttaaggcactggttggtctcgtgaatgacgaatcacctgagatacaggcacagtgcaataaagtcctgaggcatttcgccgaccagaaagtggttgttggaaacaaggctctggccgatatccttagtgagtcgctgcattcattggccaccagccttcctcggcttatgaactctcaggacgaccaggggaagttctcaaccctcagcctcctgctaggctatttgaagctcctggggcctaaaataaattttgtccttaacagcgtggcgcaccttcagaggctttctaaagccctcatccaggttctagaactggacgtagcagatatcaaaatcgtcgaagagagacggtggaatagcgacgacctcaatgccagtccaaagacaagcgccactcagccatggaacagaatacagcggagatattttagattttttacagatgagcggatcttcatgctactccgccaggtctgtcagttgctcggttactatggaaacttgtacctactggtggaccacttcatggaattatatcaccaaagtgtcgtctatcgcaagcaggccgctatgattctgaatgagctggtgacaggcgccgccgggttagaggtggaggatttacatgagaagcacataaagactaacccagaggagttgcgagagattgtcacaagtatcctggaggagtatacctcgcaagaaaattggtatctcgtcacctgtcttgaaaccgaggaaatgggtgaggagctaatgatggaacaccctgggctccaagccattacctccggggaacacacatgccaagtgacttccttccttgccttctccaaacctagccctacaatctgtagcatgaactcaaacatttggcagatttgtatacagctggagggaattggacaatttgcatacgctctgggaaaggacttttgcctcttgctgatgtcggcactgtacccagtgcttgagaaggcaggcgaccagacactgctcatcagtcaggtagccacatcaacaatgatggatgtttgcagagcctgtggctacgattccctgcaacacttgatcaaccaaaactcagactatctcgtcaatggaatcagtttgaatcttcggcatttggcactgcatccacacacacccaaagtgcttgaagttatgttaagaaactcagacgccaatttactcccactggtggcagacgtggttcaggatgttctagcaactctggatcagttttatgataaaagggctgcctctttcgttagcgtgctgcacgctctgatggcagctctggctcaatggtttccggacactggcaatctgggccatctgcaagagcaaagcctgggggaagagggaagtcacctcaatcaacgtcccgcggctctggagaaatccacaaccactgcagaggacattgaacagttcctgttgaactatttgaaagaaaaagatgtggcggacggcaacgtgtcagacttcgacaatgaggaggaagaacagtctgtccctcccaaggtggatgaaaacgacacgaggcccgatgtggagccacctttacctttacagattcaaatcgcaatggatgtgatggagcgctgcatccatttactcagcgacaaaaatttacaaattcgcctaaaagtgctcgatgtgcttgacctctgtgtggtggttctgcaatctcataagaaccagctcctcccactggcacatcaggcttggccatcattggttcatcggttgaccagagacgctcccctcgctgtactgcgcgccttcaaggtgctccgtaccctcggaagtaagtgtggcgacttcctgaggagcaggttttgcaaggacgtgcttccaaagctggcgggctctttagtgacccaggcacctatatccgctcgcgcgggtcctgtgtacagccacacattggcttttaagctgcaattggcagtgctccagggccttgggcctctctgcgagagattagatctcggggaaggcgatctgaacaaggtggcggacgcatgtctgatctacctgagtgttaaacagccagttaaacttcaggaagccgcgaggtccgtgtttcttcacttgatgaaagtggacccagacagcacctggttcctgcttaacgagctgtattgccccgtccagtttactcccccacacccgtccctgcaccctgtgcagcttcacggcgcttccggccagcagaacccctatactactaacgttctccagcttttgaaagagttacagtag

SEQ ID NO: 208296 - DNA, 1527 bp, Artificial Sequence
  Description of Artificial Sequence: Synthetic coding sequence
atggagctggacagcgccctggaggcccccagccaggaggacagcaacctctcagaggagctatcacactcggcgtttggacaagctttctccaagatccttcactgtctggcacgtcccgaggccagacggggcaatgtgaaggatgctgttttaaaggacctgggcgacctcattgaggctacggaatttgatagactgttcgaaggcacgggggcccgcctacgtggaatgcctgaaactctggggcaagtggcgaaggctctggaaaagtacgctgcaccatcgaaggaagaggagggaggaggggatggacactccgaagccgcagagaaggccgcgcaggtcggcctgttatttttgaagcttttgggaaaggtggagacagccaagaatagtcttgtggggccggcctggcagacaggcctacaccatttagcaggtcccgtgtatattttcgccatcacacatagtcttgagcagccatggaccaccccaagaagccgggaggtcgcccgggaggttcttaccagcctcctccaggtgactgagtgcggtagcgtcgcaggatttctacacggcgaaaatgaagatgaaaaggggagactgtcggtgattctgggcctgttgaagcctgatctgtacaaagagtcgtggaaaaacaacccagccattaagcatgtcttttcctggaccctgcagcaggtgacgcgaccatggctttcccagcatctcgagagagtattgccagcctcactggtgataagcgatgattatcagacagagaacaaaatactgggtgtccactgtctgcatcacatcgtgctgaacgtgcctgccgctgatcttttgcagtataatagagcgcaggtcttgtaccacgctatttccaatcatctttacactccggaacatcacctgatccaggccgtgctattatgcctacttgacctgtttcccatcctggagaagacactccactggaaaggggacggtgccagaccaaccacgcactgcgatgaggtgctgcggctgatacttactcatatggaacccgaacacagattgctcctgcgccggacttacgcgcgtaatctgccggcattcgtgaatcggctgggcatcctcacggtgcgccacctcaagcggttagagcgtgtcatcattgggtacctggaggtgtatgacggtccagaagaggaagcccgcttgaagattctcgagacactgaagctcttaatgcaacacacctggcctagagtgagttgtcgattggtcgtcctcctgaaggccttgctgaagctgatctgcgacgtagctcgcgatcctaacctgacacccgagtctgttaaatccgctttgcttcaggaagccaccgactgcttaatcctcctcgatcggtgcagccagggaagagtcaaagggttgcttgctaagatcccacagagttgtgaagatagaaaggtggtgaactacattcgaaaggtgcagcaggtgtccgaaggagctccgtacaacggcacttag

SEQ ID NO: 208297 - DNA, 1527 bp, Artificial Sequence
  Description of Artificial Sequence: Synthetic coding sequence
atggagctggacagcgccctggaggcccccagccaggaggacagcaacctcagcgaagagctgagtcattctgcattcggccaagccttttccaaaatcttgcactgcttggcaagacccgaggcaagacgcggaaatgtaaaagatgccgtattgaaggacttgggcgaccttatcgaggctactgagtttgatcgactatttgaggggactggggcaagacttaggggcatgcccgaaacactcggacaggtggccaaggccctggaaaagtatgctgcaccatcaaaagaggaggagggcggcggcgacggtcacagcgaggccgctgaaaaggccgctcaggtgggcctcttgttcttgaaactcctcggtaaagttgagactgcgaaaaattccctggtggggcctgcatggcagacaggtcttcatcacctggctgggcccgtgtacatttttgcaatcacacatagtctagaacaaccctggacaacacctcgctccagggaagtggctcgcgaggtactgacctcactgttacaggtgacggaatgtggcagcgtggccggctttctgcacggcgaaaatgaggatgaaaaaggtcggctgtctgtgatcctgggactgttgaaacctgacctttacaaggagtcttggaagaacaatccagccatcaagcatgttttctcatggacacttcagcaggtaacccgtccatggcttagtcagcatctggaacgcgttctgcctgctagtctggtgatttcagatgactaccagacggagaacaagatcctcggggtccattgtctgcatcatattgtccttaacgttccagcagccgatctcctgcagtataatcgggctcaggtattgtatcacgctatctccaaccacctatatacaccggaacaccacctaattcaggcagtgcttctttgcttgcttgacctgtttcccatcctggagaagactctgcactggaaaggtgatggcgcccgaccaacgacccactgcgatgaagtgttgagacttatcttgacacatatggaacctgaacaccgcctgcttcttaggcgcacatatgctcgcaatctcccggccttcgttaaccgcctcggcattctcactgtgcggcatctcaagcggttggaaagggtgattattgggtatctcgaggtatacgacggccctgaggaagaggctaggctgaagatccttgaaacccttaagctgttgatgcagcacacatggccccgggtctcatgccgcctggtggttctccttaaagccctgttgaagctgatttgcgatgttgctcgcgatcctaacttgaccccagagagcgtgaaatccgcgctcttacaggaggctaccgactgcctcatccttctggacaggtgttcccaagggcgcgtgaaagggctgttagccaagattcctcagtcttgcgaagacagaaaagttgttaattacatccgaaaagtgcagcaagtgagtgaaggagccccttacaacggcacttag

SEQ ID NO: 208298 - DNA, 1494 bp, Artificial Sequence
  Description of Artificial Sequence: Synthetic coding sequence
atggagctggacagcgccctggaggcccccagccaggaggacagcaacctgagtgaagagctatcacactccgcttttggacaggctttcagcaaaattctgcactgtctcgcccgtcctgaagccaggagggggaatgtgaaggatgccgttctcaaggacctgggagatctcatcgaggccaccgaatttgataggctcttcgagggcaccggcgctagactgcgaggtatgccagaaactctgggacaggtcgccaaagccttggaaaagtacgccgcccctagtaaggaggaggaagggggaggagatgggcattctgaagcggccgaaaaggccgcccaggtggggctgctgtttctgaaattactcggaaaggtggagacagccaaaaactccctcgtcgggccagcttggcagacgggccttcatcacctagctggtcctgtgtatatcttcgccatcactcatagtctggagcaaccttggacgacgccacggtctagggaagtcgcgcgggaagtattgacatctctcctgcaggtaacagagtgcggctccgtcgccggtttccttcacggtgagaacgaggacgagaaggggaggctctcagtgatcctggggctgctgaagcccgatttatataaggagagttggaagaacaatccggcgattaaacatgtattttcttggacgcttcagcaggtgacccgtccatggttatcgcaacatttagaacgcgtgctgccagcctcactggtgattagtgacgattaccagaccgaaaataaaattctgggtgtccattgccttcaccatattgtgctgaacgtacccgcagccgaccttcttcagtataatcgggcgcaggttctgtatcatgccataagcaaccacctgtacacgccagaacaccatctgatccaggcagtcctgctgtgcctcctcgacctattcccaatccttgaaaagaccttgcactggaagggtgatggggcccgaccgacgacccactgtgacgaggtgcttaggctgatactgacccacatggagccagagcaccgtttgctccttcgtcggacatacgcaaggaatctgccggcgtttgtgaatcgccttgaaagagtcattattggctatttagaagtatatgatggacctgaagaagaagcaaggctgaagatcttggagactttgaagcttctgatgcagcacacatggccacgggtgtcgtgtcgtctggtagtcctgctgaaggccctgttgaagcttatctgtgacgtcgcacgcgatcctaacctcacccccgaatctgttaagagcgcgttgctgcaagaggccaccgattgcctaattttgcttgatcgctgctcacagggcagagtcaaagggctcttggccaaaatccctcaaagttgtgaggataggaaggtggtgaattatatccgtaaagtccagcaggtgtccgagggggcaccctacaatggcacgtag

SEQ ID NO: 208299 - DNA, 306 bp, Artificial Sequence
  Description of Artificial Sequence: Synthetic coding sequence
atggagctggacagcgccctggaggcccccagccaggaggacagcaacctttcagaggagttgtcccactctgcgttcggccaagcttttagcaagatccttcactgcttagcccgcccagaagctcgaagaggaaacgtgaaagacgcggtacttaaggatctgggcgatctcattgaagcgaccgaatttgatcggttattcgagggcactggggctcggctgcgcggcatgccagagacactcggacaagtggcaaaggcattagagaaatacgctgccccctccaaagaggaagaggggtag

SEQ ID NO: 208300 - DNA, 2424 bp, Artificial Sequence
  Description of Artificial Sequence: Synthetic coding sequence
atgccccgggccccccggtgccgggccgtgcggagcctgctgcggagccattaccgggaagtgctcccgctggccacattcgtgaggagactcggcccccaaggctggcggctggtgcaaaggggagatccagcggcattcagagccctggtggcccagtgtcttgtgtgtgtgccgtgggatgcacgacccccccccgctgctcctagcttcagacaagtcagctgcctgaaagagctggttgcgagggtactgcagaggctgtgtgaaagaggtgcaaagaacgttctggcattcgggttcgctctccttgacggggctcgaggcggcccaccagaggcgtttaccacatcagtgcggtcctacctccccaatacagtgacagatgctctgagagggtctggcgcgtgggggctgctgctccggcgggttggtgatgacgtgcttgtgcacctgctggctcgatgcgcccttttcgtacttgtggcaccttcctgcgcctaccaggtgtgcggcccacccctgtatcaactcggagcagcaacccaagcgaggccacctcctcacgcgtccgggcctcgcaggaggctgggctgtgaacgggcctggaaccatagtgtcagagaggctggagtgccccttggcctgcctgcacctggtgcccggcggcggggcggctcagcttccaggtccctgcccctccctaaaagacctcgcagaggcgccgctcctgagcctgagagaacccctgtgggacaagggtcgtgggcacatcctggtagaacacgcggtccttcagatcgaggattctgcgtggtgagccctgccaggcccgccgaggaagctactagcctagaaggcgctctgagtggcacacgccactctcatccctccgtgggcaggcagcaccatgcaggtccacctagtacctcaagaccacccagaccctgggacacaccctgcccgcctgtctatgccgagaccaaacacttcctgtactcttccggggataaggagcagttgcggccttcattcttgttgtcttcgctcaggccaagcctgaccggtgcgagacgactggtagagacaattttcctcgggtcacgaccctggatgcccgggacacccagaagactcccacggctgcctcagagatattggcagatgcggcctctgttcctggagctgttgggcaaccatgcccaatgcccctacggggtgttactgaagacccactgccccttgcgtgcagctgtgacgcccgccgccggggtgtgcgcgcgggaaaagccgcaagggagtgtggcagctcccgaggaggaggacaccgatccaaggagactcgtgcagctcctgcgacagcatagctccccctggcaggtttacggcttcgttcgggcctgtctgagacgattggtgccccccggactttggggatcacggcacaacgagcggcggttcctgcgaaacactaaaaaatttatctcccttggaaaacacgcgaagttgtctcttcaggagctaacatggaagatgagcgtacgtgactgtgcgtggctcaggaggtcgcccggcgtcgggtgcgtgccagctgcggaacatcgccttcgggaggaaattctcgctaaattccttcactggctaatgtctgtctatgtggttgaacttttgcgttcattcttctatgtgaccgagaccacgttccagaaaaacaggctatttttctacagaaagagtgtatggtcgaaactacagtcgatcggaatacgccagcatctcaagcgggtgcaattacgtgaactttctgaggctgaagtgcggcagcaccgagaagctaggcctgcattacttacctccagattgcgcttcattcctaagcctgatggactgcgccccattgtgaatatggactacgtcgtgggggctcgtacatttcgcagagaaaagagggccgagaggctcactagtcgggtgaaggctctgttttccgtcttaaactatgagcgtgcgcgacggccaggactgctcggggcttcagtgttggggctcgacgacatccatagagcatggagaaccttcgtactgagggttcgcgcccaagacccaccaccagagctgtattttgtcaaagttgatgtcactggggcttatgatacgatccctcaggatagacttactgaagtgatagcttctatcataaaaccacagaatacgtattgcgtgaggcgatatgcagttgtgcagaaggctgcccatggacacgtgagaaaagccttcaagagccacgtcctgaggcctgtgcccggagaccccgcgggcctgcatcccctgcatgccgctctccaacctgtgttgcgacgacacggggaacaggcagtgtgcggggacagcgctggcagagccgctcctgctttcggcggatag

SEQ ID NO: 208301 - DNA, 3399 bp, Artificial Sequence
  Description of Artificial Sequence: Synthetic coding sequence
atgccccgggccccccggtgccgggccgtgcggagcctgctgcggagccattaccgagaggtgcttcctctggcaacattcgtcaggaggctgggtccacaggggtggcggttggtgcagcgaggggatcccgccgcatttagggcgctggtcgcccagtgcctagtctgtgtgccgtgggacgccaggccacctccagcggccccctctttccgccaggttagttgtctgaaagagctcgtggcgagggtgcttcagagactttgtgagcggggcgcgaagaatgttttggcattcgggtttgccctcttagatggagcacgcgggggcccacctgaggcttttacaacttccgtgcgctcgtacttaccaaacactgttaccgatgctttacggggaagcggggcatgggggctactactaagaagagtgggggatgacgtgctagtgcatcttctggccaggtgcgccctattcgtgcttgtcgcaccttcatgcgcttaccaggtgtgcggaccacctctgtaccagctgggcgccgctactcaggctaggccccccccacacgcatcgggtccgaggcgcagattgggatgcgagagggcctggaatcatagcgtgagggaggctggggtcccactgggcctccccgcccctggcgcgagacgcagaggtgggtccgcatccaggagcctgcccttacccaaacggcctcgcagaggtgctgctcccgaacccgaacgcaccccagtggggcaaggatcctgggcacatccgggcagaactcgcggaccgtccgaccggggcttctgcgtggtctctcccgcacggcccgctgaggaagccacatctctagaaggggctctcagtggaactagacacagccatcctagtgtcggccggcagcaccacgcgggccccccctctactagtagacctccaagaccatgggacactccttgcccgcccgtgtacgcagaaactaagcatttcttatacagctccggcgacaaagaacagttgcggccgagcttcctgttatcctcactccgtccctcgctgacgggcgctcggagactagtcgaaacaatttttctgggcagccgaccctggatgccaggcactcccaggcgcttgccaagattacctcagcggtactggcaaatgagacccctgtttttggaattgttagggaatcatgctcagtgcccatatggcgtcctcctgaagacacactgtcctctccgtgccgctgtcacccctgccgctggcgtctgcgccagggaaaaacctcagggcagcgtggctgctcccgaggaggaggatacagacccccgtcgcctggtgcagcttctgcgtcaacactcttcgccctggcaagtctatggctttgtgcgcgcatgcttgaggcggttggttccccccggtttatgggggtcccggcacaatgaacggaggttcctaaggaatacaaaaaagttcatttcactggggaagcacgccaagctctcgctgcaggaactcacttggaaaatgtcagtaagggactgtgcatggcttagaagatcccctggtgttggatgcgtgcccgccgccgagcatcggctccgagaggaaatcttggccaagttccttcactggctgatgtccgtgtatgtagtggagcttctgcgcagtttcttttacgtgactgagaccactttccagaagaacaggctgtttttctaccgtaaatctgtctggagcaaactgcaaagcataggcattagacaacacctgaaacgagtgcagttgagggaactgtctgaggccgaggttcgacagcaccgggaggcccgtcccgctttattgacatcacgcctgcgattcatacccaaacctgacggccttaggcccatcgtcaatatggactacgtcgtgggtgccagaacctttaggcgggaaaagcgcgccgagagattaaccagcagggttaaagccctgtttagcgtgcttaactacgaacgggctcggagacctggcctgctcggggctagtgttcttggtctggacgacattcaccgggcctggagaacatttgttcttagggtaagggcccaggatcccccacccgagctgtacttcgtgaaggtagatgtgaccggtgcctacgacacaatcccgcaggataggcttaccgaggtgattgccagcatcataaagcctcagaacacatattgtgtgagaaggtacgcagtcgtgcagaaagctgcccacggtcacgtgagaaaagccttcaaatctcatgtcagcactctcacagacttgcagccatacatgcgacagttcgtggcccacctccaggaaacatccccactcagagatgctgtggtgattgaacagtcctcatcactcaacgaagcgtcgtccgggctctttgatgtctttctgcgatttatgtgccatcatgctgtgcgaatcagagggaagtcttacgtgcagtgtcagggcatcccccagggttctatactgagtacactgctgtgtagcctgtgttacggcgacatggagaacaagttattcgcaggcatccgccgggacggcctactcctcaggctagtggacgactttctgttggtaaccccccacttgacccacgctaaaaccttcctacgcacgctagttcgaggggtccctgagtacgggtgtgtggtgaatctgaggaaaaccgtggtcaatttccccgtggaagacgaagcactcgggggtacagcctttgtccagatgccagcccatggactattcccctggtgtggtttattgcttgacactcgaactctggaagtgcaatccgactatagcagctacgctagaacctctatccgcgccagtctgacctttaatcgaggtttcaaggcggggcgcaatatgaggcgcaagctgttcggagtgttgagacttaagtgtcattccttgtttttggaccttcaagtaaattcgctccagaccgtgtgcactaatatctataagattctacttctgcaggcttaccgcttccatgcgtgcgtcctgcagctgcccttccaccagcaggtgtggaagaaccccacattctttctgcgcgtcatctccgacaccgctagcctgtgctattcaatactgaaagccaaaaacgcaggaatgtccctaggagcaaagggggcggcaggcccactgccatctgaggccgtccagtggctttgtcaccaggctttcctgctcaagctgacacggcatagagtcacgtacgtacctttgctgggcagcctcagaactgcccagacccagctctcacgcaagctccctgggaccactctgactgctctcgaagccgcggccaaccccgccctaccgtctgatttcaagacgatcctcgattag

SEQ ID NO: 208302 - DNA, 3210 bp, Artificial Sequence
  Description of Artificial Sequence: Synthetic coding sequence
atgccccgggccccccggtgccgggccgtgcggagcctgctgcggtctcactatcgggaagtgctgccactggcaacttttgtacgacgactggggcctcagggatggcgcttggtacagagaggcgaccccgccgccttccgcgcgctggtggctcagtgcctggtttgtgtaccttgggacgctagacctcccccagctgccccaagctttcggcaagtgagctgtctaaaggaactggtggcccgcgtgcttcagcgcttgtgtgagagaggggccaaaaacgtgctagccttcgggttcgctctgctcgacggagcccgcggtgggccacccgaagcatttacgacctcggtccgctcctacctgccaaatactgttaccgatgctttgcgaggcagtggcgcatgggggctgctactcagacgcgttggcgacgacgtgctagttcatctgcttgctcgctgcgctttgtttgtactcgtggcacccagctgcgcctaccaagtttgcggaccacccttgtaccagctgggcgcagccacccaggccaggcctcctcctcatgccagtggaccccgccgcaggttggggtgcgagagggcctggaaccacagtgttcgcgaagccggggttccattgggcttgccagcccccggcgcccggcggagaggcggatcagccagtcggtccctgcctcttcctaaacgcccccgcaggggcgcagcacccgagccagaacgtaccccggttgggcagggcagctgggcccaccccggccggacacgtgggcctagcgaccgcggcttctgtgtggtgagccctgcgcggcctgcagaggaggcaacgtccctggagggggcattgagtggcacgcgccatagccatccttccgtcgggagacagcatcacgctggaccaccgtcaactagtaggcccccacgcccgtgggacaccccgtgcccacctgtttatgcagaaaccaagcactttctctattcctctggagataaagaacagttaaggccctcctttctcctgtctagtttacgaccaagcctcacaggtgctcgtcgcttggtggaaacaatcttcctgggctcacggccttggatgccagggacgccgcggcgcctccctcgactaccccagaggtattggcagatgcggccactgttcctggaactgcttgggaatcacgcccagtgcccctatggggtgctgctcaaaacccactgtcctctccgcgccgccgtaactcctgctgcaggagtgtgtgctagagagaagccacagggttctgttgccgctccggaggaagaggacaccgacccccgccgactcgtacaactgcttcgccagcacagttccccctggcaggtctacggatttgtgcgcgcatgccttcgccgcctcgtccccccaggactgtggggtagccgacataacgagcggcggttcctgcggaacacaaaaaaatttatttcccttggaaagcatgcgaagctttctttacaggaactcacatggaaaatgagcgtgcgggactgtgcatggctgcgtcgctcccctggcgtcggttgtgtcccagccgccgagcatcggcttagagaggagatcctggcaaagtttctgcattggctgatgtccgtctacgtagtggagctgcttcgtagtttcttttacgttacagagactacttttcaaaagaacagattgttcttctaccgcaagagcgtgtggtcaaaactgcaaagtatcggtatccgacagcacctcaagcgtgtgcagctgcgcgaacttagcgaggccgaggtgcgccagcatagagaagcgcgtcctgcgctcttgacctccaggctgagatttattcccaagccagatggcctgagaccgatcgttaacatggattacgtggtcggggcacggacatttcgcagggagaagcgcgctgaacgcttgactagccgggtgaaagccctgttttccgtccttaattacgaaagggcgaggaggccgggactcttgggagctagcgtgctcggcttagatgatattcaccgcgcgtggaggacatttgtgctgcgagtccgggcccaggatcctcctcctgaactgtactttgtcaaggtggacgtgaccggagcatacgacacgatcccccaggatcgtcttaccgaggtcatcgcctccatcatcaagccgcaaaacacgtattgtgtgcgaagatatgcggttgtacagaaggctgctcatggtcacgtccgcaaggcattcaagtctcatgtcagtacactgacagatctgcaaccgtatatgagacagttcgtggcacacctccaagagacctcgcccctcagggatgcagtagtgatcgagcaaagctctagtctgaacgaagccagctccgggctattcgatgtcttcctccgctttatgtgccatcacgcagtgcggattcggggcaagagctacgtccaatgtcagggtataccccaaggctccatcctgtccactctactatgctctttgtgttacggtgacatggaaaacaaactctttgcagggattcggcgcgacggactgctgttacgactagtcgacgattttctcctggtcacgccacacctgacacatgctaaaacctttctgtcctacgcccgaacctccataagagcgagcttgaccttcaacaggggctttaaggccggcagaaatatgaggagaaagctattcggggtgctgcgcctcaagtgccacagtctgttcctggatctccaggttaactcactgcaaactgtctgcacaaacatttacaagattttgctgctgcaggcctataggttccatgcttgcgttctgcagctgccttttcatcagcaggtctggaaaaatccaaccttttttctcagagtcatttctgatactgccagtctgtgttatagcattttaaaggctaaaaatgctggcatgtcattgggggctaagggcgcggccggtcctctgccttctgaggcggtccagtggttatgtcaccaggcgtttctcttaaagctgacaagacaccgggtgacttatgtccccttgttaggctccctccgcaccgcacagacccagctgtcccgaaaactgcctggcacaactttaacagccctggaggccgccgccaatccagcactgcctagtgattttaagaccattctcgactag

SEQ ID NO: 208303 - DNA, 2424 bp, Artificial Sequence
  Description of Artificial Sequence: Synthetic coding sequence
atgccccgggccccccggtgccgggccgtgcggagcctgctgcggtcccactatcgagaggttctacctttagctacttttgtgaggcgactgggaccccagggatggcgactcgtccagagaggcgaccccgcagcgttccgggccctggtagcccagtgcttagtgtgcgtgccctgggacgcccggcccccgccagccgctccatcctttaggcaggtgtcctgcctaaaggagctggttgcccgggtcctgcagaggctgtgcgaaagaggcgccaagaatgttctggccttcggttttgccctgctggacggcgctcggggaggcccccctgaggcctttaccacgtccgtccgctcttatctcccaaatacggttactgatgcactaagagggtcgggggcctgggggctcctgcttcggcgagtgggcgacgatgttctggtgcaccttctggccaggtgtgccttgttcgtcttagtggcaccgtcgtgtgcctaccaggtatgtggccctcccctataccagctgggcgcagcgactcaggccaggccccccccccacgcctccggcccacggaggaggttggggtgtgaacgagcttggaaccacagtgtcagagaagccggcgtccctctcggcctgccagcccctggggcccggcggcggggtggaagcgcatcccgaagtcttcccctgcctaagagacctcgtagaggcgcagcaccagagccggagagaacccccgtgggacagggctcttgggcccacccagggaggactaggggtccatccgaccgcggcttttgcgtggtgtctccagcccgtcccgctgaagaagcaacgagcctagagggagccctcagtggcacacggcacagccacccatccgtaggaaggcagcaccacgccgggcccccgtctacaagcagaccaccgcgaccctgggacacaccatgcccgcctgtttacgccgaaacgaagcactttctctatagctccggagacaaggaacagcttcgacccagcttccttctgtctagcttacgaccatctctgactggggcgcgccgcctggtcgagactattttcctggggagcaggccctggatgccgggcacaccgcgacgactacctcgactgcctcaacgctattggcagatgagacctttattcctcgagctcctagggaaccacgcccagtgtccatacggagtgcttctgaagacgcactgccccttgagagcagcagttactcccgcagctggcgtatgcgctcgtgagaagccccaaggctctgtggccgcccctgaggaggaggatacagatccacggcgccttgtgcaacttctgcggcagcattcttccccttggcaggtatacggttttgtaagggcgtgcctgagacgactggtgcctccaggactttggggaagccgccacaatgaacgccgctttctgcgcaatacaaagaagttcatctccctcggtaagcacgccaaactgagtttacaggaactcacatggaagatgagtgtcagggactgcgcttggctaaggcgaagtcccggagtaggctgtgttccagcagccgaacatcggttaagggaggagatactggctaagttcctccattggctgatgagcgtgtatgtcgtcgagttgctgagatcattcttctatgtgactgagaccacctttcagaagaaccgcctgttcttttacaggaagtctgtatggagcaagctacagtccataggaatccgacaacatcttaagagagtgcagttgcgcgagctgagcgaagccgaagttaggcagcatagggaggctcggccggcccttcttacatccaggctcaggtttatacctaagccggatggtctccggcccattgttaacatggactacgtggtgggagccagaacgtttagacgggaaaaacgcgcagagagactcacatcacgggtaaaggccctgttttcagtattgaactatgagagagcccgacggccaggactccttggcgcgagcgtgctcggcctggacgacatccacagggcatggaggacatttgtgcttcgggtgcgggcccaggatcctccaccagagttatactttgtaaaagtcgatgtcactggggcttatgatacaattccacaagatcggcttaccgaggtcatcgcctccattattaagccgcagaacacatattgcgtcagacgctatgcagtggtacagaaggctgcccacggacacgttcgtaaggccttcaaatctcacgtgctacggcctgttcctggggacccagccgggctgcatcctctgcacgccgctttgcagccagttcttaggagacacggcgagcaagccgtgtgcggagatagcgccggacgggcagccccagcctttggcggatag

SEQ ID NO: 208304 - DNA, 372 bp, Artificial Sequence
  Description of Artificial Sequence: Synthetic coding sequence
atgatgctgcccaagcccggcacctactacctgccctgggaggtgtcagccggacaggtgcctgatggttctaccctgaggacattcggcaggctgtgcctttatgatatgatccagagccgggtgactctgatggctcagcacggttctgaccagcaccaagtcctcgtgtgcactaaacttgtagagccttttcacgctcaggtaggtagtctgtatatagtgctgggcgagttgcagcaccagcaagaccggggatccgttgttaaggcccgcgttctgacatgcgtggagggtatgaatctccccctgctggaacaggccattcgtgagcagaggctgtacaaacaggaacggggcggctcacagtag

SEQ ID NO: 208305 - DNA, 369 bp, Artificial Sequence
  Description of Artificial Sequence: Synthetic coding sequence
atgctgcccaagcccggcacctactacctgccctgggaggtgagcgccggccaggttcccgacggaagcacgctacgcacattcgggcgactgtgcttatacgacatgattcagagccgagtcacccttatggcccaacatgggagtgatcagcaccaagtgctcgtctgtactaagctcgtggagccattccacgcccaggtgggatccctctacatcgtgctgggtgagctgcagcaccagcaggatcgggggagtgtggtgaaggcccgtgttctcacatgcgtggaagggatgaaccttcccctcctggaacaggccatcagagagcaaagactgtataagcaggagagaggtggaagtcagtag

SEQ ID NO: 208306 - DNA, 5514 bp, Artificial Sequence
  Description of Artificial Sequence: Synthetic coding sequence
atgggcgccatgacccagctgctggccggcgtgttcctggccttcttggctcttgccactgagggcggtgtactgaaaaaggtgattcgccacaaaaggcagagcggggtgaacgccactttacccgaggaaaatcagccagtggtgttcaaccatgtctacaacataaaactccccgtgggttcacagtgttcggtggatctcgaatccgcctccggcgaaaaggatttggccccaccatcggaaccaagtgagtcgttccaggaacacactgttgacggcgagaatcaaatcgtgtttacccacagaataaatataccacggagggcttgcggctgtgccgcggcccctgacgttaaggagctcttaagccgacttgaggagctcgagaaccttgtgtctagtctccgggaacagtgtactgccggcgcaggctgctgtcttcagcctgccactggacgcctggatactaggcccttttgttccggtcggggcaacttttccaccgaaggatgcggctgcgtgtgtgaacctggctggaaagggcccaattgctcagagccagaatgtccgggcaattgccacctccggggacggtgtatcgatggacagtgtatatgtgacgacgggtttacaggtgaggattgtagtcagctggcctgtcccagcgactgtaacgaccagggcaaatgcgtcaatggcgtgtgcatttgtttcgaaggctacgcaggggctgactgctcaagggagatttgtcctgttccttgctcggaggagcacggaacgtgcgtggacggtctgtgcgtttgccatgacgggttcgccggtgatgactgcaacaaacccctgtgcctaaataattgttataatcggggtaggtgcgttgaaaacgaatgcgtgtgcgacgaaggattcaccggggaggattgttccgagctcatctgccccaatgattgctttgacagaggaaggtgcataaatggtacatgctactgtgaggaaggatttactggcgaggattgcgggaaaccaacttgcccgcatgcatgtcacacccaaggacggtgcgaggaaggtcaatgtgtgtgtgatgaaggctttgctggagtggactgttccgaaaagagatgccctgccgactgtcacaatcgcggccgatgtgtggacggcaggtgtgagtgcgatgatggctttaccggcgccgactgtggagagcttaagtgccccaatgggtgctcaggccacggtaggtgtgtgaatgggcagtgtgtttgtgacgagggttacaccggcgaggactgctcacagctcagatgtcctaatgactgtcactctcgaggccggtgcgtagaaggaaagtgcgtatgcgagcaagggtttaaagggtacgattgttcagacatgtcgtgtcctaacgactgccaccagcacggtaggtgtgtgaatggtatgtgcgtctgcgacgatggctatactggggaagattgtcgggaccgccagtgcccaagggactgcagcaatcggggcttgtgcgtcgacggtcagtgtgtctgcgaagatgggtttacggggcccgattgcgctgaactgagctgcccaaatgactgccatggccaaggaagatgcgtgaacggccaatgtgtctgtcacgaaggctttatggggaaagactgcaaggagcaacgctgccctagcgactgccacggccaaggacggtgcgtggatggacagtgcatatgccacgaaggatttactgggcttgattgtgggcaacacagttgtccatccgactgtaataatttgggccagtgtgtatcaggtcgctgcatctgcaatgagggttattctggcgaagactgttctgaagtgagtcctcctaaggacctggtggtgacagaagtgaccgaggagacagtgaacctcgcgtgggacaatgaaatgagagtcaccgaatatttggttgtgtatacccctactcacgaaggcgggcttgaaatgcagttccgagtgccgggcgaccaaaccagcactatcattcaggaactcgagcccggcgttgaatattttattagggtttttgctattctggagaacaagaaaagcattccagtgtcagctcgagtagccacatatttgccagccccagaagggctgaagttcaagagtattaaggagacctcggtagaagtcgaatgggaccccctcgatattgcctttgaaacctgggagatcatttttaggaacatgaataaagaagatgagggtgaaataactaagtccttgcgacgccctgagacctcctatagacagaccggcctagcgccggggcaggagtatgagatttctctccatatcgtcaaaaataacacacggggcccaggtctcaaaagagtgacgaccaccaggttagacgcacctagtcaaatcgaggtcaaggacgtcaccgacacaactgcactgatcacttggttcaagcccttggccgaaattgatggtatcgaattgacttatggcatcaaggacgtacccggcgatcggaccaccattgatctcaccgaagacgagaatcaatactctatcggcaatctgaagccggataccgaatatgaagtgtcccttattagccgtagaggggacatgtcctccaaccccgccaaggagaccttcaccaccggtctcgatgcccccaggaaccttcggcgagtgtctcagacagataattctattaccctggagtggcggaatggaaaagcagccatagactcttaccgcattaagtacgccccaatttccgggggagaccacgctgaagtggacgtcccgaagtcccagcaggcgactacaaagacaactctgacaggtctgaggccaggtaccgaatacggtatcggcgtgtctgcagtaaaggaggataaagagtccaatcccgcgaccatcaatgccgccacagaactcgacacccccaaggatcttcaggtatcagaaaccgctgagacatcactgacactgctgtggaagacaccactggcaaaattcgatcgctacagactcaattatagtctccctacgggacagtgggttggagtacagctgcctaggaatacgactagctatgtcctcagggggctcgagcctggtcaggaatacaacgtgctgctcaccgccgagaaaggacggcataaaagcaaaccagcaagagtcaaagctagcacggccaaggagccagagattgggaatctgaatgtctctgatataacacctgagagctttaacctgtcctggatggccaccgacggtatcttcgagaccttcaccatagaaatcattgatagtaatcggctactcgagactgttgagtataatataagcggcgccgagcgaaccgctcacataagcggactgccaccaagcacggattttatcgtttacctgagcggcctagcacctagtatccggacaaagactatttctgcaaccgctaccaccgaagcccttccactgcttgaaaatttgactatctcagatatcaacccttacgggttcaccgttagctggatggccagcgagaacgcattcgattcattcctggtcaccgtggtggacagcggaaagttgcttgatccacaggagttcactttgagtgggacacaaagaaaactcgaattgcgaggtctaattacaggcataggatatgaggtgatggtgtccggcttcacacaaggccaccagacaaaacccctacgggctgagattgtcactgaggcggagcctgaggtggacaatctgctcgtgagtgatgccaccccagatggctttaggctttcttggaccgcggacgagggggtgtttgacaattttgtattgaagattagagatacaaaaaagcagagtgaacccctcgaaataaccctcctggctcccgagaggacccgggatatcactggcctgcgagaggcaaccgagtacgagatcgaactttatggaatttcgaaaggccgccgctcccagactgtcagtgctatagctaccacagccatgggctctcccaaggaggtgattttctcagatatcaccgaaaacagcgccaccgtgtcttggagggccccaacagcccaggtggagtcgttcagaataacatacgtacctatcactggcggaacacctagcatggttaccgtggacgggacgaagacacagactcgtctagttaagctgatcccaggggtcgagtatctcgtaagcatcatcgcaatgaaaggttttgaagagagcgagcccgtctcgggcagtttcaccacggcattggatggaccttctggattagtaaccgctaacatcactgacagcgaggctctggcccggtggcagcccgccatcgccactgtagactcatacgtgatcagttataccggagaaaaggtccccgagattactaggacagtgagcggcaatactgtggaatacgccttgacagatctcgaacctgccacggaatacaccctcaggatttttgctgagaagggaccccagaaaagttctacaattaccgccaagtttactacagacctggatagccctcgcgatctgaccgccacggaggtacagtcggagacggcactgctgacttggcgaccaccacgcgcttcggtgacagggtatctcctggtgtatgaatctgtcgacggaaccgtgaaagaagttatcgtcggaccagacacaacctcttattcgctggccgacctgtccccgagcactcactacactgccaagattcaggctctgaacggtccacttaggtccaacatgatccagacgattttcacaaccatcgggttgctttacccttttcctaaagactgttctcaggccatgttaaatggcgacaccacgtcgggcctatatactatttatcttaatggcgataaagccgaagcactcgaggtgttttgtgatatgacctccgatggcgggggctggatagtcttcttgcgccggaagaatgggcgcgagaatttttaccagaattggaaggcctatgctgccggcttcggcgatcgcagggaggagttctggctgggcctggataacttaaacaaaatcacagcccaaggccagtacgaacttcgcgtggatcttcgcgaccacggggaaacggcctttgcagtttacgataagttctccgtgggagacgcaaagacgaggtacaagctcaaggttgaaggctattccggcaccgcaggagacagcatggcttaccacaacggaaggagtttctcaaccttcgataaagacactgacagcgcgatcactaactgtgccctgagttacaaaggcgccttctggtacagaaactgccacagagtaaatctgatggggaggtatggggacaataaccatagtcagggtgtaaattggtttcactggaaggggcatgagcacagtatccagtttgctgaaatgaagcttaggcccagtaattttcgtaacctggaaggaagacggaagcgcgcctag

SEQ ID NO: 208307 - DNA, 4695 bp, Artificial Sequence
  Description of Artificial Sequence: Synthetic coding sequence
atgggcgccatgacccagctgctggccggcgtgttcctggccttcctcgctctcgcgaccgagggcggagtgctgaagaaggtaattcgccacaaacggcagtctggcgtcaacgccactcttcccgaagaaaatcagcccgtggtgttcaaccatgtgtataatatcaaactgccagtggggtcccagtgtagtgtggaccttgaatcggcttctggagagaaggacctggcccctcccagcgagccttctgagagcttccaggaacacactgtcgacggcgagaatcagatagtgttcacacaccgtattaacatcccacgccgcgcttgcggctgcgctgccgcccctgacgttaaagagctgctgtcaagactggaggaacttgaaaacctggtctcttcgctaagagaacaatgcacggctggtgcgggatgttgtctgcagccagcaaccggccgtctggatactagacccttttgcagcggacgggggaactttagcaccgagggctgtggatgcgtgtgcgaaccaggttggaagggacccaactgttccgagcccgagtgcccgggcaactgccacttacgtggtagatgcattgatggacaatgcatctgtgatgacggattcaccggcgaagactgcagccagttggcttgtccatctgactgcaacgaccagggaaagtgtgtgaacggggtgtgcatctgctttgagggttacgctggcgccgactgctctcgggagatatgcccagtcccatgcagcgaggagcacggtacctgcgtggatggactgtgtgtctgtcatgatgggttcgccggtgacgactgtaacaagcccctgtgcctcaacaactgctataacagagggagatgtgtggaaaatgagtgtgtttgcgatgagggattcactggtgaagattgctctgagcttatttgcccaaatgattgttttgatcggggacggtgtattaacggtacatgctactgtgaggagggtttcaccggagaagactgcggaaaacccacctgccctcacgcttgtcatactcagggccgatgcgaagagggccaatgtgtatgtgacgaagggttcgccggagtggattgtagcgaaaagagatgccccgccgactgccacaaccgcggacggtgtgtggacggtcggtgcgaatgcgacgacggtttcacaggggcagattgcggcgaattgaagtgcccaaacggctgttcaggacacggacgatgcgtaaacggtcagtgcgtttgcgatgaggggtacactggtgaggactgctctcagctcaggtgccccaatgattgccacagccgtgggaggtgcgtggagggcaagtgcgtgtgtgaacagggtttcaagggctatgactgttctgacatgtcttgccctaatgactgtcaccagcacggtcggtgcgttaatggaatgtgtgtctgtgacgacggatacactggtgaggactgtagggaccggcagtgccccagagattgctccaataggggcctttgtgtcgacggacaatgtgtgtgcgaagatgggtttacaggaccggactgcgcagagctcagttgtcccaacgattgccacgggcaggggcgctgcgttaatgggcaatgtgtgtgccacgaggggtttatgggcaaggattgcaaggagcagcgctgtcccagtgattgccacggacagggaaggtgcgttgacggacagtgtatatgccacgaagggtttactggattggactgcggtcagcactcatgcccatccgattgtaataatttaggccagtgtgtgagtgggagatgtatctgcaacgagggatacagcggcgaagactgctccgaggtgagtccccccaaggaccttgtggtgacagaggtcactgaggagactgtaaaccttgcctgggataatgagatgagagtgacagagtacctcgtcgtgtatacacccacccacgaaggaggtttggagatgcagttcagggtgcccggcgatcagacttcgacaataattcaggagctggaacctggggttgaatacttcatcagagtgttcgccatactagagaataagaagagtattcccgtgagcgccagggtcgcaacataccttcccgcgccagaaggccttaaattcaaaagtattaaagaaacctctgttgaagtcgagtgggaccctcttgacatcgcattcgagacttgggagattatcttcagaaacatgaacaaagaggatgaaggcgagatcactaagtcactacggcgtcccgaaactagttaccgccagactggcctggcccccgggcaagaatacgaaatatcccttcatattgtcaaaaacaatacaaggggccccggcctcaaacgagttacgaccaccagacttgatgcacctagccaaattgaggtaaaagatgtgactgataccaccgccctaatcacatggttcaaaccccttgccgagatcgatgggatagaactgacatacggaattaaggacgtgcccggggaccggaccacaatcgatctcactgaggatgaaaatcagtacagcattggaaacttaaagccagacactgaatacgaagtctcgttgatcagccgccgcggcgatatgagtagcaatccagcaaaagaaaccttcactacaggcctcgacgcaccccgaaacctccgccgggtctcgcaaaccgacaactcaatcactctagaatggcggaatggtaaagctgcaatagactcttatcgcattaagtacgcacctatttcgggcggagaccatgcagaagtcgacgtcccgaagtcccagcaggcaacgacaaagactacgcttacaggcttgagacccggaactgaatacggtataggcgttagcgcagttaaggaggataaggagtccaaccccgccaccattaatgccgcaaccgaattagacacacccaaagacctgcaagtttccgagacagcggaaaccagcctcaccctgttgtggaaaactcctctggccaagtttgataggtatcgtttaaactactctctgcccactggccagtgggtgggggtgcagctcccacggaataccacatcgtacgtactcagagggctggaacccggtcaggagtataacgttcttctgacagccgaaaaaggtaggcataagtcgaagccggccagagtgaaggccagcactgcaatggggtcgcccaaagaagtgatcttctctgacatcacggagaattctgcaactgtttcatggcgagccccaacagctcaagtcgaaagcttcaggatcacatacgtgcccataaccgggggaaccccaagtatggtgaccgttgacggcaccaagactcagacccgcttggtaaaattgattcccggcgttgagtacctagtctcaataatagcgatgaaagggtttgaagaatccgagcccgtgagtgggtcctttacaactgccctggacggtccttccggcttggtaacagcgaacattaccgactcggaggctctcgcaagatggcagcccgcgatcgcaaccgttgactcttatgttattagctacactggcgaaaaggtgcccgagatcactcggaccgtgagcggaaacaccgtggaatacgccctgactgatttggagccagcaactgagtataccctgagaatcttcgctgagaagggtcctcagaagagtagcaccataacagctaagtttactactgacctggattcacctcgagacctgaccgccaccgaagttcagtcagaaactgccttgctgacttggcgtccgcctcgggcatccgtgactggctatcttcttgtgtatgaatccgttgatggaacagtaaaggaagtcattgtaggcccggatacaactagctacagcctggccgacctgtcaccaagcacccactacaccgcaaagatccaggctctcaacggacctttgagatcaaacatgatccagacaatattcactactatcggattgctctacccatttcctaaagactgttcccaagctatgcttaatggagacactacctcgggactgtacactatttacctgaatggggacaaagcagaggccctcgaggtgttttgtgacatgactagcgacgggggcggttggatagttttcttgagacgaaaaaacggcagagaaaatttctaccaaaattggaaagcctacgccgctgggtttggtgaccgacgggaggaattttggttaggactggacaatctgaacaaaattactgcacaaggacagtatgaactgagggtcgacctgcgggatcacggcgagacagccttcgcggtgtacgataagttttccgtgggggacgccaagaccagatacaagctcaaggtggaaggctactccgggacagccggggacagcatggcctaccacaacggccgctctttcagcacattcgacaaggataccgacagcgccataacaaactgcgccttgtcgtacaaaggggctttctggtatcggaattgtcaccgcgtgaacctgatgggtaggtatggtgacaacaatcactcacaaggagttaattggttccactggaagggccatgaacatagtatccagttcgccgaaatgaagcttaggcctagcaactttcggaacctggagggccgcagaaagcgtgcatag

SEQ ID NO: 208308 - DNA, 4968 bp, Artificial Sequence
  Description of Artificial Sequence: Synthetic coding sequence
atgggcgccatgacccagctgctggccggcgtgttcctggccttcctggccttggcaacggaagggggcgtgctgaaaaaagtaatccggcacaaacgccaatccggcgtaaacgccacacttcccgaagagaaccagcctgttgttttcaaccatgtatacaacatcaaactccccgtggggagccagtgttctgtggacttggaatctgccagtggagagaaggacctggctcccccctcagaaccctccgaatcattccaggagcacacagtggacggagagaaccaaatcgtgtttacacatcgaatcaatattccacgtcgcgcctgtggttgcgccgccgccccagacgtgaaggagctgctgagcaggctcgaggaactcgaaaatctggtgtctagcctgagagaacaatgcactgccggagcggggtgttgcctccagccagcgactggcaggctggacaccagaccgttttgctccggaagaggaaacttttccactgaaggctgtggctgtgtgtgcgagcctgggtggaaggggcctaattgtagcgaacccgagtgccccggaaactgccacctccggggtcgctgcatagacggccagtgcatctgtgatgatggattcaccggggaggactgtagtcagctggcctgtccatcagattgcaacgaccagggtaaatgcgttaatggtgtctgtatttgtttcgaaggttacgcaggggctgattgctctcgggagatctgccccgttccatgctccgaggagcacggtacgtgtgtggatggcttatgtgtctgccacgatggcttcgctggagatgactgcaataagccactctgcctgaataactgttataatcgagggcgctgtgtggagaatgagtgtgtgtgcgatgagggatttactggcgaagactgtagtgagcttatctgccctaacgactgcttcgatcgtggccggtgcattaatggcacatgttactgtgaggaaggttttaccggggaagactgcggaaaacctacttgcccacacgcttgccacacgcagggccgttgtgaagaggggcagtgcgtgtgcgacgaaggctttgcaggagtggattgttccgaaaagcggtgtccagctgactgtcacaaccgggggcgctgcgtcgacggccggtgcgagtgcgacgacggcttcacgggagccgactgcggggaattgaagtgtcctaacggctgttcaggccatggcagatgcgtaaacggccagtgtgtgtgcgacgagggatatacgggtgaagactgttctcaactcaggtgtcctaatgactgccacagccggggtcgctgcgttgagggaaagtgtgtgtgcgagcaaggcttcaaaggatacgattgctcagacatgagttgccccaacgattgtcaccaacacggcagatgtgtgaacggcatgtgtgtctgcgacgacggatatacaggcgaagattgtcgggatcggcaatgcccaagggattgttccaacaggggtctctgcgtcgatgggcagtgcgtgtgcgaggacggcttcacgggacccgattgcgcagagttgtcatgccccaatgattgtcatggacagggccggtgcgttaatgggcagtgtgtatgccacgaaggcttcatggggaaagactgcaaagagcagagatgtccttctgactgccacggacaaggccgatgcgtggacggccagtgcatctgccatgagggcttcaccggactagattgcggccagcattcctgccccagcgactgcaataatctggggcagtgtgtgagcggtaggtgtatctgtaatgaagggtattcgggagaggattgttccgaagtttcccctcccaaggacctcgtggtcactgaggttactgaggagacagttaacttggcatgggacaacgaaatgcgtgtgacagagtatctggtcgtctatacacccactcacgaaggcggactggaaatgcagttccgcgtgccaggggaccagacgtccacgattatccaggaacttgaaccgggcgtggagtacttcatccgggtcttcgccatcttagagaacaagaagtctattcctgtgtctgccagagtggccacatatcttccggcccccgagggactgaagtttaagagcataaaagagacgtccgtggaggtagagtgggacccccttgatattgcgttcgagacttgggaaatcatttttcgcaacatgaataaagaagacgagggagagatcaccaaaagtctgaggcgtccagagacaagttatcgacagacagggctcgctccaggacaggagtatgagataagtcttcatatcgtgaagaataatactcggggacctgggttgaaaagggtaactaccacgcgcttagacgctcctagccagattgaagtgaaagacgtaactgacacaacggcgcttattacttggtttaagcctctggcagaaatcgatggaattgagttgacctacggaatcaaggatgtcccgggcgatcggacaactatagatctgacagaggacgagaatcagtactccattggtaacttgaagcccgataccgaatacgaggtttctctcatctctaggcgaggagatatgagttccaaccctgcaaaagagaccttcacaacaggacttgacgccccacggaaccttagacgcgtgagccagaccgacaatagcatcactctggagtggcgtaatggcaaagcagcaatcgatagctatcggatcaaatatgctccgataagtggaggcgatcacgccgaagttgatgtgcctaagtcccagcaagctactactaagactacactgacggggctgcggcctggcactgaatacggtatcggtgtgtcggccgtaaaagaggacaaggaaagtaatcctgctactattaatgccgctaccgagttggacacacctaaagacttacaggtctccgaaacagctgagacctccctgaccctgctatggaaaactcctctggccaagttcgaccggtaccggctgaactacagtctgccaactggtcagtgggttggagtccagctgccccgcaacacaacatcttacgtcttgcgaggcctggagcccggccaagaatataatgtgctgctcaccgctgagaaaggccggcataagagcaaaccagccagggtgaaagctagtacggaggctgagccagaagtggacaaccttctcgtctcagatgccaccccagatggcttccggctgagctggacggccgatgaaggcgtgttcgataactttgttctcaagatccgggatactaaaaagcaatcagaaccacttgaaatcacattgctagctcctgaacgcactcgagacatcaccggtttacgggaggctaccgaatatgaaatagaactatacggcatttctaagggacggcgctcccagaccgtgagtgccattgccacgacagctatgggtagccccaaagaggtgatttttagcgatataaccgaaaattccgcaaccgtatcgtggcgagcaccgacagcccaggtggagagtttccgaataacgtacgttcctattacaggcggcacaccctccatggtaaccgtggacggtaccaagacacaaactaggctggtgaaattaatccctggggtggagtacttagtatcaatcatcgcaatgaaagggtttgaggaaagcgaaccagtcagcggaagctttactactgccttggacgggccaagcggccttgttacagccaatattacagacagcgaagccctggcgcgttggcagcctgccatagccaccgttgatagttacgttatctcatacactggagaaaaggtgccagagattacacgaactgtgtcgggtaacacagtggaatatgctctcacagacctggagcctgcaacggagtatacgcttcggatctttgcagagaagggtcctcagaagtcgtccacgattaccgctaaattcaccacagacctggactcccctcgtgacctgacagccactgaggtgcagagcgaaacggccctcctaacatggagacccccaagggcttccgtcaccggctacctcctggtgtatgaatctgtggacggaaccgttaaggaagtgatcgtgggccccgacactacctcttactccctggccgatctgtctccctccacccactataccgccaaaattcaggcgctgaacgggcccctccggagtaatatgatccagaccattttcaccactatcggactcttatacccttttccgaaggactgttcccaggcaatgctcaatggcgataccacctccggtctttacaccatttaccttaacggtgacaaagcagaagcactcgaggtattttgtgacatgacatctgatggtggtggctggatagtgttcctgcgcaggaagaatgggcgggagaacttctaccagaactggaaagcctatgctgcggggtttggagaccgcagagaggagttttggctgggcttagataatctgaacaagattacagcccagggtcagtacgagctaagggtggatctgcgagaccatggtgaaactgcctttgctgtgtatgacaagtttagcgtgggcgatgctaaaactagatacaagctcaaggtggaaggctattccggtacagcaggtgacagcatggcctaccacaacggccggagttttagcactttcgacaaggatacagattccgctattaccaactgcgcactgtcttataagggcgctttctggtatcggaactgccatcgggtcaaccttatgggccggtatggcgataataatcacagtcaaggggttaactggtttcattggaaggggcacgaacactccattcagttcgcagagatgaagctgcgtccctccaactttcgtaatctggaggggcggcgcaaaagagcctag

SEQ ID NO: 208309 - DNA, 6606 bp, Artificial Sequence
  Description of Artificial Sequence: Synthetic coding sequence
atgggcgccatgacccagctgctggccggcgtgttcctggccttcctggccctggccaccgagggtggcgtattgaaaaaagtgatccgacacaagaggcaatccggggtgaatgccacactcccggaggagaatcagccagtggtgtttaatcacgtatataatatcaagctcccggtgggaagccaatgctcagtcgacctcgagagtgctagtggcgagaaggatttagccccacctagtgagccatccgaatcctttcaggagcatactgtagatggtgagaaccagatcgtgttcacacacaggatcaatatcccgagacgcgcctgtggttgcgcggctgccccggatgtaaaagagctgctctctcggctcgaagaattagagaacctcgtgtcgtccttgagggagcagtgcactgcaggagctgggtgttgtctccagcccgcaacaggcaggctcgacacaaggcctttctgttccggccgcggtaacttttcgacagaagggtgcggctgcgtctgcgagcccgggtggaaaggacctaactgttcagaacctgaatgccctgggaactgtcatcttcggggacgatgtatcgatggtcaatgcatttgtgacgacggctttacaggcgaggactgttcccagcttgcctgcccctctgattgcaatgaccaaggaaaatgtgttaatggggtgtgtatatgctttgaaggctacgccggggcggattgtagccgcgaaatttgcccagtgccttgctctgaagaacacgggacttgtgtggatgggctgtgcgtgtgtcatgacggattcgcgggcgacgactgtaacaaacctctgtgcctcaacaactgctacaacagggggaggtgtgtcgaaaatgaatgtgtgtgtgacgagggctttaccggggaggactgttctgagttaatttgccctaacgactgtttcgaccgtggcaggtgcatcaatggcacatgttactgcgaggaggggttcacgggcgaagattgcgggaagcctacctgtcctcacgcctgtcacacacaggggaggtgcgaagagggtcaatgcgtctgcgacgaaggcttcgcgggagtggactgttccgagaaacgctgcccagccgattgtcacaatagaggccgttgcgtggatgggagatgtgagtgcgatgacggtttcaccggggccgactgtggagaattgaaatgtcctaacggatgtagcggacacggcagatgcgtcaatgggcagtgtgtttgcgatgagggttatacaggggaagattgctcgcagctgcgctgccctaacgactgccatagtcgtgggcgatgtgtggagggcaagtgtgtttgtgagcagggcttcaaggggtatgattgttctgacatgagctgtcctaacgactgtcaccaacatgggcggtgtgtcaatggaatgtgcgtatgcgacgacgggtataccggtgaggattgccgtgacagacaatgcccgagagattgcagcaaccgaggtttgtgcgtagacggacagtgtgtgtgcgaggacggtttcacaggaccggattgcgccgaactgtcttgcccaaacgattgccatgggcaggggcgttgtgtgaatggccagtgcgtgtgccacgaaggctttatgggcaaggattgcaaggagcagcggtgccctagtgattgccacggacagggaagatgcgtggacgggcaatgcatctgtcatgagggttttaccggcctagattgcggacaacactcctgtccttccgactgcaacaatttagggcaatgtgtctcaggcaggtgcatatgcaacgaggggtactctggagaggactgctctgaggtgtctccacctaaggatctggtggttaccgaagtgactgaagagacagtgaatctagcctgggacaacgagatgagagtaactgagtatctcgtagtgtatacccctacacacgagggcggtcttgagatgcagttcagggttccaggtgatcagacatcgacaatcattcaggaactagagcccggggtggaatatttcatcagagtcttcgccattttggagaataagaaaagcatccccgtgtccgctagagttgctacatatctcccggccccagaaggcttaaaatttaagagcatcaaggaaacttcagtcgaagtggagtgggatccattggacattgccttcgaaacctgggaaatcatatttagaaatatgaacaaggaggacgaaggcgagattactaagagtctacgtagacccgagacctcttaccggcaaaccgggctcgctccaggccaggaatatgagatatccctccatatcgtgaaaaataatactcgcggacccggattaaagagagtgacgactacacgtctggatgcaccctctcagatcgaggtgaaggacgtcaccgacacaacagccctgatcacttggttcaagcctctggccgaaatcgacggcatcgaattgacgtacgggatcaaggacgtcccaggtgacagaaccacaattgatctcaccgaagatgaaaatcagtatagcatcgggaatctcaagcccgataccgagtacgaggtgagccttatttcccgtaggggggacatgtcatctaaccctgccaaggagacatttactactggcttggacgccccaagaaacctaagacgcgtctctcagacagacaactcaatcacactggagtggcgtaatggtaaagctgcgatagacagctatagaattaagtatgccccaatatccggcggagaccatgctgaggtggacgtgcccaagtcccagcaggcaaccacaaagaccactcttacagggttgcggcctggcaccgaatacgggattggcgtatctgcagtgaaggaagataaggaatctaatccagcgacgatcaatgccgcgactgaactagacacccccaaggacctgcaggtctctgagacggctgagacttctttgaccttattatggaagactccactggctaagttcgatcggtatcgtctcaattattctctgcccaccggacagtgggtgggcgtacagcttcctcgcaataccacttcatatgtgctacggggtctggagccaggacaggaatacaatgtcctgctgactgcagagaaaggcagacataagtctaaacccgctagagtcaaggcctcgacagagcaggcacccgaattagagaacctgactgtcaccgaggtcggttgggacggcctgcgactaaattggactgcggcagatcaagcctatgaacattttatcatccaggtacaagaggccaataaggtggaggctgcccgaaaccttacagtgcccggctcactgcgcgcagtggatatcccaggcctgaaagccgctacaccttacaccgtgagtatatatggtgtgatccaaggatatcgtactcccgttctgagcgctgaggccagtactggggagacaccaaaccttggcgaggtggtggtggcagaagtggggtgggacgcactcaaactgaactggacggctccagagggcgcctacgaatacttttttattcaggtgcaagaggctgacacagtggaagcagcccagaacttgacagtaccaggcggcctgagaagtactgatctacccggcctgaaggccgctactcactataccatcacgatcaggggcgtgacccaagactttagcaccactcccctctccgtggaagttcttacagaagaggtgccagacatgggcaacttgacagtgacggaagtatcgtgggacgcactccgcctgaactggaccacccctgacggaacctacgaccagttcacaattcaggtccaagaggcggatcaagtggaggaagcgcataatctgactgtgccgggctctttacggtccatggaaattcccgggctgcgggccggcactccttacactgtgacactgcacggggaagtcagaggccattccactcgaccattggccgtggaggtggtgacagaagacctgcctcaactgggcgatctggccgtgagtgaggtaggctgggacggattgagactgaactggaccgccgccgacaacgcctacgaacacttcgtcattcaggtccaagaggtgaataaagtcgaagcagctcaaaatctgacactacccggctctctccgggcggtcgatatccccgggctagaggctgctacaccatatcgtgtgtccatttacggcgtaatcagggggtaccggacgccagtgctgagtgcagaagcatctacagccaaggagcccgaaattggtaatctgaacgtgtctgatatcacccctgaatcattcaatctgagttggatggccaccgacgggattttcgaaacctttacaatcgaaattatagattcaaacaggcttctggaaactgttgaatacaatatatcaggcgcggagaggacagcccacatcagcgggctgcccccaagcaccgacttcatcgtgtacctgtctgggctggccccctctatccgcactaagacaatctcagctacagccacaaccgaggcgctacctcttctggagaacctcaccattagcgatataaacccttatgggtttactgtgtcttggatggcttcagaaaacgcctttgactccttcctcgtcacagtagtagatagcggtaagttgctagacccacaggaattcacattgagcggcactcagagaaaactggagctgcgtggactgatcacaggcattggatacgaggtgatggtctccgggtttacccagggtcatcagactaagccgctgagagccgagatcgtgaccgaagccgagcccgaggtcgacaatctgctggtgtccgatgccacacctgacggtttcagactgtcctggaccgctgacgaaggcgtcttcgataactttgttttaaaaatccgcgacactaagaagcagagtgaacccctggagataacattgctggctccggaaaggacccgcgatatcacaggactgcgggaagctacggagtacgaaatcgaactctacggcatctcaaagggtcggcgcagccagactgtaagtgccattgccaccacggcaatgggtagcccgaaggaagtcatattctccgacattacagagaattcagccacagtctcatggcgtgcacctaccgcacaggtggaatcgtttagaatcacctacgttcccatcactggaggtaccccctctatggtgacggtagatgggacaaagacccagacacgactggtcaagctgattccaggcgtcgaatacctggtctctattatagccatgaagggttttgaggaaagtgaacccgtgtcaggttccttcactactgcacttgacgggccatccggactcgtgaccgctaatattactgactctgaagctctggccagatggcaacccgccatcgctaccgtggattcttacgtgattagctatacgggggaaaaagtcccggaaattacaaggacagtgtcaggaaacactgtggagtacgctctcaccgacttagaaccagcaaccgagtatacattaaggatcttcgcggaaaagggtccgcagaagagcagcactattaccgccaaatttactacagatctggactccccccgggatctcacagctaccgaagtccagtcagagactgcactgcttacctggcgaccaccccgcgcttccgtgactggatacctgctcgtgtatgagagcgtggacggaaccgtgaaggaagttatagttggcccggatactactagctactcacttgcagacctgagtccttctacccactataccgccaagattcaggccctgaatggtccactgcgcagcaatatgatacagacgatcttcaccacgatcggtcttctttacccctttccaaaggattgctctcaggccatgcttaatggggacaccacttccggtctctatacgatctatttaaatggggacaaggccgaggccctagaggtgttttgcgacatgactagcgacggcggcggttggatagtctttcttcgccgcaaaaatgggagggagaacttttaccagaactggaaagcctacgccgccgggtttggcgacaggcgagaggagttctggctgggcttagataatctcaacaagataactgctcaggggcagtacgaattgcgcgtggacctcagggatcacggcgagacagcttttgccgtgtacgataagttttcagtgggtgacgccaaaaccagatataagttgaaggttgaagggtatagcgggaccgcgggggacagtatggcctatcataacggccgcagcttctccactttcgacaaagatacagactctgccattaccaactgcgcactgagttacaaaggggctttctggtataggaactgtcacagggtcaacctcatgggtaggtacggagacaacaatcactcacagggagtaaactggttccactggaagggccacgaacattctatccagttcgccgaaatgaaacttagaccctcaaattttcgcaacctcgaagggaggcgaaagagagcgtag

SEQ ID NO: 208310 - DNA, 3240 bp, Artificial Sequence
  Description of Artificial Sequence: Synthetic coding sequence
atgggcgccatgacccagctgctggccggcgtgttcctggccttcctggcacttgcaactgaagggggagtgcttaagaaggttataagacacaaacgacaatccggggtgaatgccacccttcctgaggagaatcaaccggtcgtcttcaatcacgtctacaatatcaaactgcccgtgggaagccagtgctccgtcgatctggagagcgccagcggtgagaaggatctggcaccaccaagcgagccctcggaatcattccaagaacatacagtagacggcgaaaatcagatagtttttacccacagaatcaatataccacgcagggcttgtggctgtgccgcggcacccgatgtgaaagagctgttatcccgacttgaagagctggaaaacctggtgtcgtccctccgcgagcagtgtaccgcgggggccggctgttgcttacagccggccactggtagactcgacactcgaccattctgttcaggacgaggcaacttctctactgagggatgtgggtgcgtgtgcgaaccagggtggaagggaccgaattgtagcgaaccagagtgtcctggcaactgtcacctgcggggacgctgcattgacggccaatgtatctgtgacgatgggtttaccggcgaggactgtagccagctggcctgtccctcggactgtaacgatcagggcaaatgcgtgaatggtgtgtgcatctgttttgaggggtatgctggcgctgattgctcccgggagatctgcccagtgccctgcagcgaagagcatggcacctgcgtcgatgggctctgcgtatgtcatgacgggttcgctggtgacgattgcaacaaacccctctgcctgaataactgttataatagaggccgctgcgtagaaaatgaatgtgtgtgtgatgagggctttaccggcgaagactgttcagagctgatttgccctaatgattgcttcgaccgagggaggtgcatcaacgggacctgctattgtgaagagggattcaccggcgaggattgcggtaagccaacgtgccctcacgcctgccatacccagggtcgctgtgaagaaggtcagtgcgtttgtgacgaaggtttcgctggagtggactgctctgagaagcgatgtcctgctgattgccataatcgagggaggtgcgtagatggtcgctgcgagtgtgacgacggatttacaggtgcagattgcggagagcttaaatgccccaatgggtgctcaggccatggaagatgcgtgaacggacagtgcgtgtgcgacgaaggctacacaggcgaggactgtagtcaactgcgttgtccaaatgattgtcacagtagagggcgatgtgtagaaggaaagtgtgtctgcgagcagggattcaaggggtacgattgctccgatatgagctgtcccaatgattgccatcagcacgggcgctgtgttaacggtatgtgtgtgtgtgacgacggatacaccggggaggactgtcgagatcggcagtgcccccgggactgtagcaaccgcggcctgtgtgtggacggacagtgcgtgtgtgaagatggattcacaggccctgactgtgctgaattgagctgcccgaacgattgccatgggcagggcagatgtgtgaacggccagtgcgtgtgtcacgagggattcatgggaaaagactgcaaggagcaaagatgtccctccgattgccatggacaggggcggtgcgtggacggtcagtgcatttgccacgagggctttacaggattggattgtgggcagcacagttgcccgtcagattgcaacaatctggggcaatgcgtgtccggaagatgcatatgtaacgagggatactcaggggaggattgttccgaagtttctcctccgaaagacctggtggtcactgaggttaccgaagaaacagtgaacctggcatgggataatgaaatgcgcgtgacagaatacttggtggtgtacactcctacccatgagggcggattggagatgcagttccgcgttcccggcgatcaaacttcaactatcattcaagaacttgaaccaggcgttgagtatttcatccgggtgtttgccattctggaaaataagaagtcaattcccgtctcagctcgcgtggccacatatctccctgcaccggagggcctgaagtttaaatcgatcaaagagacatccgtcgaggtcgaatgggaccctctcgatatcgcctttgagacctgggagatcatcttcagaaatatgaacaaggaagacgagggcgagattactaaatctctgcgtaggcccgaaacgagttataggcagacaggactggcccctggccaggagtatgagataagtctgcacattgtgaagaacaacacccgagggcccggcctgaaacgcgtcacgacaactaggctggacgcacccagtcaaatagaagtgaaagacgtgaccgacactacggcactgattacctggttcaagccactggccgaaatcgatggtattgagctgacttacggtatcaaagacgtacctggagacaggaccaccattgacttaacggaggatgagaaccagtacagcataggtaacctgaaacctgacaccgagtacgaggtctcactcatcagccggcggggggacatgtcatccaaccccgcaaaggaaacattcaccacaggactcgacgccccccggaatcttcgccgcgtctctcagaccgataattccattaccctcgagtggcggaacggcaaggcggccatcgacagttacagaattaaatatgcaccaatatcaggcggggatcacgccgaagtggacgttcccaagagtcaacaggctacgacaaagaccatcacagctaagttcaccaccgaccttgattcgcctcgggatctaacagcaaccgaggtccagagcgaaacagccttattgacgtggcggccacctcgtgctagtgtgacaggctacctgcttgtctatgagtcagtagacggaacagtcaaggaggttatcgttggcccggatacgaccagctattccctggccgatctcagtcctcctagtctgtttctccattttattcagcagaaacccgaaaagcaatattgtttccattttaaagacatgattaatatcatcaacatcatcatgatgatgatgatgatgaagacaaaggacttctcccgcgacctgtccttccagaacatcagcggccagtacctgattgtgttttttttttag

SEQ ID NO: 208311 - DNA, 279 bp, Artificial Sequence
  Description of Artificial Sequence: Synthetic coding sequence
atgggcgccatgacccagctgctggccggcgtgttcctggccttcctcgctctggcgacggaggggggggtattaaagaaagttatcaggcataagagacagagcggcgtcaatgcaaccctgcctgaagagaatcagcccgtcgtcttcaaccatgtttataatatcaaacttcctgtagggtctcagtgctccgtggatctggagagcgcgtctggggaaaaagacctcgcgcctccctcagagcccagcgaaagtttccaggagcacaccgtatag

SEQ ID NO: 208312 - DNA, 5241 bp, Artificial Sequence
  Description of Artificial Sequence: Synthetic coding sequence
atgggcgccatgacccagctgctggccggcgtgttcctggccttccttgcgctcgccacagaaggaggcgtcttgaagaaggtgatccggcacaaacgccagtcaggagtgaatgccaccctgccagaggagaaccagccggtcgtgttcaatcacgtgtataacatcaaactgcccgtagggtcccagtgctcagtggatctcgaatccgcctcaggcgaaaaggatctggcaccgccctctgaaccctcagagtcattccaagaacatacggtggatggcgagaatcaaattgtgttcacacaccggataaatattcctagaagggcctgtggatgcgccgctgctcccgacgtaaaggagctgctgtctcgtttggaggaactcgaaaacttagtctcatcactcagagagcagtgcactgcaggcgccggttgctgtcttcagccagccaccggaaggctagatactaggccattttgcagcgggagggggaacttctcaactgagggatgtggctgtgtctgtgagcctggatggaaggggccaaactgcagcgagccagagtgcccaggcaactgccacctccgaggaagatgtattgacggtcagtgcatctgtgatgatgggttcacaggtgaggattgctcacaactggcatgccctagcgattgtaacgaccagggcaaatgtgtgaacggtgtgtgtatctgtttcgaagggtacgctggggcggattgctccagggaaatctgcccggtgccttgcagcgaggaacatgggacatgtgtggacggcctttgtgtttgtcacgatggattcgccggcgacgattgtaataaacccctctgcttgaataattgttacaacagggggcgctgtgtagaaaacgaatgcgtttgtgacgagggctttactggcgaggactgctccgaactgatttgtcccaacgattgctttgaccgaggaaggtgcatcaatggtacttgttattgtgaggaaggttttactggcgaggattgtggcaaaccaacctgtccccacgcctgccacacgcaagggaggtgcgaagaagggcaatgtgtgtgtgacgagggtttcgccggagtggattgtagcgaaaagcgttgccctgctgattgccacaaccgcgggcggtgcgtggacgggaggtgcgagtgcgacgatggcttcaccggtgccgactgtggggaattgaaatgccccaacgggtgctcagggcatggtagatgtgtgaacggccagtgtgtttgtgacgagggatatactggcgaggactgctctcaactgcgctgtccgaacgattgccactcacgtggccggtgcgttgaagggaagtgtgtatgcgaacaggggttcaaggggtatgactgctccgacatgagctgtcccaacgattgccatcagcatggtaggtgtgtgaacgggatgtgcgtctgcgacgacgggtacactggcgaggattgtcgcgacaggcagtgcccaagggattgctccaatcgtggcctgtgtgtcgatggtcagtgtgtttgcgaagatggttttactggtccagactgtgctgagctttcctgccccaatgactgccatggccagggccggtgcgtgaacgggcaatgtgtctgccacgaagggttcatggggaaagattgcaaggagcaaagatgtccgtcagattgccacggtcaaggccgctgtgtggatggccagtgtatctgtcatgaagggtttaccgggctcgactgcgggcagcatagctgccctagcgactgtaataatctgggtcagtgtgtcagcgggcgctgcatctgtaacgagggatactctggagaggattgctcggaagtgagccctccaaaggatctggtggtgacagaagtgaccgaagagaccgtaaacctggcgtgggacaacgaaatgcgtgtgactgagtacctggtcgtgtacactcccacacacgagggagggctggagatgcaatttagagttccgggggatcaaacctccactattatccaggaactcgagcctggagtggagtactttataagagtctttgccattttagagaataagaagtctatcccggtttctgccagagttgcaacataccttcctgctcctgaaggattaaagttcaaatccattaaggagactagcgtcgaggtagagtgggaccccctggacatagcctttgaaacctgggaaattatatttcgtaatatgaacaaggaggacgaaggggaaatcaccaaatcgttaagacgccctgagacgtcgtaccgccagacgggcctggccccagggcaggagtatgagataagcctgcatatagtgaaaaacaatacaaggggacccggccttaaaagagtgaccaccacgcgtctcgacgctcctagccaaattgaagtgaaggacgtaactgacactaccgccctcatcacatggttcaagcccctcgctgagattgatggcatcgagctgacttatggcatcaaggacgtacctggcgaccgaacaaccatcgacctgacggaggacgaaaaccagtactcaatcggaaacttgaagccggacactgaatacgaagtcagtctgatcagccggcggggcgatatgtccagcaatccagcaaaagagaccttcacaacaggtcttgacgcgccaaggaatctgaggcgggtcagccaaacagacaactccatcacactcgaatggaggaatggtaaggccgctattgattcttaccggatcaagtacgctccaatttcggggggcgatcatgccgaggttgacgtgcccaaaagccagcaggctacaactaagaccacattgactggcctgaggccaggcacggagtacgggatcggggtgtctgccgtaaaggaggacaaggagtccaatccagctactataaacgccgccacagaacttgacacgcccaaagatttgcaggtgtcggaaactgcagagacatccttgacactcctgtggaagaccccactcgcaaagttcgaccggtaccgactgaactactctctgcccacggggcaatgggtgggggttcagctcccacgcaataccacaagctacgtgttgcgaggcctggagccaggccaggagtataatgtgctgctgacggcggagaaggggagacataagtccaagcccgcaagagtgaaagccagcactgccaaagaaccggagatcggcaatctgaacgtatccgacattacccctgagtcgtttaatttgtcctggatggctaccgacgggatcttcgaaacattcacgatagagatcattgactctaatcgccttcttgaaaccgtagagtacaacatctcaggtgccgagagaacagcccacatttccggactgccaccctccactgatttcatcgtgtatctgtctggcttggccccctccatacgaactaaaaccatctccgctacagcgacaaccgaggcagaaccagaagttgacaacctcctggtgagcgatgctaccccggatgggtttcgtctatcatggaccgccgacgaaggcgtctttgataactttgtactgaaaatccgcgatacgaagaaacaaagtgaacctcttgaaatcactttattggccccagaacgcactagggacattactggactgagagaggccaccgaatatgaaattgagctctatggaatctcaaaaggtagaaggagccagaccgtttctgctatagcaacaacggcgatggggtcaccaaaagaagtaattttctcagacattactgaaaatagcgccactgtatcctggcgggctcccactgcacaggtggagtcttttcggattacatatgttcctataaccggcggaacaccatccatggtaaccgtggatggtactaagactcagacccgactcgtgaagcttataccgggggtagaatacttggtatcgataatcgcaatgaaggggtttgaggaatcagagccagtgtcaggaagcttcacaacagccctggacggacccagcggcttggtcaccgctaatatcaccgacagtgaagcccttgctagatggcagcccgccatagctactgttgattcgtacgtcatcagttataccggcgagaaagtccccgagatcactaggaccgtgtcaggtaataccgtcgagtatgctcttactgacctcgaacccgctacagaatatacactgcgtatattcgcagaaaagggaccccagaaatcctccacaatcactgcaaaattcaccacagacttggattcccctcgggatcttacggccaccgaggtgcagtcagaaacggcccttctcacttggagacctccacgtgcctctgtgacaggttaccttcttgtgtatgaatccgttgatggaacagtgaaggaggttattgtggggcctgacacaacttcctacagtctcgccgacctgagcccttcgacccactacactgccaaaattcaggctttgaacgggcctctccgcagcaatatgattcagactattttcaccaccatcggcctgttgtaccctttccctaaagactgctctcaagccatgctcaacggcgatactaccagcggactttatacaatctatctcaatggggacaaggcagaggcgctcgaggtattttgtgacatgacaagcgatggaggaggatggattgtttttcttcgacgcaaaaacggtcgggagaatttctaccaaaattggaaagcttatgccgccgggtttggcgaccgtagagaggaattttggcttggcctggataacttgaataaaatcaccgctcaggggcagtatgaactgcgagtagacctgcgggaccacggggagacagcattcgctgtgtacgacaaattttccgttggcgatgccaaaaccaggtacaagctgaaggtggaaggctactcagggacggcaggtgactccatggcttatcataacggacgctcctttagcacattcgataaggatactgactcagcgatcacaaactgtgccctgtcatacaagggcgctttttggtacaggaactgccaccgagtcaacctaatgggaaggtacggcgataacaatcactcccaaggggtgaactggtttcattggaaagggcatgaacactccatccagtttgctgagatgaagttgcggccatcaaacttccgaaacctcgaagggcgtagaaagcgagcatag

SEQ ID NO: 208313 - DNA, 5517 bp, Artificial Sequence
  Description of Artificial Sequence: Synthetic coding sequence
atgggcgccatgacccagctgctggccggcgtgttcctggccttcctggctctggccacggagggcggagttctaaaaaaagtgattcgccacaagagacaatcaggcgtgaacgcaacgcttcctgaagaaaaccagcctgtggtattcaaccacgtttacaacatcaagctgcctgtgggttcccagtgtagtgtagatttagagtcagcctccggagaaaaggacctcgcaccccccagcgaaccgtccgaaagcttccaggaacacacagtggacggggagaaccagattgtgttcacacatcgcattaacatcccccgccgcgcctgcgggtgcgccgccgctcccgacgtaaaggagctgttgtctaggctagaggagctcgagaatcttgtaagttctctccgggaacagtgcacggctggggccgggtgttgtttgcagcctgcgactgggcggctagatacccggcccttttgttcaggacgcggaaacttctctacagagggttgcggatgtgtgtgcgagccggggtggaagggacccaattgcagcgaacccgagtgtccagggaattgccacctgagaggcaggtgcattgatgggcagtgcatctgcgacgatggattcacaggggaggattgctcccaattggcatgtccgagcgactgtaatgaccaaggcaagtgcgtgaatggagtctgtatttgttttgaagggtatgctggagccgattgcagtcgggagatttgtccagtcccctgctccgaggaacacgggacgtgtgtggacggactgtgcgtgtgccacgatggattcgccggggatgattgcaacaaacctctgtgcctgaataactgttacaaccgaggtcgctgcgttgagaacgaatgcgtctgcgatgaagggttcaccggagaggactgctcagaacttatctgtcccaacgactgttttgaccgcggacgttgtatcaatggaacctgctactgcgaagagggatttacaggagaggattgtggcaaacccacgtgcccccacgcttgtcacacccagggacgatgtgaggaagggcagtgcgtttgcgatgagggattcgccggcgttgattgctccgaaaaacgctgtcccgcagattgccacaacagaggaagatgcgtggacgggagatgcgagtgtgacgacggattcaccggggccgattgcggtgagctaaagtgtcctaatgggtgttccggccatgggcggtgtgtcaacggacagtgcgtgtgcgacgaagggtatacaggagaagattgctcacagctccgttgccccaatgactgtcacagtcgtgggcgctgcgtcgagggcaagtgcgtctgtgaacagggatttaagggatacgattgctcagacatgtcgtgtcccaacgactgccatcagcacggacgttgcgtaaatggcatgtgcgtgtgtgacgacggttacacaggggaggattgtagggaccggcagtgccccagagattgttccaaccgtgggctgtgcgtcgatggtcagtgcgtgtgtgaggacggattcacgggccctgattgtgcagagctgagttgcccaaatgattgtcacggccaaggaaggtgtgtgaacggccagtgtgtctgtcacgaaggcttcatgggcaaagattgcaaagaacagcgctgcccgtcagactgccatggccagggtaggtgcgtggatggacaatgcatctgtcatgagggcttcaccggcctggactgcggacaacattcttgcccctctgactgcaacaacttagggcagtgcgtgagtggtcgctgcatctgtaacgaggggtacagcggagaggactgctccgaagtttcaccacctaaggacctggttgtgacggaggtgacggaagagactgtcaacctggcctgggataacgagatgagagtgacagagtacctggtggtgtacactcccactcacgaaggcggtctggagatgcagttcagggtgcctggcgaccagacatcgaccatcatccaggagctggagcccggagtcgaatacttcatccgcgtgtttgccattctggaaaataagaagtctattcccgtttccgcccgtgtggccacgtatttgccagctccggaaggtttaaaatttaaatccatcaaggaaacaagtgtggaagtcgaatgggatcctctagacatcgcatttgagacatgggagattatctttagaaacatgaacaaggaagatgagggggaaataacaaaatcccttagacgccctgaaactagctacaggcagactggattggcccctggacaggagtatgagatctctctgcatatcgtgaaaaataacacccgcggaccggggttgaagcgtgtgacaaccacacgcctggatgccccgtctcagatcgaagtcaaggacgtaacagataccactgcgctgattacttggtttaaacccttggccgaaattgatggaatagagctgacgtacggaataaaagatgtccccggggatcggactaccattgatttgaccgaagacgagaatcagtactccatcggcaacttaaagcctgacacagagtacgaagtcagcctgatcagtcgccgaggggatatgtcctcaaaccctgcgaaggagacgtttactactggcctggatgccccccgcaatctcagacgcgtaagccagacagacaattctatcacacttgagtggagaaatggaaaggctgcaatagattcgtataggattaaatacgcccctatatctggcggcgatcacgcagaggtggatgtgcctaagtcgcagcaggcaaccaccaagaccaccctgaccggtctcagacctggaacggaatacggcatcggggtttcagcagtgaaggaggacaaggaaagtaatccagcaacaatcaacgctgcaacagagctcgacactcctaaggacctgcaggtttctgaaacggctgaaaccagcttgacactgctctggaaaacacccctcgcaaagtttgatagatacagactcaattatagcctcccaaccggccagtgggttggggttcagctcccccgcaacaccacatcatacgtgcttagggggttggaacccggccaggagtataacgtcctgttgaccgccgagaagggccggcacaaaagtaagcctgccagggtgaaggcctctacagccaaggaaccagagattgggaacctgaacgttagtgatattactccagagtcattcaatttgtcttggatggcaaccgacggaatctttgaaaccttcactattgagattattgattccaataggctgctcgagacggttgaatacaacatctcaggcgcggagagaaccgcacacatctcgggattgccacccagtactgactttattgtttatctctccgggctggcgcccagtatcaggaccaaaaccatctccgcaaccgccacgacggaacctaagccccagctcgggacactcatttttagcaatatcacgccaaaaagtttcaatatgtcatggactacccaggcaggcctgtttgcaaagattgtgatcaatgtcagcgacgctcactcccttcacgagtctcagcaattcacagtgagtggcgatgccaaacaagcccacattaccggccttgttgagaatacaggatatgatgtgtcggtcgcgggcacaaccctagctggtgatcccaccagacctctgactgccttcgtgattacggaagctgagccagaggttgacaatttgttggtttccgacgctacacccgatgggtttaggctgagctggaccgccgatgagggcgtgttcgacaattttgtgctgaaaattcgcgacactaaaaagcagtcggaacctcttgagattacgctgcttgcccctgagcgtacaagagatatcactggtttgcgcgaggcaacagagtatgaaatcgaactgtacgggatctcaaagggcagaagatctcaaaccgtctctgctatagcgactaccgccatggggagccctaaagaagtgatctttagcgacatcaccgaaaacagcgctactgtgtcttggcgagctccgacagcacaggtggagtccttcagaataacctacgtacccattactggggggaccccatctatggtcactgtggacggcaccaagactcagacacgcctggtcaagctgattcctggagtggaatatctggtctccattatcgctatgaagggtttcgaggaatctgaacctgtaagtggaagttttaccacggcactggacggccctagcggacttgtaacagccaacataactgacagtgaggcgttagcaagatggcagcctgcaatagccacagttgacagctacgtaatcagctacacgggagagaaggtgccagagatcacaagaacagtatctgggaatacagtggaatatgccctgacagacttggaacccgctaccgagtacacgctgcgaatctttgcggagaagggcccacaaaagagcagcaccatcaccgctaagttcactaccgatctggactcccctcgagacctcaccgcgaccgaggtccagagcgaaacggcattgcttacgtggcgaccccctcgggccagcgttactggctatctgcttgtgtacgagtccgtcgacgggaccgtgaaggaggttatagtgggtcccgacaccacaagttacagccttgctgacttgtcaccatccacccactacacagccaagattcaagcattgaacggacccttgagatccaatatgatccagactattttcaccacaatcggactcttgtaccctttccccaaagactgcagtcaagcaatgttgaacggggacacgacttccggactttatactatatatctgaacggagacaaagcagaagcgctggaggtgttctgtgacatgacgagtgacggcggcgggtggatcgtcttcctgaggaggaaaaacgggcgcgagaatttttatcagaactggaaggcgtacgcagccggcttcggggaccgcagagaagagttctggttaggcctggataatctaaataaaattaccgctcagggccagtacgaactgcgggtggatctgagagatcacggcgaaaccgcttttgctgtttatgacaaattcagcgtcggagacgccaagactcggtacaagctgaaagttgaggggtacagcggcactgctggggatagcatggcctatcataatggacgtagctttagtacatttgacaaggatacagactctgcgatcactaactgtgccctgagttacaaaggtgctttttggtaccgcaactgccacagagttaatcttatgggacgctacggcgacaataatcatagccaaggcgtaaactggtttcactggaagggacacgagcattccattcaattcgctgagatgaagctccggcccagcaatttccggaacctcgaaggtcgcagaaaacgggcttag

SEQ ID NO: 208314 - DNA, 4077 bp, Artificial Sequence
  Description of Artificial Sequence: Synthetic coding sequence
atgggcgccgacggcgagaccgtggtgctgaagaacatgctgatcggaattaaccttattcttctggggtccatgatcaaaccttcagagtgccaactggaagtgacaacagaacgtgtgcaacgtcagagtgtggaagaagaaggcggaatcgctaattataatacatctagcaaagagcaacctgtggtcttcaatcacgtgtataacatcaacgtgccactggataatctctgctcctctgggttggaggccagtgcagagcaggaggtttcagctgaggacgagacactggccgagtacatgggacagacatcggaccatgagagccaggttactttcacacatcgcatcaacttccccaagaaggcgtgtccgtgtgcttcaagtgcgcaggtgctgcaggagctcctgtcaagaatcgagatgctggaacgggaggttagtgtgctgagagatcaatgcaacgctaattgttgccaagagagcgccgctaccgggcaactggattatattccccactgttccgggcacggtaacttttcctttgaatcatgtggatgtatttgcaacgaaggttggttcgggaagaattgttctgaaccttactgtcccctaggctgcagctcccgcggggtgtgtgtggacgggcagtgtatttgtgactctgaatattccggtgatgattgtagcgagctgagatgccctaccgactgtagctcaaggggtctttgtgtggacggcgagtgtgtgtgtgaggagccatatacaggggaggattgtcgggagctcagatgtcctggcgattgtagcggaaagggtcgatgtgccaatgggacctgcctttgtgaggaagggtatgtgggcgaggactgtgggcaaaggcaatgtttgaacgcttgcagcgggagaggacaatgcgaggaggggctgtgtgtgtgtgaggaagggtaccagggcccagattgctccgccgtcgcccccccggaggatcttcgcgttgcggggataagcgatcggtccatagaactggagtgggacggtcctatggctgtcaccgagtacgtgatttcttatcaacctaccgcactgggcggactgcagctccagcagagggttcctggtgattggtcaggagtgactataactgagctggaacctggcttaacttataatatctctgtgtacgctgtcataagcaacatcctctccctgccgatcacggctaaggtcgccactcacctgtccacaccacagggtcttcagtttaagacaattaccgaaactactgttgaggtacagtgggaaccgttcagttttagttttgacggctgggagatttccttcatccctaaaaacaatgaaggaggagtaattgctcaggtcccgagcgatgtgacgagcttcaaccagaccgggctgaagcccggggaagagtatatcgtcaacgttgttgcattaaaagagcaggctcgctcaccacccacctccgcctcagtatccaccgttattgacgggccaacacagatcctggtccgagatgtgtccgacactgtggccttcgtggaatggatccctccacgtgctaaggtggactttatcttgctaaaatacggtcttgtggggggcgagggcggtaggaccacctttagactccagccacctctatcgcagtattctgtgcaagctctgaggccgggatcccgctacgaggtgtctgttagtgccgtccgcggcacaaatgaatccgatagtgccacaacccagtttacaacagagatcgacgctcccaagaacctgagagtcgggtctcggaccgcaacctcactggatctggaatgggataactctgaggccgaagtacaggagtataaagttgtgtatagcactttagctggtgagcagtatcacgaagtgctggtgccccgaggtataggacccaccaccagggccacacttactgatctagttccaggaactgaatatggcgtaggcatcagtgctgtgatgaattctcagcagtccgtgcctgcgactatgaacgccaggaccgaactggactccccccgtgatttgatggtgacagctagctccgaaacttctatctcactcatatggacaaaggctagcggacctatcgaccattaccgaataacgttcacccctagttcgggcattgcctctgaggtaacagtgcctaaagatagaacaagctacaccttgaccgatctggaacccggggcagagtacattatctctgtgactgctgagagaggccggcagcagagtctcgagagtacggttgatgcgtttactggctttcgacctatatcccacctgcacttttcacacgtgacttcgagttctgtcaacattacttggagtgatccgtctcctccagccgaccggcttatcttaaactacagcccaagagacgaagaggaggagatgatggaagtctcccttgacgctacaaagcggcacgcggtgctgatggggctgcagcccgcgactgaatatatcgtcaacctggtggccgtgcacggcactgtgacatcagaacctatcgtcggaagcatcacaacgggcattgaccctcctaaggatatcacaattagtaacgtgacaaaggatagcgtaatggtgtcttggtccccccctgttgcaagctttgactattatagggtgtcttataggccaacccaggttggcaggcttgactcctctgtagttcccaataccgtgaccgagttcaccataacccgcctgaatcccgccaccgagtacgagatcagtctgaacagcgttaggggcagggaggaatccgagagaatatgcactcttgtgcatacagcaatggacaatcccgtagacctgattgcgacaaatatcacacccacggaagcacttctgcagtggaaggcaccggtgggagaggtcgagaactacgtaattgtgctcactcattttgcggtggctggtgagactatcctggtggacggagttagcgaggaatttcggctcgtggatttgctgccctcaacccactataccgccaccatgtacgcaaccaacggtcctctaacttctggcacaatttcaactaatttcagtaccctgctcgatccaccagcaaatctgacagcgtccgaagttacccggcagtctgcgctcattagttggcagcccccccgggccgaaatagagaactatgtgttgacatacaagtccaccgacgggtcacgcaaggagctgatcgtcgacgctgaggacacttggataaggctcgagggactgctggagaacacagactacactgtgctgctgcaggctgcccaagataccacatggtctagtataacatctaccgcttttacaaccggaggcagggtgtttccacacccccaggattgtgctcagcacctcatgaacggagacaccctctctggtgtttacccaatctttctgaatggagagctgtctcaaaaattgcaggtatattgtgatatgaccaccgatggaggtggttggatcgtatttcagagaaggcagaacggtcagacagattttttcaggaaatgggctgattacagagtgggctttgggaacgtcgaagatgagttctggcttggtctcgacaatatccataggatcacctcgcaggggaggtatgagctgcgcgtggatatgcgagatggccaggaggcagcgtttgctagttatgataggttctcagttgaagatagtagaaacctttataagctccgcatcggctcttataacgggaccgccggggacagcttgtcttaccaccagggccggcccttttccaccgaggaccgggacaatgatgtggctgtgacaaactgcgctatgagctataagggcgcatggtggtacaagaattgccaccgcacaaacctgaatggcaaatatggggaatctcgtcatagtcagggtattaactggtaccattggaaaggccacgagtttagcattccgtttgtcgagatgaagatgagaccctacaaccatcgacttatggctggtcgaaagaggcaaagcctgcagttttag

SEQ ID NO: 208315 - DNA, 3807 bp, Artificial Sequence
  Description of Artificial Sequence: Synthetic coding sequence
atgggcgccgacggcgagaccgtggtgctgaagaacatgctgatcgggattaaccttatccttctggggtcgatgatcaagccctcggagtgccagctggaggtgactactgaacgtgttcagagacagagtgtcgaagaagaagggggtattgcaaactacaacactagtagcaaggagcaaccggtcgtgttcaaccacgtatacaacattaatgtgcccctggacaatttatgttcgtctggcctggaagcctctgctgagcaggaagtctctgcggaagacgagaccctcgccgaatatatgggacagaccagcgaccacgaaagccaggtcacctttacgcatcggatcaatttccccaaaaaggcatgcccatgcgctagcagcgcgcaagttcttcaggagctgctgtctagaatcgaaatgctggaaagggaagtgtctgtactgcgggaccaatgtaacgctaattgctgtcaggagtctgccgcaacagggcagctggactacatcccccattgttcagggcatggaaacttctcattcgagtcttgtggctgtatatgtaacgaaggatggttcggtaagaattgctccgaaccctactgccctctgggatgctcatcacgcggtgtctgcgtggatggccaatgtatttgcgattcggagtatagtggggacgactgctccgagctgaggtgccctacagactgtagcagcaggggactgtgcgtggacggcgagtgcgtgtgcgaggagccatatacaggagaggattgcagggaactacggtgcccaggcgattgtagcggtaaaggtcgctgcgctaacggtacatgtctgtgtgaagaaggttatgtgggcgaggactgcggacaaagacagtgtttgaacgcctgctccggtagagggcagtgcgaagaaggactgtgtgtctgcgaggagggatatcaggggccggattgttctgcagtggccccccccgaggatctgagggttgccggaatcagtgatcgaagcattgagctggaatgggacggccctatggcagttacggagtacgtgatctcctaccagcccaccgcactaggcggcctgcagctgcagcagcgagtccctggcgattggagtggcgttacaatcaccgagttggagccgggcctgacatacaatatcagcgtctacgccgttatcagtaacattctatcccttccaatcacggccaaggtggctacccacctttcgacgcctcagggattgcagttcaagacaataacagagaccaccgtcgaggtccagtgggagcccttttccttttcatttgatggctgggaaataagcttcataccaaagaacaatgaggggggcgtgatcgcgcaggttcctagcgatgtaactagcttcaatcagacgggcctgaaaccaggggaggagtatatcgtcaatgtcgtggccctgaaagagcaggcccgcagtcccccaaccagtgctagcgtaagtacggttatagatgggcccactcagattctggtgcgagacgtcagtgacacggtcgcctttgtggagtggatcccaccccgcgctaaggtggacttcatcctgctgaaatatggcctcgtcggcggagaaggcggtcggaccacgtttcggctccagcctcctctctcccaatactccgtgcaggctttgcgacccggtagtaggtacgaggtcagtgtcagtgcagtccggggtacaaacgaatcagactcagccacaacacagttcaccaccgagatcgatgcacccaagaatcttagggtgggctcacggacggctactagtctggatctcgaatgggataactctgaggcagaagttcaggagtacaaagttgtctactccacgcttgctggtgagcaataccacgaggttcttgtacctagaggaattggtccgaccactcgcgctaccctcaccgacctagttcccggaaccgaatatggcgtgggaattagtgccgttatgaatagccaacagtccgtcccagctactatgaatgcaagaacggagctcgattccccacgcgacctgatggtgacagcgagttccgagacttcaatcagcctgatttggacaaaagcatctggcccgatagaccactatagaatcaccttcacgccatcctctgggattgcctcagaggtcacagtaccgaaagaccgaacgagctacacacttactgaccttgaaccaggtgctgagtatattatatccgtgactgctgaaagaggtcggcagcaatccctggagtccactgttgatgcctttactggcattgacccacccaaagacatcacaatatcaaatgtcacaaaggactccgtgatggtctcttggagcccacccgtggccagcttcgattactaccgggtgtcataccgccctacccaggtgggaaggctggattcttctgtggtccctaacacagtaacggagtttacgattacacgcctcaacccagcaacagaatatgagatctctctgaactcagtcaggggccgcgaggagagcgaacggatttgcacactggtgcacaccgccatggacaatcccgtggatttaatcgccactaatatcacccctaccgaagccctgttgcagtggaaggcccccgttggagaagttgagaattatgtcatcgtcctcactcacttcgcggtggctggcgaaacgattttggtggatggtgttagcgaggaattccgtctggttgatctgctgccctccacccactataccgccactatgtacgctacaaacggcccactgacgtcgggaacaatctctactaacttttccaccctcctagatcctcccgccaatctcacagcttcggaggtgacccgacaaagcgcgttaatatcatggcaacccccacgggcggaaattgaaaattatgtgctgacatacaagtcaaccgatggttcccggaaagaactcatcgtggacgccgaagatacctggattcgtttggagggactactggagaatactgattatacggttctgctgcaggccgcacaagacactacttggtcgtcgataacctcgaccgccttcactactggaggaagggtgttcccacacccacaagactgtgcccagcacttgatgaacggagacacccttagcggagtctatccaatctttttgaacggagaactgagccagaagctccaggtttactgcgacatgactacagacggcggcggctggatagtctttcagcgccgtcaaaatgggcagacagacttctttcgcaagtgggccgattatcgcgttggctttggcaacgtggaagatgaattctggctcgggctggataacattcatcgtatcacatctcagggtagatacgaactaagagtcgacatgcgcgacgggcaagaagccgcatttgcttcatatgaccggttttctgtcgaagattccaggaatctgtacaaactgcgcatcggcagctataatggcacagcaggtgactctctgtcataccaccaggggcggccctttagtacagaagatcgagacaatgacgtggcagtgaccaattgcgcaatgtcttataagggcgcttggtggtacaaaaattgtcaccgaaccaatctgaacggaaagtacggcgagtcccgacattcccagggtatcaactggtatcactggaaggggcatgagttctcaatcccatttgtagaaatgaagatgaggccttacaaccacaggctcatggccggcagaaagagacagagcttgcagttctag

SEQ ID NO: 208316 - DNA, 4077 bp, Artificial Sequence
  Description of Artificial Sequence: Synthetic coding sequence
atgggcgccgacggcgagaccgtggtgctgaagaacatgctgatcggcattaacctcattctactagggagtatgatcaagcccagtgaatgtcaactagaagtaaccaccgagagggttcagcggcagtcagtcgaggaagagggcggaatcgcgaactataatacctctagcaaggagcaacctgtcgtgttcaaccacgtgtataacataaacgttcccttagacaacctttgcagctcggggctcgaagccagtgctgagcaggaggtctcggcagaagatgagaccctggccgagtatatgggccaaacttcagatcacgagagccaggtgactttcacacatcgaattaatttccctaaaaaggcctgcccctgtgcctcctccgcacaagtgctgcaggaacttctctcccgcatcgagatgcttgaaagagaggtttccgtcttacgtgatcagtgtaacgcaaattgttgccaggaaagtgctgctaccggccagctggattacatcccccactgtagtgggcacgggaatttttcattcgaatcctgcggatgtatttgcaacgagggatggttcggaaagaattgcagtgagccttactgccccctcggttgctcctcccgcggagtgtgtgttgatggtcagtgcatttgtgatagcgagtattctggagatgattgctcagagctgagatgccccactgattgcagtagtagaggcctgtgtgtggacggggaatgcgtttgcgaggagccctacaccggcgaagactgccgagaacttcggtgcccaggggattgcagcggaaagggtaggtgtgctaatggcacatgcctttgcgaggagggatacgtcggagaagattgcgggcaaagacaatgtctgaatgcctgctccggcagggggcaatgcgaggagggtttgtgcgtttgcgaggaaggataccagggccccgattgttctgcagtggcaccacccgaagatctgagagttgcgggcatatccgaccgttcaatcgagcttgagtgggatggacctatggcagtgaccgaatacgtgatctcttaccagcccactgccttgggaggactccagctgcagcagcgggtcccaggtgactggtccggggtcacaattacggagttggagcccgggctcacttacaacatcagcgtttacgcggttatatccaatattctatcactgcctatcaccgcaaaagtcgccacgcaccttagcacaccgcaggggttgcagttcaaaaccattacagaaaccactgtcgaagtgcagtgggagcccttttctttttctttcgatggttgggagatctcatttatcccaaaaaataatgagggaggggttattgctcaggtaccaagcgatgtcacgtcgttcaatcagaccggactgaaacccggagaagaatatattgtgaacgtggtcgcactgaaagaacaagcacgcagcccgcctaccagcgcctcagttagcaccgtgatcgacggtccaacccagatcttggttcgagatgtgagcgatacagttgctttcgttgagtggatcccacctagagcaaaggttgatttcatactgctgaagtacgggctagtaggaggtgaggggggtcggaccacctttcggcttcaaccaccattaagccagtatagcgtccaggcactcaggccaggctcacgttacgaggtttctgtcagtgcagtgcgcggcacaaatgagagcgatagtgccaccacccagtttaccactgaaatcgatgccccaaaaaacctaagagtgggctctaggaccgcaaccagcttagatctggaatgggataattcagaagccgaggtgcaagagtacaaagttgtatactccacattggcaggtgaacagtaccacgaggtgctggtccctagaggtatcggacccactacacgcgccacacttacagacctagttcccgggacagagtacggcgtggggatttcagccgttatgaatagtcaacaaagcgtgccagcgactatgaacgcaaggactgagttggattcccccagagatctcatggtcaccgcaagcagcgagacttctattagcctaatctggacaaaagcaagcgggccgattgaccactacagaatcactttcacgccctcaagcggaatcgctagcgaggttacagttcccaaggatcgcacctcctatacattgaccgatctggagccaggagcagaatacatcatttctgtgacagccgagaggggcagacagcagtcccttgagtctactgtcgatgcatttacaggcttccggccaataagtcatcttcacttctcacacgtgacctcaagctcagtgaacatcacgtggtcagacccctccccccccgctgatcgacttatcctaaattatagccctcgggacgaggaggaagagatgatggaggtctctctggatgccacgaagagacacgcggtgttgatgggcttgcagccagccactgagtacattgtgaacttggtcgcggtccatggcactgttacttccgaacccatcgtagggagtattacaaccggtatcgatccacccaaggacattactatctcgaatgtcactaaagattcggtgatggttagctggtcaccccctgtggctagctttgactactacagggtgtcgtatcgccctactcaagtggggaggttggactcctcggtggtgccaaacacagtgactgagttcacgattaccaggctcaaccctgcaaccgagtacgagatctccctgaactctgtcagaggtagggaggagtcagagagaatctgcaccctggttcacaccgccatggacaaccctgtagacctaattgccaccaacatcacccctaccgaagcactgctgcagtggaaggcacccgtgggagaagtcgaaaactatgtgatcgtcttgacacactttgcagtggccggtgagacaatcctggtagatggggtgtcggaggagtttcggctggtcgacctgctgccttccacccactatacagcgactatgtatgctaccaatgggcccctgacctccggaacaatttccacaaacttctccaccctcttagatcccccggctaacttgacagcgtccgaggtgacccgacagagtgccctgatatcctggcagccaccccgcgccgagatagagaactacgtgctcacctacaagtctactgatggcagtcggaaggaactcatcgtggacgccgaggatacctggatacgcttagaaggacttcttgagaacactgattacactgtcctgcttcaggccgcacaggatacaacgtggagcagcattacctccacagcctttacgaccggcggaagggtgttcccacatccacaggactgtgcccagcatcttatgaacggtgacaccctttctggcgtctaccctatcttcctgaacggagagctgagccagaaactccaagtctactgcgatatgactaccgatgggggaggttggatcgtattccaaagacggcagaacggccaaacagacttttttcgcaagtgggctgactacagggtcgggttcggtaacgtggaggatgagttttggctcggcctggacaatatccatcgcatcacaagtcagggcagatatgaactgcgagtggatatgagggatggtcaagaggccgcattcgcttcttacgatcggttttctgtggaagactcacggaacttgtacaagttgagaattggttcctacaacggcaccgcaggtgactccctgtcttatcatcaaggacgacctttcagcaccgaagatagggataacgatgtggcagtaaccaactgtgctatgtcatataaaggcgcctggtggtacaaaaattgccatcggactaatctgaatggaaagtatggcgaaagccgccacagtcaaggcattaactggtaccactggaagggacatgaattctctattccttttgtagagatgaagatgagaccctacaatcacagactgatggccggaagaaagaggcaatctctacagttttag

SEQ ID NO: 208317 - DNA, 534 bp, Artificial Sequence
  Description of Artificial Sequence: Synthetic coding sequence
tgaatcaacttccccaagaaggcctgcccctgcgccagcagcgcccaagtgctgcaggagttactgagtcgcattgagatgctggaaagggaagtttcagtcctgcgggatcagtgcaacgctaattgctgccaagaatcagctgccactgtagccccaccagaagacctgagggtcgctggcatctcggatcgcagtattgagctagagtgggacgggcctatggccgtaacagaatacgttatttcgtatcagcccaccgcgctggggggtctgcagctccaacagagagtgcctggcgactggtctggggtgacgattacagaactggagcctggcctgacctacaatattagtgtgtacgctgtgattagtaatatcctgtctttacctatcacagccaaggtcgcaacccacttgagcacaccccagggactgcagttcaagacgataactgaaactacagtggaggtccagtgggagccgttcagcttttcttttgatggatgggaaatctcttttatacctaagtag

SEQ ID NO: 208318 - DNA, 12669 bp, Artificial Sequence
  Description of Artificial Sequence: Synthetic coding sequence
atgatgcccgcccagtacgccctgaccagcagcctggtgctgctggtgttgctttccaccgcgcgagccgggcccttcagtagcagatcaaacgttaccttaccagcccctcggcctccaccccagcctggcggccataccgtgggagcgggcgtaggaagcccaagctcacagctctacgagcatacagtggagggcggggagaagcaagtggtatttacccacaggatcaacctgcctccttcaaccggatgcggctgtccgcctgggacggaacccccagtcctcgccagtgaggttcaggccctgcgagtgcgtctggagatattggaagagctcgtgaaaggactgaaggagcagtgtacagggggctgttgcccagcaagcgctcaggccggcaccggtcagaccgacgtgcggacactctgcagcctgcatggggtcttcgacctatcccgctgtacctgctcatgcgaacccggctggggaggtccaacgtgtagcgacccaactgatgctgagattcctccgagtagcccccctagtgcaagcgggagctgtcctgacgactgtaacgatcaagggaggtgcgtgcgcggacgatgcgtctgcttcccagggtatacagggccgtcctgcggctggcccagctgtcctggtgactgtcaggggcgcggaagatgtgtgcagggcgtgtgcgtctgcagagccggcttttctggtccagattgttcacagcggagctgccctcgggggtgttctcaacggggcaggtgcgaaggggggagatgtgtttgtgatcccgggtatactggagacgattgtggtatgcgtagttgcccccgtgggtgtagccagcggggtcggtgcgagaacggtaggtgcgtatgcaatcctggctacgcaggcgaagactgtggggttcgctcctgtccacggggttgctcccagagaggtaggtgcaaggacggacgctgcgtttgcgacccgggatataccggcgaggattgtggcacacggagttgcccttgggactgtggggagggggggagatgcgtggacggcaggtgcgtgtgttggcctggttataccggagaggactgtagtaccagaacatgcccacgcgactgtcgcggacgaggacggtgcgaagatggtgagtgtatctgcgatacgggctactccggcgatgattgcggcgtgcgctcatgtcccggcgattgcaatcaacgtggccgctgcgaagacgggcggtgtgtgtgctggcctggctatacagggacagactgcggatccagagcctgtcctcgcgattgcagagggcgcgggcgttgcgagaatggcgtgtgcgtgtgcaacgctggctattctggggaggactgcggggtgcggagctgccctggagattgccggggcaggggacgttgcgaaagcggccggtgcatgtgctggcctggctatactggcagggactgtgggacacgagcctgcccaggggactgcaggggaaggggtcggtgtgttgatgggaggtgcgtgtgtaatccgggctttactggtgaggactgtggctccaggagatgcccgggtgattgcagaggccatggcctatgtgaggacggagtctgtgtgtgcgatgccgggtactctggcgaggactgctcaaccagaagttgtccaggagggtgcagaggacgtggacaatgcctggatggcagatgcgtctgcgaggacgggtactccggagaagattgcggggtgaggcagtgccctaacgactgttcccagcatggagtctgccaagatggcgtgtgtatctgttgggaggggtacgtgagtgaagactgctccatccgcacctgtccatccaattgtcatggacgaggtcgttgcgaggaagggagatgtctgtgtgacccaggttacactggtcctacctgcgccacccgtatgtgtcctgctgattgtcgcggcagaggtcggtgtgtgcaaggggtatgtctgtgccatgtggggtatggtggggaggactgtggtcaggaagaacccccagcttcagcatgcccaggcggatgcggtcccagagaactttgccgcgccggccagtgcgtgtgcgttgaggggtttaggggtcccgactgcgccatccagacatgtccaggagactgcagaggccgcggggagtgccacgacgggtcttgtgtgtgtaaggacgggtacgcaggagaggactgcggagaagaggtgccaactattgagggcatgagaatgcatctcctggaggaaaccacagtaaggacggaatggaccccagctcctggacccgttgacgcatatgagatccagttcattcccaccacggagggagcaagcccaccctttactgcacgggtgccctcttctgcttcagcttacgaccagcggggcctcgctccaggccaggaatatcaggtgacggttagagctctacgagggacatcctggggattgcctgcgtcaaagaccattacaacaatgatcgacggcccccaggatcttcgcgtagttgcagtcaccccaacaaccctcgagctcgggtggcttcgcccacaggccgaagtggatcgattcgtggtgtcatatgtgagcgcaggtaaccagcgggttcgcctggaagtaccgcctgaggccgatggcactctcctaactgatctgatgcccggagttgaatatgtggtcaccgtgacggccgagaggggtcgagccgtttcctatccggcgtcggtcagagctaataccggctctagtccccttggactcctgggcaccacagatgaaccacccccctcaggcccctccacgactcaaggcgcccaggctccactactgcagcagagacctcaggagcttggagaattgcgggtgctcgggcgcgacgagaccgggagactcagagtggtgtggacagcccaaccggacacattcgcttactttcagttgcgcatgcgcgtgcctgaaggccccggcgctcatgaagaagtgctgccaggcgacgtgagacaggccctggtcccaccaccgcctcccggaaccccgtacgaactctccctgcatggcgtgcctcccggtggcaagccatctgaccctataatttatcaaggaattatggacaaggatgaagaaaaaccaggcaagtcctccggaccaccccggctgggcgagctgaccgtgactgaccggacctccgattccctattgctgcggtggactgtgccagagggagagtttgactccttcgtcatacagtataaagatagggacgggcaaccgcaggtcgtcccagtggagggcccccagagatctgctgttatcacctcccttgaccccggacgcaagtacaaatttgtcctgtacggatttgtgggcaagaaaagacatggccccttagttgccgaggctaagattctaccgcagtcagatccgtctcctggtacacctccccacctggggaatctgtgggtgaccgaccctactccagacagccttcacttgtcctggacagtgccagaaggccagttcgacactttcatggttcaataccgggatcgagacggcaggccccaggtggtgccagtggaggggcctgaaaggtctttcgtcgtgtcaagtctcgaccctgatcataaataccgctttacattatttggtatcgcaaataagaagcgctatggcccccttaccgccgacggaactaccgctcctgagaggaaagaagaacccccccgacctgagttcctggagcagccactcctgggggaactaacagtgactggagttacaccggacagcctgagactgtcgtggacagtagctcagggccccttcgactccttcatggtgcagtacaaggacgcccagggccagccacaggctgtcccggtggctggggacgagaacgaggtgactgttccaggcctggaccctgatcggaagtacaaaatgaatctctatgggctgcggggccggcaaagagttgggcccgaaagcgtggtagctaaaacagcccctcaggaggatgtcgatgagacaccgtcccctaccgaattgggcaccgaggcccctgaatccccagaggaaccgctcctgggcgaactgacagtcactgggtcatcgccagacagcctctccctgttttggaccgtgccgcagggcagctttgactcctttacagtccagtacaaggaccgggatggtaggccgcgagctgttcgagtgggcgggaaggagagtgaggtgaccgtgggcgggcttgagccggggcacaagtacaaaatgcatttatatggccttcacgagggacagagggtcgggcccgtttctgctgtaggggtgacagccccacagcaggaagagacccctcctgccactgaatctccattagagcctaggctcggagaactgacggtgacagatgtcacaccaaattctgtcggactcagctggaccgtaccagaggggcagtttgactccttcattgtgcagtacaaggacaaagatggacaaccccaggtggtgcccgtagccgcagaccaacgggaggtgactgtatacaacctcgagccagagcggaaatataagatgaatatgtacggtctgcacgatgggcagcgcatgggccccttgagcgtggtgattgttaccgcaccactacctccggcccccgctaccgaagcatcaaagcctcccctggagccacgcctcggagaactgaccgttacggatatcacacctgacagtgtggggctcagttggaccgtcccagagggggaatttgacagcttcgttgtgcagtataaggacagagacggtcagccacaggtcgtgcctgtggctgccgaccaacgcgaagtaactatcccagatctggagccctctcgcaagtacaagtttctattgttcgggatccaagatggcaaacgacgatcacctgtcagcgtggaagcaaagactgttgcccggggagatgcttcacctggtgcgccccctaggttaggcgaattgtgggtaacggatccaaccccagattccctccggctcagttggactgttcctgaggggcagtttgatagtttcgtggtgcagtttaaagacaaagatgggcctcaagtcgtgcccgtggaaggtcatgaacggtcagttacggtcactcctttggacgctggcaggaagtataggttccttctgtatggtttgctgggtaaaaagcgacatggcccactaaccgccgacggtaccaccgaggctaggtcggccatggacgacacaggcactaagagacccccaaagccaagactcggtgaggaacttcaggtaaccacagtaacccagaattcggttggtctgtcttggactgtgcctgaggggcaatttgattcttttgttgtgcagtacaaggacagagatggacagcctcaagtcgtgccagtggagggctcactgcgcgaggttagtgtgcccggtctcgacccagcgcaccgctataaactcctgctatatggtctgcatcatggaaagagagttggacccatatcggctgtcgccatcacagcaggaagggaggagacagaaaccgagaccactgccccgacccctccggcccccgagccccacttgggtgagctgaccgtggaggaggcgacatcccatacccttcatctgagctggatggtgacagaaggagagtttgacagtttcgagatacaatacacagatagagatgggcagctgcagatggttcggataggtggagaccggaacgacatcactctctccggcctcgagagcgaccatcgttacctcgttaccctctacgggttctcagatggcaagcatgtgggaccagtccacgtcgaagccctaaccgtgccagaggaggaaaagcccagcgaaccaccgaccgccacaccggagcctccaattaagccacgtttgggcgagctgaccgtcacagatgcgactcctgacagtctgtcactctcctggaccgtgcctgagggccagtttgatcacttcctcgtacagtacaggaacggggatgggcaacctaaagcagtgcgcgtgcctggtcacgaggagggggttacaattagcggccttgagcctgatcataagtacaaaatgaacctgtatggatttcatggtgggcagcgcatggggcctgtgagtgttgtgggggtgaccgcggccgaggaggagactccatccccgacggaaccctccatggaagctcccgaaccagccgaagagcccctgctgggcgaactaaccgtgaccggtagcagccccgacagtctctctcttagttggaccgtaccacagggccggttcgatagcttcactgtgcagtacaaagatagagacgggagaccacaggtcgtgcgggtgggcggcgaagagtccgaggtgaccgtgggaggactggagcctggacgtaaatataaaatgcacttgtacggccttcacgaaggcagacgagttggtcccgtgtctgcagtcggagtcaccgcaccagaggaggagagccccgacgcccccctagctaagcttcgactgggacaaatgaccgtgagagacattacctccgattctttgtccctctcatggaccgttcccgaagggcaattcgaccactttctggtccagttcaaaaacggcgacggccagccgaaggcagtccgggtaccgggacatgaagacggcgtgaccattagcggacttgagcctgaccacaaatacaaaatgaatctgtacggtttccacggtggccagcgtgtcggccccgtcagtgctgtgggccttacagcccctggcaaagacgaggagatggcacctgccagcactgagcctccaacgccagagccacctatcaagccacgactagaagaattgacagtcaccgatgctacgccagattcactcagtttaagctggactgtgcccgaggggcaatttgaccactttcttgttcagtacaagaacggtgatggacaaccgaaggcgactagggtgcctggacacgaggacagagttacaattagtggactcgagcccgacaataagtataagatgaacctgtatggtttccatggcggacagcgggtggggccagtaagtgctattggagtgactgcagctgaggaggaaactccatcccctactgaacccagcatggaagctccggagcctcctgaagaacccctcttgggagaactcacggtgactggatccagcccggattcattaagccttagctggactgtgccccagggtaggtttgattcattcactgttcaatataaggacagagacggtcgtccacaggtcgttcgagttgggggcgaggaatcggaggtgactgtgggcgggttagagcctgggcggaaatataaaatgcatttatacgggttgcatgaggggcgtcgggtggggcctgtgagtacggtgggcgtcaccgctcctcaggaggacgtggacgagacaccttctccaaccgagccgggtaccgaggcacccgagccccctgaagagcctctgctgggggaactgactgttacgggctcaagtccagatagcctgagtctcagctggacagtgccacagggaagattcgactccttcacagtgcaatacaaagacagagatggtaggcctcaagctgtgagagtgggtgggcaagagagtaaggtgaccgtcagaggcttggagccgggaaggaagtataagatgcatctgtacgggctacacgaggggagacgattggggccggtgtctgcagtcggcgttacagaggacgaagctgagacgacccaggctgtgccaaccatgactccggaaccacccatcaaaccccgtttgggagagctgaccatgacggacgccacccccgactcgctctccctcagctggactgtcccagaggggcagttcgaccattttctggtacagtaccgtaacggtgatggtcagccaaaggctgtgagggtccctggccatgaggatggggtgaccatttctggtctggagcccgaccacaaatataagatgaacttatacggttttcacggcgggcagcgggtggggccaatttccgtgataggagtcaccgccgcggaggaggaaaccccttcgcccacagagctgagcactgaagccccggaacccccagaggaacccctgctgggggaactgactgtcaccggcagcagtcctgattccctttctttgagttggaccattccccaaggacatttcgattctttcacagtgcagtataaggacagagatggcaggcctcaagtcatgcgcgttcggggagaggagtctgaggttactgtcggtggcctggaacccgggagaaaatacaagatgcacctgtacggcttgcacgaggggagaagggttgggccagtgtctaccgttggcgttacagtgccaacaacaacccctgagccccccaacaagccccggctgggagagctgacagtcaccgatgccacaccagatagtctctccctttcctggatggtgcctgagggacagtttgaccattttctagttcagtacaggaatggagacgggcagccgaaggtggtgagagtacccggccacgaagacggtgttaccatttctggcctcgagcccgatcacaaatacaagatgaacctgtacggcttccacggggggcaacgggtgggccccatctcagtgatcggcgtgaccgcagccgaagaagagacaccagccccgacagagccctcaacagaggcgcctgaaccacccgaagaacccctgctaggggagctgacggtaacgggcagttctcccgacagtttgagtctttcttggaccattccccaggggaggtttgactcatttacagttcagtacaaggatcgagacgggcggcctcaggtggtgagagtcagaggggaggagagtgaggtgacagttggagggctggagcctgggtgcaagtataaaatgcatttgtatggtcttcatgaggggcagcgcgtaggcccagtgtccgccgttggagtgacagtcccgacaatgacgccagagccacccatcaaacccaggctaggcgaattaactgtgaccgatgcaacgcctgactccctgtccttgtcctggatggtccccgagggacagtttgaccactttctggtgcagtatcgcaacggcgacggccaaccaaaggctgtccgcgttcccgggcacgaagacggtgtcactatcagcggccttgagccagaccacaaatacaaaatgaatctgtatggattccacgggggtcaacgggtggggccagtttcagccattggagtgaccgaggaagagacaccttccccgaccgaacccagcaccgaagccccagaggcccctgaggagcctctgctcggagagctgacggtgactggttcgtcccccgactcactgagcctatcatggaccgtgcctcaggggagatttgactcttttacagttcagtacaaggacagagatggacagccgcaagtggtcagagtcaggggagaagagtctgaagttaccgttgggggactggagccagggcgaaagtataaaatgcacctgtacggtctgcacgaggggcaaagggtcggccctgtgtccaccgtgggcattaccgcgccccttccaacccctctgcctgtggagccccggctgggagaattagctgtggccgctgtcacttccgattctgtaggtctctcatggacagttgctcaagggccattcgacagctttctggtgcagtatcgcgatgcccaagggcagcctcaagccgtcccggtgagtggcgatctgcgcgccgtagccgtctcaggcctcgatccagcccgcaagtacaaattcttgcttttcggattacagaacggcaaacgccatgggcccgtgccagtcgaggcccggacagctcctgatactaaaccttctcccagactcggagagctgacggtgactgatgctacacccgatagcgtgggcctctcctggactgtccctgagggagagtttgatagctttgtggtgcagtataaagacaaagacggccgcctgcaggtcgtcccggtggcagccaatcagagagaggtcactgttcaaggattggagccttctcggaaatacagattcttactctacgggctgtctgggcggaaacgcttgggccctatttcagctgacagcaccaccgcccctctggaaaaagagttgcctcctcatcttggagaactgaccgtggcagaggaaacctccagctcactgcgtctcagctggacggtcgcccaggggccattcgactcattcgtggtccagtaccgggatacagatgggcaacctagggccgtccctgttgcggctgaccaaaggactgtaacagtggaggacctggaacctgggaagaaatacaagtttttgctctatggcctgctggggggtaaacggctggggcctgtgtccgcccttggaatgactgcccccgaggaggatacccctgcgcctgagttggcgccagaagctcctgaaccacccgaagagcctaggcttggcgtcttgacagtaacggacaccacgccagactctatgagacttagctggagtgtggctcagggccccttcgatagctttgtcgtgcagtacgaggacacaaacggccagccacaagccctgctggtggatggggatcagagcaagatactgatctccggtctcgaaccatctacgccatataggtttctgttatatggcctgcatgaggggaagaggcttggacccctctccgcggagggaactactggcctcgctccagctggccagacttctgaggaatcccggcctaggctgtcacagttgagcgtgaccgacgtcaccaccagctctctccgcttaaattgggaggcacctccaggagccttcgactcttttctgctgagattcggagtgccttctccaagcacactggagccccaccctcggccgcttctccagcgagaattgatggtgccaggaacaaggcactctgctgtcctgcgagatcttcggtcaggaacgctatactccctgactctgtacggactcagaggcccccacaaggcagacagcatccagggcactgcacggacactttccccggtgctggaaagcccgcgtgatttacagttcagtgaaattagagagacaagcgccaaggtgaactggatgccaccaccaagccgcgcagattcattcaaagtgtcctatcagctggcagatggtggagagccacaaagtgttcaggtcgatgggcaggcgagaacccaaaagctacaagggctgatcccaggcgcccgatacgaagtcaccgttgtctccgtgagggggttcgaagaatccgagccgctcacaggttttctaactactgttccagacggcccgactcagttgagagcactgaatttgaccgagggcttcgcagtgctgcattggaagccaccccagaatcccgtcgatacatacgatgtgcaggtcaccgcccctggtgcgccacctctgcaggcggagactcctgggtccgcagtggactatccactgcacgaccttgtactgcacacgaactacacagcgacggtgagagggctccgcggcccaaacctcacctcacctgccagcataacgtttaccacaggcctcgaagcaccaagagatcttgaggcgaaggaggtaacccccagaactgcactcctcacttggacagagcctcccgttcggcccgccgggtacttgcttagcttccacaccccaggcggacagaatcaggaaattcttttacctggagggattaccagccatcagctgctggggctgttcccaagcacaagctataacgccaggttgcaagctatgtggggccagagcctgctgcccccagtctcgacttcctttaccaccgggggactgcgcatcccctttccccgggattgtggcgaagagatgcagaacggcgctggcgccagtcgaacatccacaatattcctgaacggcaatcgtgaacggcctctgaacgtgttctgtgatatggagaccgacggcggcggatggctggtgtttcagagacggatggacggccagacggatttttggcgcgactgggaggattacgcgcacggttttggtaacatcagtggcgagttctggctcggaaatgaagcccttcactcactgactcaggccggtgactacagtatgcgcgtggacctgcgagctggggacgaggcagtgttcgcacagtacgactctttccacgtggatagcgccgctgagtactaccggcttcacttggagggttatcatgggaccgccggggatagtatgagctatcatagcggcagcgtcttctccgcccgagaccgcgatcccaacagcctgctcatcagttgtgctgtttcttacagaggcgcttggtggtataggaattgtcattatgcgaatttaaacggactgtatgggtctaccgtggatcatcagggtgtgtcttggtaccactggaaggggttcgagttcagtgttccatttacagagatgaaactcagaccaagaaactttcgcagcccagcgggcgggggttag

SEQ ID NO: 208319 - DNA, 6450 bp, Artificial Sequence
  Description of Artificial Sequence: Synthetic coding sequence
tgagccgaggaggagacccccagccccaccgagcccagcatggaggctcccgaaccagccgaggagccgctgcttggggaactgacggtaacgggttcctccccggacagtctgagtctgtcttggaccgtgcctcagggccggtttgacagtttcactgtccaatacaaggacagagacggccgacctcaggttgtgagggtgggcggagaggagtctgaggtaaccgtgggcggcctagaacctgggcgcaagtacaaaatgcatttgtacggattacatgaaggccgcagagttggacctgtgtccgccgtgggcgtcactgcgcctgaggaggagagcccagacgcccccctggcaaagttgagattagggcagatgaccgtgcgagatattaccagcgatagtctaagcctctcttggacggtgcctgagggccaatttgatcactttctcgtgcaatttaaaaacggagatggtcagcctaaagcggtacgggtgcccggtcatgaggacggcgtcaccatctcaggcctcgaacctgaccataagtacaagatgaacctgtacggctttcacggcggccagcgagttggaccggtgtcagcagtgggcttaactgcccccggaaaggacgaggaaatggctcccgccagcacagagccccctacccccgagccacccattaagccaagactggaggagctcactgttaccgacgccacacccgactctctgagcctgtcctggacagtgcctgaggggcagttcgaccacttcctcgtgcagtacaaaaacggagacggccagcctaaagccacgcgggttcccggccatgaagacagagttaccatctcgggattagaacccgataacaaatacaagatgaacctctatgggtttcatggtgggcagcgggtcggaccagtgagcgcaatcggtgtgactgccgccgaagaagaaaccccaagccccacggaaccatccatggaagcaccagaaccaccagaggaacccttgctgggagagctcaccgtaacaggatcttcccccgattccctgtcgcttagttggacagtgccgcaggggaggttcgattcttttaccgtccagtacaaagatagagatggaaggccccaggtggttcgggttggcggagaagagtctgaagtcaccgtcggcggtcttgaaccaggccgtaagtataagatgcacctatatgggcttcatgagggacgaagagtgggcccagtaagtactgtgggagtaaccgccccccaggaagatgtggatgaaactccaagtccaacagagccaggcacagaggctcctgaaccacctgaggaacctctgcttggggagctgactgtgaccggttcatcccctgatagcctttccctgagctggactgtcccccaaggccgcttcgactcctttactgtgcagtataaggatagggatggaaggcctcaggccgtccgcgtaggaggccaagagagtaaggttactgtccgcggtctggagcctggacggaaatacaaaatgcacttatacggcctacacgaggggagaaggctggggccagtaagcgctgtgggcgtgaccgaagacgaagcagagacaacgcaagcggtgcccactatgacccccgaaccaccaataaagcccagactgggcgaactaacaatgacggacgctacccccgacagccttagcctatcctggacagtacccgagggccagttcgaccattttctcgtgcagtaccggaatggggatgggcagccaaaggccgtgcgggtgccagggcacgaggacggagtgactatctcagggctagaaccagaccacaagtacaagatgaacctgtatggattccatggtggccagcgtgtggggccgattagtgtaactggtgtcaccgccgccgaagaggaaacacctagtcccaccgagttgagtacagaagctcccgagccccccgaggagcctcttctaggagaacttactgtgaccggatcctctccagacagcctttccttatcatggactatcccccagggccatttcgatagttttaccgtgcagtataaggaccgcgatgggcgaccccaggtcatgagagtgaggggcgaagaatccgaagtgaccgtgggagggcttgaacctggacgcaagtataagatgcacctgtacggccttcacgaaggccgtagagttggtcccgtaagtaccgtcggcgtgactgtaccgaccactacgccagaaccccctaacaaaccaagactgggggaactgacagtgactgatgcaactccagactcgctgagcttgtcctggatggtgcccgagggacagttcgaccatttcctggtgcagtatcggaatggtgatggccaacccaaagtagtacgggttcctggccacgaggatggagtgaccatctcaggactggaacccgaccacaagtataaaatgaacctgtatggcttccacggggggcagagggtagggccgatctccgtgattggcgttaccgctgctgaggaggaaacgcccgcacctacagagccttctaccgaggcgccagaacctccagaggagccactccttggagaacttaccgtcacaggtagtagcccagactccctgtcacttagctggaccatcccccaggggcgttttgacagcttcacagtgcagtacaaagatcgcgacgggaggccacaagtcgtgcgtgtccgcggagaggagtcggaggtgacagtcgggggtctggagcccggatgtaagtacaagatgcacctatatggactgcacgagggccaacgggttggccccgtgagcgctgttggggtgacggtgcctactatgacccccgaacctcccatcaaacctcgtttgggggagctcactgtgaccgatgcaaccccagattccctgagtctgtcctggatggtgcccgagggccaatttgaccacttcctcgtccagtacaggaacggagacggacagccaaaagcggtccgggtcccaggacacgaggatggcgtcactatctccggactagagcccgatcacaaatataaaatgaatctttacggattccacgggggccagagagttggcccagtgtccgccattggcgttacggaggaagagaccccctctcccactgaaccttcaaccgaagcccccgaggccccagaggagccactcctgggcgagttgacagttacagggagttcccccgactctctctctctgagctggaccgtgcctcagggtagatttgacagcttcaccgtccagtataaagaccgtgacgggcagccacaggtggtgagggtcagaggtgaggaaagtgaagtcactgtgggggggcttgagccaggccggaaatataagatgcatctttatggactccacgagggccagagggtggggccagtctccactgttggcatcaccgcacccctgcccacacctctcccagtggagcctcgcctcggagagttggcagttgccgctgtcacatccgattctgtgggactttcatggaccgtggcccaaggaccatttgactccttcctcgtacaataccgagacgcccagggacagccccaggccgtaccggtgtctggcgatctgcgagcagttgccgtgagtggccttgatcccgcaaggaagtacaagttcctactgttcgggctgcagaacggtaaacggcacgggcccgtgcccgtggaggctcgcaccgcaccagacacgaaaccatctcctaggcttggcgagcttaccgtgactgacgcaacccctgactccgtgggtctgtcctggacagtgccagagggggaatttgatagcttcgttgtgcaatataaggataaggacggccgcctgcaggtcgtacctgtcgccgctaaccagagggaggttactgtccagggactggaacctagccgtaagtatcgattcctgctgtacggcctctccggccggaaacgcctaggaccgatcagtgcagatagcaccactgcccccctcgaaaaagaattacccccccacctaggggagctgaccgtcgctgaggaaacaagttctagcctgcggctgtcttggactgtcgcacagggtcccttcgacagcttcgtcgtgcagtacagggacaccgacgggcagcccagggccgttcccgtggccgctgaccagcgcactgtaactgttgaggatctggagcctggcaagaaatacaaattcctgctgtatggcctactgggcggtaaaagactgggcccggtgtccgctctaggcatgacagcccctgaagaagacaccccagctcctgagctagcacccgaagcgcctgagcctcctgaggagcctcggttaggggttttaaccgtaaccgacacaacccccgactcaatgaggttaagctggagtgtggcccaggggccctttgactcatttgtggtccagtatgaggacaccaatggccagccgcaggcattactcgtggatggggatcagagcaagattctgatcagtggacttgaaccctcaacaccttatcgatttttattgtacggactgcacgaaggaaaacgtctcggcccacttagtgcagagggaacgaccggcctcgctcctgcaggtcagacttccgaggagagccggccacgactgtcacaattgtccgtgactgatgtcaccacctcttcccttaggctcaactgggaagccccacctggggcttttgatagttttctgctccggtttggcgtgccatcaccatccacgttagaaccacacccaagacccctgctccagagagagctgatggttcccggcacaaggcacagcgcagttctgcgcgacctgcggagcgggacactctacagtctgacgctgtatggactccgaggtcctcataaggctgactctatacagggcaccgcccggacactgagtcccgttctggagagcccccgggaccttcagttcagcgaaataagagaaacctcagcgaaggttaactggatgccaccaccaagccgggctgactcgttcaaagtgtcctatcaattggccgacggcggagaaccccagtctgtccaagtggacggtcaagcccgaacccagaagcttcagggtctcatacccggcgctcgctacgaagtgaccgtcgtgtccgtgagggggttcgaggagtctgagccactgaccgggtttttgactactgtaccggatggacctacccagctccgagccctcaacctcacagagggattcgcggtcttgcactggaagcccccccagaaccccgtagatacttacgatatccaggttacggcccctggtgccccgcctctgcaggcagagacacccggctccgctgtggactaccccctgcatgaccttgttctgcatactaattacaccgccaccgtgcggggcctacgaggtccaaacctcacctcccctgcaagcataacgttcaccactggactcgaagctcctcgtgatctggaagcaaaggaggtcacaccccgcacagctctgctgacttggaccgagccacctgtgcggccagctgggtacttgctgtctttccacacaccagggggacagacacaggaaatcctgctgccaggaggtattacatcacaccagctgctcggactctttccgagcacttcctacaatgcccgtctccaggccatgtggggccagagtctgctgcctcccgtgtccacgagcttcaccaccgggggtctgcgtatcccttttcctcgggactgcggcgaggaaatgcagaacggggccggtgcgagtagaacatccactatttttctgaacggcaatcgcgaaagaccactgatcgtattttgtgacatggagaccgatggcgggggctggttagtattccagcggagaatggatgggcagaccgatttctggagagactgggaagattatgcacatggcttcggcaatatcagcggggagttttggttgggcaacgaggcactgcattcacttactcaggccggcgactattctatgagggtcgatctaagagctggcgacgaagccgtgtttgctcagtacgattccttccacgtagacagtgccgctgagtattatcgtctgcacctggaagggtaccatgggaccgcaggggattccatgagttatcatagtggtagtgtgtttagtgctcgtgacagagatccaaattccctgctgatcagctgcgctgtgtcttacaggggggcatggtggtatcgcaactgtcactatgccaacttgaacggcctgtatggatccacagtcgatcaccagggcgtgtcctggtatcattggaagggattcgaattcagcgtgcctttcactgaaatgaagctcagaccccgcaatttccggagccccgctggaggcggttag

SEQ ID NO: 208320 - DNA, 27 bp, Artificial Sequence
  Description of Artificial Sequence: Synthetic coding sequence
atgatgcccgcccagtacgccctgtag

SEQ ID NO: 208321 - DNA, 27 bp, Artificial Sequence
  Description of Artificial Sequence: Synthetic coding sequence
atgatgcccgcccagtacgccctgtag

SEQ ID NO: 208322 - DNA, 9891 bp, Artificial Sequence
  Description of Artificial Sequence: Synthetic coding sequence
tgaagcagccccctgggcctgctgggcaccaccgacgagccccccccaagtgggccgagtaccacccaaggcgctcaggccccattactgcaacagcggcctcaggagctcggcgaacttagggttctgggaagggatgagaccgggagactacgggttgtctggacagcccagccggatacttttgcctatttccagttacggatgagagtgcccgaaggcccgggcgcacacgaggaagtgctccccggagatgtgcgtcaagctcttgtcccacctccgccaccaggtaccccctatgaattaagtctccatggcgtccctccgggaggaaaaccaagcgaccctattatctatcagggtattatggataaggatgaggaaaagccaggcaagtcttcaggcccccccaggttaggtgaactcaccgtgacagaccggacgtcagactctctcctgctgaggtggaccgtgcccgagggtgaatttgactccttcgttattcaatacaaagaccgggacggccaaccacaggttgtgcccgtcgagggcccccagcgttctgctgtgattacttccctggaccctggacggaagtacaagtttgtgttatacgggttcgtgggcaaaaaacgacatggtccattggttgccgaggctaagatcctcccccagtcggacccttcacccggaacaccacctcacctgggtaatttatgggtgacggaccccactccagactcactgcacctttcctggaccgtgcccgaggggcaatttgacactttcatggttcaataccgtgatcgggatggccgccctcaggttgtccctgtagagggtccggagcgttcctttgtggtaagcagcctggaccctgaccacaagtacaggtttaccctgttcgggatcgcaaataaaaaacgatacgggcccctgactgcagatgggactaccgcccctgagcgaaaggaagagcccccaaggcccgagtttcttgagcagcctcttctgggagagcttacagttacaggcgtgactccagatagcctcagactgtcttggaccgttgcgcaggggccattcgatagtttcatggtccaatataaagatgcccagggtcagccccaagctgtgcccgtggcgggtgatgagaatgaggtgactgtacccgggctagatcccgacaggaagtacaagatgaatctgtacggcctgcggggacgtcagagggtgggccccgaaagtgtggtggccaagacagcccctcaagaggacgtggacgaaacaccgtctccaaccgaactcggcactgaagcgcctgagtcccctgaggagcctctgcttggagaactgactgtgacgggctcttcccctgacagtctctcccttttttggactgttcctcagggaagtttcgatagttttacggtgcaatacaaagatagagacggtcgtccccaggctgtgagggtgggcggcaaggagtccgaggtgaccgttggtggcttagaacccggacataaatacaagatgcacctgtacggcctgcatgaaggccagcgggtaggccccgtctccgcagtgggagttaccgcaccgcagcaggaggagactcccccagctactgagagccctctggagccccgactcggcgagctgaccgtgaccgatgtcaccccgaattccgtggggttgagttggacagtgcctgaggggcagtttgattcctttattgttcagtacaaggacaaggacggtcaaccccaggtggtccctgtggctgctgaccagcgggaagtcaccgtgtacaatctcgagcctgagagaaagtataaaatgaacatgtatggtctccacgacggacagcgaatggggcccctcagtgtggtgatcgtcacagcccccctcccaccggcccctgcaacggaggcctctaagccccctttggaacctagattgggtgaacttacggtaacggatattactcctgactctgtagggctgagctggaccgtgcctgagggagaattcgatagtttcgtggtccaatacaaagaccgagacggtcagcctcaagtcgtgccagtcgctgccgatcagcgcgaggttacaatccctgatctcgagccatcccggaaatataagtttctcctgttcggaatccaggatggaaagcgcaggagtcccgtatctgtggaggcgaaaacagtggctcggggcgacgcatctcccggggctccaccccgattgggagagctttgggtgacagatcctaccccggactctttgcgactctcctggaccgtccctgaggggcagttcgacagtttcgtggtgcagtttaaggacaaagacggtcctcaggtcgtgccggtggaaggccacgaaagatccgtgactgtcactcctctggacgcaggaaggaagtacaggttcctgctgtatggccttttgggcaaaaagagacacggaccactaacggctgatggcactactgaagctcgcagcgcaatggacgatacaggaactaaacggcctcccaaacccagactcggcgaggagctgcaggtaaccacggtcactcagaatagcgttggtttgtcatggaccgtacctgagggacagtttgattcatttgttgtgcagtataaggatcgcgacggacaacctcaggttgtcccagtcgagggcagccttcgcgaggtgtcagtgccgggcctcgaccccgcccacagatataaactgctgctttacgggttacatcacggcaaacgcgtgggtccgatctctgccgtcgcgatcacggccggccgggaagagacagagactgagacgaccgctcctacgccaccagccccggaaccccacctgggggagctgactgtggaggaggccacctctcacactctgcacttgtcttggatggtaactgagggcgagttcgattcattcgagatccagtatactgatagagatgggcagttgcaaatggtgcgaatcggcggtgaccgcaacgatattaccctcagtggactcgagtcagatcacaggtatctcgtcacattgtacggtttctccgatggcaaacatgtcgggccagtgcacgttgaggccctcaccgtccctgaggaggagaaaccgtcagaacctccaaccgctacgcccgaaccccccatcaagccacgattgggagagcttacagtgactgacgccaccccagatagtctctctctctcctggacagtgcccgagggacaatttgatcactttctggtgcaatatcggaatggcgacggacagcccaaagctgtgcgcgttccgggccacgaggagggcgtgactatttccggtttggaacccgaccacaaatataaaatgaatctatacggtttccacggaggacagcggatgggccctgtgagtgtggtgggtgtgaccgcagccgaggaagagacaccttcacctactgaaccttctatggaggctcccgagcccgcggaagagccactactcggagagctgacggtaacaggcagctcgcccgacagcttgagcttgagttggaccgtccctcagggccgcttcgactctttcaccgtgcaatacaaagatagggatggcagacctcaggttgtccgcgtaggcggagaagagagcgaggtcaccgtcgggggcctggaacctggcagaaagtacaaaatgcacttatacgggctgcacgaggggcggcgggtcggaccagtctcggcagtgggagtaacggctcccgaggaggaaagcccagatgcaccacttgcaaaactgcgtctcggccagatgaccgtcagggacatcacttcagatagtctgtccctgtcatggaccgtaccagaagggcaattcgaccatttccttgtccagttcaaaaatggtgacggacaacctaaggccgttcgcgttcccgggcacgaagacggcgtgactatttctggattagagccagaccacaagtataagatgaacctatacggatttcatggcggccagcgggtgggacccgtgtctgccgtcggacttactgcccctggcaaggatgaggaaatggcaccagcttcaaccgagccgcctacccccgagcctccgatcaaacccaggctagaggaactgactgtgacagatgcaacccccgacagtttaagcctgagctggacagtgccagaaggccagtttgatcatttcctggtgcaatacaagaacggagacggccagcccaaagccacaagggtccctgggcatgaagatagagttaccatctccggactggaaccggacaataaatataaaatgaacctgtacggattccacggcggtcagcgggtgggacctgtctctgcaatcggagtgacagcggccgaggaggagacacccagccccaccgagcctagcatggaggcccctgagccaccagaggagcctttactcggagaactgacagtgactggctcatctccggactcactgtctctctcttggacagttccacagggacgcttcgacagcttcactgttcaatataaggatcgcgatggccgcccccaggtggtacgcgttggcggggaagagtcggaagtgaccgtgggcggcctcgagccaggacgtaaatataagatgcacctttatggactccacgagggccgacgggttggccccgttagcaccgtgggggtgaccgcccctcaggaagatgttgacgagacacctagtcccacagagcctgggactgaagcaccaggaccacctgaagaaccattgctgggagagttgaccgtgacgggctcatctcctgactccctcagcctgtcctggactgttccacagggccggtttgatagctttacagttcagtataaagacagggacggccggccccaggctgtgcgggtaggtggccaggagagcaaggttaccgttagggggctggaacccgggagaaagtataagatgcacctgtatggtctccatgaggggagacgactaggacctgtgagcgcagtgggagtgacagaggatgaggccgaaacaacacaggctgtgcccacaatgacccctgagccaccgattaagcccagactgggcgagctcaccatgaccgatgctacccccgacagtttgtctctgagttggaccgtccccgagggccaattcgaccactttctggtgcaatatcggaatggagacgggcaacctaaagcagtgagagttcccggccacgaagacggggtcacaataagtggcctggagccagatcataagtacaagatgaatctgtacggattccacggggggcagagggttggccctattagcgtgatcggcgtaaccgcagccgaagaggagactccttcgcctacagagctaagcacggaagctcccgagcctccagaagagccactgctgggggagcttacagtcacaggttccagtcccgatagccttagcctatcctggacaatccctcagggccactttgattccttcaccgtgcaatacaaggaccgcgacggccggccacaggtgatgcgcgttagaggagaggagtcagaggtcacagtgggcggactggagccaggccgcaaatataagatgcacctttacggactgcatgagggaagaagggtgggacccgtgagcactgttggtgtgactgtccctacaaccactccagaaccgccaaacaagcccaggttaggggaacttaccgtgacggatgccaccccagacagtcttagcctgtcatggatggttcccgaaggccagttcgaccactttctcgttcagtacagaaatggggatgggcaacccaaagtagtgagagtacctggccatgaggacggcgtgacaatttctggcctggaacctgatcacaagtacaaaatgaatttatacggtttccatggcgggcagcgagtcggacctatcagtgtaatcggcgtcacggcagctgaagaggaaaccccagcgcctaccgagccctctaccgaggcccctgagccccccgaagaaccgttgttgggtgaattgacggtaaccggttcctctccagacagcctatccctgtcttggacaatcccccaaggtagatttgacagcttcacagtacagtacaaagatagggatggcagaccccaggtggtgagagtgcggggtgaggaatctgaagtcaccgtggggggcctggaacccgggtgcaagtataagatgcatctctatggattgcatgaggggcaacgagtcggcccagttagcgccgtgggcgtcacagtgcctaccatgacccccgagccgcccatcaagcctaggttgggggagctgactgtgactgatgcaactccagattccctgagcctaagctggatggtccctgaggggcagtttgaccatttcttagtccagtacagaaatggggacgggcagccaaaagcagtgagagtgccaggtcacgaggatggcgtgacgatttccggtctggaaccggatcacaagtacaaaatgaatctctacggattccacggcggacaacgggtcgggcctgtgtccgccataggggtgacagaagaagaaacgccctccccgactgagccatctaccgaagcgcccgaagcgccagaagaaccactactgggggagttgaccgtgactggtagctccccggatagtctctcactgagttggaccgtgcctcaaggccggtttgatagttttactgtgcagtacaaggatcgggacgggcagcctcaggttgtgcgcgtcagagtggaggagtctgaggtcaccgtgggaggcctggaaccaggccgaaagtataaaatgcacctgtacggactgcatgagggccagcgcgtgggccctgttagcaccgtcggcatcaccgctccactgcctacaccgctccccgtcgagccacggttaggtgagttggcagtcgctgctgtaacttcggactcagtgggactgtcttggacggttgcccagggccccttcgacagtttcctggtgcagtacagggacgcacagggtcagccccaagcagtcccagtcagcggcgacctgcgcgcggtggctgtgtcaggtctagacccggctcgcaaatacaaatttctgctctttggactgcaaaatggaaagaggcatggaccagtgcccgtggaagcgaggaccgcaccagatacaaaacctagccctaggctgggcgagctgaccgtgacggacgccacccccgatagtgtgggcctgtcttggacagtgccagaaggcgaattcgactcatttgtggttcaatacaaggataaagacgggcgtctgcaggttgtgcccgtggccgccaaccaacgagaagtcacggtccagggattagagccaagcaggaaatatagattcctgctctacggtctctccggtaggaagcgcctgggtcctattagtgccgatagcacaaccgccccacttgagaaagagcttcctccacacctgggagaactgacggttgcagaggagacaagtagcagtcttagactttcctggactgtggctcagggcccttttgatagttttgtagtccagtaccgcgataccgatggccagccgcgcgccgtgcccgtggccgcggatcagagaactgttaccgtggaggatctcgagcccgggaagaaatataagttcctgctgtacgggctacttgggggcaagcgcttgggccctgtgtccgccctcggtatgacggcacccgaggaagacacaccggccccagagttggcacccgaggcccccgagcctccagaggagccccgattaggcgtcctcacggttaccgacacaactccagactcgatgcgcctgtcttggtctgttgcacaggggccctttgattcgtttgttgtccaatacgaggacaccaatgggcagccccaggcactgctggtggatggagatcagagcaagattctgatcagcggtctggaaccctccacaccgtataggttcctgttatatgggctacacgaagggaagcggttgggccccctctctgccgaaggcacaacaggactggcaccggccggacagaccagcgaagagagtcggcccagactgtctcagctgtccgtgaccgatgtcaccactagttcactgagactgaactgggaggcccctccaggggccttcgactctttcttactgcgttttggggttccatctccatccactctcgaacctcaccccaggccattgctgcagagggagctgatggtgccaggcacccgccatagcgcagtgctcagggacctgagatccggcactctgtactctctgactctgtacgggctgcgcgggcctcacaaggccgactctatccaggggacagctcgcactttgagcccggttctggagtctccacgagatcttcagttctctgagatcagggaaacaagtgcaaaagtgaattggatgcctcccccgagcagggctgactctttcaaggtcagctatcagctggctgacgggggtgaacctcagtccgtgcaggtggacggacaagccagaacacaaaagctccaggggcttatccctggggcgcggtacgaagtaaccgttgtctcagtgcggggttttgaagaatcggaacccctcaccggcttcttaaccacggtccctgatggacccacccagttgagagccttgaacctcacggaaggatttgccgtgctccactggaagcccccacaaaaccccgtggacacgtacgatgtgcaggtcaccgctccaggcgcgccccctctgcaggccgaaacacctggcagtgcagtcgattaccccctgcacgacctcgtgttacatacaaactatacggccactgtgaggggcctgcggggccccaacttgaccagtccggcctcaatcactttcacaacaggactcgaagctccaagggacttagaggcaaaagaagttacacctagaacggcattgctgacgtggaccgagccccctgtgaggccagctggttatcttctctccttccatacccctggaggacagaatcaagagattctactacccggtggaattacctcgcaccagcttttgggcctatttccgagcacgtcttacaatgcaagactacaggccatgtgggggcagtctctcctgcctcccgtgagtacctccttcaccaccggcggcttgcgcatcccctttccacgtgactgtggggaggagatgcagaatggcgcaggcgcctcccggacatcaaccatttttctgaatggaaatagagagcgacctctgaatgtgttctgtgatatggagacagacggcgggggatggttggtgttccagagaaggatggacggccagactgacttttggagagactgggaggattacgcccatgggttcggcaatatctccggtgaattctggctggggaacgaggctctgcattcactgacccaagctggcgattatagtatgcgcgtggacttgcgagccggggacgaggccgtgttcgctcaatacgacagttttcacgttgacagcgcggccgagtactaccgtttgcatctggagggctatcacggtaccgcaggcgattcgatgtcttatcatagtgggtctgtgttcagcgcccgcgacagagatcccaacagcctacttatatcatgtgccgtttcatatcggggggcctggtggtataggaattgtcactatgctaatttgaatggcttgtacggaagcactgttgaccatcagggcgtgtcttggtatcactggaagggattcgagttctccgtgccctttactgagatgaagctgcggccacgaaattttaggtctccagccggaggcggatag

SEQ ID NO: 208323 - DNA, 12669 bp, Artificial Sequence
  Description of Artificial Sequence: Synthetic coding sequence
atgatgcccgcccagtacgccctgaccagcagcctggtgctgctggtgttgctgtccacagctcgggccggccccttctcctccaggtccaacgtgactctcccagcccctaggccgcccccgcaacccggtgggcacacagtcggggcaggcgtaggttctccatcgtcgcagctgtacgaacacaccgtggagggcggcgagaagcaggtggtgttcacccaccgcattaaccttcccccctctacaggatgtgggtgtcctcctggcaccgaacccccggtgcttgcctctgaagtacaagcacttagggtgcgactcgagattctggaagagctggtaaagggactcaaggaacagtgcaccggcggctgctgtccagcctcggctcaggcaggaacaggccagactgacgtcagaacactgtgctctcttcacggcgtgttcgacttatcgcgttgtacctgctcttgcgagccagggtggggcgggccaacatgttctgatcccaccgacgctgagatcccacctagttccccaccttctgcatctggctcgtgccccgacgactgcaacgaccagggccgatgcgttaggggaagatgtgtgtgttttcctggctatacaggtcccagctgcgggtggccctcgtgccctggcgactgccaaggccgcggtcgttgtgttcagggcgtgtgcgtttgcagagccgggttttccggacccgactgttcccagcgatcttgtccacgggggtgttctcagagagggaggtgtgagggggggcgctgcgtgtgcgacccgggatacaccggagatgactgtggcatgcgttcttgccctaggggttgctcacagcgcggaaggtgcgagaacggtcgctgcgtgtgcaaccccggttacaccggagaggactgcggagtccggtcttgcccgcgcggttgctctcagcgagggaggtgcaaggatggtcgatgtgtttgcgacccaggatataccggggaggactgcgggactcggtcttgtccctgggactgcggggagggcggccgctgtgtcgacggcaggtgtgtgtgttggcctggatatacaggggaggattgtagtactagaacctgtccacgggactgtagggggagaggccggtgtgaagacggcgaatgtatctgcgatacaggctactcaggcgacgattgtggtgttcgctcttgccccggcgattgcaaccaacgggggcgatgtgaagatggacgttgcgtatgctggcccgggtacaccgggactgattgtgggtctcgggcctgtccgagggactgtagaggccgaggccgttgcgagaacggcgtttgcgtgtgtaatgccggttactcgggggaggattgcggcgttagaagctgcccgggggactgtaggggacgggggagatgtgagtccggtcggtgtatgtgttggcctggctataccggtcgagattgtggcaccagggcgtgtcccggagattgccgtgggcgcggacgatgcgtagacggacggtgtgtgtgcaatcctggatttactggtgaagactgtgggtcgagaagatgccccggcgactgcagaggccacggcctgtgcgaggacggtgtttgcgtctgtgatgccggttattcgggcgaagattgctcaacaagaagttgcccaggtgggtgcaggggtcgcgggcaatgtctggatggccggtgcgtgtgcgaagacggctacagtggagaagactgcggagtgcggcagtgccctaacgactgcagccaacacggcgtgtgtcaagacggcgtatgcatatgctgggagggctacgtgtccgaagactgtagcatcaggacttgtccgagtaactgtcacggtaggggcaggtgtgaggagggacgctgcttatgtgaccccggctatactggacccacttgcgcaaccagaatgtgccccgccgactgtaggggcaggggccgctgcgtgcaaggagtgtgcctgtgccacgtgggatacggcggcgaagactgcggacaagaggaaccaccggcgtccgcatgccccggcggctgcggcccccgcgagctctgcagggctggccagtgcgtctgcgttgaaggttttaggggacctgattgcgcaattcagacctgccctggggactgccgcgggagaggcgagtgccatgatggaagttgcgtttgtaaagacggctatgccggagaggattgcggtgaggaagtgccaaccatagaagggatgagaatgcacctcctggaagaaactactgtccgaaccgaatggacccctgcgcctggacctgtagatgcatacgagatccagtttatccccaccacggaaggcgcctccccaccgtttactgctcgcgttccctcctcagctagcgcctacgatcaacgtgggctagcgcccggacaggagtatcaggttacagtacgggcactccgtggcacctcttggggtttgccagcaagtaaaacaataacaacaatgattgatggaccacaggacctcagggtcgttgcagtgacacctaccacgcttgagctgggctggctgagacctcaggcagaagtggataggttcgtggtgtcatatgtctcagcaggcaatcagcgtgtccgactggaagttccacccgaggcagatggcactttattaaccgatttgatgcccggtgtagagtatgtggtgaccgtgactgccgaaagaggccgggcggtctcctatccagccagtgtgagagcaaacaccgggagttcacccctggggctactggggacaacagacgagcccccaccgtctggcccttcaaccacccagggcgcgcaggctcctctgcttcaacagcggccacaagagctgggagagttacgggtcctgggtagggacgagaccggccgcctgcgagtggtttggacagctcagcccgacactttcgcatactttcaattaaggatgcgtgtccccgaagggcccggtgcccacgaagaggtgctccccggggacgtaagacaggccctggttccaccacctccgcctggcaccccttatgaactgtcactccacggcgttccacccggcgggaagccgtctgatcctattatttaccaggggattatggataaggatgaggaaaaaccaggcaaatcgtcaggcccaccccggttaggggaattgacagtgactgaccgtaccagtgacagcctccttctgcgctggactgttcccgaaggagagtttgacagctttgtcatacagtataaagacagggacgggcagccacaagtcgtacccgtcgagggtccacagaggtcagcagttattacgtctctcgaccctggaagaaaatataagtttgtcctatacggcttcgtggggaagaagcgccatggccctcttgtggcagaggccaaaattctgcctcagtcagacccgtctcccggtacacccccccgtctcggtaacctatgggtcaccgatccaacccctgatagcctccacctctcctggaccgttccagagggccaatttgacacatttatggttcagtacagggaccgcgatggtagaccacaggtggtcccagttgagggtcccgagagatcctttgttgtttctagtctagatcctgaccacaaatacaggtttactctctttggaatcgccaataaaaagcgctacggtcccctgaccgccgacggcactactgctcccgagcgaaaagaggagccaccaaggcccgagtttctggagcagcccttactgggcgaactgacagtcacaggtgtgactcctgattctctgaggctgtcctggacagtcgctcagggccctttcgattcttttatggttcagtataaagatgctcaaggccagcctcaggccgtccctgtagccggtgacgaaaacgaggttaccgtgccgggactggatccggatcgcaaatacaagatgaacctctatggcctgcggggcagacagcgggtagggccagaaagtgtggttgctaaaactgcccctcaggaagacgtcgacgaaacccccagccctacagagctcggaaccgaggctcccgagtccccagaggaaccactgctgggagaactgacagtgactgggtcttccccagacagcctttccctcttttggactgtgcctcagggctccttcgacagctttacggtgcaatataaggacagagacggtcggcccagagccgtgcgcgtcgggggaaaggagtctgaggtgaccgtaggggggctcgaacccgggcataaatataaaatgcatctgtacggactgcacgaggggcagagggtcgggccagtgtctgctgtcggagtcaccgccccacagcaggaggaaacacccccggcaaccgagagcccccttgaacctcggctcggagaactgacggttacagacgtgactcctaattctgtgggacttagctggaccgtgcccgaaggccaatttgactccttcattgtacagtacaaggacaaagacggccagccacaggtggtcccggttgccgctgaccaaagagaggtgacagtatataacctcgaacctgaaagaaagtataaaatgaatatgtacggactccatgacggccagaggatgggaccccttagtgttgtgattgtcacggcaccccttccacctgcccccgctactgaagctagtaagccgccattagaaccaagacttggggaactgacagtgacagacatcactcccgatagtgtggggttgagttggaccgtgcctgagggcgaatttgactcttttgttgtccagtataaggatcgcgatgggcaaccccaagtggtgccggtagccgcggatcaaagagaggtgaccatccccgatcttgagccgtcgcgaaagtacaaattcctgctgtttggaatacaagatggcaaacggcgctctcccgtgtcagtggaggcgaagaccgtggcaagaggggatgcctctcccggtgcaccaccccgtctaggggagttgtgggtcaccgatccaaccccggacagtctccgcttatcttggactgtcccagaaggacagttcgattcgtttgtggtgcagtttaaagataaagacggtccccaggtcgtcccggtcgaagggcacgagcgctccgtcacggtgacgccactggacgcgggacggaagtacagatttcttctgtacggattgctgggcaagaagcggcatggccccttaaccgctgacggaaccaccgaggcccggagcgcaatggatgacaccggtacgaagaggcctcctaagcctaggctcggcgaagagcttcaggtgaccaccgtgacacaaaatagcgtcggcctaagctggacagtccctgagggccagttcgatagcttcgtggtgcagtacaaggaccgggacggccagccgcaggttgtcccggtggagggtagcctgcgcgaggtgtccgtccccggactggaccctgctcatcgttataaactgcttttgtatggcctgcaccatgggaagagagtgggaccaatatcagccgtggcgatcacggccggccgggaagaaacagaaaccgaaaccactgcacccaccccaccagccccggagcctcatctgggggagttgactgtggaagaggcaacttcccacaccctgcatttgtcctggatggtgaccgagggagaattcgactctttcgagatccagtatacagaccgagatgggcaactgcagatggtgcgcatcgggggcgatcgcaatgatattaccttgtctggcttggaatctgaccacaggtatctggtcacactgtatggatttagtgatggtaagcatgtgggccccgtccatgtggaagcactcacggtgccagaagaagaaaagccttcagagcccccaacagcaaccccagagccgcccatcaaaccgcgcctcggggagctcactgtgacagatgcaactccagacagcctctctctgagttggacagtccccgaaggccaattcgatcattttctggtgcaatatcgcaacggtgacgggcagcctaaggccgtccgggttcccggccatgaggagggagttaccatatcaggcctagagcccgaccataagtataaaatgaatctctatggcttccatggtggacagagaatggggcctgtctccgttgtaggggtgacagcggctgaggaagaaactccctctccaactgagcccagtatggaggccccggagcctgccgaggagccactgttgggagagttgacagtcaccggatcatctcctgactccctctccctctcttggaccgtgcctcagggcaggttcgacagtttcacggtgcagtataaggaccgagacggccgacctcaggtagtaagggtggggggagaggagtccgaagtcactgtaggtggattagagccaggccgcaagtataaaatgcatttgtacggtctccacgaggggcgcagagttgggccagttagtgcagtcggtgtgactgcccctgaagaggagtccccggacgcacccttggcaaagctgcgactgggacagatgacagttagagatataacatctgactccttgtcactgtcctggaccgtgcccgaaggccagttcgaccactttctggttcaatttaaaaacggggacggacagcctaaggcagtcagggtgcctggccatgaagacggcgtaaccatatcagggctggagccagaccataaatataagatgaatttgtacggctttcacggcgggcagcgggttggccccgtgagcgctgttggtttaaccgccccaggcaaggacgaagaaatggctccagcctccactgagccacctacccccgagccgccaatcaaaccaaggctggaggagctgacagttacagacgctacacctgattccttaagcctgagctggacggtgccagagggccagttcgatcattttctggttcagtacaaaaacggtgacggccagccaaaggcaacgagagtaccggggcacgaggatagagtaaccatttctggtttggaaccagacaacaaatataagatgaacctttacggcttccacggcggacagagagtgggccctgtcagtgctattggcgtgactgcagcagaagaagagaccccaagtccgacggagccttccatggaggcccctgagcccccagaggagcccctcttgggagagttgaccgtgactggttcaagccctgactcactgagcctctcatggaccgtaccacagggaagattcgattccttcaccgttcagtacaaagaccgcgatggacgcccccaggtcgtacgggtgggaggcgaggagtcggaggtcaccgtcggggggttggagccggggcgaaagtacaagatgcatctctacggcctgcacgagggtagaagggtcgggcccgtgagcactgtaggggtcactgctcctcaggaagacgtggacgagacacccagtcctacagagcctggtactgaggccccagaacccccagaggaaccccttctgggggaactcaccgtcacaggctcaagccccgatagtctgtcccttagttggactgttccccaggggagattcgacagctttacggtgcagtacaaagatcgggacggccggcctcaagccgtcagagtcggagggcaagagtcaaaagtcaccgtgcgcggtctggagccgggaagaaagtacaaaatgcacctgtatgggctgcatgagggtcgcaggcttgggccagtgtcagccgtgggcgtaaccgaggacgaagctgaaacgacacaagcagtgcctactatgacaccagaaccccccatcaaacctagactgggggagttaaccatgactgatgccaccccagactctctgtcgctgtcctggacagtgcccgaaggacaattcgaccacttcctggtccagtatagaaatggagatggacagcccaaggcggtgcgcgtgcccgggcacgaggatggggtcacaatttcgggactagaacctgaccacaagtataaaatgaatctgtacgggtttcatggtggccagcgggtcggtcccatttctgtgatcggggtaactgctgcagaagaagagacgccatcaccaaccgagctgagcacagaggcgcctgagcccccagaggagcctttactcggggaactgactgtgactggctcttcacctgactctctgtccctcagctggaccatccctcaaggccatttcgattcttttaccgtgcaatataaggaccgggatggacgaccacaggttatgcgggtgagaggtgaggaatccgaagtaacagttggggggctagagccagggagaaagtataaaatgcatttatacggcttgcatgaaggtcgaagagtgggacccgtcagtacggtgggggtgactgttccaactactaccccagagccacctaataaacccaggctgggggagttaactgtaaccgacgcaacacctgatagtttgtccttgtcctggatggtcccagaagggcagtttgaccactttctggtgcagtaccgaaatggagacgggcaacccaaggtagtgagggtgcccggccacgaagacggagttaccattagtggcctcgaacctgatcataagtataagatgaatctctatggcttccatgggggtcagcgagtagggcccatttcagtgatcggagtcacggcagccgaggaggagacccccgctccgaccgagcccagcaccgaggctccagagcccccagaagagccactactcggtgagctaaccgtgaccggcagctctcctgattcactgtcgctgagttggacgattccccaggggagattcgactcatttacggtccagtataaagacagggacgggaggccccaggttgtgagagtgcgtggggaagaatccgaggttactgtaggcggcctcgagcctggatgcaagtacaagatgcacctgtacggacttcacgaaggtcagagggtgggacctgtgtctgctgtcggcgtgactgtgcccacaatgaccccagaaccaccaattaagccgcgtttgggcgaattgaccgtgaccgacgccacaccggacagtctgtcactgtcatggatggtgcctgagggccagttcgatcacttcctggttcagtataggaacggcgatggccagcccaaggccgtacgtgtccccggacatgaagacggtgtgaccatttcaggtcttgaacctgaccacaagtacaaaatgaatctgtatggtttccacggtggtcagcgcgtgggtccagtcagtgcaatcggagttaccgaggaagagacccccagcccaacggaaccttctaccgaagctcccgaggcccccgaagagccgctgctgggagaactgaccgtcaccgggagctcccccgacagtctgtccttgtcttggactgtacctcagggtcgattcgattcctttaccgtgcaatacaaagacagggacggacagccacaggtcgtcagggtgaggggggaagagagtgaagtgaccgtcggcgggctggaacccggaaggaagtacaagatgcatctctatggactgcatgaaggacagagggtgggcccagtttcgactgtcggcatcactgcccctttgccaaccccactgccagtggagccgcggttgggtgagctggctgttgctgccgtcacatctgacagcgttggactatcttggacagtggcccagggtcccttcgattcatttcttgtgcagtacagggacgcccaaggacagcctcaagcggtgcctgtgagtggggatttaagggccgtggctgtctctggactcgacccggctagaaagtacaagtttctgcttttcggcctgcagaatggcaaaaggcatggtcctgtacccgtggaggccaggaccgctcccgataccaaacccagcccccggctcggtgagctgacagtgacggacgccacccctgacagcgtgggcttatcctggactgtccctgaaggggagttcgactctttcgttgtacagtataaggataaagacggtcgcttgcaagttgtgccagtggccgccaaccaacgcgaggtgactgtccaggggctggagcctagtcggaagtaccgcttccttctgtatggactgagcggacgaaaacggctcggccccatttctgcagactccaccacggcacccctcgagaaggaactccccccccatctgggggaactcaccgtcgctgaggagacttctagcagtctgcggctgagctggactgtagctcaaggccctttcgattcattcgtggtccaatatagggacactgatggtcagccacgggctgtcccagtggccgctgatcagagaactgtaaccgtggaggacctggagcctggaaagaagtacaaattcctcctgtatgggctccttgggggcaaacgattagggcctgtgtctgctctcggaatgacagcccctgaagaagatacacccgccccagagctcgcgcccgaggcccccgagccacctgaggaaccacggctaggggtgttaaccgtgaccgacacaacccctgactcaatgcggctgagctggagtgtagcgcagggcccctttgactcgtttgtggttcagtatgaagataccaatggtcagccacaggcattactggtcgacggagatcagtctaaaatattgatctccggcctagagcctagcaccccctaccggtttctgctgtacggtctgcacgaaggaaaacgcttgggaccccttagtgcggagggtactactggactggctccggcagggcaaaccagtgaagagagcagacccagactgtctcaactctcagtgactgatgtgaccactagtagcctgagattgaactgggaggcaccgcctggcgctttcgactctttcctgcttcggttcggcgttccttcgccttccacactggagccccacccgaggcctcttctgcagcgggagcttatggtgccagggactaggcactctgccgttctgcgcgatctccggagtggaacattgtacagcctcactctctatggcttgcggggacctcataaagcagactcaatacagggcactgcaagaacgctttcaccagtgctggagtctccaagagacctgcagttcagtgagatcagggaaacgtccgccaaggtaaattggatgccgcccccaagtcgggctgatagttttaaagtctcttaccagctggcagacggcggagagcctcagagtgtgcaggtcgatggccaagcgagaactcagaagcttcaggggttgattcccggtgctcgatacgaagtgactgtggtgagtgttagaggattcgaggagtctgagcctctcacagggttccttaccacagtgccagatggacccacgcagctgcgggcactcaatctgactgagggcttcgccgtgttacattggaaacctcctcagaacccagtcgatacctacgacatccaggtgaccgctcccggcgctccacccctgcaggctgagacgcccgggtctgcagtggactaccccttgcacgatcttgtactgcacacaaattacaccgccacggtgagagggttgagaggcccaaacttaacaagccctgcctcaatcacgtttactacgggtctggaagcaccccgggatcttgaagccaaagaagtgaccccacgcacagcacttttgacgtggaccgagccccctgtgcggccagcaggctacctgctaagtttccatactcccggggggcaaacacaggagatcttgctgcccggcggaatcacatcccaccagctgttggggttgtttccatcgacaagctataacgctcgactccaggcaatgtggggacaaagtctgttacctccagtctccaccagctttactacagggggtctccggatccctttcccccgggactgtggtgaggagatgcagaacggcgctggcgctagccgcacctccaccatcttcctcaacggaaatcgagaacggccattaattgtgttttgtgacatggaaactgatggagggggttggttggtgttccagcgccgaatggatggccagacggatttttggagagactgggaagattacgcccacggcttcggtaacatcagcggcgaattttggctggggaacgaggccctccatagtctgacacaagccggggactactccatgcgcgtcgaccttagggctggcgacgaggcagttttcgcccagtacgacagttttcatgttgattcagctgccgagtattaccggttgcacctggaaggctatcatgggactgccggtgatagtatgtcctatcattcgggctcagtgttctctgctagggaccgtgaccctaattcgctgctgattagctgcgccgtgtcttaccgtggggcctggtggtatcggaattgtcattatgccaacttgaacggcctctatggatctaccgtcgatcaccagggcgtgtcatggtaccattggaagggattcgagttttctgtaccttttacagaaatgaagctgcggccaaggaattttcggtccccagctggtggcggatag

SEQ ID NO: 208324 - DNA, 27 bp, Artificial Sequence
  Description of Artificial Sequence: Synthetic coding sequence
atgatgcccgcccagtacgccctgtag

SEQ ID NO: 208325 - DNA, 1905 bp, Artificial Sequence
  Description of Artificial Sequence: Synthetic coding sequence
tgaagcagccccctgggcctgctgggcaccaccgacgagcccccccctagtggcccctccacaacacagggggcccaggcccctcttttgcagcagaggcctcaagagctcggcgaactgagagttcttggaagggatgagaccggcaggttgcgcgttgtttggacagcccagcccgatacgttcgcctattttcaactaagaatgagggtgcctgaaggcccaggagcccatgaagaagtcctccctggggacgttcgccaggcccttgttccacccccgccccctgggaccccttacgagttaagcctgcatggtgtcccgccaggagggaagccctcagaccctataatttaccaaggcatcatggacaaagatgaagaaaaacctggtaagagctcggggcctccacggctgggggagctgacagtcacagatcggactagtgattccctcctcctgagatggactgtgccagagggcgagttcgactcctttgtgattcagtacaaagatagagacggtcagccacaggtagtaccagtcgagggtccccaacgatcagccgtaataactagcctcgacccagggagaaagtacaagtttgtactttatggattcgttggtaagaaacgccatgggcctctggttgcggaagctaaaattctcccccagagtgacccctccccaggaacaccacctcggctcgggaacctgtgggtgacagatcccaccccagattccctccatctcagttggacagtccctgaaggccagtttgacaccttcatggtccaatatcgggaccgggatggaagacctcaggtagtgccagtcgagggccccgagcgttcattcgtggtcagcagcctggatcccgaccacaaataccgctttacactatttggtatcgctaacaaaaagcggtatgggccactgaccgcggacggaacgaccgctcccgagcgcaaagaggaaccaccccgccccgaatttttggagcaacctctgcttggtgaactgaccgtgaccggcgtgaccccagactcattgcgccttagctggactgtagcccagggcccattcgactccttcatggtgcagtacaaggatgcacaaggacagccacaggctgtccccgtagctggtgatgaaaacgaggtgacagtgccgggcttggatcctgacaggaaatacaaaatgaatctgtacgggcttcgggggcggcagcgagtaggccctgagtctgtggtagccaagactgcaccgcaagaggacgttgatgagacaccctctcctacggagctgggaacggaagcaccggaatcacctgaggaaccgctcctgggggagcttacagtgaccggatcttcccctgattccctaagcctgttttggacagtgccccagggcagcttcgacagcttcactgtgcagtataaggacagggatgggcgcccccgtgctgtgcgagtcggcggcaaagagtcagaagtgaccgtagggggattggaaccaggccacaagtataaaatgcacctctatgggctgcacgagggccagcgcgtgggccccgttagtgccgtgggtgtaacggccccacagcaggaggagacaccacctgcaactgagtctccactggagcctcgacttggggagctgaccgtcaccgatgtgactcctaactccgtggggctttcctggaccgttcccgagggccaatttgattcttttattgtgcagtacaaagataaagatggacaaccacaggtcgtgcctgtagccgcagatcaacgagaagtgaccgtgtataaccttgagccagagcgcaagtacaagatgaacatgtacggcttgcacgatgggcagaggatgggcccactgtcggtcgtgatcgtcacttag

SEQ ID NO: 208326 - DNA, 27 bp, Artificial Sequence
  Description of Artificial Sequence: Synthetic coding sequence
atgatgcccgcccagtacgccctgtag

SEQ ID NO: 208327 - DNA, 12669 bp, Artificial Sequence
  Description of Artificial Sequence: Synthetic coding sequence
atgatgcccgcccagtacgccctgaccagcagcctggtgctgctggtactgctatccacggcacgtgctggcccgttcagttcgcgttcaaacgttacactccctgccccacggcctccacctcagcccggtggccatacggttggagcaggtgtaggctcaccatcaagccagctctacgagcatacagttgaagggggagagaagcaagttgtgtttacccaccgaatcaacctgccgccaagcaccggctgcggctgtcctcccggcactgagcctcccgttctggcaagcgaggtccaggccctgagagtgcgccttgaaattctggaggaactggttaaagggctaaaggagcagtgtactggtgggtgttgtccagcctccgctcaagctgggaccggccaaaccgatgtaaggacattatgctctctgcacggggtgtttgacctatcacgttgtacttgcagctgtgaacccggctggggcggaccaacatgcagcgatccaaccgatgctgaaatcccccccagctccccgccgtcagcctccgggtcatgtcctgatgactgcaatgatcaagggcgctgcgtcagaggtcgatgtgtttgctttccgggttatacgggcccctcttgcggatggccgagctgccccggggactgtcagggtagggggcgttgcgtgcagggcgtctgcgtgtgccgtgctggcttcagcggacctgattgctcgcagcgctcttgccctcgggggtgctcccagagaggccggtgcgaaggtgggcggtgcgtatgtgaccctggctatacgggtgacgattgcggaatgcggagttgtccccggggctgttcccagcggggtagatgtgagaatgggcgctgtgtctgtaatccaggctacacgggagaggactgcggcgttaggtcatgcccccgggggtgttcgcagcgagggcggtgtaaagatggacggtgcgtgtgtgacccggggtatactggcgaagactgtggaacccggagttgcccctgggactgtggcgagggagggcggtgcgtggacggccgatgcgtctgctggccgggatacactggagaagactgctcgacgagaacttgcccccgggattgcagaggaagggggagatgcgaagatggcgaatgtatttgtgacacaggttattcaggagacgattgtggcgtccgcagttgtcctggggattgtaaccagcggggcagatgcgaggacggcaggtgcgtgtgctggcccggctatacaggcacagattgcggcagtcgagcttgtccccgcgactgcagaggtcgcggaagatgtgagaacggcgtgtgtgtgtgtaacgccggctacagcggcgaggactgcggggttcgcagttgtcccggtgactgccgcggtaggggaagatgtgagagtggcagatgtatgtgctggcccggttacacaggaagggattgcggtaccagagcttgcccaggcgattgccgcggccgaggtagatgtgtggatggccgctgcgtgtgtaacccaggcttcaccggtgaggattgcgggtcacggaggtgcccaggggactgtaggggacatggactgtgcgaggatggggtgtgtgtatgcgatgcgggatactcaggggaggattgttcaaccagatcgtgtcccggtggatgccgcgggcggggtcagtgtctcgacgggaggtgtgtgtgcgaagacgggtactctggcgaggactgtggggttcgccagtgtcctaatgattgctcccagcatggagtctgtcaagacggtgtgtgcatctgctgggagggatacgtgagcgaagattgcagtattaggacctgcccatccaactgccatggccgcggaagatgcgaagaggggaggtgtctttgcgatcctgggtacactggcccaacctgcgctacccggatgtgcccagcagattgtagaggccgcggtaggtgcgtccagggggtctgcctgtgtcatgtgggttacggtggggaggactgtggtcaagaggaaccacctgctagcgcgtgtcccgggggttgtggtccaagagagctgtgcagggctggccagtgcgtttgcgtcgagggctttaggggtcccgattgcgcaatccagacctgtcccggtgactgtagaggccgaggagaatgccacgacggatcgtgtgtttgtaaagatggatatgccggcgaagattgcggtgaggaggtcccaaccattgagggcatgcggatgcacctacttgaggagaccacggtcagaaccgaatggactcccgcgccaggcccagtggacgcgtatgagattcaattcatacctaccactgaaggggcttcccctccgttcaccgccagggtcccctcgagcgctagcgcttatgaccagagagggcttgcccccggtcaagagtatcaggttacagttagggcacttagaggcacgagttggggcctgcctgcatcaaaaacgattacaacaatgattgatggcccccaggatctcagggtggtagcagttactcctacaaccctggaactgggatggctccgtccccaggcagaagtggacaggtttgttgtgtcctacgtaagtgccgggaaccaacgagtgcgtttagaagtcccacctgaggctgatggcactttgctcaccgacctcatgcccggcgttgagtacgtggtgaccgttacagctgaaaggggacgggcagttagctacccagcctctgtccgcgccaatactgggagttccccactcggactgctggggacaacggatgagccccccccgtcaggcccttcaaccacgcagggggcccaggcgccacttctgcagcaacgaccccaggagttgggtgaactgcgagtgctcggccgagatgagaccggacgccttcgcgttgtctggacagcccagcccgacaccttcgcctatttccagctacgcatgcgagtgcccgaagggcccggagcgcatgaagaggtgctacccggagatgtgagacaggctctggtccctcccccaccacccggtactccatacgagttatccttgcacggagttccacctggaggcaaacctagcgatccaatcatttaccaggggatcatggacaaagatgaggagaaacccggaaagagtagtggaccccccagactgggcgaactcactgtcaccgaccggacttcagattccctgctgctacgctggaccgtgccggaaggagaattcgacagttttgtgattcaatataaagacagagacggacaacctcaagtggtgcccgtcgagggaccacagcggtcagccgttattacttctctggacccagggcgtaagtataagtttgtgctttacggattcgtgggcaaaaagaggcatggacctcttgttgcggaagccaaaattctgcctcagagcgaccccagcccaggcactcccccgaggctgggaaatctatgggtgaccgacccaactcccgacagtctgcacctgtcatggacagtacccgaagggcaatttgacacgtttatggtccagtatcgggaccgcgatggccgcccccaagtggtgccggtcgagggccctgagaggtcattcgtcgtctcctcgctggatccagaccacaaatacaggttcacgttgtttggaatcgctaataagaaaaggtatggaccgcttaccgccgacgggaccacagcacctgagaggaaggaggaaccaccgcacccagagttcttggaacagcctctgctgggggaactgacagtgacaggcgtcacccccgattcattgagactgagctggaccgtggcccaaggaccatttgatagcttcatggttcagtacaaggacgcccaaggccaaccccaggccgtccccgtggcaggcgatgagaacgaagtgacggtccccggactcgaccccgacaggaagtacaaaatgaacttgtacgggctgcgcgggcgacagcgggtgggtccagagtccgttgtggccaagaccgcccctcaggaggacgtggatgaaacccctagtccaaccgagctcggcacagaagccccggagagcccagaagagcctctgttaggagagctcaccgtgaccggatctagccccgatagtctgtcactcttctggacagtgccccagggatcttttgatagcttcaccgttcagtacaaagaccgggacgggcggccgcgcgctgtgcgcgtgggcggaaaggagagtgaggtgactgtcgggggtttggaacccggtcacaaatataagatgcacttgtacgggctccacgagggtcagagagtagggccagtatcggctgtgggagttacagccccccagcaggaggaaactccccccgctactgagagccctttggagccaaggttaggggagcttacagtgactgacgtcacaccaaactctgtgggactgtcctggacagtcccggaggggcaatttgactcattcatcgtacagtacaaggataaagacgggcagccccaggtggtccctgtggctgccgatcaaagggaagtgactgtgtataatctggaacccgaaaggaaatacaaaatgaacatgtacgggctccacgatgggcagcggatgggtccactctctgtggtgatcgtcactgcacccttgcccccggccccagcaactgaagcatcaaagcctccactcgagccccggctcggagaactcactgtgaccgacatcacccccgacagcgtcggactgtcctggacagtcccggagggcgaattcgattcttttgtggtgcagtacaaggatagggatggccaaccccaggttgtcccagtagcggcagaccagcgcgaggtgacaatacccgacctggagcctagtcgtaagtacaagttcctgctctttggcattcaggatgggaagagacgatcccccgtcagcgttgaggccaagactgtcgcccggggagatgccagcccaggcgcccctccacggctcggcgagctgtgggtgactgatccaaccccggattcactcaggttatcctggacagtcccagagggacagtttgactccttcgtggtccaattcaaggataaggacggtccacaggttgttcctgtggaaggtcacgagagatctgtgacagtgactccactcgatgcgggaagaaaatatcgcttcctcctttacggactgctgggtaagaaacggcacgggcctctgacagctgatgggaccacagaggcacggtcagctatggatgatacaggtacaaagaggccgcctaagccccgactgggggaggagttacaggtaaccacagtcacacagaacagtgtcgggttatcttggaccgtgccagaaggccaattcgattctttcgtagttcagtacaaggacagggatggtcagccacaggtagtcccagtcgaaggcagccttagggaggtgtctgtacccggcctggaccctgctcatagatacaaactgctcctgtacggactccaccacgggaaacgtgtcggtccaatttcagctgtggccattactgcggggcgcgaggaaactgagactgaaacaaccgcgcccaccccgcccgcccccgagccccacctcggggagctgactgtggaagaggccacttcacacaccttgcacctctcttggatggttaccgagggcgaatttgactctttcgagatccagtatactgatagagatggccagctgcaaatggtgaggatcggcggcgacaggaatgacataacactctccggcctcgagagtgaccacaggtacttggttaccctttacggattctcggatgggaaacatgtgggacctgtccatgtcgaagctctcacggtccctgaggaggagaaacccagtgaaccccccactgccactcccgaacccccaattaaaccccgcctgggcgaattaaccgtgaccgatgccacgcccgattcactgtccctgagttggacagtgcccgaaggccaattcgatcattttctggtccagtatcggaatggagacggccagcccaaggcagtaagagtcccagggcacgaggaaggtgtaacaataagcggactggagccagatcataagtataagatgaatctctatggttttcacggagggcaaagaatgggtcccgtttctgttgtaggggtgacagcggctgaggaagagacgcctagtcccacggagccctctatggaagcaccagagcctgcagaagagcccctgctgggcgagctaacagtgacaggatcttctcctgattcgctatcactttcatggaccgttccacagggcaggtttgactcatttactgtgcagtataaggatcgagacggacggcctcaggtggtgcgggtggggggagaagagtctgaagtcactgtgggcggtctcgagcccggtagaaagtacaaaatgcatctatatggcctgcatgaaggccggcgcgtgggccctgtgtccgccgtgggtgttacggccccagaggaagaaagccctgatgcgcctcttgccaagctgcggctgggtcaaatgacagtccgagatatcacgtcagatagcttgtccctgtcatggactgtcccagaaggccagttcgaccatttccttgtccaattcaaaaacggcgacggccagccaaaggccgtaagagtgccaggacacgaggacggtgtgacaatttctggcctggaaccagatcacaaatataaaatgaacttgtatggttttcacggaggtcagagggtcgggcccgtcagtgcagtgggccttacagcccctggaaaggacgaagagatggcgcccgcatctaccgaacctccaactccagagccacctatcaaaccacgattggaagaacttacagtgaccgacgctacacctgattcactgagtctgtcttggacagttcctgaaggtcagtttgatcatttccttgtccagtacaagaacggcgacgggcagcccaaggccacaagggtacctggccacgaagacagagtgactatttctggattggaaccagataataaatacaaaatgaacctgtacggcttccatggcggccagcgggtcgggccggtaagtgctatcggagtcacagcggcagaagaggaaacacccagccctactgaaccttccatggaagcccctgaaccacccgaggagccgctgctgggtgaacttacggtgaccgggagcagcccagactcactttcactgtcttggacggtgcctcagggcagattcgacagttttacagtgcaatacaaggatcgtgatggaagaccgcaggtcgtgagggtcgggggcgaggagtccgaggtcacagtcggcggtctcgagccagggcggaaatacaagatgcatctgtacggtctacacgagggaagaagagtcggccccgtgagcaccgtgggggtgaccgcaccccaggaagacgtggacgagactccttcacctaccgaacctgggaccgaggcaccggaaccaccagaggaacctctattaggggagttaaccgttaccggctcctccccggactcgctgagcctttcatggacagttccccaggggagatttgactcttttactgtacagtacaaggaccgcgacgggaggcctcaagccgtgcgagtcggcggacaagaatctaaagtgaccgtgcgcgggctggagcccgggcgaaaatacaaaatgcacctgtacggcttgcacgagggtagaagattggggcctgttagcgctgtaggggtgaccgaagatgaagctgagaccacccaagctgtgcccaccatgactccggagccaccaatcaaacccagactgggtgaactgaccatgacagacgccacacctgattccctgtctctgagctggactgtccccgagggccagtttgaccattttcttgtgcagtacaggaatggcgatggccagccaaaggccgtgcgagtacccgggcacgaagatggtgtaaccatttccggcctggagccagaccataagtataagatgaatctctacggtttccacggtggccaaagagtgggcccgatctctgtgattggcgtgaccgcggcggaagaggaaaccccctctcctacagagctctctactgaagcgcctgaacctccagaggagccgctactcggtgaactgacagtgaccggaagcagtccagattcactgtccctgtcatggacaattccccagggccatttcgatagcttcacagtgcagtataaagatcgcgatgggaggccccaggtgatgagagtgagaggggaggagtcggaagtgacagttgggggcctggaaccaggccgcaagtacaagatgcatctgtacggactgcacgaggggagacgcgtgggccctgttagcaccgtcggagtgacagtgcccacaacgacacctgagccgcctaataagcctcggctgggggagctcactgttacagacgctacccctgactctctgtctctgtcttggatggtgccagagggccagttcgaccacttccttgtgcagtaccggaatggcgatggacaacccaaggtagtgcgcgtgcctggccacgaagacggcgtcacaatctctggtctggagcccgaccacaagtataagatgaacttatatggtttccacggcggtcagcgcgtcgggcccatcagcgtcataggcgtgacagcagcagaagaagagacccctgcacctacagagccgagcaccgaagctcccgagcctcccgaggagcctctgcttggcgaactcaccgttactggatcttcccccgactccctcagcctgagttggaccatcccgcagggtcggttcgattccttcaccgtgcagtataaggatcgagacggccgacctcaggtcgtacgtgtgcggggcgaagaatcggaggtgacggttggagggctggagcctgggtgcaaatataagatgcatctatatggcttgcatgaaggccagcgggtggggccggtcagtgccgtaggagttaccgtgcctaccatgaccccagagccccctatcaagccacggctcggcgagctgacagtaaccgacgccaccccagactcgctgagcctgagctggatggtgcctgaagggcagttcgatcactttctcgtgcagtatagaaacggcgacggccaaccaaaggccgtcagggtgccgggccacgaggatggggtcactatctccgggctggaaccagaccacaagtataagatgaacctttacggcttccatggtggtcaaagggtggggcccgtctccgctatcggcgtgacagaagaagagacccctagccccacagagcccagtaccgaggctcctgaggctcctgaggagccactgctcggggaactgactgtcacaggctcctctcctgattccctgtcacttagctggacgatcccccagggacgttttgacagcttcactgtccaatacaaggaccgagacgggcagcctcaggtcgtgagagtaaggggcgaggagtctgaagttactgtgggtgggctggagcccggacgcaagtacaagatgcatttgtacggcttgcacgagggccagcgggtcgggccggtttccacggtcggcattactgcgccactccccacgccactgcctgtggagccacggctaggagaactagcagtcgctgctgtgacttcagacagtgtaggtctctcctggaccgtggcgcagggcccctttgattcgttcctcgtacagtacagggatgctcaagggcaaccacaggccgtgccagtgagcggcgatcttcgcgcagtggctgtgtcaggcctcgatcccgctcgtaagtacaagttccttctctttggactgcagaatggaaagagacatggaccagtccccgtggaagcaaggacggctcctgatactaagcctagtccccggctgggcgagctgaccgttacagacgccacaccggattctgtgggcctatcttggactgtccccgagggcgaatttgactcatttgtcgttcaatacaaggataaagatgggagacttcaggtggtccctgtggcagccaatcagcgcgaagttacggtccagggcttggaaccaagtagaaagtatagattcttactctacggactgtccggcagaaaacggttgggaccaattagcgccgatagtacgaccgccccgctggagaaggagttaccaccacacctgggagaactcaccgtggcagaagagacttcttcatcccttcggctgtcttggaccgtggcccagggcccttttgacagctttgttgtacagtatagagacacggatgggcaacctcgagccgtacccgtggccgctgatcagaggaccgttactgtcgaggatctggagcccgggaagaaatacaaatttctgctatacggactgctcggaggcaagaggctgggacccgtgtccgccctagggatgacagcgcctgaagaggacacgcctgctcctgaattggcacccgaggccccagagccccccgaggagccacgtctcggggttctgaccgtgaccgatacaaccccagatagcatgagattgagctggagcgtcgcccagggtccttttgatagcttcgtcgtgcagtacgaggacaccaacggacagccacaggcacttctggtggatggtgatcagagcaagatcctgatctctggccttgagccctcaacaccttatcgcttcctgttgtacggacttcacgagggaaaaaggctggggcctctctcggcagagggcactacggggttggctccagctggtcagaccagcgaggagtctcggccacggctgtcccagttgtccgtgaccgacgtgacaacatcaagcttacgacttaattgggaggctcctcccggagcattcgacagctttctcttgcgtttcggggtgcccagcccctccaccctcgaaccccatccacgaccacttttgcaacgcgaacttatggtccccggaacccgccattcagcagtattgcgcgatttacggtcaggaaccctttattccctcaccctgtacggacttcgcggccctcataaggccgatagcatccagggaacagctcgaacactcagtcccgtgctggaatccccgcgcgatctgcaattcagcgagatacgtgagacatcagccaaggtgaattggatgcccccacctagtcgtgcagactcctttaaggtgtcataccagctggcagatggcggcgagccacagtccgtgcaggtagacgggcaggcccgaacccagaagctgcagggcctgatcccgggagctcggtacgaagtgactgtggtgtctgtgcgggggttcgaggaatctgagcctcttaccggctttctgacaactgtgcctgacggcccgacccagctgcgtgcactcaatctcaccgaggggttcgctgtcttgcactggaaaccaccccagaatcctgtggacacctatgatatccaggttacggctcctggcgctcctccactccaggcagagacacccggatcggctgtggattacccactacatgacctggtcctccatactaactatactgcaactgtgcggggtctacgtggacctaaccttacatccccagcttccatcaccttcaccacggggttggaggcaccacgtgacctcgaggcaaaagaagttacacccaggactgctcttctcacttggacagaacctcccgtacgccctgccgggtaccttctgtccttccacaccccaggcggtcagactcaggagattctcctgcctggtggcatcacatcccatcagttactcggcctgtttcccagcacaagctacaatgcaagacttcaggcaacttggggacagagcttgctaccaccagtgagcacctcgtttacgaccggcggcctacgcattcccttccccagagattgcggagaggagatgcaaaacggggcgggagcctctaggacatctactatcttcctgaacggcaaccgagagagacccctgaatgtcttttgtgacatggaaacggacggaggcggatggttggtatttcaaaggcgcatggatggacaaacagacttctggagggactgggaggattatgctcacggcttcggcaacatctctggagagttctggcttggcaacgaggcccttcattccctgacgcaggccggggattactccatgcgggtggacctcagagcaggggatgaagccgtcttcgcgcaatatgacagtttccatgttgactcagcagctgaatactacagactccacctggaaggttaccacgggacagcaggagatagtatgagttatcacagcggatcggtcttttctgccagggacagagacccgaattcgctcctgatctcctgtgccgtgtcctatcgaggtgcgtggtggtataggaactgccattatgcaaatcttaacggcctgtacggttcaactgtagatcatcagggtgtgagttggtaccattggaaaggatttgaattttctgtgcctttcacagagatgaaattaagaccaagaaattttcgttcccccgccggcggggggtag

SEQ ID NO: 208328 - DNA, 27 bp, Artificial Sequence
  Description of Artificial Sequence: Synthetic coding sequence
atgatgcccgcccagtacgccctgtag

SEQ ID NO: 208329 - DNA, 6843 bp, Artificial Sequence
  Description of Artificial Sequence: Synthetic coding sequence
atgatgcccgcccagtacgccctgaccagcagcctggtgctgctggtgctgttatccactgctcgcgcaggtccattttctagccgatctaacgtgaccttgcctgcccctcggccacctccacaaccagggggccacaccgtgggggctggggtgggcagcccgagtagccaactgtacgaacatacagtggagggaggagaaaagcaggtggtgtttactcatcggattaacttgccaccatcgacgggctgcggatgtccacctgggaccgagccacctgttctagctagcgaggtccaagccctccgcgttcgattggagatattagaggagctggtgaagggcctgaaagagcaatgcacaggtgggtgctgcccagcatcagcccaagccggcaccgggcagacggacgttcgcaccctgtgttccctccatggcgtcttcgatctgtctcggtgcacatgctcctgcgagcccgggtgggggggcccgacttgctcagatcctaccgacgccgagatacctccctctagtccaccctctgcatccggctcctgccccgatgattgcaatgaccaaggtcgttgtgtgaggggacgctgtgtatgcttccctggatacactggcccgtcctgcggttggccatcgtgtccaggcgattgccagggcagggggcgctgcgttcagggggtgtgtgtgtgtagagcaggttttagtggccccgactgttctcaacggagttgtcccagaggatgttctcagagggggcgctgcgagggaggcaggtgtgtatgtgaccccggctacactggggacgattgtggcatgaggtcttgtccccgagggtgctcacagaggggccggtgtgagaacggtaggtgcgtctgtaatcccgggtacacaggcgaggattgtggcgtccgctcctgtccccgcgggtgctcccaaagaggccgctgcaaggacgggcggtgcgtctgcgacccgggatatacaggagaggactgtggaacccgctcatgtccctgggattgcggcgagggcgggcgctgcgtggacggaaggtgtgtctgttggccagggtataccggggaagactgttcaacccgcacatgtccaagggactgtagagggcgcggcagatgcgaagatggcgagtgtatctgtgacaccggatacagcggggacgattgcggcgtgcgtagttgtcctggagattgcaaccagagaggacgctgtgaagacgggagatgtgtctgctggccaggatacactggcacagactgcggctcccgcgcatgccctcgcgactgtagagggcggggcaggtgtgagaacggagtctgcgtttgtaatgccgggtactcaggcgaggactgcggtgtacgctcctgtcctggagactgccggggcagaggaagatgtgagagcggcagatgtatgtgctggcccggctacactggacgagactgcggcactcgtgcctgccccggcgattgcaggggcagaggcaggtgcgttgatggacgatgtgtttgcaacccgggtttcactggggaggattgcgggagccgacggtgcccgggagactgccgcggacacggactctgcgaagatggggtgtgcgtgtgcgatgcggggtattccggcgaggactgctccacacgcagttgccctggtggatgtcgggggcgaggacagtgcctggatgggcgatgtgtatgtgaagatggctatagcggcgaggactgtggagtgaggcagtgcccgaacgactgctctcagcacggggtgtgccaagatggggtgtgtatctgttgggaagggtatgtgtctgaggattgttcaatccgcacttgcccatcaaattgccatggccgcggacgatgtgaagagggcaggtgcctgtgcgaccccgggtatactggccccacctgcgcgacacggatgtgtcccgccgattgtaggggaagagggcgctgtgtgcagggtgtctgtttgtgtcacgtggggtacggcggcgaggattgtggccaggaggagcctcccgcgtccgcgtgtccaggcggatgcggtcctagggagctttgccgagcagggcagtgtgtctgcgtggaaggcttcaggggtccggactgtgccattcagacttgtcctggagattgtaggggacgtggtgagtgtcacgacgggtcttgtgtttgtaaggatggttacgcaggtgaggattgtggtgaggaagtgcctacgattgagggaatgcgtatgcatctcctggaggagactacagtgcggaccgagtggacccccgcccctgggccagtggatgcttacgaaatccagtttattcccaccaccgagggagcatcccctccttttacggcgagagtgccttccagcgctagcgcctacgaccagcgagggctcgccccaggccaagaataccaggtgaccgtacgtgccctgcgaggaacttcatggggtttacctgcttcaaaaactataactacaatgatagacgggccccaggatcttcgcgtggtcgcggtgacacctactaccctcgagttgggctggttacgtccccaggccgaagtggatcgcttcgtggtttcttacgtatcggctggaaaccagcgggtgagactagaagtgccccccgaggcagacgggactctcctgaccgacctgatgccgggagttgagtacgttgttactgtgacggcagagcgcggcagggctgtctcttaccccgcctctgtacgtgccaatacagggtccagccctctaggcctgctgggcactacagacgagcccccaccctccggtccaagtaccacacagggtgctcaggcaccactgttgcagcaacgaccccaagagctgggagagcttagagtgcttggccgagatgagacagggcgcttgagggtcgtgtggaccgcacagcctgacaccttcgcctacttccagctcaggatgagggtgccagaagggccaggcgcccacgaggaggtgcttccaggcgacgtccgtcaggccttagtgccaccccccccaccaggaacaccttacgagttgtcattgcatggagtacctcccggggggaagccttccgatcccattatttatcagggcataatggataaggatgaagaaaaacccggcaaatcttccggacccccccgattaggtgagcttacagtcactgaccgcacgtctgattctctcctattgcgatggactgtgcccgagggggaattcgacagcttcgtgatccagtacaaggatagggacgggcagccccaggtagtccccgtggagggccctcagcgctccgctgtaatcacgagcttggaccccggccgaaaatacaaatttgtcttatatggcttcgtgggcaagaagcggcacgggccgctggtcgccgaggccaagatcctgccccagtcagacccttcacccggaacgcctccgcacctcggaaatctgtgggtcactgatcctactccagacagtctccatctctcttggactgtccctgaagggcagtttgatacttttatggtccagtatcgtgaccgcgacggccggccacaggtggtgccagtggaagggcccgaacgtagctttgtggtgtcctctctggaccccgatcacaagtatcgttttacgctctttggcattgccaataagaagcgatatggccctctcaccgctgatggcactaccgcaccagagcgaaaagaagaaccacctcgcccagaattcttagaacaacctctgctcggcgaattgaccgttacgggtgtcacacccgatagcttgcggctcagctggaccgtagcccagggtccattcgactctttcatggtccagtacaaagacgcacaaggccaaccccaggctgtccccgtcgctggtgacgagaatgaggtgaccgtcccaggcctggaccctgatcgcaaatacaagatgaatctgtacggactgagaggtcgacaacgtgtggggcccgagagcgttgtagccaagaccgccccccaagaagacgtagatgaaaccccgtcccctactgagcttgggactgaagcccccgagagccccgaagaacccttactgggcgaattaaccgtgaccgggtctagccctgacagtttatcattgttctggactgtgccgcagggctcctttgattcatttaccgtccagtataaggaccgggacggccggcctagggctgtgcgggttgggggtaaggaatctgaggtcacggtgggggggctcgaacctggacacaaatacaagatgcacctgtacggcttacatgaagggcagcgggttggccctgtgagcgctgtgggagtgaccgcaccacagcaggaggagacacctcctgcgacggagtctccactcgagccccgtttgggtgaacttaccgtaacagacgtgacgccgaacagtgtcggcttgtcatggactgtgcccgaaggacagtttgactcttttatcgttcagtataaggacaaggacggacaacctcaagtggtgccagtggcagccgaccagcgtgaagtgactgtgtacaatctcgagccagagcgaaagtacaaaatgaatatgtatgggctgcatgacggccagcggatgggccccctgtcggtggtgattgtgactgcgcccctgcctccagcccctgccaccgaggcttccaaacctccactagaaccacgcctcggtgaattgactgttactgacattaccccagattctgtcggtctctcatggactgttcccgaaggtgaattcgactctttcgtcgttcaatacaaggacagggatggccaaccccaagtggtccctgtggccgccgaccaacgggaggttacaataccagatcttgagccctcccgaaagtacaagtttctgctgttcggaattcaagatggcaagcggcgtagcccagtgtctgtggaggcaaaaacagtagcacggggcgacgcaagccctggcgctccaccacgcctcggcgaattgtgggttaccgatcccacaccggatagcctgcgcctgtcctggaccgtgcccgaagggcaatttgacagtttcgtggtccagttcaaggacaaggacggcccccaagtggtgcccgtggagggccacgagcggagtgttaccgtcaccccactagatgcaggacgaaagtatcggttccttctgtatggacttcttggaaagaagaggcatggacctttgaccgctgacggcactacagaagccagaagcgccatggacgataccgggacaaaaaggccgccgaagcccagactgggcgaggaactgcaggttacaactgtcacacaaaattctgtcggattgagttggaccgtgccagaggggcagttcgattctttcgtagtgcagtacaaagatagagacggtcagccccaggtggtgcccgtcgaggggagtctccgcgaggtctctgtacccggattggaccccgctcaccgttataagctgctgttatacgggttgcaccatgggaaaagggtaggcccaatcagtgcagtcgccatcaccgctggtcgggaagaaactgaaactgagacgacggcacccactccacccgctcctgaaccccatttgggcgaactgaccgttgaagaagccacctcacacaccttgcacttgtcgtggatggtgacagagggagagtttgatagctttgaaattcaatataccgatagagacggccagttgcagatggtgcggataggaggtgataggaatgacattaccctgtccggcctggaaagcgaccacaggtatctggtcaccttgtacgggttttctgacggaaagcatgtgggccctgtgcatgtagaggctttgaccgtgccagaggaggaaaaaccgtccgagcctcccaccgccacccccgagccacctattaaaccccgcctcggcgaattaacagtaacggatgccacaccagattccctctctctcagctggacggtccccgaggggcaatttgatcatttcttggtgcagtacagaaatggagacggacagccaaaggctgttcgcgtgccaggtcacgaagaaggtgtgaccataagcggcctcgaaccagatcataagtacaaaatgaatctctatggctttcacgggggccagaggatggggccagtgtcagtcgtgggcgtgaccgccgccgaggaggagactccttctccgacggaacccagcatggaggccccagaacccgcagaggaacccctacttggtgagctgactgtaacgggaagcagccctgacagtttatcccttagttggactgtgccgcagggcagattcgacagcttcacagtacagtacaaagatcgtgatgggaggccacaggttgtgcgcgtggggggcgaggagtcagaagtaaccgtaggtgggctggagccagggagaaagtacaagatgcacctgtatggcctgcacgaggggcgtcgggtgggcccagtctctgctgtgggagtgactgcacccgaagaggaatcccctgacgcccccctggccaagctgcgtttagggcagatgactgtgagggacattacttcagattccctctcgttgagctggaccgtgcctgagggacagttcgatcacttcctggtccagttcaagaacggcgacgggcagcccaaagctgttcgggttcccggacatgaagacggggttactatctcaggccttgagccagatcataagtataagatgaacttatatgggtttcacggaggtcagcgggtggggcctgtatcagctgtcggcctgacatag

SEQ ID NO: 208330 - DNA, 2022 bp, Artificial Sequence
  Description of Artificial Sequence: Synthetic coding sequence
atgcggctgagctggagcgtggcccagggccccttcgacagcttcgtggtgcagtatgaggataccaatgggcagcctcaggccctattggtagacggggatcaatcgaagattctcattagcggacttgagccgtccaccccctatagatttcttctgtacggactccacgaggggaagcgactgggccctctttccgctgagggcacaactggcctagcaccagccggccaaacatccgaggagtcaagaccaagattgtctcagctttccgtgacggatgtgaccacttcctcactaaggcttaactgggaggccccacccggcgcctttgatagcttcttattgcggtttggagtccccagcccatccacgctcgaaccccacccacggccgctgcttcagagggagcttatggtccctggcacacggcatagcgctgtgctaagggaccttcgctctggaacgctgtacagcctgactctctatgggctacgtggacctcataaggccgacagtattcagggcaccgccagaaccttgtcccctgtattagagtctccacgcgacctgcagtttagcgaaatcagagagacaagcgccaaggtcaattggatgcctccaccttccagagctgatagctttaaggtatcataccagcttgccgatggcggcgagcctcagtccgttcaggtggatgggcaggccagaacccaaaagctgcagggcctgatcccaggagctcgttacgaagtcactgtggttagcgtccgcggctttgaagaatccgaaccactaaccggcttcttaactacagtgcctgatggtccaacccagcttcgggctcttaatctgacggagggctttgccgtattacactggaaacccccccagaaccccgtggatacttacgacatccaagttaccgcccctggtgcacctcccctccaagctgagactcctggcagtgctgtggactatcctcttcacgatctagtcttacacacaaattacaccgcaactgtgagaggactcaggggacccaatctgacttcccccgcaagcattacctttacaaccgggttggaagcacctagggacctggaggcaaaggaagtcacacctcggaccgctcttctgacctggactgaaccccccgttcgaccagcgggatacctccttagcttccatacacctggcggtcagacgcaagagatactactgcctggtgggatcacttcacaccagctgctaggtctgtttccgagcactagttacaacgccagactgcaagccatgtggggacagtccctcctccctcctgtcagcacgagttttacgactgggggcctgcggataccattcccacgggattgcggcgaggagatgcagaatggcgctggcgctagccgcacgtccacaatttttctcaacgggaatagagaaagacccctgatcgtgttctgtgacatggagacagatggcggtgggtggctggtcttccagcggaggatggacggccagaccgatttctggcgagattgggaggactacgctcacggtttcggaaacatatctggtgagttctggttagggaatgaggccctgcacagcctgacacaagccggggactactcaatgcgggttgatttgagagctggggacgaggccgtatttgctcagtacgacagcttccacgtggacagcgccgcggaatactaccgcctccacctggagggctaccatgggaccgccggagactccatgagctatcacagcggctctgtttttagtgctcgagatagagatcctaattcacttttgataagctgtgcggtaagttatcgcggagcctggtggtacaggaattgccattacgctaatttgaatggattgtatggatccacagtggaccaccaaggtgtctcctggtaccactggaaggggttcgagttctctgtacctttcactgaaatgaagctacggccccgcaattttagaagccccgcaggaggcggctag

SEQ ID NO: 208331 - DNA, 654 bp, Artificial Sequence
  Description of Artificial Sequence: Synthetic coding sequence
gcccccggcaaggacgaggagatggcccccgccagcaccgagcccccaacacctgaacctccaatcaaaccaagactggaggaactcaccgtgaccgacgcaacacccgattctctctctctgagttggacagtcccggaaggccagttcgatcacttccttgtgcagtacaaaaacggggatggtcaacccaaagccacacgcgtgccaggtcacgaggatcgtgtcactatcagcgggttggagccagacaataagtacaaaatgaatttgtacggtttccatggaggccagcgggtcggacccgtctccgctatcggggttacagctgccgaagaggagacaccctccccaactgaaccctctatggaggcccctgagccacctgaggagcctctgttgggcgaacttactgtgaccggaagcagtccagactcccttagtctgagctggaccgtcccgcaggggcgttttgacagctttaccgttcaatacaaggatagggatggccgcccacaggttgtgagggtcggtggcgaagaatctgaagtaaccgttgggggattagagccgggaagaaagtacaagatgcacctttatggcctgcatgaagggcgccgcgtgggccctgtgtcaacagttggagtgacctag

SEQ ID NO: 208332 - DNA, 12729 bp, Artificial Sequence
  Description of Artificial Sequence: Synthetic coding sequence
atgatgcccgcccagtacgccctgaccagcagcctggtgctgctggtgctcctgtcaaccgctagggctggacccttttcttcaagaagtaatgttactctgcccgcgccccgcccaccacctcagcccggcgggcacaccgttggtgcaggcgtgggtagcccttccagccagctgtatgagcacacggtcgaggggggagaaaagcaggtcgtgttcacccatcgtatcaatctgcccccgtcgactggctgtgggtgtccccctggaacagaacctccagttctcgcctctgaggtgcaagctctacgggtaagactggaaatccttgaggaactggtaaaggggctcaaggagcagtgcaccggcggatgttgccctgcttcagctcaggctgggacaggccagacagacgtccgcacactttgcagcctgcatggcgtttttgacctgagcagatgtacttgttcgtgcgagcctggatgggggggcccgacctgtagtgaccccaccgatgccgaaattcccccttcttctcccccaagcgcctccggaagttgcccggatgattgtaatgaccaggggcgctgtgtgcgggggagatgtgtatgttttcctgggtatactggtccgtcctgcggatggccttcatgccccggagactgccagggaagaggacggtgtgtgcagggcgtttgcgtgtgtcgagccggcttctctggaccagattgttctcagagatcttgtcccagaggctgtagtcagagaggccgttgtgaaggaggccgttgtgtgtgcgatcccggttatactggtgacgactgtgggatgagatcatgtccacggggttgctcacagcgaggacgctgtgagaacgggaggtgtgtttgtaatcccgggtacacaggtgaagattgcggcgtcagatcttgcccgcggggctgcagccaacgaggtcgctgtaaggacggaaggtgcgtttgcgacccaggatacaccggcgaggattgcggcactcgctcctgcccgtgggactgtggagaaggcggccgctgcgtagatgggcgctgcgtctgttggcccggttacaccggagaggattgcagcacccggacgtgcccccgggattgtaggggacgagggaggtgcgaggatggggaatgcatttgcgacaccggctattctggtgacgactgtggcgtgcggtcttgtcccggggactgcaaccaacgcgggagatgcgaagacggccgctgcgtctgctggcctggctataccggaaccgattgtggctctcgcgcatgtcctcgggactgtagaggcagaggcaggtgtgaaaatggcgtctgcgtgtgtaatgccgggtactccggggaggactgtggcgtgaggtcgtgccccggcgattgccgcggtcgcggccgctgcgaatccggcaggtgcatgtgctggccaggttataccgggcgcgattgtggcacgcgtgcgtgtccaggcgattgccgtggaagagggcggtgtgtcgacggcagatgcgtctgtaacccgggatttaccggagaggactgcgggtcgaggagatgtcccggggattgccggggacatggtctgtgtgaggatggggtgtgtgtatgtgatgcaggctactccggcgaggattgcagcacaaggagctgcccagggggatgccgaggacgcggtcagtgtcttgatgggcgttgcgtgtgcgaagacgggtattcaggagaagattgtggtgtgcgtcagtgcccaaacgattgttctcagcatggcgtgtgccaagatggtgtttgtatttgctgggagggttacgtgagcgaggactgtagtatacgcacttgtccgtcaaattgtcacggccggggacggtgcgaggaagggaggtgcctttgcgaccctggatatactggacctacttgcgctactcggatgtgccccgcggattgccgcgggaggggacgttgtgtacagggcgtttgcctgtgccatgtgggctacggcggggaagactgtgggcaagaggaaccacctgcaagtgcgtgtcccggcggttgcggcccgagggaactttgtcgggcgggccagtgcgtctgtgtggagggcttccgaggtcctgactgtgctatccagacatgtcctggggactgcagggggaggggagaatgtcacgacgggagctgtgtgtgtaaggacgggtatgccggcgaagactgcggcgaggaagtacccaccattgagggtatgagaatgcacctcttggaagaaaccaccgtgaggaccgaatggacacccgcaccaggccccgtcgatgcatacgagattcagttcatcccaaccactgagggtgcttcccctcctttcactgctcgggtgcctagcagtgcctcagcttatgaccagaggggcctggcacccgggcaagagtaccaagtcaccgtccgtgccttacgagggaccagctggggattgcctgcctcaaagaccatcactaccatgatagatggcccgcaagacctccgagtagtagccgtgaccccaactactctcgagctgggctggctgaggccccaggctgaagtggatcggttcgtggtgagttacgtatccgccggaaaccaaagggtgagactggaagttcctccagaggcggatggtaccctcctgaccgatctcatgccaggcgttgaatacgtcgtaaccgttactgccgagcgaggtcgggcagtctcttaccccgcctctgtacgcgccaataccggttcatcaccgctgggactgcttggcacgactgacgagccccctccatctggaccgtccactacacagggggcacaggcacctcttctgcagcagcgaccccaggagctgggcgagctgagagtcctaggccgtgatgagaccggtcggctgcgagtcgtgtggaccgctcagcctgatacattcgcatactttcagctgaggatgcgggtcccagaggggcctggggcgcatgaggaagtattgcctggtgatgttagacaagcactcgtcccccccccccctccggggaccccatatgaattgagtttgcacggggtcccaccgggtggcaagccctccgatcccattatctatcaaggaattatggataaagacgaagaaaagcctggaaagagttccgggccccctagactgggcgagctgaccgtcaccgacagaacatccgactcactactgctccgttggaccgtcccagagggagagttcgactcttttgtcattcagtataaggaccgcgatggccaacctcaggtagttcccgtggagggcccacagcgcagcgcggtgatcacctcactcgacccaggaaggaagtacaagttcgtgctttatgggtttgttggcaagaaaagacatggtcctctggtggctgaagccaagatcctcccccagtctgacccttccccaggcactccgccacggcttggaaatttatgggtgaccgaccccacgcctgattcgctgcatctgtcatggacagtccccgaggggcagtttgataccttcatggtccagtaccgagatcgggacggacgcccacaggtggtgccagtcgaaggtcctgagaggtcgttcgttgttagctctctggacccagatcacaagtacaggttcacgcttttcggtatcgcgaacaaaaagcgatacggcccactgaccgcagacgggaccactgcaccagagaggaaggaggaaccccctaggcctgaattcttggagcagcctctcctaggcgaacttacagtgaccggcgtgacacccgactccctgcgattatcttggacagttgcccaggggcccttcgattcattcatggtccagtataaagatgcgcaaggccagccacaggccgtgcctgttgccggagacgaaaacgaggtgactgtgcccggcctggatcccgaccggaagtataagatgaacctgtatggcttgcgaggaaggcaacgagtgggacccgagtccgttgttgcaaaaacagcacctcaggaagatgttgacgaaaccccgtctccaaccgaattagggactgaggcccccgaatcccctgaggaacctctgcttggcgagctgactgtaactggcagttcccctgacagtctgagtttattttggaccgtgccacaagggagtttcgattcattcacggttcagtacaaggaccgcgacgggaggcctcgtgcagttcgggtgggtggcaaggagagtgaagttactgtgggcgggctcgagccggggcacaaatacaaaatgcacttatacggactacacgagggacaaagagtgggaccggtgagcgctgtgggtgtaacggcacctcagcaggaggagacgcctccagcaactgagtctcccctcgaacccagacttggcgaacttacagtaactgacgtgactcccaacagtgtgggtctgagttggacagtaccggagggacaatttgacagttttattgtgcagtacaaagataaagacggacagccacaggtcgtgcccgtggctgctgatcaaagagaggtgacggtgtacaacctagagcctgagcgtaagtataaaatgaacatgtatgggctgcacgacgggcagaggatgggtccactctctgtggtgattgtgaccgctccacttcctcctgcacccgctactgaagcatccaagccccctcttgaacctcgtttgggagagctgacagtgaccgatattaccccggattcagtcggcctctcttggacggttcccgagggggaatttgattcctttgttgtgcagtacaaggatcgtgacggacagccacaggtggtgcctgtggcggcagaccagcgcgaggttaccattcctgacctggaaccatcacggaaatacaagttcttgctgttcggcattcaggacgggaaaaggagatcccccgtgtccgtggaggccaagaccgtcgcccggggcgacgcatctccaggcgcccccccacgacttggcgaactgtgggtgactgacccaacacccgacagcctccggctgagttggacagtgcccgagggacagtttgactcatttgtggttcagttcaaggacaaggacggacctcaggtggtgcccgtagagggccacgaacggagcgtgaccgtaacccctctcgatgcaggaaggaaatatcggttcctattgtacggcctgctgggtaagaaaagacatggcccactcaccgcagacggcacaaccgaagcgcggtcagcaatggacgataccggcaccaaacgaccccccaagcccagacttggcgaggaactgcaggtgaccaccgtcacccagaattccgtcggactgagctggaccgtgccggagggccagttcgactcttttgttgtgcagtacaaagaccgggacggacagccccaggtggtccccgtcgagggcagtctgcgggaagtgtcagtgccgggtctggatcctgcacatagatacaaacttctgctgtacggattacaccatggaaagcgggttgggcccatatctgccgttgccattacggcaggccgggaggagaccgaaaccgaaactacggcccctacaccacccgccccagaaccccatctgggggaattgactgtagaagaagctacatctcacactctgcatctgtcctggatggtaacagaaggagaattcgactcctttgagatccagtacaccgacagagacggccagctgcagatggtcaggattgggggagacagaaatgacataactctcagtggtctggaatccgatcacagatatctggtcaccttgtacgggttttccgatggcaaacatgtggggcccgtgcacgttgaagctttaacagtaccagaagaagagaagcccagcgaaccaccgaccgcgacgcctgaaccccccattaagcccagactgggcgaacttacagtgacggatgccactcccgattccctatctctgtcatggacagtccctgaaggacagtttgaccatttcctggttcaatatcggaacggcgatggacagccgaaggcggtgagggtgcctgggcacgaggaaggagtgacgatttccggcctagaaccagaccacaaatacaagatgaacctttatggcttccacgggggccagagaatgggcccagtgagtgttgtgggagttaccgccgcggaggaggagaccccttcacctaccgagccttctatggaggctcctgagccagccgaggaaccactgctgggagagctaacggtcactggcagctcccctgacagcctttctctgagctggacagtaccccagggtcggttcgattccttcaccgttcaatataaggacagggatggcagaccacaggtggtgcgggtggggggcgaggagtcagaagtcacagtgggagggttggaacccggaaggaagtataaaatgcacttgtacggacttcatgagggaaggagggtggggcccgtgtcagccgttggtgtgaccgcccccgaagaggagtctcctgatgccccactggcgaaactacgtcttggccaaatgaccgtgagagacattaccagcgattccttatccctaagctggactgtacccgagggacaattcgatcacttcttagtacagttcaagaacggggacggccagcctaaggccgtgagagtcccagggcatgaggacggtgtgacaatctctggcctggaacccgaccacaagtacaaaatgaacttgtacggctttcacggggggcagagagtgggtcctgtgtcggccgttgggcttaccgctcccggaaaggacgaggaaatggctccggcttcaactgaaccacccactcctgagccacccatcaaaccacggctggaggaactaaccgtgacagatgctacacccgatagcttgagtctgtcatggacagtgcccgaaggacaattcgatcactttctagtccagtataagaacggtgacggccagccaaaagctaccagagtaccagggcatgaggaccgcgtgacaattagcggcctggaaccagataacaagtataagatgaatctttacggattccatggaggacagagagtcggcccagtatcagcaatcggagtgacagcggcggaggaagaaacccccagtcccaccgagccctcaatggaggctccagagccaccagaggagcctctgctgggtgagctcactgtgaccggatcatctcctgactccctgagtctatcctggacagtgccacaaggccgctttgactccttcaccgtacagtataaagatcgagacggcagacctcaggtggtgagagtgggcggggaagaaagtgaggtcacagtggggggcttagaaccaggcaggaaatataagatgcatctctatggtttgcacgaaggccggcgggtaggaccagtgtccactgtaggcgttacagctcctcaggaagatgtggacgagaccccatccccaactgaacccgggacagaagcccctgagcctcctgaggaacctctgctcggcgaactgacggtaaccgggagctcgcctgacagcttgtccttatcatggactgtgccacaagggcgtttcgacagcttcacagtgcaatataaggacagagatggccgtcctcaagcagtacgggtcgggggccaggagtctaaagtcaccgtgagagggctggagccgggcaggaagtataagatgcacctgtatggattacacgagggccgcaggctgggaccagtgtccgcagtaggcgtgaccgaggacgaggccgagactacgcaggccgtgcccactatgactcccgagccccctatcaagccgaggctaggcgagctgactatgactgatgctaccccagacagcttgtccttgagctggacagtgcctgagggccaattcgaccattttctcgtgcaatatcgtaatggcgacgggcaacctaaagccgtgcgggtccctggtcatgaagacggcgtgacaatttccggactggagccagatcacaaatataaaatgaatctgtacgggttccacggtgggcaacgcgtaggccctatcagcgtgattggcgtaaccgcagctgaggaagaaacccccagcccaacagaactgagcactgaggcccccgagcctcccgaggaaccattgctgggggagctgactgtaaccggttctagcccagactctcttagcctgtcctggaccataccacagggccactttgattctttcactgtccaatataaagaccgcgacggtcggcctcaggtcatgcgggttcgcggcgaggagtccgaggtgactgtggggggactggagccgggtaggaagtacaagatgcacctttatggacttcacgagggccgacgggttgggcctgtctccacagtcggtgttacagaagatgaagctgaaactacgcaggccgtcccaaccactacacccgaaccaccaaacaaacccagactcggagaactgaccgtaaccgacgccactccggactctttgagtttatcttggatggtcccagaaggccagttcgaccatttcctcgtgcagtaccgaaatggggacgggcagcctaaagtcgtaagggtgcctggacatgaagacggggtcacaatttcgggtctggaaccagatcacaagtataaaatgaacctctacgggttccacggagggcagcgcgtgggacccatctctgtaatcggggtgaccgctgccgaagaggaaaccccagcccccactgagccctcgacagaagcccctgaacctccagaagagcccctgctcggcgagctcacagtcacagggtcatcccccgatagcctctctctgtcatggactattccacagggacgattcgactcctttacagtgcagtacaaggatagagacggtcggccccaagtggtccgtgttcgcggggaggagtcagaagtcacagtgggcgggcttgagcccgggtgtaagtacaagatgcatctgtatggcttgcacgaagggcagcgtgtcgggccagtgtccgcagtaggagttaccgccccgaaggatgaagctgagacaactcaagcggtgcccaccatgactccggagccacccattaagcctagactcggggagctgacggtgaccgacgctaccccggactcattaagtctaagctggatggttcctgagggacaattcgaccatttcctcgtacagtacagaaatggagacggtcagcccaaagctgtgcgcgtaccaggacacgaagacggggtgactatcagcggcttagaaccggaccacaaatataagatgaatctgtacggattccacggcggccagcgggtaggaccggtctccgccatcggagttactgaagaagagacaccctcccctactgaaccatccactgaggcccctgaagcacctgaggagccgctgctaggagaactaacggtgaccggctccagccccgattctctttcactatcttggactgtcccccagggaagattcgactctttcacagtgcaatacaaggaccgcgacggacagcctcaagtggtccgtgtccgtggggaagagtccgaggttaccgtggggggcctggagcccggccgcaagtacaaaatgcatttatatgggctgcacgaaggacaaagggtcgggcctgtgagcacagtgggcatcactgctccactccccacacctctgcctgtggagccaaggctgggggagctcgccgtggcggcagtgacctcagatagcgtagggctgtcatggaccgtcgctcagggacctttcgacagctttctggtccagtaccgggatgctcaagggcagccccaggccgttccagtctctggcgatctgcgggctgttgccgtgagcgggctggatcctgcccggaagtacaaattcctgttgttcggtctgcagaacgggaaacggcatggaccggtgccagtagaagccagaactgcccctgatactaagccttcgcccaggttaggagaacttaccgtgacagacgcaacaccagactcggtaggcctgagttggacggtccctgagggcgagtttgactcttttgtggtgcagtataaagacaaggacggccgcctgcaagtggtgccagttgccgcaaatcagagagaggtcacagtgcaggggttggagccgtcacgcaaatataggttcttactctacggactgagtggacgaaagcgactgggccccatcagcgcagacagtactacagctccgctggaaaaggaactgccaccacaccttggtgaattgacggtcgcagaggagacatccagcagccttcgcttgagttggaccgtggctcaaggcccctttgattcgttcgttgtgcagtacagagatactgacgggcagccccgcgccgttcccgtcgctgccgaccaaagaactgtgaccgtggaggatttggaaccagggaagaaatataaattcttactttacggcctgttagggggaaaaaggttgggaccagtgagcgccctaggcatgaccgctccagaagaagacacacccgccccagagttggcccccgaagccccggagcctccggaggaacctcgtctgggcgtactcaccgtgacagacacaactccagatagtatgcggttgtcttggtccgtggcgcaggggcctttcgattccttcgtcgtgcagtatgaagatacgaatggacaaccacaggctcttctggttgacggtgaccagtcgaaaatacttatctctggtcttgagccttcaactccctaccgcttcttactttacggactgcacgaagggaagaggctgggacctctctcagctgaaggcaccacgggcttagcgcctgccggccagacgagcgaggagagccgcccacgcttgtcccagctttcagtgactgatgtgactacttcctctctgagactcaattgggaggctccccctggcgccttcgattcgttcctcctgcggttcggcgttcctagcccaagcactttggaaccgcaccccaggccactactacagcgcgagctgatggtgcctgggactagacacagcgcagtcctgcgcgatttaagatcgggaaccctctactcgctgaccctatatggcctcagaggacctcacaaagccgacagcattcagggcactgctaggactctcagccctgtacttgagtctcccagagatctacagttcagcgaaatacgggagacaagcgccaaagtgaattggatgcccccgccatcacgcgccgatagcttcaaggtgtcgtatcagctcgctgacggaggcgaaccccagtccgtacaagtggacgggcaagctcggacccaaaaactgcagggcctaatcccaggcgccaggtacgaagttacggtggtgagtgtgcgcggctttgaggaaagcgagcccctcaccgggtttctcacaaccgttccagatgggcctacccagctgcgagcactgaatctgacagaaggcttcgccgttctgcattggaagccaccacagaatcccgtggatacctacgatatccaggtgactgcccctggagcgccaccacttcaggccgaaacccccgggtccgcagtcgattacccactgcatgatcttgtgttgcacacgaactatacagcaaccgttcgagggttgagggggcctaatctaacctccccagcttctatcaccttcacaaccggactggaagccccacgcgacctggaggcaaaggaggtcacaccacggacagcccttttgacatggaccgagccaccggttcgaccagccggatatctgctgagcttccatacaccaggaggccagactcaagaaatacttctaccaggaggcattacatcccatcagttactcggcctttttccttctacatcatataatgctcggctgcaggctatgtggggacagtctttgctcccccctgtgtcaactagttttactacaggcggcctcagaattcccttcccacgggattgtggcgaagagatgcaaaacggcgctggcgcctctcggacatccacaatctttctgaatgggaacagagagagacccttaattgtgttctgcgacatggaaacggacggagggggctggttagtctttcaaagacgaatggatggccagacggatttttggagggattgggaggactacgctcatggattcgggaatattagcggggagttttggttggggaatgaagctctgcactccttgacccaggcaggcgactattcgatgcgtgtcgacctgcgggcaggggacgaggctgtgttcgcacagtacgattccttccatgtcgactccgctgccgaatactacagattacacctggagggatatcacgggacggcaggggattccatgtcttatcatagcgggtccgttttctcagcaagggatcgcgatcctaacagcctcttaatcagctgcgctgtaagttataggggcgcctggtggtatcggaactgtcattatgccaatcttaacggcctgtacggttccacggtcgatcatcagggtgtgagctggtatcactggaaggggttcgagttcagtgttccattcactgagatgaaactgaggcctcgtaacttcaggtcccccgcaggaggcgggtag

SEQ ID NO: 208333 - DNA, 12729 bp, Artificial Sequence
  Description of Artificial Sequence: Synthetic coding sequence
atgatgcccgcccagtacgccctgaccagcagcctggtgctgctggtgctactcagcacagcacgcgccggaccattctccagcaggtccaatgtgacactgcctgctccgcgtccacccccacagccgggcggacataccgtgggagccggtgtggggagcccctccagtcagttgtacgagcatacagtggaggggggcgagaagcaggtcgtgttcacacacagaatcaatttacccccttcaacggggtgcggatgcccgccgggaaccgagcccccagtgctggcctctgaggtgcaggccctgagggttcggctggagatcctcgaagaattggtgaagggcctgaaagaacagtgtactggcggctgttgcccggctagtgcccaggcaggaacagggcagaccgacgtgcggaccctttgcagcctgcacggcgtttttgatctgtcgcgttgtacttgttcttgtgagccgggttggggaggtccaacctgctcggacccgaccgacgccgagatccccccatcctccccgcctagtgcttcaggatcatgccccgatgactgcaatgatcagggcagatgtgtgcgaggtagatgcgtgtgctttccaggatacactggaccatcttgcgggtggccatcctgtcccggggactgtcagggccgtggccggtgtgtgcaaggggtatgtgtgtgcagggcggggttttctggaccagactgctctcagcgaagttgcccacggggctgctcacagaggggacggtgtgagggtgggcggtgtgtatgtgatcccggttataccggcgatgactgcggtatgcgatcctgccctagaggttgttcacaaagggggaggtgcgaaaacggacgatgcgtctgcaatccgggatacgcaggcgaagactgcggggtgagaagttgccccagaggctgcagccagaggggccgctgcaaagatggccgctgcgtgtgtgaccccggatacaccggcgaggactgtggaactcgctcatgtccgtgggattgtggtgaggggggacgatgcgttgatgggaggtgtgtgtgctggccaggatacactggagaggattgttccacaaggacctgtcctagagattgccgagggcgaggtcgttgtgaggacggcgagtgcatttgcgatacgggctactccggagatgactgcggcgtgcggagctgtcctggggactgtaaccaacgcggcaggtgcgaggacggaaggtgcgtgtgttggcccggatacactgggaccgactgcggtagtagagcttgccctcgggactgccgcggccggggcaggtgcgagaatggggtgtgtgtttgtaacgctggctacagcggcgaggattgcggagtgcgctcttgtcccggggattgtcgtggccgtggcagatgtgagtcgggacgatgtatgtgttggccaggctacactgggagggactgtgggactagagcctgcccaggagactgtcgcggcagaggccggtgtgtcgatggtaggtgtgtgtgcaatccaggtttcacgggagaggattgcggcagccgaaggtgtcctggggattgtcggggccacggtctttgcgaagacggagtgtgtgtgtgtgatgccggctatagcggcgaggactgcagcactagatcttgccctggcggctgccgcggccgcggtcagtgtcttgacggacggtgcgtctgtgaggatggctacagcggggaagactgcggtgtcaggcagtgcccaaatgactgcagtcagcatggagtatgtcaggatggcgtgtgcatatgttgggagggatatgtctccgaggactgttctatcaggacgtgccccagcaactgtcatggcaggggtcggtgtgaggaggggcggtgtctgtgtgacccagggtacaccggccccacatgtgctacaaggatgtgtcctgccgattgcagaggccgcggtcgttgcgtgcagggggtgtgcttgtgccatgttggttacggcggtgaagactgcggacaggaggagccaccggctagcgcctgcccagggggttgcgggccgcgagaactctgccgagcaggtcagtgcgtgtgcgttgagggatttcgcggacctgactgtgcaatacagacatgtcccggcgattgcagggggagaggtgagtgtcacgatggatcctgtgtgtgcaaagacggttatgccggggaagactgtggagaggaagtccctacgatcgaaggcatgcggatgcatttacttgaagagactaccgtgcgtaccgagtggacaccagccccaggccccgttgatgcgtacgagattcagtttataccgactacagagggcgcgtcccccccttttaccgccagggtgccttctagcgcctctgcttacgaccagcgcgggctggcacccgggcaagaatatcaggttacagtgcgcgccttaagaggaacttcttggggccttcctgcaagcaagaccatcacaactatgatagatggcccccaggacctgagagtggtcgcagtgactcccaccacactggagcttggctggctgagaccccaggctgaagtggacagattcgtcgtgtcttacgtgtccgccggaaaccagagggtgcgactggaggttccccctgaggccgacggcactttgctaaccgacctgatgcctggcgttgaatatgtggtgacggtgactgctgagcgcggaagagcagttagctatccagcctcagtgagggccaataccgggtcttctcctctaggattgctgggcaccactgatgaacctcctccatctggacctagcaccacacagggggcacaggctcccttgttacagcagaggccccaagagctcggagagctgagggtgctggggcgcgatgagacaggccgactacgggtggtgtggacagcccagcccgacaccttcgcatactttcagttgcggatgcgcgttccggaaggacccggcgcccacgaggaggttctgcccggtgacgtgcgccaggcgttggtgcctcctccgccacccggaacaccttatgagctgagtttgcacggcgtcccgcccggcggaaagccgtccgatcctatcatttaccagggaatcatggacaaggatgaagagaaacctggtaagagtagcggtccgcctagactaggggagttgaccgtcacggacagaacttcagacagcctgttgctcagatggacagttcctgaaggagaatttgacagcttcgtcatccaatacaaggatagggatgggcagccccaggttgtgcctgtcgaaggtcctcagaggtccgccgtcatcactagtttagacccaggacggaagtataagttcgtgctgtatggattcgtggggaaaaagcgccatggaccactggtggcagaagcaaagatcttgccccagtcagacccttcccccgggactcctcctcatctcggaaacttgtgggtcaccgatccaacacccgattcactccacctatcgtggactgtgcccgaagggcagttcgatacttttatggtgcaatacagagaccgggacggccgccctcaggtggtgcctgtcgaaggacccgagcgaagttttgtcgtatcttccctagatcccgatcataagtatcggttcaccctctttggtatcgctaacaagaagcgatatggacctttgaccgccgatggtaccacagcccccgaaagaaaggaagaaccaccacgacccgaatttctcgagcaacctctcctgggggaactcacggtcactggcgtgacccccgacagcttgcggctcagttggacagtggcccagggcccatttgattcattcatggtgcagtataaagatgcccaggggcagccccaggccgtgcccgtggccggtgacgagaacgaggtgacagtgcccggtctagatccagaccggaaatataagatgaacttatacggactgcgaggacgccagcgcgtcggacctgagagcgtcgttgctaaaactgctccccaggaggacgtggacgagacaccctcaccaaccgagttaggtacagaagccccagaaagtcctgaggagccgctgctaggcgaactgacagttaccggttcatcaccagactctctgagtttgttctggacggtcccgcaggggtctttcgattcttttactgtgcagtataaggacagagatgggaggcccagagccgttagagtgggggggaaggagagcgaggtcaccgtgggcggcctcgaaccagggcataagtacaagatgcatctttacggtctgcacgagggtcagagagtgggacccgtgtcagccgtgggggtgaccgctccccagcaggaggagacccccccggcaacagagtcccctttagaaccacgtctaggtgaactcacggtgacagatgtgacacctaacagcgtgggtctctcttggactgtaccggagggccagtttgactcctttatcgttcagtataaagataaggacgggcaaccccaggtagttccagtggcagcagatcaaagagaggtcaccgtttataacctagagccagaaaggaagtataagatgaatatgtacgggctccacgatggacagagaatgggacccttgtcggttgtgattgtcaccgctccacttcctcccgcacccgccaccgaagcgtcaaagccacctttggaaccgaggttgggggagctgacggtcactgatataaccccagacagtgtggggctaagttggaccgtgcccgagggagagtttgactctttcgtagtgcaatacaaggaccgggacggccagcctcaagtcgtccccgtggcggccgatcagagagaggtcactattccggacctggaacccagccgaaagtataagttcctattgttcggtattcaggatggaaagcgaaggagcccagtgtccgtagaagcgaagacagtcgctcgcggggatgcttccccaggcgcacccccaaggctgggcgaactatgggtgaccgaccctacccctgattcacttcggctcagctggactgtcccagaaggccagttcgattccttcgtcgtgcagttcaaggataaagacggaccccaggtggtgccggtggaggggcacgaacgaagcgtgacggtgactccgctcgacgccggaaggaagtaccgcttcctgctatatgggctgctgggcaagaaaaggcatggtccacttaccgccgacggtaccactgaggcgaggtccgccatggatgacacagggacaaaacggccccccaagccaagactgggtgaagagttacaggtgactacagttacccagaattccgttgggctgtcatggaccgttcccgagggccaatttgactcattcgttgtgcaatacaaggatagagacggccagcctcaggtcgttccagtggaggggagtctcagagaagtgtccgtcccaggcctggatcccgcacatcgatataaattactgttgtatggcctgcaccatgggaagagagttggacccatatcagctgtcgccattacagctgggcgggaggagaccgagactgaaacaactgctcctacacccccagcccccgaaccccacctcggagagctgaccgtggaggaggccacgtctcatacgctccatctgtcatggatggtgacagagggcgagtttgatagcttcgagattcaatatacagaccgtgacggccaactccaaatggtgcgcattggcggtgatcgcaacgatattaccttaagtggactcgagtccgatcaccgctaccttgtcacgctgtatggttttagcgacggtaagcatgtaggcccggtgcatgttgaggcacttaccgtgccagaagaggaaaaaccatctgaacctcctacggccacacctgaacctccaataaagccgcgcttgggagaactgaccgtaactgatgccaccccggatagcctctcgttgagctggactgtaccagagggacaattcgaccactttctcgtccagtacagaaatggggacggccagccgaaggctgtgcgcgtcccaggccacgaagaaggtgtaacaattagcggcttggaacccgatcataaatacaaaatgaacctttatggctttcacgggggacaaaggatgggccctgtttccgtagtgggcgtgacagcagccgaggaggagacgccatcccccacagaaccttctatggaagcccccgaacccgcagaagagcccctcctgggggagctcaccgtaactgggtccagtcctgattccctctctctctcatggactgttcctcaggggaggtttgacagctttacagtccagtacaaggaccgcgatggacgaccccaagttgtgcgagtgggtggggaggaaagcgaggtaaccgtgggtggcctggaaccagggcgcaagtataagatgcacttgtatggactgcacgaagggcgcagggtgggtccagtctctgccgtgggggtcaccgcacctgaggaggaatccccagacgcccccttggctaagttaagattggggcaaatgacagtacgagacattacctccgatagtctctctctatcgtggaccgtccctgaaggccaattcgaccactttctggttcagttcaagaacggcgatggccaacctaaggctgttagagtgcccggccacgaggatggcgtaactatctccggcctcgaacccgaccataagtataaaatgaacctatacgggtttcacgggggccagagggtgggtcccgtgtcagcagtcggcttgactgcgccaggcaaagacgaggagatggctcccgcatccaccgagccacctactcccgaaccaccgattaaacctaggctcgaagaactcacagtcacagatgctacccctgactctctttccctgagctggacagtgccagaggggcagttcgatcattttcttgtgcaatataaaaatggagacggccaaccaaaggctaccagagtgcctgggcacgaggaccgggtcactatcagtggtttagagcccgataataaatataagatgaacctctatggcttccacggcggccagcgtgtgggccccgtgtcagctattggagtgactgccgcagaggaagagaccccctcacctactgagccgtctatggaagcacctgagcctccagaggaacctcttctgggagagctgaccgtcacaggcagcagcccagactccctgagcctcagctggaccgtgccacaaggccgattcgactcttttactgtgcagtataaagacagggatgggcggcctcaggtcgtccgcgtgggcggagaagagtccgaagttacggttggtggattagaacctggacgcaaatataagatgcatctgtatggtcttcatgaaggcaggcgggtgggaccagtgtccactgtgggcgtcaccgcccctcaagaggacgttgatgaaactcccagccctacagaacctggaaccgaggcgcccgaaccccctgaggagccactcctgggggagttgaccgtgaccggcagttcacccgattcactgtcgttgtcatggaccgtgcctcagggacggttcgacagtttcacggtccaatataaggatcgcgatggacggcctcaggcggttcgggttggcggccaagagagcaaggtgacagtgcgcggacttgagcctgggaggaagtacaaaatgcacctgtacggattgcatgaggggcgcaggttaggccccgtatccgcagtcggcgtgacagaagatgaggcagagaccacgcaggccgtccctacaatgactccggagccccccattaaaccaaggctgggggagctcacgatgacagacgcaactcccgactccttatctctctcctggactgtgcctgaaggacagttcgaccattttcttgtgcagtacaggaacggggatggccagccgaaggccgtccgagtgcccggacatgaggatggcgtgaccatctctggcttagagcctgatcacaagtacaagatgaatctctacggatttcacggcggacagagagttggccctattagtgtgattggagttactgctgcagaggaagaaacacctagccctacagaactgtcaaccgaagcgccggaaccgcctgaagagccgctccttggagaactaacagtgactggctcatccccggactccctgagtctgtcctggacaataccccagggacactttgacagctttaccgtgcagtataaggaccgcgatggcagacctcaagtcatgcgcgttaggggtgaagagtccgaagttacagttggagggctggaacccgggcgaaagtataagatgcatctgtatggcctacatgagggccgtcgcgtggggccagtgtcgactgtcggagtgacagaggacgaggcagaaaccacccaggcagtgcccaccaccaccccagagccgccaaacaaaccacgactgggcgaactgacagtgaccgacgcaaccccagacagccttagcctatcctggatggtgccagagggccagtttgaccacttcctggtccagtaccgaaacggtgatgggcagccaaaggtagttcgagtacccgggcacgaagacggtgtcactatttcaggccttgaacccgatcacaaatacaagatgaacctttatggcttccacggcggccagcgagtgggccccatcagcgtcattggcgtgaccgctgccgaggaagaaactcccgctcctaccgagccctcgactgaagcccccgaaccccctgaagaacctttgttgggagaacttacagtcacaggttcttctccggacagcttatccctctcttggacaattccacaggggcgcttcgattccttcactgtgcagtacaaagacagagatgggcgccctcaggtggtcagagtaaggggcgaagaatcagaggtgactgttgggggcctggagccagggtgtaagtataaaatgcacctgtatggtctccacgagggccaacgcgtgggtccagtgagcgcagtgggcgtgaccgctcctaaggatgaggccgaaacaacccaagccgtccccacaatgacaccggagccacccattaaaccaaggctgggtgagctgacagttaccgacgccacgccagactcactaagcctgtcgtggatggtccccgaaggtcagtttgaccatttcttagtccaatatcgtaacggagacggacagccaaaagcggtgagggtccctgggcacgaagatggcgttaccatctctgggctggaaccagaccacaagtataaaatgaacctgtacggtttccacggtggccagagagttggacctgtgagtgctattggcgtaacggaagaggagactccaagccccactgagcctagcactgaggcgcccgaggcacccgaggagccgctcttgggcgagctgacggtcacgggatccagccccgattccttatctttgagctggaccgtcccccagggccggttcgatagcttcaccgtccagtacaaagatagggatggacagccccaggtggtgagggttcgaggtgaagagagcgaggtgacagtgggaggcctggagcccggtaggaagtataagatgcacttatacggcctgcacgaaggccaacgagttgggcccgtttccacagtggggattaccgccccattgcccacccccttacccgtggaaccaaggttgggagaactggcagtcgccgctgtcacctccgattccgtaggcctgagttggactgttgcacagggaccctttgactcgttcctggtgcagtatagagatgctcaggggcaacctcaagcagtccctgtgagcggtgatttgcgtgccgtggctgtcagcggcctggaccccgccagaaaatataaattcttgttattcggtcttcagaatggcaagcggcatggtccagtgcctgtcgaggcccgtaccgctccagacacaaagccgagccctcggctgggtgagctcacggtgactgacgctactcccgattctgtggggctctcctggacggtgcccgagggggaattcgattcatttgtcgtacaatacaaggacaaagacgggcggctgcaagtggtgccggtggcagccaatcagcgcgaggtgacagtccaaggcctggaaccaagcaggaagtaccggtttttactgtacgggcttagtggaagaaagagattgggacccatttccgccgacagcaccacagcccccctcgagaaagaattgcctccgcacctcggcgagcttaccgtcgccgaggaaacgagctcctcgctcaggctgagttggaccgtggctcaggggccttttgactcattcgttgttcagtatcgcgacacagatgggcagcctcgagccgtacccgtggctgccgaccagaggaccgtgacagttgaagacttagagccagggaagaaatacaaattcctgttgtacgggctgttgggcggaaagaggttggggcccgtgagtgcactgggcatgaccgcacctgaagaggacacccctgctcccgagctggcaccagaggctcctgagccacccgaagaacctagactcggggtacttaccgtcactgatacaaccccagactctatgcgactttcgtggtctgtcgctcagggaccctttgatagctttgtggtacaatacgaggatacaaatgggcaacctcaggcgctactggtggacggggaccagtctaagatacttattagcggtcttgagccgtctacgccatacagatttctcctgtacggtcttcacgaaggcaaacgtctgggaccattgtctgcggaaggcaccactggactggctccagcaggccagacctccgaagaatcgcgcccacgcctctcacagttgtcagtcaccgacgtaactacgagcagtttgaggctcaactgggaggccccccccggcgcgttcgactcctttttacttaggttcggtgttccctcccccagcacactcgagccccatcctcgccctttattgcaacgggaactgatggtgccaggtacacgccacagcgcagtcctcagagacctacggtccggcaccctgtactccctgaccctgtacggcctgcgtggaccccataaggcagactccatccagggcactgcccgaaccctgagcccagtcctggagagccctcgagacctacaattcagcgagatccgagagacaagtgctaaagttaactggatgcctccaccttccagagccgatagttttaaggtgtcataccaactggctgatggcggagagccacagtccgtgcaggtggatggccaggctaggacccaaaagctgcaaggtctgattccaggcgcgcggtatgaggtcactgtagtgtccgtgcgcgggttcgaagagagtgaaccgttgacagggttcctgacaacagttcctgacgggcctacacagctgcgcgctctgaacttgacggaagggttcgctgtactgcattggaaacctcctcaaaacccagtcgatacctacgacgtgcaagtgacagctcccggtgcccctcctctccaggcggagaccccagggagtgcggtggactacccccttcacgacctggtgctgcatacgaattacaccgcaaccgttcgagggctgcgaggaccaaacttaacgtcacctgcctcgattacattcaccaccggacttgaagccccacgggacttggaggcgaaggaggtaaccccccggaccgctctattaacatggactgaacccccagtccggccggcggggtacctgctctcctttcacaccccaggtgggcagaaccaggagattctgctgcctgggggaatcacaagccaccagcttctaggtctttttccatcgacaagttacaacgcccggctgcaggctatgtggggtcagtcactgttgccccctgtgagcacctccttcaccacaggtggactccggatcccattcccgagagactgcggggaggagatgcagaacggggctggagcgagcagaacatccacgatctttctcaacggcaaccgtgaaaggcccttgaatgtgttctgtgacatggagacagacggcggaggttggctcgttttccagagacggatggacggccagacagatttttggagagattgggaagattatgcacatggatttggaaacatctcaggcgaattttggttggggaacgaagccctacactctcttacgcaggccggggattactctatgcgtgtggatttgcgtgccggggacgaggctgtttttgcacaatatgatagctttcacgtggatagcgctgcagaatattataggctacacttagaagggtaccatggcacagccggcgattccatgtcttaccatagtggcagtgtcttctctgcaagagatcgtgaccctaacagtctcttgatctcctgcgccgtgtcctatcggggcgcctggtggtatcggaattgccactatgcaaacctcaacggcctgtacggctccaccgtcgaccatcagggggtttcatggtatcactggaagggatttgagtttagcgtccccttcacagagatgaagctgcgcccaaggaattttcgaagtcctgccggcggcggctag

SEQ ID NO: 208334 - DNA, 843 bp, Artificial Sequence
  Description of Artificial Sequence: Synthetic coding sequence
atggtgaccgagggcgagttcgacagcttcgagatccagtacaccgatagagatggccagctgcaaatggtgcggatagggggcgataggaacgatataaccctgagtgggctcgaatcagaccatcggtacctcgtgacactttatggtttcagtgatggcaagcatgtcggtccagtgcacgtggaggccctgactgtacccgaggaggagaagccttccgagcctcccacggccacacctgaacctccgataaagcctcggttaggagaactgactgtcaccgatgccacaccagactccctaagcctaagttggacggtccccgaaggacaatttgaccatttcctggtccagtataggaacggggatggacaacctaaggccgtacgggtccccggtcacgaagaaggcgtgaccatcagcggattggaaccagatcataagtataagatgaacctgtatggcttccacggtggccagcgcatgggtccagttagcgtcgttggggtgaccgctgccgaggaggaaacacccagccccacggagcctagtatggaagctcctgagccagctgaggagcctctgttgggggagctgactgtcaccgggtcctcccccgacagcctgtccttgagctggacagtgccacaaggccgcttcgacagttttacggtgcagtacaaagatcgggacgggcgtccgcaggtagtgagagtcggcggtgaggagtctgaggtgacagtgggcggcctggagcccggtagaaaatacaaaatgcacctttatgggctacatgagggccggagggtgggtcccgtaagcgccgttggcgttacttag

SEQ ID NO: 208335 - DNA, 12729 bp, Artificial Sequence
  Description of Artificial Sequence: Synthetic coding sequence
atgatgcccgcccagtacgccctgaccagcagcctggtgctgctggtgctgctttctacagcaagagccggaccgttctcttccaggtcgaatgtgacactgccagcccctcgtccacctccacaaccaggaggtcacaccgtaggagcaggtgtcgggtccccatcttcccagctgtatgaacacaccgtcgaaggtggtgaaaaacaggtggtcttcacccacaggattaatcttccccccagtacagggtgtggatgtcctcctgggaccgagccgcccgtgctcgcatcagaagtccaagcgctgagagtgcgactggaaattctggaggaactggtcaaggggctgaaggaacagtgcactggaggatgctgtccagccagcgctcaggccggaaccggccagaccgacgtcaggactctatgttctctgcacggggtgttcgacttaagtcgctgtacgtgcagctgtgaacccggatggggtggaccgacatgcagcgatccaaccgatgctgagattcctccttcctcccctccttctgcgtcagggagctgtcccgacgactgtaacgaccaaggtagatgcgtgaggggccgctgtgtgtgtttccccgggtacaccggaccatcttgcggatggccctcttgccctggcgactgccaagggcgcggacggtgcgtgcagggagtgtgtgtatgcagagccggcttttcgggaccagattgtagccagaggtcatgccccagaggctgctcgcagcgcggcaggtgcgagggaggcaggtgtgtgtgcgaccccgggtatactggggacgactgtggcatgcgctcctgccctagaggctgctcccagcgtggacggtgtgagaatggcaggtgcgtgtgcaaccccgggtacactggtgaggattgcggcgtaaggtcatgtccccgcggctgttctcagcgtgggcggtgcaaagacggcaggtgcgtctgtgatccaggctacacgggagaagactgcggtacccgaagttgtccttgggactgtggggagggcgggcgctgtgttgatggtcggtgtgtgtgttggcccggatatactggcgaagattgcagtaccaggacctgccctcgtgattgccgcggccgtggccgctgtgaggatggtgagtgtatttgcgacaccggctactccggtgatgattgcggcgtgcgcagctgtccaggtgactgcaaccaaaggggaagatgcgaggatggccgatgcgtatgctggccaggctatactggcactgattgtggttcccgagcctgtccacgcgattgtcggggcagaggccgatgcgaaaacggagtgtgcgtgtgtaacgccggctacagcggggaagactgcggggttaggagttgccccggcgattgtagagggcgcggaaggtgtgagtctgggcggtgtatgtgctggccaggttataccgggcgagactgtggaacccgcgcctgccccggcgactgtagggggcgcggaagatgcgtggatggccgatgtgtctgcaatcccggcttcaccggcgaggactgcggctccaggcggtgcccaggggattgcaggggacatggactatgcgaagacggcgtgtgcgtgtgtgatgccggttattccggcgaggattgctctacgcgtagctgtccagggggatgccggggaaggggtcagtgcctggacggcaggtgcgtttgcgaggatggctactcaggagaggactgtggcgttagacagtgtccaaatgattgtagtcagcatggggtctgccaggatggcgtgtgtatctgttgggaggggtacgtgagcgaggactgctccataaggacctgtcctagcaactgtcacggcagaggacgctgcgaagagggcagatgcttgtgtgatcctggatataccggcccaacatgcgctacacggatgtgccccgccgattgtcgcggaagagggagatgtgtgcaaggggtctgcctctgccacgttggctatggtggcgaagattgcggacaagaggagccaccggcttcagcctgtcccggggggtgcggtcctagggaattatgcagagctgggcagtgtgtgtgcgtcgaagggttcaggggccccgactgcgccattcaaacctgtcctggagattgtagaggccgcggagagtgtcatgacgggagctgcgtctgtaaagatggttacgctggtgaggattgtggtgaggaagtccccacgatcgaggggatgagaatgcatcttctcgaggaaacgaccgtcagaacggaatggacgcctgcccccggacctgtagacgcatacgagattcagttcattcccactacagagggagctagcccaccctttactgctcgggtcccctcctctgcaagtgcttacgatcagcgagggttggctccaggccaggagtatcaagtgaccgtgagggccctgcgcggaacatcctggggcctgccagcctccaaaacaattacaactatgattgacggtcctcaagacctacgtgtagttgccgtaacgcctacaacactggaactgggctggcttagaccacaggctgaggtggacaggttcgtggtctcgtacgtgtcggcgggcaaccaaagagttagacttgaagttccccccgaagccgatggaactctgctgaccgatctaatgccaggggttgagtatgtcgttaccgtgactgccgaaaggggtcgcgctgtctcctatccggcttccgtgagggcgaataccggctccagccccttgggtctgctcggcaccacagacgagcctccaccttcaggaccttcaactacccagggggcgcaggcccctctgttacagcaacgcccgcaagaactcggcgagcttcgggtcttggggcgcgacgaaaccgggagactgagggtggtttggaccgcccaaccagacacctttgcgtatttccagctgagaatgcgggtcccagaaggacccggagcacatgaggaggttttgcccggtgatgtcaggcaggcgctggtcccacctccaccacccggaaccccgtacgagctgtctctccacggtgtgccgcctgggggaaaaccaagcgatccgatcatataccaaggtattatggacaaggatgaagagaaacctggcaaatcgtcgggaccacccagactcggggagctcacagtaaccgatcgcacttcagattcgctactcctgcggtggacggttccagaaggtgagttcgactcattcgtcattcagtacaaagatagagatggacagccgcaggttgtgccagtggaggggcctcaacgctccgctgtaatcacatccctcgacccagggcggaaatacaagtttgtgctgtacggctttgtggggaaaaaacggcacggtccgctggtcgccgaggctaagatcttgccacagagtgatcctagtcctggaacgccccctaggcttggaaacctgtgggtcacggatcctacccctgactctctccatctgtcatggacggtcccagaaggtcagtttgatacattcatggtgcagtatagggaccgcgatggacgaccacaggtagttccagttgaaggtcccgaacggtcgttcgtggttagcagccttgaccctgatcacaagtatagattcactctgtttggaatcgctaataaaaagcgatacggtccgctgactgccgacggaacaacagcgccggagcgcaaggaggaacctccacaccccgaatttctggagcaaccgctgctgggagaactgactgtaactggtgtgactcccgactccctgaggttgtcatggactgtagctcaaggcccatttgatagtttcatggtacagtataaggatgcccagggacagccccaggccgtccctgtggccggcgatgagaacgaggtgaccgtgccaggcctagacccagatcgtaagtacaaaatgaatttgtacggcttacggggtagacagcgggtgggtcctgaatcggtcgtggccaagacggcccctcaggaggatgtggacgaaactccttctccaaccgaactcggtactgaggcgcccgagagccctgaggaaccactgcttggtgaattaacggtcaccggtagcagtcctgacagtttatcgctcttttggaccgttccacagggctcttttgattcgtttacagtgcaatataaagatagagacggacggccaagggccgttcgggtaggaggcaaggagagtgaagtaacggtcgggggtctagaaccaggacacaaatacaagatgcacttgtacggtctgcacgaggggcagagagtcgggcccgtctccgccgtcggagtgactgcaccccagcaggaggagacacccccagccactgaatcacccctggagccgaggctgggtgagctgactgtcacagatgttacgccaaattcagtgggactgagttggacagtcccagaaggccagtttgactcattcatcgtacagtataaagataaggacggacagccccaggttgtgccagttgcagccgatcagagagaggtgacggtgtacaatttagaacccgaaaggaagtataagatgaacatgtatgggctgcatgacggtcagcggatgggccctctgtcagtggttatcgtgacagctcccttaccgcccgccccagcaacggaagcctccaaaccgcccctggaacctaggctcggcgagctgacggtaacggatatcacaccggactcggtcgggctttcatggaccgtacccgagggagagttcgatagcttcgtggtccaatataaagatagagatgggcagccacaggtagtgcctgtggctgcagatcagcgggaggtcacaatcccagacctggagccatcacgaaaatataagttcctactattcggtatccaggatggcaagcgccgctcccccgtatccgtggaagctaaaaccgtggctaggggggatgctagccctggcgcccctcctcgcctaggcgaactctgggtcacagatcctaccccggattccttgaggttgagttggactgttccagagggccagttcgactcattcgtggtccaattcaaagataaagacggcccccaggttgtcccggtggagggtcatgagcgaagtgtcacagtaacacctctcgacgctggaaggaagtacaggtttctgctctacgggctgctgggaaagaagaggcacggtcctttgacagcggatgggaccacagaggctagatccgctatggacgacaccggtactaagcggccgccaaagcccaggctgggggaagagcttcaggtcaccactgtaacccagaatagcgtcgggctatcctggacggtacccgagggtcagtttgattcctttgtggtgcaatataaggatagggacggacagccccaggtggtgcccgtcgagggctcacttcgcgaggtgtcggtcccgggtcttgacccagcccatagatataagctactactgtacggcctgcatcacggcaagcgcgtcggacctatctccgctgtagcgatcacagcaggacgggaagagacagagaccgaaaccacggctccaaccccccccgccccagagccccaccttggagaactcaccgtcgaggaggccacctctcacacacttcatctctcatggatggtcaccgaaggtgagttcgatagctttgagattcagtacaccgatcgggatggccagcttcagatggtgcgcataggaggagatagaaatgatattacactttccggccttgaaagcgaccacagatatcttgtgaccctctacgggtttagcgatggcaaacatgtaggtcccgtacacgttgaagcgctgaccgtgccagaagaagaaaaaccctcagaaccccccaccgccacccctgagccgccgattaaaccgagactgggggaattgaccgtgaccgacgctacaccagactcactaagtctgtcgtggactgtgcccgagggtcagttcgatcacttcctagtgcagtatagaaatggagatggccagcctaaagctgtgcgcgtgccagggcatgaggagggggttacaatctccggactcgagccagaccacaaatataaaatgaatctgtacgggtttcatggcggccagcggatggggcctgtaagcgtagtgggagtgaccgccgccgaggaggagaccccaagccccaccgagccaagcatggaagctcccgagcctgcagaagagcctctcctgggcgagcttaccgtcacaggctcatctcctgactccctcagtcttagctggacagttccccaaggtaggttcgacagctttaccgtccagtataaagatagagatggaagaccacaggtagtcagggtcggaggcgaggaaagtgaagtgaccgttggtggcctggaaccggggagaaagtataagatgcacctctacggcttgcatgaagggagacgcgtgggtcccgttagtgctgtcggagtaacagcccccgaagaagagtcgccagacgctccgctcgcgaagctgcgactcggacagatgactgttagggacatcacaagtgactctctcagcctgagttggaccgtgcctgaaggccagttcgaccattttctggtgcagttcaagaacggggacggccagcctaaagctgtgcgcgtgcctggccacgaagatggtgttacaatctccgggcttgagcccgaccacaagtacaaaatgaatctgtatggctttcatggcggccagagggttggcccggtctctgccgtgggcctcaccgcgcccggaaaggacgaagaaatggcccctgcaagtaccgaaccaccgacacctgaaccacccataaagcctcgactggaggagctcactgtcactgacgctacccccgactctttgtcactgagctggacagttcccgagggacagttcgaccactttttggtacagtataaaaatggggacgggcagcctaaggctacacgcgtgccgggccacgaggatcgcgttaccatctccggtctcgaaccggataataagtataagatgaatttatacggctttcacggagggcagagagtcggtcctgtgagtgctatcggcgtgactgccgctgaggaagaaacccccagccctaccgaaccaagcatggaagcccctgagccaccagaggagcccctgctgggcgaattgactgtgactggaagtagccccgatagtctcagcctaagctggaccgttccccaggggcgctttgattcctttaccgtgcagtacaaagatcgtgacggcagacctcaagtggtccgtgtcggaggcgaagagagcgaggtgaccgtcggaggattggagccgggacgcaagtataagatgcacctgtatggccttcatgaaggccgccgggttggccctgtgtcaaccgtgggcgtcactgccccacaggaggatgtggatgagaccccttcccccaccgagcccggcacggaggccccagagccaccggaagagccactcttgggtgaactgaccgtaaccggttcttccccagatagcttgtctctctcttggaccgtgcctcaagggcgatttgatagcttcactgtgcagtataaggatagagatggcagaccgcaggctgtgagggttggagggcaggaaagcaaggtcactgtgcggggacttgagcccggcaggaaatataaaatgcacctgtatggcctgcatgaaggaagacgcctaggtccagtatctgcagtgggtgttaccgaggatgaggccgaaactactcaggctgtcccgacgatgactcctgaaccccccattaagcctcggctgggcgagctcaccatgacagacgctacacccgacagcttgtccctcagctggactgtgccggaggggcaattcgaccatttccttgtgcaataccggaacggtgacggccagcctaaagcggtgagggtcccaggccacgaagacggtgttaccatctctggcctagagcctgatcacaagtacaaaatgaatctgtacgggttccacggaggacagagggtgggcccaatttctgtcatcggcgtgactgctgcggaggaggaaactccctcacccaccgagttgtctactgaggccccggaaccccctgaggaaccgctactcggcgaactaacagtgacaggctcaagccctgatagtctttccctctcttggactatcccacaggggcatttcgacagttttactgttcagtacaaagaccgggacgggaggcctcaggtcatgcgcgtgcgtggcgaggaatctgaagtgacagtgggcgggctggaaccaggaagaaagtataagatgcacctgtatgggctccacgaaggcagaagggtgggaccagtatccacagtcggcgtcaccgaggacgaggctgagacgactcaggcagtacctaccactactcccgaacccccaaataagccacgccttggggagctgacagtcacagacgccacccccgatagcctgtctctgtcttggatggtcccagaaggccagtttgaccattttctggtgcagtataggaatggtgacggacaacctaaggtggtcagggtcccgggtcacgaagacggagttacaatatctggtcttgaacctgatcataaatataagatgaatctttacggtttccacggtggacagagagtgggtcctatttccgtgattggggtgacagccgctgaggaggagacacccgcacccaccgagccttcaactgaggcccccgaacctccagaggagcctttactgggcgaactcacagtcaccgggtcttcccctgactcattgagcttgtcctggactattccacagggtaggtttgacagcttcactgtgcagtataaggaccgggacggcagacctcaggtggtgagagtgcgcggggaggagagtgaggtcacggtggggggcctggaacctggatgcaagtacaagatgcatctttacggcttgcacgaaggccagagggtgggccccgtgagcgccgtaggtgtgacagcgcctaaggacgaggccgagaccacacaggcagtgccaacaatgacacccgaaccccccatcaaacccaggctgggagaacttaccgtcacagatgctacgcccgactctttatccctctcatggatggtgcctgaaggccaattcgaccacttcctcgttcagtaccggaacggggacggtcagcccaaagctgtacgagtccctgggcatgaggatggcgtcactatttccggcctggagccggatcataagtataaaatgaacttatacggctttcacggaggacagagggtggggcctgtgtccgctattggcgtcactgaagaggagactccaagccctactgagccatctacagaagctcccgaagcaccagaggaacctctcttgggtgagctcaccgtgaccggttcgtcacctgactccctctctctgtcctggaccatacctcaggggagatttgatagttttaccgtgcaatacaaggacagagatggccagccccaagtggtgagggtccggggcgaggaaagcgaagtcaccgttggcggtcttgagcctggtagaaaatacaaaatgcacctgtacggactgcatgaaggccagcgggtcggtccagtgagcacagtaggaattacagcacccttgcccacccctctccctgtagagcctcgcctgggggaacttgcagtggctgcagtgacgtcagactccgtgggactgagttggacagtggcccaggggcccttcgattcttttcttgtccaataccgggacgcgcaggggcagccgcaggctgtccccgtgagcggcgacctccgtgcagtggcggtctctgggctggaccctgcgagaaagtataagtttctactgtttggcctgcaaaatgggaaaaggcacgggccggtccctgtggaagcacgcactgctcctgatactaagccgtctcccagactcggagaattgacagtgacagatgctaccccggacagtgtggggcttagttggacggttcctgagggcgaattcgactcattcgtggtgcagtataaagacaaagacggcaggctccaggtggtgccagtggctgccaaccagcgggaggtcaccgtgcagggcctggaaccctcaaggaagtatcggttcctgctgtacggactttccggcagaaagcgcctcggacctatttcagccgacagcacgaccgcaccactggagaaggagctgcccccccatctgggcgagctgaccgtggcagaggaaacctctagttccttgcgactgagttggacagttgcgcagggccctttcgatagcttcgtggtacagtatcgtgatacagatggtcaacccagagctgtcccggtggctgccgatcaacggaccgttacggtcgaagacctggagcctggcaagaaatataagttcctgctgtacggcctgctgggaggcaagcgtctgggacctgtctcagcgctcggaatgactgctcctgaagaggataccccggctccagagctagcccccgaagcgcccgagcctcccgaagaacctaggctgggtgtgctgaccgtcacagacaccactcctgatagcatgcgcctaagctggtccgtggcccaaggccccttcgacagctttgtagtgcagtacgaggacacgaacggtcagcctcaagcactcttggtagatggagatcagtccaagatcctgatttctggtctggagcctagcaccccctataggtttttattatatggcctgcatgagggtaaacggttgggcccgctgtccgccgagggcacaaccggcctggccccagctgggcaaaccagtgaggaatcacgacctcggctgagtcagctctccgtgactgacgtcacaacctcctcgcttaggctgaactgggaggcacctccaggagcctttgattccttccttctgaggttcggagttccctccccctctactctggagccacatccaagaccactgttgcagcgcgagctgatggtacccggtacccgtcatagtgcggtcttgcgagaccttcgtagcggaacactttattcactgactctgtatggtctgcgaggccctcataaggccgattcaattcagggcaccgcccgcactctcagtccggtgctcgaatcacctcgagatcttcagttttcagaaatacgggaaacctcagccaaagtgaactggatgcctccgccctctcgagcagattctttcaaagtcagctatcagcttgcagatgggggtgagccacagtctgtgcaggtcgatgggcaggcaagaacacagaagctccaggggctgattcctggcgcccgctatgaggtcaccgtggtatccgtacgcggctttgaagagagcgagcctttaactgggtttctgaccacagtgcccgatggaccgacacagcttcgtgccctgaacttgactgaaggcttcgcggtgctccattggaaaccgcctcagaaccctgtcgatacttacgatatccaagtcactgcgcctggcgccccgccactccaagccgagacgcctggatcagccgtggactatccgctccacgatctggtgctgcatactaactacaccgccacagtgcgcgggctgagaggtccgaacctgaccagccccgcctcaatcacgttcactacgggcctggaggctccaagggacttggaagccaaagaggtcacaccccgcacagctcttctgacatggaccgaacctcctgttaggcccgccggctacctgttgtctttccacacgccgggcgggcagacgcaggagatcctgctgcctgggggcatcacctctcatcagctcctggggctgttccccagcacctcttacaatgctcgactgcaggcaacatggggtcaatccctgctgccacctgtttcaacttccttcactactggcggactgagaatccccttcccaagagactgcggggaagagatgcaaaatggggcaggggccagtcggacaagcactatctttctgaatggtaatcgcgagcgacccctgaacgtgttttgcgatatggaaaccgacggcggcggctggcttgtgttccaaaggcgtatggacggccagaccgatttttggagggactgggaggattatgcgcacggttttgggaatatctccggagagttctggcttggcaatgaggctctgcacagccttactcaggcaggagactattcgatgcgggttgatttgagagccggggacgaagccgtgtttgcccagtacgactcgtttcacgttgactctgccgccgagtactaccgactccaccttgagggataccacggtaccgccggtgattccatgtcttatcactcagggtctgtgttttccgcgagagatagggatcccaacagtcttctgatcagttgtgcagtgagttacagaggagcgtggtggtatcgtaactgtcactatgctaacttgaatgggctgtatggaagcactgtcgaccatcaaggagtttcatggtatcactggaagggtttcgaattcagcgtgccgttcactgagatgaagttgaggccacggaatttcagatctcctgccggcggggggtag

SEQ ID NO: 208336 - DNA, 2022 bp, Artificial Sequence
  Description of Artificial Sequence: Synthetic coding sequence
atgcggctgagctggagcgtggcccagggccccttcgacagcttcgttgtgcagtatgaggacacaaatgggcaacctcaggctcttctggttgatggcgatcagagcaaaatcctcattagtgggctggagcccagtaccccctatcgctttctgttgtacgggctgcacgaaggtaaacgcctggggcccctctcggcagagggaaccaccggtcttgcccccgccggccaaactagcgaagagtcccgacctagactctcacaattgagcgtgaccgacgtgactacaagcagccttagactgaattgggaggccccccccggcgcctttgatagtttccttctcagatttggagtgcccagtccttccacattagagccacatcctaggcccctgttacagagagagctgatggttcctggcacgcgtcatagcgcagtgctacgagacctgcgaagcggcactctctatagtctcacgctatacgggctgaggggcccgcataaagcagattcaattcagggaacagccaggaccttatcgcccgttctggagagcccaagagaccttcagtttagtgaaatcagggagacttcagccaaggtcaattggatgccacctcctagcagggccgatagtttcaaagtgtcatatcagctggcagacggcggagagccccagtccgtccaggttgacggacaggccaggacacagaaattgcagggcctgatccctggggccaggtatgaagtcacagtcgtgtccgttagaggcttcgaggagagcgagcccctgacggggttcctcaccacagtgcctgacgggcccacccagctgcgtgccctgaatcttacagagggctttgctgtgctgcattggaaaccgccacagaacccagtggacacatacgacgtacaggtgacagctcctggcgccccccctctccaggcggaaacgccagggtcagcggttgactaccctttacatgatctggtgctgcataccaattacaccgcaaccgtgcgtgggttaaggggtcccaatctcacctcgccagcctctattaccttcactacaggactggaggctcccagagatctggaggccaaagaggtgactccgcgcaccgcactcctcacttggactgagcctccggttcgcccggcaggatatctgctttccttccacacccccggtgggcagaatcaagagattctgttacccggcggaatcacatcacaccagcttctcgggctgtttccctccactagctataatgctagacttcaagctatgtggggacagagcctactgccccccgtgtcaacatccttcactactgggggcctgcggattccgtttccaagggactgcggagaagagatgcaaaacggagccggtgccagccggacaagcacaatcttcctgaatgggaatcgtgaacgtcccctaaacgtcttttgtgacatggaaaccgacggcggtggatggctggtgttccagcgccgtatggacggccagaccgacttttggagggattgggaggattacgcacacggcttcggaaatatctcgggcgaattctggctcggcaacgaagctcttcattctctgacacaggctggggactattctatgagagtggacttgagagctggtgacgaggccgtgttcgctcagtacgatagctttcacgtggactccgccgcagaatactacagactccacttggagggttatcacggcacagcgggtgatagtatgagctatcactcaggctctgtgttctccgctcgcgatagagacccaaatagcctgttaatttcctgtgctgtgagttaccggggggcctggtggtaccggaattgccactatgcgaacctgaatggtctgtacggctcgacagtggaccaccagggtgtgagttggtaccactggaagggatttgagttcagtgtgccatttactgaaatgaaactgaggccccggaactttagatctcccgctgggggaggatag

SEQ ID NO: 208337 - DNA, 654 bp, Artificial Sequence
  Description of Artificial Sequence: Synthetic coding sequence
gcccccggcaaggacgaggagatggcccccgccagcaccgagccccccacgcccgagcctcctatcaaaccacgccttgaagagttaacagtgactgacgcaacccccgacagtctgagtctctcctggacggtccccgagggccagttcgaccactttctggtgcagtacaagaatggagacggacaacctaaggccacccgggttcctggacacgaggatcgcgtcacgatcagcggccttgagcctgacaacaaatataagatgaatctatacgggtttcatggcggtcagagagtggggcccgtcagcgcgatcggggtgaccgcagcggaagaagagactccatcgccaaccgagccctccatggaggctccagagccacccgaagagcctcttttaggagaactcacagtgacgggatctagccctgacagtctgtcactttcctggacggtgccacaaggtcgatttgacagttttacagtccagtacaaggatagggatggtcggcctcaggtggtgagggttggtggtgaggagagcgaagtgaccgtgggaggactcgagcccggtcgcaagtacaaaatgcacttgtatggtctgcatgagggccggagagtgggaccagtttctacagtgggagtcacttag

SEQ ID NO: 208338 - DNA, 942 bp, Artificial Sequence
  Description of Artificial Sequence: Synthetic coding sequence
accgagcccggcaccgaggcccccggcccccccgaggagcccctgttaggcgaacttaccgtcaccggatcgtctccagatagcctgagcctaagctggacggtcccacaggggcgattcgattcttttacagttcagtataaggacagggacgggcgcccccaggcagttcgggttgggggacaggagagcaaggttacagtcaggggcctagagcccggcaggaaatataaaatgcacctttacggtttgcacgagggccggaggctcggtccagttagtgcggtgggagtgactgaggacgaggcagagactactcaagcagtccctacgatgacaccggagccgcctatcaagcccagacttggtgagctcactatgactgatgctacgcctgattctttgtccctttcctggacagttcctgaggggcagttcgaccacttccttgtccaataccggaatggagacgggcagccaaaagccgtgcgcgtaccagggcacgaagacggtgttaccatctccggactggagcctgaccacaaatacaaaatgaacctttatggctttcacggagggcaacgggtggggcccatcagtgtgatcggcgtaaccgcggcagaagaggaaaccccaagccctacagaactgtcgacggaggcacccgagcctccagaggagcccctgctcggagagttaacggtgactggatcatccccggattccctttcccttagttggacaatcccccaggggcattttgattccttcacagttcaatataaggatcgagacgggcggccgcaagttatgcgtgttcggggggaggagtcggaagtcacagtgggcggcctggagcccggtcggaagtacaagatgcacctatacgggcttcatgaggggaggagggtcggacccgtttcaaccgtaggcgtgacatag

SEQ ID NO: 208339 - DNA, 942 bp, Artificial Sequence
  Description of Artificial Sequence: Synthetic coding sequence
atgacccccgagccccccatcaagccccggctgggcgagctgaccatgaccgacgcgacccctgactcactttctttgtcttggacagtgcctgagggccaatttgaccactttttggtgcagtataggaatggggacgggcagcctaaagcagttcgggttcccgggcacgaagacggagtgaccattagcggcttggagcccgatcacaaatataagatgaacctgtacgggttccacggtggccagcgcgtcggccctatttcagtcacaggcgtgaccgctgctgaggaggagaccccatcaccgactgaactgagcacggaagcacccgagccccccgaggagcctctgctcggggagctgaccgtgacagggtcatctcctgacagtctgagcttgtcttggacaatccctcagggccattttgacagctttactgttcagtacaaggatcgggacgggagacctcaagtgatgagagttcgaggcgaagaatctgaggtaacagtggggggtctagagccaggacggaagtataaaatgcacctttatggtctgcacgagggaaggagggtgggacccgtgtccacagtcggagtcactgcacccgaggacgaagaggaggaaactcccgcacccacagagccctctactgaagccccagagccaccagaggaacccttgcttggcgaacttaccgtgacaggatctagccctgactccctcagcctgtcctggaccattcctcagggcagattcgacagctttaccgtgcagtataaggaccgagatggccgaccacaggttgtgcgagtgagaggagaggaatctgaggtgaccgtgggcggtctcgagccaggatgtaagtataaaatgcacctctatgggctccatgagggacagagagtggggcctgtcagtgcagtgggtgtgacttag

SEQ ID NO: 208340 - DNA, 1281 bp, Artificial Sequence
  Description of Artificial Sequence: Synthetic coding sequence
gccggcgaggactgcggcgaggaggtgcccaccatcgagggcatgaggatgcacttgctggaggaaactacagtcagaacggagtggacaccagcaccgggccccgtcgacgcttatgagatccaatttattcctacgaccgagggcgcaagcccgccgtttactgctagggtgccatcatcagcttcggcctacgaccagcgaggcctggcccctggacaagagtatcaagtcaccgttagagcattacgcggcacatcttggggcttgcctgcttcgaaaaccattactaccatgattgacgggccacaggacctgcgggtggtggccgtcactcccacaacgctggagcttggctggctaaggcctcaggccgaagtggacaggtttgtggtgtcttatgttagtgccggtaaccagcgcgttcggcttgaggtgcctccagaagccgatggaacccttctaacggacttgatgcctggagtggaatacgtggtcacagtaaccgctgagagggggagagcagtttcttatcccgcgagtgtacgggcaaataccgggagcagtcccctgggtctgttaggcaccaccgacgagccaccacccagtggcccctccactacacagggcgcccaagcccctctcctccagcagaggccccaggagctcggcgagctgagggtgttaggccgcgacgagactgggagactgcgtgtagtgtggacagcccagcccgatacatttgcatacttccagctccggatgagagtccctgagggacctggcgcgcatgaggaggtcctccctggtgatgtcaggcaggctctggtgccacctcctccacccggcacaccctacgaattgtctctgcacggcgttccgcccggaggaaagccaagtgacccaattatctaccagggcattatggataaagacgaagagaagccgggcaagtcgagcgggccaccaagacttggcgaactgacggtaaccgataggacctccgatagcttgctcttaaggtggaccgtgccggaaggggagtttgattcttttgtcatacagtataaagaccgggatggccagccacaggtcgtgcctgtcgaaggaccgcagaggtccgcagtgatcactagtcttgacccaggccgcaaatacaagttcgtcttgtacgggttcgtcggcaagaagcgccatgggcctttggtcgctgaggctaagattcttcctcaaagcgacccttcacccggaactccgcctcacttgggaaacctgtggtag

SEQ ID NO: 208341 - DNA, 2598 bp, Artificial Sequence
  Description of Artificial Sequence: Synthetic coding sequence
ctgtacggcctgcggggccggcagcgggtgggccccgagagcgtggtagccaagacagcacctcaggaggacgtggatgagaccccctccccgacagaactaggcactgaggcacctgaatctcctgaggagcccttacttggcgagctgacagtgacagggtccagtcctgattctctgtcgttgttttggaccgtgccccaagggtcctttgacagcttcacggtgcagtataaggacagagatgggagaccaagagccgtccgggtgggagggaaggagagcgaagtgactgtggggggactagaaccaggccacaaatataaaatgcacttatatgggttgcatgaaggacagcgagttggcccagtaagtgctgtgggcgtgaccgctccacaacaggaggaaacccctcctgctacagaatcacctcttgaaccacggctcggagagttaaccgtgaccgatgtaacccccaatagcgtaggtctgtcctggacagtgcctgagggccagttcgactcattcatagtccagtacaaagataaggatggtcagccacaggtcgtccccgtggcggcggatcagcgagaggtgactgtgtacaacctcgagcccgaaaggaagtacaagatgaatatgtatggcctgcacgatggacagcggatgggacctctgtctgtggtcatcgttaccgcgccgctgcctcccgcccccgccactgaagcgagcaaacctcctctagaaccacgacttggtgagctgacagtgaccgatattactcctgatagtgtgggactgagctggaccgtgccagagggtgagttcgacagcttcgtggtgcagtacaaagacagagacgggcagccccaggtcgtgcccgtcgccgcagaccagagggaagtgaccatccctgacttggaaccatctagaaaatataagttccttctcttcggaattcaggatggaaagagaagaagcccggtctccgtggaagcgaaaacagtcgctaggggcgatgcttctccaggagcccctccccgtcttggcgaactgtgggtcaccgaccctaccccggattctctgcgcttgtcctggactgtccccgaggggcagttcgactcatttgtggtgcagttcaaggacaaagacggccctcaggtggtgccagttgaaggccacgagcggtctgtgaccgttactcccctcgatgccggaaggaaataccggtttcttctgtatgggttgttgggcaagaaacgccacggcccactgaccgccgatggcaccaccgaggctcggagcgctatggacgacacagggaccaaaagaccccctaagccacggctgggggaagagctgcaggttacgacagtaacccagaattctgtcggtctgagctggacagtaccggaaggccagttcgactctttcgttgttcaatacaaggaccgcgatgggcagcctcaggtggtgccggtggaggggagcctgagggaggtgagcgtaccgggcctcgacccagcacataggtacaagctcctcctctacggcctgcatcacggtaagcgcgtgggtcccatctctgcagtggccatcacagccgggagggaagagactgagacagagaccactgcccccactccacctgccccagagccacacctgggagagctcactgtggaagaagctacttctcacaccctgcacttaagctggatggttacggagggagaattcgacagcttcgagatacagtatacagaccgggacggccagctccagatggttaggatcgggggcgacagaaacgacataactctgtctggactcgagtccgatcacagatacctagtgacgctctatggcttctcggatggaaagcacgttggacctgtgcacgtggaggccctgacagttcctgaagaagagaaaccttccgaaccaccaacggccacccccgagcctcctattaagcctcgcctgggagagctgaccgtgaccgacgccacccccgactcactcagtctcagttggacagttccagagggccagttcgaccatttccttgtccagtatagaaatggagacggccaacccaaggctgtccgggtcccaggccacgaagaaggcgtgacaatatctgggctggagcccgatcacaagtacaaaatgaatctgtatggttttcacggaggccagcgtatgggccctgtgtctgttgtcggcgttaccgcagctgaagaagaaacaccttcgccaacggagccatcaatggaagcgccagaacccgcggaggagcctttgttaggggaattgactgtcacggggtcctctccagatagcttaagcctgtcttggaccgtcccccaggggaggttcgatagttttacggttcagtataaagaccgggacggtcggcctcaagtggtccgggtcggtggagaggagtcagaggtgaccgtgggtggtttggaacctggcaggaagtacaagatgcatctctacggcctgcatgaagggcggagggtgggtcccgtttctgcggtgggtgtgacggcccccgaggaggaatcccccgatgccccattggcctag

SEQ ID NO: 208342 - DNA, 5208 bp, Artificial Sequence
  Description of Artificial Sequence: Synthetic coding sequence
atgagcgtgagccggaccatggaggacagctgcgagctggacctggtgtacgtcactgagcgaattatcgctgtgagctttccaagcacggccaacgaagagaacttccgctccaacctgcgagaggtggctcagatgctgaagtctaaacacggaggcaattatctcctattcaatctcagcgagcggcgcccggatatcaccaagctgcacgctaaggtgttggagttcggatggcccgatctgcacacacctgccctcgaaaaaatttgcagtatatgcaaagccatggacacatggctgaacgccgaccctcacaacgtggtggttctccacaacaaaggcaacagaggccgtatcggcgtggtgatcgctgcgtacatgcattacagcaacatttctgcctcagccgaccaggccctcgaccgattcgcaatgaagcgattctacgaggataagatagtacccattggtcaacccagtcagaggcggtacgttcactacttcagtggcctactcagcggatccataaagatgaataacaagccattatttctgcaccacgtaattatgcacggtattccaaactttgaatctaagggcggttgtcgccctttcctcaggatttaccaggcaatgcaacccgtgtataccagtggaatatataacattcccggcgattcccagacctctgtgtgcataactatcgagcccggcctcctgctcaaaggcgatattctcctcaaatgttatcataaaaagtttcggtcccctgcacgggatgtgatttttcgcgtgcaattccatacatgtgccatacatgatttgggggtcgtctttggaaaagaagacctcgacgatgccttcaaggatgatcgattccccgaatatgggaaagttgagtttgttttttcctacggccctgagaagattcaaggtatggagcacctcgaaaacggcccttctgtatctgtggactataatacaagtgatcccctgatccgatgggacagctatgataatttctcaggccatagagatgacggcatggaggaggtggtgggccacacccagggcccacttgatgggagcctgtacgcgaaggtcaagaaaaaggattctctgcacggttcaacaggggcggtgaatgctacaagaccaaccttatcggccaccccgaatcacgttgagcacacactatccgtctctagcgacagcggcaacagcaccgcgtccactaaaacagataagaccgacgagcctgtacccggggcctcttccgctacggcagcactgagcccgcaggaaaagagggagctggaccggctccttagcggttttggtctggagcgggagaaacagggggccatgtaccatacccagcatctacggtcaaggcccgcaggagggagcgctgtgccttcaagcggccgtcatgtagttccagcacaggtgcatgtgaatgggggcgctctagcatcggaaagagagactgacatacttgacgacgagctgccaaaccaggacggtcacagtgccgggtctatgggcacactgtcctcactggatggagtgaccaatacatcagagggaggatacccggaggccttgtcccctttgactaacgggctagacaagtcttatccgatggagcccatggttaacggcggggggtatccttatgagagcgccagccgtgcaggcccggcccatgccggccacactgccccaatgcggcctagctactctgcacaggaggggctcgcggggtaccagcgcgaaggtccacaccccgcatggccccagccagtgaccacgtctcattatgcacatgatcctagcgggatgtttcggagccagagctttagcgaagctgaaccccaactgccaccagcccccgtgcgcggcgggagtagtcgcgaagctgtgcagagggggctgaactcctggcagcaacagcagcaacagcagcaacaaccacggccacccccaagacagcaggagcgggcccatcttgaaagtcttgtcgcttctcgaccttcccctcagccgctggccgaaactcccatcccttcactgcctgaattccctcgggcagccagccagcaagaaattgagcagtccattgaaaccctgaacatgctcatgcttgacctagagcctgcctccgctgccgcccccctgcataagtcccaaagtgtgcccggggcatggccaggggcaagtccgttgtccagccaacctctgtcaggaagtagccgccaaagtcaccccctcactcagagccgctcagggtacatcccctccggccactctctgggcactcccgaaccagctcctcgcgcgagcctggagtccgtgccccctgggaggagctactctccatacgactaccagccctgccttgccgggccaaaccaggacttccattccaagtcccctgcatcatcctctttacctgcctttctccctaccacgcacagtccgcctgggccgcagcaaccgccagcatcactccccggtctgaccgcccagcccctgctgtctcccaaagaggcaacttccgaccctagcagaactcccgaagaagaaccattgaacttagaagggctcgtggctcatagggtggcaggcgtgcaagctcgggagaagcagcctgcagaacctcccgcgcccttaagacggcgcgcagctagcgacggccagtacgagaaccaaagccctgaggccacgagccctcgaagtcctggcgtgagatcccccgtgcagtgtgtgagtcccgagctcgctttgaccatagctctcaatccaggtggacggcccaaggagcctcacctccacagctacaaggaggccttcgaggaaatggaaggcacttcaccgtcgtcacctccccccagcggagtgagatctcctccgggcctggcaaagacaccccttagcgccttgggcctgaagccccataatccagccgacatcttactgcatcctactggcgtcacaagacgaagaatccaacctgaagaagatgagggtaaggtggtggtcagactgagcgaagagccacgaagttacgtagaaagcgtcgctaggactgctgtcgccggacccagagcccaggatagcgagcctaagtcgttcagtgctcccgctacgcaggcttatggtcacgaaattccacttaggaatggaacccttggtggctcctttgtatccccatcgcccctgtccacttcctcaccaatcttaagcgcagactcaaccagtgtgggaagtttccctagcggggaatcaagcgaccagggcccgagaactcccactcagccattactggagagtggctttcgcagcggcagccttggccaacctagcccatccgcacagaggaactatcagtccagctcccccttgccaacagtgggatcatcatattctagtcccgattattcccttcagcacttctctagcagcccggaaagtcaggcacgggcccagttctctgtggctggtgtgcacacggtgccaggctcaccccaagcgcgccaccgcaccgtcgggacaaatacaccacccagccctgggttcggctggcgagccatcaaccctagtatggccgctccctcaagcccaagcctgagtcatcaccagatgatgggtcctccagggaccggtttccatggcagtactgtttctagcccccagtctagcgctgctacaactcccgggtctccttctctgtgccggcaccctgccggcgtataccaggtgtccggactgcataataaagtggcgactaccccaggttctccgagccttggaaggcacccgggcgcacaccaagggaacctagcctctggactgcactctaacgctatcgcctcccccggcagcccttcactcggccgccatctcggcggatctgggtcggttgtccccggatcaccatgcctggaccgacacgtggcttacgggggctactcaacccccgaagatcgacggcctaccttaagtcggcaatcctctgcctcagggtaccaagccccgagcactccttcatttcccgtttctcctgcctactacccagggctgtcttccccggccactagcccttccccagacagtgccgcgtttcgtcaaggatcaccaacccctgctcttcctgaaaaacgcagaatgtcagtaggagacagggccggctccctccctaactacgccacgatcaatggaaaggtctcctcccctgtcgcatccggaatgagttcacctagtggaggctccactgtctcattcagccatacacttcccgatttttctaagtacagcatgccggacaacagcccggagacaagagccaaggtaaagttcgtccaggacactagtaagtactggtacaaacccgagattagtagagagcaggccatcgccctgttaaaggaccaggagcctggagcttttattattcgggattctcattcatttcgaggggcctatggactggccatgaaggtttcatctccacctcctacaattatgcagcagaacaaaaagggcgacatgactcatgaactcgtcagacactttctcattgagactggtccacggggggtgaaactcaaaggctgtcccaacgaaccgaactttggatcacttagcgctctggtgtaccaacattcaatcatacccctcgctttaccgtgtaaactggtgattcctaaccgagatcctacggacgaatccaaagacagctcagggcctgccaatagcaccgctgacctactaaagcagggggccgcttgcaatgtgctgtttgtgaatagtgtggacatggaaagcctaaccggacctcaagctatatcgaaggctactagtgagaccttggccgctgatcctacaccagctgccaccatagtgcacttcaaggtgtcagcgcagggtatcacgctaaccgacaaccaacgcaaactgttctttcggcgtcattaccccttgaacacggttacattttgtgatctcgatcctcaggaacgtaaatggatgaagacagaaggaggggcacccgcgaaattgttcggatttgtggcaagaaaacagggctctacaaccgacaatgcatgtcatttatttgccgagttggaccctaaccagcccgcctccgccattgttaattttgtgtcaaaagtgatgctcaatgcaggccaaaaacgttag

SEQ ID NO: 208343 - DNA, 1251 bp, Artificial Sequence
  Description of Artificial Sequence: Synthetic coding sequence
atggtgcccttccagcagcggaaggactgcgtgctggagggcagcacaagggtaacaccaagtgttcagccccacctccagccaattagaaacatgagtgtgagtcgcactatggaggattcttgcgagttagacctagtctacgttacagagagaattatcgctgttagcttccccagcacggcaaatgaagaaaacttcaggtcaaacctgcgggaagtggctcagatgctgaaatccaaacatggcgggaactacctactcttcaatctctccgagagaaggcctgatattactaagttgcacgcaaaggtactggagtttggctggcccgatttgcacactcccgcactggaaaaaatctgttcgatttgtaaggctatggatacttggctgaacgcggatccccacaacgtggtggtactgcataacaaagggaaccgggggcggattggcgtggtgattgccgcctatatgcactacagcaatatatccgctagcgcggatcaggcactcgatcgtttcgccatgaagagattctacgaggacaagatagtgccgatcggccagccaagccagaggcggtatgtacactatttcagcgggcttctgtctggttccatcaagatgaataataagccgctgtttctgcatcacgtgataatgcacggaatccccaacttcgaatctaagggcgggtgccggccgttccttaggatttatcaggctatgcagcccgtgtacacctccggaatctacaacatacccggagattctcaaacctccgtgtgcattaccatagagcctggtctgctgctgaagggtgacatcctgctcaaatgttatcataaaaaattccgttcccctgccagagacgtcatatttagggttcagttccacacttgtgcaattcatgatctcggggtagtattcggcaaggaggacttagatgatgccttcaaagacgacagattccctgagtatgggaaagtcgaattcgtcttcagttacggccctgagaagatccaaggcatggagcaccttgaaaacggaccgtccgtgagcgtcgactataacacaagcgaccccttgattaggtgggactcctatgataacttctcaggacatagagatgacggtatggaggacggcaacaaacagaataccaactcccagtcaattgggagcataagtgggggtctggaggatcaatatacctggccggacacgcactggccaagccagtcatag

SEQ ID NO: 208344 - DNA, 312 bp, Artificial Sequence
  Description of Artificial Sequence: Synthetic coding sequence
atgagcgtgagccggaccatggaggacagctgcgagctggacctggtgtacgtcacagagcgcataatagccgtgtcttttccgtccacagcaaatgaggaaaattttaggtcaaacctgagggaagtggcccagatgctgaaaagtaaacacgggggcaactacctattgtttaacctgtcagagaggagaccagacataaccaaactccacgccaaagtgctcgagtttggctggccagatctgcatactccagctttggagaaaatttgttctatatgtaaggccatggatacttggctgaatgcgtag

SEQ ID NO: 208345 - DNA, 5145 bp, Artificial Sequence
  Description of Artificial Sequence: Synthetic coding sequence
atgagcgtgagccggaccatggaggacagctgcgagctggacctggtctacgtgacagaacggataatcgctgtgagcttcccctcaacagccaatgaggagaactttagaagtaatctacgtgaagttgctcagatgttaaagtccaaacacggcggaaactatcttctgtttaatctgtccgagcggcggccggacattactaaacttcacgccaaagttctggagttcgggtggccagacctccatacacctgcgttggaaaagatatgttctatttgcaaggcaatggacacatggctgaatgctgatcctcacaacgtagtcgtgctccacaataaggggaacagagggcgcatcggggtggtcatcgcggcctacatgcactacagtaacatcagtgcatccgccgatcaagccttagaccgtttcgccatgaagaggttctacgaagacaaaattgtgccaatcggacaaccaagtcagagaaggtatgtgcactacttctccggcctactgtcgggcagtattaagatgaacaataaaccactcttcttacaccacgtaatcatgcatggtattccgaactttgagagcaagggaggatgcagaccattcctgcggatttatcaggcgatgcagccagtgtacaccagtggtatctataatattccgggagactcacaaacctctgtttgcataactattgagccgggcttgctcctgaagggggacatccttctcaagtgttaccataagaagtttcgcagtcctgccagagatgtgatcttccgggtgcagttccacacctgtgcaatccatgatctcggtgtggtgttcggcaaagaggatcttgacgacgccttcaaagacgacagattccctgaatacggtaaagtagaatttgtgttttcatatgggccagagaaaattcaggggatggaacacctcgagaacggcccttctgtttccgtggattacaataccagcgatcctctgatcagatgggacagctatgacaatttctctgggcacagggacgatgggatggaggaggttgtgggccacacacagggccctctcgatggaagcttatacgccaaggtcaagaaaaaggattccctccacggatccaccggcgctgtcaacgcgaccagacctactctctcggccacacccaatcatgtggagcacaccctgtccgtgagttccgatagtggcaactctactgccagtacaaagacagacaaaactgacgaaccagtgcccggcgccagctcagcaaccgccgctcttagcccacaggagaagcgcgagttagatcggctcctaagcgggtttgggcttgaaagggagaaacagggggccatgtaccatacacagcacctacggtcgcggcccgcaggagggtctgccgtcccaagttccggccggcatgtcgtgccagcccaggtacatgttaatggtggggctctcgcttctgagagagaaaccgacatcctggatgacgagctgcccaatcaggacggccattcggcaggtagtatgggcaccctctcttctttggatggggtcactaatacaagcgaaggcggctatcccgaggctttgtcacctctcactaatggcctggataagagctatcccatggagccgatggttaacgggggggggtacccctacgagtcggcgagcagagctggccctgcccatgcgggtcacactgctcccatgagaccttcatacagtgcccaagaagggctcgcaggttatcagcgtgaaggcccacatccagcctggccccagccagtcaccacaagccactacgcccacgacccgtccggaatgtttagatcccagagtttctctgaggctgagccacagctccctcccgcaccggttagaggaggtagcagccgagaggcagtccagcgtggattgaacagttggcagcaacagcagcagcagcaacagcaaccaaggccacctcctcgacaacaggaaagggctcaccttgagtcccttgtggccagtcggccatctcctcagccgttggccgaaactccaatccccagcttgccagaattcccccgggctgcaagccaacaagaaattgagcagagcattgaaacactgaacatgctgatgcttgatttggagcctgctagtgctgctgctcccctgcataagagccagagcgtgcccggagcttggcccggagcctcgccgttaagcagtcagccactgagtgggagctccaggcagagccatccacttacccagtccaggtctggatacattccctccgggcacagtctgggcacgcctgaaccagccccacgcgctagtctcgagtccgttcctcccggaaggtcctatagtccgtatgattaccaaccttgtctcgcaggaccaaatcaggatttccattcaaagagcccagctagttcaagcctcccggccttcctaccgaccactcactctccacccggaccacagcagccccccgcatccctgcctggcctgactgcccagcctttgctgtcaccaaaggaggccacctctgacccgtctcggacgccagaggaggagcctctgaacctagaggggttagtcgcacatcgggtggctggagtccaggcccgggaaaagcagccagccgagccccctgcccccctgaggaggcgggcagcgtctgacggtcagtatgagaaccagtccccagaggccacgagccctaggtctcccggagtgaggtcaccggtgcagtgcgtgtctcctgaactggctctgacaatagcgctgaacccaggggggaggccaaaagaaccacatctgcacagctataaggaagcattcgaggagatggaaggaacaagtccctcctctcctccacctagtggcgtgcgcagccctcctggactagctaaaactccgctgtcagccctgggacttaaaccacacaaccccgcggacatcctcttgcaccctacgggcgagccccgatcatacgttgagtctgttgcccgaacggcggtagcagggccccgcgcccaggattctgagccaaaaagtttttccgctcctgctacacaggcatatggacatgaaataccactacggaacggcacactgggaggttcctttgtcagcccctcccctctcagtacttcctcacccattcttagcgcggattcaacctctgtgggatcattccccagcggcgagtcttctgaccagggccccagaacaccaacccaacctcttttggaatcgggattccgctctggttcactcggccagccaagcccttccgcacagagaaattatcaatcctcttcgcctcttcctacagtgggtagttcctatagttcaccagattacagtttgcagcatttcagctctagccccgagtcacaggcgagagcccagttctctgtggcaggcgtgcacaccgttcctggcagcccccaggcgcggcacagaaccgtgggtaccaatacaccacccagccccggatttggttggcgagcaattaatcccagtatggccgctccatcctccccaagtctgtcccaccaccagatgatgggcccgccggggacaggcttccacggctctactgtcagctcaccccagtcttccgcggcgactacaccaggttctcccagtctttgccggcaccccgcaggagtctatcaggtgtctggcctgcataataaggtggccacaacccctggaagtccttcactgggacggcatccgggggcgcaccagggaaacctagcaagcggcctccactccaatgctatagcctcaccaggtagccctagtcttggaagacatctgggaggttctggatcagtagtgccaggcagcccatgtctcgaccggcacgtcgcgtacgggggctacagtaccccggaggacaggcggccgacactctcccggcagagctccgccagcgggtaccaggctccgagtaccccttcatttcctgtgtctcctgcttattaccctggcttatctagtcccgccacttcaccctccccggattcggctgccttcagacagggcagtccaacccctgctctccctgagaaaaggagaatgagtgtaggtgatagggccgggagcctgcccaactacgccactattaatggaaaggtgagttcacccgttgcgagtggtatgtccagcccgagcggaggctctactgtgtcattctcacataccctcccagactttagcaagtactccatgcctgataactccccggaaactcgtgcgaaagtcaaatttgttcaagatacgagcaaatactggtacaagcctgagattagtcgagaacaggctatagccctgctgaaagatcaagaacctggcgcctttatcattcgagacagtcactcgtttcggggagcatacggtctggccatgaaggttagttcacctccccccacaattatgcagcagaacaaaaaaggggacatgactcatgagctagtgagacatttcctgatcgagactggtcccagaggggtaaaactgaagggatgccctaatgaacccaattttggctcactgtctgccttggtgtaccaacactccatcattcctctggctctcccttgcaagctggtcatacccaatcgggatcccaccgacgaaagcaaggatagttccgggccagccaattcaactgctgacctcctcaaacagggagccgcctgcaacgttcttttcgttaactcagtcgatatggaatcgttgaccgggcctcaggcaatcagcaaagctacgtccgagacactggcagcggatcccacgcctgctgctacaatcgtacactttaaggtgagtgctcaaggcatcacacttacagacaatcagaggaaactgttcttccgccggcactatccacttaatactgttactttctgcgacttagacccgcaggaacgaaagtggatgaaaaccgagggtggtgcccccgcgaaactcttcggattcgtcgcgagaaaacaaggatcgaccacagataacgcttgccacctgttcgctgagctggatccaaaccaacccgccagcgccattgtgaacttcgtctctaaggttatgttaaatgcggggcaaaaaaggtag

SEQ ID NO: 208346 - DNA, 186 bp, Artificial Sequence
  Description of Artificial Sequence: Synthetic coding sequence
atgagcgtgagccggaccatggaggacagctgcgagctggacctggtttacgtaacggaaagaatcatagccgttagctttcctagtactgcaaacgaggaaaacttccggtccaacttgcgcgaagtggcacagatgcttaaaagcaaacacggaggcaactatctcttattcaacctttcctag

SEQ ID NO: 208347 - DNA, 75 bp, Artificial Sequence
  Description of Artificial Sequence: Synthetic coding sequence
atgagcgtgagccggaccatggaggacagctgcgagctggacctggtttatgtgactgagcggatcattgcgtag

SEQ ID NO: 208348 - DNA, 4338 bp, Artificial Sequence
  Description of Artificial Sequence: Synthetic coding sequence
atggaggagggccacggcctggacctgacctacatcaccgagcggatcattgccgtttctttccctgccggctgttctgaagaatcatacctgcacaatctacaggaggtgacccgaatgctaaaaagcaagcacggagataactatctcgtcctgaatctatccgagaagcggtacgacctaactaagctcaatcctaagatcatggatgtgggatggcccgagctccatgctccgccgctggacaagatgtgcacaatttgtaaagctcaggagtcctggttgaattcaaatctacagcacgtggtggtgattcactgtagaggaggcaagggacggatcggtgtcgtaatttcaagttatatgcacttcaccaacgtatctgcctctgccgatcaggccttagacagattcgctatgaagaaattttatgacgataaggttagcgccctgatgcaacccagtcaaaagaggtacgtccagttcctcagcggattgctctcagggtcagtgaaaatgaacgctagccccctgttcctgcacttcgtaatcttgcacgggacccctaacttcgacacaggtggcgtgtgccgaccattcctgaaactctaccaagcgatgcagcctgtgtacactagcggtatctataacgtgggacccgaaaatccttctcgaatctgtatcgtcatcgagcctgctcagttgctcaaaggggacgtcatggttaaatgctatcacaagaagtacaggtccgcaacaagggatgtgatcttccgcctgcaatttcacaccggggctgttcaaggctatgggttagtgtttggtaaagaggacctggacaacgccagtaaggacgataggttccctgattatgggaaagtcgaattagtgttttcggctaccccagagaagattcaggggtccgagcacctctataatgatcatggagttatcgtggactacaacaccacagatcccctgataaggtgggatagctatgaaaatctgtcagccgatggggaggtcttgcatacccaggggccggttgatgggtccctgtatgccaaagtccggaaaaagagttcatctgaccctggaatcccgggcggaccccaagcaatccctgctaccaattctccggaccactcggaccacacactctccgtaagctcggattcgggtcatagcaccgcatcggcgcgaacagacaaaaccgaggagaggcttgcccctggaaccagacgcgggttgtctgcccaggaaaaagccgagctggaccagctcctatcggggtttgggcttgaggaccctggctcaagccttaaggagatgacagatgcccgctctaaatattcagggactcgacacgtagtacccgcgcaggtccacgtcaacggcgacgctgcactcaaggaccgcgagaccgatatcttggacgacgaaatgccacaccacgacctgcattctgtagactcacttggaaccttatcatcttcagaggggccgcagtctgcccacctggggcccttcacctgccacaagagctctcagaatagtctgctatcagatggcttcggaagtaacgtgggtgaggacccacagggaacacttgtgcccgacctcggtttaggcatggacggtccttatgaaagagagagaacatttggctctcgcgaaccaaaacagccccagccactgcttaggaaaccaagcgtgagtgctcagatgcaggcatacggacagtcatcctattctacgcaaacatgggtgaggcaacagcaaatggtcgtggcccaccagtatagcttcgcacccgatggcgaggcccgactcgtgtctcgctgtcccgcagataatcctggacttgtgcaggcccagccaagagtaccactcacgccaacgagaggcactagcagcagggtcgcggtgcagcggggcgtgggttcaggcccgcacccccccgacacccagcaacccagccccagcaaggcatttaaaccccgttttccaggcgaccaggtggtaaacggagccgggcctgaactctctacaggaccgtcccctgggtctccgacgctcgacatcgaccaatcgatcgaacaactgaataggttgatccttgaactggacccaacctttgaaccaatcccaacacacatgaatgccctgggatctcaggctaacggttcagtctctcctgactccgtcggtggggggcttcgggcgtcttcccggctcccagacactggcgagggacccagtagggctacagggaggcagggcagttctgccgagcagccgctggggggcagactcagaaagctgtctcttggacagtatgataacgacgcaggtggccaactgcctttctcaaaatgcgcctggggaaaagctggtgtggattatgcccctaaccttccccccttcccttctcctgccgacgtgaaagagacgatgacccctggatatccacaggatctcgatatcatagacgggaggattttgagctcaaaggagtcaatgtgctccaccccagcctttcccgtttcgcctgagactccatacgttaaaaccgctctgcggcatccccctttcagtcccccggagccgcccctgagctcccctgcttcccagcacaagggaggacgagagcccaggtcttgtccagagactctgacgcacgccgtggggatgagcgagtccccaattggacctaaatctacaatgctgagagccgatgcctctagtaccccttcgtttcagcaggcctttgcctcctcatgcaccatcagctccaatgggcccggacaacggagagagagttcctcgtcagccgaaaggcagtgggtggaatctagccctaaaccaatggttagcttactcggaagcgggcgacccactgggtcaccattgagcgcagagttttccggaacccgcaaagacagcccggtgctgtcatgtttcccccccagtgaattgcaagctcccttccactcccatgagctgagtcttgcagagcccccagattccctcgctccaccttctagccaggccttcctgggctttggcactgcgccagtgggaagcggtctgcctcctgaggaagatctgggagcactgctagccaactcccatggcgcctcacccactccatctattcctcttacggctactggcgctgcagacaacggttttttgtctcataacttcttgacagtggctcccggtcactcatcacaccattccccaggattgcaggggcaaggcgtaaccctacccggccagcctcctctgcccgaaaaaaaacgcgcatcagagggggacagatccctgggtagcgtgtccccttcttccagcggattcagcagccctcattctggttccacaatctccataccctttccgaatgtgctccctgacttctctaaggccagcgaagctgcaagccccctccccgacagtcccggtgacaagctggtaattgttaagtttgtgcaggacaccagcaaattttggtataaggcagatatctctcgggaacaggccattgctatgctcaaagataaagagccaggctcatttatagtaagggattcccacagtttcagaggggcttatggcctggccatgaaagttgccacccctcctcctagcgtgctgcagctgaataaaaaggccggcgaccttgcgaacgagctggtacggcactttttgatcgaatgcacaccaaaaggcgtacggcttaagggttgctccaacgagccttattttggaagcctcacagccctggtatgtcaacactctattactcctctcgccttaccctgcaaacttcttattcccgaacgtgacccccttgaagagattgccgagagtagcccccagaccgctgccaactccgccgcagaattgcttaaacaaggcgctgcatgtaacgtctggtacctcaactccgtcgaaatggagtctttgaccggccatcaagccatacagaaggcactcagtataacattggtgcaggaaccacctcctgtctctactgtggtccatttcaaggtatccgcacaaggcattactttgaccgacaatcagcgcaaactattctttcgaagacattatcctgtgaacagtgtcatcttctgtgctctcgacccacaggatagaaagtggatcaaagacggaccctcaagcaaggtgtttggatttgtggccaggaaacagggcagtgcaaccgacaacgtgtgtcatctattcgcagaacacgaccctgaacagcctgcgtcagccatagtgaattttgtaagcaaagtgatgattggttcacctaagaaggtatag

SEQ ID NO: 208349 - DNA, 3618 bp, Artificial Sequence
  Description of Artificial Sequence: Synthetic coding sequence
atggaggagggccacggcctggacctgacctacatcaccgagcggatcatagcagtttcttttcccgcaggttgctcggaggaatcctacttacataatctgcaggaagttactcggatgcttaaatctaagcatggagataactatttggtgttaaacctcagcgagaaacgttacgacctgacaaaactgaaccccaaaattatggatgtgggttggcctgagctgcatgcacccccgctagacaaaatgtgcaccatctgtaaggcacaggaatcctggctcaactctaatctgcaacatgtggtggttatccactgcagaggtggtaaaggccggataggcgtggtcattagcagctacatgcacttcaccaacgtatctgcctctgcggaccaggctttagataggttcgcaatgaagaagttctacgatgataaagttagtgccctgatgcagcctagccagaaaaggtatgtgcaatttctcagtggactgctctctggcagcgtcaaaatgaacgcgtcaccgctgttccttcattttgtgattctgcacggcacaccaaacttcgacactggaggagtatgccggccattcctgaagttgtatcaggctatgcagcctgtctacacatctgggatttataacgtggggcctgagaacccctctcggatctgtatcgtcattgagcccgcccagctgttaaaaggcgacgttatgatgccacatcacgatttgcatagcgtagatagcctgggtacacttagcagtagcgagggcccacagtctgcacaccttggcccatttacttgccataagagcagccagaattctctactctccgatggtttcgggagtaatgtgggcgaagatccccagggaactctcgttccagacctgggcctggggatggacggtccctatgaaagggaacgaacatttggtagccgggaacctaagcagccccagccactgctgcggaagccgagcgtgtctgcgcagatgcaagcctacggacagagctcttatagcacccagacctgggtcaggcaacagcagatggtcgtcgctcaccagtacagtttcgcccctgacggcgaagcaaggttggtttctcgctgtcccgctgacaacccgggtctcgtccaggcccagccccgcgtgccactcacgcccactcgggggacttcatcccgggttgctgtgcagagaggtgtcggtagcggcccacatccaccggatacacagcagcctagcccaagcaaagcattcaagccgaggttccctggcgaccaggtggtgaacggggccggaccggaactgagtactggcccaagtcccggctcacccaccctggacattgaccagtccattgagcagttgaataggttgattctcgaactggaccctacattcgagccgatcccaactcatatgaatgcactaggcagccaggcaaacggatcagtgtcccccgactcagtgggtggtggcctccgcgcctcctcccgtctaccggatacaggggagggaccgtcacgcgccaccggcagacagggatcaagcgcagagcagcctctgggcggacgtctccgcaagctgtctttgggccaatacgataatgacgccgggggacagctgcctttttcgaagtgcgcgtgggggaaagcaggcgttgattacgcccctaacctgcctccctttcctagccccgccgatgtcaaagaaacaatgacacccggctacccccaggacctcgatataatcgacggtcgcatcttgagttcaaaggagagtatgtgttctactcccgctttcccagtctcccctgaaaccccatacgtcaaaaccgccctccgtcaccctcccttcagcccccccgagccccccctgagctctcctgcatcacagcacaaaggtggccgggagccccgatcttgcccagaaaccctcacccatgctgtcggcatgtccgagtcccccatcggtccaaagtctactatgctccgtgcggacgcgtcgtccaccccatccttccaacaggcctttgcctccagctgcactatttcatctaacggccctgggcagagacgggaatccagctcatcggctgaaagacagtgggtcgagtctagcccaaagcctatggtatctctgttgggctccgggcgccccaccggaagtcccctgtctgctgaattttccggtaccaggaaggactctccggttctgtcatgcttccccccatctgagcttcaggcaccctttcactcacatgagctttccctggctgagcccccagactctctggctccgcccagcagccaggccttcctaggttttggcacagcaccagtggggagcggactcccacctgaggaggacctgggcgctctcctggctaacagtcacggcgcttcgccaacgccttccatcccactgacggccacgggggccgccgacaacggttttttgtctcacaattttctcacggtggcgcctgggcattctagccaccacagtcccggactgcagggacagggtgttaccctaccggggcagccccccctgcctgagaagaaaagggcctccgaaggggacaggagcctcgggtctgtctctccgtcatccagcggattttcaagccctcactccggcagcacaatctccattccattccctaacgtgctgccagatttctccaaggcctctgaagctgcttctcccctgccggattcccccggggataaactcgtcatagtcaaattcgtgcaagacacatcaaaattttggtacaaggccgatatcagccgcgagcaagccatcgccatgctaaaggataaggagccaggaagttttatcgtcagggactcacactcctttcgtggcgcctatggattggcaatgaaggttgccacaccaccgcccagtgtgctacaactgaataagaaggccggcgatctcgctaacgaactcgttagacacttcctaatagaatgtacccccaagggtgtcaggctcaagggctgcagtaacgaaccttatttcgggtcactcacagctctggtctgtcagcatagcataacgccactggccttaccgtgtaagctgctgatccccgaaagggatcccctggaggaaatcgccgaaagtagcccgcagaccgcagctaactccgctgccgagctcctgaaacagggcgccgcctgtaacgtttggtacttaaactccgttgaaatggagtcgttgaccggacaccaggccattcaaaaagccttgtcaattaccctcgtccaggagcctccccccgtgtctacggtcgttcattttaaggtgtcagcccaggggatcactctcactgacaatcagcggaagcttttctttaggcggcactacccagtgaattccgtcatcttctgtgccctcgacccccaagaccgaaagtggatcaaggacggaccatctagtaaggtctttgggttcgtggctcgaaaacaggggagcgctactgataatgtgtgccacctgttcgcagaacatgacccagaacaaccagcgagcgccatcgtgaacttcgtctcaaaagtcatgataggctcgccgaaaaaggtgtag

SEQ ID NO: 208350 - DNA, 4338 bp, Artificial Sequence
  Description of Artificial Sequence: Synthetic coding sequence
atggaggagggccacggcctggacctgacctacatcaccgagcggatcattgcggtgtcattccccgcgggatgcagcgaggagagctacctgcacaatttgcaggaagtcacccggatgttgaaaagcaagcacggcgataactacctagtgttaaacctttccgaaaagaggtacgaccttaccaagctcaaccccaagattatggacgtcggctggcctgaattgcatgcccccccactggacaagatgtgcacaatttgcaaagctcaggaaagctggctgaattctaatctgcaacacgtggtcgtcatacactgtagaggcgggaaaggacggatcggcgtcgtgatcagctcctacatgcacttcacgaacgtaagcgcgagcgccgaccaggctctagatcggttcgctatgaaaaaattctacgatgacaaggtgagcgctctgatgcaacccagtcagaagcggtatgtgcagttcttatctgggctgctcagcggttccgtcaagatgaacgcctcacctttgttcctgcattttgtgattcttcacggcaccccgaacttcgatacaggcggcgtctgtcgacccttcctcaagttatatcaggctatgcagcccgtttacacttctggaatttataatgtgggcccagaaaaccccagccgcatttgcattgtaatcgaacctgcccagttactgaagggtgacgtgatggtcaagtgttaccataagaaatataggtccgccacccgggatgttatctttaggttgcagtttcataccggtgctgtccagggctatggtctggtgttcggcaaagaagacctggacaatgccagcaaagacgacagatttcctgattacggcaaggtcgagctcgtgttttcagctacacccgagaaaatccagggctccgagcacctttataatgaccacggagtcattgtcgattacaacacaaccgatcccctgattcgatgggacagctatgaaaacttaagtgctgacggtgaggttctgcatactcagggccctgtcgacggatcactttatgcaaaggtaaggaaaaaaagctcttctgaccctggtataccaggcggcccacaggctatcccagcgactaactccccagaccactctgatcacaccctgtcggtttccagcgattcaggacacagtactgccagcgcacgaaccgataagaccgaggaaaggctggcgccaggaacaagaagaggcctgtcggctcaggagaaagctgaactggaccagttgctttctggcttcggactggaagatcctggcagcagtctgaaggaaatgactgatgcccggagtaagtactccggcacacggcacgtcgttcctgctcaggtccatgtgaacggagacgcagccttaaaggaccgagaaactgacattcttgatgacgagatgcctcaccatgatctgcattccgttgactctttggggacactgtcaagcagcgagggcccacagtccgctcacttggggccgttcacctgccacaagagtagccagaattctctcttgagcgacggtttcgggagcaacgtcggggaagatccccagggcactctggtgcctgatttagggcttgggatggatgggccttatgagcgagaacgcactttcggaagccgggagccaaagcagccccagccactcctaagaaaaccgtccgtcagcgcacagatgcaggcctacggacagtccagctattccactcagacctgggtccgacagcagcaaatggtagtggcacatcagtactccttcgcacctgacggtgaagcccgcctggtgtcccggtgcccagccgacaaccccggtctggtgcaggcgcagccccgcgtccctttgacacccaccagggggacatcctcaagggttgctgtgcagcggggagttgggtccggtccccaccctccagatacacagcaaccatcccctagcaaggccttcaaacctagattccctggagatcaggtggtgaatggcgcagggccggagctctctacaggccccagcccggggtcccctacgctggacatcgaccagtcgatcgagcagctcaaccgactgatcttggaactcgacccaacttttgaacccatcccaacccacatgaatgctttaggctcacaggcaaacggcagcgtgtcccctgattcagttggtggcggactcagagcaagttcacgccttcccgacactggtgagggcccttcccgcgccacagggagacagggaagctctgccgaacagcccctgggtggcagactccgcaagctaagtcttggccagtatgacaacgatgccggaggccaattgcccttctccaaatgtgcctgggggaaggcaggagtcgactatgctcccaatctgccaccatttccatctcctgccgatgtcaaggagactatgactccaggttacccccaggacctggatatcattgatggtaggatcctttccagcaaagaatcaatgtgtagtacaccggctttccctgtgtcacccgagaccccctacgtgaagacggcgcttaggcatcccccatttagtcctcctgaaccaccactgtcctcacccgcctcccagcacaagggcggtagagagcccagaagctgccccgaaacactgacgcacgctgtcggtatgtctgaatcccccatcggtcctaagtctacgatgctccgagctgacgcttcctctactccaagcttccagcaagcgttcgcttccagttgtacaatctcttccaatggccccggccagcggagagagtcttccagctccgccgaacgtcagtgggtggagtctagtccaaaacccatggtatctttgttaggttcaggcagaccaacaggatctccgctgtctgctgagttttccggcacacggaaggattcccctgttctcagttgcttccccccctcagagttgcaggcaccgtttcatagccacgaactgtccctggcagagccaccagatagtctcgctcccccttcctcgcaagcttttctgggattcggaaccgcccccgtcggaagcgggctcccccccgaggaggatttgggcgctttgttggcaaattcccacggcgcttcccctaccccatcaattccactaaccgcaaccggagccgccgataatggttttctttcccataactttttgaccgtggctccagggcactcttcccaccactctccgggtctccagggtcagggcgtcacgttgcccggacagccaccactgcctgagaagaagagggcttccgaaggtgaccgtagcttgggtagcgtcagccccagcagtagcggattctcaagtccccacagcggctcaacaatatcaatcccattcccaaatgtgctgcccgacttcagcaaggcgtctgaggctgcttctccactgcctgattctccaggtgacaagctagtcatagtgaagttcgtccaggacacgtccaaattctggtataaggcagatatctctcgagagcaggctattgccatgctgaaagacaaagagcctgggtcctttattgttagagacagtcacagctttcggggagcctatgggctggcgatgaaggtggcaacaccacccccgagcgtccttcagcttaacaaaaaggcaggcgacctggcaaatgagctagtacgccacttcctcatcgagtgtaccccaaagggcgtgcggctcaaaggatgctctaatgaaccctacttcggatcactaacagctttagtttgtcagcactctataacccctttggcgttgccttgcaaactgcttataccggaacgcgacccactggaagagattgcagaatcatcaccacagactgctgcaaatagcgccgctgagttgctgaagcagggagccgcctgcaatgtctggtacttgaactctgttgaaatggagtctttgacaggacatcaggcaattcagaaggcactgtccatcaccctagtgcaggaaccaccaccagtcagtacggtggtgcactttaaggtgtctgcacagggcattacactgactgacaaccaacggaagctgttttttcggcggcattaccctgtaaacagtgtgattttctgcgccctcgatcctcaggaccggaagtggataaaggacggtccaagcagcaaagtgtttggctttgtcgcaagaaagcagggatcggccaccgacaacgtgtgccacctgttcgctgaacacgatccagagcagcctgcctcagctatagtgaatttcgtctccaaagttatgatcggctctcccaagaaggtatag

SEQ ID NO: 208351 - DNA, 327 bp, Artificial Sequence
  Description of Artificial Sequence: Synthetic coding sequence
atggaggagggccacggcctggacctgacctacatcaccgagcggatcattgctgtgtctttccccgctggctgcagcgaagaaagctatctgcacaatctgcaggaggtgacacgtatgcttaaatctaaacacggggacaattatctcgtgcttaatctgtccgagaagcgttatgatttgacaaagctaaaccctaagatcatggatgtgggatggcctgagctgcacgcccccccattagacaagatgtgtaccatatgcaaggcgcaggaatcctggctgaatagcaacttgcagcacgtcgttgtgattcattgccggtag

SEQ ID NO: 208352 - DNA, 417 bp, Artificial Sequence
  Description of Artificial Sequence: Synthetic coding sequence
atggaggagggccacggcctggacctgacctacatcaccgagcggataatagctgtgtctttcccagccggctgtagtgaagagtcatacctgcataatctgcaggaggtaacgcgcatgctcaaaagcaagcacggagacaattatctggtgcttaatctgtcggagaagcgctacgatttgacaaaactgaaccccaagattatggatgtcgggtggcctgagctacacgctccgccactcgacaaaatgtgtaccatttgtaaagcccaggagtcatggttgaactcaaatctccaacatgttgttgtaatccactgtcggggaggaaaaggccggattggcgtcgtgatatcctcttacatgcattttaccaatgtctctgctagcgccgaccaagctctggacaggttttag

SEQ ID NO: 208353 - DNA, 753 bp, Artificial Sequence
  Description of Artificial Sequence: Synthetic coding sequence
atggaggagggccacggcctggacctgacctacatcaccgagcggataattgcagtgagcttcccggccgggtgctctgaggagtcctacctgcacaaccttcaagaagtcacgagaatgttgaaatcaaaacatggcgacaactatttggtgcttaatctgtcagagaaacgctacgatctcaccaagctgaaccctaaaataatggacgtcggctggcctgaactgcatgccccccccctcgataagatgtgcacaatatgcaaggcacaggagtcatggctcaacagtaatctgcagcacgtggtggtgatccactgtagaggcggcaaaggccgcatcggcgtggtcatatcatcctacatgcactttactaatgtgtcagcctctgcagaccaagcgctggaccggttcgctatgaaaaaattctatgacgataaggtctcagcacttatgcagcccagtcaaaaacggtacgtacagttcttaagcggactactgtccgggagtgtgaagatgaacgcctcacccctttttctccatttcgtgatactgcacggtacccctaacttcgatacagggggagtgtgccggccctttctcaaactgtaccaggctatgcagccagtctacacatcagggatctacaacgttggcccagaaaatccaagccggatctgcattgtaattgagcccgcccaactgttgaaaggcgacgtgatggtcatgaattataatattgccaacatttag

SEQ ID NO: 208354 - DNA, 753 bp, Artificial Sequence
  Description of Artificial Sequence: Synthetic coding sequence
atggaggagggccacggcctggacctgacctacatcaccgagcggatcatcgctgtgagttttcccgcagggtgctccgaggaaagttatctgcataacctgcaagaagtgacaagaatgttgaagtctaagcacggggacaattacttggtgctgaatctgagcgagaagagatacgacttaactaagctgaaccccaagatcatggatgtgggctggcccgaactccacgcccctcccctggataaaatgtgcaccatttgtaaagcacaggagtcttggctgaatagtaacctccaacacgtggtggtgatacactgtagagggggcaaaggccgtattggagttgtcatatctagctacatgcattttaccaacgtttcagcgagtgccgaccaggcgcttgataggtttgccatgaagaagttttatgatgacaaggttagcgcccttatgcagcccagccagaaacggtacgtgcagttcttgagcgggctgttatcgggctcagttaagatgaacgctagtcctctgttccttcacttcgtgatcctacatggtacaccaaacttcgacacagggggtgtctgccggccttttctcaaactgtaccaggcgatgcagcccgtctatacgtccgggatttacaatgtgggacctgagaacccatctagaatttgcatagttatcgagcccgcccagctcctcaagggagatgtcatggtgatgaattataatattgccaacatctag

SEQ ID NO: 208355 - DNA, 3816 bp, Artificial Sequence
  Description of Artificial Sequence: Synthetic coding sequence
agccaggccctgaacgagcggatgaactggctgtgccggaaccaggatccaaatccaccaccgcaacccgaagagctgactagctcgctacacgctttcaaaaacaaggcctttaagaaatcaaaggtatgcggcgtttgtaagcaaatcatagacggccagggaattagttgtagagcgtgtaagtatagctgtcacaaaaagtgtgaggctaaagtcgtcattccatgcggagttcaggtgagactggagcaagcaccgggatcaagtaccctgagcagttctttgtgccgggacaaacccctgcgcccagttatcttgagtcccaccatggaggaggggcacggtctggatctcacctatataacggaacgaataatcgcagtgtccttccccgccggctgctctgaagagagctacctacacaatctgcaagaggtcacccggatgctgaaatcaaagcatggcgacaattacctggtactgaacctgtcagaaaagcggtacgacctcactaagttaaatcctaaaattatggacgtgggatggccggagcttcacgcccccccgttagacaaaatgtgtaccatctgtaaggctcaggaaagctggctgaacagtaatctgcaacacgtggttgtaatacactgtcgcggaggtaaaggcagaatcggcgtggtgatttcttcttatatgcactttactaatgtctctgcgtctgccgaccaggcattggaccgtttcgccatgaagaagttctacgatgacaaagtgagcgctttaatgcagccttctcaaaagaggtacgttcaattcctctccggactgctgagcggaagcgtgaagatgaacgcaagcccattgtttctgcactttgtcatcctgcatggcacacccaatttcgacacgggcggcgtctgtcggccatttttgaaattataccaggcaatgcaacctgtgtacacctcaggaatctataacgtcggccctgaaaatccctccaggatctgtatagttatagagccagctcagttacttaagggggacgtaatggtcaaatgctatcataagaaataccgcagcgcgacaagagatgtgatatttagactgcagtttcatacgggcgctgtacagggttatggtctcgtattcggcaaggaggacctggacaacgcaagcaaggatgatcgctttcccgattacggtaaggtggaacttgtgttcagtgccactccggagaaaattcaggggagcgagcacctgtacaacgaccatggtgtgatcgtggattataacacaacggacccactgatcaggtgggacagctatgaaaacttgagcgcggatggtgaggtgcttcatacacagggacccgttgacgggagcctatacgcaaaagtgagaaagaagtccagcagtgatcctggcattcccggtggcccccaggccattcctgcaactaactctcctgatcactccgatcacacattaagtgtcagcagcgatagcggccactccacagcctctgctagaactgacaagacggaggaacgcttagccccaggcacaagacggggcctgtccgcgcaggagaaggctgaactcgaccagctgttgtctgggttcggcctggaggaccctgggagcagcctcaaagagatgacagatgctagaagtaagtattcagggacacgacatgtagttccggcacaggtgcacgtgaacggagacgcggctttgaaggacagagaaactgacatactggatgacgaaatgccccatcacgatcttcactccgtcgacagcctgggcaccctatcgtcctcagaggggccccagtccgcccacctcggtccattcacctgccacaaatcctctcagaactctctgctgagcgacggcttcggaagcaatgttggcgaggatccacaggggaccttggtcccagatctgggtctaggtatggatggcccctacgaacgcgagcgcactttcggttccagggaacccaaacaacctcagcctcttctgcgaaagccgtctgtcagcgcgcagatgcaggcgtatggccagtctagctactcgacccagacatgggtgaggcagcagcagatggtagttgcacaccagtactctttcgcccctgatggtgaggcgagactggtgtcaagatgtccggccgataatcctgggcttgtgcaggcccaacctagggtgcccttgaccccaacacgcggtacgagttctcgcgtcgcagtgcaaaggggagtcggcagcggacctcacccgcctgacactcagcagccatcgcccagcaaggccttcaaaccccggtttcccggggaccaagtagtgaacggggccggacccgagcttagtacaggtcctagccccgggtctccgaccctcgacatcgaccagtctatcgagcagctcaacagactaatcctggaactcgatcccacttttgagccgatccccacacatatgaatgccctgggatcccaggctaatggatcggtgtcaccagattccgtcggtgggggactgagggcttcctcgcggttacccgatacaggggagggtccttcacgagcaacaggccgccaggggtcctccgccgaacagccactgggaggccgcctccggaagctgtcactcggacagtatgataatgacgcgggtgggcagctgccattttccaagtgcgcctggggcaaagcaggggtggactacgcccccaacttgccaccatttccctctccggcggatgtgaaggagaccatgacaccaggctatccacaggatctggatataatcgatggaaggattttatccagcaaagagtccatgtgctccacgcccgctttcccggtgagccccgaaactccgtacgtgaagactgctctcaggcatccgcccttcagcccccccgagcctcctctctcttcccccgcttcccagcataaagggggtagggagccgcgctcatgtcccgagaccctgacacatgctgtggggatgtcagaaagcccgattggaccgaagtcaacaatgctccgtgccgacgccagctctactccgagctttcaacaggccttcgccagctcttgcaccatttcaagcaacgggcccggtcagagacgggagagttcctctagtgccgagcggcagtgggttgaaagtagccctaaacctatggtatctctgttaggttccggtagaccaacaggttctcctctgtccgcggagttcagcggaacaagaaaagattctcccgtactgagttgtttcccacccagcgaactacaggcccccttccactctcacgagttatccctcgcggaacctcctgacagcctcgcacctcctagctctcaggccttcttgggcttcggtaccgcccccgtgggctccgggctgcctccagaggaagatttgggtgccctgctagctaacagtcacggtgcttcaccaaccccgtccatccccctaacagctactggtgccgccgacaacggttttctgtcacacaacttcctcaccgtggctccaggtcactcctctcaccatagtcctggcttgcaaggccaaggagtgactcttcctggtcagcctccattaccagaaaagaagcgcgcctcagagggagacaggtccctaggctccgtgtctccttccagcagcggattttccagtccgcactcgggctcaaccatctctatcccatttccaaacgtgctaccggatttttccaaggcctccgaggctcctacattctaccaaacatcaaagccggacatccctggaccgtag

SEQ ID NO: 208356 - DNA, 2760 bp, Artificial Sequence
  Description of Artificial Sequence: Synthetic coding sequence
atggacggcccctacgagcgggagcggaccttcggcagccgggagccgaaacaacctcagccattactacgtaagcctagcgtatccgcgcagatgcaggcatacggacagagtagctatagcacccaaacttgggtgcgccagcagcagatggtcgtagcacaccagtactcattcgctcccgacggggaggctaggttggtgagtagatgtccagccgataaccccggtctggtgcaggcacagccaagagtccccttgacccctacgaggggcacctcaagcagggtggccgttcagagaggcgttggtagcggtccccatccacctgacacacaacagcccagtccaagcaaggcctttaaacccagattccccggggatcaggtggttaatggtgcaggtcccgagctgtcaacaggcccatctccgggctcacccaccctcgacatcgatcagagtatagagcaactgaacaggctcatcctcgaattagatcctacatttgaaccaattccaacccacatgaacgctttaggcagccaggcaaacgggagtgtttctccagattcggttggcgggggactgagagcttcaagcaggttgcccgacacaggggagggtcctagccgcgcaaccggccggcagggctcctccgctgagcagcctctgggtggccgactgagaaaattgtcactgggccaatatgacaatgacgctggggggcagctccctttttctaagtgcgcctgggggaaagccggcgtggattatgctcctaatctgccaccctttccctcaccagccgatgttaaagagacaatgacccccggatacccacaggatctggacatcattgatggtcggattctaagctcaaaggaatccatgtgcagcacaccggccttccccgtctcaccagagaccccttatgtgaaaactgcactacggcaccctccgttctcccctcccgagcctcctctgtcttcgcctgcatctcagcataagggggggagagagcctcggagctgtcctgaaacactgacacacgctgtcggtatgagcgagagtcccattggtcccaaaagcaccatgctgcgggcagacgcatcttcaacaccttcctttcagcaggcttttgctagttcttgtaccatctcgagcaacggcccaggccagcgacgcgaatctagcagtagcgctgagaggcagtgggtggagtcctcacccaaacctatggtgtccctactcgggtctggccgcccaactggctctccgctttcagccgaattctctgggacgcgtaaggatagtcccgtgctgtcttgtttccctccgagcgagcttcaggccccctttcatagccacgagttgagcctagctgaaccaccagacagtcttgcccctccctcgtcacaggcgttcctgggctttggaacagctcccgtgggttctggattgccccccgaggaagacttgggagcactgctggcgaatagccacggcgcctcaccaacgccatcgattccactgaccgccacaggagctgctgataatggatttctgtcacataattttctgaccgtggccccaggccattctagtcaccatagcccgggcctgcagggtcagggcgttacattgccgggacagccacccttgcccgagaaaaagcgcgcttctgagggagatagaagcctgggaagcgtctctccaagtagctccggtttttcgtctccacattccggatcgacaatcagtatccctttcccgaatgtcctccccgactttagcaaagcttcagaggctgcctcccccttgccagacagcccgggggataagttagtcatcgtcaaatttgttcaggatactagtaagttttggtacaaagcggacatctccagagaacaggccattgctatgctgaaggataaggagcctgggtcttttattgtccgggacagccactcttttaggggagcatacggactggccatgaaggtagccacccccccaccttctgtactccagctgaataagaaggctggggatctggctaacgaattagtcaggcattttttaatagaatgtaccccaaagggcgtgcgtttgaaaggctgcagcaacgagccatattttggctcccttactgccttggtttgtcagcacagcattacccctctggctttgccgtgcaagcttctgatccccgagcgcgatcccctggaggaaatcgcagagagttctccccagaccgcagcgaattctgcggccgaactgctgaagcagggggccgcctgtaatgtgtggtatctgaacagtgtcgagatggagtcactgaccggacaccaggctatccagaaggctctgtcaatcaccctggttcaggaacctccccccgtctccaccgttgtccacttcaaagtatcagcgcaggggattacactgaccgacaaccagcggaaactctttttcagaaggcactaccccgtcaacagcgtgattttctgtgcattggatcctcaagataggaaatggataaaggacggaccctctagcaaagtttttggattcgtcgccaggaagcagggctctgccacggacaacgtgtgtcatcttttcgcagagcacgatccggagcagcctgcccgcgagtcccagagacatagaggggcaagggacggacctcacgaggctatgcctaggcgacactctggatcgccagcaaatgtattgtttgagttgatcggccaggtctag

SEQ ID NO: 208357 - DNA, 2148 bp, Artificial Sequence
  Description of Artificial Sequence: Synthetic coding sequence
atgagccaggtgatgagcagccccctgctggccggcggccacgccgtaagtctcgcgccctgcgacgagccccggcggacactccacccggcaccaagccctagcctccctccccaatgctcttattatacgaccgagggatggggcgcacaggcccttatggcgccagtgccgtgtatggggccgccaggaagactgcaacaggcccctcaagtcgaggccaaggccacttgttttctaccatcacccggcgagaaagccctcggcacccccgaagacctggactcatatattgattttagcctggaatctttgaaccagatgatcctggagcttgacccgacgtttcagcttctccctcctggcactgggggtagtcaggccgaactcgcccagtccacgatgtctatgcgaaaaaaagaggaatcagaagcacttgacatcaagtatattgaggtgacgtcagcccgatctcgctgccatgatggaccacagcactgctcatccccttccgttactccgcctttcgggagcctgaggtctgggggacttctgctgtctagggacgtcccacgcgaaacccgcagtagtagcgaatccctgattttctctgggaatcagggccgtgggcaccagcggcccctgccgccctccgagggcctttcacctcgcccgccaaacagcccatctatttccattccttgtatgggctcgaaagctagttctccacacggcttggggtctcctctggtggccagcccccggttagagaagagacttgggggtcttgcgccacaaagaggctccagaattagtgtcctctctgcctctcccgttagtgacgtgtcgtatatgtttggcagttcacagtctctcctgcactcttccaacagctctcaccagagtagtagtcgctcattggaatctcccgctaacagttcgtcctcactgcattctctgggatcagtgtctctgtgcacccggcccagtgactttcaggcaccgaggaatcccacgcttaccatgggacagccacgcacgccgcatagtcctccattggctaaggagcatgcctcctcatgtccccccagcatcacgaatagcatggtggatatccccattgtcctaatcaacggatgcccggagccaggttcctcccccccccaacgtacccctggtcaccaaaacagtgtccagcctggagctgcgtcacccagtaacccgtgcccagccacacggtctaactctcagactctgagcgacgcaccgtttacaacgtgcccagaaggtcccgctagggacatgcaacccacgatgaagttcgtgatggatacctcaaaatattggttcaagcccaacatcacaagggagcaggccattgagctgctgagaaaggaggagcctggcgcattcgtaattagggacagctccagctacagaggaagcttcggtctggcgctgaaggtgcaggaggtgccagcctcagcccagagcagacccggtgaagacagcaacgatttaatacgccatttccttattgagtcaagtgctaaaggcgtgcacttgaagggagctgacgaggagccgtactttggcagtctgtccgcttttgtgtgccaacacagtattatggcgctagcacttccttgcaaactgacgatcccacaacgggaactcggaggcgcggacggggctagcgattcaacagattcgccggcatcatgccaaaagaaaagcgccggatgtcacactttgtacctgtctagcgtctctgtcgaaacactgacaggagccttggccgtgcagaaggctattagtaccacatttgagcgagatatcttgccaacacctaccgtggtacacttcaaagtgaccgagcaagggatcacattgactgacgtgcagaggaaggtgttctttagacgacactacccattgacgaccctgcgcttttgtggtatggatccagagcagcgcaaatggcagaaatattgcaagccctcatggatttttgggtttgtcgccaaatctcagacagaaccccaagaaaatgtgtgtcacctattcgcagagtatgacatggttcagcccgcctcacaggtgataggcctggtgactgccctgcttcaggatgcagagcgcatgtag

SEQ ID NO: 208358 - DNA, 2148 bp, Artificial Sequence
  Description of Artificial Sequence: Synthetic coding sequence
atgagccaggtgatgagcagccccctgctggccggcggccacgccgtatctctggccccttgtgatgaaccccgtagaacactccaccccgctccgtccccgagcctcccaccgcagtgttcctattataccacagaaggttggggtgcccaggccctcatggctccggtaccttgcatgggaccaccaggacgcctgcagcaggcaccgcaggtggaggccaaggccacttgttttctcccatctccgggggagaaggccctcggaacccctgaggacctcgatagctatattgatttctcattggagagcttgaaccaaatgattctcgagctggatcccacgttccagcttctccccccggggaccggtggatctcaagctgaactcgcacagtcaacaatgagtatgcgcaagaaggaggagagtgaggccctggacattaaatacatcgaagtgacaagcgctcgcagtcgttgtcacgatgggccccaacattgctcttccccgtctgtaaccccccctttcggaagcttgaggtccgggggcctgctactgtctcgcgatgttcctagagaaactagatctagcagtgagtccctgattttttccgggaaccagggtagagggcatcaaaggccattgcctccatctgagggcctgagtcccagacctccgaactccccgtccatcagcattccctgcatgggatccaaagcaagctcaccacatggtcttggcagtccgctagtggcctctccacgcctggagaagcgactgggcggtctggcccctcagcgcggatctcggatatctgtgctgagtgcctctcccgtgtccgacgtgtcatacatgttcggcagtagccaatccctgctgcattccagtaattcttctcatcaatcaagcagtcgcagcctggaatctccagcaaattccagttcctcccttcactcccttgggagtgtctccttgtgtacgcgaccgtctgattttcaggctcccaggaaccctacccttaccatgggacagccccggaccccacatagccccccgctcgcgaaagaacatgcttcaagctgtcccccctcaattaccaattcgatggtggacatccccatcgttctgatcaacggatgtcctgaacccggatctagtccaccccaacgcactcccggccaccaaaactccgttcagcccggggccgcctcaccttccaacccgtgccctgctacccggtctaacagccaaacgctatccgacgccccctttaccacgtgccccgaggggcccgctcgagacatgcagcccaccatgaagttcgtgatggacacatccaaatattggttcaagccgaatatcaccagggagcaggccattgaactcctgaggaaggaagagcctggcgcattcgttatcagggattcatcaagctatcgcggctcattcgggttagcgctcaaggtgcaagaggtgcccgcctctgcccaaagccgcccaggagaagacagtaatgacctgattaggcatttcctcattgaatccagtgccaagggcgtccacctcaagggggctgacgaggaaccatatttcggttcactctcagccttcgtgtgtcaacatagtattatggccctagcccttccctgcaaactcacaatcccacaacgagagctcggcggagccgacggcgccagcgattccacagattccccagcgtcttgccaaaaaaagtccgccgggtgtcacaccctctatctctcttcggtctccgtcgagacactgaccggggccctggccgtgcagaaggctataagcactacatttgaacgcgacatcttgccgaccccaaccgtcgtgcatttcaaggtcacggagcaaggcataaccctgacagacgtgcaacgtaaggtattctttagacgacactatcccctaacaaccttgcgcttctgcggcatggaccctgaacaaaggaaatggcagaaatattgcaagccaagttggatttttggatttgtggctaaatctcagacggaaccccaagagaacgtgtgccacctgttcgcagagtacgacatggtgcagccggcatcacaggtgattgggctggttacagctctcctccaggacgctgaacggatgtag

SEQ ID NO: 208359 - DNA, 387 bp, Artificial Sequence
  Description of Artificial Sequence: Synthetic coding sequence
atgcggcccgtgcccgtgcggggcgtgcacagcctgcacccccggcccttcggggggcccgtgagcctgccctggctgcgcaccgggaggtgtcgttgggggctgggtctgtacagacagcctagcttgctgcccgaggagatttgcggggtgttcttccgccggcactatcctctgactactttgcgattttgtggtatggatccagagcaacggaaatggcagaaatactgtaaaccctcctggatatttggattcgtggcaaaatctcaaacagaaccacaggaaaacgtgtgtcacctattcgcagaatacgacatggtgcagccggcgtcacaggtcattggactggtgaccgcactcctccaggatgccgagaggatgtag

SEQ ID NO: 208360 - DNA, 4230 bp, Artificial Sequence
  Description of Artificial Sequence: Synthetic coding sequence
atgaagagcagcggccccgtggagcggctgctgcgggccctgggccgccgcgatagtagccgcgcagcgagcaggcccagaaaggccgagccacactccttcagagaaaaagtctttaggaagaagccacctgtctgcgcagtgtgtaaggttaccatagatggcactggagtcagctgtcgggtctgcaaggttgccacccaccgaaagtgcgaggccaaggtcacctcggcgtgccaggctcttccccccgtagagctacgtcgcaacactgcgcctgtccgaagaatcgagcacctcggcagcactaaatctctcaatcattctaagcagcggtccactcttcccagaagcttctcccttgatccactaatggaacgcaggtgggacctggatctgacttacgttaccgagcgtattctcgcagctgcgtttcccgcgagacccgacgagcagaggcacagaggccatctcagagagctagctcatgtgcttcagagtaaacatcgagataagtacttactgttcaacctctcggaaaagcgacatgatttgacacgactgaaccccaaagtccaggattttggctggccagagcttcacgccccacccctggataagttgtgcagtatctgtaaggctatggagacatggcttagcgctgatccgcagcacgtcgtggtgctttattgcaaaggcaacaagggaaaactgggggtgatagtctccgcatacatgcactattccaaaatatcagctggcgcggatcaggcgctggcaaccttgactatgagaaagttctgtgaggataaggttgccaccgagctacaaccaagccagcgaaggtacatctcctactttagtggactcctgagcggaagcatccgaatgaacagctcccccctgttcctccactatgtgctgatcccgatgctgccagcctttgaaccaggaaccggatttcaaccgtttctcaagatctaccaaagtatgcaactggtctacacatctggagtgtaccatatcgccggtccaggccctcagcagctgtgcatatcactggaacctgccttgcttctgaaaggagatgtcatggtcacatgttaccataagggtggaaggggaaccgatcgcacactcgtgtttcgcgtgcagttccatacctgtactatacatgggccacaattaacctttcccaaagaccagctcgatgaagcctggactgacgagaggttccctttccaggcctctgttgaattcgtgttctcttcatccccagaaaagataaaggggagcactcctcggaacgacccctcagtgtctgtggattataataccacagagccagctgtccgatgggactcctacgagaattttaatcagcatcacgaggacagtgtggacggctcactcacacatacccgcgggccccttgatggatctccatatgcccaggttcaacggccgccccggcaaacaccacctgcaccttcccctgaacctccaccaccgcccatgctgagcgtgtcaagcgactcgggccatagctcaactctgacaacagagccggccgccgaatccccaggacggcctcctccaaccgcagctgagcgccaggagcttgacaggctgctgggaggatgtggagtcgcctcaggaggaaggggcgctggcagggagaccgcaatactggacgatgaggaacagccgaccgtggggggcggcccccatcttggcgtatatcccggtcaccgccccggccttagcaggcactgcagttgcagacaaggatatcgcgagccatgcggagtgcctaatggcggatattacaggccggagggtaccttggagcgacggaggttggcctatgggggctacgaaggtagtccgcaaggctatgctgaggccagcatggagaaaagacgcctatgcaggagtctctctgaaggactgtacccatatcctccggagatgggtaagcccgccactggtgacttcggctatcgggcccccgggtatcgcgaggtagtgattttggaagacccaggactgcccgccttatacccctgccccgcttgtgaagagaagctcgcactccctacagccgctctttacggcctgagactcgagcgggaggccggagaaggctgggcctctgaggccggcaaacctttgctccatccagtgaggcctgggcatccattacctttactgctgcccgcctgtggacaccaccacgctcctatgccggactattcttgcctgaagccacctaaagccggcgaggagggtcacgaggggtgttcttatacgatgtgccccgaaggccgctatggccatcctggatatcctgcactggtgacctatagctacggaggggcggtcccaagttactgtcctgcctacggaagagttccccactcctgcggctccccgggggagggaagggggtacccttctccaggggctcatagtccccgggccggttccatctcaccaggatccccaccctatccacaatcccggaaactcagctatgagatacctaccgaggagggaggagatcggtatccacttcctggacacctcgcatccgccggcccacttgcttccgcagagagcctcgagcccgtgtcctggagggagggcccctcagggcactcaactctgcctagaagcccccgggatgccccttgcagcgcgtcatcagaactgtccggcccatccacacccctccatacgtcctcaccagtgcaggggaaggagtccaccaggagacaagacacgcggtcccccacttctgcccctacacaacgactctcaccgggtgaggccttaccccctgtgtcccaggccggcaccgggaaagctcccgagctgccttccggctctggcccagaacctctggccccttcgccagtctccccaacatttcctcctagctctccttctgactggccccaggagagaagtccgggcggacattctgacggggccagccctcgcagtcccgttcctactacgctccctggactgagacacgctccatggcaggggccaagggggcctcctgatagccctgacgggagtccgctgacaccagtgccatctcaaatgccctggctggtggcctcccccgagcctccacagagtagtcccacccctgcgttcccccttgccgctagctacgatactaatgggctgagtcagcccccactgcctgaaaagcgtcacctgccaggaccggggcagcagccagggccttggggacccgagcaggcctcttcacctgcccgaggcatctcccaccacgtgacttttgcacccctgttgagtgataacgttccccagacacccgagccgcctacacaggaatcacagagcaacgttaagtttgtccaggatacctcgaagttctggtataagccccatcttagccgcgaccaggccatagccttgctgaaagacaaagaccctggagccttcctgattcgggactcgcacagcttccaaggagcctacggcttggctctaaaggtggctacgccccccccctcagcccagccctggaagggtgatcctgtagaacagctggtgcggcattttttgattgaaaccgggcccaaaggggttaagattaaagggtgcccaagcgagccttacttcggatccctgtcggcccttgtctcccaacacagtatctcgccaatatctctgccctgctgtctgaggatcccctctaaagaccccctagaagaaactccagaggctcccgtccccacgaacatgtcgactgccgcagatttactgagacagggcgcagcctgtagcgtgttgtatttgaccagtgtcgaaaccgagtcactgactggaccccaggctgtcgcaagggcttcttcagctgccctatcctgtagcccacgcccaacaccagccgtggtgcattttaaggtgagcgcacaggggattaccctgaccgataaccagagaaagctgttctttcgccggcactaccccgtcaacagcattacattcagctcaacagacccgcaggacagacgctggactaatccagacgggactaccagtaagatctttggatttgtggccaagaaacctgggagtccctgggagaacgtctgtcacttgttcgccgagctcgatcctgatcagccagccggagcgatagtgactttcattacaaaggtgctcctgggtcagcgaaagtag

SEQ ID NO: 208361 - DNA, 4260 bp, Artificial Sequence
  Description of Artificial Sequence: Synthetic coding sequence
atggacggcggcggcgtgtgcgtgggccggggcgacctgctgagcagcccccaggctttgggacagttattgcggaaggaatctagacctcgaagagcaatgaagccccgcaaggcagaaccacactccttcagggaaaaggtctttcggaaaaagccccctgtctgcgcagtttgcaaagtaacaattgatggcactggggtgtcgtgtagggtctgcaaggtggcaacccacaggaagtgtgaggctaaggtcacgtctgcctgccaggccttgccacctgtggaactaaggagaaacacagccccagtgcggcggatcgagcacctgggctcaacaaagagcctcaaccacagtaaacaaaggagcacgctccctcgctccttttccctcgatcctttgatggagaggagatgggatctcgacctgacctacgtgaccgagaggatcctcgccgctgcatttcccgcgagaccagatgaacagaggcaccgtgggcacctgagagaactggcgcacgtgctgcagtccaaacacagagacaagtacctgctgtttaatttgtccgagaaacgccacgatcttacacgactcaacccgaaggttcaggatttcgggtggcccgaacttcatgcccctccgctggataagttgtgctctatctgtaaagccatggaaacttggctgtctgccgatcctcagcacgttgtggtgctttattgtaaggggaataagggtaaactaggagtgattgtgagtgcttacatgcattactcaaaaatttccgcgggagcggaccaggcactcgcgactctaacaatgagaaagttctgcgaggataaggtggcaactgaactgcagcccagtcagcgccggtacatttcctatttctccggcctgttgagcgggtctatcagaatgaactctagccccctgttcctccactacgtcctgataccaatgctccccgctttcgagcccggcacaggctttcagccattcttgaagatctatcagtccatgcagctggtgtacacttccggcgtgtatcacatcgccggcccaggtccacagcaactgtgtattagcctcgaaccggctcttctcctaaagggggacgtcatggtgacctgctaccataagggcggacgggggaccgaccggacactggtcttcagggttcagtttcacacctgcacaatccacggaccccaattaactttcccgaaggaccagctggacgaagcttggaccgacgaaaggttcccgtttcaggcatcagtggaattcgtcttttcaagctctcccgaaaagattaagggatcgaccccccgcaatgacccttccgtaagtgtggattataacaccactgagccagctgtacggtgggattcctatgaaaatttcaatcaacaccacgaagactcggtggacggatccctgacccatacccgcggacctctcgatggaagtccatatgcgcaagtgcagcgaccgcctcggcagaccccaccagcaccgagccccgagccgcctccccctccaatgttgtcggtgtcctctgattccggtcactcgagtaccctcactactgagcctgctgctgagtctccgggacggccccctccgaccgcggccgaacgccaggaattggatagactcttgggcggctgcggcgtggccagtggcggaagaggagccgggcgagagactgccattcttgacgatgaggagcagccgacagtgggcggtggccctcacctgggcgtgtatcctgggcatcggcccggactctctaggcattgttcatgtaggcaggggtaccgggagccatgtggcgttcccaacggcggctactaccggcctgaaggaacacttgagaggagacgcctcgcatacggggggtatgagggatctccacaaggatacgccgaggcctcaatggagaaacgccgcttatgcaggtccctcagcgagggactttatccttatccacctgagatgggaaagccggccactggcgacttcgggtatcgagcaccgggctaccgggaggtcgtgatactggaggatcccggtttacccgctctgtatccttgccccgcttgtgaggagaagctcgctctgccgacagcagctctgtatgggctgcgactcgagagagaggctggagagggatgggcttccgaggctggtaaaccgttactgcacccagtccggcccggacatcccctccctcttctattaccagcttgtggacatcaccacgctccaatgcccgactatagctgcctgaagccaccaaaggccggtgaggaggggcacgagggctgttcctatacgatgtgtcccgaagggagatacggccacccaggataccccgccctcgtcacttatagctatggcggtgccgtgccgtcatactgtccagcctacggtcgtgtaccccacagttgtgggagcccaggcgaagggcgcgggtaccctagtcccggtgctcatagtccacgggcaggctctatctctcccggctctcctccctatccgcaaagccgcaagctcagttacgagattcctacagaggaagggggtgatcggtaccccctgcctggacacctggccagcgccgggccccttgctagcgccgagtcattggagcccgtcagctggagagagggccctagcggccatagcaccctgccccgttctccgcgagatgccccctgcagcgccagctcggaactgagcggcccctcaacccctttacatactagctcacctgtgcagggcaaggaatcaacccgtcgccaagatacgagatcccctacatctgcgccaactcaaaggctctcccccggcgaggccttgccgcccgtgtcccaagctgggacaggaaaggcacccgagctgccgtccggcagcgggcctgagccgctggccccatcccctgtgtctccaactttcccccctagctctccttccgattggccacaggagcgaagccccggggggcattcagacggcgccagccctcggagccctgtgccgacgacattgccaggcctccggcacgccccgtggcaaggaccaagaggaccaccagactccccagatgggagccccctgacacctgtaccaagtcagatgccttggcttgttgcaagtccggaacccccacaaagcagcccaacgcctgccttcccactggcagcaagctacgatactaacgggctctcacagcccccattgccagaaaagagacacctgccagggcccggtcaacagccagggccatggggtcctgaacaggcttcctcccccgcccggggcatttctcaccatgtcacctttgccccattactgagcgacaacgtgccacagacccctgagcccccaacccaggaaagtcaaagcaatgtcaaatttgtgcaagataccagcaagttctggtacaaaccacacttatcccgcgaccaagccattgcacttctgaaagataaggaccctggtgcgtttctcatccgagattcccattcctttcaaggcgcctacggccttgcactgaaagtggccaccccacccccatccgcccagccttggaagggtgatccagtggagcagttagtgcgtcatttcctgatagagacaggccctaagggggtgaagattaaagggtgtccgtctgagccctacttcggatccctatccgctctcgtgagccagcacagcatcagccccatttcattgccttgctgcctccgtattccctccaaggaccctctggaggagaccccagaggcccctgtccccacgaacatgagcacagccgccgatttactgaggcagggggccgcttgcagcgtgctatacctcacctctgtggaaacggagtctttaaccggtccccaagctgtggcgcgcgcgtctagcgctgcgttgtcctgttcgccccgcccaacaccagcggttgtgcattttaaagtttctgcgcagggcatcaccctgacagataatcagcgcaagctattttttagacgacattaccctgtgaacagcataaccttctcctctactgaccctcaggataggcggtggaccaatcctgatggtacgactagtaaaatttttggttttgtggcgaaaaagcccggaagcccttgggagaatgtgtgtcatctctttgccgagttggatcctgatcaacctgccggtgcaatcgtcaccttcattacgaaggtgcttcttggacagaggaagtag

SEQ ID NO: 208362 - DNA, 3858 bp, Artificial Sequence
  Description of Artificial Sequence: Synthetic coding sequence
atggagcggcggtgggacctggacctgacctacgtgaccgagcggattttggccgcagccttcccagccaggccagacgagcagaggcacaggggccacttgcgcgagctcgcccatgtgctccagtccaaacaccgtgacaaatatctgctcttcaacctatccgagaagcgccatgacttgacaaggctcaaccccaaagtgcaggactttggctggccggagttgcacgcgccacctcttgacaagctctgcagcatttgcaaggccatggaaacctggctgtcagcagatccccagcatgtggtggtgctgtactgtaaagggaacaaaggaaaactcggcgtgatcgtaagtgcttacatgcattattcaaagatcagcgccggcgctgaccaggcactcgccacgctgacaatgcgaaaattttgcgaggataaagtagccacagagttacagcccagccaacgacgctacatcagctatttcagtggcttactaagcggcagtatccggatgaattcctcaccactgttcctgcactatgtcctgattcccatgctcccagcgtttgagcccggcacgggattccagccgtttctgaaaatttatcagtcaatgcagctagtgtataccagcggcgtataccatatcgctgggcccggcccccagcagctttgcatatcgctggaaccagctctcctactcaagggggacgtaatggtgacgtgttaccataagggtgggcgtgggaccgacaggacgctagtattccgagtgcaattccatacatgtacgatccatggtcctcagctgacgttccccaaggatcaactggacgaagcctggactgacgagaggttcccttttcaagccagcgtggagttcgttttttcctcctcgcctgagaagataaagggcagtaccccccggaacgaccccagcgtaagtgtggattacaacacgaccgagccagcagtccgatgggattcctatgagaattttaaccagcaccacgaggactcggtggacggtagcctgactcacacccgaggccccctggacgggagcccctacgcccaagttcaacgcccaccgcgccagacccctccagctccaagccccgagcctccacccccacccatgctgagcgtgagctcagattcagggcacagctctacacttacgaccgaacctgccgccgagtccccggggcgtccccctcctactgccgcagaacggcaggaactcgacaggctgttagggggatgtggggtggcttcaggagggaggggcgcaggaagggagacagccatcctagatgatgaagaacagcctacggtcgggggaggcccccacctgggggtgtacccaggccatcggccagggctgagtcggcattgtagttgtagacagggctacagggagccctgtggagtcccaaacggcggatattacagaccagaaggtacgctggagcggcgccggttggcctatggcggttatgagggctcaccacaggggtatgctgaagctagtatggagaagcgaagactatgtcgctctctctctgagggactctacccatacccccctgagatgggtaagcccgccacaggggattttggatacagagctcctggatacagagaggtagtgattctggaagatccgggcttacccgccttatacccatgtccagcatgcgaggagaagctagcacttcccaccgctgccctatatggactgcgactggaacgagaagctggagaagggtgggcttccgaggcaggcaagcctctgctgcacccagtgagacccggacatccgctgccactgctgctgccggcgtgtggtcaccatcatgcccccatgcccgactatagctgtctcaagccccctaaagcaggggaagaagggcacgaaggatgtagctacactatgtgccccgagggcaggtacggacacccaggatatcccgcgttagtgacgtattcctatggtggagccgtgccatcctactgccccgcctacggccgtgttccacactcttgtggtagccctggagaagggagagggtaccctagccccggtgctcactctcccagagccggaagcatctcacctggctcaccaccttacccccagagccgcaaactgagctacgagattcctaccgaggagggtggggatcgctaccctctgcctggacatcttgccagcgcaggacctcttgcatcagccgagagcctggagccagtgagctggagagagggacccagcgggcactccacactgcctaggtcaccccgcgacgccccctgttcggctagttccgagctgtccggcccatctaccccccttcacacatcttcacccgtgcaggggaaagagtctactagacggcaagatacacggtcccccacaagcgctccaacgcagcggctgagccccggggaagctctgccacccgtctcacaggctgggaccggcaaagcacctgagctgcccagcggctccggccccgaacctctggcgccctcccctgtttcacctaccttcccgccaagctctccaagtgattggcctcaggagaggtcccctggcggccatagcgacggggcgagccctaggagcccagtgccgacaacccttcctggcctccggcacgccccttggcaaggcccccgtggccctcccgatagccccgatgggagccctctgactcccgtgcctagccagatgccatggttagttgcctcccctgagcctccacagagcagcccaacccctgcattccccctcgctgcatcttacgatacgaatggtttaagtcagccaccactgcccgagaagaggcacctaccaggcccgggtcaacagcctggcccatggggcccagagcaggccagcagtccagcgaggggcatttcacatcatgtcacttttgcacctttgttgtccgacaacgtgccacaaactccagagcctcctacccaggagagtcagtctaacgtgaaatttgtccaagacacttcaaagttctggtataaaccccatctctccagagatcaagctatagccctgctgaaggacaaggacccaggagcatttcttatccgcgacagtcattcttttcagggagcatacggccttgctctgaaggtggctacgcccccgcccagcgcacagccctggaaaggcgatccagtggaacagcttgttagacacttcctcatcgagacaggccctaagggggtgaaaattaaaggctgtccttcagaaccatattttggttcgctgagcgccttagtttctcaacacagcatttctcctatttctcttccatgctgtctccggataccttccaaggatcccctcgaggaaactcccgaagcccccgtgccaacaaatatgagtacagccgccgatttgctgaggcagggagctgcttgttcagtgctttacctgacatctgtcgagaccgaatctcttacaggcccacaggctgttgctcgagctagtagcgcagctctcagctgctctccccggcctactcctgccgtggtgcacttcaaagtcagtgctcaaggaatcacactcacagacaaccagcgaaagctgttctttcgacgtcactaccccgttaacagcattaccttctctagtacagacccacaggacaggcgctggactaaccctgacgggaccaccagtaaaatcttcgggtttgtggctaagaaacctggatccccctgggagaatgtgtgtcacttgttcgccgagctcgaccccgatcagcccgctggcgcgatcgttacattcattaccaaagttttgctgggacagcggaaatag

SEQ ID NO: 208363 - DNA, 2346 bp, Artificial Sequence
  Description of Artificial Sequence: Synthetic coding sequence
atgaagagcagcggccccgtggagcggctgctgcgggccctgggccgccgggacagcagtcgcgctgccagcaggcccagaaaagcagagccacacagcttccgtgagaaggtgttcaggaaaaaacccccggtgtgcgccgtttgtaaggtcacaatagacggtacgggcgtgtcctgcagagtctgtaaggtggccacccacagaaaatgcgaagcaaaagttacatccgcgtgccaggcattaccccccgtagaattgcgacgcaacactgctcccgttagaagaatcgaacatctggggtccactaaatccctgaatcatagtaaacaaagaagtaccctcccaagaagtttctcactggatcctctgatggagcgcagatgggacctggatttaacctatgtaaccgaaaggatcctggccgcagcttttcccgccagaccggatgagcaacggcaccgcggccacctgcgtgagttggctcacgttctgcaatctaagcaccgcgataaatacctcctgttcaacctgtccgagaaaaggcatgacctcacgagactgaatcccaaagtccaggacttcggctggccagagctacacgctccaccactagataaactctgttcaatctgcaaggccatggaaacttggctgagtgccgaccctcaacatgtggtagtcctgtactgcaagggcaacaaggggaaactaggggtgatcgttagcgcctacatgcactattctaagatttcagctggggcagaccaagccctggccacactcacaatgcgtaaattctgtgaggacaaggtcgctaccgaactccagccctctcagagacgttatatttcttatttcagcggtctgctgtctggtagcatacgaatgaactcgagtccactgtttctgcattacgtgctgatccctatgttgcccgccttcgagccaggaacaggtttccagcctttcttgaaaatctatcaaagtatgcagctggtctacaccagcggcgtctatcatatcgcaggccctgggcctcaacagctttgcataagcttagagccagctctgctgctgaagggcgacgtgatggtgacctgctatcataagggcggccgcggcacagaccgcacacttgtgttcagggtacagtttcacacctgcacgatccatggtccgcagttgacttttccgaaggaccaactggacgaggcctggacagacgaacggttcccattccaggctagcgtggagttcgtcttcagctctagtccggaaaagattaagggctctacacctcgaaacgatcccagcgtctccgtcgattacaacactaccgaacctgcagtcagatgggacagctatgaaaacttcaaccaacatcacgaagactctgtcgacggatctctgacccacactcggggccccctcgacggaagcccctacgcccaggttcagcgtccccctcgacagacgccacccgccccgtccccagaaccacctccacccccgatgctgtctgtcagctctgacagcggccactcatccacgttgaccaccgaacctgccgctgagagtccaggccgcccaccgccaacagctgccgagcgtcaggagctagatcggctacttggcggctgtggcgtcgcttcaggcggtaggggcgcaggccgggagactgcaatcctcgacgacgaggaacagcctaccgtgggggggggacctcatttaggggtgtaccccgggcaccggccaggtttaagcaggcactgttcatgtcggcagggttacagggaaccctgcggtgtccctaacggtggatattaccgtcccgagggcacactagaacgacggaggttggcgtatggtggctacgagggctctccgcaaggttatgccgaagcctctatggaaaagcgacgcttatgcagaagtctgtccgaggggttatatccttatcctcctgaaatgggaaagccggccacgggcgatttcggatacagggccagcagtgctgccctgagttgcagcccacgcccaaccccggccgttgtgcactttaaggtgtctgcccaggggatcacattaactgataatcagcggaaactgttttttagacgccattatccggtgaatagtataacattctcaagtaccgacccacaggataggaggtggaccaatcccgacggtactactagcaaaatcttcggcttcgtggccaagaaaccaggttccccatgggaaaatgtgtgtcatctttttgctgaactggaccctgaccagccggcaggtgctatcgttacctttatcaccaaagtcctgctcgggcagaggaaatag

SEQ ID NO: 208364 - DNA, 4200 bp, Artificial Sequence
  Description of Artificial Sequence: Synthetic coding sequence
atgaagagcagcggccccgtggagcggctgctgcgggccctgggcaggcgcgatagctctagggcagcctcgcgccctcggaaggctgagccccacagcttccgcgagaaggtgtttagaaaaaagccacctgtgtgtgccgtttgtaaggttacaattgacgggacaggagtctcttgcagagtgtgtaaagtggctacgcatagaaagtgcgaggccaaggtcactagtgcctgccaggcgttaccaccagtggagctgaggcggaacaccgctcccgtgcgcagaattgaacacctgggaagcaccaaaagcctcaaccacagtaagcagaggtctacccttccgcgaagcttcagcctcgatccactgatggaacgccggtgggacctcgatcttacttatgtgacggaaagaatcctggctgccgcctttcccgccagaccagacgagcagagacatcgcggacacctcagggagctggcccacgtgctacaaagcaagcacagagacaagtacctcctctttaatctgtctgaaaagcgacacgacctgacgaggctgaatcctaaagtccaagacttcggatggccagagctgcatgcaccacctctcgacaagctctgcagtatttgcaaggctatggagacttggctgagtgctgacccgcaacacgtggtagttctctattgtaagggtaataaaggcaaactcggcgtcatcgtgtcagcatatatgcactactccaaaatctccgctggcgccgatcaagccctggcaacattaacgatgcgcaagttctgtgaggataaggtagcgaccgaattgcagcctagtcagaggaggtacatcagctatttcagtggactcctctcaggtagcataaggatgaattcgagtcctctcttcctccactatgtgttgatccccatgctacctgcattcgagcccggaacaggattccagccattcttaaaaatttatcagtcaatgcaactggtgtacacatccggtgtgtatcatatagcggggcccggcccacagcagttgtgcatctcactcgaaccagcccttctcctgaagggagatgtcatggtgacttgttatcataaaggcgggagaggaactgataggacgttggtatttcgcgtacagttccacacctgcactatacatggtccccaactgactttccccaaggatcagttggatgaggcctggaccgatgagcgctttccattccaagcatctgtggagttcgttttctcgagctctccagagaaaattaaggggtcaacaccaagaaatgacccctcagtgtcagtcgactacaacactaccgaacccgcagttagatgggatagttatgagaatttcaaccagcaccacgaggactccgtggacggcagtctaacccatactcgtggccctctcgatggcagcccgtatgcacaggtgcaacgaccccctaggcagaccccccccgctcctagccctgagccccctccccctcctatgctgagcgtgagttccgacagcggccacagtagcacactgacaactgaacccgctgcagagtcacccgggagacctccgcccacagccgctgaacggcaggagctggatcgattgcttggcggatgtggcgtggccagcggggggaggggagctgggagagaaactgcaatcctggacgatgaggagcagcccacggtgggcgggggccctcacttgggggtctaccccggacaccgtcccgggttgtcaagacactgttcctgtcgacagggatatcgcgaaccttgcggcgtgccaaatggtggatactatcgacctgaggggaccttagagagacggaggctggcctatggaggctatgaaggaagcccccaaggctatgctgaggcgagcatggaaaagcggcggttgtgccggagcctcagcgaggggctctacccatacccccccgaaatgggtaagcctgccacgggcgactttggctatcgcgccccagggtatcgggaggttgtgattctggaggatccaggactgcctgccctgtacccttgtccagccagtctgtacggtcttaggttggagcgcgaggcgggcgaaggctgggccagcgaagctggtaaacccctgctgcacccagtgcgcccagggcacccattacccttgctgctccctgcgtgtgggcatcatcacgcaccgatgcctgattattcctgtcttaaacctcctaaggcaggcgaagagggccatgaggggtgttcgtacactatgtgtccggaaggccggtatggacatcctggctacccagcccttgtgacctactcctacggcggtgcagtacctagctactgcccggcatacggtcgggtgcctcactcgtgtggctcaccgggcgaaggacggggctatccctcccctggagctcacagccctcgggccggcagcatctccccaggcagtcctccttatcctcagtccaggaagctgagctatgaaatccccacagaggaaggaggcgaccggtaccccctccctggacacctcgctagcgccggtccactggcctccgctgagtctctagaacccgtgagctggagagagggacccagtgggcattcgacgctgccccgatctccaagagacgctccctgctcagcaagctctgagctgagtggcccttctacgcccctgcacacgagcagtccggtgcaaggcaaagaatccacacggagacaggatacccgctcccctacttccgcgcctacgcaacgcctgtcgcccggagaggcactgccaccggtgtcacaggccgggacagggaaggctcccgaattgccatcaggatcaggtcctgaacctctcgctcccagccccgtgtccccaacttttccccctagctccccatctgactggcctcaagaacggtctcctggcggccattccgatggagcttccccaagaagcccggtacctacaaccctgcccggcctgagacatgccccttggcagggtcctagaggaccacccgatagccccgatgggtcaccccttaccccggttccatcccagatgccttggctggtggcttctcctgagccaccccagagctctcccaccccagccttccccctggctgccagttatgatactaacggtctgagccagcctcccctgcctgagaaaagacaccttcctggtcctggccaacagccaggcccatggggcccagaacaggccagctccccagcacgtggaatctcccatcatgtgacattcgcacctctcctcagcgataatgtgccacagaccccagaacctccaacacaagagtcacagagcaacgtgaagtttgtgcaagatacatccaagttctggtacaaaccacacctgagccgagatcaggcaatagcgttactgaaagataaagaccctggggcgttcctcatcagagactcacactcttttcaaggcgcctacggccttgccttgaaggtggccacccccccaccgagcgctcagccttggaaaggagaccctgtagaacagctggtgcgtcatttcttaatcgaaaccggtccaaagggagtgaagattaagggatgtccctccgagccatactttgggtctctttcagccttggttagccaacatagtatctcgcccatatcactgccttgctgtctgcgcatcccttctaaggaccccctggaggagactccagaggcccctgttcctaccaacatgtccactgcggcggatctcctgcgccagggggccgcatgttcagttctgtacctaaccagtgttgaaactgagtccctcaccggtccacaggctgtggcccgagctagcagtgcagccctgagttgctctccccgaccaactcctgcggtagtgcattttaaagtcagtgctcagggcatcacccttaccgataatcagcggaagttgttttttcgccggcattatcctgtgaacagcattactttttcatccacagatcctcaggatagaaggtggacaaatcccgacgggaccacatccaaaatcttcgggtttgtggcaaagaagcctggtagcccatgggaaaacgtgtgccacctgtttgctgaactggatcccgaccaacccgctggcgctattgtaactttcataactaaagttctactgggacagaggaagtag

SEQ ID NO: 208365 - DNA, 567 bp, Artificial Sequence
  Description of Artificial Sequence: Synthetic coding sequence
atggactgccggaagatggcccggttcagctacagcgtgatctggatcatggccatctcaaaggtgttcgaactcggcctggtcgccggtctcgggcaccaggagtttgccaggccttcaagaggctatctggccttcagagatgacagtatatggcctcaggaggagccagccattagacccagaagctctcagagagttccacctatggggatacagcacagtaaagagctaaacagaacgtgttgtctgaatgggggcacatgtatgctcggatcgttttgtgcttgcccaccatccttttacgggagaaactgcgagcacgacgtgcgcaaggaaaattgcgggtccgttccgcatgatacttggctgcctaagaagtgtagcttgtgcaagtgctggcatgggcagctgaggtgtttcccccaggcatttctgccagggtgcgacggcctcgtcatggatgaacatctggtggcatcacgaacccctgaactacctccgtcagcaaggacaaccaccttcatgctggtgggaatctgtctcagcattcagagttactattag

SEQ ID NO: 208366 - DNA, 519 bp, Artificial Sequence
  Description of Artificial Sequence: Synthetic coding sequence
atggccatcagcaaggtgttcgagctgggcctggtggccggcctggggcaccaggagttcgcgaggcctagccggggttacctggccttccgggatgattcgatatggcctcaagaggagccagctatacgccctagatcctcccaaagagtgcctcccatgggcatccagcacagcaaggaattgaaccggacatgttgcctcaatggcggcacttgtatgctggggtctttctgtgcctgccccccaagtttctacgggcggaattgcgagcatgacgtcagaaaggagaactgtgggtcagttccacacgacacttggttgccaaagaagtgctctctgtgcaaatgctggcatggacaactgcgctgttttccacaggccttcctacccggctgtgatgggctggtcatggatgagcaccttgtggcctctagaacaccagaactccccccctctgccaggaccaccacgtttatgctagtcggcatctgcctcagcatccagtcttattactag

SEQ ID NO: 208367 - DNA, 645 bp, Artificial Sequence
  Description of Artificial Sequence: Synthetic coding sequence
atgggcgccgcccacagcgccagcgaggaggtgcgggagctggagggaaagacggggtttagtagtgatcaaatcgaacagttgcacagaaggttcaagcagctgagtggcgaccaacctacaatccgtaaagaaaacttcaacaacgtgccagatcttgaactcaatccaattagaagcaagatcgtacgtgccttttttgacaatcgaaatctgaggaaggggccctctggcctggctgatgagatcaacttcgaggattttttaacaatcatgtcatattttagacccatagacaccactatggatgaggaacaggtggagctgagcagaaaggaaaagctccgcttcttattccacatgtacgatagcgacagcgacggtaggatcaccctagaagagtaccgaaacgtggttgaagaactgttgtccgggaatccccacatcgaaaaggagtctgccaggtccatcgctgacggcgctatgatggaagcagcctctgtgtgcatgggacagatggaacctgaccaggtttacgaaggcatcacctttgaggacttcctaaaaatttggcaaggcattgatatcgagactaaaatgcatgtcaggttcctgaacatggagacgatggccctctgtcattag

SEQ ID NO: 208368 - DNA, 804 bp, Artificial Sequence
  Description of Artificial Sequence: Synthetic coding sequence
atgcggccccggagcggccccacccggaacccccggctgcgggccttcgccggcgttcctacgagaggcagaaccagagggcagtcgaggaggtgcgccgccgaggcctccgctggacccgagagagatgcccgccctggcgcgccggcggcggggacaatgggagctgcacattccgccagtgaagaggttcgtgagttggaaggcaaaacaggtttttcctccgaccagattgaacagctgcacagacgattcaagcaactatctggtgaccagcctacaatccgcaaggaaaactttaacaacgtgccggatttagagctcaacccaatcaggtcaaaaatagtgcgcgccttcttcgacaatcgtaacttgcgaaaaggaccctcagggctagctgacgagattaattttgaggacttccttactataatgagctacttccgtcccatcgatacaacaatggatgaggaacaagtggaactaagtagaaaagagaaactacgatttctcttccatatgtacgactctgatagtgacgggaggatcaccctggaggagtacaggaacgtcgtggaagaactgttgagcggaaacccccatatagaaaaggaaagcgcacggtccatcgccgacggagcgatgatggaagcggcctccgtgtgcatgggccagatggaacccgaccaagtgtacgaggggattacctttgaagattttttgaaaatctggcagggcatcgacatcgaaacaaagatgcacgttaggttcttaaatatggagaccatggcgttgtgccactag

SEQ ID NO: 208369 - DNA, 564 bp, Artificial Sequence
  Description of Artificial Sequence: Synthetic coding sequence
atgggcgccgcccacagcgccagcgaggaggtgcgggagctggagggaaagacaggctttagcagtgaccaaatagagcaattgcataggcgcttcaagcagctaagtggggatcagcccaccatccggaaccttcgcaaggggcccagcggcctcgctgatgaaattaactttgaagatttcctgaccatcatgagttactttagacccatcgataccaccatggacgaggagcaggttgagcttagtaggaaagagaaactgcgatttctgttccatatgtatgacagcgattcggacggccggattactttggaagagtaccgcaatgtggttgaggagctgctgagtgggaaccctcatatagagaaggagagcgcacgatcaattgcggacggggctatgatggaagcagctagcgtctgtatgggccagatggaacctgaccaggtctacgagggcataacctttgaggatttccttaaaatttggcagggaatagacattgagaccaaaatgcacgtgaggttcctgaacatggagactatggctctgtgtcattag

SEQ ID NO: 208370 - DNA, 1266 bp, Artificial Sequence
  Description of Artificial Sequence: Synthetic coding sequence
ctgaacctggaggtgaagttcaagaagatgggcctgggccacgagcagggatttggcgccccctgtctgaagtgcaaagagaagtgtgaggggtttgaactgcacttctggcgcaagatttgcaggaactgcaagtgcggacaggaggagcacgatgttcttctaagcaacgaggaagacaggaaagtcggtaaactttttgaggacactaagtatacgacattaattgcaaaactgaagagtgacggcatcccaatgtacaagcgtaacgtgatgattttgacgaaccccgtcgcagctaaaaagaatgtgtctattaacacagtgacttacgagtgggccccccctgtgcagaatcaagcactcgcccgtcagtacatgcaaatgttgccaaaggagaaacagccagtagcaggatcggagggagcccagtatcggaaaaagcagctggccaaacagctgcccgcccatgaccaggacccatccaaatgccacgagctgtctccacgggaagtcaaggagatggagcagtttgtcaaaaagtataagtctgaggccctgggcgtgggcgacgtcaagctgccctgtgaaatggatgcccagggacctaagcaaatgaacatcccaggcggggatagatcaacaccggcagctgtgggcgctatggaggataagagtgctgagcacaaacgcacacagtactcctgctactgttgcaagctcagcatgaaagaaggcgatcctgcaatatatgccgagagggccggctacgacaagctgtggcacccggcctgtttcgtatgctctacatgtcacgagctgctagtggatatgatatacttttggaagaatgagaaattatactgcggccgtcactactgcgattctgaaaagcccaggtgcgccggctgtgacgaattaatattcagcaatgagtacacccaggcagagaatcaaaattggcatctcaaacatttttgctgtttcgactgtgactccattctggccggtgagatatatgtgatggtcaacgataagccagtttgcaagccatgctatgtgaagaatcacgccgtggtgtgtcaaggatgccataacgcaattgatccagaggtgcagcgcgtgacctataacaacttttcttggcacgctagcactgagtgctttctatgctcgtgctgcagtaaatgccttattggccaaaagttcatgccagtggagggaatggttttttgcagcgttgaatgtaaaaaaagaatgtcatag

SEQ ID NO: 208371 - DNA, 1266 bp, Artificial Sequence
  Description of Artificial Sequence: Synthetic coding sequence
atggacctggagaacaaggtgaagaagatgggcctgggccacgagcaggggttcggcgcaccatgtcttaaatgtaaagagaaatgcgagggatttgagttacacttctggaggaagatctgtcgcaactgtaaatgcggtcaggaggaacatgatgtgcttctatcgaacgaagaggaccgtaaagttgggaaactatttgaggatacgaaatacaccaccctgatcgcaaagttaaaatccgatggaataccaatgtataagagaaacgtgatgatactgactaatccagtggctgctaagaaaaatgtctccatcaatacagtgacgtacgaatgggccccacccgtacagaaccaggcactggcaagacagtatatgcaaatgctcccgaaggagaagcagcccgtggccggaagtgagggtgcccaatataggaaaaaacagctggccaaacagctgccggctcacgatcaggacccatctaaatgtcatgaactgtccccaagggaagtgaaagagatggagcagttcgtcaagaagtacaaatcagaggcccttggcgttggggacgtgaagctaccctgcgagatggacgcccaggggcctaaacagatgaatatacccgggggtgacagatctaccccagccgctgtgggcgcaatggaagataagtcagccgaacataaaaggacccagtacagctgttattgttgcaaactgtcaatgaaagagggagatcccgcaatatacgcggagcgcgctggttacgataagctgtggcatcccgcgtgcttcgtgtgctccacctgtcacgagttactggttgacatgatctacttttggaaaaatgagaagctctattgcgggaggcactactgtgactccgagaagccaagatgcgccggctgcgatgaacttatcttcagtaacgagtatactcaagcagagaatcagaattggcaccttaagcacttctgctgctttgattgcgatagtatactcgctggcgaaatctatgtgatggtaaacgataagccagtctgtaaaccatgttacgttaagaaccatgctgtggtgtgccagggctgtcacaacgctattgatccggaggtacagcgcgtcacatacaacaatttctcctggcacgctagcactgaatgctttctctgtagttgttgctcgaagtgtctgatcggtcaaaaattcatgcccgtggaggggatggtgttctgcagtgtggaatgcaaaaagcgaatgtcctag

SEQ ID NO: 208372 - DNA, 1239 bp, Artificial Sequence
  Description of Artificial Sequence: Synthetic coding sequence
atgggcctgggccacgagcagggcttcggcgccccctgcctgaagtgtaaggagaaatgtgaaggattcgagcttcacttttggcgcaaaatttgtcggaattgtaagtgcgggcaagaggaacacgatgttttgctatccaatgaagaggatcggaaagtgggtaagctgttcgaagacacaaagtacacaacccttatcgcaaagcttaagagcgacgggattcctatgtacaaaagaaatgttatgatactgaccaaccccgtggcggccaaaaaaaatgtctcgattaatacagtgacgtacgagtgggctccccccgtccagaaccaggccctggcccggcagtacatgcagatgctgcccaaggaaaaacagccagtggcaggatcagagggcgctcagtacaggaagaaacaactggctaagcagcttccagcccacgaccaggatccttctaaatgccacgaactctcacctcgcgaggtcaaggaaatggagcagtttgtgaagaagtacaagtctgaggcattgggcgtgggcgacgtaaagctgccttgcgaaatggacgcgcaaggacccaagcagatgaacatcccagggggcgacagatccacacccgcagcagtgggcgccatggaggacaagagcgcggagcataaaaggacccaatactcttgctactgctgcaagctgagcatgaaggagggcgacccggccatttacgccgaacgcgcaggttacgataaactttggcatcctgcctgctttgtttgttccacttgccacgagctgcttgtagacatgatctacttttggaagaacgagaaattgtactgtggccgacattactgtgattccgagaaacccaggtgcgcaggctgcgacgaactcatcttctcaaacgagtacacacaggcggagaatcagaattggcatctgaaacacttctgctgtttcgactgtgattctattttagctggggaaatttacgttatggtgaacgataagccagtgtgcaaaccgtgttacgtgaagaaccatgccgtggtctgccaaggttgtcataacgccattgaccctgaggtacagagagtcacctataacaacttctcatggcacgcctctaccgagtgcttcctgtgctcatgttgtagcaaatgcctgatcggccagaaattcatgcctgtggaaggcatggtgttctgtagcgtggagtgtaagaaaaggatgagctag

SEQ ID NO: 208373 - DNA, 540 bp, Artificial Sequence
  Description of Artificial Sequence: Synthetic coding sequence
atgaaggagggcgaccccgccatctacgccgagcgggccggctacgataaactctggcatcctgcttgcttcgtctgctctacatgtcacgagcttttagtggatatgatctacttttggaaaaatgaaaagctttactgtggacgtcattattgtgacagcgagaagcccagatgcgctggatgcgacgaacttatattttcaaatgaatacactcaggctgagaaccagaactggcacctcaagcacttttgttgtttcgattgcgattccattctcgctggagagatctatgtcatggtgaacgacaagcccgtttgtaagccctgctacgttaagaaccacgcggtcgtgtgtcaggggtgccataacgccatcgatcccgaagtgcaacgagtgacttacaataatttcagctggcacgccagtactgagtgctttttgtgtagttgctgttcaaaatgcttgataggccaaaaatttatgcctgtggaggggatggtgttttgttccgtcgaatgcaagaaaagaatgtcgtag

SEQ ID NO: 208374 - DNA, 804 bp, Artificial Sequence
  Description of Artificial Sequence: Synthetic coding sequence
atgggcgcccggcagatccagaccagcagcagccagaccagccccgaggaggctatgggaacaccccgtatccagcacctgttaatccttctggtgctcggtgcctcactgttgacttctggcctcgagctgtattgtcagaagggtctgtcaatgacggtggaggcggatccagcaaacatgtttaattggactaccgaagaggtggaaacctgcgataaaggcgccctttgtcaggagaccatcttaataatcaaggccggcacagagaccgctattctggcaacgaaaggctgtatccctgagggtgaagaggcaatcaccatagtgcaacattcttcccctcccggcctaattgtaacttcatatagtaattattgtgaggattcgttttgcaacgataaggattccctttcccagttttgggaatttagcgaaactactgcgtctactgtgagcacaactctgcactgtcccacgtgtgtggcacttggaacatgcttttcggcaccttccctgccatgtcccaatggcactacacggtgctaccaagggaaattagaaataaccggcggcggcatcgagtcctctgtcgaggtgaaggggtgtactgcgatgatcgggtgtcgtctcatgtccggaatcctggccgtgggacctatgtttgtgcgagaggcgtgcccacaccagctgctaacccaacctaggaagacggagaacggggccacatgtctgccaattccagtgtggggcctgcaattacttctgcctttactgttgccaagcttcattcacttcagttag

SEQ ID NO: 208375 - DNA, 789 bp, Artificial Sequence
  Description of Artificial Sequence: Synthetic coding sequence
atccagaccagcagcagccagaccagccccgaggaggccatgggcacccctcggatccaacacctgcttatcttgctcgtgcttggggcctctcttctgaccagtggcctggagttgtactgccagaaaggcctctccatgacggtggaagctgaccccgctaatatgttcaattggactacagaggaggtcgaaacttgcgacaaaggcgctctgtgccaagagacaattctaatcattaaggcaggcactgagactgccatactggctacaaagggctgcatccccgagggagaggaagctataacaatcgtgcagcattcatctccccccggcctcatcgttactagttattcaaactactgcgaggattcgttttgcaacgacaaagatagtctgtctcaattctgggagtttagcgagactacagccagcactgttagcacaacccttcattgtcctacttgcgtcgcacttgggacatgtttttcagctccctcactgccctgtccaaacggaactacaaggtgttatcagggaaagctggaaatcacaggaggtggcatcgagtcctccgtggaggttaaaggctgcacagccatgattggttgcaggctgatgtccggcatcctggccgttggacctatgtttgtcagggaggcttgtccccaccagctgttgacccagccgaggaagacagaaaacggcgccacttgcttgccaatcccagtatggggactgcaactgctcctcccactgctgctcccctcttttatccacttctcctag

SEQ ID NO: 208376 - DNA, 750 bp, Artificial Sequence
  Description of Artificial Sequence: Synthetic coding sequence
atgggcaccccccggatccagcacctgctgatcctgctggtgctgggcgcgtctctgctgacaagtggtcttgaactctattgtcagaagggactgtctatgaccgtggaggccgatccagccaatatgttcaattggacaactgaagaggtcgaaacctgtgacaagggagccctttgtcaagagacaatcttaattattaaggccggtactgagacagctattttggctacaaaagggtgtatccccgagggcgaggaagccattacaatcgtgcaacattcatctccccccgggctaatcgttacaagctacagtaactactgtgaagactccttttgtaatgacaaggattcgctatctcaattctgggagtttagtgagaccacggcgtccacagtcagtaccactctgcattgcccaacctgtgtcgccctgggcacatgttttagtgcgcctagtctcccatgcccaaacggaactacccgctgttaccaaggtaaactcgagatcaccggtgggggaatcgaatcctctgttgaggtcaagggttgtactgcaatgattggctgtcggctgatgtctggaatactggccgtgggccctatgtttgtgagagaagcttgcccgcaccagctactgacccagcctcgaaagaccgagaacggggccacctgcctgcccattccagtctggggactccaattgttactccccctgctcctgccatcgttcatccacttcagctag

SEQ ID NO: 208377 - DNA, 804 bp, Artificial Sequence
  Description of Artificial Sequence: Synthetic coding sequence
atgggcgcccggcagatccagaccagcagcagccagaccagccccgaggaagcgatggggactccacggatacagcacctgctgatcctgctagtcctcggggcgtcgctgttgacctcagggttagagctgtattgccaaaaaggcctctctatgacagttgaagccgatccagcaaacatgtttaattggaccaccgaagaggtggagacatgtgataaaggcgccctgtgtcaggaaactatcttgatcattaaagctggcaccgagactgctatcctagctactaaaggttgcatccctgaaggggaggaagctatcaccattgtccaacatagctcccctcccggccttatagtgacgtcatactccaattattgtgaggatagtttttgcaacgacaaagactctctgagtcagttctgggaattttcagaaacaactgcctcaaccgtatctactactctgcattgccccacatgcgtcgcactggggacctgtttttcagcacccagcctgccatgtccaaatgggactactcgctgttatcaggggaaacttgagattaccgggggggggatcgaatcctccgtggaagtgaaggggtgtaccgctatgatcgggtgccgcttaatgtccggtatacttgccgtggggccaatgtttgtgagagaagcctgccctcatcagctcttgacccaaccccgaaagaccgagaatggggcaacgtgtctgccaatccccgtctgggggttacaacttctcctgccattgttgctgccatctttcatacatttctcatag

SEQ ID NO: 208378 - DNA, 2823 bp, Artificial Sequence
  Description of Artificial Sequence: Synthetic coding sequence
atgatcagcgcccactgcaacctgcggctgctgtgcagcagcgacagcagcgcctccgcatcccaggtggcaggcactaccgaggtggttgagaacctcgttactaatgataatagtccaaatattcctgaggccattgataggctgtttagcgacatcgcaaacatcaatagggagtcgatggcagaaatcacagatattcaaatagaggaaatggctgtaaatctgtggaattgggctctgacaatcggcggcggatggctggtgaatgaggaacaaaagatccgtctgcactacgtcgcctgcaaacttcttagtatgtgcgaagctagctttgcatccgaacagtctatccagaggctaataatgatgaacatgcggatcgggaaagaatggttggatgccggcaattttctgattgctgacgagtgtttccaagccgccgtggcttccctggagcagctgtacgtaaagctcattcagagatcatcgccagaggccgacctaactatggaaaagattacagtggagtccgatcatttcagggtgctgtcgtaccaggcagaatccgccgtggcacagggggacttccaaagggccagtatgtgcgtactacagtgcaaagacatgctgatgcgccttccacaaatgacaagctccctacaccacctatgctacaattttggggttgaaacccagaagaacaacaaatacgaagagtcaagcttttggctctcacagtcttacgacatagggaaaatggacaagaagagcacaggacccgagatgttggccaaggtactcaggctactagctacaaattacctagattgggatgataccaagtattatgacaaggcccttaacgccgtaaatttagctaataaagagcatctgtcgtctcccggcctgttcctgaaaatgaagatcttactgaaaggagagacttcaaatgaggaattgctggaggccgtaatggaaatccttcacctggatatgccactggatttttgtctcaacattgctaagctgctgatggaccatgaaagagaaagtgtcggattccatttcctgacgatcatacacgaacgctttaagagcagcgaaaacattgggaaagtgctcattcttcatacggacatgttgctacagcgtaaagaagaattgctggctaaggagaaaatagaggaaatcttcctggctcaccagacgggcaggcaacttacggcagagtctatgaattggttgcataacatcttgtggcggcaggctgcctcttcctttgaggttcagaactacaccgatgccctgcagtggtactattactcgctcaggttttattcgaccgacgagatggatctcgacttcacgaaactgcagcgcaacatggcctgttgctatctgaacctgcaacagctggataaagccaaggaggcagtggccgaggcggagagacatgaccctcgcaatgtgtttactcaattttacattttcaaaattgcggttatcgagggcaattcggaacgcgccctgcaagcaatcatcaccctcgagaatattttaactgatgaagaaagcgaggacaacgatttggtggctgagaggggctccccaacaatgctactgagccttgccgcccagtttgctctcgaaaacgggcaacaaatcgtagccgagaaggctctggaatatctcgcccagcatagtgaggaccaggagcaggtgctaaccgccgtgaaatgtttgctaaggttcctcttgcctaaaatcgcagaaatgcctgagtcagaggacaagaagaaggagatggaccgcctactcacctgccttaatcgcgctttcgtgaaactctcccaaccctttggggaggaagcactgtcactggaatcaagggctaacgaggctcagtggtttcggaaaacggcttggaacttagccgtgcaatgcgataaagaccctgtgatgatgagggagttcttcatactgtcttataagatgagccaattttgtccttctgaccaggttattcttatcgctaggaaaacgtgtctgctgatggctgtggcggttgatctggagcaggggcgcaaggcaagcaccgcatttgagcagaccatgttcttgtctcgtgcgcttgaagagattcaaacttgtaatgatattcacaacttcctaaaacagactggtaccttctctaacgattcctgtgagaaattacttctgttgtacgagtttgaagtccgtgccaagcttaacgatcccctgctggaaagctttttggagtctgtctgggagttgccccacctcgaaaccaaaactttcgaaaccatcgctatcattgcaatggagaagcccgcccattatcctctgatcgccctcaaagcgctcaagaaagccctgctcctgtacaaaaaggaagaacccattgacatctcccaatactcaaagtgtatgcacaacttggtgaatctgtccgtgccagatggtgcaagtaacgtcgaactgtgtcctttggaggaggtttgggggtattttgaggatgccctaagtcatatcagcaggacaaaagactaccctgagatggagatcctgtggctgatggtgaagtcatggaatacaggggtgttgatgttctctagaagtaaatatgctagcgccgagaagtggtgtgggctcgcactccgctttttaaaccaccttacctcattcaaggagagttacgagacacagatgaacatgctctacagccaactggtcgaggctctcagcaataacaaaggacctgtatttcacgagcacggatattggtcaaagagcgattag

SEQ ID NO: 208379 - DNA, 1848 bp, Artificial Sequence
  Description of Artificial Sequence: Synthetic coding sequence
atggagatcctgcacctggacatgcccctggacttctgcctgaacattgccaaactgttaatggatcacgagcgcgagagcgtaggctttcactttcttacaatcattcacgaacgctttaaaagcagtgaaaatataggcaaagtcctcatcctgcatactgacatgctgcttcagaggaaagaggagctgctggcgaaggagaaaatcgaagagatcttccttgcccatcagactggaagacaactgacagcagagtcaatgaattggctccacaatatactgtggagacaggcagcctcctcctttgaggtacagaattacactgatgcactccagtggtattactactctctcaggttctactcaacagatgaaatggacctggatttcaccaaattgcagaggaatatggcctgctgttacctgaaccttcagcagctggataaggccaaagaagccgtggctgaggcagagagacacgatcctcggaacgtcttcacccagttctacattttcaaaattgcagtgatcgagggaaattccgagcgcgccctgcaggccattatcactctcgagaacattctgaccgatgaagaatcggaagacaacgatcttgttgcagagaggggttcaccaacgatgctgttgagtcttgccgctcagttcgccctggagaatgggcagcagatcgtggccgagaaagctctggagtatctggcccagcactctgaggatcaggaacaggtgctcacggcggtcaaatgtctccttagattcctgctgccaaagatcgccgaaatgcctgagtccgaggataagaagaaagaaatggacagattgctgacatgccttaacagagcgtttgtcaagctgagccagccatttggcgaggaggccctgagcctcgagagcagggccaacgaggcacagtggttccggaagaccgcttggaatctcgcggttcagtgcgataaggaccctgtgatgatgagagaatttttcatcctttcgtacaagatgagccagttttgtccatccgaccaagtgatcctgatcgcccggaaaacctgtttgctgatggcagttgcggtcgacctggagcaggggagaaaagcctcgaccgctttcgagcagaccatgtttcttagcagggctctagaagaaattcaaacctgcaatgacatccacaacttcttaaagcagacagggacgttcagtaatgattcctgcgagaaattattacttctgtacgaatttgaggtccgggccaaactgaatgatcctcttctggaatctttcctcgagagtgtatgggaactcccccacctcgagactaaaacctttgagaccattgccatcatcgcaatggaaaaacccgcccactaccccttaattgccctgaaggccctaaagaaagctctgttactatataagaaagaggagccaatcgatatctcccagtattcaaagtgcatgcacaatcttgtcaatctctcggttccagatggagcttcgaatgtggaactgtgccctctggaggaagtgtgggggtattttgaagatgcacttagccatatctcccggacaaaagactacccagaaatggaaatactttggctgatggtaaagtcctggaacacgggtgtcctgatgttttctcgctccaagtacgctagtgccgaaaagtggtgtggcctggctctgcgcttcctcaatcatctgacatctttcaaagagagttacgagacccagatgaacatgctctattcccagttggtagaggccttgagtaataataaggggcccgtgtttcatgagcatggctattggtctaagtccgattag

SEQ ID NO: 208380 - DNA, 2778 bp, Artificial Sequence
  Description of Artificial Sequence: Synthetic coding sequence
atggacaacgacgacttcttcagcatggacttcaaggaggtggtggagaatctcgtcaccaacgacaactcaccaaatatcccggaggcaatcgacaggttgttctccgatattgctaatattaacagagaatctatggccgagattactgatattcagatcgaggaaatggctgtgaatctgtggaactgggccctgaccatcggcgggggatggctggtgaatgaggagcaaaagatacgtctccactacgtggcttgtaaactgttatctatgtgcgaggcctcatttgcctccgaacagagcatccaacggctgattatgatgaacatgcggatcggaaaggagtggctggacgccggtaactttctgatcgctgacgagtgcttccaggcagccgtcgcgagcctggaacagctttacgttaagctgatccaaagatcctcccctgaggccgacctgaccatggagaagattaccgtggaatctgatcactttcgggttctgtcttatcaggcagagtcagccgttgcccagggagatttccagagggcctcaatgtgtgtgcttcagtgcaaggatatgctaatgaggctcccacagatgacttcaagtctccaccatctgtgttataatttcggggtcgagacacagaaaaacaataagtatgaggagtcttcattttggttgtctcaaagttacgacatcggtaagatggataagaagagtacaggacctgaaatgctggccaaggtcctccggctcctggccacaaactatcttgattgggacgacacaaaatattatgataaggcgttaaatgcagttaacctggccaataaggagcacctctcttccccaggactgttcctcaaaatgaagattctccttaagggcgagacgagcaacgaggaactcttagaggccgtgatggaaatcctgcatctggacatgccgctggacttctgcctcaatatagccaagctcctgatggaccacgaaagggagtctgtcggattccatttcctgacgatcatccacgaacgattcaagtcaagtgaaaatatagggaaagtgctgatcctccataccgacatgctgctgcaaagaaaggaagaactcctagccaaggagaaaattgaagaaattttcctggcacaccaaaccggacgtcagttgaccgccgagtcgatgaattggcttcacaacatcctgtggaggcaggcagcctcctccttcgaggtccagaattatactgatgccctgcaatggtactattacagccttcggttctattcaaccgatgagatggatctggactttactaaactccagagaaacatggcgtgttgttatcttaatttgcagcaattggacaaggccaaggaggccgtcgccgaagccgaacggcacgatccgaggaacgtgtttacgcaattttacatctttaagattgctgtgatagaaggaaatagtgagcgggctctacaggccatcatcacacttgagaatatccttactgacgaagaatccgaggataacgatctggtggcagagcgaggtagcccaacaatgttgctgtcgcttgctgcccagttcgctcttgagaatggtcaacagatagtagcagaaaaagcactggagtatctggcgcagcattcggaagatcaagagcaagtcctcactgcagtcaagtgtttgctgagattcctgcttcccaagatcgccgagatgcctgaatctgaagataagaaaaaggaaatggaccgcttgctcacatgcttgaatcgtgccttcgtgaaactgtcccagcctttcggcgaagaagccctatcacttgagagtcgcgccaacgaggcacagtggtttagaaaaactgcctggaatttggctgtccagtgtgataaagaccctgtaatgatgagagagtttttcattctgtcgtacaaaatgtctcaattttgtccctccgatcaggtaatcttgatcgctcgaaagacctgcttactgatggctgtcgcggtagatctggagcagggcaggaaggcatcaaccgccttcgagcaaaccatgtttctgtcgagggcattagaggagatccagacctgcaacgacattcacaactttctgaagcagaccggcaccttcagcaacgactcctgcgagaaactcctgctgctgtatgagttcgaggtccgagccaagctgaacgatccactcctagagtcatttctcgaatcagtttgggagttgccacatctggaaaccaaaacttttgaaactatcgcaatcattgctatggaaaagcccgcacattacccactgattgccttaaaggcactgaagaaggcacttctgctgtataagaaggaggaacccatcgacatctctcagtacagcaaatgtatgcacaatctcgtaaacctgagcgtccctgatggtgcgtccaatgtggaactgtgtccactcgaggaggtgtggggctactttgaggatgcattgtcacacatttcacgaacaaaggactaccccgaaatggagatcctgtggcttatggtgaaatcctggaacactggcgtcctgatgttttcccgctccaaatatgcgtcggccgaaaagtggtgcggcctggccctgcggtttctcaatcatctaaccagttttaaggaatcctacgagacccaaatgaatatgctgtattcacagctcgtggaggcattgagtaacaataagggccccgtcttccatgagcacggatattggtctaagtctgactag

SEQ ID NO: 208381 - DNA, 2823 bp, Artificial Sequence
  Description of Artificial Sequence: Synthetic coding sequence
atgatcagcgcccactgcaacctgcggctgctgtgcagcagcgacagcagcgcatccgccagccaggtagccgggacaaccgaggtcgtggaaaatcttgtgactaacgataatagccccaatatacctgaggcaatcgatcgccttttctctgatattgctaacattaatcgggagtctatggccgaaatcaccgatatccagattgaggaaatggcagtgaacttgtggaactgggctctcactataggggggggatggctggtcaatgaggaacagaagatccggttacactacgtagcttgtaagctgttatcaatgtgtgaggcgagctttgcaagcgagcagtcgatccagaggctcataatgatgaacatgcgaattggaaaagaatggcttgacgccgggaattttctgatagcggacgagtgctttcaggcagcggtggcgagcctggaacaactgtatgtgaaactgatacagaggtcctcccctgaggcagaccttactatggaaaagatcacagtggagtccgaccattttcgcgtactgtcttaccaggcagaaagcgccgtcgcacaaggtgattttcagcgggcaagtatgtgcgtgctgcaatgtaaagacatgttaatgcggttaccccaaatgactagcagcttacatcacctttgctataactttggagtggaaactcagaaaaacaataagtacgaagaatcgtccttctggcttagtcagagctacgacattggtaaaatggacaagaagagcactggcccagagatgctggcaaaagtgctgcgcttactggccacaaattatctggactgggatgacaccaaatactatgataaagcgctgaacgcggtgaatctcgccaataaagaacacctgagctcaccgggactcttccttaaaatgaaaatcctactaaagggggagacatcaaatgaggagcttctggaggccgtaatggaaatcttgcacctggacatgcctctggatttttgcctgaacattgcaaagctgctgatggaccatgaacgcgagagcgtcggctttcactttcttaccatcatccacgagcggttcaaatcaagcgaaaacattggtaaagtcttgattttgcataccgatatgcttcttcagcgcaaagaggaactgctggccaaggaaaaaatcgaggaaattttcctggctcaccagacaggccggcagctcacggccgaatctatgaactggttacacaacatcctgtggcgccaggccgcttccagcttcgaagttcagaattacaccgatgctctacagtggtattactactccctgcgtttttactcaacagatgagatggatctggattttactaagttacaacggaacatggcttgctgctatctgaatctacaacagctagacaaagccaaagaagccgttgcagaggcagagcgacacgatccacgaaacgtgtttacccagttttatatcttcaagatagcagtgattgaggggaattcggaaagggctctgcaggctattataactctggaaaacattcttactgatgaagagtctgaggacaatgacctggtggctgaaagaggcagtccaaccatgttgttgtccctggccgcacagtttgcactggagaatggacagcagatcgtcgcagagaaagcgctggaatacctggctcagcacagcgaggatcaagaacaagtgctcactgccgttaagtgtctgctccggtttctgcttccaaagattgcggagatgcccgaatctgaggataaaaagaaagagatggacagactcctgacatgcttgaacagagcctttgttaagctgtcacagccgtttggggaggaggcgctgagtttggagtccagagccaacgaagcacagtggttccgcaaaactgcttggaacctggctgtacagtgtgataaagaccctgttatgatgcgggaatttttcatcctgtcgtataaaatgagccaattctgtccgtccgaccaggtcatcctgatagcaaggaagacctgccttctgatggcagtcgccgtggatttggagcaaggcaggaaggcctctacagcctttgaacagacgatgttcttgagcagagccctggaggagatccagacctgtaacgatatccataatttcctcaaacaaacagggacattttccaatgattcttgcgagaagctgctgctcttatacgaatttgaggtccgggcaaaacttaacgacccgctgcttgaaagtttcttggagagcgtgtgggaactccctcacctggagacaaaaacttttgaaactattgccatcatcgccatggagaagcctgcccattatccgctaatcgccctgaaagcgctcaaaaaggccctgctgttgtataagaaggaagaacctattgatatctcacagtactctaaatgtatgcacaacctggttaaccttagcgtgcctgatggggcgagcaatgtagaactctgccccctcgaggaagtgtggggttacttcgaagacgctctgagccacattagtcgcacgaaggactatcctgaaatggaaatcctgtggctgatggtcaagtcctggaatacaggggtcctaatgttttcacgaagtaagtacgcctctgctgagaagtggtgcggcttagcgctgcgatttcttaaccacctgactagttttaaagaatcctatgaaactcagatgaacatgctctactctcagctcgttgaggcactgtccaataacaagggaccagtgtttcacgaacatggatattggtccaaatcggactag

SEQ ID NO: 208382 - DNA, 372 bp, Artificial Sequence
  Description of Artificial Sequence: Synthetic coding sequence
atgatggccaaccacctggtgaagcccgacaaccggaactgcaagaggccacgagaacttgaaagtccggttcccgatagcccccagttatctagtctgggtaagtccgactcctctttctctgagatttcgggcttgttctacaaagatgaggccctggagaaagacctcaacgacgttagcaaggagattaatctgatgctgtccacttatgccaagcttttgtccgagagagctgcagtggatgctagttatattgacgagatagatgagcttttcaaggaggccaatgctatcgagaacttcctaatacagaagcgggagttcctgaggcaaaggttcactgtgatagccaacacactacacaggtag

SEQ ID NO: 208383 - DNA, 372 bp, Artificial Sequence
  Description of Artificial Sequence: Synthetic coding sequence
atgatggccaaccacctggtgaagcccgacaaccggaactgcaagaggccaagagaactggaatccccagtgccggactcaccgcagcttagcagcttgggtaaaagtgattccagcttctccgaaatcagtggcttgttttacaaagacgaagctctggagaaggacctgaatgatgtttcaaaggaaattaatctgatgctcagcacttacgcaaagctcctaagcgaaagggccgcagtagacgcttcatatatcgatgagattgacgaattgtttaaagaggctaatgccattgagaacttcttgatccagaaaagagaattcctccgtcagcgattcaccgtgattgccaacactctccatcggtag

SEQ ID NO: 208384 - DNA, 1059 bp, Artificial Sequence
  Description of Artificial Sequence: Synthetic coding sequence
atggccctgcggcccgaggaccccagcagcggcttccggcacagcaacgtggtggcattcatcaacgaaaagatggctcgtcacacaaaagggcccgagttctacttagaaaacatttctttaagctgggagaaggtggaggacaagctgagagctattctggaggactccgaggtgccgtcagaggtgaaagaagcctgtacttggggatctttggccctgggcgtgagattcgcccatagacaggcccagctccagcgccacagagtcagatggctccatgggtttgcaaagctgcataagagcgctgctcaagctctcgcgtccgacttaaagaagcttagagagcagcaggagacggagaggaaagaggccgccagcaggctcaggatggcccagacatcgctagtggaagtgcagaaagagcgagacaaggaattagttagtccccatgagtgggaacagggtgcagggtggcctggcctcgccacggccggtggagtgtgcaccgaaggagcagcagaagaggaggaagaggccgccgtcgcggccgctggcgctgcaggcggcaagggtgccgaagaggaacagcgcggctgctggcggttgtggctgcccctgtggaggccctggttgcctctctggcggctggggcttcccccttggaggccttccagtccaacttggagacctggcctgccaccctggagacctcagcgcagctggcgcgagagctcttgctctagcctggagatgcttatacgcaaatctactcctatcggaggcaggcgaagggaaatctctgggagatcaaagcaaccccacctgatctccctagagccgagaactcccgggcccgagccacatcagaacctttttctcagctcgtctctgccacatacgcatacccacactcaagccttgttcccaccgtcgcagacttatcctctctatcctctccacaagcaacaatctcagcaccagtttcgcctgagctgcctgcccaccggaaggccacttatcttagcttgtgggctgatgggcggccctacggagtag

SEQ ID NO: 208385 - DNA, 1059 bp, Artificial Sequence
  Description of Artificial Sequence: Synthetic coding sequence
atggccctgcggcccgaggaccccagcagcggcttccggcacagcaacgtcgtagcctttatcaatgaaaagatggctcgccataccaaagggcccgaattctacctggaaaatatctccctctcttgggaaaaggtcgaggacaagttgagggccatcttagaggacagtgaagtgccttccgaagtgaaggaggcttgcacttggggctctctggccctcggtgtgcggtttgcgcatagacaagcccagctgcagcggcaccgggtcagatggctccatggcttcgctaaactccacaaatctgccgcccaggccctggcatccgatctcaagaagttgagagaacagcaagagaccgagcgaaaagaggccgcatcacggctgaggatggcgcaaacatctttagtggaagtgcagaaagagcgggacaaggagttagtctccccgcacgaatgggagcagggcgcgggctggcccgggctcgccactgccggcggagtgtgtacagagggcgctgcagaagaggaggaggaggccgcagtggcagcggctggcgcggccggaggaaagggtgccgaggaagaacagaggggttgctggaggctgtggttaccactgtggagaccctggcttcccctgtggcggttaggcctgcctccttggagacccagtagtcccacttggcgacctggattgcccccttggaggccacaacggtcttggagggaatctagttgctctagcttggagatgctcatcaggaagtccacccccatcggggggcgtagaagggaaatctcgggccgctcaaaacaacctcaccttatcagcttggaaccaagaacacccggaccggaaccccatcagaatctcttcctctcttcttcactgcctcacacccacactcatacccaggcgcttttccccccaagccagacctatcctctctatcctctgcacaagcagcagtcccagcatcagttcaggctgtcctgccttccaaccggacgtccattgattctcgcctgtggactcatgggcgggccaaccgaatag

SEQ ID NO: 208386 - DNA, 1230 bp, Artificial Sequence
  Description of Artificial Sequence: Synthetic coding sequence
atggccctgcggcccgaggaccccagcagcggcttccggcacagcaacgtggtcgcgttcatcaacgaaaagatggcccgacatactaaggggcctgaattttacctggagaatatttcactttcttgggagaaggtggaggataagcttcgcgccattctggaagactcagaggtgccttctgaagtaaaggaggcatgcacctggggttccctggcactcggagtgcggttcgctcacaggcaggcccagctacagcgccacagggtgcgctggctgcacggtttcgctaagctacataaatccgctgcccaggctctggcatctgatctgaagaagttgagagaacaacaggaaacggaacggaaggaggccgccagcagactgcggatggcacagaccagcttagtcgaggtgcaaaaagaacgagacaaggaactagtgtccccacatgaatgggagcaaggagccggatggccgggtttggctacggctggcggggtctgtaccgaaggggcggcagaggaggaggaggaagccgccgttgcagctgctggggccgccggggggaagggcgccgaagaagagcaacgagacgttgaggtggtcgctgccccagtcgaggcaatggcgcccccagtggaggcgggagctgcccccatggagacgcagtttccccacgtggaagcacgcgctgcaagcatggagaccaccgaaaaacttgaacggatcctgcttcagcttctcggggatgccgaccaggagaaatatacttactggggtcagaaggagggagacctcaggtcagtggaaacagccacttcttatttcagcggcacaactaacccctggagtcgggcatcttcagagcctttgcctgtgcagctgcccgcctcttacagctatagctactcatcgccatttagtagcttttcagacatccctaccattagtccccctcaggcaaccgtcactgcgccagtgccacctcagctcccatccgattgggaggccttcgatacatctctgtggtccgacgggggccctcaccgcatcgaccaccaggagcacccacgagaccggaggtatagcgagcctcatcaacagcggccgcccgtctataggcgtccgggagattgggactgtccgtggtgtaatgccgtaaatttctcacggcgcgatacatgcttcgactgcggaaaaggtatttggttgcaaaagccacactag

SEQ ID NO: 208387 - DNA, 939 bp, Artificial Sequence
  Description of Artificial Sequence: Synthetic coding sequence
atggccctgcggcccgaggaccccagcagcggcttccggcacggcaatgtggttgctttcattatcgaaaaaatggcacgtcatactaagggccctgagttctacttcgagaacatatctctcagctgggaagaggtagaagacaaactccgcgctattctggaagacagcgaggttccttccgaggtgaaagaggcatgtacatggggctcgctggccctgggtgtgaggttcgcgcacagacaggggcagctgcagaacagacgcgtacaatggctccagggcttcgccaaacttcatcggtcagccgcactggtcttggcttccaacctgaccgaactaaaggagcagcaggaaatggaatgtaacgaagcaactttccagctgcagttgactgagacgagcctggccgaagtgcagcgggaacgcgacatgctgcggtggaaactattccatgccgaactggcaccaccacagggccagggacaggcaacagttttcccgggtctagctacagccggtggcgattggacggagggtgctggagagcaggagaaagaggcagtggccgccgctggagccgctggcgggaagggagaagaaaggtatgctgaagcgggcccagcccccgctgaagttcttcagggactcggtggtgggttccggcagcctctcggcgcaattgtggcgggcaaactgcacctctgtggtgccgagggagaaaggtcccaggtcagcacaaattcacacgtttgcctgttatgggcttgggtacatagcttgaccggcgcatccagttgtcctgctccttatttgatccacatactgattcccatgcctttcgtacggctcttatctcacacccagtatacaccatttacgtcgaagggccatcggacaggctctaactcagacgcttttcagctggggggtctctag

SEQ ID NO: 208388 - DNA, 4494 bp, Artificial Sequence
  Description of Artificial Sequence: Synthetic coding sequence
atgagccgggccgtgcggctgcccgtgccctgccccgtgcagctgggcactctacgaaatgacagcctggaagctcaactccatgagtatgttaagcagggcaattacgtgaaggtgaagaaaatactgaagaagggtatttacgtagacgcagtaaattcacttggtcagacagctttgttcgtggctgcccttctaggccttcgcaaattcgtggacgtgttggtggactacggaagtgaccctaaccatagatgttttgatggctctacacccgttcacgcagcagcattctctgggaaccagtggattctgagcaaacttctggatgctggtggggacttgaggctccacgatgagcgcggccaaaatccaaaaacctgggcgctcactgcaggaaaagagcgctctacccagatagtggaatttatgcagcgatgtgcctcgcacatgcaggctattattcagggtttctcttatgatctgctgaagaaaattgacagtccacagcgactcgtgtacagcccaagttggtgcggcgggttggtgcaggggaaccctaacggaagcccaaatagattgctgaaagcgggagttattagtgcgcagaacatttactcatttgggtttggaaaagcaatgccatggttccagttctaccttactggagcaacccagatggcttatcttggaagcttaccagtgatcggagagaaggaagtgattcaagcagatgatgaacctaccttcagcttcttttctggcccttacatggtcatgaccaatttggtatggaacggatccagggtgacagttaaggaacttaatctgccaacccacccccattgcagccgattaaggctggctgatctgcttatagccgaacaggagcacagcagcaaactgaggcacccttacctcctgcagctgatggcagtgtgcctgagccaggatttggagaagacccgcctcgtctatgagagaatcacgatcggtacgctgttctctgtgctgcacgaaagacgctcacagttccctgttttacatatggaagttatcgtgcacctgctcttacagatttctgacgccttgcggtatctgcattttcaaggtttcatccatcgctccctgagctcttatgccgtgcacatcatttccccaggagaggcccggttgacgaatctggaatatatgctagagtcggaagaccgcggggtgcaacgggatctgacccgcgtaccgttaccaactcagttatataactgggccgcccccgaggtgattctccagaaagccgcgacagtgaagagcgacatctacagcttctcgatgatcatgcaggaaattcttactgatgatataccctggaaggggctagatggtagcgtggtcaaaaaagccgtggtgagcggaaattacctcgaggccgacgtgcgtctccccaagccctattacgacatagtgaagagcggcatccacgtcaaacagaaagacagaactatgaacctccaggatatccggtacattctcaagaatgatcttaaagactttaccggagctcaaaggacccaacctacagagtcccctagagtgcagcggtatggattacatccagacgtgaatgtgtatttgggactcacgtccgagcaccccagagagactccggacatggaaataatcgaattgaaagaaatggggagtcagcctcatagccctagggtccactccctgttcacagaaggtacgctggacccacaggccccagatccgtgtctgatggcacgtgagacccaaaatcaggacgcaccatgtccggccccctttatggcagaggaggctagctctccaagtactgggcaaccctctctctgtagtttcgagataaatgagatctattctggctgcctcatccttgaggacgatatcgaggaacccccaggcgccgcctcctcactggaagcagacggcccaaaccaagtggatgagctcaagagcatggaagaggagctggacaaaatggagagggaagcctgttgttttggctcagaagatgaaagctcttcaaaggccgagactgaatatagctttgatgactgggactggcagaacggtagcttgtcaagcctttcccttccagaatctacaagggaagcgaagtcgaacttaaacaacatgtccactaccgaggagtatctgatctcgaagtgtgttctggacttgaaaatcatgcagaccattatgcacgaaaatgatgataggttgcggaacatcgaacagatcctcgatgaggtggaaatgaaacagaaggagcaagaggagaggatgtccttgtgggctacatcacgagagtttactaacgcctataagttaccacttgccgtgggccccccatctttgaattacattcctccagtgctccaactgagcggcggacagaagcccgatactagtggaaattaccccacactcccgaggtttccgcgcatgctgccaaccctgtgcgaccctgggaagcagaacactgatgagcaatttcagtgtacacagggtgccaaggattctttagagacctcccggatacagaacacgtcttcccaggggaggcctcgcgaaagcacagcacaggccaaggccacccagttcaatagtgctctgtttactttatcttcgcataggcaggggccatcggccagtccttcctgtcattgggacagcacgagaatgagcgtcgagccagtctccagcgaaatatacaacgccgagtctcggaataaggatgacggtaaggtgcacctaaagtggaaaatggaggtgaaggagatggctaaaaaggcagccacaggacagctcacggtcccaccttggcacccacagagtagtctgacactggagtcagaggcagagaatgaaccagacgcactccttcagccccccatccgcagtcccgagaatactgattggcagcgtgtgattgagtaccatagagagaacgacgagccaagaggcaacggaaaatttgacaagaccgggaataacgactgtgactccgatcagcacggccgacagccaaggctcggctcatttacatcaattcgtcatccgtccccaaggcaaaaggaacagccagagcattccgaagctttccaggctagcagcgacaccttggtcgcagtggagaagtcctacagccaccaaagtatgcaatccacctgtagtcccgagtctagcgaggatataacggatgaatttttgacgccagatggtgaatatttctactcctctacagctcaggaaaatttggcactggaaacaagctcgccgatcgaagaagacttcgaggggatccagggagccttcgctcagccacaagtgagtggagaagaaaagttccaaatgcggaagatcctgggtaagaatgccgaaattcttcccagaagccagtttcagcccgtccggtccacagaagacgagcaggaggagaccagtaaagaatcacccaaagaacttaaagaaaaggacattagtttaactgatatccaggacctgtcttctatctcctacgaaccagactcttcctttaaagaggcatcatgcaaaacaccaaagataaaccatgctcctacatccgtgagcacaccactgagccctggaagcgtcagctcagccgcctcccagtacaaggactgccttgagtctatcactttccaggttaagacggagttcgccagctgctggaattcccaagagtttatccagacactgtcagatgacttcatcagcgtgagggagagggccaaaaaacttgactcactgcttacctcgtctgaaacgccacccagcaggctgaccgggctaaagagactgtcctccttcatcggggcaggcagtccttcactggtcaaagcctgcgactcttcacccccccacgccacccagaggcggtctctgcccaaggtggaagctttctctcagcaccatatagacgagcttccacccccctctcaggagctgttggatgatattgaactgctgaagcaacagcaggggtcttccactgtgcttcacgagaacaccgcctcagacggtggaggtactgccaacgatcagcgccacctcgaagagcaagagaccgatagcaaaaaagaagacagttcaatgttgctgtcaaaagagacagaggacctgggcgaagataccgagcgggctcacagcacattggacgaggatctcgagcggtggctgcaacccccggaggagtcagttgaactccaggacctgccgaaggggtctgagcgcgaaacaaacatcaaggatcagaaagtcggggaagagaagcgaaaaagagaggatagtattacgcccgaacgacgtaagtctgaaggagtcctcggaacctctgaggaggacgagttgaagtcctgcttctggaagaggttagggtggagcgaatctagccggataatcgttctggatcaaagcgatctgagcgactag

SEQ ID NO: 208389 - DNA, 4356 bp, Artificial Sequence
  Description of Artificial Sequence: Synthetic coding sequence
atgagccgggccgtgcggctgcccgtgccctgccccgtgcagctgggcacactacggaacgacagtctagaggcccagctacacgaatacgttaagcaaggaaattatgtcaaggtgaaaaaaattttaaaaaagggcatttacgttgatgcagtgaactcccttggtcagaccgcactctttgtggccgccctgctggggcttagaaagttcgtggatgtgctcgtggactacgggtcagacccaaatcaccgctgcttcgatggctccactcctgtccacgctgcagctttctctggaaatcaatggattctgagtaaactgttagatgccggtggggatctgagactgcatgacgagcggggacagaacccaaagacttgggcacttaccgccggtaaggaaaggagcacccaaattgtggaatttatgcagaggtgcgcgtctcacatgcaggcaataattcaaggatttagctatgacctcttgaaaaaaatcgactcgccacaaagactggtttattccccaagctggtgtggaggtttggtgcagggaaacccaaacggaagccccaacagactcttgaaggccggagtgataagcgctcaaaatatctactcattcggcttcggtaaattctacttaactggagcaacccagatggcttacctgggcagcctgcccgtaatcggggagaaggaagttatacaagctgacgatgagcccactttctcttttttctcaggcccgtacatggttatgacaaatctggtgtggaacggaagtcgcgtaactgtcaaagaattgaacctgcctacacaccctcactgcagtcggttacggctagcggacctcctgattgctgagcaagaacactccagcaagctgcgccacccataccttctgcagctgatggccgtctgcctgtctcaagacttagagaagacccgcctggtgtatgagcgcattacaattggaacgctgtttagcgtgctccatgagcggcgcagtcagttccctgtgttacatatggaagtgatcgtccacctgttgctgcagatcagtgatgcacttaggtatctccacttccaaggcttcattcataggagtctaagtagttatgccgtgcacataatctcacccggcgaggcaaggctcacaaatctggagtacatgttggagagtgaagatagaggcgtgcaacgagacctcacccgagtccctctgcccactcagctatataactgggccgcacccgaggtgattttacaaaaggccgcgacagtgaagagtgatatctatagcttttctatgattatgcaggagatccttactgatgacattccctggaagggcttggacggatcagttgtcaaaaaagctgttgtgtccggaaattacctggaggccgatgtgagactgcccaagccctactacgacatcgtaaagagcggaattcatgtgaagcagaaggaccgtaccatgaacctgcaagacatccgctacattctaaagaacgacctgaaagactttactggggcacagcgtacacagcccaccgaaagccctagggtgcagaggtatgggctgcaccctgatgttaatgtttatcttggccttacctcggagcatccccgggaaacccctgatatggagattatagagctgaaggaaatggggtcccaacctcattccccgcgagtacactccctcttcacagagggcactctggacccccaggcaccagatccgtgtctaatggcgcgtgaaactcagaaccaagatgccccgtgtcctgcccctttcatggcagaggaagcaagctcaccaagtacgggtcagccttcactgtgctcattcgaaatcaacgaaatctactccggatgcctgatcctggaggatgatatcgaggaacctcccggggctgcttcctccttggaggctgatggccccaaccaggtggacgagctcaaatcaatggaggaagaactggacaagatggaacgtgaggcctgttgcttcggttcagaggatgagagttcatccaaggcagaaacagagtactcgttcgacgactgggattggcaaaatgggtccctttcttccttgtctctgccagaatccacgagggaggcaaagtctaatctcaacaatatgagcactacagaagaatatctcatcagtaagtgcgttttggacctaaaaatcatgcaaacgatcatgcacgagaatgatgataggctgaggaacatagagcagatccttgatgaagtggagatgaagcagaaagaacaagaggagagaatgtctctctgggcaacgtctcgagaattcacaaatgcttacaagcttccgttggcagtaggcccacctagcctgaactatatccctcccgtgctgcagctgagcggcggtcaaaaacctgataccagcggtaattaccccaccctccccaggtttcctagaatgctgccaactttatgcgatcctggcaaacaaaacacggacgaacagtttcagtgtacgcagggggcaaaggattcattggaaacgagccggattcagaatacttcatcacaagggcgaccacgggagtccactgctcaggccaaagccacgcagtttaattccgccctattcaccctctcctcacaccgacagggaccgtccgcaagccccagctgccactgggactctactagaatgagcgtcgagcccgtcagctccgaaatttataacgctgaatcaagaaacaaggatgacggaaaagttcacttaaaatggaaaatggaagtcaaagaaatggctaaaaaagctgccactggccaactaactgtacctccttggcaccctcagagctccctgacactcgagagcgaggcggagaatgaacctgacgcgctcctccagccgcctatcaggtctcccgagaacaccgactggcagcgagtgatcgaataccatcgtgagaatgacgagccccgagggaacggaaaatttgacaagaccggcaataatgattgtgattccgaccagcatggccggcagccaaggctgggttcttttacctccatcagacaccctagcccacgccagaaagaacagccagagcattccgaggctttccaggccagcagtgataccctggtggcagtggaaaaaagttactcaacttccagccctattgaagaagacttcgagggaatacagggcgctttcgcgcaacctcaggtgtccggtgaagagaagtttcagatgcggaaaattctagggaagaatgcagaaattctcccccggtcccagttccagcccgttcgcagcacagaggatgaacaggaggaaaccagcaaagaatctcccaaggagctgaaggaaaaagacatttcacttacggacatccaggatctgagttctatcagctacgagccggattcttccttcaaggaagccagctgcaagactccgaagatcaaccatgctcctaccagtgtatccactcccctgtcccctggcagtgtgtccagcgccgcctcccagtataaagactgcctggagagtataactttccaggttaagacggaattcgctagctgctggaatagtcaagagtttattcagaccctgtctgatgattttatttccgtgcgggagcgggctaaaaaactggattcccttttgacgtcctctgaaactcccccatcacggctgaccggtctcaagagacttagctctttcatcggcgcggggtcgcctagtctggtcaaagcttgtgacagcagtcctccacatgctacccagcgcagaagcttacccaaagtggaggccttcagccaacatcacattgatgagctgccccctccctcccaggaactgctcgacgacatcgagcttctcaaacagcagcagggaagcagcactgttctgcatgaaaacactgccagcgatggtgggggcacggccaacgatcagcggcacctggaggaacaagagaccgatagcaaaaaagaggacagttcaatgctgttaagtaaagagacagaggatctgggagaagatactgaacgtgcccattccacactggacgaagatctcgaaaggtggttacagccacccgaggagtctgttgaactccaagacctcccaaaaggatccgagagagagaccaatatcaaggatcaaaaagtcggcgaggaaaagcgaaaacgagaagatagcattacccccgaaaggcggaaaagcgagggtgtcctcggtacgtctgaagaagacgagctgaagagctgtttttggaaaaggctgggatggagtgagtcctccaggataatcgtgctcgatcaaagtgacttatccgactag

SEQ ID NO: 208390 - DNA, 4476 bp, Artificial Sequence
  Description of Artificial Sequence: Synthetic coding sequence
atgagccgggccgtgcggctgcccgtgccctgccccgtgcagctgggtaccctgaggaatgactcgctggaagcacagttgcacgagtacgtcaaacagggtaactatgtaaaagtgaagaaaatcctcaaaaaggggatctacgtggacgctgtgaacagcctgggccagactgccctttttgtcgccgcccttctcggtctaaggaagttcgtagacgtcctcgtggattacggaagtgatccaaaccataggtgctttgatgggtccacaccagtgcacgcagccgccttctcaggaaatcagtggatcctatctaaattactcgacgctgggggagatttgaggttacatgatgaaagaggtcagaaccctaaaacatgggcccttactgccggcaaggagaggtccacacagatcgtagaattcatgcagcgttgcgcttcccatatgcaggctattatccaaggatttagctacgatctccttaaaaaaatcgacagcccacagcgtctcgtgtactctccctcgtggtgtggaggactggtgcaggggaaccctaatggcagcccaaacaggctcctcaaggccggcgttattagcgctcaaaacatctattcctttggcttcggaaaattttacctgacaggcgctacacaaatggcatatctgggatccctgcctgttattggggagaaagaagtgattcaggcagatgacgagcctacattctcgttctttagcggaccttacatggtaatgaccaacttagtttggaacgggtctagagtcaccgtcaaagagttgaacctgcccactcaccctcactgctctcgacttcgcctggccgacttgttgatcgcagagcaggaacactcatctaagcttcggcacccctacctgctgcagctgatggcagtttgtctgtctcaggacctagagaagaccagattggtgtacgaaagaataactattggaactctcttctccgtgcttcacgagaggcgcagccagttccctgtgttgcacatggaggtcatcgtacatttgctgcttcagatttctgacgccctccggtacctgcactttcaagggtttatccacaggtcactcagcagttatgccgttcacataatcagccctggcgaagctcggctaaccaatctcgaatatatgctcgagagcgaggaccggggtgttcaaagggatctcacccgggtgccgctgcccacacagctgtataactgggctgccccagaggtgatcttgcaaaaggcagctactgtgaaatctgatatttacagtttttctatgattatgcaggagattctcacagacgacataccatggaagggactggatggcagtgtcgttaagaaagctgtcgttagcggcaattatcttgaagcagatgtgcgtctcccaaagccttactacgacatcgtgaagagcggtattcatgtgaagcagaaagatcgcaccatgaatctgcaggacattcggtacatactgaaaaacgacctaaaggattttactggtgcccaacgaacacaacccactgagtctccccgcgtacagaggtatgggctgcaccccgatgtaaatgtctatctgggactcactagcgaacacccccgagagacacctgacatggagatcattgagcttaaagagatgggctcccaaccccacagcccacgtgtccacagcctgttcacagaaggaacgctagacccccaagccccagacccttgcctaatggcccgtgaaacccagaatcaggacgccccatgtccagccccgtttatggcagaggaggcttccagcccatctaccgggcaaccaagcctgtgttccttcgaaattaatgaaatttattcgggctgcctcattttggaagacgacattgaggagccaccaggagctgcctccagcctggaagctgacggaccaaatcaagttgatgagttaaagtctatggaagaagaattggataaaatggaaagggaggcatgttgttttggtagtgaggacgagtcttctagtaaggcagaaacagagtactctttcgacgattgggattggcagaatggtagtctgtctagtctttcgctccccgagtcaacacgggaggccaagagtaacctcaacaacatgtcaaccacggaagaatacctgatctcaaaatgcgtgctggatctgaagataatgcagacaattatgcatgagaacgatgatagactccgaaatatcgagcagatccttgacgaagtcgagatgaaacaaaaggaacaggaagagcggatgtccctgtgggccacatctcgcgagtttactaacgcatacaaactgcccctcgcggtgggacctcccagtcttaactacataccccccgtgctgcagctctctggagggcaaaagcccgacaccagtggaaactacccgacccttccccgctttcctcgaatgctccccactctatgtgacccaggaaaacagaatactgacgagcagtttcaatgcactcagggcgcaaaggattccttggagacttctaggattcagaatacaagtagtcaaggaaggccacgggagtccacggcgcaggctaaggccactcagtttaattctgccctttttacattatcctcccaccggcaggggccgagcgcgtcgcccagttgccattgggatagtactcggatgagcgtcgaacccgtgagcagcgagatttacaacgcggaaagcaggaataaggacgatggcaaggtgcacctgaagtggaaaatggaggtgaaagagatggcgaagaaggcagcaacagggcagttgacggttccaccctggcaccctcagtcttctcttaccctagagagtgaagccgagaacgagcctgatgcactcctccaaccacctatccgatcgccagagaatactgattggcagcgcgttattgagtaccacagggagaatgacgagccaagggggaatgggaagtttgacaagacagggaacaacgactgcgactccgaccagcacggaagacagccgagactcggtagtttcaccagtattaggcacccgagcccgcgacaaaaggaacagccagaacatagcgaagctttccaagcgagctccgatacgctagtcgccgtggaaaaatcctacagtcaccagtccatgcagtccacttgtagcccagagagtagcgaggatatcacagatgagtttctcacccctgacggggagtacttctatagttctaccgcgcaggaaaatctggccttagaaacaagttcccctattgaagaagattttgagggcatccaaggagccttcgcccagcctcaagtctcgggcgaggaaaagtttcagatgcggaagattctcggaaaaaacgccgagattttaccgcgctcccagtttcaacccgtcaggagcacagaagacgaacaggaagagaccagtaaagagtcccccaaggagttaaaggagaaggacatttcgctgactgacatccaggacttatcttcaataagctacgagccagactcctccttcaaggaagccagctgtaagacccccaaaattaaccatgctcctacttcggtcagtacccccctttcccctgggtcagtcagttctgcagcgtcccagtataaggactgcctggaaagcattacctttcaggttaagactgaattcgcctcctgttggaactctcaggagttcatccaaacattgagcgatgacttcatatcagtgagagaaagggcaaaaaagcttgatagtcttttgacttccagtgagaccccaccctcccggctgactgggctcaaacggctctcttccttcattggcgctggcagcccgagcctggtgaaggcgtgtgattccagcccaccccacgccacgcagcgccgtagtctgcccaaggtggaggctttcagccagcatcatattgacgaacttccacctccttcgcaagagctcctggatgacatcgagctgctgaagcagcagcaggggtcgtccaccgtgctgcatgaaaacactgcctccgatggaggcggcactgcaaatgaccagcgccacctagaagagcaagaaacggactctaagaaagaggactcgtcaatgcttttgagtaaggagactgaagaccttggagaggataccgaacgcgctcattccaccctagatgaggatttggagagatggctccagccaccagaagaatcagttgagctacaggacctgccaaagggaagcgagcgcgaaactaacattaaggatcagaaggtgggggaagagaaaagaaagcgggaagactcgatcacccctgaaagacgcaagtctgagggcgtgttgggaaccagtgaggaggatgagctgaaatcctgtttttggaaacgactgggctggtcggaatcgagtcggattatcgttctggaccaatcggatctttctgattag

SEQ ID NO: 208391 - DNA, 8370 bp, Artificial Sequence
  Description of Artificial Sequence: Synthetic coding sequence
atgcccagcgacgccaaggacagcgtgaacggcgacctgctgctgaactggacctcactcaagaatatcctctcaggccttaacgctagttttcctcttcataacaacaccggaagtagtacagtaacaactagcaagagcattaaagatccaagactgatgcgcagggaagaatccatgggcgagcaatcaagcacggctggtttgaacgaggtgctccaattcgaaaaatctagcgataacgtaaattcggagatcaagtcaactccttctaactccgccagctcttcagaggtggtaccaggcgattgcgctgtgctcactaatggcctcgacacaccttgttttaagacctctgttaacgactctcagtcatgggctcataatatggggagtgaagattacgattgcataccaccaaacaaagtgaccatggcgggtcagtgcaaggatcaaggcaacttttctttccccatctcagtcagcaatgttgtgagcgaggtggaaaatcaaaaccattccgaggagaaggcccagcgagcacaacaggagtctggtaatgcctacaccaaagaatacagtagccatatctttcaggattcccagtcttctgatctgaagacaatttatcagacagggtgccagacatcgaccgtgttccctctgaagaaaaaagttagcatcgatgagtatctgcagaataccgggaagatgaagaactttgctgacctagaagatagctccaaacacgaagaaaagcagacatcctggaaagagattgataatgactttaccaacgaaacgaagatcagtcctatagacaattatattgtgctccaccaggagtataaagaatctgagagccataattcctttggaaagagctgcgataagattctgatcacccaagagctcgaaattactaaaagtagtacgtctacaattaaggacaaggacgaactcgatcatctggcccttgagtggcaaatcacacctagcttcgaatcattatcacagaaacatcctcaacattcggtggaatatgagggcaacatccatacgagcttagctattgcccagaagctaatggaactcaagctgggcaaaatcaatcagaattacgctagtatcattaccgaagcgtttccaaagcctaaagacataccccaggccaaagaaatgttcatcgacaccgtgattagctcttataacattgagacagcacacgatagcagcaattgttccatcaccagggaacacatctgcgtacatagaaagaatgaaaatgagccagtgtctctcgagaatatccagagggactacaaggagacagcttacgttgaggatcggggccaggatcacaacctcttttgcaattcgcagctgtcaaacgacatctggctgaatgtcaatttcaagaagcagactgacagagagaaccagaacgaagcaaaagagaatagcgcttcctgtgtggaaaacaatatcgagaatatttacggcgacaagaagcaggattcacacaccaacgagaacttctctaacatcgacgagaaagaagacaagaactatcataacattgagatcctgtcgtcggaagagttctcgaccaagttcaacctgatctgccgggaggataacgccgtgtccgctgcgactgccctgttagagtccgaagaagacactattagcgctgtgaagcagaaggatacagagaacaccggcaggtccgtagaacacctggcctccaccaccttccccaagactgcctcctcgagcgtgtgcgttgcatctaacgccgcaatacagattgctagcgcaacgatgccggcactctcccttaacaatgatgaccaccagatttaccaatttaaagaaacttgctccagtgagagccctgactttgggctcctggttaagcaccgggtctccgactgtgagattgacacagataaaaataagtctcaagagagtttccaccagagtattaatgagaatctggtgctgcagtccatagaactcgagagcgagatcgagatcgaacttgaagactgtgacgacgcctttatctttcagcaagacacgcactcccatgagaatatgctgtgtgaggagttcgtaacgtcgtacaaagccctaaagtcaagaatcagctgggaaggactcttggctctggacaatggggagatggaagtgcttgaaagtaccacaggccgtgagaactcggaccagcattacagcaaagaatcaaactacttctattcaagcactcagaataatgaaactgagctgacgagtcccattctcctacccgatttgcagataaaaatcacaaatatcttccgccctggatttagccccacagccgacagtcttgctctaaaggattctttctgcactcacgtgacagaggccacaaagccggagatcaacaaagaagatggcgagatcctgggtttcgatatttactcccagccctttggcgaaaatgccgactatccttgcgaggataaagtggacaacatccgccaggagagcggacctgtttcaaacagcgagatctctctgtccttcgatctgtccagaaataccgatgttaaccacacctcagaaaaccaaaactctgagagcttgtttactgaaccctctaacgttacaaccatagacgatggctcccggtgcttttttactaagagtaaaacagattataatgacactaagaacaaaaaggaagtggagtccagaatatcaaagcgcaaactacacataagttcacgggaccagaacattccacacaaggatctacggcggcataaaatatatggccgaaaacgccgcctgacttcccaggattcttctgaatgtttttcctccctgtcccaaggtcggattaaaacattttcccagtccgaaaagcatatcaagtctgttctgaatattctctcagatgaggcttccctctgcaagtcgaagtgcctgtcgagaaagctcgataaagcagtagtgcatttaaagaaagctcacaggcgggtgcacacctcgctccagctcattactaaagtcggagaggagcggaagggcccactgcctaagtcttacgcgattatctgcaacaacttttgggagagttgtgacctgcaaggttatagcagcgtgagccagaggaagtattattctaccaagcatttttcatcaaagcgaaagtacgacaagagaagaaagaaaagagcaccaaaggcagatatctcaaagagcctgactcatgtgagtaaacacaaaagctacaagacttccggagaaaaaaagtgcctttctaggaagtccatggcatcctctgtgtcgaagtcccacccaacaaccagccacatgggggaattctgtaatcaggaacatcctgaatctcaacttcccgtctcttccactagtcagtctacgagtcagtctgtctattataatagttccgtctcaaacccgagtctcagcgaagaacaccagccttttagcggtaagactgcatacctgttcagccctgatcactcagatgaaaaattaatcgaaaaggaaaatcagattgatacggctttcttgagctctacctcaaagtatgagaagctcgagaaacacagtgcaaaccacaacgtgaaggatgccaccaaagaaaattcatgcgatgcaaacgaagtgataaatgaaagcaattcagtttcactcagctgcataaaggagaacatcaattccagcacaggtaatgattgcgacgctacttgtatcgggcatacgaaggccaagactgatgtgttaatatccgtgctggactctaatgttaaacactttctcaatgacctgtatcagcagggtaacttaattctgtccgattgtaaacgcaatttggaagtgaagtggacagaccccattgaaagacccaagcaaaacataatcaccggcaactttctcatgggcccactcaacctgacgctgatcgctagtaagaagtatagcatcccccagcttagtgctgccgccgttacagacagtgagggtgaaagtagcaagtcctatctggacaagcaaaggattcttacagtggattcctttgctgcatccagcaccgtaccccattgtgaacagagctgtcgcgagaaggagctgttgaagacagaacaatgctcttctggaaactgcctccacacagacgggaatgagacgaatgtaacggagaattacgaactcgacgttgcctctggtaccgaagaagacaaatcttatggcgagaacatcgtcgaactctctagctcagactcaagcctgctgctgaaggataacgtgaagggttcttcaagcgaaacgtgtatcgtgaagaaggacacggaagatagaattacttggaaagtgaagcaggctgagaaggctaaggattcagtgtacaaacgctcgatgaccgaaggctccactgtaaatacagagtacaaaaaccaaaagaatcaaataagtgaagagtcatgtcttaatgaaaagataatcaccaccaatctgattgactctcacctctccacaaaaaacactacaactgagtccgtccctctgaaaaatactgtgagtaaccccctgaacaaacgagaaaaaaaaggagaaataaaagtttcgaaggactctcaaagtgacttgacccttcactcagagattgcttatatttcaaagcctggaatcctcggggtgaaccatacgccaatactgcccgcgcactccgaaacatgcaaagtaccaacgctgctgaagaagcctgcctcatacgtgagcgacttcaaagagaaacattgcagtgctaaccatacagcactcattgcaaacctgtcacagatcctccagcgtgctgatgaagcctcatccctgcagattctgcaggaggagacaaaggtgtgtctgaacatcttaccacttttcgttgaggcatttgagaggaaacaggagtgttctgtagagcaaattcttatctctagggagctgctggtcgatcagaatttatggaacaactgcaagcacaccctcaagccctgcgccgtggacactcttgtggagctgcagatgatgatggagaccatccagttcatcgaaaacaagaagcggcacttagaaggagaacctactctgaggtctctgctctggtatgatgagacactgtacgccgaactgctgggcaagcccaggggtttccaacagcagagcaacttctatccagggttccagggaagactcaaatacaatgcgttctgtgagctacaaacgtatcacgaccagctggtggaattattggaggaaacaaagagagaaaaaaattcatactacgtctttctgaaatacaaacgtcaggtcaacgagtgcgaggcaatcatggaacattgcagtgattgtttcgacttcagcttgtcggtgccattcacatgtggggtcaacttcggcgacagccttgaggacctcgagattctccgaaagtcgactctgaagctgatcaatgtgtgcggggacagccccaaagtgcacagctatcccggaaaacaggaccacttgtggatcatcatcgagatgatttcatctaaggtaaacttcatcaagaacaacgaagcagtgcgcgtgaagatctcgctctacggactggaacacatcttcttcgatgcagccaagaatctcgtgtggaaggagagaacccagagcttttccaaaaaatattctcagaagaaagacgaggaacgactgctccgcgtaaacaaatgtgctttctccaagctgcagaagatctatgacaccctgtctaaggatttaaacaacgaaccgatttctccaataggtttggaggaggacaccatcatcgcgagtcgcaagagtgaccatcctatcaacgaggccaccatcagcatagagaattctaagttcaactcgaacttgctggctcacccagatatctgttgcatctcggaaattctcgaccaagccgaattcgccgacttgaaaaagctccaagatttgaccctgagatgcacggaccacttagagatccttaagaaatacttccaaatgcttcaggataataatatggataacatttttattacggaagaaaacgtgctcgacgttgtgattaatcactctcatgaagcgatcatccttaagcccgaagcaattgagatgtatattgagatagtgatggtgtctgagaccattcacttcctcaaaaatagtatagccaaaaaactggacaaacagcgctttcgaggcatgctgtggtttgacctgtcccttcttcccgagttggtccagtgtcaggagaaaatggcttcctttagctttctcaaggacaattctaccgacgtgtgtttatggaaggtgatcgagacagctgtgtccgaactgaaaaaggatcttgatataatctgcaagtacaacgaagcagttaattgttcttacgccattcatcttctgtcacgcgaattacaggaactcagcgagatcaaaaagctgctcaaaaagtcaaaatacttcatatctacctacatcgactttgttccttacatcgcatccataaactacgggtccacagtgaccgaactggaatacaattacaatcagttctccaccttattgaagaatgtaatgtctgcgccccgcaaggatctggggaaaatggcccacatacgaaaagttatgaagactatcgaacatatgaaaatgatctgtaccaagaacgctgagcttactatctccttctttctatgccagatgctgtacaataggcgaaaaatcctccagctcaaacgcaaagagaagatgaacatccacattgttaaacccggcgagaacaataacaagttctccatctctaccatgctccctcccgtctctgaatgtatcaacaagaatatttctaactcttccaaaaagcgcccatcaaccgtggacaagtgcgaggactcccaggagcagcagcaggatacaacagtgtccagctgtaaaaaactgaaagtggacatgaaagatgtgacgaagatcaatcgagaaaaagctaccttcaagcatccccggacgaccggtagccatcccaagagcgaaaacaaaatcgtccctagctcctgcgacagtctgaagcgcaaccacctgactcccaaaaaggtggaaatgcagaggtctctgccaggaagcctgctcccactggagaaccccaaagacacatgcgcgtccaagagtgaatccaaaattgacctgacagtgtcaagtgaccacttttctgggcaacaagaaaacctgaacagcatgaagaaaagaaacgtcaacttctctgctgccgaaacaaagtccgataaaaaggattgtgccgcttttgctatttgtgaccagaagagtgttcacggcaccttcagtcctgatcatggcaccctgctgcaaaagtttctgaaaaattctccagacccaacacaaaagagttgtttgagtgatatcaacccagaaaccgacgtgtccctggttcccgacgcaagtgtgctcagtaagcctatattttgcttcgtaaaagatgtgcatccagacctggaaatgaatgacaccgtctttgaactgcaggacaacgatatagtcaatagctcgatcaaaaactcctcgtgtatgacctctccagagccaatctgtattcaaaataaaatccctactctgcaaatcaacaagctgcaaccaacggaaaccgagtccgaagataagtacatgaaagacactctcaaccctaacaccgtccatacttttggagccagcggtcatattactctaaacgtcaaccaaggggccgagtacagcctctctgagcagcaaaacgacaaaaactccaaggtgctgatgcaaaatgctgccacatactggaatgagctgcctcagtctgcttgcaaccccacttataatagctcggaacatttattcgggacctcatatccatatagcgcatggtgtgtttatcaatactccaactctaacgggaatgctattacgcagacctaccagggtattacttcttacgaagtgcagcccagcccaagtggactgttgactacggtagcttctactgcccagggaacccattctaatctgttatatagccaatacttcacatattttgcgggcgagccacaggcaaacgggttcgttcctgtcaatggctacttccagagccaaataccagcttctaattttcggcaaccaatcttttctcagtacgcaagccatcagcccctgccccaggccacctatccatacctccctaatcggtttgttcctcctgaagtgccctgggtgtacgctccctggcaccaagagagtttccacccagggcactag

SEQ ID NO: 208392 - DNA, 1233 bp, Artificial Sequence
  Description of Artificial Sequence: Synthetic coding sequence
atggtgctgaaggccgagcacacccggagccccagcgccaccctgccatcaaacgttccgagttgcaggtccctgtctagctccgaggacgggccttcaggacccagcagccttgctgacggaggccttgcccacaatttacaggattctgtgcgtcaccgcattctgtacctctctgaacaattaagggtggagaaggcatctcgggacgggaacactgtgtcatatcttaaactcgttagcaaagcagacagacaccaggtcccgcacattcagcaggcgtttgaaaaggtaaaccagagggcttccgcaacaatagcgcagattgagcaccgtctgcaccagtgccaccagcagctccaggaattggaggaaggctgcagacccgaggggttgcttttgatggcggagtccgaccccgctaactgcgaacctccgtcagaaaaggccctactgagcgagccacctgagccagggggagaggacggccctgtcaacctgccacacgcgtcaaggcccttcattctggaatcgcgcttccagagcctgcagcaaggcacttgtctagagactgaggacgtggcacaacagcaaaatctgttgcttcagaaagtgaaagccgaactcgaagaggccaaacgattccatataagcctgcaggagtcataccattccttaaaagagagatcactgactgacctacagctgctcctcgagtcactgcaggaggagaagtgtaggcaagctttaatggaggaacaggtcaatggcaggttgcaggggcagctaaacgagatctacaatctgaaacataacttggcctgttcagaagaacgaatggcgtacctctcctacgaacgagctaaggagatctgggaaattactgaaacatttaagtctcgcatttccaaactggaaatgctccagcaggtcacgcagcttgaggcagcagagcatctgcaatcacgacctccacaaatgctcttcaaatttctcagcccaagactgagcctggcaaccgtactgctcgtgttcgtaagcacactgtgcgcctgcccctctagcctaattagctcccggttgtgcacatgcactatgttaatgctgatcggtctgggcgtgctcgcttggcagcggtggagggcaattcccgccaccgattggcaggagtgggtgcccagtaggtgcaggttatactccaaagacagcgggcctcctgccgatgggccctag

SEQ ID NO: 208393 - DNA, 1233 bp, Artificial Sequence
  Description of Artificial Sequence: Synthetic coding sequence
atggtgctgaaggccgagcacacccggagccccagcgccaccctgccttccaatgtgccttcctgtcgctcattatcctcatccgaagacggcccatccgggccttcatcactcgccgacgggggcctagcccacaatcttcaggactccgtcagacacaggatcctgtacctgagcgagcagctgcgagtggagaaggcctctcgcgatggcaacaccgtcagttaccttaagcttgtcagcaaggctgatcgccaccaggtccctcacattcagcaggcttttgaaaaagtcaaccagagagcctccgccaccattgcgcagatcgaacataggctgcatcagtgccatcagcagctgcaggaattagaagaaggctgtcggcccgaagggcttctccttatggcagaaagtgatcccgccaattgtgaacctcccagtgagaaggccctgctgtccgaaccacctgagcccggaggagaagacgggcccgtgaatctgccccatgcatcgaggcctttcatccttgagtcccggtttcagtcgctgcagcaaggaacgtgcctggaaactgaggatgtcgcgcagcagcagaatctgttgctgcagaaggttaaggcagagttagaggaagctaagagattccatattagcctccaggagagctatcactccctcaaggaacgttccctcaccgacttacagctgcttttggaaagtctccaggaggagaaatgcagacaggcgttgatggaggaacaggtgaacggacggctccagggccagttgaatgaaatttacaaccttaaacacaaccttgcctgttccgaggaacgaatggcttatctttcctacgagcgcgcaaaggagatttgggaaatcacagagactttcaagtcaaggatcagtaaattagagatgctgcagcaagtgactcagctggaagcagctgagcacttgcagtcccggcccccacaaatgttgttcaagtttctgtcaccgagactgtcactagccacagtgttactggtctttgtgagcacactgtgcgcatgtcctagtagcctaatatctagcagactgtgtacttgtacaatgctcatgctcattggactcggtgtactcgcctggcagcggtggcgagctattcctgcaacagattggcaggaatgggtaccaagccggtgtcgtctctactccaaggactccgggcccccagctgatggcccttag

SEQ ID NO: 208394 - DNA, 945 bp, Artificial Sequence
  Description of Artificial Sequence: Synthetic coding sequence
atgcggcccgagggcagcctgacctaccgggtgcccgagcggctgaggcagggcttttgtggcgtgggccgagctgcccaggcccttgtatgcgcctctgccaaagagggtaccgcctttaggatggaagcggtccaggagggagccgccggcgtggaatccgagcaggccgcactaggggaggaagcagtactgctgcttgatgatatcatggccgaggtcgaggtggtcgcggaagtagaagtggtggctgaggaagagggccttgtggaaaggagagaagaggctcagcgggcccaacaggctgttccaggaccaggtcccatgacacccgagtctgcccccgaggaattgctggcggtgcaggtggagctcgaacccgtgaacgcccaggcaagaaaagcattttcgagacagagggagaaaatggagagaaggcgaaaaccccatctggaccggaggggggctgtgattcagtccgtgccgggattctgggcaaacgtgattgccaaccatccccaaatgagtgctttaatcaccgacgaggatgaggatatgctgagctatatggtgagcctggaggtgggcgaggagaagcacccggttcacttatgcaagattatgttgttctttagatctaatccctatttccagaataaagttattactaaagagtacctggtgaacatcaccgaatatagagcctctcactccacccccattgagtggtatccagactacgaagtcgaggcataccgtcggagacaccacaactcctccctaaacttcttcaattggttttccgatcacaactttgccggatccaacaaaatcgccgaaattctttgcaaagacctgtggcgtaaccccctgcagtactacaaaaggatgaagcctccagaggaaggtaccgagacttccggggacagccagctcttgtcttag

SEQ ID NO: 208395 - DNA, 927 bp, Artificial Sequence
  Description of Artificial Sequence: Synthetic coding sequence
atgcggcccgagggcagcctgacctaccgggtgcccgagcggctgcgccaggggttttgtggcgttggcagggccgcacaggccctggtgtgcgcaagcgccaaagagggcactgcttttaggatggaagccgttcaggaaggtgcagcgggagtggagagcgaacaagctgcattaggagaggaagccgtcctgctcctggacgatattatggccgaagttgaggtcgtcgccgaggaagaaggtctggtggagcgcagggaagaagcccaacgcgcccagcaggctgttcctggccctggtccgatgaccccagagagtgctccggaggaactcctggctgtccaggtggaactggagcctgtcaatgcacaggcacgtaaagccttctcgcgacagagggaaaagatggaacgccggaggaagccccatttagaccgacggggcgctgtgatccagtctgtgccagggttttgggctaatgtgatcgccaatcaccctcagatgagtgccctcatcaccgatgaagatgaagacatgctgagttacatggtttcactagaagtcggagaggagaagcatcctgtccatctgtgcaagataatgctcttcttcagaagcaacccttattttcaaaacaaagtgattaccaaggaatacctagtgaatattaccgaataccgagcctcgcacagcaccccaatcgaatggtacccagattacgaagttgaggcgtatcggagaagacatcataacagctcactgaatttcttcaactggttcagcgatcacaactttgccgggtccaataagattgccgaaatactgtgcaaggacctatggcgcaatcccctccagtactacaaaaggatgaaaccaccagaagagggcaccgagacttccggcgactcgcagttactctcctag

SEQ ID NO: 208396 - DNA, 2097 bp, Artificial Sequence
  Description of Artificial Sequence: Synthetic coding sequence
atgatgcggagccggagcaagagcccccggcggcccagccccaccgccaggggcgcaaattgcgatgtagagctattgaagaccactaccagggatagagaagaattaaagtgcatgctcgagaagtacgagcgtcatctggctgaaattcagggtaacgtgaaggtcctgaaaagcgaaagggacaagatcttcctgctgtacgaacaggcccaagaggagataacccggctgcgccgcgagatgatgaaaagctgcaaaagccccaaatcgaccacggcccatgcaatcctgaggcgcgtggagacagaacgcgacgtggcctttaccgacctgcgtcgcatgactactgaaagagatagcttgagagagcgtttaaagatagcccaggagaccgcgttcaacgaaaaggcccacttggagcagcgcattgaagaactggagtgcactgttcataacctcgatgacgaacggatggaacagatgtccaatatgaccctaatgaaagagaccataagtacagtggagaaagaaatgaagtctttggcgagaaaggctatggataccgaatccgagttggggcgccagaaggctgaaaataactctttacgcttgctttacgagaacacggagaaagacctgtcggacacccagaggcatctggcaaagaaaaagtacgagctgcaactgacccaggaaaaaattatgtgtctggatgagaagatagataacttcactcgtcagaacattgcccagcgcgaagaaataagcattctcggaggtacactgaacgacctggcaaaagagaaggagtgcctacaagcctgtctcgataagaaatctgaaaacatcgcctcactgggcgaatctctggctatgaaggaaaaaacgatttcaggtatgaaaaatattatcgccgaaatggaacaagcttccaggcagtgcacggaggcactgatcgtttgtgagcaggacgtctccagaatgcggagacaactggacgagactaacgacgagcttgctcagatcgctagggaaagagatattctggcacacgacaatgataacctgcaggagcaattcgccaaggctaagcaggagaaccaggcactgtcgaagaagttgaacgacacacacaatgaacttaatgacatcaagcagaaggtccaggacacgaatctggaggtgaacaagctgaaaaatatcctgaaatccgaggagagtgagaatcggcagatgatggagcagctccgtaaggccaacgaggacgcggagaactgggagaataaggcccggcagagcgaagctgacaacaacaccctgaaactggagctcatcaccgccgaagcggaggggaatagactgaaggagaaggtcgatagcttaaatcgagaagtcgaacagcatctcaatgccgaaagaagctataagagccagatctccaccttacacaagagtgtagttaaaatggaagaggaattgcagaaggttcagtttgagaaagtttccgctctcgctgacctatcaagtacgcgagaactctgtatcaagctcgattcatccaaagaactcctgaataggcagctggtcgcaaaggatcaagagatcgaaatgcgtgaaaacgaactggattctgcacactcagagattgagttactgcggtcgcagatggctaatgagcgaatttcaatgcagaacctggaggccctgctggtggccaatagagacaaagagtaccaatcccagatagctctgcaggagaaggagagcgaaattcagctgctgaaggaacatctttgcctagctgagaacaagatggctattcagtcccgggacgtggcacagtttcggaacgtcgtgactcagctggaggctgatcttgacataacgaaacgacagttagggacggagcgctttgagcgggagcgagccgtacaggagttgagacgccagaattactcctctaatgcataccacatgtcatcaaccatgaagcccaatacaaaatgccacagccccgagcgagctcatcatagaagtcccgacaggggacttgacaggtccctcgaggaaaacctgtgttaccgcgatttttag

SEQ ID NO: 208397 - DNA, 2073 bp, Artificial Sequence
  Description of Artificial Sequence: Synthetic coding sequence
atgatgcggagccggagcaagagcccccggcggcccagccccaccgcgcgaggcgctaactgcgacgtcgaacttttgaaaaccacaacaagagatcgagaagaactgaagtgcatgctggaaaaatatgaaagacatctcgcggaaatccagggcaacgtcaaagtgctgaaatctgagcgcgacaaaattttcctgctatatgagcaggcccaggaagagatcacccggctgagaagggaaatgatgaagagctgtaagtcccccaaaagcaccaccgctcatgcaatcctgagaagagtggaaacggaacgagatgtcgctttcaccgacctacgccgtatgactaccgagcgtgattcactgagggagcgccttaagatcgcacaggaaactgccttcaacgaaaaggctcatctcgaacaacgaatcgaagagcttgaatgtactgtacataacctggatgatgaacgcatggagcagatgagcaatatgacgctgatgaaagaaacaatctccaccgtagaaaaggagatgaagagtctcgcaaggaaggccatggatactgaatccgagctgggccgacagaaggctgagaataattctctccgcctcctgtacgagaataccgagaaggacctaagcgacacacagcgtcatctagcgaaaaagaaatacgaactgcagctcacacaagaaaagattatgtgcttggatgagaaaattgacaattttacccgccaaaatatcgcacaacgcgaggagatctcaatcctgggaggcacactgaatgatttggccaaagaaaaggagtgtctacaagcttgtctagataagaagtcagagaacatcgctagccttggcgagtcgctggccatgaaagaaaagaccatctcaggcatgaaaaatataattgctgaaatggagcaagcttcaaggcagtgcacagaggccttgattgtttgtgagcaggatgtcagccgaatgcgaagacagctggatgagaccaacgacgaactggcacagattgctcgcgagagggatattttggcccatgataacgataatctgcaagaacaatttgctaaggcgaagcaggagaatcaggccctgtcaaaaaagctcaacgacacacataacgaactgaatgacatcaagcagaaagtacaggacaccaatttggaagtgaacaaactgaaaaacatcttaaagtctgaggagtctgaaaaccgccagatgatggagcaactaagaaaagctaacgaggacgccgagaactgggagaataaagcccgccagtctgaggcagacaataacactttaaagctggaactgataaccgctgaggctgaggggaatcggctcaaggagaaggtagactcactcaaccgggaagtggaacagcacctcaacgctgaacgttcttacaaatcacaaatatccacactccacaaaagtgtggtgaagatggaggaggaactgcagaaggtgcagtttgaaaaggttagcgcactggcagacctctcctctacgagggagctctgcattaagctggactctagtaaggaattgctgaataggcagctcgtcgcaaaggatcaggagattgaaatgagagaaaacgagcttgattcagcccattccgaaattgagctcctgagaagccagatggccaatgaaaggattagcatgcaaaatctagaggctctactggttgcaaaccgagataaggaataccaatcacaaatagcattgcaggaaaaagagagtgaaatacagcttttgaaagaacatctgtgtttagcagagaataaaatggccatccagtctcgcgacgtggcccaattccgcaatgtcgtgacgcagctagaggctgacctggatattactaaaaggcagttgggtactgaacggtttgagcgtgaaagggcagtgcaggagctccgaagacagaactatagctccaatgcttatcacatgtcatctacaatgaaacctaatacgaagtgtcacagtccagagcgggcccaccaccgatcaccagatcgtggtctggacaggtccctagaatag

SEQ ID NO: 208398 - DNA, 2097 bp, Artificial Sequence
  Description of Artificial Sequence: Synthetic coding sequence
atgatgcggagccggagcaagagcccccggcggcccagccccaccgctcggggagcaaattgtgacgttgaactgttaaaaaccactactagagaccgagaggaattgaagtgcatgctggagaaatacgaaaggcatctggctgagatacagggaaacgtaaaggtcctgaagtccgaacgagacaagatatttctgctgtacgagcaggcccaggaggagatcactagactaagacgagagatgatgaaaagctgtaagagtcctaagagcactactgctcacgccatccttcgccgggttgaaactgagcgggatgtggcattcaccgaccttagacgaatgactaccgagagggattctctgagggagcgactgaagatcgctcaagaaactgcctttaatgagaaagcccacctggagcagagaattgaggaacttgagtgtactgtgcacaatctcgatgatgagcgcatggagcagatgtccaacatgacactcatgaaggagaccattagcaccgtggaaaaagaaatgaaaagtctggcccgcaaggccatggatacagaatctgaattgggcagacagaaggccgagaacaattctctcaggcttttatacgaaaatactgaaaaggaccttagcgatacacaaaggcacctcgcaaagaagaagtatgagctccagctgacgcaggaaaaaattatgtgtctagacgagaagattgataattttactagacagaacattgcccaacgagaggagatttctatcctgggtgggactttaaacgacctcgcgaaggaaaaagaatgtctgcaagcttgcctcgacaagaaaagcgaaaatattgccagtctgggtgagagcctagcaatgaaggaaaaaactatatctggcatgaaaaatattatcgcagaaatggaacaagcctccaggcagtgtactgaggcattaattgtatgtgagcaggatgtatcccgcatgcgccggcagctcgacgaaacaaatgacgagttggcacaaatcgccagggagagggatattcttgcccatgataatgacaatctgcaagaacagtttgcaaaagccaaacaggagaaccaggctctctctaagaagcttaacgatactcataacgagctgaacgacatcaagcagaaagttcaggacaccaatcttgaagtgaataaactgaagaacatcctgaagtcagaggagtccgagaaccgccagatgatggagcagctgaggaaggcaaacgaggatgccgagaactgggaaaacaaggcaaggcaatctgaagctgacaacaacacgcttaagcttgagctcataacagccgaggccgagggaaatcgcctgaaggagaaagttgatagcctaaatagagaggtcgaacagcatctgaatgccgagagaagctataagagtcagatttctacactgcataagtcagttgttaaaatggaagaggagcttcagaaggtgcagttcgagaaagtgagcgccctcgccgacttgtcaagtactagggagctctgcatcaaattagattcgagcaaggagctcctgaacagacaactagtcgcaaaagaccaggagatcgagatgagggagaatgagctggacagcgctcacagtgagatcgagttgttgcgttctcagatggctaatgagaggataagcatgcagaacctggaggccttgctcgtcgccaacagggacaaggaatatcagagccagattgctcttcaagaaaaagagagcgaaatccagctactgaaagagcatctgtgtctggcagagaacaagatggctatccagtccagagatgttgcccagttcaggaacgtagtgactcaattagaagccgatcttgacattactaagaggcagctaggaaccgagaggttcgaacgcgagcgcgcagttcaggagctgagacggcagaactactcctctaatgcatatcacatgtcatcgacaatgaagcccaataccaagtgccattcgccagagagagctcaccaccgcagccccgatagggggctagatcggagtctggaggagaacctgtgctacagggatttttag

SEQ ID NO: 208399 - DNA, 2097 bp, Artificial Sequence
  Description of Artificial Sequence: Synthetic coding sequence
atgatgcggagccggagcaagagcccccggcggcccagccccaccgccaggggtgccaactgcgatgtagagttattgaaaactaccacccgggatagggaagagctcaagtgcatgctggagaaatatgagcgccacctggctgaaatccagggaaacgttaaagttcttaagagcgagcgcgacaaaatcttcctgctgtatgagcaggcccaggaagagatcactaggctcaggagagagatgatgaaatcctgcaagtctccaaaaagcacaactgctcatgccatacttcgccgagtggaaaccgaacgcgacgtggcattcactgacctcagacgtatgacaaccgagcgcgactctctcagggagagattgaagatcgcccaggagaccgcctttaatgagaaagcccatctcgaacaaagaatcgaagaactggagtgcacagtgcataacctcgatgacgagcggatggaacaaatgtctaatatgacgttaatgaaagaaactatcagcacagtggagaaagaaatgaagtcccttgctcgtaaggccatggacaccgaatcagagcttgggaggcagaaggcagagaacaactctctccgacttctctatgaaaacacagaaaaggacctgagtgacacccagcgtcatctggctaaaaagaaatacgagttgcagctcactcaagagaagatcatgtgcctggatgagaaaatcgacaacttcacccgccagaatattgcccaaagggaagagatcagtatcctgggaggtactttgaacgacctggcaaaggagaaagaatgtctgcaggcatgtttggacaaaaagagtgagaatatcgcatctctcggagagtcactggctatgaaggagaagactatttccggaatgaagaacatcatcgctgagatggagcaggcatctcgccagtgtaccgaagctttgatcgtgtgtgagcaagatgtcagtaggatgaggaggcaactggacgaaactaacgacgagctagctcagatcgccagggagagagatattctggcccacgataatgacaatctgcaggagcagttcgctaaggctaagcaggagaaccaagccctgagtaagaagcttaatgacacacacaatgaactgaacgatattaagcagaaggtccaggatactaaccttgaagtgaacaagcttaagaacatcctgaaaagtgaagagtccgagaacagacagatgatggaacaactgcggaaggctaatgaagacgccgaaaattgggagaataaggcacgacaaagtgaagccgataataatactcttaaacttgagttaattaccgctgaggcagagggaaacaggctcaaagagaaagtcgatagcttgaatcgagaggtggaacagcacctgaatgctgagaggagttacaaaagtcaaatcagtaccctgcataagagcgttgtgaagatggaagaggagctccagaaggtccaattcgagaaggtgagcgctttggctgatctgagtagtacaagggaactgtgcataaagctggactcaagtaaagaattgctgaataggcaactggtcgcgaaggaccaagagatcgagatgcgggagaacgagctcgactcagcccactccgagatcgagctcttgagaagccagatggccaatgagcgcatctccatgcagaatctggaggccctgttggtcgcaaatagggacaaggagtatcagtcccagatcgcactgcaggaaaaagagagtgagattcagctgttgaaagagcatctgtgtctggccgagaataaaatggccatacaatccagggacgtggcacagtttcgcaacgtggtgactcaactggaggccgacctggacattaccaagcggcagctggggactgaaaggttcgagagagaaagggcagtgcaagaactaagacgtcagaactattcgagtaatgcctaccacatgtccagtacaatgaaacctaataccaaatgccactcaccggagagggcccatcaccggtcacccgataggggccttgacaggtcattggaggagaatctttgctaccgggacttttag

SEQ ID NO: 208400 - DNA, 2097 bp, Artificial Sequence
  Description of Artificial Sequence: Synthetic coding sequence
atgatgcggagccggagcaagagcccccggcggcccagccccaccgcccgcggcgcgaactgtgacgtcgaactgctgaaaaccacaacccgcgacagagaagagttgaaatgtatgctggaaaagtacgagaggcacctcgccgaaattcagggaaatgtgaaagtgcttaagagcgagagagacaaaattttcctgttgtacgaacaggcacaagaagagatcactaggctgaggagagagatgatgaagtcctgtaagtccccgaaatcaaccacagcgcacgccatcctacgaagggtggagaccgaacgcgacgtggcattcacagacttgcgtcggatgacaactgagcgcgattcactgagagagcgattgaagattgctcaggagactgccttcaacgaaaaggcccacttggaacagaggatcgaagaattagagtgcacggtgcataacctggacgatgaacgcatggaacagatgagtaatatgaccctcatgaaagagaccatctcaacggtcgagaaggagatgaagagtttggcccgcaaagctatggatacggagagtgaactggggcgccagaaagctgaaaataattcgctgaggctgctgtatgagaatactgagaaggacttatcagatactcagcgccatcttgctaagaaaaaatatgagttgcaactgactcaggaaaagattatgtgcttggatgagaagattgacaatttcaccaggcagaacatagcacaaagggaggagatctccattctcggcgggacccttaatgacctcgccaaagaaaaagagtgcctgcaggcttgcctggataagaagtctgaaaatatcgcctccctgggggaatcgctggcaatgaaggagaagaccatctccggcatgaaaaacatcatagcagagatggagcaggcgtcgcgccagtgcactgaggcgctcatcgtgtgcgaacaggacgtgtccagaatgagacggcagctagacgaaactaacgacgaactagcccagattgccagggaaagagacattctggcgcatgataatgacaatctccaggagcagttcgctaaagctaaacaggagaaccaggctcttagcaagaagttgaatgatacgcataacgagctgaatgatatcaagcagaaggtacaggatactaatttagaggtgaataaacttaagaatattctgaaaagcgaagagagtgaaaaccgacagatgatggagcagctgcgaaaggctaacgaagatgccgagaattgggagaataaggctagacagtcagaggcggacaataatacgcttaagctggaactgatcacagccgaggctgagggcaaccgtttaaaagaaaaagtggacagcctgaacagagaggtcgagcagcaccttaacgctgaaagatcgtataagagtcagattagcacactccataaatctgtggttaaaatggaggaggaactgcagaaagttcagttcgaaaaggtgagcgcgctggccgatctgtcctcaaccagagaactgtgcatcaagttagattccagcaaggaactcttgaatagacaactggtggccaaagaccaggaaattgagatgcgcgaaaacgagcttgactcggcccatagtgagatcgagctcctgcggagccaaatggctaacgagaggattagcatgcagaacttggaagctctactggtggctaatagggataaggaatatcagagccagatcgcactacaggagaaagaatctgaaatacagctcctcaaagaacatctgtgtctggccgaaaataagatggccatacagtcacgcgatgtggcccagtttcggaatgtcgtgacacagcttgaggctgatctggatataacgaaacgtcagctcggcacggaaaggtttgagagggaaagagcagttcaggagttacgccgacagaactatagcagtaatgcctatcatatgagcagtaccatgaagccaaacaccaagtgccatagccccgagcgcgctcatcaccggtcccccgatcgtgggctcgataggtcccttgaggagaacttgtgttaccgggacttctag

SEQ ID NO: 208401 - DNA, 894 bp, Artificial Sequence
  Description of Artificial Sequence: Synthetic coding sequence
atgatgcggagccggagcaagagcccccggcggcccagccccaccgcaagaggggctaactgtgacgtcgagttgctgaagactaccacacgtgaccgagaggagctgaaatgtatgttagagaagtacgaacggcatcttgccgaaatacagggaaatgtgaaggttctaaagagcgaacgtgacaaaatatttcttctgtacgagcaggcccaggaggagattaccaggctgcggcgggagatgatgaaatcctgtaagtcacctaaaagtacaacagcgcatgccatcctccgccgcgtggagaccgagcgagatgtggcattcacagatttgcggcgtatgacaaccgagagggatagtctgcgggaacgcctgaaaatcgcacaagaaactgcttttaatgaaaaggcccacctagagcaaaggatagaggagctggaatgtacggtacataacctagatgatgaaaggatggagcagatgtcaaatatgacgctcatgaaggaaacaatctctactgtggagaaagagatgaagtccctagcccgtaaggctatggatacagagtcagaactgggacgacagaaggccgaaaacaacagcctgcgtctgttgtacgaaaataccgaaaaagacctcagtgatacccagcgtcatttggccaaaaaaaagtatgagctgcagctgacacaggaaaagatcatgtgtctggacgaaaagattgataatttcacacggcagaacattgcgcagagagaagaaatttccatcttagggggcacactaaatgaccttgccaaagagaaagagtgtttacaggcgtgcctggacaagaagtccgagaatattgcaagtttgggtgagagtttagccatgaaaaccgtgtattag

SEQ ID NO: 208402 - DNA, 1881 bp, Artificial Sequence
  Description of Artificial Sequence: Synthetic coding sequence
atggccggcgagcggccccccctgcggggccccggccccggccccggggaggtcccaggggaaggcccccctggtcccggaggcaccgggggtgggcccggcagggggaggccatcttcataccgagcattacgcagcgcagtgtcttctctggcgcgcgtggacgacttccattgcgcggagaaaatcggcgccgggtttttctcagaggtgtataaggtccgtcataggcagagcggccaggtgatggttttgaagatgaacaagctgccaagcaaccgggggaatacattgagggaggtccagctcatgaatcgcctcagacatccaaatatcctgaggtttatgggagtgtgcgtccatcaggggcagctgcatgccttgacagagtatatgaacggcgggaccctggagcaattacttagtagccccgagccactctcatggccagtgagattgcatctggcgctggatatcgcccgaggcctgagatacttgcattctaagggggtttttcatagagacctcacatcaaaaaattgtcttgtgaggcgcgaggatcggggctttaccgccgtagtgggcgactttggattggccgaaaagattcctgtgtacagagaaggagctagaaaagagcctctggctgtcgtggggtccccttactggatggcacctgaggtgctcagaggcgagctctatgacgagaaggctgacgtctttgcctttgggatcgttttatgtgagttgattgcaagagtacctgccgaccccgattatctaccccggactgaagactttgggttggatgtgccagcctttagaactctggtgggggatgattgccccctcccttttctgctcctggcgattcactgctgtaatctagagccttctacacgggccccctttactgagattacccagcatttagaatggatcttggagcagctgcccgagccagcccctctaacacgtaccgctctgacccacaatcagggatccgtggcaagaggaggaccctcagcgacgctgccacggcccgatccccgactgagtcggtctcggtccgatctgtttctccctccatcaccagagtcaccccctaattggggcgataatctcacacgggtgaaccccttctccctgcgagaggacctccgtggtgggaagatcaagctgctcgacaccccaagtaagccagtgttgcccctggtcccaccttcccccttcccgagcacacaactgcctttggtgactacgcctgagaccctcgtgcaacctgggacaccggctagacggtgtcgctccctgccctctagtcctgagctgccacgccgtatggaaactgctttgcctggaccaggcccgcctgcagtgggaccttccgccgaggaaaagatggaatgcgagggaagttcacccgagccggaacccccaggtcctgcaccacaattgccattggccgtcgccacagacaacttcatttcaacctgctcttctgcctctcagccctggtctcccaggtctggccccgtgctgaacaataaccccccagctgttgtggtcaactcaccccagggatgggccggtgagccttggaaccgcgcgcagcatagcctgccaagagccgctgccctggaacgcactgaaccttcgcctcctccttcagcgcctagagagcctgacgagggcttgccatgcccagggtgctgcctaggcccattcagcttcggcttcctcagcatgtgccccaggcccactcccgctgtggccagatataggaatttgaattgcgaagctggaagtctgctgtgtcatagaggacatcacgctaagcccccgactccttctctacagctcccaggcgcccgatcatag

SEQ ID NO: 208403 - DNA, 474 bp, Artificial Sequence
  Description of Artificial Sequence: Synthetic coding sequence
agcgcccgggccgccgccctgagccggaacctgcagggccagcggccgcttccgcttgccgtggcaaccgacaactttatcagcacctgtagtagcgcatcccagccttggagccctagatccgggcctgtcctgaataacaaccctcctgcggtcgtggtgaacagccctcagggatgggccggagaaccctggaatagagcccagcattccctcccccgcgcagccgcgctggaacggactgagcccagcccaccaccatcagcccccagagagccagacgagggattgccttgccccggatgctgcttgggtcccttctcattcggattcttgagcatgtgcccgcggccaaccccagctgttgcccgctacagaaatctaaattgcgaggctggctccctcctgtgccatagaggccatcacgcaaaaccccctacaccaagtttgcagttgccaggcgctcgcagttag

SEQ ID NO: 208404 - DNA, 1077 bp, Artificial Sequence
  Description of Artificial Sequence: Synthetic coding sequence
atggacgacgccaccgtgctgcggaagaagggctacatcgtgggcattaacttgggcaagggctcctacgccaaggtgaagagcgcttactccgaacgcttgaaattcaatgtcgcggtgaaaatcatcgataggaagaagacccctaccgatttcgtggagcggttcctgccaagagaaatggatatcttggcaacagtgaaccacggatcgatcatcaaaacctacgaaatcttcgagacatctgacggacgaatatatatcataatggagctgggcgtccagggggacctgctcgagtttatcaaatgtcagggtgcattgcacgaggatgtagcacgcaagatgtttagacagctttcctctgccgtcaaatattgccatgatcttgacattgtccaccgagatcttaagtgcgagaaccttcttctggataaggacttcaacataaaattgagtgactttgggttctcgaaaaggtgtctgcgtgactcaaatggccgcattatcctgagtaaaaccttttgtggtagcgctgcttatgctgcaccagaggttctgcaatccataccctaccagcccaaggtgtatgatatttggtctttaggtgtaatcttgtatattatggtttgtggcagcatgccatatgatgactctgatatcagaaaaatgctacgtatccagaaagagcatcgggtggattttcccaggtccaaaaacctgacctgtgaatgtaaggacctaatttacagaatgctccagcccgacgtgtctcaaagactgcatatagacgagatcctgagccactcttggctccagccacccaaaccaaaggcaaccagctcagcctcgttcaagcgtgaaggcgaagggaagtacagagccgagtgcaagctcgacacaaagaccggcttgagacctgaccatagaccggaccataaacttggggcgaaaacccaacatcggctacttgtcgtgcccgagaatgagaataggatggaggacagactggctgagaccagccgggccaaggatcatcacataagcggagctgaagtcggaaaggcctccacctag

SEQ ID NO: 208405 - DNA, 807 bp, Artificial Sequence
  Description of Artificial Sequence: Synthetic coding sequence
atggaggacttcctgctgagcaacggctaccagctgggcaagaccattggagagggaacgtacagtaaggtcaaggaagctttttcgaagaaacaccagcggaaggtggccatcaaagttattgataagatgggaggacctgaagagtttatccagagatttctccctcgcgaactgcagatagtgcgaacactcgatcataagaatattatccaggtgtacgagatgctggagtctgcggacggcaagatatgcttagttatggagctggccgaggggggcgatgtgttcgattgcgtgctgaatggtggcccattgccagagagccgtgccaaagcactcttccgccagatggtggaggcgatccggtattgtcatggctgcggagtcgctcatagggacctgaaatgcgagaatgctcttctccaggggtttaacctgaagctcactgactttggttttgccaaagtattgccaaagagtcacagagaactgagccagactttttgcggctctaccgcctatgctgctccggaggtcctccagggcattccacatgattccaaaaagggggatgtgtggtcgatgggagtcgtgctttatgttatgctgtgcgcgtctttaccttttgacgacaccgacatacccaaaatgctctggcagcagcaaaaaggggtttcctttccaactcacctgtccatcagtgctgactgccaggatctcctcaagaggctcttagagccggacatgattcttcgcccttctattgaagaagtcagctggcatccctggttagcaagtacctag

SEQ ID NO: 208406 - DNA, 987 bp, Artificial Sequence
  Description of Artificial Sequence: Synthetic coding sequence
atgggcaagggcgacgtgctggaggccgcccccaccaccaccgcctaccattctctcatggacgagtatggatatgaagtcgggaaggctattggacacgggtcctatggctccgtgtacgaagctttctacactaaacagaaggtgatggtggctgtaaagatcatctctaaaaagaaggcttctgacgactacttgaataagttcctgcctcgcgaaatccaggttatgaaagtattaagacacaaatacctcataaatttttatagggccattgaatccacttccagggtgtacattattctggaactagctcaaggcggcgatgtcctggagtggattcaacgctacggagcctgcagtgagcccctggccggaaagtggttctcccagctaacactggggattgcatacctccactccaaaagcatcgtgcacagggacctgaaactggagaacctgctgctggataaatgggagaacgtcaagataagcgactttggattcgctaaaatggtccccagcaaccagcccgtggggtgcagtccatcttatcgccaagtgaactgcttctcacacctctcacagacctattgcggttccttcgcgtacgcctgccctgagattctgcgagggttaccttacaacccttttctaagtgacacatggtctatgggcgtgattttgtacactttagtcgtggcccaccttccgttcgatgacactaatctgaaaaagctactgagagagacgcaaaaagaagtaactttccctgctaatcacaccatttcccaggaatgcaaaaatctgatcctgcaaatgctccgacaggcgacaaaaagagcaacgattctggatatcattaaagacagttgggtcctgaagttccagcccgaacagcctacccacgagatccgacttttggaggctatgtgtcagcttcacaacactaccaaacaacatcaaagtctccagatcacgacctag

SEQ ID NO: 208407 - DNA, 1017 bp, Artificial Sequence
  Description of Artificial Sequence: Synthetic coding sequence
atgggcaagggcgacgtgctggaggccgcccccaccaccaccgcctaccactcgttaatggacgaatacggctacgaagtgggcaaggctatcggtcacggctcttacgggtccgtgtatgaggccttctatacaaagcagaaagtgatggtggccgttaaaataataagcaaaaagaaagcatcagatgactacctcaataagttcctcccaagggagatacaagtcatgaaggttctaagacacaaataccttattaatttttaccgggccatcgagagcacatcaagagtatacataatcctcgaactggcccagggcggagacgtgctagagtggattcaaaggtatggagcctgttctgaaccgctggctggaaaatggttctcacagctaaccctcggcatcgcttatctgcacagtaagagcatcgtccaccgcctgatgccgtcactgagcgctgcaggacgggaccttaagctggaaaatttactgctggacaagtgggagaatgtaaagatctcggactttggctttgccaagatggtcccgtctaatcaaccagtcgggtgttcccccagttaccggcaggtgaactgtttctcccacctgagccaaacctactgcggtagcttcgcctatgcttgtccagagattcttaggggcctgccgtacaatccattcctctccgacacttggtccatgggcgtaattctctacactctcgtcgtggcccacctacctttcgacgacaccaatttgaagaaacttctacgcgagacacaaaaagaggtgactttccctgctaatcatacaatcagccaggagtgtaagaacctgatcctccagatgctgagacaggccactaagagggccacgattctcgacatcatcaaggatagctgggttctgaaattccagcccgagcaacctactcacgagatcagactgcttgaggctatgtgtcaactacataatacgacaaaacagcaccagagtctacagattactacctag

SEQ ID NO: 208408 - DNA, 759 bp, Artificial Sequence
  Description of Artificial Sequence: Synthetic coding sequence
atgaaggtgctgcggcacaagtacctgatcaacttctaccgggccattgagagtacatcccgcgtctatatcattctggagctagcccaaggcggggacgtcctggagtggattcagagatatggggcatgttccgagcctctggccggcaaatggttctctcagctgaccctggggattgcttatctgcactctaagtcaatagtccaccgcgacctgaagctggagaacttactcttagacaaatgggagaacgtaaaaatttctgacttcggcttcgctaaaatggtgccatctaatcagccagttggatgctcgccgtcttatcgacaagttaactgcttttctcatcttagtcaaacctactgtggctccttcgcgtatgcttgccctgaaattctcagaggcctcccctacaatccatttctttcggatacatggtcgatgggcgtgatactctatacgctggtggtggcccacttaccttttgacgatactaacctgaagaaacttctccgggagacacaaaaagaggtgacctttcccgccaatcatacaattagccaggaatgcaaaaaccttatcctgcagatgttgaggcaggccacaaaaagagcaactattctggatattattaaggactcctgggtgctcaagttccaaccagaacagcccacccacgagatcagactactcgaggcaatgtgccagctccacaacacgaccaaacaacaccagtcgctgcagatcaccacttag

SEQ ID NO: 208409 - DNA, 822 bp, Artificial Sequence
  Description of Artificial Sequence: Synthetic coding sequence
atgagcggcgacaagctgctgagcgagctgggctacaagctgggcagaaccattggagaggggtcctattcaaaagtgaaagttgctacgtctaagaagtacaaagggacagtggccataaaagtggtggacaggaggcgcgccccacccgactttgttaacaagttcttacctagagagctcagcattctgcgtggcgtccgacaccctcacatcgtgcatgtgtttgaattcatcgaggtgtgtaatggcaaactttacattgtgatggaagctgccgcaactgatctgctgcaagctgtgcagcgaaacgggcgcattcccggtgttcaggcacgagacctcttcgcacagatcgctggagctgtgcggtatttgcatgaccatcatctcgtacatcgggatctgaagtgtgaaaacgtcctcctgagccccgacgagaggagagtgaagctgacagactttggctttggcaggcaagcccatgggtatccagatctttccaccacgtactgcggaagtgcagcctatgctagccctgaggtgttgctgggcattccctatgaccccaagaagtacgacgtgtggtctatgggtgtggtattatatgtgatggtcacaggttgcatgccgtttgacgattcagatatagctggccttccaaggaggcagaaaagaggcgttctgtatcccgaaggcctggaactcagtgagcgatgcaaggccctcatcgctgagctgcttcagtttagtccttctgcgcggccatctgccggacaggtggcccgaaattgctggctcagggccggggacagcgggtag

SEQ ID NO: 208410 - DNA, 822 bp, Artificial Sequence
  Description of Artificial Sequence: Synthetic coding sequence
atgagcggcgacaagctgctgagcgagctgggctacaagctgggccgcacgataggggagggtagttacagcaaagtcaaggtcgcaaccagcaaaaaatacaagggcaccgttgccatcaaggtggttgacagacgtagggctccccctgacttcgtgaacaaatttcttcccagggaactgtctatactgcgcggcgtgcggcaccctcatattgtacacgtctttgaatttatagaggtgtgcaacgggaaattgtatattgtcatggaggccgcagctacagatcttttacaggctgtccaaaggaacggccgaattcctggtgtgcaggctcgcgatctctttgcacagatagcaggcgccgtcagatatctgcacgatcatcacttggtacaccgtgatctgaaatgtgagaatgtgctgctcagtcctgacgagcggcgagtcaaactcactgacttcggattcggcagacaagcccacggctaccccgacctgagcactacgtattgcggctctgcggcttatgcctcccccgaggtactgcttgggataccctatgaccccaaaaaatacgatgtgtggtcgatgggcgtcgttctgtacgtcatggttacaggctgcatgcccttcgacgatagcgatatagctggcctgcccagaaggcagaagagaggagtgctctacccagagggactagagttgagtgagagatgtaaggccttgatcgccgaattgctccagttctcccctagtgccagaccctctgccggacaagttgcacggaattgttggctcagggccggtgactctggatag

SEQ ID NO: 208411 - DNA, 6411 bp, Artificial Sequence
  Description of Artificial Sequence: Synthetic coding sequence
atgagccggagccggcacgcccggcccagccggctggtgcggaaggaggatgtaaacaagaaaaagaagaattctcaactacgcaagacaactaaaggggctaataagaacgttgcttcggtgaagaccctttctcccggcaagctgaaacagctgatacaggagcgcgacgtgaaaaagaagaccgagccgaagccgcccgtgcctgtgcgatccttgttgacccgcgccggggccgcacgcatgaacctggacaggacagaagtcttgttccaaaaccctgagagtctgacatgcaacggcttcactatggctctccggtctaccagcttaagtcgtaggctgagtcagcctcctctcgtggtagctaagtccaagaaggtgccactgtccaaaggcctcgaaaagcaacatgattgcgattataagattttacctgctctgggggtgaagcactcggagaacgactccgttccaatgcaagacactcaggtgcttcccgatatagagactctgattggcgtccagaacccgtccctcctgaaaggaaagagccaggagactacacagttttggtcccagcgagttgaagattcaaaaatcaacattcccacccattcaggtcccgccgctgaaatcttgccaggcccactggaaggcacccggtgcggagagggtctcttctcagaggagaccctgaatgacaccagcggttctccgaagatgttcgcccaggatactgtatgtgctcccttcccccaacgcgccacaccaaaggttacttcccagggtaacccatcgattcagctggaggagctgggatcccgcgtcgaatccctaaagttatctgacagctaccttgatcccattaagtctgagcatgactgctatccgacttcttcgctcaacaaggttatccccgacctcaacctcaggaactgcttagcactcggtggctccacaagtccgaccagcgtgataaagttcctgctcgcaggaagtaagcaggcaactcttggtgccaagcctgaccaccaggaagcttttgaggcaactgcaaatcagcaggaggtgtctgataccacctcatttttagggcaggcgtttggggctatcccccaccagtgggaactgcctggtgctgatccagttcacggcgaggcccttggagagacacccgaccttccggaaattccaggtgcaatacctgtacagggggaagtctttggtacaatacttgaccagcaagagaccttgggcatgtcaggctcggtggtgcccgatctccctgttttcctcccagttcctccgaatcccatcgctaccttcaatgctccttccaagtggcccgaacctcagtcaaccgtctcatatggcctggccgtgcagggcgcgattcagatcctccccctcgggagcggtcatacaccccaaagctcctctaactcagaaaaaaattcgcttcctcccgttatggctatcagcaacgtggagaacgaaaaacaggtgcacatcagctttctgcccgccaatacacagggattcccactggctcctgaacgagggctatttcatgcttccctgggaatagcgcaactttctcaggccggcccttccaagtctgatagaggatcctcacaagtgtctgttacatcaacggtgcacgtcgtgaataccaccgtggtgacaatgccagtgccaatggtgtccaccagcagctcttcctacactacgctgcttcctacactggaaaagaaaaaaagaaaaaggtgcggggtttgcgaaccttgtcagcaaaagaccaattgtggcgagtgtacctactgtaagaataggaagaatagccaccaaatctgcaagaagaggaaatgcgaggaactcaagaagaagccatctgtggtagtccctttggaagtgattaaggagaacaagcgccctcagcgcgagaagaagcctaaggtcctaaaagccgactttgataacaagcccgttaacggccctaagtctgagtccatggactacagcagatgtggtcatggcgaggagcaaaagctcgagctgaaccctcacaccgtagaaaatgtcaccaagaacgaagacagtatgacaggcattgaggttgagaagtggacacagaacaagaaatcccagctgactgatcatgtgaaaggggacttcagcgccaatgtgcctgaggccgagaagagtaaaaacagcgaagtggataagaaacggacaaaatctcccaagctattcgttcagaccgtacggaatggaattaaacacgtccactgtctgccggccgaaactaacgtctcgttcaagaaattcaatattgaggagtttggcaaaactctggagaataacagttataagtttctaaaagacaccgctaaccataaaaatgccatgtctagcgtggcaactgacatgagctgcgaccatctgaagggccggagtaatgtactcgttttccagcagcccggcttcaattgctcttccataccacactcttctcattccattattaaccaccacgcctccatccacaatgagggcgaccagcctaagacacctgaaaatattccatccaaagagcctaaagatggttcccccgttcaacctagcttactgtcacttatgaaggacaggcggttgacattggaacaggtcgtagctatcgaagcccttactcagctgagtgaagcacctagtgagaattcttccccatccaagagcgagaaagatgaggagagcgagcagcgaactgcatccttgctgaattcctgcaaggcgattctttataccgtgcgaaaagacctgcaagaccctaatctgcagggggaaccaccaaagttgaaccactgccctagcctggaaaaacagagttcttgcaacaccgttgtatttaacggccagacgactaccctcagcaactcccacataaacagcgccaccaaccaggcatcaactaaatcacatgagtattctaaagtaacaaatagcttgagcctttttattccaaagtccaacagcagcaagatcgacacaaacaagagcatcgcgcagggaatcataactctggacaattgcagcaacgacctacatcaacttcctccgcgaaataatgaggtggagtattgtaaccagctgctggactcttcaaaaaagttagattctgacgacctctcgtgccaagacgctacccatacccagattgaagaagacgtcgcaacccagctcacccaactggcatccattattaagattaattacatcaagccggaggataaaaaggtggagagcacaccgacttcactcgtgacatgtaatgtgcagcagaagtacaatcaggagaagggcaccattcagcagaagccgcctagctccgtgcacaataatcacgggtcttcactgaccaagcagaaaaatccaacacaaaaaaaaaccaaatctacaccttcacgcgacagacgcaaaaagaaaccgactgtcgtgtcttatcaggagaacgaccgtcagaagtgggagaaactgagctacatgtacgggacaatatgtgatatctggatagctagtaagttccagaacttcggccagttctgccctcacgacttcccaacagtttttgggaagattagctcctcgaccaaaatttggaaacccttagcccagactcgctccatcatgcaaccaaagacagtctttcccccactcacccagattaaactacagaggtaccctgagtctgctgaagagaaggtgaaagttgaaccgttggacagcctttcactgtttcacttgaagaccgagtctaatgggaaggcattcactgataaggcatacaatagccaggtccagctgaccgtaaacgccaaccaaaaggctcatcccctaacacagccgtcatcaccacctaaccagtgtgccaacgtaatggcgggggatgatcagattagatttcagcaggtggtcaaggagcagctcatgcatcagagactcccaacactcccaggcattagtcatgagacacctttacccgaatccgcactgaccctgaggaatgttaacgttgtgtgcagtgggggaataactgttgtttcgactaagagtgaggaggaagtgtgtagttcaagctttgggacaagcgagttcagcactgtggattcggcccagaaaaactttaatgattacgccatgaacttttttactaatcctacaaaaaatttggtgtcaatcacaaaagatagcgagttgccgacgtgttcctgcctggacagggtgattcagaaggacaaagggccgtactatactcacctgggcgcaggcccatctgtggcagccgtgcgtgaaatcatggagaatagatatggacagaaaggtaatgccattaggatcgaaatcgtggtttacactgggaaagaaggtaaatcttcacatggctgtccaattgcgaaatgggtcctacgccgaagctcagatgaggaaaaagtgctatgcctcgtgcgacagaggactggacaccactgcccaactgcggtgatggtagttttgataatggtctgggatggaatccccctccctatggccgataggctctacactgaattaacggaaaacctgaagagttacaacggtcacccaaccgataggcgctgcaccctgaacgagaacaggacttgcacttgccagggaattgacccagagacctgcggggcaagcttcagtttcgggtgcagttggtcgatgtacttcaatggctgtaaattcggacgatccccttcacctagaagattcaggatcgacccctcatccccactgcacgaaaaaaatctggaagacaacctgcaatcgttggccactcgtcttgcacccatctataagcaatatgctccggtggcctaccagaatcaggtggagtacgagaacgtggcccgggaatgtcgcctgggatctaaggagggaagacccttctccggcgtgaccgcatgtctcgacttctgcgctcacccccaccgagacatccacaatatgaataacggatctactgtggtgtgcacactcacgagagaagataataggagcctgggcgtcataccccaggatgaacaattgcacgttctccccctgtacaagctttcagatacggacgagttcggttccaaggaaggcatggaggccaagattaagtcaggagccattgaggtgctcgctcctcgcagaaagaagaggacttgttttacacaacccgtgccgagaagtgggaaaaaacgggcagctatgatgaccgaggtgcttgcacataagatcagggctgtggaaaagaagcccattccgagaattaaacggaagaacaattccaccaccactaacaattccaagccatcctcccttccaacactggggagtaacacagaaaccgtccagcctgaggtgaagtctgagaccgagcctcactttatccttaagtcctcggataacaccaagacctacagtctcatgccatcggctccgcacccagtgaaggaggcctccccgggttttagctggagccctaaaaccgcgagcgcgacacctgcccccctgaaaaacgacgcgacggcttcctgtggcttctcagagagatcctctacaccgcactgtaccatgccgtcaggaagactcagtggagccaacgcagctgctgccgatggccccgggatctcgcagttgggagaggtcgcacctttgcccacactttcagcaccagttatggaacctctgatcaactccgagccttctacaggggtgaccgagcctctcacgccccaccagcctaaccaccagccgagttttctgaccagcccccaagacctggcgagctcccctatggaggaggatgagcagcactctgaggctgatgaacccccatccgatgaacctctctctgacgatccgctgagcccagctgaagagaagctgcctcacatagacgagtattggtccgattccgagcacatatttctggacgccaatatcggcggagtcgcaatcgcaccagcccatggatcggtgctgattgagtgtgcccggcgtgaattgcatgcgacaacccccgtggaacacccaaatcgcaaccatccaacccgcctgtccctagttttctaccagcacaagaacctcaataagccccaacacgggttcgagctcaataaaatcaagttcgaggccaaggaagccaaaaataagaagatgaaggcgagcgaacagaaagaccaggccgctaatgaaggtcctgagcagagctcagaagtgaacgaactgaatcagatcccctcgcataaggcactcacattaactcacgataacgtggtgacagtgtccccttacgcactcacccacgtggccggcccgtataatcactgggtgtag

SEQ ID NO: 208412 - DNA, 330 bp, Artificial Sequence
  Description of Artificial Sequence: Synthetic coding sequence
atggccgaccggctgtacaccgagctgaccgagaacctgaagagctacaatggacacccaacggataggcgatgtacgctcaatgaaaatcgcacctgtacatgccaaggcattgaccctgagacttgtggcgcctcattctcctttggttgtagctggtccatgtactttaatggctgtaaattcggtcgtagccccagccccaggagatttaggatcgacccttctagccccctgcacacctactatgagagaattaccaagggccggaacccggagagacgttatatgaaacccgaaaggatcagccctggccatgaggcaatgtag

SEQ ID NO: 208413 - DNA, 726 bp, Artificial Sequence
  Description of Artificial Sequence: Synthetic coding sequence
atgcagtgcttcagcttcatcaagaccatgatgatcctgttcaacttgctgatcttcctatgtggcgccgctctgcttgccgttggtatctgggtgtccattgatggcgcctctttcctcaagattttcggtccactctcgagcagcgctatgcaattcgtcaacgtgggttatttcctgatcgcagcgggcgttgtggtgttcgctctgggctttctgggatgttatggagcaaagactgagtcgaagtgtgcattggttaccttcttcttcatactcctgcttatctttattgccgaggtcgcggccgccgtcgtagctctggtgtatacaacaatggccgagcatttcttgacactgctcgtggtgcctgcgataaagaaggattatggcagccaagaggactttacccaggtctggaataccaccatgaaaggcctgaaatgctgtggatttactaattacactgattttgaggattccccatacttcaaagagaactctgccttcccaccgttttgttgcaatgacaatgtcaccaacaccgcgaacgaaacttgcactaagcagaaggcccatgaccagaaggtcgagggctgttttaaccagctcctatacgacatcagaaccaacgccgtgacagtcggcggggtggctgcaggaattggaggactggaactggctgccatgatcgtctctatgtatctgtactgcaacctgcagtag
